United States Patent 9,073,990 (PROTEASE-ACTIVATABLE PORE-FORMING POLYPEPTIDES) - sequence listing, part 3

SEQ ID NO: 6042 - protein, 355 aa, Campylobacter curvus
MFVKLLRSVAIGLIVGAILLVAMPSLRSLNPLSTPQFDSTDETPASYNLAVRRAAPAVVNVYNRGLNTNSHNQLEIRTLGSGVIMDQRGYIITNKHVINDADQIIVALQDGRVFEALLVGSDSLTDLAVLKINATGGLPTIPINARRVPHIGDVVLAIGNPYNLGQTITQGIISATGRIGLNPTGRQNFLQTDASINHGNSGGALVNSLGELMGINTLSFDKSNDGETPEGIGFAIPFQLATKIMDKLIRDGRVIRGYIGIGGREIAPLHAQGGGIDQLQGIVVNEVSPDGPAANAGIQVNDLIISVDNKPAISALETMDQVAEIRPGSVIPVVVMRDDKQLTLQVTIQEYPATN

SEQ ID NO: 6043 - protein, 578 aa, Campylobacter curvus
MKISLHLSGMTATAVVLGSSWAIAADLPVKAVAPPPELSAWETQIGARWWYSSGKVQKDLFGTNNTPGVSLAVSRLIYDNLTGHSGELFGRVDHTTGLFFKFNAGLGSMGSHGKLNDEDFDPSAMGGSGYSNTLSTLRDGNLSYATADVGYSFVTAPGAKLGAFVGYNHFFTQENAYDCVQQAANQFVNGCGVNTRAITESNHWQSLRVGLSGEFAVSERLKLSVDAAYLPYVSFRGVDDHVLRSLRIDEIGDNGNGAQIESVLSYAVTDGWSLGLGGRYWTFKSNDTSARFQQLPRAPDASTQRTTFTAERYGMFLQSSYKWGDTTPPSAAVGFATKAPPLAVNWTGVYVGGQLGAGFGPKHWSDSIGSTTSLVNPGSDFPAGTPPGLNVGGFGKSTPMAGGLGGAQLGYNFQTGRTVLGVEADVAFADLKGSHTIYSGLGGGQAEAHTTALGSVTGRVGYAVERNLLYVKAGGAWAVTDHTLDTSSIFIPSQGEGCCHDNVRSTRLGWTVGAGLEYAVDRHWSAKLEYDYMDFGSQSVSFPVNARLGLPSVDIDQAFHVVKMGVNYKLDWGVVASN

SEQ ID NO: 6044 - protein, 236 aa, Campylobacter curvus
MKYKLLPCLLAILLTGCDRTEVTLSFTPEMASFSNEFDFDPLRGPVKDFTQTLMDEQGEVTKRVSGTLSEEGCFDSLELLDLENNTVVALVLDANYYRDAETLEKRVRLQGKCQLAELPSAGVSWETDDNGFVIKASSKQMQMEYRYDDQGYPLGKTTKSNDKTLSVSATPSTDPIKKLDYTAVTLLNNQRVGNVKQSCEYDSHANPVGCQLIIVDEGVKPAVERVYTIKNTIDYY

SEQ ID NO: 6045 - protein, 703 aa, Campylobacter curvus
MRNIGLALLLGSTGAPAQEGPAPAPTLGTVEVRAERAAPGSSLGLDIPQDVGSRLGLTPRETPASVSAMDAEDIAGRDLTRAQDVATRMPGITESPAPGNGGTSLSARGFVGHNSVAQLIDGTRLAVAAGTVTYPFSTWPLASVEVLRGPASVLYGDGAIGAAVNYVTRKPAWNRTHREAFLTAGSHGQRQGGVGLRGPVNDAAAYSVYLDAAGGDGYRALEEVERRNYALALSVRPASGLAATFSLDGGMNDDARYFGTPLRGGSFDDRVRRINYNVSDAVVRYDDRLWRAKVEYRAGPDVRLRNETYHATSERHWRNAESYGFDRTGGSVIRSDYLEILHDLQQTGNRLDVSIDGSVAGLPNRFVAGVDWHRTRLLHTNNAPYRGASAVDPYAFDPGVFDSPDPTKPGRQARLRTTALYAENALDLAPRWKLVGGLRHERTRLDDDNLRTAVRQRKSYAPTTGRIGLVWTASETLSFYGQYATGTDPLSGALSLPGGGTVFDLTRGRQAEVGAKGLLPAIRGEWTAAAYRIDKRHLLSRDPDEPGVVRQVGHQSSTGLELAFAAEPVSGWTVDANAAWLRARYEDFDEASGGTAVSRRGNVPVGVPERTAHLWTTYRLAPRWRAGAGLRYVGARFTNAANSGRLPGYTVADASLAYEHSSALRLMLSVRNLADRTYPVSGSGSTWLLGAPRTVQLTLRATF

SEQ ID NO: 6046 - protein, 821 aa, Campylobacter curvus
MSGNIGANPVIIIGCASAYAVEFNKDLIEAEDRENVNLSQFETDGQLPVGKYSLSTLINNKRTPIHLDLQWVLIDNQTAVCVTPEQLTLLGFTDEFIEKTQQNLIDGCYPIEKEKQITTYLDKGKMQLSISAPQAWLKYKDANWTPPELWNHGIAGAFLDYNLYASHYAPHQGDNSQNISSYGQAGVNLGAWRLRTDYQYDQSFNNGKSQATNLDFPRIYLFRPIPAMNAKLTIGQYDTESSIFDSFHFSGISLKSDENMLPPDLRGYAPQITGVAQTNAKVTVSQNNRIIYQENVPPGPFAITNLFNTLQGQLDVKVEEEDGRVTQWQVASNSIPYLTRKGQIRYTTAMGKPTSVGGDSLQQPFFWTGEFSWGWLNNVSLYGGSVLTNRDYQSLAAGVGFNLNSLGSLSFDVTRSDAQLHNQDKETGYSYRANYSKRFESTGSQLTFAGYRFSDKNFVTMNEYINDTNHYTNYQNEKESYIVTFNQYLESLRLNTYVSLARNTYWDASSNVNYSLSLSRDFDIGPLKNVSTSLTFSRINWEEDNQDQLYLNISIPWGTSRTLSYGMQRNQDNEISHTASWYDSSDRNNSWSVSASGDNDEFKDMKASLRASYQHNTENGRLYLSGTSQRDSYYSLNASWNGSFTATRHGAAFHDYSGSADSRFMIDADGTEDIPLNNKRAVTNRYGIGVIPSVSSYITTSLSVDTRNLPENVDIENSVITTTLTEGAIGYAKLDTRKGYQIIGVIRLADGSHPPLGISVKDETSHKELGLVADGGFVYLNGIQDDNKLALRWGDKSCFIQPPNSSNLTTGTAILPCISQN

SEQ ID NO: 6047 - protein, 1089 aa, Campylobacter curvus
MKKSLLLTLLLLVHVCAAWAADKVITGNVIADDDKQPLIGVSVYVSADDLKKAGSSLMSLGVVTDIDGNFSITVPSGVKKLQLSYIGYTTQQIELKSGQTHYNVALQPSSTMLNDVVVTGYQTVERRKLTAAVAKIDISEGRIGTVKSIDQALSGQIAGLSAVSTSGAPGSPVKIRIRGTSSLNGTQDPLWVLDGIPLEGTDIPSLESLKNIDDVQQSSIAGLNPADIADITVLKDAAATAIYGARAANGVIVITTKNGKAGKTKINFSTRLTWSPQQNIDRLNLLNASEKVDLELQLMKSDYAMNAEKGEIYRILNRYNAIDAFKKDGWDALSKEAQNEINALRLINTDWNDILLQDAFSQEYNLSLSGGNEKATYYTSLGYSKEQGNIPNVSSDRLNLVMKANYKVNRMLKFGTSVFVNRRKNGSYLSTDGFTNPMFYARIANPYLTPYDKDGNYVYDSDIQNGNSDLLFNTFEERQNTSNETTINSLSSIFDVELRFDDRFKITSQVGLQLDKTSREQIADQESFAMRLEHKNHRYNGTSFLPQKGGFHKAYENSDSQVTWKTMGTYRDTYADIHEFEIMVGSELRRTWATTLYSAGYGYDRRTMTNQPVVFPSDSQAFPLHTKTNVENAYVSAFSTMSYSLLNRYTLGGSIRFDGSDLFGVDKKYRYLPLYSVSALWRISEEPFTENAKWLDNLVIRASYGLQGNIDKNTSPYLLGKYQSNATPILPGNTEDMIVVTSAPNDKLRWEKTHSVNVGLDFAVLNQAINLSVDYYYRKGVDLIGMQMLPLETGFSSTNINWASMTNKGIEIGLSTRNIHTKSFMWTTTFNFAYNLNKVLKEAIREDAIYPSREGYPAGAIFAFPYAGIDENGQMTFYNKETGKVESMKEFFKVQEFGFGTYNLSHAELRNKYEYIGTTDSPYTGGFNNTFTYKAWELGINCIFNAGGYVRVQPSYSLTSFDRGQNTNRDILNRWTPENPNGTMPALVDSNTDMDAYFFLDGAVNPYAYSSLWVKKQNYMRIQSIRLGYELPFSLIQKLGISQATVALEGRNLFVFGSSYRNYLDPETMGNPYAQPIPKSFTFSLNLNF

SEQ ID NO: 6048 - protein, 645 aa, Campylobacter curvus
MNKILWNTLKQSPGILGAALALTNAALATETSSVRLDSTPDLATGAIHSVEWQQAEHSELLTLTQGNSDFEVSSLVDLTDGAKNEIAPVAPVMTNNGEAPAQTATSDALSVSETSELQLAQVETAAPVENSEVGISDLEQMELYTAETDVMDQVTSVSQLSDVQPTDWAFQALQSLVERYGCIAGYPDGTYKGNRAMTRYEFAAGLNACLERVNELIAASTANLVTREDLAVLQRLQEEFAAELAALRGRVLALEARTAELEANQFSTTTKLRGEVIFFIGDTFGDRAEYTTVGGPNVEDSDDPTQSYFGYRARLNFDTSFTGEDLLRTRVEAKDVPNLSREGLTNTLMTRLGTDGGDGDFTLDDLYYRFPVFNGKGQVYFGAKSLDLDDLQDPLSPFQSTGAGAASRFGRYNPTTFRGNEGTGLGMKYQLNERMRINFGYLANQDDAPDPTEGRGLFDGGHSAFVQFIYEPLDNLVVALDYNRRYFREGDVSVSGGTGSFLANRPFGDNPTTSDNLGFQTNWRIADQFELGGWLGVAWADDKPTGRGDDLDATILNFAVTLAFPDLFREGSLGGVIVGMQPKVVYHTLERLEEEKTGIHIEAFYRYQVNDYVALVPGVYIITDPEHTDENDTVVVTTFRTQFRF

SEQ ID NO: 6049 - protein, 1000 aa, Campylobacter curvus
MSKSITKTQTPSVHTMTTHRLNLAIKAALFGVAVLPLSVWAQENTQTDANSDAKDTKTPVVYLDAITVTAAPSAPVSRFDTDVTGLGKTVKTADTLAKEQVQGIRDLVRYETGVSVVEQGRGGSSGFAIHGVDKNRVGITVDGIAQIQSYKDESTKRAGAGSGAMNEIEIENIAAVAINKGGNALEAGSGALGGSVAFHTKDVSDVLKSGNNLGAQSKTTYNSKNDHFSQTLAAAGKTERVEAMVQYTYRKGKENKAHSDLNGINQSLYRLGAWQQKYDLRKPNELFAGTSYITESCLASDDPKSCVQYPYVYTKARPDGIGNRNFSELSDAEKAQYLASTHPHEVVSAKDYTGTYRLLPDPMDYRSDSYLARLNIKITPNLVSKLLLEDTKQTYNIRDMRHCSYHGARLGNDGKPANGGSIVLCDDYQEYLNANDASQASFRPGANDAPIPKLAYARSSVFNQEHGKTRYGLGFEFKPDTPWFKQAKLNLHQQNIQIINHDIKKSCSQYPKVDLNCGISEIGHYEYQNNYRYKEGRTSLTGKLDFNFDLLGQHDLTVLAGADKVKSQFRANNPRRTIIDTTQGDAIIDESTLTAQEQAKFKQSGAAWIVKNRLGRLEEKDACGNANECERAPIHGSNQYVGINNLYTPNDYVDLSFGGRLDKQRIHSTDSNIISKTYTNKSYNFGAAVHLTPDFSLLYKTAKGFRTPSFYELYNYNSTAAQHKNDPDVSFPKRAVDVKPETSNTNEYGFRYQHPWGDIEMSMFKSRYKDMLDKAIPNLTKAQQEYCKAHLDSNECVGNPPTPKTSDEVFANLYNATIKGVSVKGKLDLHAMTSKLPDGLEMTLGYGHTKLGKFDYIAPKDADGWYQARPAFWDAITPARYVVGLNYDHPSQVWGIGTTLTHSKQKDENELSALRIRNGKREIQTLTHTIPKAYTLLDMTGYYSPTESITARLGINNVLNTRYTTWEAARQLPSEAASSTQSTRYIAPGRSYFASLEMKF

SEQ ID NO: 6050 - protein, 1181 aa, Campylobacter curvus
MKFSVLVAFVLAIPLALFSQEFRGTIGGLVSDSTGATIAAAKVTVMDVETGAKAETVSDNTGHYAAPFLAPGDYSIVVKMSGFKEFVRKGVHLGASDHVAVDARLEVGEMTQSVEVTADVSIVNAESASVGQAVTTKEVDELPLNGRTPTVLATLALGVLPTGQPSLIHPFDSGAGNAWSVAGTPAQTSETMVDGVPNATWDGRLAYSLPQDAVQEVRIKAFDSDASFGHTGGGTLNQVMKTGTNTVHGTLWEYNQPNTLTANDFFNNAKGVQRPTSHLNQYGLTAGGPIWIPKVFNGKNKLFWFFAFEGMKDGQPNPVFLTIPTAAERTGNLSQILAADKTQLYDPYSAVVNGTTITRSPIPNNVIPTNELNPVALAYLKFFPLPNVAGTADGQQNYGNSATTNDNYNNEMGRLDYNMSDLSHLSFNVRKTDYSQTKNNYFGNIAEGSVLKRANWGATLDEVYTINSSNVVDVRANFTRMAETHDMPSAGFDPTTLGLPSYLATNSHYLQLPVIAFSSSTSMQALGATGADQIPSQSLQLYASWVRIMGNHTLKFGTDERQYRLNTFTAGSSSGQFSFSGNNWVRASSTASSTVAVGQDYASFLFGLPYTASGSTYDINTYASWYSYYASGFAQDDWRLRRNLTLSLGLRYEWDGPYHEKYGRTVDGFDTTTPNPLGAAAAAAYAKAPSALLPASAFNVLGGLTFATPNNNAVYQNRSRMFSPRASLAWSPERFHGKTVIRAGFGVFESPVAISYVGPDGKYSTSPRTPLGQEGFSQSTALTATANNYALPGAVSLSNPYPGGFLQPAGSSLGLLTYAGQTLQFLNPNAQNGYSMRWDFDIQQELAHNLALEVAYIGNHALHLPVNVTQLNGIPRQYLSTLGVRDTATNALTASIANPFSGLQSNQNTATTTVAQILARYPQFPVGDAAGGWSGSGGVLEFNNDIGSSYFNSLNVHLTKRTSKGLMLTTNFIYSKMIERLSWLNDSDATLERRVSPNDRPLRLVVSAVYELPIGRSKLINLQSRFTNALLGGWKITTIYSRQAGAPINWVNGSSTAPGDYVYFGGPVNLNNRQVNGTAFDKTAFDTASADAFQYHIRTFSTTFGNLRADGINQLDASILKRFNFSETTKRYFELRGEMFNVPNHPVFAAPNTTANNAQFGQITATVNRFRTLQVSARLVF

SEQ ID NO: 6051 - protein, 1483 aa, Campylobacter jejuni
MTITGKLKSVLLTYSFIILINLLTAMSESLASSWNPPPPPPPPPIEGLNNFKSLNPPSKHSLGNSSKVEQSQHTNKNCTTSNIQMQFSQSLEVPTPTGEFGKKYSKLINPKTSKQNLKIEFPKKIISLVRDELTLKYFTADIERILTLFSKKDDLILSEAKEKYKEVIQDPYIAQFTNKNQNTGSFLENKLFEETREEAILRLLSLEQLDAQMKKEILSKQGDILEQLKFINANTEILGSYGQTASTDILKKIPKELPKILSKQGDILEQLKFINANTEILNEHSKAILKDKLKELSKQLDEISSNQLVGFILDENKINTNLKNVHFSEKKVRETVSNLNNKILEKIFLKDDGTITEQDLTKILQKHQETVLIKNLTKAIVYIDGNKNNATVNKTLEKCLEQTTPEQQELILDVLTHNTRIRTVLITKIEREQRQNHNKKLNKNIAGDSFVDALKKALVHRTSNSETILKVVEQRKQETPKNLNVWDRISQNIPNLNNQNVQDENNKEWDESNKNADDLNNTNIYMITKHDLERAVNETITKFSAMSTLLKDKKNAGAYQRYLKEAEDQLALAQEKGKELIKNSAQTFKIIPKKYQDDINENWQNYLSPAEMIELTALNEHTNTLKSNKNKSGHFRSSEEALQYKAKQHEYYTLLAELKKIGIAKQQEKLVKDYVDEMITNAKQAVEKFERTSLEHINQKKENKQISKEILDAQERLENAKQKIEFIKFKYIISNKRQVNSSDEDSDDDADKNAIKQKTELENAQKDINQAKKNLEDAKAKYAALQITLNYSPNGMDSKTTEDQEQFKTDNIAAESLEDMAVMFKDSEEAAERKEEVTLNYSPNGMDSKTTEDQEQFKTDNIAAESLEDMAVMFKDSEEAAERKEEVTLNYSPNGMDSKTTEDQEQFKTDNIAAESLEDMAVMFKDSEEAAERKEEVTLDYSPNGMDSKTTEDQEQFKTDNIAAESLEDMAVMFKDSEEAAERKEEVTLDYSPNGMDSKTTEDQEQFKTDNIAAESLEDMAVMFKDSEEAAERKEEVTLNYSPNGMDSKTTEDQEQFKTDNIAAESLEDMAVMFKDSEEAAEQKEEVNRQHHEEQNRQKQEHNCLDTEEEVVHKEKIADLTAETETKVFKKEIALEENEAMDVSFKTETIVEQDEAIQRQQVSDDTSRKVAILVKATSTLHKPVHHNILSDRLKVTVIGAGDEKTNINRGLWISGLYGVNKQGSWKNIPKYQGRTTGFTIGADAEFINNHDVIGIAYSNLESKIKYNKKLGKTAVYGHLLSIYGLKELIPGFSLHTIVSYGYNYIKNKSKNLDKIIGKYQNNNLSFQTLLNYKYCTKYNLHFIPSIGFKYDYSRASNYKEYNIDIENLMIQKKSNQSFESSIGGKIVSKPIIITNNTILTLSVHGNIERHFNNKNTKVNAKATFKKQTLQETIIIPKQPKFGYNIGNNILMSIKNINVLYEYNYYTHKKYHSHQGLIKLKINL

SEQ ID NO: 6052 - protein, 800 aa, Campylobacter jejuni
MGIVMTSRKPTRDTARFKALLLAASLLGGATSAYAQDAEKAAEVDSVVVTGKRLSEASVAIGTDRATATVSITREALLSAPAGITGLKMLESLPGFNVQANDALGMYEFGNSVSVRAFNFQQIGFLLDNIPMGRSDQFGGSPIYRYVDNENLLRVTASSGAGDVGLPSYASLGPIVDYFTQAPSQEAGGAISQTFGSDALRRTFLRLEMGKLGPVSGYVSGSWIKGDLWRGPGTIDRKHYEGKLKYDLPNGGDVTFQTVHNDYFDYDSPSITKAQYAGTAGDVFGRKGRYFAYLGAPPTSVPFGTAITIPTASLPETVAGVPYSNTGYAQYYKFAINKRKDHLYGLTLNTPLGESLDLTTTAYYEDKGGYGVSPEAYATSLASHNAQRLIVPGLFAPKGIQYGLSGVDGIRQGVTAKLAWHVGFNKIEAGLWLENDDYHRTQNRYNVAGGNPDGAPLFNERVHAQRDYTSLRETKQFFLKDTLTLMDAKLKLELGFKATDIDYKIAGYRNPNDYINRRRPLLKDNWKDSFLPQVGAVYSLTGRDQVFASYSENMALPRGADDIFSAASPTVAGPDPETSTNWELGYRANHKTFNASIVAYQTEFKNRLQSFAALVPGGGGITETFFQNVGAVQAKGVEFSGQWKPEFLAGKAYFNANVSYNSAKFQDDVLNYRASTTAAATTLGIAGKKVPDFPDWVVQGGLTVEPFDGLLMNISARHLESRFTNFINSEKVGGYTIVNAYIDIGDGFSAGPLSQIKARVNVDNLFDKDYLGTISTTVNTAASFRPAPPRTVQFTISADF

SEQ ID NO: 6053 - protein, 1588 aa, Campylobacter jejuni
MNKIFKVIWNPATGNYTVTSETAKSRGKKSGRSKLLISALVAGGMLSSFGALANAGNDNGQGVDYGSGSAGDGWVAIGKGAKANTFMNTSGSSTAVGYDAIAEGQYSSAIGSKTHAIGGASMAFGVSAISEGDRSIALGASSYSLGQYSMALGRYSKALGKLSIAMGDSSKAEGANAIALGNATKATEIMSIALGDTANASKAYSMALGASSVASEENAIAIGAETEAAENATAIGNNAKAKGTNSMAMGFGSLADKVNTIALGNGSQALADNAIAIGQGNKADGVDAIALGNGSQSRGLNTIALGTASNATGDKSLALGSNSSANGINSVALGADSIADLDNTVSVGNSSLKRKIVNVKNGAIKSDSYDAINGSQLYAISDSVAKRLGGGAAVDVDDGTVTAPTYNLKNGSKNNVGAALAVLDENTLQWDQTKGKYSAAHGTSSPTASVITDVADGTISASSKDAVNGSQLKATNDDVEANTANIATNTSNIATNTANIATNTTNITNLTDSVGDLQADALLWNETKKAFSAAHGQDTTSKITNVKDADLTADSTDAVNGSQLKTTNDAVATNTTNIANNTSNIATNTTNISNLTETVTNLGEDALKWDKDNGVFTAAHGTETTSKITNVKDGDLTTGSTDAVNGSQLKTTNDAVATNTTNIATNTTNISNLTETVTNLGEDALKWDKDNGVFTAAHGNNTASKITNILDGTVTATSSDAINGSQLYDLSSNIATYFGGNASVNTDGVFTGPTYKIGETNYYNVGDALAAINSSFSTSLGDALLWDATAGKFSAKHGTNGDASVITDVADGEISDSSSDAVNGSQLHGVSSYVVDALGGGAEVNADGTITAPTYTIANADYDNVGDALNAIDTTLDDALLWDADAGENGAFSAAHGKDKTASVITNVANGAISAASSDAINGSQLYTTNKYIADALGGDAEVNADGTITAPTYTIANAEYNNVGDALDALDDNALLWDETANGGAGAYNASHDGKASIITNVANGSISEDSTDAVNGSQLNATNMMIEQNTQIINQLAGNTDATYIQENGAGINYVRTNDDGLAFNDASAQGVGATAIGYNSVAKGDSSVAIGQGSYSDVDTGIALGSSSVSSRVIAKGSRDTSITENGVVIGYDTTDGELLGALSIGDDGKYRQIINVADGSEAHDAVTVRQLQNAIGAVATTPTKYFHANSTEEDSLAVGTDSLAMGAKTIVNGDKGIGIGYGAYVDANALNGIAIGSNAQVIHVNSIAIGNGSTTTRGAQTNYTAYNMDAPQNSVGEFSVGSADGQRQITNVAAGSADTDAVNVGQLKVTDAQVSQNTQSITNLDNRVTNLDSRVTNIENGIGDIVTTGSTKYFKTNTDGVDASAQGKDSVAIGSGSIAAADNSVALGTGSVATEENTISVGSSTNQRRITNVAAGKNATDAVNVAQLKSSEAGGVRYDTKADGSIDYSNITLGGGNGGTTRISNVSAGVNNNDVVNYAQLKQSVQETKQYTDQRMVEMDNKLSKTESKLSGGIASAMAMTGLPQAYTPGASMASIGGGTYNGESAVALGVSMVSANGRWVYKLQGSTNSQGEYSAALGAGIQW

SEQ ID NO: 6054 - protein, 232 aa, Campylobacter jejuni
MKNIAMALAATLGIIPALSSAAEIYNKDGNKLDFYGRVAAKYLFKKQSNEDATYVRIGFKGETKINSQLTGFGQWEYNIAANNTESQGDKGNKTRLGFAGLKLADYGSFDYGRNYGVVYDVLSYTDMLPEFGGDSMAATDNYMTARSTGLATYRNDNFFGLVEGLKVAAQYQGRNEDGDVTRNERSIQKANGDGFGLSFNYQNIQGSGVSFAGAYSSSNRTEGQKVSTTDEK

SEQ ID NO: 6055 - protein, 490 aa, Campylobacter jejuni
MINPGTTVLLFKILLVCYLLFSVMLVRAGVTEPNPRLEDAFDFMNVLAKKGLHDLKEERWNAYGQFTYISSWKSGFPASYTNLNGSINSLLPGSERSFTGTATLYLGLKTWHGGEIYYVPEMISMRPLSDLKGLGGAIQNFELQKGGTETPIFYQSRLFFKQTFGFGGERIQLTSDPMQLGTTVDSRRLVVRFGNFSVIDFFDKNSYSGDLRRQFLNMAFMTYAAFDFAADARGYTWGGVAEYFHDDWTFRFGHVATAIDPNQIPLDMRVFKYYGQQVEVERRHLLNGYPGAVRILAYRNHENMGKFSDAIAAFRFDPNKNATTCTGFNYGSGNAGAPDLCWARNPNDKMGIGINIEQQVLDGVGLFFRGMYSDGKTEVYSYTSTDRSISLGALVNGFRWGRDGDLLGIGFAAGWISGQHAKYLNMGGVDGFIGDGRIKARAEDVVDIFYSVNVLSSLWVTADYQHITNPGFNADRGPVNIYGLRVHAEF

SEQ ID NO: 6056 - protein, 315 aa, Campylobacter jejuni
MNKLAAVISASLLMASAAHAEVYMGGKMGKSWVDDACVAGQACDKDGSTLGAFVGYEMNDYFAVEAGFDNVGDFDQTSLGGHVEAITLAPKFSLPVTEDIALYGKVGGAYLMMNDGKDDFSYLGAAGVEFNISENVTARAEYQAITDISNDAVKAMGNSATLGVAFKFGGNDEVVVEEPIVEEVVVEEPIVVTKTFETQTMGTGSFALNSTTLKPESASKLDDLVAFLNEYPQATVGVIGYTDTSGPAAYNQKVSEKRAESVANALVEKGIDASRIQARGEGENNPIASNETREGREQNRRVEVVVPEFEYQVQQ

SEQ ID NO: 6057 - protein, 1035 aa, Campylobacter jejuni
MTITKNGTLGNGSDNSITLKAQNGDTRTLVNLTNQGTIKGKIGIENNNGSFTGTITVRTFENKKTIDGDIYMGIWGGNGGTISIENFNNEGFISGKSRNEKGVHFEGKNNAKVYINTFRNSGSIEGGENSSHERHGVYVQGNVDVTLFENTGFISGKNGQGVYFQGNVTINTFENEGTITSEKGQGVRFEGNVHIKTFENKSGGTIEGKNGQKSIILVGTNGSTPTLENFNNEGFIKGEIGIGGTQGFRGTVTVKTFENKNGGTIDGGIYIPASTGTISIENFNNTGTIKGGNYQGVYFQGDKVHIKTFENKGFISGSAYDMIYKNFNVSGGVSMAGGTIDTFINKGTIQSTGTNHNPAGVKLNYATVKTFENTGFISGTIGVLATQGTIETFKNSGTIEATGKDGHEAAIQIRSAFKNSSSITHFTNEGIIKSKSHGVLIESGDKIETLTNKGTIETELNGIGFYNYTGSEETHLGKIILESDSSIKAGKNGIDIDNQTTARSIRVGGIEVQKGASVSGDEAGIYLGKDKEITAPITISGTVSGGNAGIVNEGRMARGITHNGEAELVISNQGLVGKDDKGNTVTNNKGSVTIKDWVVTTNEEGKLDTVVVGGNKTDSVKVSNITVDQSGLELEELNEIKNLISGVSTNNIANVKTNGGGEISLSYDPISARLSTDVQLNASIAGANFRSSVATASKRATFIDNVMANAMQSFSLDSSGKSQKIALSEKGNLYADASDYIKNDYIKNDYIKSDLTQANYGLNKEHALFILPYLSSQSVELSLNEESKGHTKGTIIGYSTLKDSGIYGVYAGYEDTKMDSTYFDVNNISYYTGLKYFNTLFTTAKGQEVYIKAQAQAALIKNDFTKKIGKTEAKAKAHSYTYGINTAWGMNFIADKNIFSPEAGFAYEGSYTEAFSMQDTRGQATVRGGERTYANHLNLFSTKTSFTWFRDWLPNLKTSVELGAKFNVNPKVKARARFGNMKVNDEFHLPRVRKFASTSLIVPVNEAFYFSLNYNGMFDEKGNTHTGFAQFNYLW

SEQ ID NO: 6058 - protein, 690 aa, Campylobacter jejuni
MTQIKNMKFKKSLLCFLILSGALLKAEEKYQLNDVVVSASGFEQDLVDAPASISIITKEELEKKPIKDIGEAIGDIPGVDVTMNKTGTYDFSIRGFGSSYTLVLIDGKRQSVANGFYDNGFSGSESGYLPPLSMIERIEVIRGPASTLYGSDAVGGVINIITKKNPDKTEANIEFNTLLQQHSNHYGNAGGFNAYVATPLIEDTLSISARLKYYDKAASDLKWPTPVWNNSQQRPDNYQIASHSPGAFTSLGFGSRLNWTVDDKNNIYFDIERYINEISVNSTSSRAIKSERQLFKDNIVLNHDGNYDFGSTNSYLQYGSTKDKELHSQIWVGEGKVVLPWNLGQYGNLVNTFGARIDYEMLKNDQASAGSQIRGKNLDQTTVALYGENEYFITDDLIFTTGLRYIYSDLFDSEFTPRVYLVYHLNDNIAFKGGVSKGYKTPAAKELTNGYYNYSNDNAYFGNPDLKPEESINYELGVDFRIFDFAHYSITGFITDFTNQISSEDLTGMQNGINCSNGTVCTRPINLGKTQTKGIEFAFNTKTYNGFSLNSSYTFMDNRYKDGQKNWFGGDRIENLPRHIAMLKLNYERGKFSSYIKTRARLDTIAKAKGGGNGSLPWQKYKPFYIVDLGINYKINKQSSLSFVVQNLFDKNFFDPQVTKWAGANPAGYANRYQDYTEGRSFWLSYKYDF

SEQ ID NO: 6059 - protein, 242 aa, Campylobacter jejuni
MKKILLATVALVAFGAAPALAADLAARPYNKAPVYAPPVPIYNWTGFYIGGHIGGAFAGDNSIGTGVTANSDGKFLGGVQAGYDWQFAPSWVLGVEGQYSWLSGSNDAVAFTVVGQPGTYTFSDNQRGLASVTGRLGYTWGPALLYVKGGWAYADYKSSLTFTAPGGAAVGVSSTSSQDGYTVGAGLEYLFAQNWSGKIEYQYYDFGNVDLGAGFTAKNDQHVVKAGLNYRFNWGGPVVAKY

SEQ ID NO: 6060 - protein, 718 aa, Campylobacter jejuni
MHPNKKFYKLFKLSLFALLLITNLNAQESNEAINLQKVVVSATGFEQDADSNLRNVISIEGKDLQNKGYVSLEQALERISGISFVNFGLGRNIDMRGQGNKSNIAVKVMIDGRAINVLDNSHGVTPLNSINLDNVERIEIIPGGGSVLYGNGTRGGVINIITKKQKSDAFAINLKSSTYNHGGLGGNLGINGAKQINENLAFSFDIQSFNLDGYQKGYNEKGYFINTKTYIDINDNSDLTLGYNYFKSKNTSSGYLTKTQAQSNPTQKGNSDNITQINRPEISLDYHYYFDDIWEFNLEAFWQNQKINYLKDVSTMSYRGMSLPVYQNGSGFEDTLTGISLKNKLNYANNSYFIFGYEFANHDAKRKSLVYYSAAPIINYHRMTTLMDMTKQSHSIFALNSHNFNEFFTLSGGARYEFSTYNTNRSYRNEMSMNGRPPSSNPMITDSTTLFDTDKNTNNFAFEITPNFKYSDTGNLYLKYERGFVSPTPAQFVNRNNNTSNGIPPYYSSNLKAEIFDTFELGIDDFWWDFYGFNLTLFYTLSKDEISYLGNPHSTSGSWWKYYNIDQTRRLGVELSLSQNFLDDDLIFRESLTYLDAKISKGVNDGMRIPYVSKIKATAGLEYAWNKNFSNFVDLTYFSRAKDGGTINENTGKMSKNSWIRDYFLTDIGMKYNYKKLQILAGIRNLFDKRYYTYQDSINDQYLVGNGRNYYVEFKYAF

SEQ ID NO: 6061 - protein, 300 aa, Anaeromyxobacter sp.
MRTTKKIYSKTLLSIALIGLSGLAFANDTDVQSMDNSTKSSQSESMKMLLKEPGGLSYVDRNTYQTGLEAEIETSNSRNHDKHLKEHGGQVFQTTKFENEWTVDEDGKGTLGSKIETLIGTDENRLFIEANLDKAESHDPKYDVSALYSRNVAPFWDVQAGVRYSEDKNNSNSDRVDGVIGVLGLAPYFFETQAYLYGGDNNFWGASLEVERDFLLTQKLITQPYLEVDAVFSDDSNYAAKSGLSELKTGIKTRYEITKRIRPFIDVAYQYEKGQKATSLQEATDSEKGWVYGAGIELVF

SEQ ID NO: 6062 - protein, 259 aa, Anaeromyxobacter sp.
MNKILIGAIGAVALSLSAPASAADLAARPYTKAPPPMVAAIYDWSGFYIGINGGGGSAHKCWDFVTPVTGVLIGEGCHNATGGTVGGQVGYRWQSANWVFGLEGQGNWADFSGDNVSTTFIGTGLRDRSKINAFGLFTGQVGYAWNNVLFYVKGGGAVVSDRYRGYDVITGLEFDRANETRWGGTVGAGLEFGFAPNWTVGVEYDHIFMGNRTIGFAGSGNFVVAPAGAFTRSERIGQDVDIGLVRVNYRWGGPVIAKY

SEQ ID NO: 6063 - protein, 597 aa, Anaeromyxobacter sp.
MTSNFTRSLLAITITLATTPAIANPAFQQTIFFGDSLSDSGYYRPLLPNEIQAITGKFTTNPGWVWSEYVASYYGSNASPNGNGQTGNNYAAGGAHINEPSISILGEAPSLTSQTNTYLSAHGGKADPSALYTLWGGGNDLLDTLTTPEQIHTIIGNATTAEISLVSTLKNAGARYIVVATIPDLGLAPRARSTGTSAQSTAAANAYNTTLFTGLKSAGLQVIPIDTFHLLEELITSPATYGFSDTTNTACTLTLPLCNPTTLVDTNAPNTYAFADDIHPTTAAHHMLGQYAISILEAPRLQQVLTRSAQGIARARAYQVAWHLDGTPQQDGLHWWGSMRSDSQRNDSNDLYKSVAPAGLFGFDWNSGQIVSGSFIGYGRMHADFSNGNGTFKQKDTTLGGFSGWYTGPVWVNAQISYTLLNYDIKREVQLGPATRVHRGSPNGSNLTVALNASYEMGEGRLRYGSVAGLTWQKTKLESYTEQNASSTALGYPDQQLNSLLGRVGLQMRLEGNVVTPYLQVTYDHEFKKQQNQANAWLQTMPEAGIYSVPGLTFNRNYASIVLGARTKIGHLQSNVGLTTSTEKNARDVTLFVNGSF

SEQ ID NO: 6064 - protein, 386 aa, Anaeromyxobacter sp.
MRKKLLAGAIAALASVGVHAQSSVTLYGIIDNGLTYVNNVKGSSLFKLDDGINQASRWGLRGVEDLGGGLKAIFTLENGFSLNTGTASHGGALFGRRAFVGLTSDRFGTLIAGYDYDFIYDYISYYTNVAQFAPSYAFHGSYDVDRLAGEPVSNMVRYETPIWHGFGAGVMYGFSNTPGRLGGTFNGAASVFSAGLKYSPTGSLKAPYSVAASFTRTQGGAVAATGGPGAGTMAQYALQADAIYTAALAGQVSLGDRFALNGVYTYTSANSRTLGTVVSSGYEAGLTYQAAPDISFGAGFTYMDQRRLGKFNLYSLGADYRLSKRTDVYAFGTLQHAFAGRQFADNFLISTPFSYGATVGTNAIFGNGRSSTANQLAVQVGIRHLF

SEQ ID NO: 6065 - protein, 713 aa, Anaeromyxobacter sp.
MNRLSSTSGDNAPRSHPRCIVLALLAGVGAAPVFAAEAAPVLNPVVVTGSRVEAESFDLPFSVDVVDMARVRAGNLGVNASEALTGIPGLVVQNRQNYAQDLQISIRGFGARSAFGVRGVKLIADGIPASNPDGQGQAATFNLDVAERIEVLRGPFSTIYGNHAGGVIQLFSRDPKGTPSVRGGALAGSWGTTRIGVGSEGEKDGVGYLLDASRFDTDGYRDHSAATREQAFAKLNFAPDADSRLTLTASGLRQPDTEDPLGLTWATYRRDPRATESVAKTFDTRKRIDHLQGGATYERRFGDDRLQLVAYAGQRSVTQYQSIPAGPQANPRHSGGVIDFDRDFHGVGARWIGRRELGPGKLTFTAGIDVDRSEDDRQGFENFIGTTLGVKGRLRRDEMDTVTSIDPYVQTAWEQGAWQWTAGLRHSRVKFDVDDDYLANGDDSGALTFRETTPALGVVYKLSPALNFYGSAARGFETPTMTELAYSGAGGAAGFNFGLEPATSTQLELGVKAFVGDNTRLNAAIFQVRTDNELVVESSSGGRTVFKNAGTTLRRGVELALDSEFSPNWRARLSVTRLQAIYDETFVTGSGTAAKTIADGRRLPGIPALSAYAELEWIPVGGIAAALEALYRSKMYVEDTNTERAAPAHALANLRFTAEQKSGPWTFNEMLRLDNLFDREHVASVIVGDGNGRFYEPGPERSWYAGVRASYRF

SEQ ID NO: 6066 - protein, 940 aa, Anaeromyxobacter sp.
MRKLKFNHMLALASTVALVSGSQTVYAQQQDASAQVEEVVVTGFRASLANSISAKRESASVIDSVYAEDIGKLPDTSIAESLARLPGLAGERRDGRTSGIAIRGFNENYVATTLNGREILGIGDSRGVEFDLYPSEMLSGVDVYKTPNATQVNQGLGGIVNMKTLRPLDGASVISLSGAYEVNGLKSSNPDVDDNGHRLAFTYSEKFVDETLGVALTLATLESPSQEEQFRAWGYTDDGAGNTVLGGHDSYVRSSLMERDTISGVVQFRPNDTVSVTVDGLYIDFSETKVLRGLEEGTVWGGPSVTNVTDTVENGLVTAGHWDGFHSVIRNDGETKEGKLHSFGVNADFAINDNWSLNVDLSTSESEKEIISMESYSGTGRAGTTGQGAPAARSFVMTSTGVKYSAHPTLSTPDYSDPSVLRIAGPQAWGGGISSLTGGFDNAQDGFVNSPSIEESLDAFRIQFNGDVEWGIVNGLEVGAHYSDRSKSKVNYGAYLVAPGFYQADGSLPSDISEISDIAIPAEYIVGTADLSFLSLGSMVAYDGIGLYKSGFYREIDAGNYETDRKGDTYTIDEKVATAFVMANIDAGQLTGNAGIQIVSTDQKASGFDSVPVAPTADGTVQAVAVSDGDKYTDILPSLNLTYALTDDQNIRLAVARTMSRAVMDDLKPGRTVTFSFDAARRASNDPEFSAWSSTSGNAQLKPIKAVQIDLAYEYYFARDGLFSIAGFYKDLQNWHLEGSETIDFTSYFVPGYHDANMPGGTTFASFWGGNSSVFETNGGSVSGYEVQASIPFHLFSDALDGFGIIASGTFLDSTLVHNGESSDIPGFSDESYQFTAYYERAGFEARISGRKRTKFLTEVPGLSLRATPAMDMGAELWDAQIGYNFAESGIRGLEGLTVTLQAQNIFDEDTVNAESGDARRVTKYQNFGANYLLGFNYKF

SEQ ID NO: 6067 - protein, 706 aa, Anaeromyxobacter sp.
MRRPPARSIGLSPVPLSLVLTLGGTWPSLALAAETAIDLPPVYVTTATRTEHDITTAPAPVQLIDSTDIQAAGATTLRNILDLTPGVHVSPTGTTLQIRGLGGSDTLYLIDGRRVEGEFSNSFELERIAASMIDRIEIVRGPASMLYGADALGGVVNIITKQPTAGLEGSVDLQYGANNHGDGERSLLSADLRGGSEALLFSLYANRVSRDPYAERETARVTVPQSGTQIAPSAHPNARIRNGLKDSYDVDVEYRDKADVDTVGGAVELLPTPELKLRLDLNAMQEDRESTYISSRYATAVLASGRPIQAANIPARQYDDNERLDTALGLDWSPFRTLDLRYRLQYSRYEKDRVAYALPYADLGYATREASASAVNRSTMEQWVNELTGVWRPAEGHSLVGGLEHRENDVDSTAYDADGRRFDSAFLQHEWQILPDLSAVYGVRYDDDSVGGSNVSVQAGGVWTLSPLLRLRANFAQGYKAPDGRDLYVNQVNPQGVPMLGAEVIDPGQGKTSAHTVDPETSDTIELGLAGGTRVWDYGLTVFHTDVTDRIEMVREGSGLLTYNTFRNIGKVRIRGIEAEGSVGLTTELRARASVTLLDAENRSGGDALLTTPETLATASLDYAPGPGWLLRAIVRHTGEQDYSGRAGVEKADDYTLVHLKASYAPPALEGIEVYGGIDNLFDGKVDPGLGSDPGPYAYLGVRYHF

SEQ ID NO: 6068 - protein, 213 aa, Anaeromyxobacter sp.
MKAALKGKYDLDHNSSGAATVAFNAGDVKLRASITDATFKNSPSLTGLVLAVEKPGSFSVDYNVPKKDFRFQFMNTVRVAEKPLNLAYIHSKGDNRTILDGTLVWDPSNKVSANYAVESGNCKLKYSYNHKGLTTIEPTYDVAKNSWDFAVSGKVYGDDSLKASYQTSSKVLGLEWTRNSKQTGCFKVVASVNLAEEKKIPKLSVESTLNFEM

SEQ ID NO: 6069 - protein, 654 aa, Anaeromyxobacter sp.
MNVVIRASIAGNGTLSRRIVAGGAFAFALSASSGAFAACTGTGSLVGLGAQVLPFSAGGAAVNSLVSAINATNTVFLTQSTAFVSAPPNPAPGQEGGGVWVRGIGGELNTKNTTTTSNVSVGGVTNPGQIDCNNSSQLNFAGMQIGADAARLNWNGWNVHLGTTIGYLGARSRDTSSAGPENPMGGTFQNSLQVPFVGVYAAATRGGFFVDGQVRLDYYQNALNDPIVSGIFNQKLDARGLSFAGNFGYHHQLPNNWFIEPSAGIIVSRVQVDPLNITGTLVLPSAGGISLPGTLRVDDMYSTLGRWSLRAGTSFVSNNIAWQPFGTASIYHEFQGRANASFTGYFPIPGFDIAGNVSTTSIGTYGQFGLGIAAQVLNTGWLGYLRADYRTGSNIEGYSLNGGLRYQFSPDQIAGAPMFTKAVKAPVMAGPYNWTGLYIGASAGVLNGRNDWSFPGLGTRTNPRYAGFAGGGQIGYDWQIGTWVVGLEGSLMGSNARGARSCPNALFYTCENEMNWLGTATAKLGYTIWNRSLVYLRGGAAFGNTRIVTNCNTGPDRGYIDYSIPAVIAQPGCGANSSKTAAGWTVGLGTEFALTRSWTVRAESNYFDLGTERYSLAQGGGIPPLQIDTHNNGFISTIGLNYRFPIEPVMAARY

SEQ ID NO: 6070 - protein, 754 aa, Anaeromyxobacter sp.
MRGRGFSQRLPMIRLHPLVVALSLALPVVPLCAIAAEADAGAAAARDVHDFDRLQVTATRTQRALVEVPGTVDVIDREQLDNQLVRELKDLFRYTPGVSVTSTSGRFTGASGVRIRGLDGNRVAILVDNVPVSDTFNFGSYLNANRNFVDLETLKRVEVVRGPASSLYGSDALGGVVAFVTKDPSDYLSADKHSYVGLKFGYEGDWNGLFAGATGAFGGERWSGMVAVSHRQGQEAQNQGDNRSRNYTRTAPNPQQVDGRSVLGKLVYAPNAQQRFKLTVEGNEDDGRIEALSGIDARSPSASQRILSQDGRDHQTRARVSLRHELDALDTALADDLFWQLYRQDSASLQRTDELRGNNTRRHNEHHFDQRVYGLLVNAHKAIDTGTLRHDITYGLEGSWTDTREKRDGYSLNLANGAVSKLVGQDVFPVRDFPMSETTKLGAYAQDEMRLLDGRLSLIPGVRVDYFRLSPRVDDIFRQDNPGVAAETIDEQQVSPKFGAVWRFSDAWSAYANYAHGFRAPPYNDVNIGFTNLQARYTAIANPDLKSETSRGGELGLRFNDTVGYLGVNVYYTDYRNFIESYAPAGVNAEGLLLFQSRNVDDVVIKGAEARAGVDLGALAGWQGWSVNSAVAYSQGDNLTDDTPLNSVDPLRGTLGVAFDSERWGAEVIGTFVARKRRPQLASYYTPAGYATLDLMGHWEFAPGAKVTGGIFNLADRRYVDWNALPNGTLDSSTVLDRFTGAGRTASVSLAVSW

SEQ ID NO: 6071 - protein, 1078 aa, Anaeromyxobacter sp.
MRIGLFLAAVCLYGQTYTGSIGGRVVDGSGSAIPRSQVTIIEEATNTTLKTVTSDSGDYLVNYLKPGSYTVQVSAPGFKAHVETGVPLQINQARRIDPVLEIGQVTEKVEVTASAAQVNYASPEIGQVVDAQQLVELPQIATNSRGRSPFLLAKLLPGVTTNGNTYTNINGFSFAGGRKATNEILVDGVPTTNPSDNTYTLTPSPDSISEFKVLTTPFSAEYGHTGGGVMIATSRSGGNVVHGSAYDLFRNRILNGRDFFSPAQSTVKYVQNDPGGTIGGPVVIPHLYNGKDKTFFFVDFNVTLASQGNVFQGIVPTELQRNGDFSQTLAGGQVVPIYDPNTAHLAPDGKTILRDPFPGNVIPAGRFDPVGAAILKFFPPPNANINGNNYFVTPPSTNDNWQYLGRIDQNFGQNDRAFFRFGQYSPNNNAPDNIPNKANNGTFGGWVDTQAVINETHVFSPTLVSDFRFGLVQEDNYTTAATAPVPELGLKGVNLNSFPQVSVAQMVALGSKASNHDRDRSWVFNEALTLTKGRHSVKFGGDFRRQMYDSYSPGKLSGSYTFGNTFSAVSPNDTKSGFGLADLLLGMPASSTFSFNDYTYRLNINSAGGFVQDDFKILRNLTLNLGIRWEWDGPYSEANNQFASFNPSIVNHVTGNLGDVQFAGRGGAPTHFSPNIYHDFLPRVGFAWSFLHDTVLRGGYGVYRLPAIGFSSIGPVSQYAQAATFTSLDNNATPRYTLSQGVPPIPYNVDAAGNPNIPASLSNPTQNVTQLEFRDRTPYNQTWQIGMQHQFKGNWLAEIDYVGTRGVKLPMLEAMNQLPYAQWGPGNRQGLRPFPQYLTVNKFVNDSNSFYNSLQTSLQRRWNNGVLSFAYTWAKITADLDGSAVQDIYNVRAEHGIASYDVPHRFVANYVYRIPLGRDGKLLNGVPVIQDIVRGWEFSGITEFQVGLPLAVTQNNGTGGFTGTQRPNQIAPAALAGDQRSLAAWFNINAFTQSAPFTAGTAPRYSFYGPGIENWDASLMRNFQIRERLRLQFRGEFYNSFNHPNFKNPNTTLGNINYGRITSDNGPRNMELGLRLFF

SEQ ID NO: 6072 - protein, 684 aa, Anaeromyxobacter sp.
MSSISRGHARNCAPIFVSRIRTGLLTSAVVTTVLGASLAPAQAQFARLYGFGDSYADTGAAPGGAYRLIGANGTGTVTIPYFPFTLTPSDFWPCPSPTYTSCRFTGSTNFVDSLQSIYGLSGLTNYSIGGARTGNTNTMPFLSSGYGLPYELQQFAASGTRFTERDLIALSIGGNDLSGINVGTGDVASQNAIIVAGALQSAAAAVGGVQQLVAAGARNIAWLGTGSSKWFPEATLGSQGGAIGTFNFSASQRDAWADTYYQQTQLMLAPMAQAGVRIFLFNFGILQQRVAENPAMYGFAGVPAGFTGCEAGPGTGATPGTVAVNVAGCFYENSVHPTGAAMALIANYMANQIDAPTTVTPQAAIATGLLGSFSNSVFDRLEAGRRFQPSGVNAAMAAMPSKAVALTEPADRWSVYGAASYAGGSRDRQFYATGYDYDAAGGYLGLEYRLNANWRVGGVFGYSQPDVKLAVQDARNRIDAFQFAGYSSYTDAHWFADGLVAYGRQDFTLERRGIIDIIRASTSADVVTVAARGGYLFDAGRLRVGPIAGLNYTNATIRGYTETGDVLLTMMVDRQTLDTLTGDAGVQLRYPLQFGNGLYAPFLNLTAAHDFLRSGHTVTTTLVSAPLLPILTPVSADGGTYGRVAAGVSALVATNVTATLTGTTSFARKGGDDAGVTGGVKLAF

SEQ ID NO: 6073 - protein, 209 aa, Anaeromyxobacter sp.
MRPLLPLLATTTLAVAAPATAETPPTAFQQPVLITFDAPNDTPTASLSTQSRPTLSSSANWTGFYIGGQLGVGVVDSDISSNDEDFIGGVTFGYDHDFGRWVLGGALDYDFADINAGPGTSIEEIFRVKLRGGPKIGNGLLYGAAGWANADTDTAGRDDGWFIGAGYEYLVSSQFSVGGEVLYHEFDNFNSTGIDVEATTIQVRATFRF

SEQ ID NO: 6074 - protein, 964 aa, Anaeromyxobacter sp.
MTTNNYSKVIRNQRIFAKSLLCLSVLSAMGYAQTPEAEKADEENIEVIEIRGIRASSAENLSIKRTSDAVVDAITAEDIGKFPDKNVADSLQRVPGVVIQRSGGEGATVSIRGLSSDLTFTQLNGNFIASSPGEPSRSFSYALMPSTMIERVEVFKSSEARLDEGGIGGTVLMYSRKPLNMDKNSGIVNLEYSNSDITDKYEPQFSGIYSWKNDDEDLGFLLGYTRQDRTNRSQSARVNIINKNFLYQERKDNQLVEGGAKGYAPQSMVQEVLEEQREREGFQVTTQWRPTDSLEFGMNYFRFTLGQDSILNQLEYPEWNNNDNFWTDVRVDAEAEYVTGIDYSAGTSGSQRLSAIPRINGEYKREESTSDTFDFYAKYEGDNFNAKLTFGKTKAEGGPSEKFRAAYYANESSLYYGYDLSGHKMTTYMDPKMIENLTAGIGGQADVGATDSSFVTGTQEEKYASLDVDYFVDWGLVHTLHFGMKYRDGKIHRDTRNTFYLSPDFDIAAGEAAGTINLDDDYSRNDGIPDIRDVIMSGSLGNLSDVINTNLFPAVDWQRYQQIVSENFVQYTRIEPNYVYNVQEEITAAYLQADFSYEDFRGNLGLRYVSTTTTSGSSDKILYRLDWKDAQGNLLPEDEQRVEDFVYLEKENTYDRWLPSLNLVWDLADNWVWRFAAAKVMARPGYDDLGQFQTLVYTSNEYSADRSAADDFDSIRDSEGWTGSGGNSSLLPMESTQFDTSLEYYYGEGSGVGIAFFKKNVDNFVVPLIIDTTRSVPEQSFTLPNAGDKVVTAGGDDLLVRDFYTVANGTDASSSGMEVFMQHFFDNGFGIYANYTRNNTNQANVELDGQKVGESPLIGSSKYQWNLSAFYENDDLSVRASYNKRGPSVGGYVASWETNYYTEAYDQIDVNASYNLTDSLMLSASVINLTQSETYVHLGNDTDNRFIQNAYAGRRFYLGATYRF

SEQ ID NO: 6075 - protein, 468 aa, Anaeromyxobacter sp.
MRAFSGKRSTLALAIAGVTAMSGFMAMPEARAEGFIDDSTLTGGIYYWQRERDRKDVTDGDKYKTNLSHSTWNANLDFQSGYAADMFGLDIAAFTAIEMAENGDSSHPNEIAFSKSNKAYDEDWSGDKSGISLYKAAAKFKYGPVWARAGYIQPTGQTLLAPHWSFMPGTYQGAEAGANFDYGDAGALSFSYMWTNEYKAPWHLEMDEFYQNDKTTKVDYLHSIGAKYDFKNNFVLEAAFGQAEGYIDQYFAKASYKFDIAGSPLTTSYQFYGTRDKVDDRSVNDLYDGTAWLQALTFGYRAADVVDLRLEGTWVKADGQQGYFLQRMTPTYASSNGRLDIWWDNRSDFNANGEKAVFFGAMYDLKNWNLPGFAIGASYVYAWDAKPATWQSNPDAYYDKNRTIEESAYSLDAVYTIQDGRAKGTMFKLHFTEYDNHSDIPSWGGGYGNIFQDERDVKFMVIAPFTIF

SEQ ID NO: 6076 - protein, 210 aa, Anaeromyxobacter sp.
MRKLLAAVFALTLLAVPFTSHAQVSLGLRLGYAPALGDAAKDAKMSDGVKSQIPIQLDAGYKLTPKLSLGGYASYGFGQSGDEFDAYCDGADCSTRVVRVGVQGLYTFDAIGRLQPFAGVGAGYEWGSLTAEAGGQEATLSYRGFELLNLTAGADYAVSPQFAIGPYLGFSVGRYSNVSMDLGAEEISGEIDDQAMHEWLQLGIRGRFDL

SEQ ID NO: 6077 - protein, 620 aa, Anaeromyxobacter sp.
MTLRNYILFCLIFLCQLVLAQNDTITNLKEVVVSDTYLHNNNKSQSIQVLNDSVIIKNQSSLASLLNYNSTIYFKEYGRGMLSTVSFRGTTSAQTAVIWNGININSQLNGSTDFNTVTGNDYATISVKAGGGSVIYGSGAVGGSVHLNNNLSFKKQFTNTLQLSYGSFDTSGINYKTLLSNEKWSTQIGFSYHESKNEYPYIELFNWKGAQRKNLNGEYLNTSLNANIGYKINSNNLIKLYSQTSNTDRHLSLVSESDTKTKYVNSFSRNLLEYDSNFYQYSINLKSAYIIEEYQYFANIASDYFSFGKSESAIAKLDFSYQILKSLKINTILDYSQTKGYGTSFGNNTRKIGSAALLVKQQLGKKWQNELGIRQEITDNYKSPLLLSAGTSRFLNNWYTVKINFSRNYRMPTFNDLYWEGTSDHGNPNLKVESSYQAEVGNVFSFKKIKLSQTFYYNKIKDLISWKPGDGGGWTPQNTNKVTTYGLETVLGWANNIGKHLFSMSGSYAYTISQDEETKKQLFFVPFHKITASVGYSYKNFAVNYQFLYNGFVYTRSDNDPKEIIKSYKVSNIGIDYDFKFLSNSKLGFQVLNLFNKKYQTLEDRPSPGRNFNIYITLKF

SEQ ID NO: 6078 - protein, 445 aa, Parvibaculum lavamentivorans
MTLKMRETMNKRILSMAVAAAIVGSVTQVQAAGFQLAEYSATGLGRAFAGEAAMADNAAAQFRNPAMMTYLSGTQVAGGAILVMPNIDINGEVTFVDGTNPTSANDIADDAVVPNFYVTHQLNEQWFLGLALGSNFGMATELDDSFRGTQFGNEASVTTIEINPNIAYRINEQFSVGAGVRFVIGEGSIGAKSSADSVLPTPMGNLPVPKGTTLKYMEGDDTSWGWQLGAAWQINDSNRIGVNYRSAVDQNLEGEANGLAFNPMDPTLKMDGAMELSLPATAELASFHQLTEKLAIHASINWTDWSSFEKLEAVIPALSEPTQLVKQENWKDSYRFALGTTYDLSQKSTLRAGVAYDRSAVSDANRTLTIPEMDRLWLSAGYGYHYSDNLDLDFGVTYIFADESPVVEPRPGIESDRSSALFGGTFSGTTSGNIMLVGVQASYRF

SEQ ID NO: 6079 - protein, 1090 aa, Parvibaculum lavamentivorans
MATILFAQKPQGDATILVKVTIVDVDKNPLPGATVKVTGKAQGVVANDQGEVSLWVDRNTQIEFKYVGMKPLFMRVTKPLSGYITLEDETSELDQVVVTGYQRTTKRRTTGSLTTLTAKDLKGAPTANLDMLMQGKVAGMDVKAVSGRPGESAKIRIRGTNTITGNAEPLWVVDGVPLQKDIPSISSSQIRAGDFNEIFANGISGINPNDIESITVLKDASATAIYGSRAAGGVIVVTTKRGKEGKMSINYSANVSIVTRPPGNANLMNSSEKLAWEQELWNEFSAKGFADGTHYPVIGAVGMIRSGYGKYANMTLEQQNAEIARLGEQTTDWFDELFQNSVSNSHYLSLSGGSEKNSYYVSLGYAKNNGLVKKTDYERYNVSAKLDMKPNKRVKLGISADMAIQESTSPSLNVDPFKYAYFANPYERIYNEDGSYAADNTYYSITHANGAYDKLLPDGGYNIFREINETSNETKNMSASLIANLSVNILDNLSFEGLASYGYVTNASDNINGKNTYAAWQDRPFEGSASSISKRTYGSITQTNAYNTNYNLRGQLHYFNTFGRDHYISALLGSEIRGQYSKSIYEKRYGYDPISGNSSIPIYPESMDIGYNNLISYAAIVDQLSGQSIVEDAFASFYLSLDYVFKQRYILSLTGRTDGSNNFGSNEQFNPTGSVGLSWNVDQEEFMKPLKPIISTLSLRAAFGYTGNINKSVYPQLVMDYENSFRKADNDYYRMGTLRNAPNAKLRWEKTRDMKISMDIGFLNDRLRLQGELYDRRTRDAVTSVPVVYTTGFSYQSYNTSELLNQGAEVTISANVLKTKDWNLSLTANIAYNRNKLLKYSSPNGSIFNSNYVGYPLSSIVSGKVIGIDEKLGIYAYATRPDVTMSTEADRGEAKNYAFYLGTSNAPTNGGYSISLSYKKINLSLGGSYSLGGKILNNITCPVSYTMLNESSAAVESIPTQENDLYTNFLNVTKDRVNRWTKDNPITNGYPRIIDAYGEYLGLDNYMITSSQITRASMLEKVSYFKLGSLLLGYNFENEWLKRAHISSLALSFSVSNLFIITNYSGIDPETPGAVYPTPRTFSMGVSIGF

SEQ ID NO: 6080 - protein, 736 aa, Parvibaculum lavamentivorans
MTRTGHTPARGERRHAAPRRNTGAWRARAARSCTTLLGCAMATTGALAADAAASAPDDRHALPAINVTASSASADPLTQPLETGSRLGLASLDTPASVETVTADTIEARGDRTVLDAVTRTAGFASAIAPGTGGTALSVRGFSGQESVMTLLDGVRLMPAAGTITFPFDTWSVARIEVLRGPASVLYGEGAIGGGVNVVPKRPQRTRETTLQVGVGPDGAKRFAFDTTGALGPRLSYRFYASDARANGLAERADTHTTAIGGALTFDVSPRLTLTLDYDYGRQMPATYYGVPAPNGVLDPSLRKLNYTVGDATISYYDQWTRLSASYRPTAGVTIDNQLYYLTSNRHWRNAESYVLDSATARVTRGDYLDIGHHQRQIGDRLSARFDGMLFGRANRFVVGTEFSQTTFSGTNNSPYGGETTVPVHGFDPGVFTSPDPTVPQFSTRARQAAVFAENRLEVLPRLAWVSGLRYDHIAFSREQAATGAGFDKRFANIGWRTGFVFDIAPMFSAYAQYTTGAEGVGSLVTLSASQMNDRLATGAQWEAGLKQTLLDGRAYWTVAVYDITKRNLLSTDPFNPALRQQVGRQSSRGVELTGGARLPHGWTIDANVALLRARYDAFNQTVGGATVSRAGNVPSGVPQQTANLWVGWAFAERWQANAGVRYVGATYGDDANRVQVPSYTVFDASLRWQPTSRTELALYLRNLANRTYAVTTSNGGEQWLLGPSRSAELVATMRF

SEQ ID NO: 6081 - protein, 345 aa, Parvibaculum lavamentivorans
MKNTFLLTFALILLAGSPLKAQEKEEAATLNKVVNTLKERITLAGYAQLGYTYDDAAKKMNTFDIKRIIFMAHGKITDRWTCDFMYDFYNGGMMLEVYTDYRILPGLKVRIGEFKVPYTIENELSPTTVELINCYSQSVCYLAGVSGSDVACGMTSGRDIGAMVHGGLLNDLLCYKLAIMNGQGLNIKDKNNQKDIIGNLMVNPLKWLSVGGSFIKGTGHAIADSEITDIRAGENYTKNRWSIGGVITTTPFSLRSEYLAGKDGGVKSDGFYATGCYRMLRNFDLVASYDYFNANKAVSRKQTNYIAGLQYWFYPKCRLQAQYTFCDRNKGKDSNLFQAQVQVRF

SEQ ID NO: 6082 - protein, 409 aa, Parvibaculum lavamentivorans
MKKTGALLIGSALGLAAGQTMASGFGVSYQSVSAMGTAYAGAAVLSENASNQWYNPATLAGLKKTELSLALHQVWVDTNFEADGAAGPGNLDDIEPFVGSGFLAVPIGETMTFGLAITSPFGTKVEYENNWGNALSPVGPFSGDFYSTESDLQTININPSLGIQLTDNLNVGLGVSYQTLDADIENAGTRLEGDDDTYGWNLGLTYSPDDNNHFGVAYRSKMKFEVDGDITFKPAVAGPLAGTYSGSADVDLPASLQLSYAGDLSDRTQILLGVEWMEWSSLDELSIDHVAPAPLPNPAVENFDWENTARYSLGLRHGVSESTVLRFGVAMEESTQGTDNRSAISPDSEKVWATIGAGFEPMENMLIDVAYAHVFVDDADINRVDKGVPLLGTYELDADIIGAQLSYRF

SEQ ID NO: 6083 - protein, 1440 aa, Parvibaculum lavamentivorans
MKNYLNAFLFLAFAAIASTSVANAQIMVDTTPAGPSENDLVVKSGQVSVYELPEDYKQILLIDDKRIFAIEYSLYSTPDKGNILSLPGVSLGQWYSDEVTGKFFPWASDAKDAEDLSRKLSAESKVFLEKNRGELLNNRGDLELYSYSNGGGFIYNSWRTKEPTSKQRPLNPDGSSEGLIYYYNGTLYHTKGGNKGQGRIQAYGGCEANTISKSQNGEPIKVISSQIVESGYCEWEGDQLSSRYAPVFTGGILDFAEDMPVLGNKYWYVKYESENVNTIVGTISNEGSSLSFNGIFTPVDPEGQDVYGNLLFKGDGITYLNNQVRLYGNLDVAASSQLSITSSSSDLISTPLMFLDGKNIKDGKSNNTLTIMQKGVLQVTGNDLDDDSGPRLPGQPSDKAAVVAHRSPVISFNAGDDKFGIESNSLAVVSYVDFLPSQYSKYKTNCQADQDQATCYKAVPQIAFDAGNDKLINEGVLIGPGEASTGNFLEVALGGGDDVVENSGYLGCLTSAADPGGWNGYVGQNTCSQADQLVNDQLPDGAKNELNRNYNVNLVFANGDDTLSNSGYIRGAINMGNGNDSVETSGGIRGSIVLGHGSDTLGIIQNNDWIGSGVIDDTVSLALSKDVDTGDVDERNNVLLQGRAIISFRNSLGFGSDQCGTKKDKNGGYGCRWGSVGSEGAGYQYPAITGSLGNDTIAVGGQKRDSPAQIWGKVELGANDDSFIVKESGAVSVYGDINFGPGADNFINDGVVKLPGEAQKDGLVLSGNILMGTGSDVVTTNSNIEGPGYIDGGSGEGDVDTITFRASDSAIHQFKVGKVRNFEIANQVSGQWDYDGDYKAAGISVMSVKGGRFLVLDSEQATFEHFVLNGGEIYASLENKNSAPLVSDTFDYQAGSLVINAAQQNDPEGVYTIIKSESQAEMNQLAANTELQYGSNVGQFTGIGESNGIGNSAIYDVYLKEGSLQLVVSQKSSGEIIDCLDDEGCDKDIPSDEKDIVEEITEPGSPGAEIIDAILDDILDEIDLPIIGYGTFARLIISGLAPRNIDGAGRGMATYNNLLTDVVFERLPLRQFDPVVVEETVVEQEEVIEESAPPVRGLWNKSGEVSDQQAQQALDQAIAQAEVTGETTIESLEASGFIEDTSLTAQYARRDGVRAWFRGFGGDDHDSYNDNFYNPYYVNAGGGVLGVDVSVTDNFQIGAFANYGNINLIQQNTLAGGGSWNSDGWGGGVKADYWTDNFYVQGLFSATGFSGNQKREIIEITDQLGDETASGDKSATSYGLAFRLGAPFEAGKFVLEPQFTTTWSFNNEHQFTESGAGQLNLTYKERSTTYVQTDLAMKFSYPINTGETSQLVPSLRVGWLGDWSGNLSDQTLGYRFTNKEANIKSANEDTNGVLVEGGLDYTIANVNSSSYKVYLRGGIEAWGGARGTDYRASGGFEWQF

SEQ ID NO: 6084 - protein, 196 aa, Parvibaculum lavamentivorans
MSKQGIIMKKSVLALGLIGLVSLPTFAASTNGGAYVGGGLSVYQDSDTDGHGNLDSDGMGYNLYGGYQFNRIVGVELGYNDYADYKNGAEKLSPTSISASANIGYTFDNTIRPFVLAGLSSVDLHANQAANYGDDSGTGFHFGVGVEYTPIEHLTLRLISQADAVSVDDYSYQGSLKNDDHTLAFNSVSFGGSYNF

SEQ ID NO: 6085 - protein, 319 aa, Parvibaculum lavamentivorans
MKKILLCLGLASVLFSADNNVKFEITPTLNYNYFEGNLDMDNRYAPGIRLGYHFDDFWLDQLEFGLEHYSDVKYTNTNKTTDITRTYLSAIKGIDVGEKFYFYGLAGGGYEDFSNAAYDNKSGGFGHYGAGVKFRLSDSLALRLETRDQINFNHANHNWVSTLGISFGFGGKKEKAVEEVADTRPAPQAKCPVEPREGALLDENGCEKTISLEGHFGFDKTTINPTFQEKIKEIAKVLDENERYDTILEGHTDNIGSRAYNQKLSERRAKSVANELEKYGVEKSRIKTVGYGQDNPRSSNDTKEGRADNRRVDAKFILR

SEQ ID NO: 6086 - protein, 440 aa, Parvibaculum lavamentivorans
MTTREETMKYFNKTLLAAAIGLASTQTLAAGFQLNSHSATGVGRAISGDAVIADNASVLSRNPAAMALFDNTALSLGVTYADIDVSVKDVCKAGTPICFGSDTDAAEDKIIPNFYYINPINDKWAFGVAAFSNFGTGTDPGALANNAVTLPGLGTIPAPVDLLGNTEVITMNLNASLSYRVNEQLSLGAGVDVIYGQGTLTRKGNLPFGPNGEMVPVSLVNVDADGWALGGILGAVYEFNADHRLGVSYRFSPEFKASGDVQTLVPQAQAYANFDEIVIPLPDIFQVAGFHQLTEKFALHYTAQLTSWGDFKEITLENGTLGQTSIPSSQLKHYAWDDSWLFSIGGTYQLSDAWTLRAGYMHDQGVVDEISSISIPDSDRNWYTLGASYALSANATLDLGVALVRGEDTQVLEQSAIIGDVIAHTRSNAVYYSLQYNYKY

SEQ ID NO: 6087 - protein, 1724 aa, Parvibaculum lavamentivorans
MIDVEYSNDKNHKNHKTINKGTININSKNSVGIDFAKYELGLLQTDVSLGNINVNGSNNYGFRMAKLFDGETKTYQGADNGSNLTVDGNKYYDNTTITGEGGKIVVGGKENVGVSISKGVSADKSANPISNIKSLNIEVVGENVVGFLRNKDFSINNTGNIVLDDTTVQSLTFGNGAKNSTLVRSDNGTIDIKKNLNATKGSTGNSFSQATSGGRVVNHSILKSTLSHFTGMISYGRGNLRSSTAINKGTIELTGDSDSNIGMAALNSGEIRNENGTIKVLGKGKNKAAIYTDQTSSATLNGGNYFISGESSSGIYNQGSTILGDNNKIFASNGAVGIYSSGGTIDGSHAANGVDIEVDDGDSEEKGLAVYGENGTDIKLQNSKINVKKGIAGVAAFGANTKINLNGATLKYSGSGYAAYATGGGKIDLSNSRIELRGRATGFEMAGSGTSPITLNSNTRIHVYSNDVTVMNIKDMASLNYSNLNSTAFNSYLQGATVHAENGATDYKLAAVDGIGAYNINSSLDKKLAVNPANKNTNDYIFTRLLSVQRARMNLKSGNNVRAVLSSSELAAIKEKTVVGLAMNSSKNAVSNTETAINLENNTTVTADRTDAGDGAVGLFVNYGTVNVASGATINVEKENNVVNEKAVGIYAVNGTEVDNKGTINVGGKNSIGIFGIAYRTDNAGNKKIDEFGSNAVGQGKVNIKNQGTLSLNGEGASGILVKNNKGTAASLGEHKALNTGTINMSGNKAIGMFAEKGYLKNEGTINITGSQQGIGMYGHLGSILENGTNGKINVADSNDENKLNIGMFTDDINTKIMNAGKISVGKNSYGIYGKNITTTATSKIKTGDNGVGIFSSTKDSNTTLDLAPGSEITVGNNNAVGVFSLGNKAAHITSFSKMNIGNGSFGYVIRSKGSTLNSNYAGETELKQDGTYIYSTDEDGTITNKTKLKSSGNKNYGIYASGNVKNLADINFATGYGNVGLYSTSNNSNKGITNGEAGSSGIKPKITVGASKIRDTNGNLLKEKDRLYSIGMAAGYSWTEEDLKKPEAQRPKQFIGRIVNYGTISVTGDDGIGMYAVGRGSRAINHGLIDLSGKNSIGMYLDQGAIGENYGTIRTAPNNTKDGIIGVVALNGSVIKNYGTISISGAGNTGIYKAQGGNNEGKKPEVSNGATDISSKATADTSKKLGTSQILSPPGATNAVIKEKGKVLTPDYVDRPTPNAPNVRAGSTILNLKQLQKFNGNSRARASELGMYIDTSGIKFTKPIEGLEKLTNLKRINLIFGVEATKYSNNTAIQIGSNILEPYNKVIEKLSRSGSGKKWILNSSSLTWMATATQNPSNGTLGNVYMKKIPYTTFAVKGDTDTYNFLDGLEQRYGVEGLNSREKELFNKLNDIGKGEAQLFVQAVDEMKGHQYANTQQRVYATGQILDTEFNYLREEWATASKDSNKIKAFGARGEYKTNTAGVIDYKNYAYGVAYIHENESVKLGKDIGWYTGFVHNTFRFEDIGKSKEEMLLGKIGMFKSIPFDDDNSLNWTVSGNVFVGRNKMHRKFLIVDEIFNAKSKYYAYGIGVKNEIGKEFRLSEDFSIRPYGALKLEYGRISKIKEKTGEIRLEVKSNDYVSIKPEIGTELKYKYLFTNRKTLTVGLGVAYENELGKVANPKNKARVAYTAADWYNLRGEKEDRRGNIKTDLTIGLENTRFGATANVGYDTKGHNVRTGLGLRVIF

SEQ ID NO: 6088 - protein, 743 aa, Parvibaculum lavamentivorans
MGSRVAHRNTSGCPVNCVVSRPALGRNPLACLIHGLALGLSLTQAGAALAADGDTDQDHALTLDTSVISATQPDSATGPQAGYVAKRSLSGTKTDASLSEIPQSISVITRDQMDAQQVQSVNEALRYTAGVQANTTAASQRFDTLSIRGFDVTTGMLRDGLKGNTAQAWPKVEAYGLERIDVLKGPASVLFGQNSPGGVVNQISKRPLDKPFHEVQIQGGSFDRAQGQFDFSGPLDDEGQFLYRLVGLERDSGTQFDHIKDDKQYFAPSFTWKPNDDTSLTFLADYTQDTFGAPRVFLPARGTLLGNPNGKVRHNVFLDEPGLDNDRTQYSLGYLLEHRLNDVWSLNSSARYGHVNLLTNTASGMSLAPDLRTLNRAAYRFRIVGDTYSLDNNAQARWNLGSTQMVSLLGIDYRRTREDYYLRGGSASPIDIYNPVHGGVFDPSTPFTNTVQRADQVGVYAQQQFTFDEHWVLTVGGRQDRSSARTDNRMNDSGSKQDDEKFTYRTGLVYLADNGLAPYISCSTSFDPVLGTNFYGTPYKPTSAKQSEVGVKYQPPGIDSYITLSLFDLTQENVKTADPANPLNTLQTGEVNVRGIELEGKASLARGLDLLAALTYNDAEVSKSNNPLEKGKRPTDTPEKMASLWADYTLPEGPLSGLGFGAGVRYIGSTEADAANTQRVPSYTLLDAAVHYDFDKLIPAAKGLRLAVNATNLTDKHYYEGCSLTNCSAGYDRSVIASLRYRW

SEQ ID NO: 6089 - protein, 768 aa, Parvibaculum lavamentivorans
MIDFHHRPLLLALASVGMIALMPQAYAQGDNGETAIQVGQVSQKAKAIANKKNVPLKATYSEHVISAKAVRRASPMQNAQTILATKPSINAYSTGPNGVRSTITFRAFNSGQFSETFDGIPLNDMFNGGATNQASNRNAIPLTLNDISGINIYNGINNPSVNSYNSLGGTINYQPRKPSKTMGGSVGAGYGSFGTFQWNASFNTGSIDGFRSLFAYNRQTSNGWLQNSGNQNTNYYYAGILPYDHGMSRMSAYVIVNRNVGYTPHSVPQALISQYGYSYQWPLNYSTTSNTDTELTAILGDKSVINRHVILGAKVYVQNNNYHRTSYANPAFDQSATQPYYLPNQSTGYPFWLSYPVPPTYDPSAIFGSTHYGTNYHLYEDISNGLGFSPKAQFLLPHNRVTLGGNVSYGMLHSAEYWYGSYAMPKVSQFNSAWDEHDTRLLSSVYIQDNISLLGGKVHITPGIKYLYAYTTSSDNIGFYYPIGGTVANSQAFTSPTIGISYVPLHGLSFYGSWGRNIKFPNIGAYYGNIAEQNNAGQYVVVPVTVQPEYVTDYELGMRYRHRGFVGSLNAYREQFQNTFLTNTNASGVSNTYNGGSSRYEGAELALEQRLGHFLLGHWTAFANYSYNQAVFTSSFNSSYAGNVLAGQPLANVPKNMFNVGLDWGYHHLHAHIDGKYISSQYINQQFAGTPTSQTIPPYFLLNLGVEDTIPVHADYVKNVKLALNIDNLLNRRYFPKGSSNTDYYGNTYLSVLEGMPRFVFGSVTVKF

SEQ ID NO: 6090 - protein, 784 aa, Parvibaculum lavamentivorans
MTRFYTRHLLTLTIAANFSLPVLTQAAESFVANDIRVDGLQRIASGTVFTYLPVNRGDTVDDAKVADAIRALYRTGFFENVRIDRQGNILVVKVKERPAINKLTITGNKDIKSEELLKGLSEIGLSEGGTFDRLSLDRVTQELKRQYNNRGKYNVQMTTTTTPLDRNRVDVTIAIKEGKAAKIRHINLIGTEKFNNKDVMSAWESKEHNWASWYRRDDQYSKEKLSGDLEKLNSWYLDRGYVDFNIDSTQVSISPEKHNMFITAGVTEGDQYKISSIKVTGNTVLPQEKIEKLVIPKTGDIFSRVLLEYSSAAIINTLSNIGYAFSKVNPIPTANRADRTVAVNLHVIPGPRVTVRQILFKGNTRTSDEVLRREMRQFENSWYSQAAIDRSKIRLQRLGYFEAVDVESTPVPGSNDQVDIVYTVKETTSGSFQVGLGYSKTYGVTTSVQLSQNNFLGSGNRVSVDASRSRYQDRYSFSYTNPFFTDNGVSLGYNLAYQKLDYSDFNAAQYNSKRMSGQTIFGIPITENDTVSWVIGADSNQITTFPGSTPKAIIDYIDAVGQRTFRAWRTELGWARDTRNDYFMPNLGMYQRIGAEVTLPGSTIKYYKINYQISKYWPIIPALVLNTRLEVGYGDDYGKSHTRILPDGTVATASGLPFFENFYAGGTNSVRGFRDNTLGPRSEVTALYNQGQPLGGSFKTVGSTEMYFPKLFDSPSARISAFLDFGNVFNGVNNFKANELRASSGVALLWRAPIGPISISYAFPIKKENNDEIERLQFTFGGQF

SEQ ID NO: 6091 - protein, 190 aa, Parvibaculum lavamentivorans
MSFLNILNAENLSYMSSSYQIGTVFMRPLNTNKLLQGASILQGYEVNPKNDWAYSRYYFFIDYGNVLFNNDSTLQANMFTYGVGGDFMVAYAKNPINRWAFFFGLQLAANTWILNNKVKDLVVNTWDSLKDFNFHNTYFRAIGKFGVQFRTIVLYHKVDVEIGMKIFLTPERRSLFERSFLFFVSHSWHF

SEQ ID NO: 6092 - protein, 434 aa, Parvibaculum lavamentivorans
MRKYLLASAASLGLMVAASGAAHAQAAKAPAPGQIVVHLNGLLNDQINMIGATGDNVQGGNKLNPIGMAGFLRLYPGFDATTENGIEYGVAAELRTTYSSAGVGIHESTAGTSGVTGLAIRRAYAYIGTPQTGFVRFGQTDGIWWLLSTGEYYNFGDGNLWNADGGVGSSVPNQDHPSGLFTSSGSLYTTNKIVYISPDVAGFKAGFDFEPNSNGFKEGESCSLTTDCATLSSAAGGAGNARRKNTVTGGLEYSSEFSGTGVTLAVDYLHAAPIGVSSGGVTATGYTFNGYKSMGIAEFSGQVKYAGFTLGANVKTGQVNDGYTFLLPGQRDLLFYEVTGIYDFGPYTVGAYYFNQQSAGAYTLGSSYGRTATNYGIAVGANYALSKNLGLYATYLYGHRHQAGYNFISNSATVATGYDNVQSQAFSLGAALKW

SEQ ID NO: 6093 - protein, 186 aa, Parvibaculum lavamentivorans
MGVANAGAAANPENASTAFFNPAGMSRLRGTNISFGVAVLDIDAEVKSGSTIATDALGDPVKGSGGGDIADLAVLPNFFMTHEVNDSIDVGFGIHAPYGLAADYDDDFVGRYFADKTELTAISFTPSIAVNNGKDLSMGLGINIVYAEARLTKFQDIRAGLAAQSDDATARVLAKNYEAAYGGTLF

SEQ ID NO: 6094 - protein, 868 aa, Parvibaculum lavamentivorans
MTQRPNPWIFCCCALSCLCFSPAYAAVLKTLTATDNFDGINNAAFPTKTSDSDEGTNYILSNDIVIQNVAATNPRNSSCFKNTKGNLIFNGNNRSLTFNNITTAVEGKAILNSSETFLSMSCFSKLQFLEPVSSRKGKSIVVSKGTLMFRTNKELLFDGCYSSDKGGAICCMPSPGSARNSSLTFSRNRKVTFSNNTSVNGGGAIYTQHLRIIAAGPTLFTNNMSSGDVNSRPGGGAIAIAKDGELSLFAEDGDITFSGNLTSRGRHFEKNAIHLENDAYISYITAKEGRSVTFYDAITSTNASTVPLLINQLTDGTTHKGSVVLSAKDCVASCSSLISTNMSRIAQDIILAGGSLNLNSGVILTTNSITQHPNTTFVIDQSTMLRLQENAHILNMTIPVKLQTLVLRPKESKRKYNSLSSRQPGQIILLSQDKIFSLSGSINIDFEDEDFYENLELANPVKVPLIHIEARELEDIRIKIDHLHVPTNPYGYQGSWDLQWLDTPSQQISTRLANNAEKTAQLIWTPKHYRPRLIDTQGNSLVPNSLWNAFVDIRGIHNLMDTVSDGSLYHNGLWAAEVSNYFHKDHHKDNRGFRHTSGGYALGLSQQTPSKDIFSLGFFQMFGVSKDASLAKNHEHILAGSVYAQHSIPVQPILNWSLGNLWVRPEFLSKISSDIPLILNIQATYSHSKNKLTISRKSSEITHGYWNTHCIGAELGSSLSFDFYEEHNIFHHILPFMNLQGVYAYQRKFKEEGEKKHEITSSKLGNISLPVGIRLEGHTSQWPIFYATSVAFIADLYRQNPCSTITATYEPFAIWETSGTNLERQALAAQLSMHCAILENITLFSKCCAEIRKSSQYYSGDIGSQFLF

SEQ ID NO: 6095 - protein, 784 aa, Parvibaculum lavamentivorans
MSPSRVLSPLSRALLLACLGGPALVTAEAAGAAEIRADARQYYRLPAEPLEQALNHLGRQAGVLIAFSPEQTAARRSQPLDGEYTLDEALAALLASSGLEARAQGGGAYILETLPVEDPASLQAVTVVGDWLADASAADVFEHPGARDVVRREQFQAQGAASTREVLERIPGVSAPLNNGTGSHDLALNFGIRGLNPRLASRSTVLMDGIPVPFAPYGQPQLSLAPVSIGNMDAVDVVRGGGAVRYGPQNVGGIVNFVTRAIPEDFATRLDVHSELSPSSSQDGLKTTHNVLIGGTGANGLGGALLYSGTRGGDWREHSDTRIDDLILKGRFQPSDEHAFSALTQYYDGEADMPGGLSAAAYRDDPYQSSRPYDKFWGRRTLASASYEYTPNASQKLNVTGFFTKTLRSGYLDQGRNLTLSPREYWVRGLETRFSQGFELGESRHEVGIGHRYVNEASHELRYWTRADSGQLPSTGSRNDRDTRGGTEANAFYIDDRIDIGNWTITPGIRYEKIDSQQKNLLKGSKDSGRYNASLPALNVIYHLTPSWNLYANTEGSFGTVQYSQMGKAVRSGDIEPEKARTWELGSRYDDGILRAELGAFLINFDNQYESNQQTDSVTARGKTRHKGIEAALAYDLADLDPLLSGFDVYASYAYVDASIREDGPNKGNQVPFSSKHKGTLGANYRTGAWSYNLDGSFQTSQYADNANTESESADGSTGRIAGWMVWSARGSYDFGPQLNDLKLGLGVKNLFDRRYYTRSFDDNNKGLYVGQPRTLYVQASVGF

SEQ ID NO: 6096 - protein, 1012 aa, Parvibaculum lavamentivorans
NVSGSTETINVKEKKVGETQISAKKLAKQQASDSRDLVRYETGITVVETGRTGASGYAVRGVDENRVGIMVDGLRQAETLSSQGFKELFEGYGNFNNTRNSIEIENVKTATITKGADSLKSGSGALGGSVIFETKDARDYLIDKDYYLSYKRGYQTMNNQNLKTLTLAGRSKKFDILIIDTTRDGHEIENYDYKIYPNKQADLSAVGPTREKADPYQITRQSTLIKLGFQPNENHRLSVALDDSILETKGMDLSYVFRPCKDKACSETFGERIINDQSKRKNIQFSYENFSQTPFWDHIKLSYSSQKITNKARSDEYCHQSTCAGVRNPQGLNLVEEGGVYKIKDKYNGDFEYVEDKSSYYPSYELHNSKNEKISSGVNTEGNPLDSVLINCEKLNCEGKKFRIYQEYDEKYSKKYTYEDRKIEVGTLPNGKKYGKIPLRKGDVPSWGGPPQEETARFLFPRSYGYSTDFVNDRDLNTNTQQIKLDLDKEFHLWHTQHQLKYGGLYEKTLKSMVNHQYNTAANVQWWADYFFCARQEGGNLGGEKKPQPNVSVAGCANRTPLHSDIGKDTYLIPVTTKNNVLYFGDNVQLTSWLGLDLNYRYDHVKYLPSYDKNIPVPNGLITGLFKKFKPEEYVYGNKNLIPQGYKNCTYGTDCYQKNFEENLALLLRKTDYKHHSYNLGLNLDPTDWLRVQLKYANGFRAPTSDEIYMTFKHPQFSIQPNTDLKAETSKTKEVAFTFYKNSSYITLNAFQNDYRNFIDLVEVGERPIEEGSTIKYPFHQNQNRDRARVRGIEIASRLEMGDLFEKLQGFHLGYKFTYQKGRIKDNGLHPKYKEFLELNKDEHPEYEAIARKPQPMNALQPTTSVYNIGYDAPSQKWGVDMYITNVAAKKAKDSFNSQWTSMVARKEKQYTDEENIKASKANGKDVKDSRGLWRNNRYTVIDTIAYWKPIKNLTFTAGVYNLTNKKYLTWDSARSIRHLGTINRVQTETGKGLNRFYAPGRNYRMSVQFEF

SEQ ID NO: 6097 - protein, 392 aa, Parvibaculum lavamentivorans
MTARNFVVLVAALTLYTGVLQNAGAQNGVTIYGIADVAMVYSSNQGGASNTYMRSGNLAGSRIGFKGTEDLGGGTQAIFQLESGFNLDTGEMSSSSTLFNRQAFVGINNTRYGALTAGRQYTPYYLFVGPIGPTNSLTGATGAHPGDIDGLDTTIRSNNSITYTSPVWNGLQVSALAGFGETAGDMGSGRTISAAIKYDINNWNFALGYQRLNNSNNPGGVWSPNASANFNTSPVNNGYLSADSAQYLAGAARYTMGKVIVGANASRVEYRPNGNSLFTQKATFDTLGLLTGYQMTPVFFVSVGYSYTKEKAANGISDPAKYHQLALEQTYSFSKRTAIYFLEAYQVAKGNTLGLGGSGPVRAVAVVGDSQNGTPSDGANQAVFMVGIRHSF

SEQ ID NO: 6098 - protein, 622 aa, Campylobacter hominis
MNKTIIALSISSLLYSSLSFAEQTSPTTIDKADETIVITANRSIQDKFDTLASVNIFTRENIEQIQPLSISDLLGRVAGISINTQGTSAHKTSAFVRGTNSDHVLVLVNGVRIGSATLGSKSLASIPVQLVERVEVIKGPRAALWGSDAIGGVIQIFTRDLAAGEGQVGIKVGSDSLYQGYGALGFGNKEHGYTLSATAEKSDGFDVVVPDGNSQYTVDQNDDDGYDRQSIALSGTSQFTQAYALELNTQYDQGTTEFDANTKYGGDETTYENYHFLLRNHLQLEQVYLQLGLSTSEDSTEDNYSKYNSQNSASNANSLFTTNREQVTALAQLPLADSSEITAGFEWYTESIESNKEYDETDRDANAVFVTGRHDIEQVKLEASVRYDKVGDIDSETTYQVAAGYQVNDQLLFSLSHGTAFKAPSFNDLYYPWQGNPDLISETADTSEFLARFQNDTLSAEVSIYQSDIDNLIEWAPTASGAYKPSNVAKAKILGAEATFTAAIYNTNNTLTLSHVDAEDKTTDHQLARRPNFSANYNFVYSLKQFDFTFDVDYQGSRYDGANDPVKTLKAFTLLDVGLNYRLNNQVSLLAKVTNLTDKDYQTSSEYPGSERGYTLTVDYKF

SEQ ID NO: 6099 - protein, 232 aa, Campylobacter hominis
MQKNAAHTYAISSLLVLSLTGCAWIPSTPLVQGATSAQPVPGPTPVANGSIFQSAQPINYGYQPLFEDRRPRNIGDTLTIVLQENVSASKSSSANASRDGKTNFGFDTVPRYLQGLFGNARADVEASGGNTFNGKGGANASNTFSGTLTVTVDQVLVNGNLHVVGEKQIAINQGTEFIRFSGVVNPRTISGSNTVPSTQVADARIEYVGNGYINEAQNMGWLQRFFLNLSPM

SEQ ID NO: 6100 - protein, 678 aa, Campylobacter hominis
MQGLHFRSRITGAFVLSSCLFVAPLEAADELEPIIVTTPMRMAQTVDDSLHPVSVITREDIERLQPNSVPELIRGLPGVQVGASGGFGKQTGVFLRGANANQMIVLVDGVRAGSATAGGAAWEFIPVDQIERIEVVRGPRASAYGADAVGGVIQIFTRSPAREPVRELMVGYGRYNTRQASASVSADSGAWRYHLGASHLASDGYDVLRGGDPDDDGYRNDAVNARLGYRMDNGVDLEWRLLRAQGRTEFDSLWTSGTHEEDFVQQAASVQLSGPAGSAGGWRVIAGETRDERDTLDGDGRYRYDTRRRNLSAQTDWLLSRTQLSLGADYLHDQVSGSTDFARDSRDSRAVFAQLHSEWSRHQFGAGLRNDWYSDFGTHGTGDLAWAYRLDEAWRIRGSAGTAFRAPTFNDLYFPWGLGNPDLDPERARNLEAGLEYGRAGHRLGLNVFENRVRDLIIYDTDTFTMQNINRARITGAEASWQWAGRDWQLAASYTWLHARDEATGNQLPRRARHSARLDADRSLGALRYGLSLIGQGRRYDDPSNTLELPGYVTMDLRGGVPAGSSLGTLRRLEQRVRPGLRDRGRLPSAGAGIERIPARQVLIQHTTKRSPWATDSPASIPAPATMAAPGWPRGCACQGLGAHRGDGRRGRTQQPARRHAGRAGAGAAFGAVAGGPA

SEQ ID NO: 6101 - protein, 230 aa, Campylobacter hominis
MEQDNKRNWVMDKTTVKILMGMALLSSLQAAEADLDEKSKKPKFADRNTFYLGVGYQLSAINTSFSTESVDKSYFMTGNGFGVVLGGKFVAKTQAVEHVGFRYGLFYDQTFSSHKSYISTYGLEFSGLWDALNSPKMFLGLEFGLGIAGATYMPGGAMHGIIAQNLGKENSLFQLLVKVGFRLGFFHNEITFGLKFPFIPNKRMEIIDGLSATTLWHRLPVAYFNYIYNF

SEQ ID NO: 6102 - protein, 366 aa, Campylobacter hominis
MKKLLIALPLAAAATTHAQSSVTLYGVLEDGVDYVSNVQGKHLVQLASGVTAGSRWGVRGTEDLGGGLSAIFRLESGFDINSGRLGSGLAFSRNAYVGVGDAKLGTLTLGRQWDSIVDYVEPFTLNGNIGGYYFAHPNDMDNTDNGFPISNAVKYRSPTIAGFTFGGLYAFGGQPGRFSDNATFSVGANYAAGPVGFGIGYLRINNPGVSTQGYQNYPSFTNAVYGNYLDAARAQKVFGVGASYQVVQWLKLLADFTNTNFQQGSAGHDATFQNYELSALVKPTPAVTIGAGYTYTTGRDHATNAEPKYHQFNLSVEYALSKRTSVYAMGAFQKAAGDAPVAQIAGFNPSGNQKQAVGRAGIRHVF

SEQ ID NO: 6103 - protein, 501 aa, Campylobacter hominis
MKLLKLSLAAAVCIAGATATTAMAKEKRSLKGNMTLKYNVLPGEANSLSEMFTKGEWYGRLRFNSFLWDWDTEDYLTGGKKKDNWAIGIGGSFEYKTAYWNGFGATAALYTSQNPWHMDKNEVGYVKAGKDTFSRYKVKTEGTFGMTVLAQAYLEYKRNKTSLKVGRQIFESMLTKSNDTKMIPNTFEGYSLTSKYFSGTTIKLAYFLKQKLRDHTSFHDVITFKDANGESWANNDDSAVNKALSYANFVAAGKDPNHDLIVAEIANKSLIPNLKLKLNYTTVPEVVALGAIEAHYKIPVGNYNLVPGFRYIKQWDRGADDIGALGVAVANLKGKSAGYDDPYSVDSSVWMARLDLKAKNKMWWARVGYSKVADDADIIAPWRGFPTGGFTRAMAQYNWYANTKTWMVRGVVNFDKAGLVPGLKASLRYAMQDFDDNKAGVQADSNIVHLDLVEKVKSIPGLYLKFRTGIVNGDDNTYDINGKLKADPSYNEYRFEINYLF

SEQ ID NO: 6104 - protein, 810 aa, Xanthobacter autotrophicus
MPIPFKPVLAVAAIAQAFPAFAADPAPQSAQTLNEITVTGTHKTQKLGEEKIRRKTLDKLLVNDEHDLVRYDPGISVVEGGRAGSNGFTIRGVDKDRVAINVDGLAQAESRSSEAFQELFGAYGNFNANRNTSEPENFSEVTITKGADSLKSGSGALGGAVNYQTKSASDYVSEDKPYHLGIKGGSVGKNSQKFSSITAAGRLFGLDALLVYTRRFGKETKNRSTEGNVEIKNDGYVYNPTDTGGPSKYLTYVATGVARSQPDPQEWVNKSTLFKLGYNFNDQNRIGWIFEDSRTDRFTNELSNLWTGTTTSAATGDYRHRQDVSYRRRSGVEYKNELEHGPWDSLKLRYDKQRIDMNTWTWDIPKNYDLRGINSEVYHSFRHIRQNTAQWTADFEKQLDFSKAVWAAQYGLGGGRGDNANSDYSYFVKLYDPKILTSNQAKITMLIENRSKYKFAYWNNVFHLGGNDRFRLNAGIRYDKNSSSAKDDPKYTTAIRGQIPHLGSERAHAGFSYGTGFDWRFTKHLHLLAKYSTGFRAPTSDETWLLFPHPDFYLKANPNLKAEKAKNWELGLAGSGKAGNFKLSGFKTKYRDFIELTYMGVSSDNPNKPTYAPLSDGTALVSSPVWQNQNRSSAWVKGLEFNGTWNLDSIGLPQGTHAGVNVSYIKGKAKQTNGQETPINALSPWSAVYNLGYDAPSKRWGINAYATRTAAKKPSDTVHSNDDLNNPWPYAKHSKAYTLFDLSAYLNIGKQVTLRAAAYNITNKQYYTWESLRSIREFGTVNRVDNKTHAGIQRFTSPGRSYNFTIEAKF

SEQ ID NO: 6105 - protein, 726 aa, Xanthobacter autotrophicus
MRSVSSRLRRALLASAATLVTGAASAQSASTSLPTITVESAAPQRTVSARKPRQVTGGGRSARQVTPAAPSPNSAGQGTRAPGSLTVPTAQQALKEIDRTPGAVAVVPDTAFKNGPANTVKDILGWVPGVLIQTRWGPDGRVSIRGSGLSRNYGNRGINIFMDGLPLNTSDGLFDLFEVDPSVYRYVEVFKGANALRYGANSLGGAINFVMPTGRDAPAFDARVDGGSFGYVKTQSSIAGVNGPADYFITASAQREDGYREHSRTDTERLNANFGYQFSPDAETRFYLNAGRWRAELPGEVTKQAALNSPRAADSEFLRQDQQRNIDTVRIANKTTLRFDDTTVDLGVFGLARHVMHPIYQWLDFTAQDYGGFVRATDERSLGGLRNRLTAGVNVLNGTIDINQYQNLTGAVKGALASSNLWKSDNVTAYAENSLYVLPNVALIAGAQFLHASREQQDRFLSDGNQSGTRNWDLVSPKVGVLWDVDPTWQVYGNISRNAEVPTFDVNSFSSPASSNVEAQTGTTYEIGTRGRRPDVTWDLSAYRTDLRNEFQCLTTSPFSPCTVVNADRTVHQGVEAGLGVALLKSSFAQDDRFWFNVAYTYSDFRFDRDATWGNNRLPGLPPHYLRAEILYKHQNGFYAGPNVEWMPQAFFADNANSLTIDPYALLNFKVGYDHGIGWSGYVEGRNLLDTRYISSTITAGVATATSALFNPGMGRAIYGGIRYRM

SEQ ID NO: 6106 - protein, 435 aa, Xanthobacter autotrophicus
MRAEQRYLSGLLCCLVAGGALAEGFFEDSRRSLRYSQSYWKENDGGGFGPTRDEWVQATQFSFSSGWYREVLGLDYSYGLADALHVGRDANNISNLRADRSVQQPHGIAKPLELYLRGRWVDEAGTFSAGVGKKSRQYQLYRDDRYSRILPAATLGQDLSYERGALSLNFSRIDGFSPRNDSGWSQDLRTYRGQRIDDLRLYALGHVLPGGSNLQLEHGVARDYLRASSVKLTHSFELAPERGIDVYAIWGRQQDAGKRFEYSGVRGLYEAERSHDARHLDLLFKYRFSRYYAGLTWNKVWGDDYDRTFFAQDNGTWNSSGKLFYYFGLQDEEMFKLLGGMDFADFGLPRLKLDMHYAASNHAKGYAGFSRREFQSVLRYAFDGWFDGLDVAWLHGRFRTHGEPDGIQRQSLSRGPAGIISHSAERFYLNYTYRF

SEQ ID NO: 6107 - protein, 242 aa, Xanthobacter autotrophicus
MKKFFSQSLLALIVSMNVLLAMDGNGVFIGAGYLQGQAQMHADIDSHKQATNATIKGFDALLGYQFFFGKYFGLRLYGFFDYAHANSIRLKNPNYNSEAAQLAGQILGKQEINRLTSLADPKTFEPNMLTYGGAMDVMVNVINNGIMSLGAFGGVQLAGNSWLMATPSFEGILVEQALVSKKATSFQFLFNVGARLRILKHSSIEAGVKFPMLKKNPYITAKNLDIGFRRVYSWYVNYVFTF

SEQ ID NO: 6108 - protein, 257 aa, Xanthobacter autotrophicus
MRKSLLALSVLATTVAIPAQAEYLYGFANMSVNYLDWSNDTTDRSGKEDFSYLELEGGSGYSWGELYGFADFENMENGFDETRTSIKGSVAWKTGLKELRLYGQLYNTNSAGFTAQNTVTGVSYNFSGDNWYFNPWVGFHHTITTNSFQFDKNGDQLAAKSFSGMNGGMFGWALGYNFKLGNQSFSLSNWHETEFARTDDYVAVSGETDDLSMNGAVALWWNATDAVTTGIQYRYADNKLGQTKLDQAVIYTVKYNF

SEQ ID NO: 6109 - protein, 668 aa, Xanthobacter autotrophicus
MTVQQLSLLALLLTLTAQTARAEHLLLDEIIVRADKESPKEESLSVREVRESPARDMGEALKQVEGINIVHKGAIANDVVLRGFQKDNINVLVDGVRLHGACPSRMDPPSFHYDFAEIEQVRIIKGPYDLSNPGGLGGLIDAQTKRPGKGFGGELSLGYGDWHGTNAAATASYGTERYDALMGYAYKYSDVPQSGNGKLLTQIYPATSPNRYKNTAIDSKAYEINTGWGKLGLNPTANSRTELSYTYQDADHVLYPYLKMDADYDRTDRMNWSYRIQNLSALLQDLKLQVYWDRVEHLMDDRSRFSSSTSPRFYSMQTDASTQTYGAKLQAELKLGPGSLKSGLDYYNRNWDATNRRAMYFNYRDLAMIPDVTIENFGLFGEYTLPLGGKLSLTGGVRGDLTRAKADRANTMVTAGSSKEFSTISANLQLNYTPFKELVIFTGLGRGTRTPDQQELFLDLPGNPAWRGNQGLKATVNHQADLGAKYATDRFYVNASIFYSDLQDYVNFYQASATLKSYQNIHASIWGAELGSQVSLPADLFLRGTLSYTEGRNISGNRPLSEMPPLKGTISIRYDNGSFFAELLETLSREQDRIDSSLNEQKTAGWVTTDLKAGYQYKGFSVTGGINNILDTQYYSHLSYLRDPFVSGVGYRVPENGRNVYLTMAYKF

SEQ ID NO: 6110 - protein, 226 aa, Xanthobacter autotrophicus
MTGRRPCRRWRGRVVEESKMRKVTLAAAAVIAASVSTAQAADMGYYRSNAPYTVNQPLNAFSWAGPYLGGNLGYSWGNVTNNITKPSGFSGGVQGGYNWQSGNIVFGLEGDIQFSTADDTFAQYKFSNPWFGTGRGRIGYAMNDVLIYATGGLAFGQLKGQNVFASESHSSAGWTVGAGAEFAFAPKLSAKVEYLYMSLSTSNFFITGMPNGYNAGLVRAGINYHF

SEQ ID NO: 6111 - protein, 947 aa, Xanthobacter autotrophicus
MERTTMVRSVLATALAMALTACGGGGGGSNVRVDPPPTTPTPPTPPPPTTPPPAKPQEPTFDAHLAVTNARAAQAAGLTGQGVRIGIVDSGVQRTAVALNGRVLANFNYIDPARNNLGVDDVVGHGTAVASLAAGAAVGSWPGGIAPGAQIVSARIISDKPPTDDGSGQGNAFSGPLGVAQVHQDLISYNVKVMNNSWGGLYWTDLPTTAQVAAEYRPFVINHGGLVVFAAGNDGRSEPSSLAALPSQKGVAGSLPAADLERGWLVATAVDPYTPSALASYANACGQAARYCLAAPGSAVYPDANGGSYYWNYGTSFAAPLISGAAALVWQRYPYFDNNLVRQTLLGTAKDIGAPGVDAVFGYGLLDIGRAIKGPGRFDWGDVVANVDVASTGSLWSNDIVGSGGLVKQGGGTLVLAGNNSYTGATRIERGILSLQNGGVIRSNVTILGQSDPDSTGLQFNGGTPRVIGNVINGSSVFLTTGNTTGTIEGDYTQQAGAQLMIALGAKALQVTGNAKIDGGVRVHGVVTGYVPQNGARQDLIHAVGSLSGTFSTPATSSGLDGVSLLQSSYGYDSNNAWLNLTQVSVSAAATGLGVSAQAAAQRLEGAFAALDRNAGLQGSAFGTAAGALQRTGGGSEGLAASLQSLSGQAHARAESATFDSIDMSRRAIAERFDRVQAAPRLRGTWQSALGEAGQGSFAGNTADSHGWMAGQDLPLGSNGLMGVAFGETRSNGGSSFGGDRGRDRQAQAQLYAGWNLGRGYALAQFGSGQFTRALDRQLLLGAGAYGVSARYGGRFSSASVEGGYRFGRAGASLTPYLGASSTRVDTDAFNELGGFGFGLRGDANRVQRSQVLAGLRGERGWGRWTVRGHAEWQQRLDARDADWQASFVGVDAWAPLAGWDAPRGSALFGVALESWWGRNGRLSLGFDQRIGGEGARQAALRYSTGF

SEQ ID NO: 6112 - protein, 232 aa, Xanthobacter autotrophicus
MLKRALAGVSALALLGCGAASAADLATKYPVKAIAPVVPVFSWTGFYIGANVGYAWGSTDFHGNTRTGLPYSYSVGGQDDWLGGGQIGYNYQFANNVVVGIEADIDWTGIGSSGVAVNGPLAGQTINGSLDYFGTVRARLGYAFDKFLPYITGGAAWGHVDYGNIYGVGTSSTNWGWTIGAGFEYAVTNNITAGLEYLYVDLGGNNYLFPNLTSLDTSFNMSVLRARVNYKF

SEQ ID NO: 6113 - protein, 1051 aa, Xanthobacter autotrophicus
MRSRKKEGVYFMSILKRQVLFVLFAFAATLCAFAQNKTITGLVVDGNGESIIGASVLVKGTTNGIITDIDGKFTLNDVPEAGVIQISYIGYKTQEISAKNKANLKVVLVEDNEMLDEVVVVGYGVQKKSDVTGAMIRVGSEELNSRPVANAFEAMQGKAAGVDIVSNERPGEVGTINVRGVRSLSASNTPLYVVDGIPLMSNSGIETLNPQDIESIDVLKDASATAIYGSRGANGVILVTTKSGKEGKMSLNYSGTVTIENLQDYSEMMNSAEYIDWRRWSYYYLNPSKYPRGDQPTKENDYEIFLGATDPTAWKNIEKGWAGGTWDGSRVPNTDWCDMVTQTGVTHEHTLSASGGTDKMKGYASIGYLDNEGTVKGQSYTRYTTKLSLDLKPTKWFNLGLNVNGTFSEQQYGSSASSVGQLIKGMPSNLYAASTSLFPYASPYDEDGNRIEYPGGDDKVKNVMNEWNNSQNERRMFRAIGSLYAQLDLGEIYAPLKGLRYRFNFGPDFRYYRNGTFRNEESISSEGKNRASLSNQSDFSWTLDNLIYYDKEFGKHSVGLTLLQSATGYHYEESSMAAEGIPLESAKWNALSKENVSLLDEWNSGLIEKQLLSYMFRVNYDYNNKYLLTVSGRWDGASQLAEGNKWAFFPSAALGWRLDQEEFLKDVTWLNQLKFRLGVGVTGNSAIDPYQTKGAIVSLYYPFGSALAPGYAASEPLIKDGAVAMANKNLSWEKTTQYNIGLDYSVLNGRISGVLDFYTSRTTDLLMAMTIPSLNGYTNTYANVGKTSNIGVDITLNTVNVKTRDFEWSTSINAAWQKDKIDELANGKEDDINNNWFIGQALGVIYGYECGGLWKEEDAAEMAKFNAKGHSFQAGMVRPIDQNGDYKIDPNDDRVIIGHTRPRWTFGMTNTFTYKNFDLSVMMYGRFDYMVDTGGEWQGGRYMQRKINYYNENNKNAEYQKPIYNIGGGDPYYRIVGYKNGSFLKVRNISLGYTFPQTLIKKWNLSNLKVYVQAKNPGRIFSNIDFLELDASQAFTSTWNRGFTIGLNVGF

SEQ ID NO: 6114 - protein, 789 aa, Xanthobacter autotrophicus
MKKFLILFFLGTIALYSQEKVTVSGTVYDNANNETLIGVSIYFPELNAGTSTNEYGFYSLTIPKGNYKIQISYLGFTSITEQITLSENITKNFKLNEEAESLNEIVIESDIEKLNVRTPQMSVNKLTSSTIKKIPVVLGEADIIKSLILLPGVTSAGEGASGFNVRGGAADQNLILLDEAIVFNSSHLFGFFSVFNPDVIKDVKLYKGGIPARFGGRLSSVLDIYQKEGNSKEFNLTGGIGLVSSRLLAEGPIEKEKSSFVVAGRASYAHLFLPLFDNDNKAYFYDLNSKINYRFNDRNNVFLSTYFGKDVFGINDSFVNDYGNTVLNLRWNHLFSDKIFSNLSLIYSDYFYGLTLDFVGFEWDSGITNFNLKYDFKHYLNEKFKLTYGINNIYIKFNPGEIIPNREDSGIQADKLIDKYANEFAAYIAAEQKVNDKLTVQYGVRFSNFTRLGQDEINVYADNNPVIYNEEFKRYESAEAIGTESYKRSDVLASFQNFEPRVSLSYLLNNDTSIKMSYNRMAQYLHLLSNTSSPTPLDVWAPSGQFIKPQLLDQYALGYFRSIKNGDYSLETEVFYKDIQNRIDYINGANLIANNEIETVILNGQARAYGLEVLLKKNEGNFKGWLAYTLSRSEQQTLGRTANEPGINSGEWYSTPFDKTHDISLNGSYELSKKWTFNANFLFQTGQPTNYPVGQYEISGLNVPIYDDNRRNADRLPAYHRLDISATLTPEKNKNRRWQSEWVFGIYNLYGRQNAASINFSQNRETFRNEAVQTSIFGLVPSVTYNFKF

SEQ ID NO: 6115 - protein, 258 aa, Xanthobacter autotrophicus
MKRLLLATVAFAALSAPAMAADLATKYPVKAVAVAPVFSWTGFYIGANVGYGGDKFTFDEVESYNGYPYYATSTSLNSSGFFAGGQIGYNYQFANNVVLGAETDLQWSGIEGKADYSSVYLYGGYPYTSSFGASVDYFGTIRARIGYAFDRFLPYITGGAAYGKTKVSGSYYDYSVGGFSASGTNWGWTVGGGVEYAITNNWTFKTEYLYVDLGSTDYTYASGSGPEAMIALDRGYSNTTGSVDTKFHTLKAGVNYKF

SEQ ID NO: 6116 - protein, 759 aa, Xanthobacter autotrophicus
MKRLLLALAIVCGGITGVFAQEFLVEGRVMSENKALEFANVLVKGTSLGAVTDQEGYFKIALSKSGEISLQVSSMGYKTLNKTLKVPSDQARNLSFELESMDSGLDEVVVSGTMQEVSKLDSPVPVEVYSANFFRANPTPSVFESLQNVNGVRPQINCNVCNTGDIHINGLEGPYTMILIDGMPIVSGLATVYGLTGIPQSLINRMEVVKGPASTLYGSEAVGGLINVITKSPDTAPQVAVDAFASSWGEVNTDIGFKSNLGSKLQSLSGVNVFYYDNPIDNNSDGFTDLTLSKRFSVFQKFNLKRPQNRVFNIAGRYVYEDRWGGEMNWDKSFRGGDEVYGESIFTSRWETFGTYQLPTNESLNLMFSANGHHQNSVYGTTIYEANQRIGFAQLTWSKSSQNHQFLTGLAYRYTFYDDNTPVTSSADGKLNQPSKVHLPGLFLQDEIKFQRNQSLLLGLRYDYNSVHGSIFSPRLNYKLASEDKSTVLRVSVGNGFRVANVFTEDHAALTGAREVVFEEELQPEQSWNTNLNFVKKIYSDKGTFIGIDATGFYTYFTNRIVPDYETNPNQIIYANLDGSAVSKGVSVNLDLAWANGLTVTTGATLMDVSIEEEGVKSRQLLTERFSGVWSVGYDFHVLGLTVDYTGNVYSPMRLPLLGELDERDEYSPWWSIQNIQLTKKLGDRWEIYGGVKNLLNFTPPANSIARSFDPFDKGVDFNPDGSVEPTPNNPQALTFDPTYVFAPNQGIRGFLGFRWTIL

SEQ ID NO: 6117 - protein, 790 aa, Xanthobacter autotrophicus
MVRFLLLSLWILAIGGGSAQKISGQTVYKAHVSDAEGNAVEYATAVLLSGEKQVGGAVANSDGDFSMEAEAGKYRLVVQCLGYEPLRKELILPIKRRDSLILDLSNHVLREVVVRAKNIERKADRFIMSVMPSAGKDGTELLSQAPGVWLSDGTISINGAQGAKVFVDDREIRLTGEELLAYLRSLKSEDIKRIEVIPIAGVEYEASTKGGVIKISLRRRPDNGMQGYVSLGTSLSPSLQGYIPSASVNARVGKWSLNGAVSGTFTPRDKGEMNSNREYGTVGNKFVSQSLYDTDSKYGNGRVGAIFEIDSLNSVGAEIEYINQASDGTSWSQTDLVKNSYPMKSTGNYRQKDDYNTFSATVNYLRKMDERGSIFKVIADFVNKRSTGDNLHTIRYEQSNWSRDTVYRSHAAADYDMATTDISFQKNLREKMSLKIGAKYTYTLMDDHSLYEGLNSSGSWIPNEEYGYTLRYNENIVGAYASFSAEIKNWSFVAGVRAEYSKTSDRSEDFSRDYLDLFPNLNVTYAFDPIKRWMLVGQYARNIERPPFYTLNPNRIQSSDYSYQIGNPYLRPTYINRFSVTLVYNYRYTVTVGGNLHHDLIREFCKQDVVNPDVSYITYENHDRENHWFVAVSLPYQPFTWCNLTGNFIGVRQDIRMTELSSFSSHYLGFANAIATFTLPAGFTVEARYSGTSRLYSGNSEVAPRHTVGVMARKKLLNDKLLLAVSVDNIFNQANEYASTLDVYRTSSRYENGLTGRVFKVALTWNFNSGKKVRKSKIEIGSERSRLNEK

SEQ ID NO: 6118 - protein, 677 aa, Xanthobacter autotrophicus
MVGQRDAQIERKHSEIQKIVISETEIERYGDATVGEVLRRLPGMTFTGPAGVTKDIRMRGLDKGYTQFLINGEPVPAAKKERQIQVDRLPADMIERIEIIRNPSALYDANGIGGTVNIVLKNRADGITRLRAAYGRNGDMEVGDVVAQWSRRFDDLDVLLAVSHTVGAEDVDEDKIAYNPNGTVKQVDLKEKPVRKDETLFAPRFVWHFGDDRLTLEPFVSKGSERKDEPTTTYNASGAITKSTDKDEDKTDTISRLAMRYDGKTGWGDWFVKAGVQEAEEKKDATTYEYRANGTLSKTTLEDETLRERGVYAGTGLSLALGGGHRLSAGLEWRDGDYRNRKTKTENGADKSDAKDRFDIDETRLIAYLQDDWRINADHALTPGVRVERISRESTDSNGVSRKNDLTGTNPSLHYRWGLGEDLNLRASVARTVKLPKFDELNPFLKLESGVYKGGNPDLKPETALGYELGLEHYFWGNRGVVGLNFYRRDVDDFIQKEERLEGALRVERPYNVGEARFWGAELDWRIPLLRSGAHELTITGNHSEMRGRVKVAGVPGTSEVKDMPPRVTNLGLDWLHRPTMWAAGFSVNYQPNFTTDGVNADGVREIKRREAATQLDLYLGKTISAEAELRLIAKNVLAVDKEEETTKYTRAGALSSHEWKVEHSRPMLMVTLESRF

SEQ ID NO: 6119 - protein, 271 aa, Xanthobacter autotrophicus
MLDWVDGRPAAELSVRDRGLAYGDGLFETLAVRAGTPRLLERHLARLEEGCRRLAIPLDTAALRQELLAFCAALGDGVAKLIVTRGEGLRGYAPPAEASPRRILSGSPRPAYPERHWQQGVRLFACRTRLAEQPLLAGLKHLNRLEQVLARAEWSDAGHAEGLMLDVHERVVEGVFSNLLLVLDGTLVAPDLRRCGVAGVMRAELLERAEGIGVPLAIRDVSMAELATADEVFLCNSQFGIWPVRALDEHVWPVGELTRKLQDQLRDDLDF

SEQ ID NO: 6120 - protein, 921 aa, Xanthobacter autotrophicus
MFFRKEKWPSFSLFPLALFFFSPFVLLAQLSSEPSVPATQQQPQAEQPKATESSPSQEQEETQAPQLPSAPPSPEQAPTGQAQPEVPSSPPSPPAAITPPGPSAQLPPNIPVLLPIHVTAQEELPEEENVVETNMETNVLGTPMKVIDIPRTVQVVTRQELNTINAQTVNDLAAFTPGVNPTQMTGSPVAEPLIRGLPGTVYRNGMLVGFSQSAQWGPLMNMMAYDNLDVVTGPVSIVYGPQELAGGFANEVTKQPYFDKFRGNASYTLGMYDTNFWNIDIGGPILKDKLAYRFDYFGQDGYAPYNYYDGAYLQRQCFYLDLGAKPYENLSIDFNTELDINHFNTVAGLNRPTSALINDGLYQTGTWVGWYGPPGVFHPGIGTAPPGAGYAVSWGPLVPISPRTNLFANPENSTNQAYYVAQAIETLKVNDSLTVVNNSLFEYFSTFIDQAIPSTFWAILPNGYDFDDRLEFRASFDLYPQGKNSGEQNPLAGNNSVEPHGLEFHNLIDGGVEFRYFSDTEYSGVWHSPINIWNLTQPLGYNAFSPLVSFAQATSPLFANPYLTDIPVPGYPGAFFNVFNYLSTADTFYELSPFYQHQVNFTDKWSLMVAARMNSYFVQASPPQGTPAILSAVAPSFGLPPYTSTSMNIVQPEVTISPSYKPFPWMNTYFTFFYGQTTLLSQFGSFAPEFPSAYYHQNNFLYEVGTKFNLLHDKLFLGLSGYYQTGFIPAQVIPGGPVATTAVAIKGAQLMGNYQPNKNFWLNFGYAFIVGQELWQGLPIGPLAEQPYSSAVAKQLGLPVDPLVNEPPLNYPFIGFPTNYGNLMATYKFDSGLGISLWALAESGNFIFYTYSTRIPSWYTLNARIFYTSKRWEASLYLYNITDEHYWLPGAPGFSNARFMNYDYIVPQLPFWIQGTLSIFF

SEQ ID NO: 6121 - protein, 770 aa, Xanthobacter autotrophicus
MPALSSTTSARSSAPCRTRLLALLIAVSAVRQAHALADETPRAFHIERAPLEHVLLEIARVSGLHVSFASGVVKERWAGPIDGKMSAQEAARRALQGSGLTLASLPDGTLTVVASDQAEAPPNVGTLAATEVHGEAGDGFAVFSTGAISRVEMAVSNVPHAVSMLSGGLLASRQSPTLSEAVSQAGVVPVLVDQAAPPQYAIRGFMTDTISVDGLPDRLASMRPMEALDEIAVIKGPNADVAGVTMAGGTINASLKAPGAAPMRSIAVETGSHAERKVIADLGGAIGTNGLIYRVVGVQDASANSDAGHTGRRTSYGHGALGWSDANTEAIIGVETLASRQPVQPSTFVLNGGVVRLPSLSPLGNADDDVQGRAERFYYTLSHSLTDDWAVHSRGSYENLRLQSAQWHLMPSADGSAPMPTVGMGYRSDNRVWALSSDLTGTIRQGPLTHSLVVGWDEIQDRLDFHYPGATVLGQQNPYVPTPLPSAEFVPGLSLSQTVRQSVFRLRDRIAIGERWELSASIRANDYVAKLPHARLQGLAWTPAFGVVYKLDARTSWFADYSHGFQINTGYFYNGATMQPERSQQVETGLRWEDRQRKLTAQLALYHIDANHVGVGDTAHPGYYTEITEQSSDGIELSLQGSIARGWETSLWLSGAHVKRRLPGNPSFTAPGLGGAMWTTYTVQSGTLAGAGAGLGVTAQRWIPCYDTAPFRVPGFVQLDGSLFWRSKQWRIDLIARNLFNVRAYGNTVSSSFVPILPGRTLTLRLARNF

SEQ ID NO: 6122 - protein, 1066 aa, Xanthobacter autotrophicus
MKMTSTKGGARARLLTSTLLAGLATVAAPLAITAIATAIPTLASAQDYTSGTLVGTVRDASGAPVSGAAVTVKSLGQGFTRQLVTGSDGQFRVPLVPQGGYSVAISKEGFQPTSDGAVAVRSGGDSAYSFTLSSADASVSEVVVTATANPQLDFGGTTTGLSVDLETLTKQVPVNRTITSVVLLAPGAVQGSNTNFRGQPSIGGSSVAENAFYVNGLNITNFDNYLGGSTVPFDFYKSVDVKTGGYQAEFGRSTGGIVNAVTKAGTNEFKFAVRGQWEPDSLQEDQKDTFLRRGKLAKTDNKSLTLEAGGPIIPDRLFFFAMTQMRDNQTTFGSITGGSYNKETQRDPFYGLKLDGYITDRQHLEFTYFDTKGSAKRSTRQYEFDDTTGTDTFGDKLGGTLFSLGGANYVGKYTGTFTDWFTLSAAYGVTKDSYRVTPQDLSGNYVTNTADPAHPGETSVISRQKTSSYDSSYETKREFYRIDADFYFDLLGKHHIRAGYDQEDLTLDHVNQYPGAGTDWDFLLAGATDARGVAAGQTYVKGRTFKTGGIFEGTNKAYYIQDSWDILSNLTLNLGIRKDQFQNSGARTAKGSETFVEFDNEIGPRIGFTFDPFSTGNDKIFGNFGRYYLPVASNTAFRQATASYDIDTFFTAPQGVALGADGTPIRGTQITQTTNPGFASAAACPAPVAGVTPPGATDAVGCAVRGDGSLQPFAANTSKNLKSTQEDEYILGYEHQFNSLWKASATLTYRNLNRVSEDVAIDAAVRNYCVKNGIAGCGSTYNVAGPTPGCTTFSAGPRAGQTRCAGFSGFRQYTIVNPGEASTITLRQPLPGEATARTISFSKADLGYPTVKREYVGLEMKVERAFDGKWGFQGSYVLAESKGNYEGFVKSDAGNGQTDSGITQDFDQVSLTDGAYGLLPNHHAHQFKLFGSYAITDNLLVGGNALVLSPKHYGCIGLHPTDDIVNSGYGVASFACGGKIVPRGSAFETPWTARLDIAVRYLVPTTKFIPGGLTLRADISNILNSRTETEAWEFGDSDAGGADEHYKDPIQYQAPRSVRLGFDWEF

SEQ ID NO: 6123 - protein, 565 aa, Xanthobacter autotrophicus
MLRSSYRAVVAGLVLLPLLASAAPFTSPGDRDLIRDRQQRLLDEQRKRLEELQQLPGKGAPAAADASGDDERCFEIRRIELEGAGHLGESARRQLLAPYQGRCLGVGQLNALLKAVTDHYLDRGYVTTRAYLPQQDLASGTLRIIVVEGRLEGLDSSALASPRELAMSFPGRTGELLDLRELEQLVDQLSRLPSRQAQLELVPGSEVGGSRVRLKGERDKPWRVSATRNNDGDVSTGEQQMGLGLDWDSPLGLADQLNLRANRDAVTDRWRHSDSQSLFYSLPWGWWTFTYGYSQSDYRTRNEASGFPFKLDGDSRSHQFRAERVLHRDGVSKTAMSLGLSHQRTNNYLEDTRLEDQSTRITETQLGFNHGRRIGSGFVNLDFGWQQGIGALGAQGRGHPHAGDPNARYDKYSLTLSYLQPFQLWGERFSFDSLATGQRSEDVLFSPQRISLGGNSSVRGFKDQTLTGDSGGYWRNQLRWRRAVEWAPLRPWLQEYGVAFAYDVGVIRHDRYNDGASGRMSGNAIELDARGRYFAASVGFARSLERPSAIERREHPIYFRVDAFF

SEQ ID NO: 6124 - protein, 831 aa, Xanthobacter autotrophicus
MALRPGMRSVARTPSPLLFSLSRTGLAALMAAGLAAGAALPRAALAQAGAAATGAVQRPFQVPAGPLAAALTAFAADAGVSISAPPALVQGRRTQGVQGRLTVREALDRLLAGTDLQAQAAGEGGFVLRAVPEANQASTVLGEVRVTAAAPAESPWGSTSGYVARRASTATKTDASILEVAQSVSVITRDRMDDQGVRTLNDAVQYTAGVRTNTGGANPADDSLSVRGFSQFSGNFYLDGLRLMPLGTLGFFGMEPYGAERMEVLKGPASVLYGQNSPGGIVNFVSKRPSADPVRGMELSVGSHARRQAAFDLGGPVGDDGTVSYRLVGLARAADQQIDFMRDDRVYLAPSLTWAPDARTSVTLRGFYQKNHAMMSTNVQWDALNGRNPNGRLPLNRFLGEPGFDREETEVASLGYDARHEFDSGWTLRQNFRYLHARNHEQYMFRYGPLIDGSITNREIDSRDGKGGVYTVDTSLSGQFAAAGLQHELIVGLDYNRSRSSFDSYIADGPQLDIYRPVYGSFIDTSLLQPDALRDERAQQVGLYVQDRIRKDRWVLALGGRHDWSRLEQTSRLADPVSTSVRKPKSFTGRVGLTYLADNGVAPYVSYSESFVPLMGADRNDRPFDPETGKQVEVGVKYSPDERSSFTLAAFELRRQNVLTTDPENVRYSIQQGEVRSRGIEFEAAVQPMRGLKLLAALTYNPVKVTRAQPDQWGGNVQGKSPYEVPRKMASAWVDYAFGGDLLGLGAGVGARYIGWSWGDADNSFRVPSFTLVDASLRYDLGKMRSDWRGASVSLTVKNLFDKYHTASCFSANACNYGEARNMVVRFGYIW

SEQ ID NO: 6125 - protein, 270 aa, Xanthobacter autotrophicus
MRDVRRINPHRSVRIVRTERHRLSRQRRDVRRINPHRSVRIVRTERHRLSRGDTRAADGITYITATNAGSGEYQRLTLSYQYRWGDHEFWLHTSHSENLTSSRSYDSSVDAVPEDEIVAYVSGASINSRIDLISLDDLGRLNDDFSRPATANLSIHSQWTDAFKTSLNVSYQGAYTSAVDTGEWYFAERNTFCTQCEDLELAYPVYQDIHRPARTLVNANLQYQLRAFNQAIKLSLEIDNLLDQRTYAVANNQQGVETGRSFWVGLEYTW

SEQ ID NO: 6126 - protein, 871 aa, Xanthobacter autotrophicus
MVRSFKTVCLEKREKRKKHAIRPVAILIYLIVTGASSLSNSALANSDIEFNADILDLKDKQNIDLSDFSRAGYIMPGRYEFVVRINNNELPDIYNINYVVPADDPKGSEPCLPPELVRQLGLKPEWLDKIRFNDNQTCLDTSSIPGMTINASLGSGNLLLTIPQAYLEYSAPNWDPPSRWDDGISGILFDYNVNANVTDPAKGKQRQQVTGLGTLGANLGAWRFRADWQASYQHTTGIPQSTENSWKWNQYYLYRAIPQWEARFVMGETYSRSDIFDSFRFTGVHLATDDNMLPPNLRGYAPEVTGVAKTNAKVTISQQGRVIYETQVAPGPFRIQDINDAVSGKLDVRVEEQDGSVQEFQMDTASIPYLTRPGRVQYKFSAGKPSNIDHNTEGPVFGMGEFSWGVSNGWSLYGGSIVAGDYNALSAGIGRDLMAFGALSFDATHSWAKIPRDDKRYNGGSYRLSYSKRFEAINSQVTFAGYRFSERDFMTMDQYLERRYRDGNADNNKELYTIMFSKQFPDWGLSTYLNYSHQTYWNKPTNDNYNLSLAKSADIGRFKNINFSLSAFRNKFNGTNDNGVYMNVSMPWGDRATISYNTVINKSGNSHNVSYYDRIDDNSSYRVGAGVSSNGKPSADAYFMHYADAALVTASASHINGEYTSATLSLQGGATLTPKGGALHRVSRTGSTRLLIDTDGIANIPVKNFGAISHTNMFGKAVLPDINDYYRSSASIDLNRLPENVEALRSIQQLTLTEGAIGYRRFDVIEGQKAMAVIRLKDGTFPPFGASVTTEKGRELGIINDGGNVYLTGINTGDVLSVRWSGKEQCKVLIPTLVENVQISSLLLTCSDDGTATSTFNQREVSLPKTKFLSR

SEQ ID NO: 6127 - protein, 532 aa, Orientia tsutsugamushi
MKKIMLIASAMSALSLPFSASAIELEDEVGLECGPYAKVGVVGGMITGAESTRLDSTDSEGKKHLSLTTGLPFGGTLAAGMTIAPGFRAELGVMYLRNISAEVEVGKGEVDSKGEIKADSGGGTDAPIRKPFKLTPPQPTMMPISIADRDFGIDIPNIPQAQAQAAQPPLNDQKRAAARIAWLKNCAGIDYMVKDPNNPGHMMVNPVLLNIPQGNPNPVGQPPQRANQPANFAIHNHEQWRSLVVGLAALSNANKPSASPVKVLSDKIIQIYSDIKPFADIAGINVPDTGLPNSASIEQIQSKIQELGDTLEELRDSFDGYINNAFVNQIHLNFVMPPQAQQQQGQGQQQQAQATAQEAVAAAAVRLLNGSDQIAQLYKDLVKLQRHAGIRKAMEKLAAQQEEDAKNQGKGDCKQQQGASEKSKEGKVKETEFDLSMVVGQVKLYADLVTTESFSIYGGVGAGLAYTYGKIDNKDVKGYTGMVASGALGVAINAAEGVCVDLEAGYMHSFSKVEDKYQVNAFIASACVRYNF

SEQ ID NO: 6128 - protein, 217 aa, Francisella tularensis
MMRLKSIVIATTVLLGSATASIAAGSDNIDTLANTNSATTQSSGFAANNFIAPFANTYSALTNKDNTWGPQDRTGQWYLGVDANGLAGTPNSPSGAGANFTIGYNINKYFAVQYNQLVGRVFAGLGEGVVNFSNNTMFTPYAAGGAGWANLAGQATGAWDVGGGLKFELSRNVQASVDYRYIQTMAPSNISGANGRAGTNMIGAGLTWFFGGKDTTN

SEQ ID NO: 6129 - protein, 183 aa, Francisella tularensis
MFGGNAVGYGTPHIKILNASGDTISKKDYNGITFAFIAGYKQFFTPNFGLRYYINVNTIGKDVGQKFRGTLMDYGVNIDMLYNFIARPNANLGFFLGAGAGANTWGKDIGKDIADSKNVKKTAFSAGLNFGLRSVFAKHYGLEIAARVPFTKTTIFDGDNGGQKIKMTGSYDYNVELRYIFNF

SEQ ID NO: 6130 - protein, 691 aa, Francisella novicida GA99-3549
MSKGFVSGLMTGICYLALQSGAYSQEQKEPEELGPIVVTAARGEQSLDEVTRSVAVVVSEQIERASTNSVAEILRDVPGVKIVDSSVAGLQRISIRGEESSRNVVLVDGQEITDHTSYGAVFLISPSDIERIEVVKGPGSVLHGSKAIGGVVNIITKKGADRALQVEVGTSFDTSTNGISGFSAASGTVDRWDYRFSLSKDKHGDRETTGGTLEGSSHESQSVSAYVGYNGDQHKFSIKAERYEKEGETYSEPEFPITAIDLQLPKRDRSKIAFFYDFKEVSESIANIHLDGYFQQIDRIATNNYTAQTPFGTFDTVSVRENKIESELYSLGLNGQVDLTLADQHLTTAGFQAVQDRLDKVSTSIGSDDPFGPAPETPFSDRDEDEAKLTTLSAFLQDEWDITEELTLTGGGRYYFVQLENDGSAGDKDENDQAFVGAFGLNYVGFENLAFRAHLSQGYVYPTLLHSTTGSIFSPAGQIFGNSDLDPETSVTAEIGGRYDDGLLVIDVSAYYTDAKDYIDTVRCDPASHGSKCTAGSLIYENIDSAKTWGLELAASYQIDNWGLTPYANLALMRRQFNTSSTSTFHTDTPLFSGRVGVTKEWDFDSGVNAYADLYSRFASERRLVTSREDESEAGFATLNLAGGFSYDFDDERKLKVNAAVENIFDLEYKPSLDELTAPGRTFKLSASVIF

SEQ ID NO: 6131 - protein, 336 aa, Francisella novicida GA99-3549
MMRLKSIVIATTVLLGSATASIAAGSDNIDTSANTNSATTQSSGFAANNFIAPFANTYSALTNKDNTWGPQDRTGQWYLGVDANGLAGTPNSPSGAGANFTIGYNINKYFAVQYNQLVGRVFAGLGEGVVNFSNNTMFTPYAAGGAGWANLAGQATGAWDVGGGLKFELSRNVQASVDYRYIQTMAPSNISGANGRAGTNMIGAGLTWFFGGKDTTNNDTGNIQDNGATTAAQTVAMPTIDESKYVLPAGIKQCEGNFNLTEDGVACYTVNGDDVTVYLDTKFAYDKATLNAKGKKAIASFVNFIKDSNIGSVTVKGYASQGQTGSEFDIYNPKTF

SEQ ID NO: 6132 - protein, 2660 aa, Francisella novicida GA99-3548
MATKKRSGEEINDRQILCGMGIKLRRLTAGICLITQLVFPMAAAAQGVVNAATQQPVPAQIAIANANTVPYTLGALESAQSVAERFGISVAELRKLNQFRTFARGFDNVRQGDELDVPAQVSENNLTPPPGNSSGNLEQQIASTSQQIGSLLAEDMNSEQAANMARGWASSQASGAMTDWLSRFGTARITLGVDEDFSLKNSQFDFLHPWYETPDNLFFSQHTLHRTDERTQINNGLGWRHFTPTWMSGINFFFDHDLSRYHSRAGIGAEYWRDYLKLSSNGYLRLTNWRSAPELDNDYEARPANGWDVRAEGWLPAWPHLGGKLVYEQYYGDEVALFDKDDRQSNPHAITAGLNYTPFPLMTFSAEQRQGKQGENDTRFAVDFTWQPGSAMQKQLDPNEVDARRSLAGSRFDLVDRNNNIVLEYRKKELVRLTLTDPVTGKSGEVKSLVSSLQTKYALKGYNVEATALEAAGGKVVTTGKDILVTLPAYRFTSTPETDNTWPIEVTAEDVKGNFSNREQSMVVVQAPTLSQKDSSVSLSSQTLSADSHSTATLTFIAHDAAGNPVIGLVLSTRHEGVQDITLSDWKDNGDGSYTQILTTGAMSGTLTLMPQLNGVDAAKAPAVVNIISVSSSRTHSSIKIDKDRYLSGNPIEVTVELRDENDKPVKEQKQQLNTAVSIDNVKPGVTTDWKETADGVYKATYTAYTKGSGLTAKLLMQNWNEDLHTAGFIIDANPQSAKIATLSASNNGVLANENAANTVSVNVADEGSNPINDHTVTFAVLSGSATSFNNQNTAKTDVNGLATFDLKSSKQEDNTVEVTLENGVKQTLIVSFVGDSSTAQVDLQKSKNEVVADGNDSATMTATVRDAKGNLLNDVKVTFNVNSAAAKLSQTEVNSHDGIATATLTSLKNGDYTVTASVSSGSQANQQVIFIGDQSTAALTLSVPSGDITVTNTAPLHMTATLQDKNGNPLKDKEITFSVPNDVASRFSISNSGKGMTDSNGTAIASLTGTLAGTHMITARLANSNVSDTQPMTFVADKDRAVVVLQTSKAEIIGNGVDETTLTATVKDPFDNVVKNLSVVFRTSPADTQLSLNARNTNENGIAEVTLKGTVLGVHTAEAILLNGNRDTKIVNIAPDASNAQVTLNIPAQQVVTNNSDSVQLTATVKDPSNHPVAGITVNFTMPQDVAANFTLENNGIAITQANGEAHVTLKGKKAGTHTVTATLGNNNASDAQPVTFVADKDSAVVVLQTSKAEIIGNGVDETTLTATVKDPFDNAVKDLQVTFSTNPADTQLSQSKSNTNDSGVAEVTFKGTVLGVHTAEATLPNGNNDTKIVNIAPDASNAQVTLNIPAQQVVTNNSDSVQLTATVKDPSNHPVAGITVNFTMPQDVAANFTLENNGIAITQANGEAHVTLKGKKAGTHTVTATLSNNNTSDSQPVTFVADKTSALVVLQISKNEITGNGVDSATLTATVKDQFDNEVNNLPVTFSTASSGLTLTPGESNTNESGIAQATLAGVAFGEQTVTASLANNGASDNKTVHFIGDTAAAKIIELTPVPDSIIAGTPQNSSGSVITATVVDNNGFPVKGVTVNFTSNAATAEMTNGGQAVTNEQGKATVTYTNTRSSIESGARPDTVEASLENGSSTLSTSINVNADASTAHLTLLQALFDTVSAGDTTNLYIEVKDNYGNGVPQQEVTLSVSPSEGVTPSNNAIYTTNHDGNFYASFTATKAGVYQVTATLENGDSMQQTVTYVPNVANAEISLAASKDPVIANNNDLTTLTATVADTEGNAIANSEVTFTLPEDVRANFTLGDGGKVVTDTEGKAKVTLKGTKAGAHTVTASMAGGKSEQLVVNFIADTLTAQVNLNVTEDNFIANNVGMTRLQATVTDGNGNPLANEAVTFTLPADVSASFTLGQGGSAITDINGKAEVTLSGTKSGTYPVTVSVNNYGVSDTKQVTLIADAGTAKLASLTSVYSFVVSTTEGATMTASVTDANGNPVEGIKVNFRGTSVTLSSTSVETDDRGFAEILVTSTEVGLKTVSASLADKPTEVISRLLNAKADINSATITSLEIPEGQVMVAQDVAVKAHVNDQFGNPILNESVTFSAEPPEHMTISQNIVSTDTHGIAEVTMTPERNGSYMVKASLANGSSYEKDLVVIDQKLTLSASSPLIGVNSPTGATLTATLTSANGTPVEGQVINFSVTPEGATLSGGKVRTNSSGQAPVVLTSNKVGTYTVTASFHNGVTIQTQTIVKVTGNSSTAHVASFIADPSTIAATNSDLSTLKATVEDGSGNLIEGLTVYFALKSGSATLTSLTAVTDQNGIATTSVRGAITGSVTVSAVTTAGGMQTVDITLVAGPADASQSVLKNNRSSLKGDFTDSAELHLVLHDISGNPIKVSEGLEFVQSGTNAPYVQVSAIDYSKNFSGEYKATVTGGGEGIATLIPVLNGVHQAGLSTTIQFTRAEDKIMSGTVLVNGANLPTTTFPSQGFTGAYYQLNNDNFAPGKTAADYEFSSSASWVDVDATGKVTFKNVGSKWERITATPKTGGPSYIYEIRVKSWWVNAGDAFMIYSLAENFCSSNGYTLPLGDHLNHSRSRGIGSLYSEWGDMGHYTTEAGFHSNMYWSSSPANSNEQYVVSLATGDQSVFEKLGFAYATCYKNL

SEQ ID NO: 6133 - protein, 393 aa, Francisella novicida GA99-3548
MMRLKSIVIATTVLLGSATASIAAGSDNIDTSANTNSATTQSSGFAANNFIAPFANTYSALTNKDNTWGPQDRTGQWYLGVDANGLAGTPNSPSGAGANFTIGYNINKYFAVQYNQLVGRVFAGLGEGVVNFSNNTMFTPYAAGGAGWANLAGQATGAWDVGGGLKFELSRNVQASVDYRYIQTMAPSNISGANGRAGTNMIGAGLTWFFGGKDTTNNDTGNIQDNGATTAAQTVAMPTIDESKYVLPAGIKQCEGNFNLTEDGVACYTVNGDDVTVYLDTKFAYDKATLNAKGKKAIASFVNFIKDSNIGSVTVKGYASQGQTGSEFDIYNQKLSEKRAQAVADYMKQLGLDSEKIITKGFGYDDTLGGIPKSDPRNQRVEASVSAPLKEAN

SEQ ID NO: 6134 - protein, 932 aa, Francisella novicida GA99-3548
MTMTTLHPTMRRGSLAIAISLCVSTSAIAQEQTEKNPTNLDKIEVTGSRIRSVDVENSQPVLVLTRQDIEKQGLTSVADVLKRIPSNGATMNTTVNNGGDGSATVSLRNLGASRTLVLVNGRRWVSGLSGSVDLNTIPSAIVERVEVLKDGASSIYGSDAIAGVVNIITRTNFDGAEVNAYVGQYGQGDGQRTSFDATVGATSERGNLVIGLSSVKEDAVMAGDREISAEPVYGAGSSAYSSYSASGRLRANGTSGAWTVLPDSATASGDSRYPRYALDQYTAFNTSEYGYNYAKDNYLVTPQKRDALYVQGNYALTDNVRFKFDGLYNRRQSSQQLAGFPLASVNTGILLSGDSYYNPYNAAYGGDGRDVGWSHRLTEFARTYQQDVKTSHVYTGLEGDFQFADRQFSWDVGFAHNQTDQTETQYGDVNLLNLSNALGASGIVNGTLACLDSGGAVIAGCVPFNPLSPAGGVTQEMLDYILFTAHNTYQYKNSSFTANLTGDLFELPAGWMSFAAGVEHREESGFSSPDALISAGYTSGNSFTPTSGSYTLNDYYTEVAIPLLKDVPGAQLLELSAAVRYSDYNTFGSTTNSKFGFKWKPVADLLIRGNYATGFRAPSIEDLYLGASDSFDTYSDPCSTNSTSYTSAIAATCAARGVPANYVAEYNSASGNSGQTIYPFTYTSNANLQPEKSKNTTLGFVYSPASVQGLDVSLDWWKIEITDAITEFSANQILSQCYQFNVSAFCDLVTRDATGAITGLVIQPVNVGEQRMQGYDFTARYKLPQTAIGQFMLTLDSTYVAVNEQKQDDNSAWESYNGIYHTNNPNWRTRGTLTLDWSYGNLAANWAVRYYSGMKDYDSELDDNGNYRHVAATAFNDMQVSYQLPWNATVRLGLNNVFDRDPPVALSASANSFDSAYAIPGRYSYLQYTQRF

SEQ ID NO: 6135 - protein, 951 aa, Mannheimia haemolytica PHL213
MKRLQLLFILFITATSFAQNTGSIVGKLTDKEYNNEPLPFANILIKGTTTGTTSDIDGLYKFEDLEVGSYTIVFSFVGYETQEIKAEVIAGKITPINIALGASAATLDEVVIKTTTRKESEAALLLDQKKAVEIKQSIGAVELARKGVSNAAGAVAKISGVSKQEGSSNVYVRGLGDRYLNTTMNGLSLPSNDVNKKNIDLNLFSSDIIENVSISKAYSSRFYGDFSAGNVDITSKDYKGNGFFDFNVGSSVNTNSADKTFFRSEGTSYFGFYNRYDNNPFAVVLSHGFDPQQADTPIDITFGGAFGKSFDFENGSRLSFYATGSFENGYEYRRGSNVDYTNVEKKAFEDAEEFEYSTKTTAMASINYKIDDTNSLKFNSLFINNASDKVGYFGIDGNGRNRDAILNTDEGFYQMNVQFNQNLIYVNQLTGRHRFNEGKYNLDWGVGYNVVNAHEPDRKRISVENYQFALDNDASTLPTFYSNVVFDNQRYFQNINDDELNSRLNLAYTINETVKLNLGYAGKTKERQFDNIRYGYDIVNANTPINNVNDLNSIFTLENLNIGNSTDGLYELKVINAYPGLSNTNRPGSAENTYNGNLNVYAGYANAEITLNDKWLFVPGIRVEGIDQQIAYDVINLGAAGNSSVVSNETVFLASLSVKYSLNEDQNLRFSASQTISLPEFKEVAPFVYESISQRIGGNPDLLGTQDGINYTNVNDVSYSKILNLDLKYEWFISKNEILSVGAFYKQIKDPVNQVVAFDATGTQRFFRTGEQAEILGFEAELRKNIIIDDETEDAKLSTGFNFTYMHTQQDLYESIIGTYSVSFNKDEEELQGASPIIVNADISYSPTFGNYKPTANLIFSYFSDRIDALGSGQLGNVIEKGIPTLDFILKNKLNSKMELNFGIKNILNPTIQYLREGTSVGDVLVTSPNGKDVTDYKRGLNVGLQFKYKF

SEQ ID NO: 6136 - protein, 1084 aa, Mannheimia haemolytica PHL213
MKYHEKPAHFRELFSNLLPILLALFIWTNPVLAQNNGELITLSLKNKTIGEALETINKRYNYTFVLRTPDIDTKRKVSIDAKQQKIEDVLNNLFRGQDVSFDINNKTVRISKNVRQKDAESTQGATARNVTGQVTDSSGEPMIGVSVMVKGSNNGVVTNMDGKYEIKIDHPNQVLQYSFLGYLSQEKRIGDNRMLNVTLEEDVKKLDEVVVVGYSVQKKKDITGAVSTVLAKDIENIPVNDFGSALAGRSAGVQVITPSGKPNEGFSIRVRGATSINAGNEPLYVVDGVPTSDTKTINPSEIESITVLKDASSAAIYGNAGANGVVLITTKRGRKGEAQIELNAYYGFSERAKRIDVLNKDEYQDLLSDLGYPAMDTSVYNANIDWQDEMFRNAAMQNYQLSISGGNEKSLYYISAGFIKQDGIVKPSSFERMNFKINLEQELKKWVKIGTNLSYSKINDVDVSDGNSETVILQAITTPSVVGKYNADGTFPTLPFLSSLENPLSAVESYTRDYVYHKLLGNLYAEISFTPDLKLKTSMGIEMGASRYKEFLDPFSSAWGRNQQGQASYNTSLNYKWINEEILTYTKKIGDHSFSALAGFVASRYVGESANSSIRGFSDNKIHSMNAGTVLNKPSEDYGASTNASVLGRVTYDYQNKYLATVNFRADGSSKFGVNNRWGYFPSFSLGWRLTGEEFMKPLDWLSDLKLRVGWGQVGNDQVGYYSSYGIYGIGANYNMDGIILPGYYQSQIGNDKLRWERTTQTNVGLDFSFLNGRMTLTADAYYKKTTDLLLMVKLPQTSGFDSGMQNVGSVVNKGLEFQLTTRNLTGELKWTTDFNISTNKNEVTDMAGSPAIFTGSLDKKISGNVSIIQKGQALGSFYGFQAAGVNPQNGRMMYEKANGMLVYEEDLSADEDRRILGCAQPKFLYGINNVFSYKNFDLSFFFQGSYGNDIYNATRMFTEGMFDSRNQSDRVLMRWRNPGDYTTVPRAEKDKYPAISSRFVEDGSYFKLKNVKLSYTLPRPLTRKALMDRVTVYISGDNLVTFTNYRGYDPEVNIGGGSSSAMGIDQGVFPHARTYILGATIVF

SEQ ID NO: 6137 - protein, 974 aa, Mannheimia haemolytica PHL213
MKTKSRYLAAAGGLALIAAFPQWAAAQSQSQSQSTSSEAETAAQPNPAVLDEVVVTGYLQGLRRSIDEKRNSDMISDSVSADDMGKLPSSNLTEAASRIPGVSAVRNHFTGEGDRVVIRGMATEYNAYAVNGVRMGGTGSPGDNFFRGVRLSFLPTSGVDAITVYKSLLPYMDGDAIGGTIDIKTPTAFDYDPTHVAGSIEGTLLQQRDDRTSWAADVAFGKQFSDRLGLFVTGNYSERASQFEQIGNSGDNMPRNWYSKAQSLDFDPQTFVTRGLEMSTGDTDVTRWGFNGSLDWRGDNHDFHLRGQYNEYEETQFRNRLNFRNEAGTSASARLEQVDKSRGDLIQPANAVIGYDDIKGAIYNYTTAQIVDRDKDDKITDADKGSNSYYSLNGSSGSWDPKGFRLRRYWEGGTTEGVLQMVNFGGESRFREFTLDYDLSHSESEDNIVDSYEMYFGRNAYLWKGNEGVEIVSQGDPQYLKWVLNPAGMAGVQDLTQYTASSLSGSYGGAKETLNQAQFNLRYQPTGSWLQEVRAGAKYYKSERERLEGSLIDLEPRGTMADYSALFGEAITDMFDGRYTGQYQLGPVIDTDKMMAEIERAKAGNSTLLTLNEADSIDYASTWFYDEQVVSAYVMGTARFGAAEVIAGVRVEDTSNDIRAWTENPVRGEDYTTDTSGFTNWLPSIHVNYDVSWNAKLRAAIWTSVSRPDIKRMTSVKEYSYDGDPDGDGVTNPTSEWVLTGIVQGNPDLEPMTSVNYDLSAEYYNGRTGAYSVALFYKDLDKFLFRSSSSVIRDGTEGEFDDPSGVPVSMPMNGRKAEIRGVEINARQQLHWLPAPFDGLGVAANATIQRSEAETGLSWHPEGYTLPFMETPDHIVNLELFWERNGWEAYVAYNYQDVSLEDIEDFGNDPYEQDYHFVDLMARRQITPNLTATFKVQNLLDNYTYFYTFGEGKGGVRDYIENGRYLSLNLNWRL

SEQ ID NO: 6138 - protein, 333 aa, Mannheimia haemolytica PHL213
MKMKMAPALIALAIAAMGTSTAQAANDWYTGIGAGWAYGHDLNDFGKDADKDATALSLFGGYNFNDNFGAELGYLYAGKGGVDGVDFKTQGATLSGLARLPLGDIFSVFAEGGAYFNHVNGNGSSDNGTAPLAGLGVTAKLSDLIDLQARYRYMWNLGDEQKTWETNMSVATLELVMHPNRSTYVAPVAAPAPEPVPEPVVVDKNFALSSDVLFAFGKSTLKPEGVAALNTLYQQIVDVQPKDGSAVVVGYTDRIGSDAYNLKLSEARARTVADFLVGKGLPAGKVAIEGRGEANPVTGTQCNGIKAKAQLISCLAPDRRVEVRVTGVQQVTQ

SEQ ID NO: 6139 - protein, 191 aa, Mannheimia haemolytica PHL213
MKKTTLAIALGALAFASVASANWYVEGDAGYSKLRTSGGLSSKISDGSFSPSVAVGYKVNDWRFALDYTYYGKGDEGFGDLGGSGENEVKAYGFGLAAYYDFDLGTSLTPYLGARISANHIKVNSDFNNASDYFHFSNSNTEFGYGAIAGVSYNFAPQWDLNVAAEYNRLGEVRDVKVNQYGAKVGVRYTF

SEQ ID NO: 6140 - protein, 943 aa, Mannheimia haemolytica PHL213
MFKKNTLSTAIIAILASTASVQAHAEDSKTAEKDVEKITVTGIRGALGRALDTKREASGVVDSISAEDIGKFPDTNLAESLQRITGVSIDRSGGEGQKITVRGFGPQFNTVLVNGRQQASEDPGRDFSFDTLAAEMVKTLDVHKTSSATVQSGGIGATVNIETAKPFAINGFKLAGSVKATYDGNSEETSPQASLLISDTFNDDTFGALFAISYLERETKLNRAQSAGWRENSSFGKGAPVTESGDVYTGNIFIPQNFDSLVTTEKRERTNANLVLQYAPSDNLVITADALYSDFDVKSDTTSYGHWFTSDNVENAVVDANGTITSMYQETGLATDFHAKKADRLTDSLSIGLNFDWDVNDNLNMKFDLSNSTAKREPNNGRGGSLALLGYANRVQWNVDGNILPYYSDFATPDPSIYSGQQEGDGVNQDPNSPDYVSPTGVSDYLDPANSRAHVMIRDSKEIEDVVTQVKWDSLWLSDGDTGFSAARFGAMYSTETKTVNSWDNTTSGIHCTYCNYQDFPDVSAFPQEVFDAGSDFLSDVSGSGRTPSQWLKFDGEALFDFLGAVEGVDFNAVKTNNSFEVKEETTAFYLELDFEGEIAGMPLYTTGGFRYESTDVTVGATQANVQRLDILDATEMLAVYGPASDFDESSSYAQILPNFSTKLEITDELVARVAASRSISRPTLSSLRPITSLDTVRQGNLQSSSGNAALVPFSSDNLDLSIEWYYADASYVSAGYFRKHVANFITSSKNPKTFVTADSSLLTDPSTGSDVSAPDADDQVAVFTNTAPSNGESAVVDGWELAAQHTFDSGFGLLANATLVNSDAELDNADITQVFALTGLSDSTNLIAFYESGAFQGRIAYNWRDTFLQNLTQGGGDGVTYVEAYSQWDASASYDLTDQITVFVEGINLTEEYTHNRGRFSNQILEVVDSGRRISFGVRGSF

SEQ ID NO: 6141 - protein, 204 aa, Mannheimia haemolytica PHL213
YYIRLQYNSEFSPLNTKVDGITGAQKDSKDTNDLYKPSFMAGGSAFGYRMDDIRVDIEGLYSQLSKSTLSRAPTPDIVDNLTAISGLVNVYYDVVIEDIPITPYVGVGLGVAYISNPAKAQVIADQKHGFGFAYQAKAGISYDVTPEIKLFAGARYFGSYGANFDKSEEVNKGTSEDKETKVTAGAYKVLYSTIGAEAGIAFNF

SEQ ID NO: 6142 - protein, 171 aa, Mannheimia haemolytica PHL213
KVDGITNATGKQKDSPFTRSFIAGGGAFGYKMDDIRVDVEGLYSQLAKDTAVVNTSETNVADSLTAFSGLVNVYYDIAIEDMPITPYVGVGVGAAYISNPSKADTVKDQKGFGFAYQAKAGVSYDVTPEIKLFAGARYFGSYGASFDKTNKDDNDIKNVLYSTVGAEAGVA

SEQ ID NO: 6143 - protein, 693 aa, Mannheimia haemolytica PHL213
MKIKKSLLLSLSLMVSLSRAEDDGFYMSVGYQIGEAVQKVKNTGALQNLADRYDNLNNLLNQYNYLNSLVNLASTPSAITGAIDNLSSSAINLTSATTTSPAYQAVALALNAAVGMWQVIALFIGCGPGPTNNQSYQSFGNTPALNGTTTTCNQAYGTGPNGILSIDEYQKLNQAYQIIQTALNQNQGGGMPALNDTTKTGVVNIQQTNYRTTTQNNIIEHYYTENGKEIPTHYSGGSTFSPTIQLTYHNNAEYLLQQAATIMQVLTTQNPHVQTSNGGKAWGLSSTPGNVMDIFGPSFNAINEMIKNAQTALAKTQQLNANENAQITQPENFNPYTSKNKQFAQEMLNRAEAQAEILGLAKQVADNFHSIQGPIQGDLEECKAGSAGVITNNTWGSGCAFVKETLNSLEQHTAYYGNQVNQDRALAQTILNFKEALSTLNKDSTAINNGISHLPNAKPLQNMTHATQNPNSPEGLLTYSLDTNKYNQLQTITQELGKNPFRRIGVIDYQNNNGAMNGIGVQVGYKQFFGKKRNWGLRYYGFFDYNHAFIKSSFFNSASDVWTYGVGMDALYNFINDKNTNFLGKNNKLSVGLFGGFALAGTSWLNSEFVNLTMMNGIYNANVSTSNFQFLFDLGLRMNLARPKKKNSDHAAQHGIELGFKIPTINTSYYSFMGAKLEYRRMYSLFLNYVFAY

SEQ ID NO: 6144 - protein, 307 aa, Mannheimia haemolytica PHL213
MKKTLVALAVMAFAGSANAGFELYKKDAVSVTMGGDIEVRYVKDKAKDSEMKQQIHDADVSFDVRYAVNDEVQFGGFWEFQDTGSTNGDAYVAAYAGAHTFKVGRLCSVLDDAGIGSDYVFGLDAFFNGTDQFCGEETMRYDFDSSDFYASAAIRQFRNSKELNTDSRLFDAKVGYRGLKDFDFTAFVGSAEIGKTAVATHDETLWSLQARYNGVENLGLAAAYYATENDGVDADNIALAATYKLDVVKLAAGVNFADSDAANSDVTSWYVNAGYPLAPSATLYAEVGGNDADNTETAYAVGVKASF

SEQ ID NO: 6145 - protein, 143 aa, Mannheimia haemolytica PHL213
LGDVKAQHAFSLTYQRLIYRSEKIFSLDWGVSATYFQSQQGKSDVFAFSIFPVLRFYLYRNKNYDFYTNYSIIGPAFISKQDIDGFETGPKITYQDTMGFGVFFGKERAYNFELRIMHYSNGNIFTRNAGVAIPIQFTLGKTF

SEQ ID NO: 6146 - protein, 431 aa, Mannheimia haemolytica PHL213
MKKLTCLASAVLGLLSTSAAMAQSTVTLYGLVDAGYNHVSGLKNGSFNGIASGIMEGSRWGLRGNEDLGGGYKAIFTLESRFEVDTGSVTNRPNSGTQLPDRVSNSVAASLTGLAIPAALKAGLITGTNTNIATNAFGVNLAGNLFDRQAFAGLITPFGAFTLGRQYTPAYLINGAFDASQTQSSLAAGQIASLPAAFDIRLSNTVQYGIKTGGITAALMYGAGEVLGNSSAGRFFGGMVMYAGDGFALGYGHNEKKNELGQKSLHNDVFGANVTIGPGTLYGQYATIKDENPSGLATIGAGVSASAIAAGLPAALAPAVGAAYQSAYNAAFRQDARLMHIGYKVTSGVHTVVVAYNRLDDKRAVNADTDSYGATYTYALSKRTNLNAVLTRYNNKGAGQIAPGGNGFLGGVTAAAGVDSTNIAFGIRHTF

SEQ ID NO: 6147 - protein, 931 aa, Mannheimia haemolytica PHL213
MQIKPTAIVVKRRMKKNLLMFIALFGFICVMQGQNERIITIAFDNIPLKDALLKLEDKTNYFFYFEEVWLKDHRVTKNYNNRKIRAILNELFEETSLNYFIKDNRIILLNNAIVLEQLPFDFFDEGNLKEEIQDRSAPIFQEEFLPKGTNRKRGPITIGKQNPNTRDKEFTISGRVTNMNNNEPVQNLSIFTIDREIYTNTDSDGFYSFKLPQGLNRLETNLLGYEKVYQDLIIYGNGAMNLEISEDVEVLDEVVVESKKNANVRDAVVGASIINVEGIKTIPLVLGERDMLKAALTLPGIKTAGEGSGGLNVRGGRADQNLMLLDDIVIYNPTHFLGLFSAINPFTTQSLEIYKASIPAEYGGRLSSVFDIETKIGNTEKISGEGSIGPITANLALEVPLIKKKASIIAGFRATYADYILKNLDEESLNNSEASFYDGIVKYSHDVNENNSVQSTIYYSKDKFSITSDSVFGYSNGLVSLKWNHKFSEKSRASIIVGNSRYQYDILYKAEANNDFDFGYVLNESLFKVNLYNALSNKHKLSYGLSSKLYVSDPGTIKPIGSDSNVQQRKIDREKGLESALYISDLFEVDDKLLLDIGLRYSLFAGLGEASQNVYVEGVPKSEGSIAEVRNYGNNEVIKTHGGFEYRISGRYLLDKDLSLKAGFNRTLQYLHLLTTNTTMSPTDIWKLSDLNIKPQRADQYSIGIFKNIVENDLEFSLEGYYKKMHDLLDYKIGAQLILNDALETELLQGQGKAYGVEALIKKTAGRFNGYLGYSYSRALIKLNSAIQQEQVNNGDFFPANFDKPHDLSLIGNYRFNKRISASANFVYQTGRPITYPVGKFIYANEEQVLYSDRNQFRIPDYYRLDLGINIEGNHKKKKIGHSFVNISVYNVLGRNNPYSVFFVNEEGRIKAFKTSIFSIPVPTITYNFKF

SEQ ID NO: 6148 - protein, 1135 aa, Mannheimia haemolytica PHL213
MYKFYTNNPAVPKGYAAKILLIMRLTTVLLLFTFMQVSAASYGQRISLKGRDLSLEQVFNAIRQQSGYDFVVKENLLLNAKPVSLNIHDATIQDALSACLKNQPFTYVLIEKTIVIKKKEPSILEKVSAIFAKIEVRGRIVDANGRPLAGANIAVVGGSKNTITSTNGTFYLGGVNEKAEIEISYVGYLTRRVVVRAELGDLILELIESKLNEVQVIAYGNEEKRFSVGSVASVNASEIEKQPVTNPLLALQGRIAGLAVNGSNGVPGSTALVQVRGQNTLGTTLQVKPYDQPLFIIDGVPFAQQNVNINQLNSLATAQSFTGGISQATGISPFNSINPNDIESITILKDAAATSIYGSQGANGVVLITTKRGKSGQTTLDVNLNTQFNFVARPVEMLNTQQYLQLRREAFAADELTPSGNPEDYSNYAPDLTLFDQNKYTNWQKLIRGRTTNNTDFHATVSGGTAASTYLVAAGYTRSNYNYPGDFSNQRFTLHSALHSASANNRFTLDLVTDYGYDQNNSAAYGGNQSVVLAPNLPDLKDASGNLIWNYKGYSLDGQNFYAGLLRRVYLQNYNFNTALNLSYKVLTGLTIGANIGYNRSSTEERSENPASSQEPTYAEPSAAFGDNVAQTINVEPQLNYTLPLGKGVLTALLGATYKKVTSDAYRVEGYGYSSDYFLRTIIGATTTYPSQTLDMLRYNAGFARLKYVHDEKYIVEVSGRRDGSSNFGPGRQFGNFASVGAGWIFSEESLFDSFPTLTYGKLSGSYGTSGGDASRAYSYQALYQNLSGVPAFQDIKQAYAYNLYNPDFSWATKKALNLSLDLGFIDNRVVLNATYYRNREGNQLVDMPLAAQSGFTRVFGNLDAVVQNKGWEFTATTTNVKGRDFTWSTTFNLTLNRNKLLEFPNLESSAYANKYIIGQPVSTIIGYRYKGVNPTTGLYEFYDRNGEVTSSPRSGRVANGGDEVPLGDMEVKYMGGFGNNFTYGNFGLYVFCQFSSSNAPNYLAALYNTDFPGSIANQPAEILGKYWKNPNDQATIQRLGSSFYSGSLSTIPPFTRSDGVYSDNTYLRVKTVALSYALPGNFLQKIHVRSGSIYMNAQNLFTITNYKAGDPEQPGTFTAFPLQRIVAFGLNFKF

SEQ ID NO: 6149 - protein, 619 aa, Mannheimia haemolytica PHL213
MINKKRLLLSTVSIMVISGWNQASAAVESQDSLVVTASRFKQPISSILAPYTVVTRDEIDRWQSNSVADILRRLPGVDIARHGGIGQLSSLFIRGTHASHVLVLMDGIRLNQAGISGSSDLSQIPVSLVQKIEYIRGPRSAVYGSDAIGGVINIITTREKLGTSLNVGIGSHGYQTYDGATQQTLAENTVLTAAANYTYTKGYDVVADGNTGGFRQPDRDGFMSKMLWLGVDQKFNEQVSGFVRAYGYNNRTSYDADINWSYPYARPDTRELYSRHYDMGVRFNQGIYSSQLITSYSHTKDYNFDPQYGRYDKSASLNDSEQYNLQWGNTFQLYQGIVSTGVDFQKQSIEAGTSYIPKSKTVRNTGMYLTAQQQLKDFILEGAIRSDKHSEAGWNTTWQASLGWEFIKDYRLIASYGTAFKAPTLSQMYGFGGNHDLKPEESKQWEGGIEGVTGQLTWRMTVYRNEIEQLIDYANSRYYNIGKAKIKGVEWTGLIDTGMFQHQLTIQYIDPRNSETNEILVRRAKQQVKYQLDWQLYDFDWGLTYQYLGRRYDKDFSTSPAKRVKLGGVSFWDLTVSYPVTSYLTIRARIANLLDKDYETVYGYRIPGREYYLTGSYNF

SEQ ID NO: 6150 - protein, 712 aa, Vibrio sp.
MSYQNLDGKVRVRAGLSTTYSVLAIAIASATSMSAVAAPAAKNETTVMETVVVTGSVIGNSDIEDVKEYPGARTVITRDQIEKTAAGSIDNALQRVPGIKVQDESGTGVLPNISVRGLKASRSGHAQFLMDGVPLTLAPYGHTGQSIFPATLSMLDRIDIVRGGAAVQYGPNNVGGVINLVTKPIPHTWQTEISNRLTVFDGGDAPLNDFYLRTGGWLSDTFALQLEGNFLKGESFREHSDTDVKNFQAKAQWLLSDTQEIQAFLQRYDAETQMPGALSPQDYEQDRHQSKRPYDDYEGKSTRWSVKYIHDLPFADSAELEVLTFGHKSERLFKWGFNSAGGHWADPALPATDVRTSPREFTVYGIEPKMAMYFGEGKSVTQNWIVGTRYVNEDIDYKLTQTPIAGGATKVPRDWHLDTDAFAGYVSNEIGLFNDTLKVTPGLRVESVRMTFTDRGKKQTADNKVTEWLPGLTVAYNVTDQWVTYANAQKSLRAPQIAYIRGLGEEGSELAWNYEVGARYTQDATSFNAALYRIDFEDQLQWQSSTQTFDNIGKTLHQGLELSARYVPEVLPALSLGASYNYLDATLEEEGANKGNQLPYTSKHQLGWDATYAFYGMDTTLSGFYFSDSYTDNANTSAEDATGATGKVPSYMVWNFNLGTDLYKDDKGKLRMNVAVNNLFDEEYYFRGIDTSPVGRYPAPGRSYTLDLNYQF

SEQ ID NO: 6151 - protein, 592 aa, Vibrio sp.
MNKLLTLTPLAVAIGSSLVAPSAVASEETNSTPSATETIQVFGHQYEGYAEHMPQSGTKTDVEWLDVPQAVSVVTKTEMQDRGAVRLVDALDGVAGVNNTLGEGSRDQFMIRGFDSLNDMYRDGLRDDGTLQSYRSLANVERVEIVKGPAGALYGRGSAGGIINLVTKRANGENFTHVNGSVGSNNQYVGQVDSSMAFTDKVNGRINLEYRQADSYVDHVDSNDFFIAPTIRVLPAEGHTIDIDVEYAHQELVPYRGVPSKNGKPVDLPVSTYFGGTNDYQESDSLRIAVDYEWRLNDQWVWNNRAAFNHIELEQKGTRQGKVTGNEVSQTVNNFGYDPRTTTTLQSELVWETRDNQLMVGADFNQIDIDLTLASDKTLPPQNIYDPVVGPTPDPGFKPFRDNTTTTTGLYVQDVYTWGDLSLIGNVRYDSMELEQQKAGSDKEKLDDDKVSYRAGLVYRINSDTSVYASLARSWQLPYAGIYINPKLAEFFHTDLKEVGAKAYLLDNALMLNAALFQIDQEQPQTNVDGDVIDKIEVRHQGIELEARGQITKQWDISVGYSYLDAEDKATGKKPNDVSDHLFSLWSTYQFG

SEQ ID NO: 6152 - protein, 351 aa, Vibrio sp.
MKKHILTLLIPTLMASNAMAAQLYQAEDGSVLNIYSRLGFNVTSKNDEHGDANGEFDGRIGLNGSQTINEYASIIGQAQYQVGAAEYANQVNDKPSLTARYVWAGIDAKDYGRITGGRVASGLIMFTDIGDVFASSDVSMARQANKVDKTATQVFRQDGTLQYQNSLGNFDFSVAYILGNNTSELDYGYNAALRYTLDMGNLGTLAPVVAMQKNKGDARESNDTDYTFWGAGTRYYLGDLMLGALYSEDELEGYYSQTSTDKVMELTAVYSVNDKWALRAGYRSLENSEGDKLELKDTTLEVQYKLTPRSSIYTNYVDRNGSRGYSNGQEVSFGGAHADESYYHLGLRYEL

SEQ ID NO: 6153 - protein, 466 aa, Vibrio sp.
MKVRTIVGVAFAVALLVASTAAAENRAGFFSLSPYFGGYTFDGEQHIRTAPTFGIRGGYNLTPTWGVETVFGFSPAEETKGSQVDVDSYTYRLEGLYHFMPESSLVPFLAVGAGGTTLDYAAGSNGRDRTDGILTYGGGVKYFITDVVAVRGDVRGIFDLGYSYSNVEYTVGLSYLFGGAAPAARAVPAPQAAPAPPAPEPAPVVEPEPAPLPMAAEPTPGLMKYCITLNIEFDIDKADVRPQYHDEVKRVADFLKEYPSTTAVIEGHTDNVGDDAYNMRLSQRRAESVVNYLVDNFGIDRTRLSARGFGKTRPIADNSTEAGKQRNRRIEAIIDCALEDPKVIAALPDRLCIALKVQFDTDKWDIKPQYRGEIAKVGDFMTRNPTTTAIIEGHTDRVGTADHNMKLSLRRAEAVVNYLVEHFGIERSRLSAKGYGFSRPIAYNSTAEGRALNRRINAIIDCVIKK

SEQ ID NO: 6154 - protein, 214 aa, Vibrio sp.
MKKTICSLAVVAALVSPSVFAHKQGDFVLRVGAASVVPNDSSDKILGSQEELKVDSNTQLGLTFGYMFTDNISLELLAATPFSHDISTDLLGLGDIADTKHLPPTLMVQYYFGEPQSKFRPYVGAGLNYTIFFDEGFNNKAKNVGLTDLKLDDSFGLAANVGVDYMINDQWFLNASAWYANIETEATYKFGGAKQKTDVKINPWVFMISGGYKF

SEQ ID NO: 6155 - protein, 748 aa, Vibrio sp.
MVLCGSIPTFAQEKGVATGGLSDIVVTARKRSESMQKVPVAVSVASADALEQHQIFEAAQLPQLAPSLQVQTVNSQVGAKNFSIRGVGTAVYGPQVESSVAVVIDDVVMSRPSMGVVQFFDLDRVEVLRGPQGMLFGKNASAGLINIVTAKPKIGKTEFLAHATWGKTNSVTSGNEATLEMAGNMPVSSNSALRVSGFVTRQDGFAKNVYRSENLGLTEYGARAKYLVEGDVLQLYVAADIAHEEGPGGSVLIRRFAAPGGVIDTASRADGVIPSKDNGLVSGNARTTNSFDLGGIQATLGYDLGDGYSLSNITAYRSYKDSLQFDTDSTSLSLFDQNQGGRDYWQFSNELRLTSPGTGPFTFQAGLYYLYVNAREFLTQGGNLETLLPAPPAGMSNLGVVLDFRARSKSAAAFAEGQWAITDKIKLMAGGRFTHDELRFYSSRTNPNAFAPLADLGVDNVAVKNDDFSYRLGLQYEVNNQTLAYATYSRGYKGPTFDQVAVTPVDEEIAKSYEIGIKSTLLDNRLRLNLALFRTDFSGYQAQVLAGSTLAYRTVNAGDLRTRGVELEFSALPIDGLTFNGGVTYNRAEYRNFGSVPCYPGQPTGTSGTNVCLPNGSTNVSGNQLVVAPKLTGTLAGRYEAAVSSDATIYVQADGYYRSAFRYTADLDPQMRIGGSVIVGASIGAKLFGDSVDASLFVRNLFDKRIPTWITADPVAGAYGDAAGGGDYWHQFGTTSFRTVGISLNYRM

SEQ ID NO: 6156 - protein, 330 aa, Vibrio sp.
MNKVAIAVAAVVAGSSALLNSAQAEMYIGGKVGMTTLDDACYLNSPCDDEAFGAGLHIGYDFTDIIGLEYGVDFLGDYEGNSRSGANTINTIDGNLTALTLAPKFNWHLNDSWNLFAKIGGAYMMSDDETDFVPTGSLGAEYSIDRNWSVRAEYQRYQDMSDDVWDDMDANFFGIGVNYKFAAAPVVAAVVTEEVIEPDPEPVMMSKVHKEEYGTGTFEFDSAKLTESVSERLDNFVSFLNEYPQAQVEITGYTDSSGPAAYNQKLSERRAQSVADYLTAAGIGSDRLTVKGMGEENPVADNSTREGREKNRRVEVVVPSFEYQELVQPE

SEQ ID NO: 6157 - protein, 697 aa, Vibrio sp.
MFTKSHLALVIGAVLAAPAVANVQTDEHLVVEGREFGYKADTNSTAMRMEMTQLETPGQVAVIDETVIDEQRASTLGEVLRNDASVSAGGTSRNRERFSLRGFELSSSDGFLRDGRQHWSHYRQPIELLERVEVLKGPSGLLYGKSEPGGLVNMVSKKPTTQTQVSLSQDIGSNEHSRTVLDVSGSLNDAETLRARAIFCEENYSSWRTYGDGTKPQTDRVVGGLVVEYDITENIMVSAHYDRTKDEGSVDSGAYIVDGKPVRGDKYIWDAQWSKIDNDVENYGIDINAQVTDNVNVKAGYNRQDFKRFDVESYPKFDNYDKDGVIRHKGNERTDNWVFDTAYLDVTTNFSLLGTENTFLVGANYLDYKYDRFMAFHAGEDVAAGTTVTRPGTVRSKKSPRREHDTWGIYAQNMMTINDYWQVLAGARYDEKREDSLTENQVSPKLGVIFHPTSNGSIYVQYSESFMPQGEVSNGSRIYINDGEKLDAERGISYEIGTKWELFDQRLFVSGAVFDITLENISLDVESGKDASNQLLHKKTQGGEQVHKGAELMAQGFVTPELSLTASAMYLDAELKKAERFEGNRPADVPEFSASLWSSYKVQDNTNLNLGLIYEGDRYGDAKNTFKKDGYARIDMGVSYKHKYDENLDIIARFNVENLFDTDYLAGGGSTNGDQKGASGVVVGEERNYMATIQFKY

SEQ ID NO: 6158 - protein, 349 aa, Vibrio sp.
MKMKTLAVAVAALACGSQAFAAEVYNSDGTSLSIGGHVSVGVGEYFEEEVKVHQVSPRINVAGKKDIGNGITIDAKGEWALNYLNGGSQSFSTRLGYIGATHQQFGRLVGGTQWSPYYDVAGVADLPIAFANDFLYDNHNNLGTGRAEKMISYRKSFEFGEGFAFNLGLGWQGENDDRGLSLQQNPNTGLPEYVSKGSKYDQRGQIALSGSVAGFGLGYVYSGGDVENSGLGTKTAESHLVSVNYGEYGSGLYAAVVYGMNEYFYEMREETTQIEGLLAYGVNNWTFSVNYEGVEDDKDNKTVSSETALQAEYAVTPAFVTFAGYQFDLGNDYNNEENDYWTLGARYYF

SEQ ID NO: 6159 - protein, 806 aa, Vibrio sp.
MASSPHTPLARALRIALLGLSVSLPIGSLAQAAPSHHVEVPAGSLEGALNAYARQAGVLLSFDPALTRGLSSRGLSGDYPIDVGFASLLGNTDLAAEASSDGSWRLVRATSQGAVTLQAQTISALGEENPLGPVGSYVAKRSVTATKTDTPIHETPQSISVVTRERMEAQGVQSVNEALRYTPGVSSYGANNRSDWYTVVRGFSPTTYLDGLQLPTTINLASWMVDPYMLERVEVLRGPAGVLYGQGDPGGVINQVSKRPSTVSSHEIQAQYGTDARRQLGFDSTGALDDEGVWSYRITAIGHEANIRDTPWEDKRQALSAALTWQPSEETRLTVMGNYLADDSNAQDNFLPAVGTLSHSPYGKIGRDTFTGDKHFSKYEKTQYSLGYEFETRLNDVWQLRQNLRYSHLDLNDNMVFGVGTTAYYGMEGGDERTLLRYAGIENPKYSRWAVDNQAQADFSTGDIRHTLLIGVDWQRQQTSDPQAYVLTTPVDLYGGTDYGPVDPSQFTPDTWSYSHQTSRQTGLYLQDQLHFDDHWVLTLGGRYDWATSQTRNWTDAGSDPEIHTRDEAFSGRVGLVYLADNGLAPYLSYSEGFTPNPGTDANNQPFEPTEAKQYEAGIKYQPPGSNSSLTAAVFEITQDNVLTTAPGNPNDKVQTGQVRSRGIELEGVASLSNELNLIATYTYQDVKVTKANDETDGKTPISIPTPRNLASVWADYTLHDGLLKGLGFGAGVRYTGRNPGAPDNSLNVPAYTLLDAAVHYETGPWRFAVNASNLADKEYVAGCYDATRCIYGNGRTVLGTATYRW

SEQ ID NO: 6160 - protein, 183 aa, Vibrio sp.
MSYKYAVACLLSALSVTAHAEPTKHIVGANLGYGDVSYDVNNGHDDGDMFLGDVYYRYMFDQNFGLEAGYKGAFNGIGSVLMSPISEITDVSYGGPRISGYVSYPLGAGFELYGKGGITYYTLSYTLKNNGQNKEYDESSLGGEAAAGVAWGYKHFGLNLEYNYAKNSDFDSGGVMFGAQMRF

SEQ ID NO: 6161 - protein, 325 aa, Vibrio sp.
MKKIAIAVATVLAGGVISNVALADTYIGGKVGYNSLNDACYLNEPCDDDSFATGMHIGYNFNEYVAAEYGVDYLGDFTANFKKPGLNTVDGDLWALTLAPKFNLPLTDSWNLFAKVGAAYMMAGDEKDFVPTGSLGAEYKINYNWSLRAEYQRYQDMSDDIIDDMDSDFFGIGFNYKFGSEPVVQEEAVEEVVETRPSTRIVEHVYPAQTATVQFGLESAEVKDASALSGTVDLMNTYPQAKVEITGYSDTTGSAQYNQQLTEKRAKAVANEFEAKGIAADRMTVKGMGEANPVASNETRQGREANRRVEVVVPAFEYQTTEQAQ

SEQ ID NO: 6162 - protein, 372 aa, Vibrio sp.
MFKKTSLALAVAGLAFAGNSMAAPSVNISGFVDLGLEYYSGDGTGLIAQGFNSPQSNTDERNLAMNNPVVSRFIVSGSEEHANGWTTGYRIEQEVNALDDGGASFNTRQGYISLSKDKHNITIGSQWSPLFEYSAWNSMKSEGHGYGAYYFTACELPGSLSCGFRNDSTINYTYGGGGYSTDPFTFTVAAHINEDGRVLEDVNGNPIKDADGNEQTMNDAGITGMSIGGAASFGPATVNFAYIQSIVTESDVAKANGGLAAPSLMSVGAKYRAAEELELGFNYQTVDKDDGTDDERTSMSFGGMYNVAPDLSVHAGYGFGEDDNGAELESNIYAQVIKNISDTFHVRLELEQVSTKNSGDDSVAVVYLRQSF

SEQ ID NO: 6163 - protein, 770 aa, Vibrio sp.
MKGSRADKHSHYRPPCRPSRLATHFVAEITVIANTNSLHLLYICKSLLFVTPDNNKESPVMAKRSVAPASISMLGLLVVPAVHAAAQTDTQSSLALPATAVTSVYEQQSYKASESRSAMKIDAPLRDIPQTVNVVPESVIKDQGAQSMEDVLKNVPGIGLSNGDGQRDQVTIRGFSAIGDMYIDGVRDDALYFRDLSNIERVEVIKGPAAVLYGRGSSGGLINSISKKPSFTPKREVGMNVDSEGKRRTQFDTGWADPQSNQAYRVTGAFEDSDTFRDDGYIDRKAIAPSAYFRLSDDLELNLGATYLYDKRLIDFGIPALGNRPVDVDRDKRFGSGDADQDYARSEVFSLTASLDYRINDNFTLTNTSRYYRYDLDRNNTLADSSPTRFVTAPDGELLIKLNRGNVARDEYGVFNQTELKQQAQLAGMQHNLLYGVEAGFQDKYQRVLSQTNVAQVPVYRDALVPVPEHAANLSSKGTNFQQTTGLYVQDMIELNAHWKALVGVRYDIFGQEYDDDRVQNIDLDRTDKTWSPRAGLVYQPDAIQSYYVSVSRSYQPSGEVFAVSPSNQHLEPEETTNYEIGAKWDLLDSRLSLTAAVFRLERTNMKTADPANPNLTVLAGEQRTDGFEATVSGHLTDKWQIYAGYAYLDAEITKSNSKTNGVANEGQTPTLTPRNSANVWLVRTLTPEWRVAAGANYVDERYTALDNVVVMPGYTTFDAALLYSVPQWDAALRLKNVFDRDYYASAHGSVDLITPGAPRTLEASFNYRF

SEQ ID NO: 6164 - protein, 711 aa, Vibrio sp.
MESPIRFHRSAVAIVVSALLAGHANATESVSQHETITVLGETYRNTATKTVLEPEETPQAITVITKDDMDLRGVNSVSEALRYAPGVNTELRGGAVSRLDLFNIRGFINYTNFYDGLPLLYNGWNLQPQVDSVALEQIEVFKGPTSVLYGNIPPGGMVNIIAKAPQSTPSHSVSISTGTNSLKELTFDTTGQIGDSNVDYRIVGLAKQRDGQADTSEDERYVLAPSFNWQATESTLVNVNVYYQNDPSAGIYTTVPASGSVIKNPLGSMSPSTYLGDEDWNTYEREVLMMGYKVQHDFNNNWQFLQNARYMTADAYQENTYNGALEADNRTVGRNAYLTDEKSKSFVIDNQLSGYVKTGNFEHNLLFGLDYQYLDSDVKYKDTLGYSLTQDIFNPDHNSIDRNALNFQYKQNLDIKTKQIGVYFQDQVRYDQLVMIAGLRWDKYDSNTDAVSDYLGAVSNSKEELDDTNVSFRVGGLYELDFGLSPYLTYSESFEPIAGADSSGKAFEPSTGHQWELGFKYAPLSGDISGNLALFHITKKNAILTDPNNPYAPNYQAGEVVSQGIELEAKWQATAQADFTLGYTYTDMEITEDSYYNQEGKTPVWVPEQTASLWANYFFEGNLSGLRTSAGVRYVGEAQIDAQNSQKVPDYTLFDLAASYDFSTVSESMKGASVTLSASNLFDKEYYSCYDKNNCWFGAERSIEAKLEYNF

SEQ ID NO: 6165 - protein, 740 aa, Vibrio sp.
MTRQFMLTPTSMAVVLALSTPNVLAQEDENIVVIGQQQDSAVGPDFSYLGAKSRAATKTDIAINETPRAVSVVTREQMDDRASISISDALQYTPSIQTNYFGEDNKQDWFIIRGFKQANSGLYQDGTRLYSSGFYSWQIDPFALERVEVLRGAASVLYGQNPPGGVINVVSKRPQFDGGSGLVSLEYGSEDRKQLSLDVNSEVSEQLAFRFQGLARKNGTRISGVEAERILLSPSMTYKFNETSEITFLTSYQKDDSDPYLQFLPVEGTLTPNKNGKISDSLAIGNPNWETFEREQVSLGYEFSHAFNDTTSFVQAARYSEMDVKLRQMYSYVYSADVPALGPALDPSNERKTILRGASTEDGSSDAFNIDNRLMHQVNWGSVEHNLMLGIDFQMISIDGKDFANDPIVANGNALLNTPMGALPDPRFNVFNPTYSDNIMLLDPNTLQPLSETDKQRTKIDNQQLGVYFQDHMLINDKWAMLLGARYDDTSNEVHNVTTGARTKVDNGEWTFSVGTAYISDSGFTPYFSYSQYFDPIIQEDSNGKSAKPESGDQFEIGMKYQPDSFDGYFNIATYRATKENLARIYLSELTQIGKIENNGVEFEAVANVTPSLTLIGNIAYVDAEIKQDINKAWVGKTPSQVANTVSSAWAHYRFFDGPLDGFAVGLGARYTGESYGDNEERLKVPSYFLMDATVSYRIGDYKLQVAAKNIADKKYIATCDGFCWYGDRQNVIASLTYDW

SEQ ID NO: 6166 - protein, 591 aa, Vibrio sp.
MKKYLTIFVLFLGTLFSYAQSTKPAKKNNKIDTVKTEVIEVVTTYNPEIADANKIKQNPTIKLLAKSKKKKLKYTIYSAPVASTFIPKSGVAKSIDVGVKERIYNNFLALGYGNFNSPYVETYLHNYTRFQSEFGLSAKYTASLDNIENTKLNSDFSNLNASIFYKKEERYFDWTITLKGERNTYNWYGIDEPTFTETAIGNIDESQTYNYFNLVGDIDFIDAYITNSQLSLAYFTDYYNSAEYKFNLNTNFDLPLDFLNSSFNNIQIKTGLEYLGGSFEREFTSTIAIDYSIFTAKINPEYNTKFGDFSLKLGFKFFTAFDTENEVNHFLVYPDIQIQKPILKDNLTVYAGVLGNLNTNTYKDFSSENPFLSPTQFITQTNEKYNAFLGFNGILNKSLSYNLSATFKDEEDKALFVKNYSKSNGANNGNNGILFRGYEYGNSFSVVYDDVQTISLAAEIEYDVSKQLSLSTQFQFNHYESTTETEAWNLPNLEASFSAKYKTNTWYANTNIFFVGERKDILYSGSSFNISGAQTLDSFVDVNLNGGYHFSDKFSAFVKLNNVLNNNYQRFSNFNVQGFQVLGGLTYKFDF

SEQ ID NO: 6167 - protein, 438 aa, Vibrio sp.
MKTNKTLLSTAVAFGLLSSANLANAAGFQLAEYSATGLGRAYAGEAAMADNASAQWRNPAMLTYLEGTQVSVGAIYVNPNIDVKGTTTLQHPATGQTVAVTDSASDDFAHDAVIPNLYISHRYNDQLAIGFALGTNYGMETDLGKDFAASHFGNEASVISKEANLNLAYQLNEQFSIGGGIRYIIAEGSFGATAPKTNILNLPQGTTLKYMEGDDTTWGWQVGSAWQINENHRVGFTYKSEVELKLEGHAEGVGFGFGTTIPKSRDNGYMYLTLPATAELASFHQLTEKIAMHASFNWTDWSSFEKLEAHMETAGTQMVKVENWEDNYRFAVGATYQLQPKLALRTGIAYDTSAVSDKNRTITIPETDRTWLSVGATYDWTQNFTLDAGFTYIIAKDAPIKESRGYESDDKAQAIGGQFVGETTGNVWLIGVQANYRF

SEQ ID NO: 6168 - protein, 159 aa, Vibrio sp.
MTQNTRLFKKTLLAVTVAFASGQSMAAGFQINAQSATGIGRAFAGDAVIADNAAVMARNPAAMALFDKMELSLGFESITSMIEVKDAKYNVNTPLGSSTVNVADTDDVGDTSIAPNIHLIVPVNDKFAWGVNAYSNFGTKTEFSDNYTATEYGGLTDVI

SEQ ID NO: 6169 - protein, 827 aa, Vibrio sp.
MYKNTTALSVAISLALGTAAVAPLAAQAEEQQVEQLQKMKVTGSRISTTDMEGPNPVDVYTADDIAKMGAVSVDDVLRGLTQNGAGSYGSSFTNSFAAGTSGVSLRGLGASRTLVLLNGRRVANYAFAQNLNDTFVDLNSIPLSAVERIDVLKDGASAIYGSDAIGGVVNVILKRDYEGFDVRLNGGQTSYSDGEDLDVTLTGGKTFNDATNIMASLNVVQKGNIMMKDRPNTKNADHSSQGGYDWRSSAGTPGRVYKEDGTWESLCPGGSAECNYNYNEEIAMIPESDRYNFLTSLNHQLNEDTNLFAELSLNRVESKTISAPTPDFQNVTISKDNPNNTYGEDVTMRHRILEAGNRINEITTDSIRIVAGAEGYANWFDTDVDWTADAGYHYTETENVGKNYLTIAGYQAAIDSGAYNPFVTNNPSSSLDGARVETKRKGESKLGFINAGASFPVFELSGGDAYVAVGGEFRYEGGSDTPDPLGEAGEIIGSGGTSSDGDRTVFAGYVELVAPVIEEVEVQLAGRAEHYSDFGSAFSPKVAVRYQPMDEVLFRASYSHGFKAPTLPEVNAGASTSYQTLYDPQTDTRGQYKVISQGNKDLDAETAQSFNIGTVIEPLEDLSVKVDYFYIVNDDKIDTLGAQKLIDENSPNVVRKANGDIDYILDEYVNVAKQQVSGIDSEVKYDLSTDSYGDFLVKLAGTYNIEYKQSDSDGNLEDYIGTYYGGPRFKGKATLGYGYEDFAFTNIVNYTHSYDTRYETAEHSEVDALTTWDTQLAYTGIENATVAVGIRNVTNELAPFYNEAEGYHFAFHDNTGRFYYLQLEYGF

SEQ ID NO: 6170 - protein, 274 aa, Vibrio sp.
MKRLIVVAIAGAISGSAVAQQAGDNVATLGWLHVMPQGSGGEFTSHVSNVPINGPLRLPDTFTSPGTGLSINNADTVGVTLTHFFTDHIAVTSVIGVPPEFALTGHGVIQPFGPSAALGNVDLGKPSNQPAVKNARQWSPALILQYYFNSATARFRPFIGVGIAYSWFTNIQLNDNFVQDVNNNLGSVLAAGAGKPGPTSVEAKASSSFVPIYNIGASYAITERWSLTATVSYMPLKTYASTIIKAADGSTLATTRTKLQADPLITFVGISYKF

SEQ ID NO: 6171 - protein, 589 aa, Vibrio sp.
VPLFDVDRLEVLPGPQGTLYGRSSLGGAINVSFKRPTREYETNVVGEAGNFGLFHGTIVQNLPIGDNIAIRGGLDYIRNTGYETSGADSKDDFAARLSALYEPNADFTAYVWGYYVTKNGNSPNLLTKGVDPVTGGFSPDTYLNSNPWNDLRSPQIMALPANPLLPLVRPFCPQTDYDNYTLGAQFDVKLGDELTLTYIPSYLDMDVSSDYFLGAYPGNKTDHFDQQTHELRLAGDGERLKWIVGAYAYRVHSHGTFFFDSLPISIVDTHRLQGVAAFGQATLSIADSFRLIAGGRFSYDDRIGTGRAGLALTPYAYARNFKRADFKLGVEYDAGPRTLLYATLQTGYQPGTFNAFPSSPAADNEVRSAKLTALHLGFKTRLFDNRLQINSEAFYYDYRDLFASAYNTVLNTNQTFNAAKVEIYGNQLDILFRPTSDDQLSLSVGYLHARNKSFDLPPGIVFPGMPTNYDGLQLQYAPDWTISAGYHHDFQLARGYIRAQAYSRFESSFFADFNHTPGGRQKPYTKTDASLTYFAENGRWNAGVWVKNIEDEPVQAGTAGGSNQPFVPIAASTFLEPPRTFGVRVGLNL

SEQ ID NO: 6172 - protein, 713 aa, Vibrio sp.
MKLTPVSAAVLSVLAASQVHAESKVFSMEEVVVTANKIEQPLSKVSGSIVVVTSDEIESRGETELYDALRNEPGVSVTGGAGRPQNITIRGMTGNRIMIVRDGIRSADGFGANDINDAVGRDTFDLSNFQSLQIIKGASSSVHGSGAIGGVVILESSQPGDFLKDKDFYTDVSVTYTDISHKYKGTSNLAFRSGDTESLLNVSYWQGQEARNFDEDLYNRDLDGYSGAYTFNHFFNEEVMLKAKAELYTQNQERLEGVASIQADGVWPIEDFAEDETTEEYSAYIGAEVTPINPTWFEELDTKVYWRHTEVVEDTNRLMHQVDHNGLITKRRELEHKTFIDETIGFRGDFTNKIYAANAVHQLAYGVELSTDYYERTDSDSKIDWNGVRPSTKKPFAPARAYNIGLYVRDMVELGKWTITGGLRFDAHSLTPDSQNEIQGFAVKDMDSSEISPSLSISREVFANNIVYLSYDHGYRAPEYDKAYGFVNHDFVPLTPFVIAPNLDLEAETSDSFEIGNKFDNGRAHVYVSVFYNKFENFIDIVTTDLDSSTGNYIKQYQNLNDVETYGAELSAGYGLTKQWDISTKFGYVDGKDTKGEYVRSITPFEGNVQLKYAHQDFNAYVAWNWAAAMDRVPKCQTTLGQATECAQTSAWNTFDIGATYHVSKDLRVSANIVNLFDKEYIRYQDVAGIAEKSKRYSTEPGRYFTLNAKYEF

SEQ ID NO: 6173 - protein, 326 aa, Vibrio sp.
MKLKTLAVAVALMASGSQVVASELYNQDGTSLEMGGRAEARLSMMDGKAEDRTRIRLNFLGKQEINENLYGVGFWEGEFVTETYDVFDSKGNKVGETDSLETRYAYAGLGGKYGEVTYGKNDGALVVLTDFTDIMAYHGNTAALKLPVSDRTDNMLSYKGQFEQLAVRASYRFADRTTDAQGFTDNEEDGFSLSGVYAFANTGFELGAGYADQNDSDEFMLVAAYSVGDFYFAGNYTGADMDVAGKTFDYKGYELAAAYTMGQTVFTSTFNKGELEDADTVENLAVDVTYYFKPNFRGYASYNFDLMDNEGAAEKDELALGLRYDF

SEQ ID NO: 6174 - protein, 372 aa, Vibrio sp.
MDLEKMMKNTLKVVLLTSMLPLAASASQELTPWYVGAGLGVNNYEHIATDNGDDNPYAWDIFAGYMFNDYFGAEIGYRDLGSADWTYAGIGNDADVKGATLGLVGVWPLGNRWSLSAEAGAMYYTLENNQRVGSVSTSYSENDFAPYFGAGVGYNFTDNLKLQAKYRRYENLDDNAGANAIVPVNADSNYWGLELSYRFGSPAAPVAAAVVAATPVDSDNDGVYDDKDQCPATPATHKVDSVGCTIYENVKKQEDVGSIQFANDSAVVKKEYYKDIERLANYLNKNPEFTVEIAGHASNVGKPDYNMTLSDKRADAVAKILVEKYGISQSRVTSNGYGITKPLVAGDTKEAHAANRRIEAIVTTTEKQPVLK

SEQ ID NO: 6175 - protein, 323 aa, Vibrio sp.
MKKAALTTAILTALVSAPSFAATVYKNDGTELKVGGRVEFRGDFIGSDGAEVEGSMEDQSRARLNLKGKTDIGNGMSAFGVYEAEQKTGKSEFKNRYMYAGVNTDVGAFSVGRQDMAAVIISDMTDITEFSGVQQVIDSSSDKQDSVFAYRGEFDALQLQATYQANSGDSQDKYGISGMYSLPMGLDLGLAYSGGDVDKSNSEDQILGGIAYSLDNLYLAGTYSQGSLTDSEDFTAYELVASYKVATKVTLAALYTAQENDPDNGSKYDSVEGIELVGYYKLNSNFRTYLSYYINQLDEVKDATSGLVTEGEDTLRLGVRYDF

SEQ ID NO: 6176 - protein, 614 aa, Vibrio sp.
MKKTLLALAVTSVYFPSFSIIAAEDNTQTDDVMVVTANRFEQPVTSVLAPFNIVTRQDIDNIQAKTLTEVISLLPGVQVTQNGGRGQSSSIFVRGANSDQVLVLVDGIRMARSVAGNVDFNQIPLTQVERIEFTRGARAAIYGSEAIGGVINIITLTGTDTPSKTKLDLGVGSHNYQEANASGAYNIGDKTVLQLAAGYESDDGYNVRPQPGLNDGDKHGFDSRNASLALHHQFSDQVSGYVATRWYKNQYQYDGSSIDTGHQYVRAETEFNDYSAGLKYAQNSYKSSLIFNYQKQDNFDYVDKTNEVNRQDQYHQRNVQWHNQYQLLSTLSVSGGIDWRQEQWNDLTGFAGNKERDNTGYYAIGLWDYSLVSIETSIRLDENQQYGTHSTYNIAGGWYLNDSIQLRGSYGTAFKAPNLYQLYVKSAWSTGNPNLNPETSKNIDVSLHADYDIGSFAVTAYQMRIDDLIAYTGGTPSYQNVAGESKIKGIEVEADFDTGFLSHQLNFDFKDPRNSKGQRLDRREKFSFKWVGTASIGDLDSALTYQYHGKRPDQYGPTGELAAYDTWDLALTYWLQPKLALKGRVANLLNEDYETVGGYQMPGRTYYTSINYLF

SEQ ID NO: 6177 - protein, 449 aa, Vibrio sp.
MLPIITKTPRIAACVIALLGLGLHATSSVAEPAGAPAADPPRALADWGVQFSATYIGETLADVSGGMRRGTIYAGRLDLGTTVDLDRLFGWHGATFHANLFQIHGNNLSRNYVGNLLLVSGIESLPATRLYEAWIEQSMLGGALSIKVGQQSADTEFVDSRYLDMFVNAALGWPGLTGVVLPSGGPSPPLAVPGVRIKARFGDKLTASVAVFDGDAAPPGPGDPQSRNPNGLLFRVHDPAWLIGQVKYGFGNGNGMPSGITAGAWYHFGTFDSQRFTAQGSSVADPAGSGLPARLRGDQGVFAVYEQPLSHSAADPAKGTGLVARVLASPSDRNLISFYVDAALLFTGFSPSRPDDKFGVAISYARISDAARALDRDVRRWSGIASPVRDFEAVIELTYLAQITGNFAVQPVIEYVMHPAGGATDPFDPAGTRRIRDAVVLGIRTTLSY

SEQ ID NO: 6178 - protein, 361 aa, Vibrio sp.
MKNLSKIVVANSLLTCAAAQAGGLYLYETTASDIGLASAGMAARAQDASVMAANPAGLANVSGKSFSGNLIGLYGDAQLDTMTGDAGNVIGFVPMASAFYSQQVNDKWTLGIGLYGNYGLGLEYEGLLNNHLDIPTATTQALTIQPSASYRINDHWSVGAALGIQYGMYEVETKGALNFNDEDQDTQVNGRVGVLYEATPGTRLGLSYSSETEFEFDNSNSIAPQQLIFSAYHEVNDDLAVMWNVNWQDWSEYTTTLGVETQDTYQIALGTQYKLNEKMMWNAGFAFDTSMYESQSNGDITVPTGKAYRIGTGIDYKLDSENSIGFAFEAILMESSETPRFQAGFDEPALYFMSMSYNWKN

SEQ ID NO: 6179 - protein, 265 aa, Vibrio sp.
MRKSLLALSLLAATSAPVMAADYSDGDIHKNDYKWMQFNLMGAFDELPGESSHDYLEMEFGGRSGIFDLYGYVDVFNLTSDPGSDKAGAEKIFMKFAPRMSLDAVTGKDLSFGPVQELYVATLIEWGGNSGVNSQKIGLGSDVMVPWFGKVGVNLYGTYDGNKKDWNGFQISTNWFKPFYFFENGSFISYQGYIDYQFGMDDAAGNKFGSTASNGGAMFNGIYWHSDRFAVGYGLKGYKDVYGIKDTDGFKSTGFGHYLAVTYKF

SEQ ID NO: 6180 - protein, 713 aa, Vibrio sp.
MKLSPVSAAVLSVLAAGFAHAETEPSHYEEVVVTANRIEQPLSEVAGSVAVLEGETLEKQGKTELYDVLNQEPGVSVTGGAGRPQNITIRGMTGNRIAIVRDGIQSADGYGAADINDKYGRNTFSLSNVKQIQVVKGASSTLYGSGAIGGVVIIESKAPEDYLYHRDYYVDAALTYSGISNRYQGNHALAMRHGDGEALLTIDYWQGEETRNFNQDLYNREVDGYNLGFTHHYWLNDALRLKTHLEYFDDYAKRREGTSSIQKDDKWDLVSFYEYQRSQTRLASVGADYTANLSWMDTLEGKLYWRSTENITQTNRLMANDRSGAGILSYRRELRDEGFNDEALGATLNAQKEWQQGEWLHQFAYGMSVDGHDYQRPKSIRRMESSGDDLQTDEPFAPAREYRFGVYGQDNLLLGDWTLAAGLRFDAQKLSPKNTDRIHGYKVVTMGSSEWSPSASISYQWHPEWNTYLSYNHGFRAPSYDKAYGASDHSFVPLTPFIIKPNNKLRAETSDSFELGSKYDNGQTQLYVAVFYSIFDNFIDVKQVGYDNATGSVIQQYQNIAGVKTYGAEMSVMHRLDDRWSVENKLGYVDGKDGENQYVRTLTPLEGSVQLNYQRERWDAYSRLNWASAMSRVPTCTTEQGKETECATTTGWVSWDIGLNYQWNAQLSASFNVVNLLDREYTRYQDVAGVTPSDTLYSTEPGRYFTVHAKYVF

SEQ ID NO: 6181 - protein, 469 aa, Vibrio sp.
MDKFFKVSALTAAMFGVVAVAPATASTESAAGGEYVEKVNEFMQDSSLNALFIVDTRSRTRTTGKPGGENGDRWSRLNYSSYNAILDFTSGYHDGWVGADVAAYYSGDLYNDSLYNSNEGYLCNEISTCNNLDWGAGDGQQLKVYKAALKFKANENFNARFGMLQAGGNGTIGNVWSFVPGTYRGFELNAKLGDFNLSYFGADQFTAPWLLHEDDYAPALWSDTSWSYLHSLGLNGNLTDSLFMQLGLGQATGVQYANGVDWGAGQVTSYHNETDNTSYKAYLKYTVSDRTTLAFDFYGVDDDVKYDGLGFHTGLSLNQSFGKLAWMSELRYTDTDNRADFVPRTIHTYGMNNGTWSQWWDALSDWNKAGELAWYNRLSYNQGNGWNYYLGFGYGTGADSAASGASGDWDYESEYAVNATVSYSLQSGALKGSTIRLHGTILERDEYAGAGDADETDLRLQVLIPYSFH

SEQ ID NO: 6182 - protein, 668 aa, Vibrio sp.
MESPACSSIKLSSLCLAVGMALANPVLAQESDSHFEEVVVWGTKVSSNTESMFADDMSLKQADHMSDLLRDIPGVDVGGTHSVNQRITIRGLGETDLDIRLDGASQHASMFHHIGNLTLNPDILKSADIQVGNNSVTQNGLGGSVYFETKDARDLLRYDETFGARVYGGFASNDNQQGSLTLYGLLSENVDAMVYGHYVTRDDFKDGNGDKTFGSAGDVYNILAKLGYEFNDIHRFELSYDMYRDSGDYSPRPDMAGSANNGLSSKLLIPTDYDRDTVTLSYELRGEKHQGNVTLYNTETEIKRDETVMAPRWPSNRLSKNTAKNQNLGLNAKFQSDFALAQFDNRVTYGFDYMDKTSSSYYGSSKFMDESAVSTALFVEDQFFFSDAFFITAGLRFDDYKRKAETGTSNFDDVTWALAAEWAVTQDWTLFASSRSLFKGPELMETFIAYQDVAYLDEGMKAETGQNTQGGLRFNKTLDKHFFGANVTVFQTNIDDYIADKYQDATQTYLIYNIGDVEIKGFEASASYGYDKFNSKLSYSQSDTKNKNTGGPVAGGNGRSIDMGDSIALTLDYQSDSLETIFGWTSMFVLEEDNVFDGQPAKDSYDVHNLYAQWVPSNVDGLSVTFGIDNIFDEVYTSHASRSGTVRGFTLDDYEPGRNFKLSAAYQF

SEQ ID NO: 6183 - protein, 215 aa, Vibrio sp.
MNKTLLALLVTCSVSVSAAPYVGLEYGLGTTDHDLEPHFSADNVTLNPELEDGIFSGFVGYAFNDNWALELGYSQFDLDDSRSKNLGIKPIDGKDYHHEMDWDASIKAKQVSLAPVFSYALNDKWTTKFKAGLTYTQYDAKVSKHQEYKLVANDDVEMTNTLFHSAEKNNEFGAMFSVGAEYQVFPKLTIGANAKYQLDSYANTASFNVGTTYYF

SEQ ID NO: 6184 - protein, 319 aa, Vibrio sp.
MKKLAAVISASLLMASAAQAEVYVGGKMGKSWLEDACVAGQSCDKDGSTLGAFVGYEFNDYIALEAGFDNVGDFDQTSFGGHVEAITLAPKFSLPITQDIALYGKVGGAYVMFDGKDDYSYLGAAGVEFNLSQNVTARAEYQTITDISNNVSKAAGNSATLGVSFKFGGNDEPVVVEEEPVVEEVVVEEVVEPVVVTKTFETQTIGTGSFDLNSTTLKPESASKLDNLVAFLNEHPQAKVEVVGYTDTSGAAAYNQKVSEKRAESVANALVEKGIDASRIQARGEGENNPIASNDTREGRQQNRRVEIVVPEFEYQVQQ

SEQ ID NO: 6185 - protein, 355 aa, Vibrio sp.
MSYLHLWITFLFISFSQCSYATAELPTSTQSNINTEFSNSTLLPDNGDYWYVGTKLGLSVYQYGCEEWSIDCDRTDLGGGFFVGYQINESWGIELGKTFLGAAKAEYFSRKVTGDMETIDLFGKYTYGLTDRFGFFGKAGLANWNGKTKSDYVETTTFGHDLSVGFGAQYALNKRWLTQLEYQYINSIGDDTVGESDYHLMSIGIIYRFGFHELKQPFSCPIPNERQIITAYVDDELFDSNSTTITKPELLDPFIARLHYYSESTLSIIGHTDAIGSEAYNQSLSEKRAESVAKYFIKSGISNNRISTQGRGEKDPIAPNNTQNGRYLNRRVELRSNSFLYIPNKKLITQHQENN

SEQ ID NO: 6186 - protein, 230 aa, Vibrio sp.
MKNIFALSALSLAFASSAFAGSSYVTGNVQFHDDGRIHGSDVTSTLEAGHTFDNQFGGFTVYTEFDGIQLGKLETENGGAGNTTPAITVGGEQSFNITDHLWVAAGYQHLFSAGENVQYRPLVKIGYNFDNGISLSNRTRAHIDATDADADTDYRMDNRIGYVMNEDVTLSYNNVYMIEAETMDHEFRATWTRKGVQPYFELRSQAHGAENASGDSLVNNAFVFGASYGF

SEQ ID NO: 6187 - protein, 652 aa, Vibrio sp.
MSTLRLPVITATGILAFVSVPHVFANDAVSKMETVVVTASSYEQSQADAPASISVISREELDSRYYRDVTDALKSVPGVVVTGGGDTTDISIRGMGSKYTLILVDGKRQSTRETRPNSDGPGIEQGWLPPLQAIERIEVIRGPMSTLYGSDAIGGVINVITRKDALEWTGNVQLGTVLQENSRSGGEQSANFFVNGPLAENLSLQVYGQYTTREEDDIEYGYEDKDMQSISSKLTYQINERHSVQLEGGTSAQSRRGNVGLSVPTTGCRGGCEDSLNEYRRNYVTVSHNGDWDSIGISDTYLQREESENKSREMTITNTTFKSSLVTGIGNHTLTTGVDATHAELEDFTSNKASSKTETSNTQWAVFIEDEWRIADPFSVTLGGRLDHDENYGAHFSPRVYGVWRVDPSWTVKGGVATGFRSPQLREITPGWAQVSGGGNIYGNPDLDPETSLNKEISVLYQGDSGLDVSLTAFHNEFKDKITRVVCPDTICTDGPNQWGADPTYRINVDEAVTQGIEATLASPLTETIYLSSSYTFTDSEQKTGEYKGMPLQQLPKHLFNVDVTWQTTTDLESWAKVTYRGKEMDPVTGPSRNSIVEPAYTFVDAGVTYQLTDNTRIKGAIYNLLDEEISYEEYGYIEDGRRYWLGLDVAF

SEQ ID NO: 6188 - protein, 779 aa, Stenotrophomonas maltophilia
MSRKKTCQIAPLSLRSPKVNTNKTLLALSVPGMLMSPFAMAQEDEPIVLDTMQIEERTVDTNPYAQAGAPYKAQVSGDSRHVKELADTPQTISVLTQTQIQESGRTDLKDILAAQPGITLGTGENGNAFGDRYIIRGHEARSDVFVDGLRDPGMTTRESFATEQVEITKGPSSTFAGRGSTGGAVNSITKQASTEYDFSKLEAGLGTEDYRRIALDSNKRINDDLAVRANILHSYKEIPDRGPADQERNGLALSVDYKATDKLKLTADYYYLKAEDTPDLGTYIVAGGGKPVADLPVYSQDGQDFLESEINTFTLRAQYEIDSDTRVENLMRYGTTDNGYVTTGARGTNRDASDPDAPSAATVSLSTHQGWQEVDYFADQLNVYLTRDLGGLKHNFVVSAEYSALDVDNGVYNVTNTGDTNCVTSGRGGASAGFCIVDANGNYIDNINSVTGRSIEKGAQDSDYSIDTVSVSIMDTVDINEFWSVFAGVRADSFDYDNVVTSRGVATAYDYSDTLWNGHVGVVYNINEDANVYLTYSTSSNINGGESDLGGNCGYGGICGDPQQVTDSKPEDTENFELGTKWNVYNDKLLLTAAIFQITKDDVMESIGDDDYASIGTLNTGKNRVKGAEFSVVGNITEDLSTQFGVTFMDAEVLESFDTDSVGLTLSNFADNSAFWQLRYQASDAFSFGGTMTYSSEMYAGQPDSAAGYNTGIDDYSYKVPSYTSFDVFATYAFSEQLNLRLNVANVTDKDYYLAAYRSGAFTYIGAARNAKLTLTYEF

SEQ ID NO: 6189 - protein, 147 aa, Wolbachia endosymbiont of Culex pipiens
GPISDEETSYYVRLQYNGEVLPFKTRIDGIEYKKGTEVHDPLKASFMAGGAAFGYKMDDIRVDVEGLYSQLNKNDVSGATFTPTTVANSVAAFSGLVNVYYDIAIEDMPIAPYVGVGVGAAYISNPSEASAVKDQKGFGFAYQAKAG

SEQ ID NO: 6190 - protein, 1081 aa, Pandoraea pnomenusa
MRRLTFLLLCLFIGIGVATAQTMKITGNVISSEDQQPVIGAAVVVKGTTIGTVTDFEGNFSLDVPRDAKMIFISYVGLKTKEVPVASVINVVLDSDSKALDEVVVTAMGLTREKKALGYALQEVKSDELTKAGQQSLATSLSGKIAGVQITSQGGQVGASQNIVVRGNSSFGNNQPLIVVDGVPIANDNAKGATVNLGSGLNDINPEDIESISVLKGGSAALYGMRAGNGVILVTTKSGKKDKGVSISYEGDITIDRVYNLPRLQNKYGQGYYASEYDWKEAQAGGYSGDYQAFALENGYNYVDGMGSGINDNADESWGPRLDIGLNLPQYNSPVIDGVRQATPWVSCPDNIKNFFQTGYSMNHTVALSASTDKTSTRASLSFRDQSGTTPNTDQKRYAMAVNTKMTFNKYIDFDLSANYIRTKSANLPGTGYNSTNALQSIMQWFGRQVDLKDLKNNWDQVDEYGKYTHYNWIQSFHANPYWTLNKNTNSYDRNRFYGKTSLYIKPTDWLKFEGRMGLDHYDSNQFSRILWNIDYPNGYFRSFDRSMTEFNADFIAYVNKNFGDWALNGLAGANYRDYQTAIMGTGADELTAEGLFTVANAHGTPYTLNDHEKRRSNSVYANASIGYKNMAYAEVSVRNDWDSTIKDAFFYPSFSGSWILTETFPGLQNGDYLNFLKLRGGWAKIGSATDPYRSNAYYSLISSSFNGTTLFYNPTILPPTNLRPESVKTWEVGVEANLFNNRLHIDAAYYNKVTSDQIMNANVATSTGYTSMYINAGKISNKGVELQVSGDIIKNPKGFNWTATLNWAKDKSRIDELYTDPVTGQSLDAYQIGSSWSVKNYAMVGKSWGTLVGTGYVYNEDGSILVEDGIPVYEAGKEIGDVTPKWLAGFSNEFSYKDWSFGFLLDFRLGGDIYSVTQAFGSQTGILKHTAEGDLRENGVVLGQNYMTDKVFKTADGKINDVAVNAEDFFYNYYTICEMSVFDGSYLKLREAHLTYNFPKSILEKTKCIKAAHVSLVGTNLALLWVHKSNIAHIDPESTSTGGDDPETAATSRGFNSGVGFESNSYPPSRSFGLKLGVTF

SEQ ID NO: 6191 - protein, 223 aa, Escherichia coli
MNKAVALILAGTAMATASPALAQTVQNDSPFTGARVQAVTGYDNIKAGSSVDDDGNPNNDQSAEGVIYGAAVGYDVDLGPVVIGPEAEFAWSTADTDFDNGDFEGFGFGNVSADRDLYLGARVGAKIGDQALAYVKGGYTNAKLNIRSNDGTTKFDTDYDLDGYRVGGGLEYAINRNMFVNAEYRYSNYSRAEVDFDGTLPDSDRFDVDLDRHQVSVGLGVRF

SEQ ID NO: 6192 - protein, 196 aa, Wolbachia endosymbiont of Pristophera geniculata
SDEETSYYVRLQYNGEILPLFTKIDGIDYKKGTDIYSPLKASFIAGGGAFGYKMDDIRVDVEGVYSYLNKNDVKDVVFTPVDTIANSLTAISGLVNVYYDIAIEDMPITPYVGVGVGAAYISTPLATAVNGQNSKFGFAGQVKAGVSYDVTPEVKLYAGARYFGSYGANFDTSTGGKDKGGHTVLYSTVGAEAGVA

SEQ ID NO: 6193 - protein, 282 aa, Anaplasma phagocytophilum
MNYRELFTGGLSAATVCACSLLVSGPVVASPMSHEVASEGGVMGGSFYVGAAYSPAFPSVTSFDMRESSKETSYVRGYGKSIATIDVSVPANFSKSGYNFAFSKNLITSFDGAVGYSLGGARVELEASYRRFATLADGQYAKSGAESLAAITRDANITETNYFVVKIDEITNTSVMLNGCYDVLHTDLPVSLYVCAGIGASFVDISKQVTTKLAYRGKVGISYQFTPEISLVAGGFYHGLFDESYKDIPAHNSVKFSGEAKASVKAHIADYGFNLGARFLFS

SEQ ID NO: 6194 - protein, 320 aa, Helicobacter cetorum
MNTNLKKALFLTTLGYLQANEGFLAIMPDENKQEDISQEQKLEHKMEQKIAPQNTLKKQQSAPLQSAELLQSQVKREVKEQKKSQKHLVAMQTKNGFFLGSEIAITGTSLKQSLSFISNTTDDLLTYSKTSKNANFNMGLLIGYQHYFGASKRHGIKISSHLYGGTPSDVSTDIKIYKSKVSANYTPLNFGIDVKYLFDFLNVIKKNRHTLGLSVGFGWRMQYYFAKIDPIKTSHSEFITNKPKDIFNHGFYPTIGLHYYLNHHQFEVNYRFGGAINYQSVVPSKIVVQNGNFKGEVLFSNFLTEATNSSYIAFNYAYLF

SEQ ID NO: 6195 - protein, 157 aa, Salmonella typhimurium
AADRTSNNLLYTGNFGGLTVKANYVANGKTNDDANNTTGFSVAGMYDFNNGLAMGLGYGQQKNQQGTTPINTVVSNISNDLNANQTFASVSYTMGDLYLAGLYQYARNVGYLYNHQDNKNTDYQGFSLATAYTLNQLVLRSTYNYMEDTDQNVKMAN

SEQ ID NO: 6196 - protein, 342 aa, Pasteurella multocida
MKKTIVALAVAAVAATSANAATVYNQDGTKVDVNGSVRLILKKEKNERGDLVDNGSRVSFKASHDLGEGLSALAYAELRFSTKEKVEVKDTNQQVVRKYEVERIGNDVHVKRLYAGFAYEGLGTLTFGNQLTIGDDVGVSDYTYFLGGINNLLSSGEKAINFKSAKFNGFTFGAAYVFSADADKPAPRDGRCFVVACLYNRKMGDVGFALEAGYSQKYVTAAAKQEKEKAFMVGTELSYAGLALGVDYAQSKVTNVEGKKRALEVGLNYDLNDKAKVYTDLIWAKKGPKGATTRDRSIILGAGYKLHKQVETFVEGGWGREKDANGVTTKDNVVGVGLRVHF

SEQ ID NO: 6197 - protein, 185 aa, Xylella fastidiosa
NFPDKRRLTNDAPFFALGIGKFINPVWSIDGTLNYQNPQFKRNKDLNWSQYGFSVDFRRHFIQDNRGWNPYLLLGAGYQRSEEEFDNTPNVNSPGERKKGGFAAKVGAGLQTTFRSRVAVRAEVAYRGDHDKDSVRQPVAGVAAPSSKKWFGDTLASIGVVIPFGPAASSPTPPPAPPAPTPPPP

SEQ ID NO: 6198 - protein, 185 aa, Xylella fastidiosa
NFPDKRRLTNDAPFFALGIGKFINPVWSIDGTLNYQNPQFKSNKDLNWSQYGFSVDFRRHFIQDNRGWNPYLLLGAGYQRSEEEFDNTPNVNSPGERKKGGFAAKVGAGLQTTFRSRVAVRAEVAYRGDHDKDSVRQPVAGVAAPSSKKWFGDTLASIGVVIPFGPAASSPTPPPAPPAPTPPPP

SEQ ID NO: 6199 - protein, 129 aa, Xylella fastidiosa
NEIAESGAYFSAEYLGPRDWQVWGFDAGLGVAGHIHETGDVFFGGGLQAQRDIGRGWFIEASLMPGLYFENEARNDLGSNFEIRSLIGIGRDLRGGKRLSLALTHMSNASLARENPGLNTITLRLHMPL

SEQ ID NO: 6200 - protein, 754 aa, Bacteroides ovatus ATCC 8483
MRFGLIATLLWSCLFPALACAQNAEITGHVVDTQGRPIAGAAVFLAERNLRTATDATGHFTFAAESSTPAEVRVEVPGFAPQTAQVTPGNDAEIALVPATVAQNISVTATRSSLSEDVTASSVRVLPSEQLADTAAITLDDKLRQVPGFELFRRSSSRVSNPTSQGVSLRGLGSTAASRTLVLADLIPVNDPFGGWIHWDETPQLLVQQVEVVRGGGSDLYGSSAIGGVMDIVEHPPTLAAGQLDLGYGQQNTPTSSLIESLSHGEWHGLFAGDFVRTDGYTLIAPDQRGEVDTPSNVHYQNANAQIERTFGSRGSAFLDGNFLNEARSNGTFVQNNATRLWRYSTGLDWAVTNTSSFKLRAFGATEHYRQSFSSVAPDRDSETLTRLQHVPTGELGFNGQWLQSFGAHFTLLAGADFLDVRAMDYEQTFFGHPTGYIDTTGRQRDTGVYGEGIFQYNNWTITGSLRFDHFVNLDAQQWIRAKGALTTTPIADRTENVPDPRLGVVRRLTNNIALTATAFRAFRSPTMNELYRTGQVGQQITIANPQLRSERATGWEAGVQIAAPSRNTAVRASYFWTEVNRPVVAVTQSVNGNSITLLRENAGQIRSRGLALDGDWMLRPWLFFSGGYQYADASVTRFDQTPALIGNWIPQVPHNTGTVQATLNKKQFGTLSIQVRGSGQQFDDDRNTFLLHSFFRTDLFAAHDFGRHFQVFLSTENLFDRTIEVGRTPVLTLGTPRLVQGGLKIFWANADRS

SEQ ID NO: 6201 - protein, 451 aa, Bacteroides ovatus ATCC 8483
MSLSAAYANAAAFQLAEVSSSGLGRAYAGEAAIADNAAVVATNPALMSLFKANQFSIGGVYVQSRININGEVNVNVGKGVVQVAEEKADQKKVVPGALVPNLYFVAPINDKFAIGAGMNVNFGLQSKYKKDYDAGVFGGTTELNSINLNLSGSYRISKGLSIGAGLNAVYAKAKIERHAGVLDKAIDTIADYNGMVGGIKIPSLQVLVPIFSKLKNGVNTDTLLTQLQDNNAWGFGWNIGAVYEFNQGNRIGIAYHSKVDINFKDDDALSYQFEAVNIIPVKEKGGLTLHLPDYFEISGFHQLTAKFAMHYSYKYTKWSRLQSLHATYDNGKVAFHKDEKFHDSSRVALGATYNVNDKLTLRAGIAYDESADHPSASIPDTDRTWYSLGATYNFTPNLSVDVGFAHLRGKKQQFKEKHKIGSTGVEFGSIDANYKSTARANLYGLNLNYRF

SEQ ID NO: 6202 - protein, 769 aa, Bacteroides ovatus ATCC 8483
MRKQLCEDGVEGFQQRGPLVSAIGLAMFSCGEAGLAAEVAREREDSVELDSFSVLGEKDDGYKVDRTSSPKHTAPLLDTPQTISVIPETLYREQGARNLTEVLRNTPGISFNAGENGFSTSSNNFSLRGFDTSGNIFIDDSRDSGSYTRDVFNIEQVEVVKGPAADNGRGGAGGYVNMVTKVPTLERSIGGVATYGFDQYQSEARKRTTLDLNQPLADTVAMRLNLLWEDSGIPGREHAEKNSWGLAPSLAFGLGTDTRAIFFYEHLEQNDRPDWGVPGATVRYMDRHDPGAGSGDRDEFYGLDSDYDDTTSYSFMARFEHDLRDGLSLSNQTRWSRVSRDARYTVPTGYVPATRQATTQTQFYDRDNYTFSNLTNLSARFLTGSIKHNLAAGLEFTLEKSESKGYPTVNGGNTPINEPDYNRTGSATPSKANDSKVKIDTVALYAYDTAEFNERWQLTGGVRLEHYRVRIDSKLANGTRMAIDGYDDSEFTVGGKLGLVYKPAKNGSIYAAFGVSHQPPGSYLSNPDISRPDANVFPGFVEGADPVVSYSYEIGTKWDFFKDRLSTAAALFYTEKKDVPITGRDAGETQDSHKGDGKQVVYGLELSATGKLTENWSVFGGLMLMESERRHSTRMDQVRRNANPADYGSHSRTDGDDLAFTPEVSASLWTTYRLPFGLTVGGGLQHVGSSYLGRPDDANRIIANGLYGKLPSYTIYNLMASYDINQNIGIRMNVDNLTNEEYPVSSNWNGTRVAWGSPRLVQVSTDFRF

SEQ ID NO: 6203 - protein, 307 aa, Bacteroides ovatus ATCC 8483
MTIIATAIGGELADFVDTLNPLDSDGQGALSAFGLRNPIYRQITRFVNPNFSAAGAGFSADITDQISFAGGYLVPLYSASNPLPQVGQPAPIPSGGGLTAGDYAAIAQLTFRPLKSLGFGLTYVRSYTQSPFFGMSFAGYTGSTRAQTGLSSFLSPAAVVPTSANSGGFEFSWNAHRRVIVSGWVGASFTEAEDNGGFTVDNEGFFRPINRGDTSTVLNYALTFAFPDLFLKGSMGGLVLGSQPQVIASSINNNTDPDMNFHVEGFYRLQVNDNISITPGVFAVFNPEGNSQNDTVVVGTIRTTFTF

SEQ ID NO: 6204 - protein, 1096 aa, Bacteroides ovatus ATCC 8483
MLQMYKEIAGRVLQKQVFLTFLVLLMMQTSAFGQKDSKITIQQKNMTVIEALKSVERQTKMSINYSDSQLKSKKLTNLNLKNALITTALDTILKGTGFTYQIRDNYVIVTEQKSVAPSVVKNIRGKVVDENGEPLIGVNISVEGSSTGTITDMNGSFMIKASDKSKLKISYIGYATQMIAVSNKDFYQVVLKQDAEVLDEVVVTALGIKRAEKALSYNVQQVKGDELTTVKDANFISSLNGKVAGVTINSSNSTGGASRVVMRGVKSITSSNLALYVIDGVPMYNMMNGGNSQSVFADQPGTDGAADINPEDIESISMLTGPSAAALYGNAAAAGVVLITTKKGSVDKTSVTVSNNTTFSKVAMMPEMQSKYGNVAGNVDSWGPIVNSDYDPRDFFRTGSNVINSVALSTGNQKNQSYLSASTTNTTNILPNSGYNRYNFTVRNTTSFLKDKMTLDAGASYILQNDKNMVSQGYYYNPLPGLYRFPRSENFEDVRMFERYNEGLGIMEQYWPYGEISSGLANPYWVQNRQIRENKKTRYMVNASLKYQIFDWLDVTGRVKIDNYENRKTYKAYASTGSLSAGDRGTYHDTWAQSKTTYADAIATVNKNFSDWSVNVNLGVSLNDSRYESIGYEGGLKIYNFFAVHNLDFDKAWKPKQEGWHDQTRAIFANAELGWKSMLYLTVTGRNDWDSRLAFSDYKSFFYPSVGLSAILTSMFDTPEWLSFLKVRGSYTEVGNSYDRFMTTVTYPYDEASHNWNTTSVYPNTKLKPERTKSWEVGVDARFLNDISFNLTYYRSNTYNQTFHATLSASSGYSSIPIQSGNIMNEGIEMSLGYDKKWGDFSFNTNYTLTWNRNEIKQLADGAYNYATGEPIVMPELDVLHYGQLDARLLLRVGGSMGDVYGQKVLKRDLNGYILNEEGVGLALENKETHLGSILPKMNMGWNLGFGYKGINLGMTFTGRFGGIVLSETQSVLNAAGVSKISADVRDAGGVPINQAKIDARNYFQTIQTASVYYTYSATNVRLGELSLSYTLPKKWFANKLGMTVGLVGKNLWMIYCKAPFDPELTTSAASNFYQGFDAYMLPSTRNFGFNVKFQF

SEQ ID NO: 6205 - protein, 738 aa, Bacteroides ovatus ATCC 8483
MKYMLLTGLLLGSLTVQAQVSGTVKDQAGEPIIGANVFWKNIPGGVATREDGTFSISKPDKSNHLIVSFIGYENDTIQVNDKKAVLDVVLREGMELSEVQIVSRKLSTLKLRSSVMNEEIITSDELCRAACCNLGESFVTNPSVDVSYSDAATGAKQIKLLGLSGTYVQMLTENIPNYRGAASPYGLGYVPGPWMHSIQVSKGISSVKNGYEALTGQINVEFKKPQLPEADWVSANLFASTTNRYEANADATVKLSKRWSTSLLAHYENETKAHDGNDDGFADIPRIEQYNFWNRWAYMGDHYVFQAGIKALDESRKGGQVSHSGVPAADRYEIDIDTRRYEAFTKNAYIFNKEKNTNLALILSGTLHNQDALYGRKIYNVDQSNAYASLMFETEFTKEHNLSAGFSYNYDGYDQHYRLTNNAETPLTKAFARESVGGAYAQYTFNLDNKFVLMAGLRGDHSSEYGFFVTPRAHIKYNPNDFVHFRLSAGKGYRTNHVLAENNYLMASSRKVSIADHLDQEEAWNYGASISGYIPLFGKTLNLNLEYYYTDFLKQVVVDMDTNPHEVAFYNLDGRSYSQVFQVEATYPFFQGFSLTAAYRWTDAKTTYNHQLMEKPLTGKYKGLVTASYQTPLGLWQFDATWQMNGGGRMPNPYTLADGTSSWDARYKGFSQLSAQVTRYFRRWSIYIGGENLTNFKQKNPIIDAADPWGDRFDSTMIWGPVHGAKGYIGVRFNLARD

SEQ ID NO: 6206 - protein, 765 aa, Bacteroides ovatus ATCC 8483
MKYIIFCAALCLASIHSFAQTIHGTISDQESGEVIPFATIYNMQQKTGVTTNTLGQFSIIANIQADSLTISCIGYQAITVLARNPLNIQLTPNALTLNEVVVSVNREHERRTEAPVAISSISSKTIEENKPTTIDQVLNQVPGVNMVALGSEQHTMSIRRPIDFGASYLYLEDGVPIRTSGVFNHNALLEINMANTSRIEIIRGPASSMYGSEAIGGAVNFISRKSSALFTAGISVQGNDIGYKRTDFYASNSFGKKLGVRVSGYYADQRDGVVSHSDFDKLALSLSATYSISKNTELVWSNTLIDYYAQMSGSLDSTNFYSKTYTSNHTFTNRQVDAFRTKLALNHYWNDQAKSTVTGYYRNNSVKQNPSYRVRDDFRPWIPSGNPRLAHGEVNDNSFNSYGLIMQHKQDFSWLNSSLIVGGSFDYSPNTYQAHYIQVNKNDEGVYDSFTKTDSLLADYGANLTNVAAYAQIKLSPLKGLNIIGALRYDQFNYSFDNHLGANAFTAVLDGKNTFSQFTPKIGLTYDFKNNRGIYVNYSQGFVPPQVTELYRGNEVPTLKPVYYNNLELGGWVTFANEKAKLDVSVYKMDGFNEIISVLQDDGSTIRQNAGETTHQGVEYGLNFFPHPDLKFRLSGTNALHKFIDFNESGEDFSGNKMPQAPEWIANAQVTYTPRFFKGFRVSLEWQHIDEYFMDQRNTKTYRGHDILNVRVGYTRKSFEIWANLLNTTNELYSTVARATAWGQSYSLGRPRNINIGIAYKFQQK

SEQ ID NO: 6207 - protein, 481 aa, Bacteroides ovatus ATCC 8483
MMAKITSIRSFALLIFLVLPTLSVPLPVCAEKLILYMDTVTKQLYAEPGENRIKLGVFQQVEETVSKSSAEEKSRPDESPTRHAETRSAQDSEQRVETQSKQTNEQIKHASRTPVPSAEKPKEEKKWYERISIKGYTQFRYGKSLWGDNDGASYWQDKSAGPDKSSFLIKRARLALSGDITDYLYFYLQADLASSAILRDAYGDLFFDKGKEYRVRVGQSKIPLGFESLQSSSERLALDRTDAMDCCNERDIGAFFMWTPTHVQERFKAAKKLKGTGDYGMFSFGTFGGQGPNNVDLNNGVHIVGRLTYPFQFGNGQLIEVGASAYHGRYVPKYDKTKITDVPEKGIRDERVGVHAILYPQPFGLQAEWNWGNGPSLSDDKKTIANHSLNGGYVQAMYKYDGFRWGTLLPFVKWQRYNGALRLQDNTPQDRVRDWEFGVEWQISPAVELTTVYHMMNRTDLKYDKQFKSDVVRFQVQWNYF

SEQ ID NO: 6208 - protein, 708 aa, Bacteroides ovatus ATCC 8483
MSTKTLSAITLALTFNASSYAFADTSNEQDVEQLDTMVVTASRIKQQAEKIPGAVTVITAKEIEQQKAVSDDLTSIIATMVPSMTPSRQKMSNQGESLRGRNALILVDGVPQNNPLRNGNRYGYTIDPSMVEKIEVIAGASAAQGMGATGGIINYVTKSAKPGDHWKQTIGTRVTTNLHDDGTGGKVYYALSQFDNIYDFYLSGSWDRQGLYYDGNNNPVGMNSIQGETQDSTASDIYFKGGYNFGDDLDQRIEMTVNRYDIGSNDNYVAIKGDFDQGIPGTVEKGHPVGDSVRNEVALYNLKYEHNDFANGILTAQVFYQNYDAVFGDANWGATSTVQNDQGIISSDKSGFKLSYERYDLLDLDDSWVFGLDGLQDKTVQKLVHTDLNVTPNMEYQSLAPFIQADFLATEDLRLSMGARYETMRVKSSDAKTLWGYGYNDVIGGTNDYSETVFNLGAIYSLTDQVNLFAAFNQGFGLPDYGRVLRGNWGDDPAVNKPIDFNDLASAKPVVTDNYEIGANYTGEKLKLSASTYLSIAKNGANLVLRGDNYDVDRQKTQIFGYELSSHYQLFDDTALQLMYSHVEGRVDTNEDGHLDSDMDLKNLTPDRILLAVDQRVNDKLSGRLQYNYLFDATKEDNAVGQAQHFDGYGLTDLSARYDLGKQGRVSLGIENIFNKQYVNYFSQIRASDDYYFSGRGRTFSLNYELDF

SEQ ID NO: 6209 - protein, 378 aa, Bacteroides ovatus ATCC 8483 [sequence omitted]

SEQ ID NO: 6210 - protein, 1009 aa, Bacteroides ovatus ATCC 8483
MKNNRKQRGAYNEVSFRMVFLLVFLMTTVTGFAQNKTVSGIVVDKAGEAVIGASVLVKGTSNGTITDFDGKFTLSNVPEKGIITITYIGYEGQDISIAGKNTLKVILAEDTETLDEVVVVGYGTQKKTDLTGSVMSVKSEDITSVTANNPVQALQGRVTGVSVVTDSRPGKSPTLRIRGNGSISAGNDPLYVVDGFPLMNGSLNEINANDIASMEVLKDASATAIYGSRGSNGVIMITTKTGAKDSKSLTLNANYGFQMPGRLVETMNHEQFVDFINSAYMNSKGITIYNDENPAPNIHTDWQRETIKSSSPVQDYSISLNGTSGDTQYMMSGGVYLQDGLLSNYDYNKYTFRTNLQHKFNNFIKLGTHMQYTYSEGGLATTTNYDGALTELWRYGWPTLPVYREDGSYAIPNDNPAISSYFDSGIKWNAVNYYNEVKRESSVSRLFGDIYAEFQLAKGLTFKTNFGLDIANTRDYNYITSDYTLSTGTGQGGNGYSKKISRITENILTYTNTWGKHRLTATGVYSWQNYIYEDLSIDGKGFANDETGAWDISQASRETVDYGSDKYQNSLVSWTGRVSYAYNDRYLLTATARYDGSSRFGANNKWGFFPSVGLAWRASQEAFLIDNKYITNLKLRASFGVTGNQEIGNYKSLAQLNADNYIYNDGELQGYYESIGNPDLKWERANQFDIGIDLSLWNRLHITADYYYRKTSDLLYQVPIPSTSGFSSMLSNVGSVLNKGYELSITGNIVNTNDFKIDATINLSRNINKVKELYNNVESITLSSGLGLSRYLKVGESLNSRYALLSDGIIRTEEQLKKYRKIEGTAKLGDEMYKDLDGDNQITAKDQVNIGTTDPKLIYGIGLNVQYKKFSLNILGNGAHDFVGGTSYLQIAENQINSSVICMPSLYAYERMWSESNPSGTYPAPGASNVHESDRINSGWNYFVVKSIALSYDFGKNPIKGIKGIKSLSATVNFQNFITFSNQRGYNPENGDIKYPWVKIVNIGVNAKF

SEQ ID NO: 6211 - protein, 716 aa, Bacteroides ovatus ATCC 8483
MVQEESIKARSTVTKEALDKQTATGNAIDKLKYTPGLNISSEDATGLSGFRFTMRGLNSDQVGMSVDGMPINDSGNYALYSNLLGDPENIDQIFVTQGSAESDGPHIGSSGGNIGIVTIRPTKETGAFVKQSAGSNGTYKTFARLNTGEINGLSNWLSMSHTEGQKWRGDGAVRADKVEWNSFFDMGSGNTANLILKYHEQDNNSYSQLTKSQFQQNGRKFDPYPSTPARGSNGKLSSYYELAQNPFQTFTAVLNTQFKLADNLALSVIPYYFWGNGSGVNSSSYALNRGSNQNGVFDLSNLPTAAAYNADGSSTTGVYYRPSRTQTWRPGITTKLNWDVNDEHSVQVGYWYERARQLQTQPFIRLKSNGKPESIWPDSDYMVDANGNEIQGRDRYTVTPAQKVWAQDTWYFAPDWTLIGGLAYMNVEREGNNHGSLTERPEKRDQTYNKLLPNVGLKYQLDERDQLFYSLSRNMRIPQNYVLYDPGTGSINSKPETSWNHELGWRFTEQDMTLAATLFYMQFKDRQVSSRDINGDFADINAGAVDNSGLELEWSGLLPHHFNYYTSYTYTRAKQKDDLTVFNNGAAIELPTSGKQFANVPKNMLAANIGYDDGSYYGTFGAKFTSKLYGDLTNDESIPGRTIFNLGAGIYLPVDKKIVKDATLRLNVDNLFDKEYLDGVYTTKTNAGAYSGFRDGDPAYIVGVERTVTVSLEANF

SEQ ID NO: 6212 - protein, 247 aa, Bacteroides ovatus ATCC 8483
MENSMRARTVLATVSVFALATSLASNSVHGADLGPAPVYYKAPPIEPRNPWMIRLRVLGVLPDTAGSSVNVPGTPLLSSPNSGLSISDQAIPELDITYFFTANLAAELILGVTSHHVSGNGALTGLDIGKAWLLPPTLTLQYHFTDFGPLKPYVGAGINYTVFFNQSAANTSLAGLSVTDLNIKNQFGAAVQFGFDYMLDRHWGLNFDVKKLWLRPEYSATLNNAIAVTGRAHIDPWLVSGGVAYKF

SEQ ID NO: 6213 - protein, 178 aa, Bacteroides ovatus ATCC 8483
MVNMEQQRIEVVGKLGSTYGIRGWLRIYSSTEYAESIFDYQPWFLKIKGQWQPTELESWRYHNNDLIVKLKHVDDRETAQTLANIEIGVDLAVFPELEEGDYYWHDLIGCNVVNLENYAMGTVTEMMETGSNDVLVVRAKSKDAFGKQERLIPFLYEQVVKRVDLNTKTIVVDWDAGF

SEQ ID NO: 6214 - protein, 938 aa, Bacteroides ovatus ATCC 8483
MKKVFIRIIFFAILSIGNLAWAQVSISGAVKDNLGNLLVGAHVSLSPGNHFATSNDQGRFSVSNLRSGEYLLSISYLGVKTHIEYINVEEQDIEFNIILEDDPLALNSVVVTGTFEPRSKLSSSTAITTLETKSLKQAFPRGAADLLQSVPGTFTDPSAGEVFTRVYTRGISASSEDDMGWYYVSLQEDGLPVSLVQHSYYGPDIFHRVDITTERVEAIRGGSAAITALNAPGGIYNFISRTPTDVFGGEIRLQGGVQGENNPLYRIEGNLGGPLGNDWFFNLGGHYRKDDGARNTDFTFSKGGQLKFNVIKKHSKGYIKFYGKLLDDFTNRYTGVAATNWDDPKAAFSQDFSTTALMMPAFSANIPDGRRINEGATNRFDPSQGVHAQDKAFGVDILQDLGNDWSARLNVKHSHKNANWQTAISNAFVSLDNPLAYFISGAQFPIGQVVFRDAATGSELARLDNSGILAGESIQYLGNGTLPNDAIMGTASWLKQNRSDEWMNQLTFRKRSVNHDLTFGFGSGFSNTSLYTQGSFGFVTYEPNPRMLEVTLENPGQPVLALSDSNGLSNYGGLFFDNSRADVSQFAFFANDRWKLEDRLHLDVGLRYESIGHKGSKDQAAPLQRGGGYDGDPTTAYDNGILTPTGARDNFDFNYSYLSYSAALNYKFNDHTAIFSRFSSGNKAPELNYYFNNFSGVPINKEGEVQEITQAEIGLKYSNNRFSAMTTAFWSQLKNIGIADFQFDSDDGSVFYAPVQFNDSRTIGLEWESAYTPVSYLTFSFNGTIQNPKATKWTVYDAAGSVDSSDDTITDYSDNTLSFNPKLMFNLGFDYQKDKLNGFFKWQFLGEREGNIANAFQLPAYSVFNAGLGYDITQNLSANVVVTNLFNSEGLANFFGANSFGASANGATTDFIQSNPNTSFVVVPILPRGTMLSLGYRF

SEQ ID NO: 6215 - protein, 737 aa, Bacteroides ovatus ATCC 8483
MISPRTTPVGLLLTSTALSSALVLASPALAQPASVELSELSVEGSRSRTGLAGADSNVAVSQDSAATSGGGGGPSGVTGYTARISPTATKTNTPLLETPQSVTVLTREQLNDRNVQTLNEAIGYVAGVSSNVFGFDPRFDSFYVRGFSLTYDGIFRDGLRQIASGLTVPRIEPYGIEAATILRGPASGLYGLGSPGGILDVTTKRPVFTRFGEVQLQVGNFDRYQGNFDIGGPVEGTDGTLAYRIAGIKRQSDTFLPGGADDRSYIAPAFTWKPSADTTFTFLSEYQENKLPGSTTFFNQNFRPTRLYASDPAFNDFKQQQGRVGYAFEHRFDGDLFFRQNFRFYDVNTDYRYTSIAGINPDGVTASRSTGFSRQHLTQFTLDNQIEAHVTTGPVQHTLLAGLDYAHYDFNYRFGFGTAPDLNLVTRNYGLQPIFAAPLGPRTAQSQDQVGLYLQEQAKFDRFVLTLSGRYDWVFQNTVDTTGTATQQNDQAFTGRVGLNYLLAPGLVPYASYATTFAPQPGTDASGRAFRPATGDQIEAGVKYLIPGTNIQASFAGFDIVQSSVLRTDPNNIAFQIATGSVQSRGFEMEAIANFAPGTNLTLAYTHLDLRYLNQTLFTGQVLDGNYLSGIPGDTFTGFLTYLFPPSSALSGLTLGGGLRFSANSYANDENTIRNPTVTLFDALVAYDFAAIDAKYRGFRAQVNASNIFDRDYFTCQAGFCYRGAPAAVIGSLIYRW

SEQ ID NO: 6216 - protein, 766 aa, Bacteroides ovatus ATCC 8483
MTHTKIRKTLISAAVAAATLSAGQLSAAQIEEIIVTTQKRQQSLQDVPISVSAFSGSFIEKAQISDAKQVALLTPGVSGDTDDSFLDSMNVRGISTNDFGVGAEPSIGLYQDGIYLGRTGGAVSSFFDVEMVEVVKGPQGTLFGRNASSGAISITTAKPTGEAGGSIDIGFGQDGYGEVTAVINTPINDQFSGRLAVYHQQQDGWVTNINDGQQTGGVENTAARYTLAFENDDITSTLMLEYEDRQGPPTIYQAFDPDETGLPFYSTDAAEDQFTSDVSSSDLIDEGEVWGVTLNVEVDLGNDYTLSSTTGLRGHNYYYLEDFDGGSSFLSNYNQIQEQDYFSQEFRINKETDSVSWFVGASWYKEELKVRFNQTLDEDTFCAAYGTYYEYDDITDCATLYEYYEYDPIVGIGTRNDSVDVDAEYDGWGLYGDATFHVNEDLDFIVGARYTEDNRDFAQNFGGEERNATWYTFPFYTSDFVQGNDKWTNTSVRAAVNYQLSDEVSTYATYSTGYKAGGFNTMELSFADDIAVDDLDGEDALDFDPSLASFDKEEVTNLELGLKGQFLDGQMQLNAALYSYQFDGMQSGYYVDGRYTVANVGDAEGSGLELDMRYLPTDNVDIYLGLAWADSELTKPNSSLSADFCEDDCTGAMLPGTVDFSAALVATYSRPIEGGDLNLTWETFHQGASPGFGDFSREPIMLDEFTVSNLRVGYDSSDNWSMTVWVNNVFDTFYYKGVAPADGIIAPHYFGFSEPRRMGLDLAYKF

SEQ ID NO: 6217 - protein, 718 aa, Bacteroides ovatus ATCC 8483
MRIGIISGVIGLFVTLPVHAQKSDSIKSMLLPDVVVTESYQQRQAKKSALTVEVIEQDFLRKHFTGNFMQAVENIPGVQAMDIGSGFSKPMIRGMGFNRIAVLENGIKQEGQQWGADHGLELDAFNIEAVNVLKGPSSLLYGSDAMGGVIDIASPPIPSANMLFGDVTLLGKSVNGTLAGSLMLGLKKNAWYAQIRYSEQHFGDYRIPTDTIVYLTQKMPVYGRKLKNTAGVERNIGLFTQYQRKGYRADYSISNVYQKTGFFPGAHGVPDASRVEDDGDSRNIELPYSKVNHLKVTTHQQYAWEKLILSGDLGFQNNHREEWSAFHTHYGSQPAPEKDPDKELAFDLNTYSASVKARFIGSSSWEHTLGWDRQHQQNDISGYSFLLPEYHRSSTGLLWLTTYKPNNILSVSGGVRYDYGYIGISPHEDVYLADYLRRQGYDDEQVESYKWNSHAVRKHFGDYSFSLGLVWTPSVQHMVKVNIGRSFRLPGANELAANGVHHGTFRHEQGDASLKSEQGWQMDASYNLRYHGLSVSVSPFVSWFSNYIFLRPTGEWSVLPHAGQIYRYTGAEALFAGTEATIDINFLRHFNYRISGEYVYTYNCDEHIPLSFSPPFGMRNTLTWQRKHYMLYAEWQLIARQNRVDRNEDRTPGANLFHLGGSLNIPVGRTNEIEITLTARNIFNTRYYNHLSFYRKVEIPEPGRNFQLLIKIPFKKLL

SEQ ID NO: 6218 - protein, 376 aa, Bacteroides ovatus ATCC 8483
MKYGRLAALAAGLFGTTAFAQSSVTLYGVLDTGIEYVSHANAVGDHVVRMPGITGELPSRWGARGAEDLGGGLKAVFIVESGFNLKGGDSGQGGRLFGRQALVGLEGRWGALTFGRQYSMSYWALADADILGPDIYGIGALDAFLPNARSDSTVAYKGKFYGFTVGATWSFGRDSTGTGNSPGQGTCAGQVPGDVNQCREWSAMLKYDGTYFGVATAYDEQRGGTNAAANFFDGITPFAISGTGDKDARLQANGYLNVAGVKVGGGWVGRHVESSGPGGDVRSSLFYLGAQYYVTPTLAIDGEAYRVIVEQQDARATMASLRATYFLSKRTAVYCNVAHVWNSARARYSVSAGGGGTTPAAGVGQLGAIAGVRHTF

SEQ ID NO: 6219 - protein, 1042 aa, Bacteroides ovatus ATCC 8483
MRIYLRLLVAFLLLSAGNVVYAEAQQEKRVTGTVTSEGEPLPGVSVQVKGASSGTITDIDGNYSIEAPANGTIVFRFVGLRTVEQAVNNRNVINVTMESESKELEEVMVVAYATAKKYSFTGAASTMKAGEIEKLQTSSVSRVLEGTVSGVQASASSGQPGTDAEIRIRGIGSINASSAPLYVVDGVPFDGSVNSINPDDIASMTVLKDAASAALYGSRGANGVIIITTKQGQQDSKATVKVKATLGGSSRAVRDYDRVNTNQYFELYWEALRNQYAKSSDYTPATAATQASKDLVTKLMGGGPNPYGTQYPQPVGTDGKLAAGARPLWNSDWSDAMEQQALRTELNLSVSGGGKANQYFFSAGYLNDKGIALESGYQRFNLRSNVTSEMTSWLKGSINLSFAHSMQNYPVSSDSKTSNVITAGRTMPGFYPICEMNTDGSYKLDDNGDRIYDFGSYRPSGSMANWNLPATLPLDKSERMKDEFSGRTYLEATIIEGLKFKTSFNFDLINYNTLDYTNPKIGPALENGGGSSRLNSRTFSWTWNNIASYDKTIGDHHFNVLAGMEAYSYRYDELTASRTKMAQPDMPELVVGSQLTGGSGYRIDYALVGYLTQALYDYQNKYFFSASFRRDGSSRFAPETRWGNFWSLGTSWRIDRESFMASTANWLSALTLKMSYGAQGNDNLGTYYASKGLYTIVSNLGENALVSDRMATPNLKWETNLNFNVGVDFSLFNNRFSGSFDFFTRRSKDLLYSRPIAPSLGYGSIDENVGALKNTGIEMVLNGTIINQNGWVWKLGMNLTHYKNKVTELPLKDMPQSGVNKLQVGRSVYDFYMKEWAGVDPDNGNPLWYMDEKDANDNLTGKRVTTSDYASANYYYVNKSSLPKVYGGFNTSLSWKGFDLSAIFAYSIGGYIYNRDITMILHNGSLEGRDWSTEILKRWTPENRYTDVPALSTTSNNWNSASTRFLQNNSYMRLKNLTLSYDLPKQWISKLALSSVQVFVQGDNLFTIHRNQGLDPEQGITGITYYRYPAMRTISGGINLSF

SEQ ID NO: 6220 - protein, 1113 aa, Bacteroides ovatus ATCC 8483
MREKRWLLCFLVAMCCTFSAWALPSQDKTVTLKLHNVSIETVLDAVKKQTGVNMLYNSQMFKGVPPVSIDAKNEKWEIALKLILNPQGFDYVVKDGIVVIRKMQAEKRENRIRGMVVDSNRDPIPGASIIVKGTRTGTSTNIEGEFTLDVKNDKVTLEVSFIGMKKQTLQVDATRKKMLEITMVDDVKTLEDVVVTGYSNVRKSSFTGSSTQITGDELRKVSQTNVLDAMQSFDPSFRLMTNTQFGSDPNALPEMYIRGRSGVGVRDLDKNQLSKSNLENNPNLPTFIMDGFEVSIEKVYDLDPSRIESMTILKDAAATAIYGSRAANGVVVITTVAPKPGEVRVSYNFTGTLEMPDLRDYSLANASQKLEMERLAGLFENTDFGTEIYDYNRKFAEIQRGVDTDWMVLPLRNAFDHKHSLFIEGGTQNLRWGVDASYNGANGVMKGSGRDRYSVGFSLDYRMKSLQVKNTVSFTHSKSKESPYGSFSDYTILQPYDTPYNDNGTLKENLKFSQVSGGRVAKNPLYEATLGNYTWSAYDEVSNNLSLNWYLTDYWTVRGQFSVNRKYSNGERFIDPLSSKTTASPRDGGHNLGDLYVDNGNNLSWNANAALYYTRSFNKHNLNLSVAWEASSGSSDATSAHYRGFPNGQFHSPNYAAEIYEKPSRTEGTSRMVSTWATGNYTWNDIYLADFSVRFDGSSDFGSKQRWAPFFSGGLGVNIHNYEFLKGNEIVNKLKVRASYGRTGKASFPSYAATTMYEALFDEWYATGFGAVLKALGNNNLSWEKTDKFNVGIEMQFLNRRLTVDADYYHDKTIDLVNDVSLSQTSGFSSYKDNMGEVLNQGFELQVRGEVFRNRDWLVALWGNMAHNKNKIVKISDSQRAYNLRVEQFYQNSANEEYGRYNAQYAVPISQYEEGQSLTSIWAVKSLGIDPTTGKEIFLNRDGSVSDTWNATQEVVVGNTEPKFNGSVGFNLAYKAWSLFAAFQYEWGGQEYNQTLVDRVENARIQYQNVDLRVLTDRWKQPGDIAQFKDIKNADNVTMPTSRFVQDKAYLRLSALTLSYDFNREWIKKHLGMNMLRLEASTRDFINWNSIRQERGLSYPKSWTVDFSIKAQF

SEQ ID NO: 6221 - protein, 355 aa, Bacteroides ovatus ATCC 8483
MKQVCVLGNGQLGRMLRQAGEPLGIAVWPVGLDAEPAAVPFQQSVITAEIERWPETALTRELARHPAFVNRDVFPIIADRLTQKQLFDKLHLPTAPWQLLAERSEWPAVFDRLGELAIVKRRTGGYDGRGQWRLRANETEQLPAECYGECIVEQGINFSGEVSLVGARGFDGSTVFYPLTHNLHQDGILRTSVAFPQANAQQQAQAEEMLSAIMQELGYVGVMAMECFVTPQGLLINELAPRVHNSGHWTQNGASISQFELHLRAITDLPLPQPVVNNPSVMINLIGSDVNYDWLKLPLVHLHWYDKEVRPGRKVGHLNLTDSDTSRLTATLEALIPLLPPEYASGVIWAQSKFG

SEQ ID NO: 6222 - protein, 511 aa, Bacteroides ovatus ATCC 8483
MLFSGAAAFAGETPAITETNETSKIANADLATQQEVMSQVTSVSQFSDVQPTDWAFQALQSLVERYGCIAGYPNGTYRGNRALTRYEFAAGLNACLDRVNELIATATAELVTKEDLATLQRLQEEFSAELATLRGRVDALEARTSELEANQFSTTTKLQGQVVSVISDVLSGDRVNNADIVDTNTTLGVRARLELVSSFTGRDTLFTRIEANNITSPDINTPEGNLFFASVEPSTNAAIGTLWYGFPVGKNTQAKLIAVGGAADDLTSTVNIFDGDGAFGALTTFGTRNPIYGQIGGTGLGVTHQFSDKLALSLGYLSGTANDPSPQNGLFDGAYGALAQLTVRPSDRVSVGLTYINSYRQPLATGSNAATTFQGLGERFSSNSYGLQASIGLSEKLVLGGWAGYTNSRILTGDRGDVDIWNYAVTLGFPDLGKKGNLAGIIAGMEPKVTSSSIAGLNRDRDTSYHVEAFYQYKVSDNITITPGIIWLTSPDHNDNNDDVVIGALRTTFSF

SEQ ID NO: 6223 - protein, 640 aa, Bacteroides ovatus ATCC 8483
MKKNKKTILLSLTLASSLLHAEDNGVFLSVGYQIGEAVQKVKKKDKVQKLSNTYEQLSRLLTNDSGTNSKTSAQAINQAVNNLNERAKTLAGGTTNSPAYQATLLALRSVLGLWNSMGYAVICGGYTKSPSENNQKNFHYTDENGNGTTINCGGSTNSNGTHSFSGTNTLKADKNVSLSIEQYEKIHESYQILSKALKQAGLAPLNSKGEKLEAHVTTSKYQQDSQTKTTTSVIDTTNDAQNLLTQAQTIVNTLKDYCPMLIAKSSSNGGTNGANTPSWQTAGGGKNSCETFGAEFSAASDMINNAQKIVQETQQLSANQPKNITQPHNLNLNSPSSLTALAQKMLKNAQSQAEILKLANQVESDFNKLSSGHLKDYIRKCDASAISSTNMTMKNQKSNWGNGCAGVEETLASLKTSAADFNNQTPQINQAQTLANTLIQELGNNPFRNMGMIASSTTNNGAMNGFGVQAGYKQFFGKKKRWGLRYYGFFDYNHAYIKSNFFNSASDVWTYGVGSDLLFNFINDKKTNFLGKNNKISFGLFGGIALAGTSWLNSQFVNLKTISNVYSAKVNTANFQFLFNLGLRTNLARPKKKDSHHAAQHGMELGVKIPTINTNYYSFLDTKLEYRRLYSVYLNYVFAY

SEQ ID NO: 6224 - protein, 1093 aa, Bacteroides ovatus ATCC 8483
MKSDSFRFSRKATAVLLLCTGLVASHPIALWAEDGVTTVQAVQQQQVIVKGTVSDAMGPVIGANVIEKGNRGNGTITDIDGNFSLKVKPGATLEIHYIGYKTVEVKAVPGKPLNVTLTEDSEMLDEVVVVGYGTMRRKDVTGSVVQIRPTAMQNEAPKTVQDVLRGAPGLKVGLDTSAKGGGSLEVRGDRSLSSLTDGSPMIVLDNMPFYGELSEINPEDIGQIDVLKDASAAAVYGARAANGVVIITTKKGKIGKPVINFSAKVGFVTKANYKEVYDGDGYMKYREDWYKTATYGMNPETGKYEAYQTGTIKPGYYDRPDRLPAGVSIEDWRNYSVNAEGQSDLGIYADRVLTQTDQLIRDNFLAGRTYDWYNSAYQTGINQDYNASVSGAGEKMNYYMSVGYLRNEGVIRGTEYQAIRANMKLTTNITDWLEVSGNVNFQSRSDGDLALNEGSTLANSPFANYRDADGNLAVHPMGEKNTYNMGYNYDFNHQYEQLEKGYYVLNSIFTAKLKLPFNINYSFNASPRLQWFYDRWFQSSEHPDWDAVSHGANRNTASKFDWSINNTLSWDHTFVKKHHVILTLVQEAEKHQSWSEGIAARNFQPTDVLGFHYVNTAGKLESSFSSEDTYRTAVGLLGRLFYSYDDRYMITASVRRDAYSAFGEKEPWATFPSVALAWTFTNEKFFKWEPMSMGKLRLSWGVNGNRAINNPYLALATLDIGAKMFSYLDASGNLKEMEYLKIGRMANPDLKWEKSEAYNVGLDFGFLNNRITGSLEGYVIKTKDMIMGRTLPPFTGFDEIATNLGEVQNKGVELTLNSQNMAMKNFEWNTSFSFAYMNNEVKHLYGEYENVLDANGNIVGSKEKDEYGKWWIGRPISAIWDYRVTGIWQPDEIEEAKKVGQLPGDPKVANNYTEDDIISSDGSRIPVYNDKDKEFLGQTTSPYILSMRNNFTILKNIDFSFNLYSCIGSKMKDTSYLNQVNASEIDYGLNQSIKEYWTPEHQSNTYARLNSKGPTGVNSPARYIDRSFIRLENISIGYTFPKSIVSRWGLSNLKVYGTIRNAALWTMSHWKLNDIETGGLAPRTYSLGINVTL

SEQ ID NO: 6225 - protein, 373 aa, Bacteroides ovatus ATCC 8483
MNDLYNRCRACRPVCLVALALTCLSASPSIAEANNLRSAVSWNLHLSLEGIDNFSGGIAPGAVGNATARAGFAFNTRRAGWWTGGRFVAQFLAIQNGNPEHYVGDTQGVNAFTGLNRGAFYQLYYRQNIDNATLRAGLISANDYFDSTGVASNFLNVSYGFGSAMGINVPGASSYPFSSLGVMGSYSADGWTGMAGIFEGDAIHPFKDPTHRGNMIWLEADKSGSLGDGKYTVKVGGWRNRQLPQYQATLGNDTSGMYTTGEYRWEMDGMDWGSFLEFEAAPNPVNLLPWYMGAGLRLKHFWAVRPGDSAGIGMARAWLRGAPYNAETDFEGYYSARIIRRLYLQTDIQYVVHPSAIYQNALVGIVRLHVTFS

SEQ ID NO: 6226 - protein, 1088 aa, Bacteroides ovatus ATCC 8483
MNEKFKALIRSFFLLVQLLLFMSFQDGNAQKEITGQVIDDNNIPMPGVTVLIEGTNQGTATDFDGFYSLEASPSDVLVFSFIGYDAQKVTVGEKTTIDLVLQANAEAMDEIVVIGYGTAKRSDLTGSISSVKAEELDKIKPVSFEGGLASRAAGVQVTQSEGGPGAGFQVRVRGGSSINASNDPLYVIDGFAIPGSPVSTSTGIGNSTTSPLSTIDPSTIESIEILKDASATAIYGSRGANGVVLITTKGGKKGRTDLNFEAYTSVSNIVRPIDLLSAQEFVDWRYEYTPFDPNNPTGQFVGAYRDQFGNPIDLNNPDVILTDWQDEIARTAITSNYKLSLSGGSENTSYAGSFSYLDQEGVIKTSNFERYAASIKVDQKISDKWKAGLNVNIGYNKRSGVVSAATENANGRSGIVTNAVLFSPVQGLTRYDDAEYDDDGRLLSLRGGDIVNPNRILEGNLNEGDNFQSFGNIFVQYNFTDALSFKSSIRGNFYTNKGQAYYSEKFGWGQSANGRAFTNESRGAGFITEQNLSFNKTFDDHRINATAVYEQQQNFNEFLVARSTGFNLPGVNLDNLGTATVTLPTNSGYNDNSLKSYLGRVQYDFKNRYTLNLSARYDGSSRFAEDKKWGFFPSAGVAWKVSNEKFLENSKTFNNLKLSASYGETGNTQIGSYRSIAAGTLANYIFAGDQLATGVAIDRLGNPDLTWETTTQYDIGLSLGLFKNRITLDADYYNKSTTDLLLEVPLPTTSGFEFSFSNLGEVENKGLEFALNTINIEKDNFTWNSSFNISFNKNEIKNLGGANEFFVTAIGDNQIQNDYIVRVGESLGSIYGIEEQGVYNYGDFAAFDGLTDTQAAEQIRQDAATQGIPYYDLVYTLKDGVVTSAGQPDNTQYRPGIPKFVDQNGDGIVNSDDRTIIGNTLPEFFGGFNNNFTYKNFDLSVLTSFSYGNDVYNKNIKQGTSQDIPFFNKYGQVRDRWTPENPNTNVPGIWGYGDAGISGNTYSSYVEDGSYIRLSNITFGYNLPNDTANKMGLKSFRVYGAVDNLYIWTDYSGYDPDVSVGNNQLTPGLDVDSYPRARTFRIGMNIGL

SEQ ID NO: 6227 - protein, 825 aa, Bacteroides ovatus ATCC 8483
MEVFLMRLRLMLTLGSLPLLGMASPAAHAACTFSPGPGNDTYTCDSGTAPALVDSSGDNRLVFPASGSGAITGDVTFGAGKDSIDMASGSVGGNVNQGAGIDDFVMSGGVIEGNLNQGDGLDTFHMSGGWIKGTFDSGDYAEMDDGRIGNVNMRLDENTFIMRGGSVDRNVITAFDKDYIEVFEGNIGGNISVSGGDDQVLVHGGQVGGDVLLSTGNDRFTWDGGRIGGRVDAGPGDDTALLKGLTPEVLSITLDGGEGNDSLTFDASQPAGGAHYVNWERVALNNGSRLALDDTLVLGDSNSSTGSLALDASSRITSRQGVITAFAPGQRAAISNAGTLDLTAGNDAMGRLRIEGDYTGNNGTLRLNSVLAGDGAASDRLVVSRGAIAGSTQVLINNLNGAGAATAQNGIQVVEARNGATSTATAFVQTQRLSAGAYDYRLFKGGVTAGSENSWYLRSTLVAPPAPAPVPAPGEPPVIAPAVTPPVAAPAPGQAELPAPVQGQSLPLYRPEVPVYAAAPRGAAIIARQALGTFHQRQGDQLLLQGESALPASWGQAYGGTLRQQWSGTVSPSLDGDLYGFKVGQDLYAKVGDNGYRQHVGIYVSHSRLDADVKGFALAVHDRSVGDLKLDGDSVGTYWTLVGPQGAYLDAVLQYTRLDGRARSERGDTLNLDGHAWTASLESGYPITLSERWRVEPQAQLIAQKVALESARDSVSRISHDAQVELTGRLGLRLEGAFTGSSGRLLQPFAQVNLWHGDGGRDTLTFDDADKIKTDYRYTSVQLESGVVAQVNEALSLHGGVQYTANLDSRQQEASGVNLGVRWQF

SEQ ID NO: 6228 - protein, 373 aa, Bacteroides ovatus ATCC 8483
MKNVGRWAAAAVPAALASLGCQMAYAQSSVTLYGVVDESVRYLTHANAAGDSSIGLGNGGMTQSRWGLKGVEDLGGGWSTFFKLENRIYINSGQSDPTLPFFNEAQVGVRSDSYGQIILGRQYNVVIEGVTVAGYGSNSWIPYDFSFQPEVTMTGGIWTSNQVQYQARYNGFTFAAGYAFGGNAGNSYGSQIGAAAAYKPEGGPFSLGGAYEESKDSVNGAAAKTWTFGGAYTWNLTRFSAGYIVNQNDAGFSNFANGPFTAPVLAALKYTDFARRRMIMGGITQQVSNKWHFAANVWRTLQDGKTAAQDGSAWQYQLVADYNLSRRTDIYLEGDYSIYRGDLIGAQLQGVNGVGLAQKGSQIGLMAGVRHQF

SEQ ID NO: 6229 - protein, 981 aa, Bacteroides ovatus ATCC 8483
MRKSILLFVLFSLMNIPLLLFAQGGYRVTGRILSAEDNQPLIGVSVLEKGTSNGVITDIDGNYSITVTKSPATLQFSYIGMRPVDRQVTASTRIDLSMESDAQQVDEVVVVAYGVRKKGTIAGSVSTVKAEKMENVPAASFDQALQGQAPGLMVMSGSGEPSVAASFQIRGINSLSSGTSPLFILDGVPVSSADFNTLNPSDIESISVLKDASSTSIYGARAANGVVVITTKRGLALDKAKVTFRTQLGISQLAQDKWNQMNTEERILFEKEVGLDKGKDYDILRKTDINWLDVVFNNKAMLQNYEVSVNRATDRLNYYVSGNFFDQDGIAQGSGFRRYNMRANADVKASNWLKVGTTSTVSYEEIEQAQTGAYTSVTPISASHFMMPYWNPYKEDGSVASTKDGSWTGTNQNPVDWMQNNPVSYKKYKVLSTLYAEVSPVRGLTIKSQFAADYAHMTAFSQSFPSFSTNNNSGTAGRSSNDRLSLTITNTANYHFTLKEKHDFNFLLGQEGVDAQSEGFSISMRGQNNDLLTNISNGTLAASWSDTAAGTVYSYSYLSFFGRGEYNYDSRYYADFSVRTDASSRFGKDNRWGAFWSVGLMWDMKKENFLKKYDWLTTMRLALSTGTSGNSDIGYYAWQSLVKGGMDYMGETGIYPAQSGNSNLSWEKTWTTNLALHLGFWNRVNLDVELYNKKTTDMLMDVPQSYAVNGSGSRWDNIGAMVNRGVEVTVNGDVLRTKDFSWNLNANFSYNKNKITELYNGVDEYEIASANLKYVVGHSATEFYINRYAGVNPTNGDALWYTKDGEITTEFRDSDKVMTGKSFVAPWQGGFGTTLTWKGISLAAQFSWVADRWVFNNDRYLDEGNGLFETYNQSSRLLYDRWKKPGDVTDIPRYGVTPQMDSRFLEDASFLRLKNLMLSYNFPQTLLKKTNFLTHLRVFAQGQNLLTFTKFSGLDPEGVSNMYQAQYPSTRQFTFGLEVSF

SEQ ID NO: 6230 - protein, 194 aa, Bacteroides ovatus ATCC 8483
MSRIKTFIIGSAVVVTAGASAAYAGSPTQAQPEPVVAQPVTPVVAGTDWSGPYYGASLGFGSWDLGGASGEGRNEGAFLGYDYDFGNYVAGGELQYIGNDVTVGGTALNGMARLKGKLGYDAGPVLLYGTAGYAWADSSAGDGDGYVAGVGMDYQFDNGVAVGAEYLYNEFSDFANTGNTLTGNTIEARISYRF

SEQ ID NO: 6231 - protein, 992 aa, Bacteroides ovatus ATCC 8483
MNNLKVKPLALAIALGLSPSALVYAQSDSSADAQLEEVIVTGVKAADLNAREAERSKDAFSSIISQDDAGNFADQNVAESLQRLPGITLQKSEGEGRYVNVRGLGADFVSVTMNGSELASGGGDGRAFALDAIPADMLGSIEVYKSLTPDQDLNSIGGTVNVKTVSAFDKKRDTLKLKAQVNNQVYKDQLSPKISLSGTNLLFDDRIGIGYSVSTEQRNSVNYEVRHHSTTDARYITNGNTTALVPYQFEAKQEEGERTRNAASLDIGFRPTNNSEYYLRLSHTSYQDLDVALREYSRFDTSSASEFVLLDVENKIMGAAGTELQHQFFIQDGVATTDSVAIGGKNNFDNGWEIEYDLSVSKGEWDKPGASRVQFRARDMPMIGGWGPNYLWSMPIERDHLEYLAGVDQVLSNAPYNYGSRQQPDMGFDNLFIEDSFRTDDVSQLKIDIKKEFETGKINYIKFGGTVKNRERDRNKDRWSVIPSDKASIGCPAAEDPELCFDLASSELGDFETFEPAHADIRHNFITYDDARYLIDATKTAATEFDKNNNDQDSVKDDYVLTEDVQNIYLMAEFATSDNSTLIVGGKYETTTFDSTGNFSIRWDRNEDSSSATSDDIVVPLTNTQTTYSDFLPSIHWKYEPRDDLLVRAALWTSFTRPNFSDSRASVEFSGRVILCDANAVEETSLTCDDRPTDLNSAWSSDEAVKANTVIGKANTLKIGNPSLKAQYATNLDTSLTWYASDDLYFQAALFAKQIDGFIAEVRGQEMSLEDLPFYVPVETINESSPALNLIPGKVYDDVNMSINGEVAHVYGLELTYSQYFNSGLFIQSNATFIGSSADVGSTVREDKIALPFQADETLNLTVGWENDDVSVRLIGNYRSAVLEQIGSCTAANKAQDIADAAARAEAGGNGAIIPESCKKWADVYEDNTFGLDFKATWKVTDMIGVYFDALNLTGDRSVRYYTGNEYSNGKMMYSGEDFGTSFQLGVNVKIM

SEQ ID NO: 6232 - protein, 792 aa, Bacteroides ovatus ATCC 8483
MKRLLTLLLFFNTMLLLLQAQPMHQIKGTVIDKNSRQPLEFINVMIIGLNKGSVTNAEGRFTIEQVPPGIYRLQASAIGYKSVTTSEYILSTKNLNIPIEMEENLTELEGVTITASPFRRDVESPVSLRIIGIQEIEKSPGANRDISRIVQSYPGVAFSPIGYRNDLIVRGGAPSENRFYLDGVEIPNINHFSTQGASGGPVGILNADLIREVNFYTGAFPADKGNALSSVLDFKLRDGDMERNSLKATLGASEVSLASNGHIGKKTSYLVSVRQSYLQFLFDMLDLPFLPTFTDAQFKLKTRFNEQNELTVLGLGGIDNMRLNTKADSEDNEYILSYLPKIKQETFTVGAVYRHYAGAHVQSAVVSHSYLNNRNTKYRRNDESHPDNLMLRLRSTEQETKLRLENSTTFRNWKINLGVNLDYSQYTNTTFQRVYTNQPQTFDYHTYLGILRWGLFGTINYTSMDDRFTASLGLRADASDYSSTMKNLSDQLSPRLSLSYQLADHWFASGNAGLYYQLPAYTALGFKNNNGTFANKYNLRYMKVSEGSLGISWRKGDTFEASVEGFYKDYDKIPLSVADGIPLNCKGNDYGVVGNELLTSTAQGRSYGAEILVKWLIAKKLNLASSFTLFKSEYRNDKESEYIASAWDNRYIFNLRGTYNLPHQWSFGMKVSCIGGAPYTPYDETKSSLVSAWDAQGKAYYDYSKYNKERLPAFAQVDVRVDKTFYLKHCMLGFYLDLQNITVSKLKQQDVLMSTGIIENPEAPAAAQRYRMKRIKQSSGTLLPTLGITFEY

SEQ ID NO: 6233 - protein, 1100 aa, Bacteroides ovatus ATCC 8483
MPHLILENKNLILFLNLKFNFMKRRGLIFNSRPNKTAVFALGLMLGLCPVSKAWADADLSDNQVVMQTQKKVKGQVIDATGEPLIGVNISVIGGTEGTITDIDGNYTVSVPTGAKLKFSYIGYKDQLVEVGTQTIVNVKMQEDSEVLDEVVVVGYGSQKKETLTGAVTVVSDKMLENKGAMSSPVQALQGQVPGVIITRSSGAPGDESWGMKLRGAVSANSTDPLIIIDGVEYESVNELRLLNSADIESINFLKDASAAIYGSKAAGGVILVTTKQAKEGKAKIEYSGSYTHKFVGLQPKMMSIDQWSEAIITTRHNDGLGDDDQWIKYAQLAQAYKGGYIDLSKNPNPIPAFGDVDDYVFMDTNWQDVLFGNAGSTQHNLSVSGGNEKSLYRLSVGYMYDDSTLKWGNNNNKRFNVRLTNTVKLTDRFTIESVMAYNRQDQVSPTMIDRVLTSSYPQPGLPSSTMDGKPYHWGGNYTPNWYAELGGDNKLKVSGINISENLKYQFTSYLDAVVNLGYNTSTATRDGVKNSITWYTYDGTLSTAKTNAINNPNQASTEYSKSFARTDYYSVSGYLNYHQTLGEKHNVTAMLGAQYNLKEYDYTVVTAKDVQSSLEILNGSGEITLKNSAKTSGPSKWHEAMMSYFGRFNYNYMSKYLLEMNLRYDGSSKFRPENRWDFFYGFSGGWRLSEEEFMKNVKFVNELKLRLSYGVVGNQSGISRYDGMQLYNFNSVNGAYIGDGRISYIKTSGEIATMGRSWERIHNYNLGLDFHLFDSRLQGTVELFMKKNNNMLIAVAYPGILGDKAPASNSGKFEAKGYEGTVTWSDKIGKVNYHVGGTFTYADNKLVDYGGVTVFKSGFVDKQQGYSLNSVFGLKYCGKIQTEEQLRKYIYKYYNSNGIGMPKDLRLGDNMYEDVNGDGKLDEKDYVYLGSDDPKISYSFNVGIEWNNFDLSAVFQGTAKRTIFRDESNDNYRIPMRAAHLNSTTQSVGNVWSPDNRDGRYPTYTNISTINNYNYQCSSWSVENGNYLRLKSLTLGYNFPASLLSKTKAISRLRIYVSGADLWEVSKINDGWDPEASRKVSGNGRFPFNRTCTVGLDVTF

SEQ ID NO: 6234 - protein, 496 aa, Bacteroides ovatus ATCC 8483
MLVKSGVASGLPLLLSLGIVQPALAQASSPAAAPAENAAPPAPATRAPDGVPGGNGATAAQTDAAPTGFWDRSNLFGDMGGLRTKLGDHGITLNLQETSEYLRNLSGGTSRGGAYDGLTQFGFSVDTEKAIGLPGGTFNVSGLQIHGTSLTARNLQLLQTASGIEAEATTRLWELWYQQSFANGRADVKVGQQSLDQEFMVSQYASTFINATFGWPVLPAVDMPAGGPAYPLSSLGVRLRAKPSDAWTVMAGVFDGNPAGGVGDAQQLNRHGTNFNLRNGALFIGELQYALNAPPADPKAPQAGLPGMYKLGVWYNSERFADPRYDTNGVPLADPASNGVAATHRGNYGFYAVADQMVWRPGADSPRSLNVFARVMGAPGDRNAVDFTLNAGVTLKAPFAGRDNDTAGLAVSYAKIGSRARGADGDTGVFQTPGYPVRRAETLIEATYQYQVTPWWQLQGDFQYAFRPGGGIPNPNEPGSRIGNEAIVGVRTTITF

SEQ ID NO: 6235 - protein, 1655 aa, Bacteroides ovatus ATCC 8483
MMAQKPNFLKKLISAGLVTASTATIVASFAGSAMGAATQQNRTTNGAATTVDGAGFDQTVALANVAVALNAVITANANNGINLNTPAGSFNGLFLDTANNVAVTVSADTTLGFITNAANNGNSFDLTLGAGKTLTITGQGITNAQAAATKNAQNVVAPFNGGAAIANNDLSGVGTIDWGAADSTLVFNLANPTTQKAPLVLGNNAVIANGVNGTLNVTNGFIQVSDKSFATVKAINIGDGQGFIFNTDATVGNALNLQAGGATINFNGTDGTGRLVLLSKNGAATDFNVTGSLGGNLKGVIAFNTVAVAGQLIANAGPANAVIGTNNGAGRAAGFVVSVDNGNAATIAGQVYAKDMVIQSANAGGQVNFGHIVNVGTDGTTAFKTAASKVAITQNSNFGTTDFGNLAAQITVPNTMTLTGNFTGDASNPGNTAGVITFAANGTLASASADANVAVTNNITAIEASGVGVVQLSGTHTAELRLGNAGSVFQLADGTVINGKVNQTAVVGGALAAGAITLDGSATITGDIGNGGGAAALQGITLANDATKTLTLGGANIIGSNVGGTIDFQANGGTIKLTSTQNNILVDFDLDITTDQTGVVDASSLTNAQTLTISGTIGTIGANNKTLGQFNIGSSKTALNGGNVAINELVIGNNGSVQFAHNTYLITSTTNAADQGKIIFNPVVNNNTTLAAGTNLGSAANPLAEINFGSKGAHADTILNVGEGVNLYATNITTTDANVGSFVFNAGGTNIVSGTVGGQQGNKFNTVALDNGTTVKFLGNATFNGETTIEANSTLQIGSNYTADFVASADGTGIVEFVNTGPITVTLNKQAAPVGYLKQITVSGTGNVVVNGIGNAGNPGAATDTIAFENSSLGAALFLPSGIPFNDAGNTMPLTIKSTVGNRTATGFDVPKVIVLGVDSVIADGQVIGDQNNIVGLGLGSDNGIIVNATTLYAGIGTINNNQGTVTLSGGVPNTPGTVYGLGTGIGASQLKQVTFTTDYNNLGNIIAANATINDGVTVTTGGIAGTDFDGKITLGSVNGNANVRFADGIFSNSTSMIVTTKANNGTVTYLGNACVGNIGDSDTPVASVRFTGSDDSAGLQGNIYSQVIDFGTYDLNILNSNVILGGGTTAINGAINLLTNTLTFASGTSTWGNNTSIKTTLTVANGNIGHIVIAEGAQVNATTTGTTTINVQDNANANFSGTQTYTLIQGGARFNGTLGGPNFAVTGSNRFVNYGLIRAANQDYVITRTNNAENVVTNDIANSSFGGAPGVGQNVTTFVNATNTAAYNNLLLAKNSADSANFVGAIVTDTSAAVTNAQLDVAKDIQAQLGNRLGTLRYLGTPETAEMAGPEAGAIPAAVAAGDEAVDNVAYGIWTKPFYTDAHQSKKGGLAGYKAKTTGVVIGLDTLANDNLMIGAAIGITKTDIKHQDYKKGDKTNVNGFSFSLYGAQQLVENFFAQGSAIFSLNQVKNKSQRYCFDANGNMSKQIAAGNYDNMTFGGNLTVGYDYNAMQGVLVTPMAGLSYLKSSDENYKETGTTVANKQVHSKFSDRTDLIVGAKVVGGTINITDLAVYPEAHAFVVHKVNGRLSKTQSVLDGQVTPCISQPDRTAKTSYNLGLSASIRPDAKMEYGIGYDAQIASKYTAHQGTLKVRVNF

SEQ ID NO: 6236 - protein, 1085 aa, Bacteroides ovatus ATCC 8483
MKRNKWLLSLSIGLLCCGSAYAQTTVKGKITSEGGEPLIGATVAVKNSTDGTVTDIDGNYSLKTKKTLTQKDLLVFSYVGYKTLQKNYAGNTMNVKLAEESQQLNDVVVTALGIKREEKGLGYATETVKGDMITSALPTNWSTALNGKVAGLSVISSGGPLNSSRISLRGDVSLNQNGNDALVVVDGVPMSSPMTNPGVAYGAGSNSELSVDYGNGFSDINPDDIESIQVLKGASATALYGTRAANGVIMVTTKSGAGAPKGIGVSYSGNFSIDDVMRWPDYQYEFGQGLPSNIGPAGSIYEGQPYYSYGKAEDGSYASTSGTSSAYGARFDANRLFYQYDPVTQGRASVATPWVAYKNNRKDLFQTGYTLTNSVALTGKSDRGSVRASITHTKNEWILPNTGFQRITAMVSAQQQISRALRINFKSSYTYRKLNNTPALGYNSNSISYFLIFQNPNVNLDWLRPMWRTGQENVKQLQPYSSFIGNPYVILYESENPSEKHSNVSSISANLRINSKFDFMIRSGIQLSADQREQHRPISDVVFGNGFFKKQNVFDYELNSDALFTYHDSFANGLRVNASAGGNMMQQSYDMLAASVVGLITPGVYKLANGVSNPNVQTVIKKKALNSLYFTANFSYKDKLFLDVTGRNDWSSTLPKSNRSFFYPSVSVSAVMNEWFTLPEQISLLKVRGSLAQVGNDTDPYKTSPYYGTSDFPGSAIVSSTLYNQDFKPEISTNYETGFDFRMFHNRIGLDFTFYYNRTKNQILDAPMDPTTGYSKATINSGCVRNRGYEIQLDVTPVVSRDFRWNATFTWSKNENRILSLAEGADENQLISSIGSVSIIGRVGGTTGDLWGYKLVRDPEGNVVINDNGLPERSGEIEYVGTAYPKWKAGLYNEFSYKNFTLSVLLDGQMGGKMYSHSHHKMTEQGKLQHTLNGRLPGTEFYMSKDDPRIAAAGLSPQDGMYMIAPGTVKNDDGTYSPNTKVVTVESYYKEYYRMANVETNTFDTSFLKLREMRLEYKLPNSTLKKTPFSKASVALYARNLFCITDYPLFDPESAALNGSSMVTGVETGSLPTARTFGLNINVSF

SEQ ID NO: 6237 - protein, 990 aa, Bacteroides ovatus ATCC 8483
MKSPTSNLSKPLFRRSVLSTVIALTAISASAQEATQDTNLEEVVVTAQFQRNLENALDVKRNASTIVDGISADDIGTLPALDMGEALQAVAGVQLNREGERRESSINLRGLPSGFVLTTANGQTFSNPTRSDKVFGAPNPFGAYDPAVFNGIDVIKTQTAAMQEGGIAGTVDQKLAKALDKKDGLAISVGARSEELADALDKEFVISGSKHLIEDTLAITATLATSDQTFRRDTIKINRYDNLPTNGNFVGADGEDYATWAAANNLPANAVVKMPGELRQGSEINSGSRTSFSGGIEFQATDELKLGLNTVYTSRDMDDNGQQELDIRPRQSGVKVTPLTAPFATGAVDSNDNPLYSVSDIRTTNSSYAYTSRVFDILEESQAVLLDAEWTNDVWTLDGVATFSSSTNELNEILISPRFDRLASGDNGIVNIFRTGQGNIGDFETTFENFDNLDLDQPWNVLDTVSGAGTVTQVNQGRLNTLITGSWEKIDRNVTSFEANALRVLDSGPLESVQFGFRQSQEEQNSDRLRSSPTGLVLDGVLTNDRRIDPAYASESAFFGGEAPGFAGAGEGWYAFDVNALTRDLAATIGTVNPASTGEEPVRVPHSNLIARGGQQSAGLIYDTTLDTSALYAMANLSFDAFNRPVTGNVGVRYVSSTQEASAPFYAFGITDINNPETKTVESDYSFALPSLNFAMDLSDDLKLRVGYGESISRPNIRAATPSTRVDAGREGEVNIVLPGANVKPFSAKSYDMSLEWYNREGSAVTLAVFKKDINDFFQTASFCSDQLLAEYGIDVGDITQGSDDSCTTNGVDAYDSADANYILAGDQVNISQIRNSDAQISVQGYELSVQQNLNFLPYPWNGLGGVINYSSTSQDSPLEARIPGISDDTYNVIAYYEQGPFGIRFAYNYRTEYELESVGTFNGEGNKNVKAAGRIDMSAYYNVTEDLTLSFKGYNLTESLYEEYQDTERQPRANHFDGRVFVMQAKYTF

SEQ ID NO: 6238 - protein, 415 aa, Bacteroides ovatus ATCC 8483
MARIGLKRGVLAAVAGMLVASAAQAGGLERSGYNIDLLFDPSDYAAEATATYVNPQRELKNVADINPANGIGSNGIGGGSTSVRDTESYWAPRIGVKAGLGDSIDCMADYSQPWGAHTNPGKNWMGANDNIETKVESDNYAATCSYKWDVGPGVVRIIGGGFYQEIGGFKDRLVAPEIAVAPLTGVGRLELEGEAWGWRTGIAYEIPEYAMRASLVYNSKVDYDDLSGFIDLTQFAFPTPGGPIRGTKYDVSGSASMPDSLELKVQSGIAPGWLAFGSVKWTDWSQLQVLEFCPATASPLTPCTTLDLLYRDGWTVTGGVGHKFNDQWSGAVSLTWDRGTSHGYGTQTDTWLLGSGVSYTPTENVELRLAGSVGILTSGSSGPVSFNGERIGNEVTYDFDNDFVGAISTSLKVRF

SEQ ID NO: 6239 - protein, 684 aa, Bacteroides ovatus ATCC 8483
MAWISSGGAGNCAPNLFTRIWTVLLTSALMTAISGAMPAPAQAQFARLFGFGDSYADTGAAPGGAYRLIGTYGSGTVSIPYFPFTLTPNDFWPCPSPTYTSCRFTGSTNFVDSLQSIYGLSSLTNFSIGGARTNNTNTMPFLSSSYGLPYELQQFVASGIRFTDRDLIALSIGGNDLSGINVGNGDLASQNQIIVAGALQSASNAVGGVQQLVAAGARNIAWLGTGSSKWFPERTLGSQGATLGQFNFSDPQRDAWADAYYQQTQLLLAPLAQAGVRIFLFNFGILQQRIHDNPGMYGFAGVPAGSFGCEAGPGTGSTPVTVAVNVAGCFYENSVHPTGAAMALIANYMANQINAPTTVAPQAGISTGLLGGFSNSVFDRLEASRRFQPYGVNAAMAAMPSKAVALADPADRWSVFGAASYAGGNRDRQFYAAGYDYGAAGGYLGLEYQFNSNWRVGGVFGYSQPDVKLAVQDARNRIDAFQFAGYGSYTDAHWFADGLVAYGRQDFALERRGIIDVIRANTSADVFTVAGRGGYLFDAGRLRVGPIAGLNYTNATIRAYTETGDILLTMLVDRQTLNTLTGDAGVQIRYPLQIGNGVYTPFVNLTAAHDFLGSSHTVTTTLVTAPLLPVLTPVSADGGTYGRVAAGVSAVVAANVTATLTGTTSFARQGGNAGGVSGGFKLAF

SEQ ID NO: 6240 - protein, 798 aa, Bacteroides ovatus ATCC 8483
MNKQNSRAALLPLAFAIIAPGTFAQPATDGPSLILEEVTVTARRREEGLQSAPIAISAFTGDSLAYRGATKLTDIASFVPSLTLENNPAFGGSSNSAAIFLRGVGQKDFLPTTEPGVGMYLDGVYIARSVGGILDLLDIEQLEVLRGPQGTLFGRNTIGGAINITTIKPDPSGDLEGDISTAVGTDNRFNLTGSVMIPLSDTFAARASFASFKQDGHVERTDGTDLGDDDTLTGRVAFAWLPSDRLRVDISADATRDRENGPAMELLGIDFTDLSQLNGLVASVPPPQAFIHNVTTAALGPGMPCAATDAAGNGVTSNPASANCYDNRYVGRDGDNQGTAPTKSDTDILGLSATVEYEYSDTLTLKSITAWRDLESEFARDGDHSPHRISQFYDNLEQEQFTQELQLLGNGSNFNWILGAYYFSEDGNNENELDFTISNFRSGGGFDNEAWAAFAQFTLDISEQLHLTVGGRYTDETKMFQPDQVIYENYYAGISGQVPPGNPLAALDAPFLQAGSLILPNIEKEIEISEFTPMANLSFDVSDDVMLYATYSEGFKSGGFTQRVFPPVVAGFTAPPGTPDIDLIPTYEPEFVTVYELGFKSTLMDGKVRVNGAVFHTDYEDLQVQVFNSVAPVTENIGEASINGFELEVQAAPGNGWLIEGSFSYLDAQYDEIETNLTLIGKNFEFERVPETSGSLGVSKEFALTDAGIVVIRVDWSFRDDTYNDAYNTELLKTDAYDLWGASARWTNNNGDLTATLSGRNLTDEEYLVTGVYGTAFQSFEGSFDRGQQWLLELRQSF

SEQ ID NO: 6241 - protein, 230 aa, Bacteroides ovatus ATCC 8483
MTEARAGLFARRRYLPALAVLYAALWLALAIEPHDRSDWLLENALVLGFGVALYATRRWFVFSRVSYTLIFLYLCLHAVGAHYTYSLVPYDAWWQRLTGHSLDQLLGWERNQFDRLVHFSYGLLLAYPIREIFLRVVDVRGFWGYLLPLDVALSTSALYELIEWGAAEFFGGELGVAYLGTQGDIWDAQKDMALAGLGALIAMLLTALFNRGARRDPARDWVDRMKPGHT

SEQ ID NO: 6242 - protein, 242 aa, Bacteroides ovatus ATCC 8483
MLEMGQMAGFIKSFGSKLAGATALAGVAAIAFSTLGAAPAAAADMAMPVKAAPVVVDTWNPWQIRLRITGVVTNDSGHVNGVAGSGISTSDTVIPELDISYYFTKNWAAELILGTTYSYIDGTGSLNGTAVGKTWLLPPTLLLQYHFTDFGAFQPYVGAGVNYTIFYNQSANQVTSIDVKNTWGWALQAGFDYMIDRHWGWNVDVKKIFLEPDFNVTVGRTPLTGSTNLSPWLLSTGVTYRF

SEQ ID NO: 6243 - protein, 851 aa, Bacteroides ovatus ATCC 8483
MECGAALKLNQYIYLGIASTICLLITQKANAQEKPINTKDIGLITNIPRLSDIERPQTSVRDWLAQSAPTPPQIKITGVRINRTDDTFELILETPDGEISAPETLQEGNIFIADIPNAILALPEGREFREDTPVDGISYVTVTQEESNNTVRVTIASPGNLPTIQVVNQSNNLTIAVTPTSPDIELIVTAQKRPEDAQDVPLSLTVIPQQEIEDAQIRSFQDIANNTPNFSFLPTTAGSADFGYYSVRGLNNFNFLANQDTVGFYIDDVPFDYGGFLDVGLIDLARVEVLRGPQSTLYGRSSPAGVVNVISRPPSNQPEMQISALYGSYNSRELQLSLSDAIIPDKLAFRLAGAYNARDGVFDNIFLNKPIGERSQLTGRAQILWTPTPEWNISFNAYASDNDNGNPTFSRQNAQNPFQVSQEVDGFNRLSTNTQALKISYNGNGFRATSITSRRFSNQNTLVGDNFPGDLLQQIIGINSTLWSQEFRLQSPESADRLRWLLGGYYESRNFNVLDDTFKYTDAGAVAFGVPAPGSDRVSAEQNRQTYAIFGQIDYKPIAPLTLFAGWRYETADAELDRRRVFVNPDGTVNPPTAEVRNATLNSDAFIPRFGLQYRFNPNLMAYATIAKGYRPSGFNYRADTEDTRRFQEETTWTYEVGLKSSWLDDRLSANLSIFQSDVDNYQVLLTDDFGFFRNVTNANVKVTGLEFELKAKPLQGLDLIAGIGYVDSKFKNYRNPFTNGDFSNNRVPFAPELTYNLAVQYRSPGGIFARAELRGYGITYFDDANQVKQDPYALVNARIGYEGEKYGIYLYANNLFDTRYITSGFLFPPPNVTAGFGDPVTYGVRVSASF

SEQ ID NO: 6244 - protein, 227 aa, Bacteroides ovatus ATCC 8483
MKHQMKFLAIAAAAMLAAGSVCAQTAGTWMVRAGATRLAPVGPSGCMTAPDYGDGSGCTRSNVSANTQLAGGITYMYTDNISVDVPLALPFKHDVIGAGSMEGAGKLGEVKALPMTVFLQYRFLEANAKFRPYVGLGVTYAYFFDEQGSYHLTQTTNPGGPPTSFTVDAKFILTPQIGATLALNDKWFIDVFYSKAKLSTTTHFSSGQTMPADLDPAAYGIAVGYKF

SEQ ID NO: 6245 - protein, 500 aa, Bacteroides ovatus ATCC 8483
MKRYLTFIVILACTLVSAQNINDVLRFSHENLQGTARFQGMSGAFGALGGDLSALSVNPAGSAVFNNGLVTISGTHYEMDNLANYFGTYSGIKTNDVDINQFGGVFVFKSNGNSDWKKMAIAINYDIVQNFDDEFNIQGDSNQGIDNYFLSFAQGVPFGSILLQDGEYIEDGYLDIGSNQGFGDQQAFLGYYGGILDPEDQDEATTTYNSNALYDNVNHNFLRLTSGFNSKFTFNLASQYQDKLYLGASLNFHTIFYDQVDEFRENGYDTSSPIQNTDFFNFLHTEGSGFSFTLGAIAKLNQSVRLGGSYQSPTWYRLTDDFSQRIDSDLADDDINFINFDVVNLFEAYTIKTPAKLTGSMALVFGKEGLLSFDYGYQDMSQAELRPTSDSSFATINSEIANNLGAVSSFRLGGEYRVDQVSLRAGYRFEQSPYSDGNNIGDLTGYSGGLGYNFGGSKLDLAVNRTEQDYNMQLFNTGITTPALINKINTNVTLSYTMNF

SEQ ID NO: 6246 - protein, 548 aa, Bacteroides ovatus ATCC 8483 [sequence omitted]

SEQ ID NO: 6247 - protein, 694 aa, Bacteroides ovatus ATCC 8483
MSKIHLRRLAQGVGPIPLLAALSALPLQAQETDQAPLVLDTVIITGDNITRDMMQTASSVSVVTARQLEREKAGNDELRTAIAGTANVIYTDNVSTPVIRGQDAQGPHTGANAFFAGSVPRATINLDGHYLSYNELYFGATSTWDVDSIEVFRGPQTTSQGANAIAGAIIVSTRDPSFTPEGAYRLEGGNYNQRAASFMWSGPLTDELAARVSLDYSARDSFIDYVSPTFVQNEIGQDFVNANARVKLLWQPAELAGLSAKLTYSHSRMQRPSAEGASEPYDELESIATWMPGWDQTTDTAILDVDYDTGNGMVLSSKTQYSTSDVERRIGTVNMGDADVSQDNYSNESKLTFGTPDDRLSGVAGIYVAFTDQDETLEQGGLSTFSDKKSNLGLYGELNWRMDERWTLSAGLRYQRDHIRRQGDVSPLFANSDVDYDHTFDVLLPKLTLAYQATPDWTVGALVSKGYNPGGISLDFGYSKEWTEFDAETVWNYELFTRAELMEGRLALTGNLFYMDYQNAQHNIAHLVDGVTYLQTVNAQDARAYGLELGADYRATDALTLRGSLGLLHTEFERFDQMPAYEGNEFARAPGKMLTLGASWDATDRLNLGGQVRYVDGYYSNTANTPAYEVDGFTLVDVQASYQVNDRVALYGYVNNLLDERTPTLLEPARGNVVFTQGSLTSPRMVGIGIRGTF

SEQ ID NO: 6248 - protein, 766 aa, Bacteroides ovatus ATCC 8483
MIMLSTARASRFPLQRLVLLIGLHALSLASYAQDTATPTDSAQEPATGAADTTLGTVSVIGQGETRQVQRVDEKDIKAYSAGTNPMKVLQRLAGVSFQAGDPLGREESSQRISLRGFDMHHLGYTLDGVTLGNMSFANFNGLSITRAIIAENIAKSEVAAGIGALGTASNSNLGGTIAFTSSNPEKEFGARLSQTLGSYDTTRTYVRVDTGEYNGLAAYVSGEKYDADAWKGHDNPQESDALNAKVTYDFDANHLSFYHSTSTHNEANLPSMSSSMIRRLGYNWSYYTPDWTRAVNAANGIFTGGVTRAGDATYNGSSLRDDELDILSGNFSLSDDLLLDATVYHHHDSGRGNSYYPFVYTSGSTTVPTNSIRSTVYGINRSGFQTSLTYFLSQHEIQGGFWIQSNKNDVSRYLFDPTGTAPQNHIVRTKGLPQVATILSQDYNDLTRQFYLRDSYTLLDDRLKLEFGAKNTVTTSTVEGKGGGYASGSLQARDRFLPQLGATYKLDDQDEVFTSYSENVAAFPSGGYGPFFTTQTAVDAAGGFKNLKPETSKTVEVGVRRSNALYSTSAAVYNTRFDNRLVAITNCTGIVICQNSVANVGSVTSRGLELTFALTPDENWSWSNTASYNHSTYDDDYQSGTSEVHVKGRTVVDTPRLMYSSSLDWHWQQWNAGLQGSYMSKRYYTYTNDSSVAGYWLANTMLGYDFGKLGAVKDTTLSLNVVNLFDKRYVSTINTDASAASDPTGDLQILQIGNPRSAFVTMAVRL

SEQ ID NO: 6249 - protein, 691 aa, Bacteroides ovatus ATCC 8483
MLMAASVSALALASPAMAETEASQGEEASDVIVVTATRTQLTNFDYPGLTSVISLEALDQNRPSDLIELLEDIPALEVSGGPRRTGQTLSLRGLGRENVTLLIDGARQNFNSAHDGVLFLDPSLLGRVESVRGSAASLYGSGAAGGVVAFETLEADDLLEDGQRYGVRASAGYRSVNEESRGSVALVGDFGDLEGVAAVSLRQSGDIALGSGDDLSASDDIVSTLLGGEWDMAEGVELELGWLSFRNDSVEPNNGQGAAGVDSLNPLMNKDVASDSLRATLRFDAHSPLINLETTVYHNIGAVDEVDASINRLVERDLTTTGIRAENRAEFALGGLDLALVTGAEWYEDEQEGFDSATSDGVRGGVPSGSTRFTGVWAQLESTLDLGAAGELIVLPGVRFDQFESASSAADDNKDEAVSPRIAATWAPNDSIRIFGSWSEAFRAPSLNELYLSDTHFSLPHPILGAPVFITNSFIANPNLKPEETETFEIGAAFSHEGLFTANDRLEIKGAWFQTEAEDLINLNVDFAFNPTCFAPPFMPCSAGTTYSENLSEAELEGFEIAAAYSVGAFELSGSVFEVDGEDKATGDPLGALQPVMGFVNARYTFEPQRLTLGGRVAFASDFDKVASAAEERDGYAVLDLYASWTPMADQPLRINLGVDNVFDEDYERVFAGVSEAGRSVRVDLTWTGAW

SEQ ID NO: 6250 - protein, 147 aa, Bacteroides ovatus ATCC 8483
MLSSIDRSYDSGYALTGAAGLDRGRYRFEAELGYQKNAIKNSVADISMTTYMANGYYDLELPLAQVKPFVTAGLGVATFNDDNGAGKTVSDRVFAWQAGAGAGFSVSPLVNVDARYRYFSASDPQLTGNSRYSIGSHNVSLGLRIGF

SEQ ID NO: 6251 - protein, 213 aa, Bacteroides ovatus ATCC 8483
MCIDVLAQQQENIMNKKMMLLVAVAITGASINSSHAKGFDQGYVGLEIGKQESSALKSLNNKYCQSGECVDEDTFSFGGLVGFNFNKFVAIEGAAQFAKYDYDFYTARYNSSIPSLYRHKGDVKVTTYSLGPKLQYPVNDIISFFVKPSIAYTKTEAAGESEDSADFMYTLGAEFSLTSYAALRASYESVDTDSIDGSSASLKTMKLGAIFRF

SEQ ID NO: 6252 - protein, 859 aa, Bacteroides ovatus ATCC 8483
MSNARMPRSLRTIAVADSIGKPSLEISSVGKVSTVAGLIAVASFSAAEAQQSNLPPVTIDAPVVRPHHARSKPTADHVRARTALRRAARRAQPAQVAPVPFPNAGNLAADRNPYADAAAPYKVDHLQASGKFPEPLLNTPKTVTVLSKDVLADKGATLLKDVARTTAGVTLGTGEGGNAFGDRFFIRGFDARNDVFIDGVRDPGVSVRENFFTEQVEILRGPGSSFAGRGTTGGAINIVTKQATTEGNFYNMDTMFGTDQTKRVVLDVNQVISPTLAVRAGGLFQDANVAGRNYITDDRGGGFLAVTWKPVDAIKVQANYIHTDLHGLPDFGVPYFRPNSALVGGFYNSTAGGPFPQFGLNRNTWYGFLNRDFQSYRQDIGTLNLEAHITPDLMVTNKTRVQHSILSYIGTLPERPVVTDPNPANWTLSANPQSRFQPTNVFANQTEATYKFGTGPWRHTALAGVEISAERSSIDKYSGLSSEQLPGGLSGTGSVPGVNIFNPQFTNASFPEPSLAGLPTKINIDTKSVYLLDTANYNDFIILNGGIRYDDYHVNTSGYGTVNGVSNVFGTQSLDSGLTNYNLGAVVKPLPNVSLYAAYATSSNPVGAEFDGTSAQYGGLAPILNGNSSQIFGPEKNRAAEVGTKWELFDRHLLLQASLFQTWKDNARESQNIANGGAATPTCPYPAGSSGTVSCITAGAAYWIRGIDIEAAGKITDKWSVFGGIVLMQSEVTKSLVPSAQPLLYASNVGLPLANIAHQSFNVLTKYQLTDVWEIGGQATYRSQIYGGTFLAANQGTSLPDYWRFDAFVEAKVNKNWQVKLAVNNITNKLYYDALYQSATPFVFVAPGRVAYLTLSARY

SEQ ID NO: 6253 - protein, 363 aa, Bacteroides ovatus ATCC 8483
MDNLKHLDGHQIVKVNDTADKDAFRLSSKYRKGIYTLSLQQRPEGFFTKVQERDDIAIYAQQAQAANTLFALRLNDKNSDIFDRTLPRKGLWLRVIDGHSNQWVQGKTAPVEGYRKGVQLGGEVFTWQNESNQLSIGLMGGQAEQRSTFRNPDTDNLTTGNVKGFGAGVYATWHQLQDKQTGAYVDSWMQYQRFRHRINTEYATERFTSKGITASIEAGYNALLAEHFTKKGNSLRVYLQPQAQLTYLGVNGKFSDSENAQVNLLGSRQLQSRVGVQAKAQFAFTNGVTFQPFVAVNSIYQQKPFGVEIDGDRRVINNKTVIETQLGVAAKIKSHLTLQASFNRQTSKHHHAKQGALNLQWTF

SEQ ID NO: 6254 - protein, 729 aa, Bacteroides ovatus ATCC 8483
MKRSHLWVLNPCLLAMLSTSAWAEEQKEENIVVSASRAHRSVAEMAQTTWVIERAEIEQQVQGGKEIKEVLAQLIPGMDVSSQGRTNYGMNLRGRSMMVMVDGVRLNSSRSDSRQLDSIDPFNIDRIEVISGATSLYGGGSTGGLVNIVTKKGQPDTEVEFQTGAKSGFNSHNDHDENVSAAVSGGNDNASGRLSVSYQRYGGWYDGKGNEVIIDNTQTGLQYSDRLDVMGTGTLNIDDHQQLQLTTQYYKSESDGKHGLFLGENFSAVTGDAKAYNKGNLNSDRLPGTERHLINLQYSNTDFWGQDLVAQIYYRDESLTYYPFPTLTKGVVSSIGASQQKTDFYGGKLTLNSKPMDDLTLTWGVDADHETFDANQQFFNLDKAAASGGMDLENAYNVGRYPGYSITNLAPFLQASYDINAITLSGGVRYQYTENKVDDFVGYTQQQAIANGKATSADAVPGGKTNYNNFLFNAGILGRLTEQQQLWFNFSQGFEIPDLAKYYGSGTYQLVDGHYRLLNSVNVNDSTLDGIKVNAYELGWRYTGDNLRTQVAAYYSLSDKTITINKTDMTINLEDDKRRIYGIEGQVDYFFTDSDWSTGANFNAIKSETRENGKWEKLTVDSASPSKASAWVNWAPGDWTLRVQSTQTFDVSDADGKKIDGYNTVDFLGSYDLPVGKVSFSVENVLDKDYTTAWGQRAPGLYSPTYGAPGLYTYKSRGRTFGLNYSVLF

SEQ ID NO: 6255 - protein, 1074 aa, Bacteroides ovatus ATCC 8483
MNLKRLAKRALATLSLSMLCLIAFAQGHQISGTVIDGTGEPIIGANVLEVGTTNGVITDIDGNFKLSVQPNAKIQVSFIGYITQTVTVGSQKNIKVTLKEDAQALDEVVVVGYGTMKKTDVTGSLASVSADKLAARGALRVEDALQGSVPGVNITATNSRANGKFSMQIRGQSSINNSNGPLYVVDGMVVSSIDFLNSEDIERIDVLKDASSTAIYGSRASEGVILITTKGAGAGQSKAQPVEITYDGYYGIRKVARMPKFMESTEWMNYRFAKYTTSSGPDETGHIKYIIKDADLQSVFQNGTEWKESPLYARWMNNESYDWADQVLQTGSQQNHFISASGASEKTSYRLGAGYQGEENVFKKNSYDRFNIKAAFDSKLSKVVEAGMSVNMVYDVQDDWITDSSNAYSPYNNAFWFAPVISPWDEDGNLLARPAKVGNMSLTSTPSPLVDLDIDAYENQTRKFHVFGNAYLRFNLMKGLKFTTTFSPNFYHGRQGIFMGTGVSDKYPDGTAYYQNKKQNYASVVNTDRMDWTWDNQIDFTKTWGNHRLGAMGLFSMYRTDKETYTQSVTDISDDRLSYHAMEKGAKNQATKSSYTESSMVSVAARLNYAYKERYMATVTVRADASSRFAKGNRWGWFPSAALAWRMSEEDFLKDVEWLDNLKLRLSYGITGNNNVGDYATSYYTSGPSYAVIGGNEFQGYYGNGIIDQALMWEKIKEFNFGVDFAVLQNRINITADAYRRLADGQIMKSTVPLETGESSLTTNIGSVQNAGIELGVNFGVIRNQNFTWDVNVAFARNWSKIKELPSGDDVSNNWFIGERLNVLRDYTYAGVITADGVTMHTINGDKHYTLQEVYDKYGPKSPNKLKWYEGQMAVNDWNDDGKINDEDKQIYGCTDPKWTGSLSSTMTYKGFDFSFMLYTKQGQWSRSYFHEQYMDISDRGRQKMSFDYYIPAGTPVLDKATGDITYLETPHMGAYPYPNNYEKTGGGYFSKSSSGVRYQKTSFVKVKNITLGYTFPKKWMSKIAVKHLRLYVNVLNPFCFTGYDGFDPEWASANLTDGGPASVTYQIGANIKF

SEQ ID NO: 6256 - protein, 1129 aa, Bacteroides ovatus ATCC 8483
MVKKSIFLHLKKRLKLFCIINVFFMIPSSSFGTNSIRWNSEEDLFSVQYENTTVKDILDYIEKHSKYIFIYSANVQKNLNNKVSISVSNKKIDAVLKELFSETGLNYKMLGRQITISVPEAPKVQQTTQQKGIKVTGNVSDEKGEPLIGVTIILKNDSTVHSLTDMNGNYSIMVPTRKSVLSFRYIGFVPKEEIVDNRKVVNVQMVEDVGQLDEVVVVAYGAQKKESVVGSITTIEPAKLKVSTSRSLSNNLAGTVAGVLAVQRSGEPGYDNSSFWIRGISTFQDAGQNPLVLIDGIERDLNNIDPEEIESFSVLKDAAASAVYGVRGANGVILINTKRGQVGKPRVTVKAEFAATQPVKLPEYLGAADYMQVLDDILIDTGQQPKYTDRIAKTRSGYDPDLYPDVNWMDAITNDYASNQRVTVDISGGTETLRYSFVAAAYNERGILKRDKSYDWDPTIKLQRYNVRSNVDLKLSPTTQLRFNIGGYLQDRNSTTKDISQIFQKAFVAVPHAFPAQYSSGQIPTTEEPNVWAWATQSGYKRKSDSKIETLFSVEQDLKFLLPGLKLKGTFSFDRFSSGTVSRGKTPDYYVPATGRDDEGNLIIASKSNGTNFLDYSKSGDYGNKSVYMEATLSYDRTFADKHAVAAMLLFNRRNYDDGSKLPYRNQGLAGRASYTYAGKYVGEFNFGYNGSENFARGKRYGFFPSGAIGWIVSEEAFMQPLRKVISKLKLRASYGQVGNANLGGRRFAYLSTITDDYETLNMYKWGLDSSYGLTGMAEGEFAVQDLTWEIVNKMNLGVELGFLNGMIDLQLDYFDERRKDIFMPRESVPMTAGFMKQPWKNFGKVTNQGVEVSLNVNKQFGKDLFVSLMGTFTYAHNEITEKDEPSAVVGTNRAETGHPVGQLTGYIAEGLFTADDFEDVSTGKLKEGIPTQSFVGKLRPGDIRYRDVNGDGKVDVFDKSPIGGTKDPEIVYGFGLNMKYKDLDFGALFQGIGRSWNILGSSIIPGANRGVTGNMFTNANDRWTVDNPSQDVFYPRLDDGINSNNNQPSTWWLQNMSFLRLKNIELGYSLPKNLWRNTTVISGIRFFVRGTNLLTFSKFDLWDPEVENNTGAAYPIMKSLSAGFEIKF

SEQ ID NO: 6257 - protein, 698 aa, Bacteroides ovatus ATCC 8483
MRSKLHARLLSGAAVLALGAPAFAQDAEPALQDVIIVTGTRIDPATETGITPDAAPLQGGDITYLTARTPGGARLGNGELSGQMQYRGLFGERLNLRVDGQRFASGGPNLMDPVFHYAPAPLVAAIVIDRGVSPVSAGPGLAGGADAVFKRVDYAQGDEARFGYDLTVGARSVNDSLSTGGVVGLASDAWRVNLLGAWEKGDDTEFGDGEIGGTAFERGVYGLSAGARTALGEFTLDLRRQNTGPSGTPPFPMDIQYFDTDFARLGYAKAFGDLHFTASVHATDIVHLMDNFSLRPAPMPGRQRATFADASTQGGEGSISFPAFGGDLALGLDGEQVEHDVTITNPTNTDFFVTPFPRVEMQRFGGFAEWSGALGAINAQLGLRADRNGYDAGEASLGSALPMGPRMLATAFNDADRSGEDTTVDAVARLWTTERGGLSWRVTLAHKQQVPGYIQRFGWLPINASGGLADGNIYVGDLALEPETAWIAEAGYDYASARAYLRPTVFIRQIDDYIQGVPFDGTVGVADSPVEMIATMNGDPTPLRWANVEARLYGLDMDGGYDFDGPLRLDGVFSYVRGERRDIDDNLYRVAPLNLTLGLTWEADVWSATVETRAVADQEEVSLTNSEEATDGYVVLSAYGEWDLYDGVTLSAGVENLLDEVYQDHLAGYNRNGFGDVPVGDRLPGAGRGMFVRLNMSY

SEQ ID NO: 6258 - protein, 308 aa, Bacteroides ovatus ATCC 8483
MKNKIVLLAPVSLSFLFSFSTYAADYEFNGLSLSASLGILSGKAHEYVYHPETDTKLSQLDWRIKNAPIIKGELNYDVLDWLSMNGQGWTTLVKNKAAMDDYDWLNPYQDTWTHWSHHEDTHLNYANELDMSLRAWLMQKQNYKLGLATGYQWNSFDWKATGGCYQYNGGLYAGCFPGDQPGIGYQQKFRTPYVGLAGRYFINNFEFSGVLKFSDWVSARDHDEHYARNLTFNERGNSSRYYAATIHSGYFLKPNTKIFVEASYNHYPNGRADTEIIDNDTGERSYFGDSAGLSNKHYTVALGLQYLF

SEQ ID NO: 6259 - protein, 266 aa, Bacteroides ovatus ATCC 8483
MKRINALTIAGTDPSGGAGIQADLKTFSALGAYGCSVITALVAQNTRGVQSVYRIEPDFVAAQLDSVFSDVRIDTTKIGMLAETDIVEAVAERLQRYQIQNVVLDTVMLAKSGDPLLSPSAVATLRSRLLPQVSLITPNLPEAAALLDAPHARTEQEMLEQGRSLLAMGCGAVLMKGGHLDDEQSPDWLFTREGEQRFTAPRIMTKNTHGTGCTLSAALAALRPRHTNWADTVQEAKSWLSSALAQADTLEVGHGIGPVHHFHAWW

SEQ ID NO: 6260 - protein, 750 aa, Bacteroides ovatus ATCC 8483
MRLITVRATKERRGLPALVLACASSLAHAVEGPIQSDMLAATDISMTDWQSGDIPVVLTPARLKQPRSETPATVTVLDAELLHRLGVRNLHDAFRLVPGMTVGSVSSNLPSVSYHGTNANEQRRLQVLVDGRSVYNPNLADVDWLNIPVALEDIARIEITRGPNAAAYGANSFLAIVNIITKHPYDTHGTSLTYWDGGNGYNRYHASYGGGGENLNYRISVNGKQDDGFDRRANDEPFVDSYDLDGFNFSANMQLGSRDTLQVQAGLLNGDHQYHPDAGDGQTSIPESDERDRFASVNWRREVNANHFFQVQAYAHRRIRRQDWTNCNHPILFSDNLSALYAANQRFGSILIGANGATLSEIYANIVSGSGSGLGSAEDDAIARALIEEMSASDPDATVCGRINLDIAETRQDIELQDTYTFTDEVRLVSGLSFRKDSFYSETYFNGGDDNYLQRAFFNLEYRPQPDLGFNLGGMAEHDQANGAYFSPRGAMFYHLTPNQTLRLVISHAVRTPDTYEQSVAWSFVARDLDPPVDGETEARSFLIRSPGELDNEKIVSREIGYYLNYPEWGLEADIKVFHDTMWDLISAPLQYFSFEPENNLKIKQTGFEVETTYSPSLRDTLRATYAYLDQDEEYTGSVTDFYTAYTSFDVSRLFQIESRMSARHSGSFAWLRRINDRFDAATAYYLADTIGDYVYERADLIISYHRRLGRGQMALSAKLEHYLNDDPIMYRDNVLDDRTHLFLSANLKF

SEQ ID NO: 6261 - protein, 1173 aa, Bacteroides ovatus ATCC 8483
MKKNLFQQNEKKFRKKIKVFVIAALLLMVNSFTYGNDKDQKITLKLENTTLTKIFEAISSQTEYNFFYEQSQIDLNSKVSIDVKDEYIKVALLKLFSNLNYAFKIVSTQIIVTNPNNSLAALKKTNGKDGTTKQGFKISGKVLNENNQPLPGASILIKGSKKGVVSDFDGLFQITLENKTDILIISYTGYKTQEIPFSSENIVVKLNPDKNVLNEIVIVVGYGKLAKKRVTGSVSSISSNQIAALPVVSIENAIVGQVAGVQVQETTGEPGASPQIRIRGTGSISAGNDPLFVVDGIPISKGSTSVSAQGELSRRVGRFQQPSSNPLATINPNDIASIEILKDASAAAIYGSRGANGVVIVTTKRGTSKDTGVFSFNSFYGIQNVTNKIDLMNSEELISYARDARNNNYLSSVPGASINNPIGPGDRGNTNYELPESYLNWDGTDTDWQDLIFREATMRSYNFSYASPIKEKTSFYISGGYFNQEGIIAKSEYERFTLLTTINSELTEKLKLDLRLAPTLTNNQKQPANAPYFARPPGIIYSALVHSPIVKPYNSEGMPNQTNNQSHLGGGTTTASNPLAISDAIDDQLFQFQNQASLGLTYEIIPGLDFKTFGGSYINIFNRDFYRANSLLYRNATNGESFGQASASTSVNYLWENTLNYEFEKGDHYLNAVTGYSFQKDKINISQVSANNFPDDQVTTLSGGQVFAGTSVEEEWSLASAFVRGTYSYKDKYLFTGTMRTDKSSRFGDDNQTGYFPSFSLGWRLHKEGFMEKIDAISELKVRLSWGETGNFEIPNYGSVGLLSPSNYNFNGSEANGLLQTTIPNPKLTWEKSAQTNIGVELGLFNNRLFFIADYYKTITSDLLLNVSLTAVSGFNTVLQNLGEVKNEGFEIALRSRNFVNEFSWSTDLNLSANKNEVMSLNAQNEPIISKGGAGERHITRVGSEIGSYYGYVVDGIYQNQTDITNAPVDTQAPNPAPGDLKFKDVNGDGQITAADRTVTGSYFPDFTWGITNNFSYKGVDLSFIIQGVEGNEILNLTRRHLGNGEANFNSYAMWNNRWKSEENPGNGIIPRADRETGKHGNNNRPSSYQVEDGSFIRLRNITFGYTFPENKILNGRIDKLRLYITGNNLFTFTDYLGYNPEVSNISGGLTPGEDYGAYPLNKTIVFGINLNF

SEQ ID NO: 6262 - protein, 1082 aa, Bacteroides ovatus ATCC 8483
MNKHAKRTVLVAGTCLSVMVAGFPGTLSASTGTMIAAQQTKSISGTIVDSNGIPVIGANVLVKGTTNGTITDIDGNFTLTVPAGAILQISFIGYNSQEVTVGEQTSFNVVLKEDTETLEEVVVVGYGVQKKKLVTGATVEVKGDDVAKRNTISALGALQNQSPGVNIQATSGKPGDGYKISIRGAGTNSSTNPLYIIDGVAGGDINALNPADIERIDVLKDAASCAIYGARAANGVIMVTTKQGKAGKVTVTYDANVGWQNVYKKPDLLNAKEYMAVQDQVAYNNGGNPYDWSKYIDADLLADYQSGANEGTNWLDQIINDNAITTSHALNISGGSELSKFSTGFGYQYQDGVIGNIAKSDYRRFTFRLNSEHIIYKTDDRDVIKFGQNLYYQHAQTQGIQIGNQYSNAISTMLRANPCVPVYNANGDYFMYDDLKNSGTDGWFAYNSYTSNPVAEIVNTQSGNNKSKNFNLNAVAYFEVQPIKNLTYRSQAYYKQYSSLWKGYTGEYKINDQGNAADQSTLSENMTIGWNWGVTNTLNYKFDLPKEHHFDVLVGTEYSREGNNMAETLEAIAKGNVFTDFSHAYFDNFTGRTGLATVGGYPVDDHSILSYFGRVNYDYKERYMFTAIMRGDGSSNFADGHRWGYFPSFSAGWVISNEQFMQSTTNWLDFLKLRASWGQNGNENIGAFRYLATYSFGDLGQYPFGSDKNSATQGGYPTRLSNNDLTWETSEQTNIGVDTRFLGGKLSFTFDWYSKKTKDLLINVPVSSINGFTTKAANAGSIENKGIEISLGWNDSVGDDFTYGANFNLSHNKNEVIEVNNGSGYVEGGNDNLSQNTGFMARMKEGHPIGYFYGYKTDGVMQNMDDVQAYLNQNCGGNVANSLQGTSIKPGDLKFVDVNGDGVINSDDKTDLGNPHPDITMGLNLNAAYKGFDLSISAYGAFGQQVARSYRKFTDGQYENYTTEVYDYWHGEGTSDRYPLLTPGNAGPNWQNISDIYVEDADYVRLQNLTIGYDVKRVWKTCPLQQLRVYFTAQNLFTITGYKGMDPENGMALNSNEPWVTGVDVGNYPQPRTYMFGVNVKF

SEQ ID NO: 6263 - protein, 722 aa, Bacteroides ovatus ATCC 8483
MRYLPLLAPITLPLLTLPLLAHAQTLTVSPGDNLGAVVQTEAIDDVIMTGGTVDSLNQRDGYDTFKMTGGHIKGVFENGDSARFEGGTIGRVDLNLANNVFIMSQDTAVDTRIEGDLLSERGDDTFTLRGGSIGGRVYTGSGDDRVTVSGLGGKTQLTRLDGGAGNDSLVFQGSQLSTGTDYTYWEVIWLNDNSHLRLDDTLTLGDGTSATGILTIDASSTLSSRQGMVAAFIPGQKITVRNAGLIDLSTGNDAQGRLTLNGDYLGDNGTLKLKSVLAGDEAASDRLVVSLGSISGSTNLQVDNLGGAGAATARNGIQVVEAREGATSGDTAFVQTQTLSAGAYDYRLFKGGVTAGSENNWYLRSTLVAPPPASAGEPTIQVPIAAPAPGLDALPTPIPGRNLPLYRPEVPVYASAARGAAIITRQALGTFHQRQGDQHLLAGNGALPASWGQAYGGHLRQQWSGTVSPSLDGNLHGFKVGQDLYAHASDSGYRQHMGLYLGHSRLDADVKGFALAVKDRRVGDLKLDGDSVGAYWSLVGPQRWYLDSVLQYTRFDGRARSDRGGKLDIDGHAWAASVETGYPIALSHQWTLEPQAQLIVQKTALDSASDSVSHVSHDAQVEFTGRLGVRLEGAFEHLGVRLLQPYVQLDLWHGDGGRDTLTFNHADRIKTDYRYTSLQLEAGLVAQISDALSLHGAVLYSGNLDSRQQEASGVNLGVRWQF

SEQ ID NO: 6264 - protein, 1124 aa, Bacteroides ovatus ATCC 8483
MKKIRKVNRVMKISTLLSLAFACTVSASTYGQNYKLSMNKQDCSISEVLKEIEKNSEYTFFLNDNQVNVNRKTSVKANNASLEEVLEQALKNTGYQYEIVDRQIIIKSKSVSSVSHPNALFQSSPRKITGQVKDALGEPIIGANVVVKGTTNGTITDIDGNFSLEVPDNAILVVSYIGYTDRTVEVGNSSKVMVSLSEDTQKLDEVVVVGYGTQKKVNLTGAISSLDAETLENRPITNSTQALQGTQGVYVNQAGAQPGADGATIRIRGQGTLNDNNPLILVDGIEFPLEAVNPNDIESISVLKDAASSAIYGSRAANGVVLVKTKGGKKGKFTVDYNNYFGVQQATYLPDFVYDPVVFMEMRNQAQRNEGKLTVDYSDALIEEYKQGMLTDPIMYPQNNWLDIMYNNAFIMEHNMRFSGGDDKYTYSVSLGYGDQNGVLRGTDSNKYTLAVNTTAQVNSRLKIGANINAHYQIYNEPVAGVANLVEMTYKAQAFHPTYTADGRYADTFIRTPGHNIYRHPLALADEGENKHKSLRMLANLSAEYKLPFDIVYNLNVGLNKYDYLQSRFAPDVYEYQLKTNEEKRVVYDGQNTRHAYKGDKNNLAVTVFNTLSWGKKFNDAHDVKVLAGYSFESDDKTEFSAKVEGFLGNELHELNAGSSNPSVAGTSSRSVLMSYFGRVNYGYKDRYLFEGNFRYDGSSRFAKGNRWGIFPSFSAGWRLSEEEFMKDIPWIYNLKLRASWGQLGNERIDLFRYVDLMNLKVIKNDGSITDYNYPLNGAMQSGAAITAYNDPNITWETTTMTNVGIDASLLNGNLDFSFEFFDKRTSDILRKVTLPDQVGGLDGPIRNIGEVSNKGFELNMGYRNNIGNFRYEVNGNMTFIKNKIVSLKGQTIIDGMFILEEGKPIDSYYMLHAIGIFQSEEEIKNSPYQTAATKPGYLKFEDTNGDGKITEDDRQIRGGVIPKITYGFNINLGYKDWDLSAFFQGVTDVYTYGDRIGATPLWFGCGLPEQWLTDAWTPERGTSATLPILTTYEGCLNENFRTNDFWLRNASYLRLKNLQLSYNVPVSFLKSGVVKRLKVFVNAQNLFTFSPMKDFDPEKNLKGSNWYAYPSVRTYTAGVNVTF

SEQ ID NO: 6265 - protein, 2902 aa, Bacteroides ovatus ATCC 8483
MKQFKKKPKKIKRSHQNQKTILKRPLWLMPLLIGGFASGVYADGTDILGLSWGEKSQKVCVHRPWYAIWSCDKWEEKTQQFTGNQLITKTWAGGNAANYYHSQNNQDITANLKNDNGTYFLSGLYNYTGGEYNGGNLDIELGSNATFNLGASSGNSFTSWYPNGHTDVTFSAGTINVNNSVEVGNRVGSGAGTHTGTATLNLNANKVTINSNISAYKTSQVNVGNANSVITINSVSLNGDTCSSLARVGVGANCSTSGPSYSFKGTTNATNTTFSNSSGSFTFEENATFSGAKLNGGAFTFNKKFNATNNTAFNSGSFTFKGTSSFNGANFSNASYTFNNQATFQNSSFNGGTFTFNDQTNQSTQHPQIQNSSFSGSATTLKGFATFEQAFNNSNHQLTIQNASFNNATFNNTGKITIEKDASFNNTSFNTPVDTNNMTISGGVTLSGKNDLKNGATLDFGSSKITLTQGTTFNLTSLGSEKSVTILNSRGGITYNHLLNHAINSLTNALKTNESSSKPQSFAQGLWDMITYNGVTGQLLNENAATSKPTDSSPSKSSTNSTQVYQVGYKIGDTIYKLQETFSHNSIIIQALESGTYTPPPVINGSKFDLSASNYINADMPWYNHKYYIPKSQNFTESGTYYLPSVQIWGSYTNSFKQTFSASNSNLVIGYNATWTDHNVSSSDTVAFGDTSGSALNGHCGPWPYYQCTGTTNGTYSAYHVYITANLRSGNRIGTGGAANLIFNGVDSINIANATITQHNAGAYSSSMTFSTQNMDNSQNLNGLNSNGKLLVYGTTFTNQAKDGKFIFNAGQATFENTNFNGGSYQFSGDSLNFSNNNQFNSGSFEIGAKNTIFNNANFNNSTSFNFNNSSATTSFVGDFTNANSNLQIAGNAVFGNSTNGSQNTANFNNTGSVNIAGNATFDNVVFNSPTNTSVKGKVTLNNITLKNLNAPLSFGDGTIVFSAHSVINIGEAITNGNPITLVSSSKAIEYNDAFSKNLWQLINYQGHGASSEKLVSSAGNGVYDVVYSFNNQTYNFQEVFSPNSISIRRLGVGMVFDYVDMEKSDRLYYQNALGFMTYMPNSYNNNLGNLNNTIYYYDNSIDFYASGKTLFTKAEFSQTFTGQNSAIVFGAKNIWTSVSDAPQSNVIIRFGDNKGAGSNDASGHCWNLQCIGFITGHYEAQKIYITGSIESGNRISSGGGASLNFNGLQGILLTNATLYNRAAGTQSSSMNFVSNSANIQAQNSYFIDDTAQNKGNPNFSFNALNLDFSNSSFRGYVGQTQSVFKFNAVNAISFTNSSNLSSGLYQMQAKSVLFDNSNLSVSVGTSSIKANAINLSQNASINASNHSTLELQGDLNLNDTSSLNLNQSAINVSNNATINDYASLIASNGSHLNFNGAVNFNSANITTSLSSSSIVFKGAVSLRGQFNLSNNSSLDFQGSSAITSNTAFNFYDNAFSQSPITFHQALDIKVPLSLGGNLLNPNNSSVLNLKNSQLVFSDQGSLNIANIDLLSDLNGNKNRVYNIIQADMNGNWYERINFFGMRINDGIYDAKNQTYSFTNPLNNALKITESFKNNQLSVTLSQIPGIKNTLYNIGSEIFNYQKVYNNANGVYSYSDDAQGVFYLTSSVKGYYNPNQSYQASGSNNTTKNNNLTSESSVISQTYNAQGNPISALHVYNKGYNFSNIKALGQMALKLYPEIKKILGNDFSLSSLSNLKGDALNQLTKLITPSDWKNINELIDNANNSVVQNFNNGTLIIGATKIGQTDTNSAVVFGGLGYQKPCDYTDIVCQKFRGTYLGQLLESISADLGYIDTTFNAKEIYLTGTLGSGNAWGTGGSASVTFNSQTSLILNQANIVSSQTDGIFSMLGQEGINKVFNQAGLANILGEVAMQSINKAGGLGNLIVNTLGSDSVIGGYLTPEQKNQTLSQLLGQNNFDNLMNDSGLNTAIKDLIRQKLGFWTGLVGGLAGLGGIDLQNPEKLIGSMSINDLLSKKGLFNQITGFISANDIGQVISVMLQDIVKPSDALKNDVAALGKQMIGEFLGQDTLNSLESLLQNQQIKSVLDKVLAAKGLGSIYEQGLGDLIPNLGKKGIFAPYGLSQVWQKGDFSFNAQGNVFVQNSTFSNANGGTLSFNAGNSLIFAGNNHIAFTNHSGTLNLLSNQVSNINVTMLNASNGLKINATNNNVSVSQGNLFINASCVQQSDPTTASATNPCTTAQNNASSSNASNNAPIALNNNDESLVVTANGFNFSGNIYANGVVDFSKIKGSANVKNLYLYNNAQFQANNLTISNQAVLEKNASFVTNNLNIQGAFNNNATQKIEVLQNLVIASNASLSTGIYGLEVGGALNNLGAIHFNLENSQTPVNPLIQVGGIINLNTTQTPFMNVSVANGGTYTLLKSSRYIDYNINPNSLQSYLKLYTLININGNHIEEKNGVLTYLGQRVLLQDKGLLLSVALPNSNNASQNNILSLSVLHNQIKMSYGNKVMDFTPPTLQDYIVGIQGQSALNQIEAVGGNNAIKWLSTLMMETKENPLFAPIYLENHSLNEILGVTKDLQNTASLISNPNFRNNATSLLEMASYTQQTSRLTKLSDFRAREGESNFSERLLELKNKRFSDPNPSEVFVKYSQLSKHPNNLWIQGVGGASFISGGNGTLYGLNVGYDRLVKSVILGGYVAYGYSGFNGNIMHSLANNVDVGMYARAFLKRNEFTLSANETYGGNASHINSSNSLLSVLNQRYNYNTWTTSVNGNYGYDFMFKQKSVVLKPQVGLSYHFIGLSGMKGKMQNPAYQQFVMHSNPSNESVLTLNMGLESRKYFGKNSYYFVTARLGRDLLIKAKGDNVVRFVGENTLLYRKGEIFNTFASVITGGEMHLWRLMYVNAGVGLKMGLQYQDLNITGNVGMRVAF

SEQ ID NO: 6266 - protein, 653 aa, Bacteroides ovatus ATCC 8483
MRNNSTWSRSSGQTAEWKNLSSYLQRAVIPLKGELTVGDDYTAGDFFDSVSFRGVQLASDDNMLPDSLKGFAPVVRGIAKSNAQITIKQNGYTIYQTYVSPGAFEISDIYSTSSSGDLLVEIKEADGSVNSYSVPFSSVPLLQRQGRIKYAVTLAKYRTNSNEQQESKFAQATLQWGGPWGTTWYGGGQYAEYYRAAMFGLGFNLGDFGAISFDVTQAKSTLADQSEHKGQSYRFLYAKTLNQLGTNFQLMGYRYSTSGFYTLSDTMYKHMDGYEFNDGDDEDTPMWSRYYNLFYTKRGKLQVNISQQLSEYGSFYLSGSQQTYWHTDQQDRLLQFGYNTQIKDLSLGISWNYSKSRGQPDADQVFALNFSLPLNLLLSRSNDSYTSKKNYAWMTSNTSIDNEGHTTQNLGLTETLLDDGNLSYSVQQGYNSEGKTANGSASMDYKGVFADARVGYNYSDNGSQQQLNYALSGSLVAHSQGITLGQSLGETNVLIAAPGAENTRVANSTGLKTDWRGYTVVPYATSYRENRIALDAASLKRNVDLENAVVNVVPTKGALVLAEFNAHAGARVLMKTSKQGISLRFGAIATLDGVQTNSGIIDDDGSLYMAGLPAKGTITVRWGEAPDQICHISYELTEQQINSAITRMDAICR

SEQ ID NO: 6267 - protein, 714 aa, Bacteroides ovatus ATCC 8483
MNMDIDQTGPWPTRLPLRSRNAFLLGCTAFFALTPALSFAQDAVPEGDTTVLETIVAHGAGGGSVLNTDEDSKSIIATETTGAGKMPTDILIAPASVSVITSKEIEERAADTIEQVVQYTAGVVTDFYGSDDRYDYFDIRGFTPYTYRDGLAIGRTFAGVREEPYAFERIEVLKGASSSSFGAAEPGGSVNYVTKTPKSDRFGEVYGTGGSFSHKELGFDFGDNLTADETLSYRLTGKFQRSDAEYDYSQDDENFVMGGVTWRPTDATSLTFIFDHLDKDGVPGSGGHPLGTDFDRDQFFGEPDYYFSETNRNSYSVLFDHDFGNGLSFSSNARYSNLNDGFGSAYIGSTPTDGSTVAGRYFFGNEKSTDQFVIDAHLVYEASLDNVESRTLFGADYNKYESDSANFYAPAPSIDWEDPIYSGGPGAMAPYASTNNDQQTNAIYLQQDLTFFDKLTVSFGLRNDWLDLSETNLLAGTRRAGNHREFTTRIGASYKVTEELAPYISYAESAAPPAAGSDPTTGKQYEVGIKYRPDAFPAMFTASVYDLTKGNITVFDQVTYLPQTVEKVRHRGFELEAKAEVTNNISVIAAYSYIDSKIEEPGGANDGNRLMRVPKNMASVWGTYTLEGDGARGDMLFGLGARYTDAYYTSITNTTSSESAVVFDAAFTYKIQENTTFQLNVNNLFDEKHVASKDSGAVYYNPGRSILATLRQSW

SEQ ID NO: 6268 - protein, 352 aa, Bacteroides ovatus ATCC 8483
MIEGGSAGLQGSRWGLKGSEDLGGGLKALFVLESGFYSNNGVLNQGGAMFGRQAYVGLSHSIGTVTLGRQYDPVVDFYGPFLAAPQWGGYMTSHPGDLDNALNSRRINNSIKFRSASYRGLTVEAMMSLGGTAGSFPTNWIWGAGTSYAAGPFSFGAGYLNVRNPNTSFFGANPNAGPATSNNLGSAGSATSPESNPVFAGYASANRLEIAGVGAGVTLAALSVNLAYSNTRFEGLGSASGPNALRYAGTAAFNNVEINARYQFTPSLLAGVAYDYTRNGGAGGKGGANYNLVSAGVDYFLSKRTDVYTVAVFEKASGTDSLGQPAVAQITGLTPSATDRQVSLRIGLRHKF

SEQ ID NO: 6269 - protein, 1002 aa, Bacteroides ovatus ATCC 8483
MYMKQSMKSKGFERRLLLIMWGLFLSLSAFAQQISIKGHVVDAAGEPVIGASVVEESTTNGTITDIDGNFSLKVSPKSMLTVSFIGYATQTVPVNGKTSLTITLKEDTEVLDEVVVIGYGTMKKSDLTGAISSVSSKDLMKQPSPSLGAALQGRATGLQVISSGAPGDNVSMKIRGIGSINNSDPLLVIDGVPTDVPLNMINMDDVETVDVLKDASATAIYGSRGAYGVIIITTKKGKSDAAHFNFKASYGIEKAIRTLDLLDATQFASLHNEMMTANGQPQNPLFEDPTSLGRGTNWTDELFQTAAIQNYSLNYSGGNDKTTYYVSAAYFNQEGIVRTTQYERYTVQFNMDTQMNNWLKMGNKLSLNHDIKKKGEYSIKNTMLALPTQAIKNDDGSWAGPVGLPMYVGDIANPIGKMMTNSTATKGFNILGNIYAEVKPWEWLTFKTIVGVQALFWDDKGWSPKYDWQPISQPESYASRKYNKSLTLLWDNTLTFNKTFAEKHQLTVMVGSSAQSNTYEYLGGSIMGFISPTAQQLDNGTLEPTVNGNGSDWALLSYLGRINYTYDNKYLLTATIRRDGSSRFSKKNRWSNFPSVSLAWRLSEEPFFKKSFWLSDVKLRAGYGLTGNQASVGNYAYASTIQTIQYNFNGTQVNAIAPSVMPNPNVRWEEVEQYNVGADLTMIDGRINLSLDAYIKNTNDMLVDMVVPISTGYSDINVPKINAGKMRNKGFEVSVSSRNLVGEFSWNTSLNASYNKNEIIRLNGDVPMYFDNNIHAVGHPVSSFYGYVTNGIFQTQEEVDRYAIQTQGNDPYNRTSAGDIKFKDLNNDGIINDKDRTYLGSPTPTWIFSMNNSFAWKGFDLEIFLQGAAGNKIYNANRASLEAMSVAQNQMTTVLDRWRGEGTSNSMPRAVFGDPNKNGRVSNRFIEDGKYLRLKNVTLGYTLPAAWSKKAAMSSVRFFVSGQNLLTLTRYTGLDPEISGSGNDNNVYPIARNITFGASVSF

SEQ ID NO: 6270 - protein, 2806 aa, Bacteroides ovatus ATCC 8483
MRNKFFKKFITVIFLLIYNIEIFAANLVVDPNSNYNTKLDKSANGVPIVNISTPNKNGISINEFSEYNIDEKGQIINNADNIGRSHLGGLINANPNLAPNQAANLVILQVNGSNRSQIEGYLEALSREKIDVILSNENGLYINNSGTINIKNFTATAGKVNLKDGDFIGIDVEKGNIVIGPKGMDGTNANYVEIIAKTLELRGNVVTNDLKVVTGSNSTTSTNNIAIDAKELGGMYANRIRIISTDKGAGVNSDAFIVSKNSKLEITADGKIKVNKVQGKGIDIKGKEYEQKDLAYSDEGISINADKIKLSGTGTQANKQINLNGTVENSTTIYTKEGIKTKGLTNTGIVQAINKIEVEGNLTNNGEILTNKNLTAKDTVSTKKIIAKDGISVGKLENSGKVISNKKLNVDGSLNNSGEIQTLDNINIKENTVNTGDILTNGTLTSKDVKNDKVISVSKDINIGKLENSGKVSTAKKLDINGNLTNLGNIQAVENISVTNNVLNKGTILTNGSFTSKDIKNEKELSANKDISVSKLENSGNVVTNSKININGVLTNTGELKALDSITVSGNTTNNGSILTNKNFVTSDLINNKKLIAKEKIDVKNLKNTGTIASGNKFTINGNFENTNNIETTKLDITGNKLTNNGSIKADNITTNVANITNDGKILSFNNISFSNAQNITNRNEITALKDIEANNTNLVNSGDIASNGKVLLNNSNITNAKKIASSTIEIKDNKKFDNTGEIKGNNVTLTTTNDIDLVGKLHGAQSLTISGKNIINNGETTGTGTTTITASNNFTNNKNLSAQTLTLTATGDVVNNKELNGGKVSITGNNIQNNDLIAAAGDLTLTATNKVDNKSGKTIFAGNKLTVTAKEIKNNKRAELLGTNIELTADKVRNEVGTIKAFNDITIKTDKFENIGEVKDLDKYESYYETWDGKILSESEINDWKRYYSESSRKRSNGSAGDHVRDKQREAYERISNTVVEDKYKSLLFPKYKKLMEGYLGNEGEHREKTGTAKIQDIPLKEKVKSLGETERGKVLAGGNITIEGKNAGNTSEVLNKDSIISAGNTVRINTNKLENIVSIGEKVKVKTGQESMKIKFEHTGRRPRKKVRMEVTYTRDFADDYITKKVPVLDENGKQVYETYEVGDKTRRRKKYETVTEYVGRYAYVTGSPSVIEGKNVVINPSSIVKQEINDANGKINEGKENKVIKEERKVHTGVNKDIKKENIAPNQINVKDELKKYGNVGTDGTIYNGNNGINGQIAGSTKVIDKIIKNGKIDTDASLSSALFIKNISSDSKYIMETRLKYIDQKRFFGSDYFLNRVGYEDKWNRVKRLGDAYYENELIERSVTEKLGTRFLNGKEISAKDLMDNAVEEAKKNGLTVGQPLTKEQIAKLDKDIVWYEYQEVDGIQVLAPKVYLSQNTLKNINTDTRSRITGIENTYVRTGNLENAGLIGGYGNTYVEAKEVNNRTLGNQLAEIRGNKTTIIAQNNINNIGAKISGNENLNLVAINGDIVNKSTVEKIEFNNGEFDRSKFTKIDSVGEIVSNGNMYMLTNNYTSVGAITQAKNLNINVTNDINIKSQEVSGEQKFGKDDSQYNYYGFERNIGSVVKAENLNTTASNLNISGSAVTTKTANLNVDKLNIESKVDKEDEIKKSSYKSFLKSGSKKETIHNEENSAGSLYVENKGTIKGDVNLVGSNLVLGNDSFVGGKVTTDSRELHSSYSLEEKKKGFSGSIGSGGFSVGYGKSESKLKEKDLTNAKSNLVLGDGTTLNKGADITATNLIHGNISINNGDVKFGARKDVKDVETSSKSSGINLSVRIKSQALDRAKQGVDSFKQMKSGDILGSIASSTNTVTGVVSGLASNQGTKLPLSAVNKNNSDDDNDDDQNNQDNTVGKDNLKAAQATNNFYANVGVNLGFNKSSSNSNSHSESGVVTTIKGKNGNSSITYNNVKNIEYIGTQAQNTKFIYNNVENITKKAVELNNYSSSSSRSSGISAGVTIGYGDGTQTSVDAVKFSASKSKMNTNGTNFQNGRFVNVDEVHNNTKNMTLSGFNQEGGTVTGNIRNLTIESKQNTSTTKGSTKGGSLSIAPNGMPSGSANYSKTNGERKYVDNATTFLIGDGSNLKVGKVENTAGAIGTTGNGKLSIDEYVGHNLENVDKSKTVGGSVGISTSGINSIGINYNDRKQEGITKNTVIGNVEIGKSSGAEINKDLASMTEVTKDRKFETNVNIESQTIKYALNPEAFKQDLKKAKNEIEDIGNVIENTVNPPGEDKRNFFKNLRAQRWDTSFYNVTGSRMEELSRQFKAGEIDENQLKEAARDLIKGYGKDIGIDFEVVYLDEETMPKDSKGSTGSSYILDKKNRKVLIPIDVSKIGDINELLGTLTEEVSHGKDALEGRQDKKVAEDKSNDEEGLESLGRPANDYVENKLGEDNNSKIKLSTDGIDLTNADVGEKVGDVNTQDDRNSGYAETLPSQKDELWLNNMHFRLLKFKKGINEFKYVALGTAIRINSMLFNPEDKTIRDFTLGAFSAGAEDLSLNTYKIPKKFQYNTSAYKYGELFGHSTMSAIGILGTIIGSGMEGGGTAAAPATGGLSLIGVPAGVVVQTYSAGLTATSAINSAKAGLDIKAMKSEGGSSSSAETEIYDKKEKDEKLEKIELESREKRPTYRESEKDVYDFLDEKYKNNQNVEVQEQASFKGGEEAKRFGEKGSVRPDDTVIIKTETKNGTVISRESYEVKNYKIENYNNMTSKIAEQAKVRLKELPEGTVQKVVIDARGQKLTAETEIKTINDIVKKSNGIINAENIFFIK

SEQ ID NO: 6271 - protein, 1071 aa, Bacteroides ovatus ATCC 8483
MQAQPMLPNQPTNQPTNQPTNQPTNQPTNQPTNQPTNQTNQPTNQPTNQDSNLSEQLEQINVSGSTENSDTKTPPKIAETVKSAKKLEKEQAQDVKDLVRYETGITVVEAGRFGNSGFAVRGVDENRVAVQIDGLHQAETISSQGFKELFEGYGNFNNTRNTAEIETLKQVTIRKGADSLKSGSGALGGSVSFDTKDARDYLLNKNYYASYKRGYNTADNQNLNTLTLAGRYKYFDAIAVLTSRKGHELENFGYKNYDERVQGKAREKADPYRRTLDSTLLKFAFQPTDNHRFSIIADLYKQTSKGHDFSYTLKPNTQYTKYGEKELRHTNDKVERKNIAFVYENFTETPFWDTLKITYSHQKITTTARTDDYCDGNEKCDLVNNELGLHYNNENKLVDKNNNPVVYNKKDIPKKNYYYVTAEKYNQYYNEGVPKKDADSMGIKPIFGDYVLDPSLNGPRCKNKFHKESGHEGLCEIGVNSSLSVETLKANGITYDLTDPKNSKLVNKWLDHERHIISCDGINCDKKMISGYKINGESIDIPFTIKKFKGKNVAYIDKQLDKQYENGCFKENGCQKNPKNADYLIMPGSIGYQTNLWSQRDLISQTKQLNIDLTKHKVLFNTEHDFSYGGLWSQMKKSMVNISGDQPLDQAWFVDLPETCDTYVNGKLNSDRTHTLCDNKNTFSFLIPVKTKTGALYFIDDFRINDYLAFNLGYRYDRVKYKPEYTPGKTPKIPDDIVTNLYITTPEFNASQADSDLNESLKKQANAAANIKEIAQPKKFSASSYSFGTTLDPLNWLRLQAKYSKGFRAPTSDEIYFTFKHPDFSIRPNRDLQPETAKTKELSLTVHNDMGYITTSVFDTRYQNFIDLSYQGRHDVHGHSKLIPFHFYQNVNRPNAKVTGWEIASQISLGKITQFLNGLNLSYKYTYQKGRIDGGIPMNAIQPKTSVYGVSYAHPADKFGLDLYFTHVSAKNAEDTYNMFYKEEGKTDSTIKWRSESYTTIDLLGYIKPIKNLTLRAGVYNLTNRKYITWDSARSIRPFGTSNLINQTTGAGINRFYAPGRNYRMSVQFEF

SEQ ID NO: 6272 - protein, 1057 aa, Bacteroides ovatus ATCC 8483
MNKHFLGKCTFVHWYCLALAILLWLPITILEAAPSQNLKVSGIVTSATDGEPLIGVSVQVKGTSTGTITDLNGKYTLNVSTGQTLVFSYIGFMEQQVVATKPVINVVLKEDTKTLDEVVVVGYGTMKRSDLTGSVVSVTGDELKKSVVTSLDQALQGRAAGVSVTQNSGAPGGGISVSIRGINSLNGNEPLYVIDGVAISGNTDGNSSVLSSINPSDIVSMEILKDASATAIYGSRASNGVVLITTNQGKASKTKVSYEGYYGLQQLPKKLDVLNLREYAEYQNLRAQVLGFGDREEFKDPSLLGEGTNWQDEIFRNASMHNHQINISGGNEGTTYSLSGGYLSQDGIGIGSSFERFSARVNMDNKITNWLSTGLRASVAKTQQNNTIDNGNIIRTAIQQLPEVPAKNPDGSWGMQSENMYGTYFTNPVAEALMRENYEKGLQLYVDFFADITLYKGLVFRAEYAGNYYYNNNYQYTPSYDYGLYTQESLGSRSASNGSNWTLKTYLTYTNTFGRHQITAMAGHEAQENNWESLSGTRSDYFLNSVHELDAGSSLTAKNSSSKGSSAIESYFGRVNYGFDDRYLLTLTVRGDGSSTFAPNNRWGIFPSAALAWKLKNEKFLKNVSWLDNLKLRLGWGLVGNQAAENYAYGVKMRTVATIWGSGYYAENYGNENLKWEETEAWNAGLDINLFGNRVELIIDGYYKNTDNLLMKASLPSYVNGVISSPWVNAGAMTNKGLEFTLNTVNINKNDFMWRSGLTISFNRNEITKLYTETAGLSGTINSETYTYSEVGQPIGQFYGYNVIGMFTKEDDFYKRDSYGNYILDKNGERVKVAIPKGKNISESEIWVGDYIYEDIDDNGVIDEKDRTYLGNPEPKFSYGFNNSFSYKGFDLNIFINGVYGNKVVNMLRKEFTNPMNNSGMLKEAVNIARVELIDPSQPTTLSNVYVSNAGSAQVQRITAANANDNNRMSSRFVEDGSYLRIKNISLGYTFPKKWISKLNIDNLRVYMNIQNAFTFTKYKGYDPEVGAYNYDVLTRGIDNARYPSQRIYTFGLNLSF

SEQ ID NO: 6273 - protein, 657 aa, Bacteroides ovatus ATCC 8483
MKKKFMLLALIVLGGMCAFAEESPVLELKQTVVTSDSFGTPVRETAKNMTVINAKEIKEKGAKTIADALRGVPGVVVRQMDGASPMVDLRGSGATSQFNTVILLDGIPVSGLAGFNLNTVPVDEIEKIEVLQGAGAVMYGDGAIGGVVNIITKAPTKKAVYGGAGLEVGSWRTIRENVYLGGKIGDKFLLNASYSGNSSKDYRDRSPQYENKKDKRDSLWLRGKYLLDNGSIAINYNHSEDKDYYTGSLSKEQFDKNPRQVGSWSGYTYGINDIINAKYNQKINDKIDIFLTSGYYHNKNKFQKNSTSEYFIRPEVKLTYAKDSYVTLGLDYRDGKRDFKDDVFVNGVSQKAPDDKRESFAGYVMNKTTFDNWQFTQGYRREKVKYEYSSKVYDPMTWQLKEIKPKSADYSNNDSFEFGVNYLYSDTGNVFFNYARALRTPTIQDAGAWYGPVKTQKNDIFEIGLRDAYKNTSISTSIFYVNSKNEIYYDKTNSFNENNKNFDGKVRRIGAQLSLAHYFDKLTLRERVSYIVPKVTSGIYDGKEFAGVSRWTANVGATYNITKGLTANVDGYYQSDAYAEDDFDNYFSKGNNYVTVDASLSYAFENGIELYTGVSNLFDKKYANAVTSTRSTFGAGPRKVYYPANGRSVYAGIKYTF

SEQ ID NO: 6274 - protein, 835 aa, Bacteroides ovatus ATCC 8483
MSKHHLILAPLILGIGTNVDARDYFDPSLLASDVAGGGDIDLSAFAIPGGGMEGEQEVGIYINNDFYSRATLNFKNTDERGLLPDFPADFFDDILYEEYLVFDKTQVIPSSDFLAKVPFSEVTFDQALSRVNVSIPQAYIDEGAKLVSSPDTWDYGVPALLFDYNISGNRNKYNDSNSESFYASSLVGVNLWGWRLRTSANYNQYTTESVWGKTRSETNSFFNTYIERDISSLRAGLRIGEASTGGIILDSIPFRGIKLYSDDDMLGYRLRNYSPTVRGIARSQAVVTISQNGRQVYQTNVPPGPFQLNDFYISGYSGDMVVTVREADGSEHSFVQPYSTLPEMKREGVSGFELSVGKYDNYGSDDYYDQPSFVYGNWSRGFSYGITTFGETLQAEKYQSLGLGSTVSLGALGAASADVSVSRAEKYGDVKTGQSYGFKYSKSQLETGTTLTLATYRYSTKNFYTFSDFASNSEEARFVWENKLKNRMTLSVSQALGAYGHLSLSANQQSYWTSSEVTRNYSLSHSFSWEDIFFSTTFSLDQSHNRYNDYAENKQIDFYVSVPLSKFLGDKDITSSSLTYNVTNSDHRVRNSAALNGNIPETDFRYRVGGSWGNNNLNSTKTASLSWTGSYTSASLGYTYSHNNNTLDYSLSGAAVAYPWGLALGNNNVTNSGAIVVETSGAPGVRTSAGYSTSFLGTALIGSPQKYTENRIDLYPDGLPDDTVLAETSKVAVPAKGAVVVLDYKVFKGSQVVFSLKQESGKPLPFGTIVSLDGMPKGKENTGIVGEDGQVYMAGVPSKGSLKAVWGGNTCGIKFHLDDKKTVGPIRETTEVCKA

SEQ ID NO: 6275 - protein, 803 aa, Bacteroides ovatus ATCC 8483
MKLISILLLFTSLSTFAQINLTGNLIDSDGAPIAFANLVLQDIEDGTFKYGTSSNEAGIFTFSNVIVGDYDFKASFVGYVTLSRKLTLQNDTALNNLQLETDAAQLDAVMLIAEKPTVERRADRLIFNVENTSLSTGNASQILQSTPGVFEMNGSYTVKGSVAQVYINDKRVYLTNEELEQLLSGYSGENVKSVEVIYNPPAQYDADGGAVINIVTSKNVSLGYKGSITGKYEIDTFAKYNIGTSQYYKNDWLNVYANYNHNPRKDLTLEESQVGFFNSDGTRSSRWFTDANSVSRSQSHAFNTIIDISLNDKNSLSILGYLGLDNGREVESDVNTLILPQGATSFSGFDTDSNMGRDATIGSLNMGWNSILNENGGSLSMEGSYFFTDVDNDQEFFSTFFDDTQTTTGTNSFNTVGFQDINIFTAKADYLNQFGAYSLSAGLKYSDISSQSKQDFFDTNTGSDIDPSLSDNYLYDERIYAAYAQLEREWSKWSFAGGIRLEQTDVVGDSESLGIVNSQNYLGFFPNLSITHSLNEGNDLSLSYKRSIDRPRYGDLNPFNNFINDNNIESGNPNLQPAFTNKITLGWTHNYELFVDAYYIYTKGILDNLPFQNNDTNVLTIQSANLNYEYQYSIDATLIKYPNEKWTSLTSVSAFYMENEFETLQSASSNQQLNTTGLYIQTQNLFELSKDGTLNMLVEADYISSILFGSYKYENMLASSIGFSKRLWNDRAIVTAKYSDIFLSQNQPFITRYANQDNRVLTIPETQLFTIGFTYKFGNFRLENREPEVSEELERTGKKTKGL

SEQ ID NO: 6276 - protein, 1119 aa, Bacteroides ovatus ATCC 8483
MNYRKKAILMVMALFCLNIAILAQAVSLKMDNVSVKEAMTQLKNKSGYSFVYKVGDLDTKKIITVKAKELNEAIDQILYGQDVVYEVKGKNVIVQKGQARQNTSKDGKKRKITGVVNDVNGEPIIGVTIKEKGTTNGTVSDINAKFTLEVSPGAVLELSYIGYQPLEVKVGNQTDLSIVLYEKQELLDEVVVVGYGTMKKSDLNASIVSVKSEKLNKAASPNFSEMLMGRAAGLTVKQGSAQPGGGIEVLIRGAASTGAGNDPLYVVDGFPIVNAGVNPGSGNQWTAGSNSPLSSINPNDIESIEILKDASATAIYGARGANGVVLITTKRGTQDTKVEYNMNMSFQTINKRPELLTAGELMTTQNSYYKEQYLMQNLVYPYGNTDPGAVSPYVPMYTDEEIAKAGKGTNWYDMITRTGLIQQHNLTVTYGNEKMRSLISLNYFDQKGVVKTSGYKRYSFRYNLDHKITKWWDYGISATASYVVDQNATLGGGYDSTAGIIESALSYSPTVKAERDPTTGKWMEDPKQALLNHPLSYLDIEDETKTKRFLATAFTNFYFIKDVLWLKLSAGADIRDGSRHSYYPMTTKYGSSVNGDANINSANREDYVADMVFNFQKTFKERHKLLALLGYSYQVQNDDGAYARAMGFMSDALMYYKLQAGETRPVVSSYKNKHVLASYFGRAQYSFKDKYLFTFTARIDGSDRFGKNNRYAFFPSGAFAWRMNQEDFLKDVNWLSDAKLRVSMGQVGNENLPNDAASEYFAFDGRNYYLGDTEKRGVNLGKFGNPDLKWETTTEVNFGLDFGFFRNRINGSVDVFFKEVKDLLSWRSLPHTAVTTGIWSNIGKTKSTGFELTLNTVNLEGPLHWESTLTYTSYRDRWKERDPKVILAPYVKENDPVSAIYTLIPDGIKQAGEDTPAMPDLLPGQRKYKDVNGLDEEGNLTGKPDGKIDQADVVYLGTRAPKFTMGFSNDFRYKGFDLNIYLYASVGGYSYPYTQVEHGVYGGNGIQRLKDNNNFLADIKNRWTSDNMSSAMPSGEVNSYDSYGAPNWEKNTYLRLKSVTLGYDLSRLFKADKLKVRFYFSGQNLLTFTGYKGLDPEVENDRASYPQQKTFSFGLDVKF

SEQ ID NO: 6277 - protein, 390 aa, Bacteroides ovatus ATCC 8483
MKTKKIEIIVGSLVGLASSVAHSQSSVTLYGEIDNGIHYQTNVGGGKAVYMDSLNGIDGSRWGLTGKEDLGGGLKAIFTLESGINVNNGQLAQGGTAFGRQAFVGLSSDAYGSLTVGRQYDMVWYFPEFLAGAAAVGDLASAHPGDFDNTSNSVRFNNSVRYMSPDFHGFSFGVEYSLGGVPGDFTSTSGYSLGVGYTHGPLQIGAAFDYFKHPTSTPGNGWFTNYASGFNLLASSLNSAYQVAQAYQDAVIAAAYTIGNATISASYSNVQYANLGASFQNGTAIFNNYDIGLNYRVTPAFFVGVAYDYMKARSVTTAQGNSVGNQHYSQVAFTLDYLLSKRTDVYFSGGWQRASGTSSTGAPAVANIGGSGDSSNNHQMVYRLAIRHKF

SEQ ID NO: 6278 - protein, 501 aa, Bacteroides ovatus ATCC 8483
MKRIVSFLVFIAIISSVQGQTMQDAYRYSTSELSGTARFIGMSGAFGALGGDISAMTSNPASSAVFLSSSATASLSYRGLDNSILYNGGRSNSSESNIDLDNIGGVFVFTTNKDSDWKKISLGLNYSTERNFDENYTVRGTSSNSIDQYFLNYADGVPLELLQLQDSENISDLYSFLGENYGFGTQQAFLGYQGFVIEAEADSPENTEYFSLIDDGSFDQRYAYAATGLNGKLTFNIGTQYKDFLYLGLNLNSHFINYENSTELSEFNNNPESLTTEVYFGNSLLTNGDGFSFQLGGIAKLNENIRLGLSYDSPTWFSIREETTQYLESNSPADEFVSVIPNIINVYPEYRLEIPSKISASAAYLFGKQGLISFDYGRKDYSNIKFKPENEIDFQNLNANISDNMKAASTYRVGGEYRIADFSLRAGYRFEESPFKDENRVGDLTGYSGGVGYSFGSINLDLAYSNASYEEGNPIYNVGLTDPVNIDRDLSKVVLSLTFGL

SEQ ID NO: 6279 - protein, 814 aa, Bacteroides ovatus ATCC 8483
MKSFRLSLTALACLSALSQTSYAEANSVSANSEANIERITVYGRQNSVVKNSGLATKSDMSLMETPAAVVIVDQDLIETQGTDNLQDLIRNISGVTQAGNNYGIGDNIVIRGLGANYTYDGMYGGAGLGNTFNPTRSLTNVESVEVLKGPATGLYGMGSAGGVINLIEKKPQFESKNKFIAEVGQWDTYSLALDSTGGLTNDVAYRLVAKTARSDGYRDIGTDRDEMYGALKWVLTDSQDLMLSGAYIKDAIAVDSIGHPIRIYNADSVGGKTAGEVTWQDLINDPSGKGLQLTDEQRQQLAASLSSGDGLTPYSFGDAGLISPMAKDNEGEELRFKLTHNIYFNDNLFLNQQVQYRDYTSGFARQTGAYNYVYWKQGKNPINTEPRAPLVENGVLYPFAARRQEYRKVDADETSWQYFADLRYDFQIGHIDNELLINANYEDRNIRFKQYSIYDADQVFKDKDGKITYQGSLPYIYDIRHPNWGTGKFEDYDPLKTANYNKTVSAWGLGLQHVGYLGYGFTTRIGIAFNEIKQSYEHLGLDPRYSISQSQATPEADTTDNGMTYNLGLTYMPIEDLSFFINHSKGRTAYSVLDAVKDNATNRDDSESISNDLGMRFKAFEDQLLGSLVLFKSSRTNVAYNNPDYTNGILTPNIPVYFYDGSEDTQGVELDLNAHLNDQWRVNLNGMYQDARDKQNPNDIANYDSRQKGVPYVTASAWVTYGANWFALSSPIELSLGAKYVDDRSTHSSSFGIPDGYVPSYTVMDSAISYTADSWKIQFNINNLFNKDYYNKAMFLGGMPGEERNVKLQYSYSF

SEQ ID NO: 6280 - protein, 731 aa, Bacteroides ovatus ATCC 8483
MLNHTPLATALALAFAIPFAPPALAQSASQPAAASKPADTQNKAPATAAQTLPTIGVQAQAVQQDFQADRATVGAKTPTALRDIPQTVTVINRDLLASQGATSFTDALRNAPGVTIGAAEGGQIGNNINLRGFTAQNDIYLDGFRDRNQYYRDTFDLESLEVLYGPSSMLFGRGSTGGVVNQVSKKANLVDSAEISGMIGTDDRYRSTVDVNHKLTDTSAIRLNAFGQSLGSTRDVMKNKDFGVAPELRFGIGTPTEITLSALIQRNNDMPDYGIQALNGRPSPVPKNTFYGLTSDRTIQDVQIFNAAIKHKFSDALTLTNQTQISHSTTDARETAPQAVLTGPLSSSTALTNGNFTTLSPSQLFIKLQSHDRVIQNHAIYNDTMLEYKFNTGPIRHDLIAGVEVGHDSYTNQAYTRNNLPIVPMLNPPIMGTPSNVTTTVGNYADSSANEIAAYLNDTITLTPHWKLIGGLRWDRFSAQIRNTISAPAYASQTNYFTSVRTGVIYQPTDWQSYYVSYGTSFNPSLETLTVTNLTQNLAPESTKSYEVGGKWDLFGGNISVTSAIFREEKDNARTQVSSTEYQLAGDIRVDGFQASVTGHITDKWQIFGGYTYMDATILKAADGTQGHTPANTPRNTLTFWTTYAITPHWEIGGGPIYMSPRYASNTNYVKVPGYTRWDATAAYHAKKYDVRLNLLNLTNKYYYDALIPSDGGRSVPGIGRTLLATFNYRF

SEQ ID NO: 6281 - protein, 1068 aa, Bacteroides ovatus ATCC 8483
MKRKLMLLLACLFVGIGLVTAQTQKVTGVVISEEDGQPVIGASVLVKGTQIGAITNVDGDFTLLNVPSSAKTLQISYIGMQTQEVAIKPNLKVVLKPDTEVLDEVVVVAYGTASRQSITGAVASIDSKKLEMRPVTEVTGTLEGAAPGIQVNNSYGEPGSDKSEIRIRGFGSVNGTNAPLIVVDGSPYGGSLNDINPQDIESISVLKDASSAALYGNKAANGVIMITTKKGKSHKLNFRIGVKQGMYTRGIPEYDKLGVNQWMEAMRSGMQSYWEKDGGVTPQQAFEASKTVNDDIVFSPIFDKNGAAMFDENGKFVAKVKPGYNDLDWLKALERTGYRQEYTASADAMGEKYDIFSSFGYLNEKGYIIGSDYDRFTARLKANYQPTSWFKTGVSLSGTMSGSNYQANAHDAYFANPFYTAGQMAPVYPYLMHNEDGSVATDGNGNSYDISNYDYLSGRNIIYEIQNDISRKERNAVSGQIYGTISFLKDFAATVRGDLYNVNNTEKAFNNPYCGDGAANNGRLSKVHDRTREYRFTQELTWTHDFDKHHIDVLLAHESFKHSYNYDFMMKEQMKVSGNTEMSNFAKMTSIDGYNQEYTTESYLSRARYNFAERYFLDASFRRDGSSRFSDPWGNFWSLGASWIISQEKFMKDLTWIDNLKFRVSYGEVGNDAGADYYAYKELFYSDVNAGIGAFYKIQIPNKNLKWETSGSLDIALEGRLFNRFNFSLDFFNKTSKDLLFTVHNPLSAGATDWFATSDETPSGMSQYFANIGSVRNTGLEVAMDVDAIRTKDWKWNIGLNLTTIHNEITKLPGGKDILHGTQNYSEGHSIYEFYTYTYAGVDQMNGRALYNANSQLGESTINALKAQDEYVTINGKNYVYNTSYAEKEWQGSALPDVYGSINTSLTWKDLTLSVLCTYSLGGKVYDYNYQGLMYTTTNGPGALHKDVLNGWQAVPEGMTEDSPNRLNPNGTPQFDLSSLASTSYGASSRWLTDASYFVIKNINLNYSFPKKVVTKWGLGGLSVYGSIENAATFTARKGMNPQYSFTGSQDNTFVAARVFTLGLNLNF

SEQ ID NO: 6282 - protein, 1120 aa, Bacteroides ovatus ATCC 8483
MKNITLTKIPIGEGKEPCLNSKKIVLSLATISFLASCANAKLNSEIKTYDEVNKNVKTRSASVYSPQAKINTTINSLHNQQVTITGNGTSNSLTIGSSGTLGSIGNTGKIIYAHANGSNTLTLANLTNNRTINGKIGIENNGNFTGTIAVNTFENTGQINGQIYMGIWGNNSGTLNIDKFDNSGTIIDNNKGVFEGKNTNIQTFNNSGFISANKGVDIGNIGTIKNFNNNGTIQGSEVGVAINTKIDTFTNNGFINSPGSGQWNNGIWISSNATIEKLVNNGTIKGGHSAIMVTSQHIKTVENTGIIHAEGEWGSSILLEYGGFIEHIINTGTISNNNVGIGSAYGVFGTLTIKDGGMVYGKYSAIGVGRSQTLGDLYIDGRSNNGTVSGIYSEEHGILLENNSRTQKIELKNGGIIKGNIDGIRLINSASLSGEMILSGEGSRVEGGRGVGILNRSGKIEGSIKVEDGATVTATSNRAIANSGSGSITGGITVSGKNTKLEGNIINTGNASIGSDIKIEGGAKVEGGLVNQGNGSISGSVQVSGGSSIDSITNEGNGAISGSITVYKDSKLDSITNTSTSSTGISGSITNNSDNKLEISNSGNIGGKIESTGSADMVISNSNGGTISGGISSSGSGSTSISNSQGSTINNGITVSGSAQVEISNQGSVGKDENGNTVTNNGSGSVGIKDWLVSTDKNTGKLNTVVIGGSRAFNVKVENITVDQSNVDLEELNDINNIISGVNQNNIGNIGTNGSGEISLSFDPITGKLTTDFNLNASISGATFRSLISTTSRRSTFIDNVMGNSMQSFALASSSKSQSIAMSEKGNLYADASDYIKSDLNNGSYGSNKEHSLFILPYTSSQNVELSLNEESKGHTKGTIIGYSTLKDSGIYGVYAGYEDTKMGSTYFDINNRTYYAGLKYFNTLFTTEKGQEVYIKAQGKAALIKNDLTEKIGNNEAKAEPNSYAYGVNTALGMNFISNKDIFSPEIGLAYEGGYTEAFSMKDTIGQATVKGGERTYANYLNLFSTKTSLTWFRDWLPNLKTSVELGAKFNINPKVEAEARFGNIKVSDEFDLPRVQKFVSTSFIVPVNEAFYFSLNYNGMFDKDGNTHTGFAQFNYLW

SEQ ID NO: 6283 - protein, 1054 aa, Bacteroides ovatus ATCC 8483
MKNKKNHMKRMLMLSLLTSACCIHSYATTNKSTLVRETESVESILQNRRISGVVNDNFGPVVGANVSIKGTTIGSITDMDGKFSFDAPENGILVVSFIGYTTQEIPVKGKNEFIITLKEDTELLDEVVVVGYGTQKKVNLSGSVSAIEGEQIASKPSTDVLSALQGEMPGVTITRGGGQPGAEGTGVQIRGYSSVNDTKALVLIDGVEGDMSMLNADDIESISVLKDAASCAIYGARAAAGVILVTTKNGTEGKPKISYNGYVSFNIPGNMPERVPAWEEQDFINRTRIPRGGPEWNAEKSSWIGNPNFNYRPLGNGRWDLFDSVDWLGEGLKNSTLQHNHSVSVSGGTDKINYMLSANYYYKNGLLKYGPDDYERYNLLAKLNAKLNKYVDLGVNVQYNADDMSENSFGAGEIFRLLYENRGRQPIYQPEAENYPSPYNGDLQDNPIDIMKNGGEKSTEYESYTGKAQLTIKDFIKNLRINLSASRRAGYYHQESYKRTLTYYNYVGDVRRTTNSPNSLYKSQYKEYHDLLEATINYSFNLKEKHNFNILAGSSYENYRMNQIKGTANNMISNDFFSFNYYDTSKATNSILADQIDTWAMMSYFGRINYNFKERYLLEANVRYDGSSRLAPSHRWKAFPSVSAAWRVNEEKWFNLDWVSNLKLRMSWGQLGNGAVLGLYDYIPLITYSQKDIPASYQGEKWLYQSSMASEDKTWETVETTNIGLDFGLLNNRLTGSFEYYWKFNNDMLSALQLPHQIGINVPNMNVGKLKTWGWDFNINWRDQIKDFSYQIGFNISDSKNELLKYDGASVVNAGVVKLLEGYPINTIWGYQTDGFWSSREEYLQYKADHPGYESFQDGIISGGDVKYVAQGKPDHKIGVGNGSPEDSGDLVMLGNTTPRFLYGINLAAQWKGFDLSLIFQGVGKRDLVLNGRMFPIANDAEMPWTIHRDYWTEENPNAYWPRLYQYKGDDFNSKPADRWIQDASYFRLKNVTLGYTIPISKKYMEKLRVYVTGQDLFEISDILEVMDPEVESNANRGMYPFFRSWTLGLNVTF

SEQ ID NO: 6284 - protein, 789 aa, Bacteroides ovatus ATCC 8483
MLKQKLYWCLFFFSLLGFGQEKVILSGVASDTNNNETLIGVSVYISELNIGTYTNEYGFYSISVPQGNYTVQVSYVGFETILEKIEINQNVKKNFSLKESNQELKEVVITKNIYRTNIKKPEMSVNKLSINTIKQMPAILGETDVIKSILTLPGVTNAGEGQSGFNVRGGSADQNLVLLDEATIYNTSHLFGFFSVFNTDAIKDLKLYKGGIPSRFGGRVASVLEIYQKDGNNTDFHMNGGIGIISSRLLVEGPIVKNKGSFLFAGRSSYAHLFLKLTDNKNSAYFYDLNTKLSYKLNENNNLYASGYFGRDVFSLNESFVNTYGNSVFNLRWNHLFSNKLFSNLSLIYSDYYYGLTLDFIGFNWDSGIKNYNLKYDFKHYLSDKVKLFYGANAIYHDFNPGKIEPTNDTSGINPDQLAKKYAFEPSVYIDVEQQITDKLAINYGLRYSKFYRLGDEEINLYANNQAVVYNEDFQIYEKATPIGSEYFGKNKTIAQFGNLEPRVSIAYTLNESSSIKASYNRMSQYLHLISNTQSPTPLDVWAPSDDYLKPQILDQVAFGYFKNFQNDDYTLEVETFFKKLKNRLDYIDGADLIANDDIEQVVLKGEARAYGLEILARKNNGKLNGWISYTLSRSEQRTPGRTAVETGINNGEWYKTGWDKLHNIAITSMYKLNEKWSFSSIFSLQSGQPVTYPNGQYQYQGISVPTYGLRNENRLPTYHRLDISATLVPEKNKTRNWHGEWVFGIYNVYSRKNAASISFRQNQDSGNNEAVRLSIFGIVPSVTYNFKF

SEQ ID NO: 6285 - protein, 156 aa, Bacteroides ovatus ATCC 8483
MNIIEANVATPDARVAITIARFNNFINDSLLEGAIDALKRIGQVKDENITVVWVPGAYELPLAAGALAKTGKYDAVIALGTVIRGGTAHFEYVAGGASNGLAHVAQDSEIPVAFGVLTTESIEQAIERAGTKAGNKGAEAALTALEMINVLKAIKA

SEQ ID NO: 6286 - protein, 342 aa, Bacteroides ovatus ATCC 8483
MKQSLTYGGRLEGMAKLDFDKIFGIKNSSLHYIMYQGLGQGLSQEAIGNDFGVTQIFSSDILAIANLSLQQKLYHDQVYLSAGRLAVGDIFARDDTFAYYLNGALNSTPGQLLINQPAFTTYPFNTWGVAGTYTFPDNQYFGLGVYDANVDDLNNAEHGFNFRFQPEGNVLVVGQVGVNPGKDDTSQFLPGHYQLGAYYNSGTVDVLGDSTETREGNWGLYGIARQMVYQEEGDQGLSLWGLFTMAPQQAINTQPYGVSGGFFYQGLLPNRDDDVTAGAFILGFYSDNLVNQSYELVFEFAHRYQFRDWSYLTLDFQYVVNPAGNDDIPDAWVFGTEFSVKF

SEQ ID NO: 6287 - protein, 1066 aa, Bacteroides ovatus ATCC 8483
MQKKLVLSCIALSLSLFNAPTLRAQTTTSLYGTISDRSGAVIPAAQVTATHVGTNQARSAKTNAEGQYRFEFLPIGEYTVEMTATGFKKFVQKGVLLEVNVAARVDSTLDVGTLSEEVEISGSAPVVNTANAQLGRSVANEEINTLPIVGRNVYTLLSLTPGVTSNANSIVLGYPEQRTMINGGVDGGAGSVSYYLDGGNNMTGLRNTGNIAPNPDAVEEFRVVTNGYSADYGRFAGGVVNILTKSGTNDFHGSLFEFFRNNDLNAYPWVGVAAPLHRNQYGGTLGGPIRKSKTFFFGTYSGLRQITSSVLNGAIVPTALERAGNFSQSKTAPKDPSNGNAPYPGAVIPTNRLDTAAMNILNKNIPLANAAGSIWQGSISSPYNTDEVLFKVDHSFNDRQRLTASYYETSGHQSISPGGNLPWSTENFNWRQQNVNLSHTYTLSASMANQFWAGYTRNFGGRLNTPQTSLGDLGSSFNVQGPPALPQITVTGYFTLGQAIAGPVAGTNFYFTRDQVSYIRGRHNISFGGELSLNKDVQQTLLNNYGVFSFTGTKTGNALADYMTGLPVTMNQDSPITALDNSWTTAMFIQDDFRIHSRLTLNLGLRYELQTPPTDPFDRESTFIQGVQSQVLKGSNVPIGLLVPGDPGITRGIVSLQKTHFSPRLGLAWDPKGDGKTSIRAGGGIFYGSVSGNEWNSTSNYNPFAVRQQFNTVQSLTNPYGLLPGGVSPFPFTYNPNAPQFILPASIYGVAPNFKWPYTYQFNFSAQREVFKNWTLTAAYVGSLAHRLPFAEDLNYPYYNSTATSSNVNNRRPIQPGTLAQIFSVQSVMNTSYHSLQVTLEKRLSKNFSAKAFYTFAKALEDVQLDNNTTNGGAQNFRNLSEERGLSDNNRRHVMVSSIIWNLNYFNKTNRWLKTIVKDWSISGIVTLQSGGPFNVTTGSDTNLDGTNNDRANLVGNPFLDPHRSRSDVTNAWFNTAAFAKGANGTDGTLGRNVMTGPGYKNLDLGIFRDFRVWERVLLQARGEFTNAFNMVNLGNPNGTLSSALFGTIRSARDMRQVQIGLRLTF

SEQ ID NO: 6288 - protein, 817 aa, Bacteroides ovatus ATCC 8483
MNDRPPPNQTASHAGPFRTGFLLALAALCSVAVQAQTTAPATATPAADDDEVVKLDAFTVSTDRDVGYRATNSIAGTRTNTPIKDVPLNIQVFTKDLAEDLLIKNQVQFETYNASLVAGGIDVFSDNHIQQPYEQFLYRGFKQNWGLRDGVREYDPVDSQGLARVEVVKGPAAALYGLAYPGGIMQNISKTVELEKNFTSLRLTGGMYGDYRATADINATGTIAGQKIGVRFNGAYEKTEDNREHSQGDVRLLNVAVAWQPTATTKLEFMAEDGYRAKPNGLGYFLTGEAGAANNQAQIPLQILNPSIDWDWNWANDNNLNVLETKRYKGTVTQQIGEDVTVQAYLQYSRRLEIPGNGWDASGSGGANAWESASSGWDQATNTIRSTYNYRDWGNQMHAYGATAVYKLNFEQIKNTFAFGANVWKEDELSRHSAPLNPLASALVYPVQMGVPINVPPFPPADLQPDLTGGNGYHHEDNSNDYYFVNWQASMFNDRLKTNIGVNKTNLKTIAWDNGVDTEPNVYTASKYSPLFGAVFAVTKEISVFAVRSTSLFPDSTKDSFGNQFSPQVGLGYEGGVKVDLLDGKISGTISYFVIQQTGGTQNDPTKENRNTVRFDSLTPEQRQIEFGGVRPLGDIVQGGEQESKGFEMDLTFQPLRQWQIVTSYSNVNHEFTKSALPATIGQTNPQAIKNSFAVISKYSFLDGELKGLAVGGGLRWWDKSLQDYQRRAPNGGVYSGTGDFIDVARYSPSRTWAELFATYRWKVWGQNVMLQFNAQNILRADSYVGWKATGSADKLAVDRYKVPTPIVYRLTFGLDF

SEQ ID NO: 6289 - protein, 676 aa, Bacteroides ovatus ATCC 8483
MRIKAVIRARTFRQSLLLSSALMSLAAMPAYAQEKPKSDEQSGVILNRIVITSAPQSTPFKVVTDPKAPRQPVPASDGADYLKTIPGFSTIRNGGTNGDLVFRGMFGSRVNIRTDGGVILGACGGRMDNPTSYISPESYDRMSVIKGPQTVQWGPAGSAATVLFERDPQHFDKLTLKGDSSILFGSNGRFDARVDATVGDKPGYIRMMANKSRANDYKDGDGNRVPSKWDKWNTDLYLGLTPDADTVLEISGGLGDGEARYAGRAMDGSQFERQSFGLKFSKSNVSDYLEKIEAQLYYNYADHIRDNFRLRPPQKMPMESEVDRRSMGGRVSTTWNFDEHRLVAGLDFQTDTHRGKEKVNMQLTDNWLKDAQFANYGVFGEWTWNFADNQRLVAGGRIDRASVEDDRASSLTYGDKRNQAAFSGFIRHEQDWSSLPVNSYIGLGYVNRFPDYWELFSPKGVTGSALNAFEGIESEKTVQVDFGAQYSEGDTDIWASGYFGVINDFILFDYSNPGGSVATNVNARIMGAELGVSRQFANYWKAEASIAYAWGQNTTYDEPLPQIPPLEGRLGLTYERDNWSVGALWRLVAAQTRIAENMGNVVGKDFDKSAGFGVFSVNGTYRFNESVRLSLGVDNLFNKEYTEHLNRDGDAGFGFSSNYQLREPGRTFWAKTDFKF

SEQ ID NO: 6290 - protein, 794 aa, Bacteroides ovatus ATCC 8483
MFNLSIRQGFLHSSMMMGTLFSAAATSSSVMAQQNDGAPGIPTSQQQKAAPASDEALMTVLSPPVKKVAGSTVSINAAEMQQRGVNDFGSIMRYQPLIGAVGSSGGSGSGKSGFDRAGYAGYNIRGLEGNRVALDVDGIPQPDATGRSYAGRAGVNTFGIGRDYIDPYLYGRVDIEAGATATSRANTALGGSVSFQPKSADDYLLPGKPSYFGYQSDYDSSNRSWHSGITAAMGDDTLRGLIAYSRRDGQQTRNNSGVLDAYPANWHSDAVLASGIWQPNDQHRLIGTVDFYSKVNHTRYDSWNSRSTAVLGDANQQSNTRRWGVSLKDEWTPDNNGIDSLSNKIYFQRTEAHDNTLSPQEPISRGYQRTYSDYNVNIWGYEAQLAKTLGRHTLLSGVNASVAETERPFRQSPTQSVTKPQADSRTLALGAFVQDSMQFDIAGHGLVVVPGLRVAHQETKPQDVGNLAAGTAVLTPEVAQSLYGKTNSDTQLLPSISFNYDLTPGLMTYLQYKRGAQFPNANQLYGSWNLGSNYIPGAQYALVGSTELDTETSNNVEWGVKGQVSEGVTLNGSLFYNTYKNFIAYTRYTRAQSPEKFVNVPSNLATIYQAENRDKAYIWGGEISTKINYGTWFEEVNGLNTTFALGYSQGKSKSSYSGDKYVDLDSVAPVKAIVGMGWDDPSQRFGAAVTATFVKGKKAEATNRESYTNNGSSLTDPSSEYTRVPGYGVVDLSAWVKVSKNVKLSGGVYNLTDRKYWDYLSSRDLTGQTARDRNDRALAVMPGRHFQLGVNVDF

SEQ ID NO: 6291 - protein, 820 aa, Bacteroides ovatus ATCC 8483
MLLLAQGGPQNMKATNQYLSHSRRTNRPLALAVAAACGAVGVAGVAIPGVAQAQIEEVVVTATRRAESVQEVPMSVSVLGETQLQDLNITDMEDYLMMLPNVSYVTLGPGSGNIYIRGVSSGGESTLGANPSVAVYLDEQPVTLVGNYLNPHIYDVNRIEVLAGPQGTTFGANAQSGAMRIITNQPELGEFSGGYSLDTSQVKSGDPSYRAEGFVNIPIGERAALRVMGYYKHDGGYIDNVQGSHTFKRGYIRAGLPEGSPLRDIASDFTASNADIAKENFNEATTYGGRAALRVDLNDSWTFTATAMMQDLDREGVWDHDPTIGDLQVMQLLPESMTDKWTQFSAKIEGELFGGTLTATAADLDRDIEVYADYSLYSDYYVSQGFVDPYYNCYVSYFGTCGDPREQFTQESNQGRQTFEIRYASDPDKRFRYMAGFYYVDVEGTNDYEWHVLGLAETPQAAVDAPDIYWTTDFERLYEETAIFGEVSFDITDRLTLTGSARQFDYESSLDGFSGTVFWPCGGFGPQGDRPASNYGDSCAPDSRVTESKDEVYRIAADWQVTDDIMLYTTWGEGYRPGGLNRFCQTRIPDGLPGQGSINIGCEFTSDFLTAVEVGFKSELFDGRLRLNAAAFWQDWEDFQFSRLDTSISPITLTYNVGNAESNGFEFDFAAMITDNWSITGAASFLDSTLTSDYRRNPSSPEPDAASGTDLPRVPDVKFNLTTRYDFMQDWFVQASYMYTGKSTNTLFDGGSAQNELREQPSYDVLNTALGLQRDTWTAEVYVQNVTDERGVVWINAVNWDTREQVNQPRSIGVRWRQSF

SEQ ID NO: 6292 - protein, 846 aa, Bacteroides ovatus ATCC 8483
MKQRLGIVIALFCLSPAIFAQQKAEKNAREDNASFTFTESQLNEDDDAAQSASAFVSSNNDVYLSNVGYLFSPMRFRVRGYNSQYSDTYINGVLFNDVETGRFSYGMIGGLNDATRNKEGIGAFEINNFTFGPIGGATNINMRASQYAAGSKLSLSGCNRNYILRGMYTYSTGLLKNGWAFTGSLGYRWANEGVIEGTFYNAFSYFLAAEKVFNDKHSLSIATWGAPTERGQQGASTEEAYYLANSHYYNPNWGYQNGEKRNSRVVRSFEPSAIASWDFDINKEMKLKTSAGFKYSNYGTSALGWSGNAADPRPDYYKKLPSSIFNVYDKSTVPSEDELNLFNEVTERWKTSKSTRQIDWDQMYFANQQANALGKETLYYQEERHNDQLAFNFSSIFNHTIDQHNSYVVGLAVNTTKGMHYKKMKDLLGGDLYTDVDKFSVRDYGYNSYVIQNDLDNPNRRIGEGDKFGYDYNIFVNKQNVWARYQGDNDGHFNYFVSGKIGSAQISRDGKMRNGRAPKKSLGSSGTAKFLEGAVKAGFTYSINGNHSLILNAGYENRAPLAYNSFIAPRIKNDFAHGLRTEKIYNGELTYRFNTPIVSGRVTGYYTRFNDQVEMDAFYNDNEARFTYLSMSGIDKENWGVEAAATFKLMSNLSLTAIGTWSDARYMNNPTAVRTYESESESNIDRVYCKGLRDNGTPLSVYSLGLDYSVKGWFFNVTGNYYHRVYLDFSTYRRLGSVLGKYSDGAVDANGNPVGYNVPEQEELNGGFMLDASIGKYIRLKNGKSLSINLSVNNILNNTNLRTGGYEQNRDDSYDDGEARTYVFSKNSKYYYAPACNAFLNIGYRF

SEQ ID NO: 6293 - protein, 217 aa, Bacteroides ovatus ATCC 8483
MKHRLAGATALVLLVATVPALAQGTRSGDSGPYIRGSLGYSWSSEDEIDYSPLWGIGAGYRINPNLRVDLTADWRDRYIVEGGRGFAAGGLPINSEVDNRTLMVNAYYDFGAFDLMGNRQQVRPYLGAGIGLSTTKVDDVDVIIADQNRLERFFGSDDDQFSWQLMAGAQVETGNGLFFDLGYRYVDLGKVQLTSTTGALDEDLSAHELVATLGYRF

SEQ ID NO: 6294 - protein, 1021 aa, Bacteroides ovatus ATCC 8483
MEKFNAMRTRLLQDLQKKTIRFKSIVALTCLLLTSVSAFAQTKTVTGTVTDAANEPLIGASVLVQGTSTGTITDMDGKYSISVTPEDVLVFSYVGMTTQSVKVGAQNVINVTLKEDSQVLAETVVIGYGSAKKRDLTGSITNVKGEEIANKPATNPLSSLQGKVAGVQIVNSGRAGADPEIRIRGTNSINGYKPLYVVDGLFNDNINFLNPEDIESMEILKDPSSLAIFGVRGANGVIIITTKKAKEGQTLVNINTSFGFKKVVDKVDLVNGPQFQELYSEQLANQKDTPFDFSGWNANTNWQDEIFQTAFITNNNISITGASPKHSFYLGVGYSHEQGNIKHEKFSKVTINASNDYKITDFLKVGFQFNGARTLPADSKQVLGALRAAPIAPVYNKEYGLYSVLPEFQKAQINNPMVDVDLKANTTKAENYRASGNIYGEVDFLKHFNFKAMFSMDYASNNGRTYLPVMKVYDDTAAGDVVTLGTGKTEVSQFKENETKVQSDYLLTYTNSFDHGNHNLTATVGFTTYYNSLSRLDGARKQGVGLVIPDDPDKWFVSIGDAATATNGSTQWERTTVSMLARVIYNYKGKYLFNGSFRRDGSSAFSYTGNEWQNFFSLGGGWLMTEEEFMKDIKWLDMLKIKASYGTLGNQNLDRAYPAEPLLSNAYSAVFGKPSIIYPGYQLSYLPNPNLRWEKVEAWEAGFETNVLRNRLHFEGVYYKKRTKDLLAEVPGISGTVPGIGNLGEIENMGVEMAASWRDQIGDWGYSVSANLTTIKNKVKSLVQDGYSIIAGDKQQSYTMAGYPIGFFYGYKVAGVYQSQADIDASPENTLATVTPGDLKFADVNRDGKITPEDRTMIGNPTPDFTYGLSLGVNYKNWSLGIDMMGQHGNEIFRTWDNYNFAQFNYLSQRMDRWHGEGTSNSQPLLNSKHSINNLNSEYYIEDGSFFRIRNVQLAYSFDKALLAKIRLQALKVYVNIQNLKTWKHNTGYTPELGGSATTFGVDDGSYPVPAVYTFGINLTF

SEQ ID NO: 6295 - protein, 1050 aa, Bacteroides ovatus ATCC 8483
MKKIRTILSMSVLLLGAANIWGQSAHKLTGKIFSTKNQPVEGAIVTVLDTVNVTTSRDGAFKFELKDPSKAKEISVWAAGYYPVQQKLNSRSEVVIMMTPEGQYKYNESVVLPFREEGDTRLSNSTSATNITKKDFLLGGTKIDRALAGQIAGLEIKRGSGMPGEGSYYNLRGIRSLTGDNAPLIVINGIPYMPDKTSSTVIGGFTRDIFQSYNLQDIQNITVLKGAEAAMYGSLGSNGVILIQTDGAVSNDLETKISYYGSFGVNWNDKRMPLLGVEDYKSYLSDVGLTIYEYPKDFYENFPFMKDPNDKRYAYLYNNNTDWQELIYKNSTSTDHLFRVEGGDAIAKYDLSLGYSRDNGLMDNTSMERFHTQLNTNILVSQKVNIFANLGLAYLNGHFQEQGMSAATNPILAAYFRSPLLSPYDKDRDGNVLATYSSYRYGESRTTAYGVSNPLALINTLDAHNRQYDLNMKAGISYKPFLGLTVSGIVGLYYNFNNEHLFIPGQSDPTILPVVDMYDTRNNAVKEGEAETTNFFLNLNGNYQKTFNYVHKLNAIAGWQMLTSKNEYDAGEGRNTGNDFYQTLGSVQAIGRRFLGYTNNWNWMNFYAHADYTYNDKIQASVNMAVDGASSTGTEVNRFYMYPSVGLTWLGKGWKPFQNTTWINKFNIRAEYSLTGNTRFASTLGSFNYSAAPYQQLSTIVRTNVPNTSLKPERNASLNLGIDLSALRNRLNVSFDYYNNQVSDMISAMPLSSIYGSSAYYANIGKMENKGIELSVQASLVRTRNLEWIVGGNIARAMNKIKSLGGEDQIVLDYNNGVQMVHRVGESPYQYYGYQADGVFSTQAEADAANLSNRTGMRYNAGDVRFVDQNGDNRIDDKDRVLLGNASPRYFGGFYTQLKYKGFALSAEFSYSKDNMAYNAVRQQLESVSTTNNQSFAVVNRWGLEGEVTDIPRAVWNDPVGNNYFSSRWIEDASYLRMRNVTLSYTFTKKLWNFFRAGTIYVTGENLFTVTNYLGMDPEFSYSYAENMQGFDNAKLMQPKTVKVGVNLNF

SEQ ID NO: 6296 - protein, 1039 aa, Bacteroides ovatus ATCC 8483
MVMKNVKKKIQRIPYLFLLMLFSCLTASAQQGITVKGTVLDDNGETIIGASVVVKGNNSIGTISDIDGYFVLTVPNEKSVLVVSFVGMEAQEVKATKGIIRVILKDDTQLLDEVVVVGYGQQKKASVVGAITQTSGKTLERAGVNNLGAALTGNLPGVITSSSTGMPGAEDPKIIIRTQSSWNNSEPLVLVDGIEREMSSVDISSVENISVLKDASATAVYGVKGANGVILITTKRGKEGKANVQIKANMTAKVVSKLPEKYDAYDTFYLMNNSIEREAALNPAGWANYTPAAIIDKYRHPANAEEWDRYPNVDWEKELFKKVAMSYNTSVNVSGGTKVVNYFAAVDFVNEGDLFKSFENGRGYNSGFGYNRINVRSNLDFHLTKTTKFSTNLFGSNAQRQLPWNMGDNDTGFWNSAYKSAPDAMRPIYSNGMWGWYAPRDADVPNSAYSLAVGGKEKRTTTKMTTDFILEQDLTMLTKGLRFKANFSMDYTFVENNRGLNDMYNDAQRLWVNSDTGEYVYKFDPDTGTGLDKVINPIYWSQQSGSANMGSTYRKLYYSMQLDYARTFGKHEVTALGLFSRLKEARGSMFPIYREDWVFRLTYNYAMRYFFEANGAYNGSEKFGPDYRFAFFPSLSIGWMISEEKFMKNLKFIDMLKIRGSWGRIGDDNVGGRFLYKDQLSNGGNTVMGSINPDNSPYTFWKTSSLGNPNISWETVEKRNIGLDYAFFNGLIAGSVDIFNDVRTDIIVDGGSRAIPSYFGATAPKANLGKVNSHGYELELRLNHIFNNGLRAWLNTSMTHAINEIKFRDDAPLLPAYQKGVGHTINQVYSYIDHGNLGTWDDVIGSSTWTTGNDMKLPGDYNIIDFNGDGIVNIDDRAPYQYASTPQNTYNASLGFEWKGFSCFAQFYGVTNVTREVNFPTFRSTAHVAYAEGAYWTPGGNATLPTPRWGTTVDPAATGTRYWYDGAYLRLKNVEVSYTFKNNWLKKIGVNSCRLYLNGDNLYMWTDMPDDREANYGTGSSDGAYPTVRRFNLGIDITL

SEQ ID NO: 6297 - protein, 938 aa, Bacteroides ovatus ATCC 8483
MNRKFIYIGCTVFAMSLFHAGSIQAQEENKDSLVNVAFGTVAQKDLTHAISTVNTSELTKKVNSSSSLVGLESLIGGYTGSIWGQEALILVDGVPRSASNVRASEVENISVMKDAAAVVLYGSRAAKGVILITTKRGKNEPMHIDVRGNAGINIPKSYPKYLDSDCYMTLYNEACRNDGLSEKYNTSDIYNTAMGANPYRYPNIDFYSSDYLRKAYYNADMTGEVYGGNERTHYYLNFGMDYSNDLLKYGESKNAYNMRFNVRGNVDMTLASWLKATTNAAIVYTNQYAGRGNFWGVASTLRPNWFAPLLPIDMMDTNVSQIQEYIANSNHLIDGKYLLGGTSSDMTNPFADLLAAGYVKEKARMFMFDVSLAADLGSLLKGLTFKTSYSVDYTSYYSEAFKETYAVYEPTWAQVNGKDMIVALKKHNEDKKDPNEYIGKSTYDQTMTFSAQFDYARTFEKFHNVAATFMGWGYQTQKSADENHESSDYHRTSNVNLGLRASYNYNHKYYIDFNGAVIHSAKLPEGKRNAFSPAVTLGWRISKEKFMENVDFINDLKVTASYAKLHQDLDISNYYLYKGTFSKEGYYVQWHDGTAGGWTPVSKRGDNPNLDFITRKEFRAGIDATLFNRLLRLNANYFKQDTKGLLTQGASFIHPAYFALGSNSSFMPWINYNEDRRSGFDFSLSANKKFGDFNVTLGFNGMVYSSEALRRDELYDEDYQFRKGRALDASYGYVCEGFFQDQTDIDNHARQTFGTVKPGDLKYKDINEDGVIDNKDQIELGKNGWAAPPFSFGLNLTVKWKNFSLFAMGSGQTGAIDYKSSSYYWNRGTSKFSEIVWGRWTEETKDVATYPRLTTTNGDNNYRNSTFWMYKRNYFRLNQAQLTYDFPENTFKGTFIRGLSVYCGGNNLLTISKERKHLELSTGSPQCRNFYAGFKAAF

SEQ ID NO: 6298 - protein, 540 aa, Bacteroides ovatus ATCC 8483
MVFAPVSVEATDVIGDSLEQVTSITQFSDVYPTDWAYQALSNLIERYGCVAGYPNGTYRGNRAMTRFEAAALLNACLDRVTEVTDELKRLMKEFEKELAILKGRVDGLEARVGELEATQFTATTRLKGRSVFVVGANTYSGSDTFGFWSVPMAQTMNGAASFNYNFEIDLDTSFTGNDLLRTRLRAGNFQNSGFGNNYLAINTLESAFQEPALANTFAINRLFYSVPFGADVKVALGPIVRMDDPGMLGLWPSAYNKGRILSLFTFAGAPATYNFNALGAGGGFTLQRLFGRDNLRLSSSYIAVNGQFSNTNPNDAQTPGVLPSSFSNAGGLASEATSSSWTTQLSFSGEQPRWRWGVAAAYTYSRNLSFPNGTPRAIEISGPDSNFPTNSTSNVGVSAYLEPLTSGVWPSISLGWGYSSVERAPYMPVYRPRVQSWMVGLQWAGKALEGNSFGTAIGQAPFVTNSGVGTPRGFPVARIAQDSNLVWEAWYRWQLSDHIAITPAIYYAWQVGGEVGALSPTGLGTTINNLGGLMQTSFRF

SEQ ID NO: 6299 - protein, 460 aa, Bacteroides ovatus ATCC 8483
MKYCAISYYRSISLAVALVASSGLGLAHAAEQSDETTEIYRPAITNSSWEDTIRAPSVYDQPFKVSLFSAIHGEDSARLWSQTKSVAAYGVGFAGFLALLPSSITNWDKSGEKLHKKWWDNVSSGPVWDRDNFAINYIGHPYFGGVYYQAARKSGYRQWDAFMYSFMMSTFYWEYGVEAFAEVPSIQDLVVTPVLGWVYGEWAFNKEREIRQRGGTVWGSEGWGDTALFFLDPIDSLGRGVNTLFGDDVVKAGTGYLSMTEVPLDNGRIDKQVQFQVQYAIGAGKANESVSRHQSANNKAGSVEDPVDFGIVGISIGSSYMSPGEVWNLESGWAPSASVGLYFTRSFSTRLSYARGKLTDKRTGQSTTFENYSFDGQYYFNGQNTLRPYLTLGIGESLIELDKEKKAFQVNGGAGLHYRLSPNWALQLDWRHFYSAKLSSWDNLTVGQLVYRFGQGESWL

SEQ ID NO: 6300 - protein, 998 aa, Bacteroides ovatus ATCC 8483
MKKMQFHRSVLGSVAISALLFSGAGYAQEADEADDVVEVVTEAPAEDEARQEKIVVTGSLIARDEFASSSPIQVITAEVATLEGLVDTAALLQGSSLASGSTQLNNTFQNFVTNGGIGSQTIDLRGCGDTRTLVLIDGKRPGSSGTRGSIAALDLNVVPQSIIQRVEILKDGASTIYGSDAVCGVVNIITRDSVDSLELNGFISQPFESGGEQYSLSAAYGFDLGDFANFTFSAEYRLDEEMDVSQRDYLDCPRDYVRDPVSGRLIDRLNFSATATDPNRNCSSLYHNTAIDLFSEERLVPSPDGITVPTAFGGFIPGYRPRVGTGFTADGQPFYEDILDAPFLDNQDFFPKNENLSLFATADVDLGGIAWDTELLYSKRKTDVEGWRQFFPIVGSAINPAGNNPGFGYIADPTYSNSMFSLVQAVMPYPTTNNIEVDYYYASSSLSGGFAPGMLDGWSWKVDGSYSRGEGSYGGNEILASLSGDWNLDGVADTDGDGVPNTVGPPSINYLDPDILSGARVQDLVNAVGGYQTGNTVYEQTTFTAVLAGELFELPAGPLGVGLGAEYREFSIDDQPGVLTQSGDIWGSSTAGPTVGTNSVSELFAEVSVPLLKGAPLAEDVEFSASIRGFDYDIGGSDSIYKAGLNWQINPVLRARTSYGTSYRAPALFELFLDDQTGFLAQTSIDPCIDWGQSQNANIRANCAAAGIPDNYVGAAGSALVVTSGGGEDLRPETGDTFTVGIILTPTGADLNIAFDYYEIEIKDQITSLSGAQIVGGCYGTTTFPNDFCSLFDRAAADDPVAPFGLDNILAPTLNVDSQSQRGLDMEVRYTHEFNFGTMIFDGSVNWAFERYINVFGADFVSGIDNNDFNGTVGYPSIVGDASIRLDRGDWTYTWFTDFIGRQDDNRYYADNFNEPQDYFGLPGLYTSSTEAVFQHGASVRWQGDSLTLAFGINNIFDETPPQVSPDLVQISAGNTPLSATGYDLRGRRAFMSVSKTF

SEQ ID NO: 6301 - protein, 847 aa, Bacteroides ovatus ATCC 8483
MKQVITPSLCALAITSLFANDLYAAAETVERIEVTGSRIKRTDIEGPSPIQSISREDIANMGFDNLQQLLERMPANGAGAFSTRGNSQDSTANGGASISLRGLGPDATLVLINGRRVAASAFAEGITNSFVDINNIPISAIERIDILKDGASAIYGSDAIAGVVNIVLRKDIEGLEINLGFGDATGTDYGEQTASLVWGIKSEKGSASIILDYFKNDTLAASEMGRFGTANQSPYGGEDYRSSRGFPGYFYVDGVKTIDPDCPADSATASGSCLFDYGPYNLTIPKSERVGAIGQFDYDFNDELSAFLEFAVQHNTSEAGGAPTPLDEDAGLTVPGTYPNNPWGQDIEIGRYRTVDAGARRWDIESDSMRLVVGLRGMINDWDWEVSAQRGRSKSTQTGDRSQGWVRTDYLQAEIDAGNYNPFGGTYNPQDVIDRITTSLVRQGESNITSYDASITGQAFTLGGRDIMMAAGAEYREEDVSDVPDEQFRRGLIFGTEAVSAQGARDQYAAYVEFSIPLTDSFELQLAGRYDNYSDFGSTINPKVAFQWGMTEDLTARASWSTGFRAPSLAQIGLGPSEESNFFIDKYRCAADGVDCELLDYNTVFAGNPDLEAEESESWNVGMIWAPSQQFDLGVDIFSIVQDNKIDKLLLSDIYDANCDDQNSSICERSAAQPAQNLGPIDVIHSSFVNLGSQEVQGMDVSAHYRLELDSYGDIKFGLEWSYLHNFEKDNGVESVDYTGGYEYPENRWLATTNWMKDDFAANVNLSYIGEFDDFNKTRTVESQLLVDMSGSYRFSEMFKFSVGVNNVFDEGLPFAIGDGDADLYGYAMAVHNPLGRYIYTKLTMKF

SEQ ID NO: 6302 - protein, 1110 aa, Bacteroides ovatus ATCC 8483
MLQIYEFIVDQTAKGRSFLLFFCLLMMQTPSFAQNSAKITIQKKNISVIEALKEIEKQSDYSVGYNDSQLKNKPVLNLDLKAATLEYALSQILRGSGFTYQFKDKYIMIIPDKKLKETPTKKVSGIVIDENNEPLIGVNIKVEGSSEGAITDIDGNFNIMAPQGSTLSFTYVGYTPQTVKITDKNIYEIRLASDTKQLNEVVVTALGIKREQKALSYNVQQVKSDQLTTIKDANFVNSLSGKVAGVIINSSSSGVGGASKVVMRGTKSIEKSNNALYVIDGIPMYNFGGGGSTEFGSKGETESIADLNPDDIESLSVLTGAAAAALYGSNAANGAIIVTTKKGKIGKLQASVSTGIDWLKPFVMPKFQNRYGTGSNGKSDGSTVWSWGPKMGNSPGYDPNDFLKTGAVYNNSVTLSTGTEKNQTFFSAAALNSDGMIPNNRYNRYNFTFRNTTSFLNDKMKLDVGASYILQNDRNMTNQGQYSNPLVPAYLYPRGDNFSTVKVFERYNEARKINEQFWPSGEGDLRMQNPYWIAYRNLRENSKKRYMLSAGLTYDVLDWLSLSGRIRIDNSNNTYEQKYYASTITTLTEGSEQGYYGIEKSGNSQTYADFLVNINKRVGDFTIVANIGTSLSDNSYDMLGYNGPIQEKGIPNVFNVFDLDNTKKRATQEGWEEMTQSIFASAEVGWKSMLYLTLTGRNDWASQLLGSSQTSFFYPSVGLSGVISEMVKLPEWIDYLKVRGSFSSVGMPYPRFLTIPTYKYDTTILGWLPKTHYPIGKLYPERTDSWEAGLDATFFKDLRLSASFYYANTYNQTFDPKISASFGYSKFYVQTGYVRNMGMEGMLSYGHRWNEFGWNSNFTFSWNKNKIIELVKDFHHPETGKILNIPELEMNGLGYSRFILKEGGTLGDLYSKADLVRNDKGYIEMDANGALAKDANVEPIKLGSVLPKANFAFSNEFTYKGVSAGFLLSCRLGGIVYSATQAALDQYGVSEASAKARDAGGVVINGRTMINAQQWYETIGSSSGLPQYYTYSATNIRLQEAHIGYTIPRRWLKNICDINVSLVGRNLWMIYCKAPFDPESVATTSNYYQGIDYFMMPSTRNIGFNVKFNF

SEQ ID NO: 6303 - protein, 355 aa, Bacteroides ovatus ATCC 8483
MKLRHMLLGSAIALVVPAAASAQQATGEGFYVGAQTGINWLQDTEFDGAIRNTATFDGAWTGVIEGGYRLGNGFRFGAEVGYTDHTIDEIKGGAAGRAGGAGDINAWTFMATAYYDIDTGTAFRPYIGLGGGVIRAKVDGAADVFAAGNRVSDSDSALAYQVAAGVAYAVSPNLDLTLGYRFLGSEDLDIRPTGGTQFDTDYQSHSVLVGVRWTFGAAPAPTPAPEPAPAPVAQPAPPPPPPAPAITRNFTVFFDWDKATLTPDAEKVLQSVAADARTGGIAALQVTGHADTSGPADYNQRLSMRRAEAVRDYLIAQGIPAGEIAIEGRGETDPLVPTADGVREPSNRRGVIIFP

SEQ ID NO: 6304 - protein, 1092 aa, Bacteroides ovatus ATCC 8483
MKQINQDNTMDVQRHLFLRRCFAYICCLLLCFITATTVYAQKVSVKGTVVDTNGDAIIGASVKVLKKSSVGTITDLDGNFTLSVPEDATKLEISFVGMKSVVATVKPGKHLKVVLEEDNQTLDEVVVVGYGTSRRGDLTGAISSVSEKVLKDIPITSAAAAITGKLAGVNVVATDGSPDATIQITVRGGGSITQDNSPLYIVDGFQVSNINDIPPGDIQSIDVLKDASSTAIYGAKGANGVILVTTKSGKAGKTEISFNAHWGVSNVYNLTGVLSPYEYYCYQKELDPGTSLTSSINSMYGRWDDRNIYRSVEGTNWQDKVYGNTGFKQSYNVGITGGTDATLRYNLSYTRDDEKYIMLNSNYVRDNLSVKMDKKLSNKLKFEFSSRLTRMVIDGAGTNGGKLRDAVLFSPINSLASIDAGDAFGGEIDYSDDALLSSLNDPVYNTVNEYKKQNQFSMTYNAGFNWEIVKGLTYQLKGSYAYTYNYTDNVWLKKTGESSSNAGQPVAKRTDEKGARWNLQNILSYRFSLKKNHRLDLMAGHEMVSNYRNQMIASSKYYPMDFTASEVLAMWNYGESQPTYTTLGEPSRTASYFGRLNYAFKDRYMFTFTARADGTNVFAPENRWGFFPGMALAWRISQEKFMKQTEDWLDNLKLRVSYGSVGNARVNSYWRQDYKMESSANRQYYLNETVQSALKLQNTLRNENLTWETKLSSNVGIDASLFNSRLNVTVDFYNDITKDLILRMDLPSNSGYEYQYQNVGRSTNRGVELTLSGTIINSKDFYLGANFNISFNKNIVNKLDGTATVLSAQSNWRPDIGSDDFRAIVGQAVGQIYGFEVEGFYSVDDFTFDENTKKWILNEGVVDDRALFSNDLPNFGPGFIKLKDQNNDGVIDADNDRKVIGSVQPKHIGGFGLNAAWRGFDLAAMFNWSYGNKVYNANKIMASTHTNRKYNNIRDFMSLENRWSIIDPETGANVMYGNDANPERFVEINSKASIWMPMMGRTLVTDWAIEDGSFLRCSNLTLGYTLPVTVTRKLGVKNLRVYATANNLFCWTAYSGQDPEVSTQRSTPLTPGVDYSAYPKAHSYVFGLNVTF

SEQ ID NO: 6305 - protein, 959 aa, Bacteroides ovatus ATCC 8483
MQKFKLNALMLALFAANSAIAATEEPPEETSKTAQVQTDVEVIEVRGFSRSLIQSLNQKRFSDTVSEQISADDLGALPDISMADALTRLPGISAVRTGGQAAQINIRGLSGGFVFSTLNGREQVSTSGSRSIEFDQYPSELISSAAVYKSPKASLIEGGVAGTVELETASPLNNDQTHKFVANVRGMYNDRASEVSDATEFGDRISFSYQGKYLDDTLGVALGFARLFQPSVATQFIGLAYNDRKDVDGAPNDTDGPIDSPESEYISEGFELQHLGGEETRNGYLAAVEWAPVDNFKLKGDAFLSRFDKESFARGFRVKLGGPSAAYANAQLDGNAVIGAAVNRTSQSYTRVEIVNDDNQDFDEVDSFGVNADWQVTDRLNVNADVALSRAKSNFRNGLLWSLVAEDANAETPVFDSNVAINYQLNGLNLPDVGFNQAAAFSDIDRVMVSKYGIYPDQTEDEVTAFRLDFKYELESDIFSSVEFGARYSDREYSRKRSVFEYGNDGAFSTTQPPLRLTDDMASVVDWQGDFNYFPSYLAIDLDKALNAWFPDGTPEPVQTWGNADGVDDAQGYTTNYSWSVLQSGSVFEDVLAAYVMVNINTQIAGLDLSGNVGVRRIETDQSATVLENVAGDARLGAQNIVDENGIVNDLYAPNVLGTKYTDYLPSLNLNLQLNDNSLVRFAAAKVMSRAPINRLAGDASANVSDDGVINGSSNNNPFLKPFYADQYDLSYEYYFEEGNGTVAAALFYKNIDSFVETLSIENFDFKGNGFNVPDSIEDPVSGEQVATTNGIYTTAVNNGEGGYIRGLELAYTQVFTFLPEPFNGLGANASYSYTESEIESITSLGGDTLVQSLPGLSNNVLNATLFYALDDFETRLNVRYRDEFVSEQVAINEQVVNFDAETVIDFQTSYRFSDSLTMLLQVNNLTDEPTQSYFGSEQRTGTTQYFGRQFYLGFTYSH

SEQ ID NO: 6306 - protein, 206 aa, Bacteroides ovatus ATCC 8483
MSKTLIAALATMASTALIGTAQAADFSYRAPYTVNQPLNAFSWAGPYLGGNLGYAWGSVQNSLTKPDGVFGGVQAGYNWQSGSMVFGLEGDIQANAANDTFAAWKFSNPWFGTVRGRLGYAFSNVLVYGTGGLAFGKLRAETFALSESHTNAGWTVGVGAEVGIYQNWTAKVEYLYVDLSSSNFTITGAPHSYQSGLVRAGVNYHF

SEQ ID NO: 6307 - protein, 650 aa, Bacteroides ovatus ATCC 8483
MIHHLSPKMTEVKSIHTQNITQRTLKAVAHTYRPLSMAIALMGLSSIATAQEFSQTVFFGDSLTDTGRLVQIGKNSLASSVFNQAQPSFTTNTDPVWSSILAKSYGHTADANDGTTLTGTNYAVGGARTKEDVVKNAPVPFFTIPLFTIPSAQTQINRYLTLNNHQADPKALYTVWTGANDLFEAAKAPTQLQAAEIITTAANDQANLVGQLGQAGAKHILVPSLPDVGVTPEYAQDPTKSATASLSAHIYNQTLYQSLNNQTTNVIAANTFALLKEAVSNPAGFGFSNVTEPACQNLDANLSSLACKPSDWQQTAANANETYAFADKIHPSGRTHRILAQYYRSIIDSPNQMGQLPQHLIKHGQQSQQQLVRRLDSLNNHQQSLWIDGSISNQSLDTRNKIDRPTIKLGLDIARPNQHTGAYLTYQQQDYHLSDSITADVKQTGIGLYHRHDFDHLRISANLGVDHLSTQSLRQIMWDGENRNHQAHATGKRRYASVQGSYGFTQNNVTYRPYVGIHAQDIKQNRFFENQPNLSTALSFKLPDHQSLQADIGVNIDYAMNDKLNLLAGLGYQHEFKDNNKTVETAVLSNRDYHRSFVTTVPFDKKHTTHAHLGATLALGNNTHLNAGIQANHQDHDTKVGGFVGAQMAF

SEQ ID NO: 6308 - protein, 759 aa, Bacteroides ovatus ATCC 8483
MRKLQVLAGVAGATMIMAASQAAAQEATSLEEIVVTAQKRSENLQDVPVSVTAFTADQLKNQRVGDVLALSGLSPGLQIKTDDNAANPRIFIRGIGVNDFNPATASAVGVYVDGVYVASPLAQMAGFYDLQQVEVLRGPQGTLYGRNTTGGAINVTTKKPSSTPEGDLAVDYGRFNSLKVQGGFGGPVGGDTLSFRIAGLYDKSDGYTRNRLTGHKGNDADRKAVRGALRFKPDDKLTVDVSASYSKSSGGSILTYNRSLVAQTAEAASTALPDPTFGYAFCKPEYYTSGQCTNVAGYANTSSNKYEGDYRFEGKDVVKLFGATTSISYDFGGVTLYSVTGYQRAKRDDHEETDANPVSIFDARYIAKQDTTSQELRLQSNGATALRWVAGVYAARDNLDNDSHYNVLEVARVPDPVNNPTGMDPANSVGVFGWPLHQKSTSYAAFGQVDYDLTPKLTLTGGLRWSQDKKTFHYVSDVDYGLLTLFEYDNAKTFSSISGRLGLRYALSDDANVYATYNRGTKSGGFFSGQTTDPRDLGPYKDETVNAYEVGAKSEFLDRRLRINVSAFYYDYKDLQVYTQVQRDGLPVQLFTNASSARVYGGEAEIEARPISGLSLTLGASLLSAEYKDFISYVDPSSAPIDYSGNALPSAPKTSLNGAARYEHPLGAGDLVTQLDFTYRGKVYYDTANTERLSDKARAYVNGQVGWAFADGRYELGVWGKNLADTTNISDITPIAAFGFDVFSMGPPRTYGVYFRAKY

SEQ ID NO: 6309 - protein, 763 aa, Bacteroides ovatus ATCC 8483
MRKRLKTDHLATSVAAALTTLTRRPAAASMALLLGASSLPAIAQEARTLDAVSVVGTGSTRTTASISVAEIQAQVPGVAPQQLLASLPGVNVQTTDPFGLYEFGDSMTIRGFSANQIGVTLDGIPIETFDTREGGPITRYVSSENLLDVTVSAGSGDVTQPSYHALGGAIRYTSLPPKGGDTWSGNLTQTIGSDDLVRSFVRLDTPQWWDGGPSAYVSASRTQGGVWDMEPATQKSDHFEAKIRQAWDAGSLTLGWIYNNRKDYDVQSYNSDGSVSWDLHERITGNPEVDAEHYSEWQNGRRDSLLSLHGDFLFNDAIGFTFTGYYENKHGYGVGGTPPSTATGLYNDAIAGTPGRTDIAINDPQIVDAAGNVTRVGAMTRREEIMGGDRYGATTAVSWETEHNKLEVGAWYENYDFDQVRPLYNLDPATGALLKSALPIVIYYDNHFSTEVKQLYIKDTLRLLDDRLTLELGAKGLDVKRDYNGIANLDDFNVGVRRDVTIKNSDWFQPQVGASFQLADGVQVFANYAENFSSAPRLALTSGAFNPDIAPEESTNIDIGIRAESSQWSGYIAAYKIDYENRIIALTDPDPLVVAPTVYANVGDVQTYGAEVSGMWKPAPGWRLGASLTWNKSEFQDNYFGPVSGSLVQVEGNEVPDSPKVMFSVNGGWEGENFFANLDTKYTGKRYGDTLNTDQVDATFIVNGSVGYQGGSDGFLAGGRLQLSVYNLFDKDDAIGAVFPNESSGSYQLIAPRQVFASLSYKF

SEQ ID NO: 6310 - protein, 218 aa, Bacteroides ovatus ATCC 8483
MKRFFRTLLSLVCAAVVSNAHAQTAPSAPTSPWSLALGAVHMNFNTKADLYAGGPVPGAGVNASDDTVLGLEIAYSLNPNWTARLDIGTPVKTDLSGTGNLGTLGRLGGVKAGPAILTLSYSPGMWGPIRPFFGGGMSYLKVFSTSEGALQNLKVDNNFGGAFIVGADWPLADGYSISFTLQKVYLKTTASGTMGGVPVTANVRLDPLVSFLAVRKQF

SEQ ID NO: 6311 - protein, 634 aa, Bacteroides ovatus ATCC 8483
MKKYLLSVSAVAFACPALAQAANDVVVADRRADPAAITVIATGSETLVSRVGQPVTVIAADEIRSIQGPDIARVLERVPGLALTRNGGPGSFTGVRLRGSDAEQVLVLVDGVRVEDVSAPSGGFDFGTLTPGGIERIDVLRGSNSIVWGSAAIGGVIAVQSRELDGIEASAELGNHDTYTADAAAGLSSDRAALTLNGGYSSSDGVSAAASGTEPDGFRQWRVGGRGRVNLTDEIAVLASARYADTRTDIDGFGPPTYVEFGDTPEYQTTRQASGRVGLRYTGAVLTLNTGFALSDTKRDYYDPTYSADPSYGYKGRSERVDLTGRLNLPADFTLDFGGDSEWTRYSGTYDAQQKARLTSGHALLGWSSARASLAAGVRVDDHSRFGTAWTFGANGTLELVDSLRLRASYGEGFKAPTLFQLLSDYGNADLRAERSKSYDAGLEWGSRTGKLHAAVTVFRRDSRNLITFVSCASLDACATRPYGLYDNVGLARAQGVEAELGARPVDTLRLQAAYTYLETENRTAGTANFGNDLARRPAHALTLSSDWAPVDSGPLAGFTLGADLRLVGDSYDNASNTRRLDGYALTTVRASFPLTENVELYGRVENLFDVAYQTVADYGTWGRSAFLGIRARY

SEQ ID NO: 6312 - protein, 775 aa, Bacteroides ovatus ATCC 8483
MKKYIFSLVCLCCALLPALEGQAHEYPNHPELRKSDANIIGHILDKNTKEHLPYITVALKGTTIGTVTDATGHYFLKNLPEGNFVLEVSSVGYKTVRRNVTLKKGRTLEEDFEIEEDAVALDGVVVSANRNETTRRLAPTLVNVVDLKIFENTNSTTLAQGLSFQPGVRVESNCQNCGFQQVRINGLDGPYTQILLDSRPIFSALSGVYGIEQIPASMIERVEVMRGGGSALFGSSAIAGTINIITKEPIRNSGMLSHTITGIGDGDAFDNSTALNASLVTDDQRAGLYIFGQNRHRSAYDHDGDGYSEIPKLHGQTVGFRSFLKTTAYSKLTFEYHHMEEFRRGGDLLSRPPHEANVAEQTEHSINGGGLKFDYFSPNEKHRFNVFASAQHINRDSYYGPGDRDPLDAYGNTTDLNWMAGSQYVYSFGKCIFMPSDLTAGIEFNQDKLEDNMWGYNRTVDQKVNIGSAFLQNEWKNEHWGFLIGGRLDKHNLIDHVIFSPRANLRYNPTENINLRFSYSSGFRAPQAFDEDLHVENVGGNVAMVELADNLKEERSQSLSASADIYHRFGAFQVNFLVEGFYTKLSDVFALTDGEVVDGILTRTRYNAPGARVMGLTLEGKMAYLTKFQVQAGVTLQQSHYNEPHVWNPDAPAVKKMMRTPNTYGYFTATYTPVKPLSIALSGTYTGSMLVPHEPVPGFLENPITVNTKDFFDISLKAAYDFKLYKSVNLQVNAGVQNIFNAYQNDFDKGADRDSGYIYGPSLPRSFFAGVKISY

SEQ ID NO: 6313 - protein, 713 aa, Bacteroides ovatus ATCC 8483
MKPTFIILLFSFIATCSTFAQQSSNYVSGRVTDTNGEPLPGATISIKGKGTGAVTTSDGTYTLQLPGTGVYIITASYVGYQTAEKKFTTDENKKLSFRLSEDQFDLGTVVVTGTRTPKLLKDAPIITRVITSEDIKKVNANNVADLLKTELPGIEFTFAMDQQTSINMQGFGGNSVLFLVDGERLAGETLNNVDYDRLNLDNVERIEIVKGAASTLYGSSAIGGVINIITRESDDPWNLNLNSRFSEHNDHRYGGTVGFNAGKFNSLTNVQYNNVDTYGVDNLGDFSTVFGSRVWNFKERLIYHPLETLKLTARAGYYFRERNKPGDTQDRYRDFNGGLKANYTFNTLSNLEVGYTFDQYDKSDYQVLYKNDVRDYSNVQHNVHALYNYTFNEKHTLTVGADYLRDYLMSYQFTDNANYIMHTADAFGQFDWNPTERLNVIAGLRFDYFSDSNVRHLSPHLGMMYKIGNCSLRGSYSQGFRSPTLKEMYMVFNMANMMMIYGNPDLKSETSHNFSLSAEYTKNRYNFSVTGYYNLVHNRINTVYSDDPKGQIYTNTDKVDIAGVDANISAKYPCGLGFRMSYTYIHEFMRDGQKKFTDTRPHTATVRVDWGENLDKVDFNYSLNGRILSEVKTNVYNDSFNNPAAGSTAVTYPGYMIWDLTFSVGVFKGVNMNLAINNLFNYVPDYYYFNSPTTTGANLTLGLSLDIDRFFKK

SEQ ID NO: 6314 - protein, 1087 aa, Bacteroides ovatus ATCC 8483
MLNAFFLKSKLLRMSGILLVILSFCIPAFSASLEALGIEQKKVTVNGVVLDDTREPLIGVSVLVKGSQQGTVTDLDGKYSITAPADGILVFSFVGMEKQEIPVKGRNNILVTMRSSSVALSDVVVIGYGKQSKAALTSAITKVDSKDMAISPTGNPMSMLQGKVPGMEIRVNSGQPGADPQIIVRGGTTTAPESDSPMVIIDGVIRTMKDINYADIETIQVLKDAASTAIYGSKASRGIVMITTKQGKAGKGSISFSYGLSVDHQPKRMPLSGAREYLTATRTAALHATDPDKYLSGTFAMSTANKRNALNTTAFLDDYIANYGQGYVEDLLYNQGWEMMEDPANPGKMLIFKETDFQDNLFQTPVNHDFNINFSGGNEKATYYMSLGYLTQDGIVVGTHYNRWSFLTNASYKIRKNLTVKGMVNYSMRTTAGINENNVMSRAAKMPPTVRQYYEDGTPAPGELTSSFRTRLHEVYYQEKENRVSRINLSAELDWEIIPGLHLKPMFSYTNNEGKDHNFERYNEVVKNRPVSEAHNMDLHYQYDLILNYAKTIKDKHNLDLMVGGNYIYDNWYRFSGSGYGGTSDYIETLNGIATESAKTTSTFEEKKMNSYFGRVNYNYDMKYLFSASIRYDGSSHFAANHKFAAFPGVSAGWNMHREAFFEPLSKVVSNLKLRASWGKTGYDNLALENTEGSYEAGKNYAGEAGILNTVLMNRNLLWEETTSTDLGLEAGFLNNRINLSFDAYYKKTTNRLLNENLWSETGFASIKSNFGSLNTKGVEIAINAIPIQTHDFRWNIDANFSIWRTTIGKLPNNGADKNRTGGGIIFDPKLGKYVEVGGFAEGERFGSRFAYQLDGVYATDEDAANAPYDEGVSSGWLGKGKCAGDAIWRDVDGNGIINSKDMVFVGYIHPDKMGSFNNTFTYKNFTLRIATDFSLGNVIDNHFRAQANANSRNNFATIHDVASSKMWHKPGDIASIPRYDVESDWDNGKRNHGRPSSSTIGFSGGSANTLYIKKGDYLAFREVSLSYPLRTKWLRAAKIETLDLTAAVYNLGYWTAYDGLTPEVIGADAGKYSRPRQFIFSVKFTM

SEQ ID NO: 6315 - protein, 248 aa, Bacteroides ovatus ATCC 8483
MLKRMILLGALGVLASAEESAAFVGVNYQVSMIQNQTKMVNDNGLQKPLIKFPPYAGAGFEVGYKQFFGKKKWFGMRYYGFFDYAHNRFGVMKKGIPVGDSGFIYNSFSFGGNTLTERDSYQGQYYVNLFTYGVGLDTLWNFVNKENMVFGFVVGIQLAGDSWATSISKEIAHYAKHHSNSSYSPANFQFLWKFGVRTHIAKHNSLELGIKVPTITHQLFSLTNEKGYTLQADVRRVYAFQISYLRDF

SEQ ID NO: 6316 - protein, 801 aa, Bacteroides ovatus ATCC 8483
MKYLYLTVAAMVASINAHALQGKVVDSKGNPVTNATIQVVGSSETFAVNKLGEFSIEETHAYEIHIVAPGFSHKVIRIGDTLNTEPMQIPLTRSVIEQVDVIGLPIHASVIESAQPISVLSGNELRNRQAATLGDSLEGEVGVHTNFHGNVASTPIIRGLSGPRVQITQNSMDVSDVSRVGPDHAVTSEVSTAKQVEILRGPATLFFGSGAIGGVVNVVDTRVPKDSTTYGEWFISHETVNKQKLGAVNINTGLDAIALHFDGFWRESSDYQVPVNPETNTDDQSADSQQTTHSNNYFVNNSSEESHGFTLGGSYLLDNGYVGASYGKLYRQYGIPGHSHGGEQHNANEVSVFAELDQDRFQLISEIDLNSKWLTGVNSRLGYTNYSHAEIEAGFTGTIFTNKTVEAKVDLMHQPIQEWKGGWVFHYKHSDVSAIGQEAFTPPSNTASYALAAVEEKHIGNVLLQLGMRVEYVSLIADNVLLPELNLHSHSEQNNTHSEEHEDTLTVIQVFETDQSFSPVSISAGAVWDFTPGYNLAISLAHAERAPHASELFSFGPHIGTGSYEIGALFELNNTSSEPQFDINRSTIQLETSNNIDLTFRKYEGEVGVILNAFYNQVDNYYYQTTTGLYAQSGHNHAHGDDEAHDVHDDELPVYLFKSADAQLYGFEAQSMWQVTPRLKTTLFSDYVQAKLREDSTYLPRTPPLRYGAKLDYQYGRITANISWSHLNDQTHVAPLETKTLGYDWLDASASWSLPIKTAEVALFIKAENITDTEARVHTSYLKNIAPKPSKNFSIGLRGNF

SEQ ID NO: 6317 - protein, 1097 aa, Bacteroides ovatus ATCC 8483
MKEIIKHKFPYLLFFLLLFSSFASAYGQERMITLNLSKVPLNTALKEIEKQTSMSVVYNTNDVDINRVISIKVSKESLTNVMGQLFKGTNISYSIVDKHIVLSTKKEVEQQKKTPIVATGTVTDAQGEPLIGVSILVKGTATGAITDMDGNFKIQAAKGDVLEISYIGYASQSITLANAQPLKVTMGEDTQTLDEVVVTALGIKREQKALSYNVQKVNNDALTSVKDANFVNSLNGKVAGVNIQRSASGVGGSTRVTMRGNKSISGDNNVLYVVDGVPIGNQADRTGDGTGFGSGRTSGEGIANFNPDDIESVSVLTGPSAAALYGASAANGVILINTKKGEAGKMRIDVSSSVEFMTPLTMPKFQNRYGISGNYYSWGDKLENQSSYDPKDFFELGATFNNSFNLSTGNDKNQTYFSIAAVNSDGIVPNNKYHRYNVTLRNTAKFLNDKLTLDASASYIREYYNNMISYGTYFNPIVGAYLYPRGEDFEKEKYFERYNSELGYSQQQWSPGDFGMDIQNPYWIAYRNIRPEVKDRYMLYASLKYDITNYLNVAGRVRLDNTYTEKEDKRYASTINTYASTNGRYTYSNETFRQKYADIMVNFDKQFAEIYHATINAGTSFEEYDTKGRGYGGQLLLVPNKFVYSNIDPTQSTASQTGGDSRRRNFAVFASAELSWNSALYLTLTGRADKPSQLVNSDDPWIFYPSVGLSAIVTELLPNNIKEKLEPTLGFLKVRASYTEVGSPIPYTGLTPGTLTHELEGGTFKPFKYYPISNLKAERTRSYEVGLDSKWFNNTITFGVTYYHSNTYNQLLKATLGSNFEYMFVQAGNVQNRGLELSLGFDKKFGDFNYNTTFTATTNKNKIIQLARDVLNPVTNTLIDLTDIQVGRFRLREGGEIGTVYANEWLKRDGDNYIDYQPGQALTTETTSPYKLGSVNPKWNLGWQHGFSYKGFNLNLLFTARIGGIAISKTQAMLDRYGVSEASADARDAGGVSLGYFKVDPKTYYDAVSNLDAYYTYSATNVRLQEARLTYTFPNKWFKGTVNNLSLSVYGTNLWMIYNKAPYDPELTASTGTFGQGYDYFMLPSQSTYGLSLKFGF

SEQ ID NO: 6318 - protein, 897 aa, Bacteroides ovatus ATCC 8483
MKLIDKRTLLASVAAMATLVGAGQAFAQATETATVEEVIVTGSRIKRADITGVGPATVISQDQIERTGLTNVESLLQRLPASAGNAGNQTNAYWTGNGYGTAQVNLRGLGINRTLTLINGRRVVNGGTGANSAPDLNMIPTAIISRIDVLKDGASAIYGADAVAGVVNIITQNNFEGLKLSAKYGVTDEGDGQDYTVDVLWGMRNERGGVTAGLTYQKTEAVNLASRAPCGLGEVGGQLVCISSASTIGGRAVLPNGQQINFNQTPGGNGNFYEPYSAAKHNFNSNPFLNAVSPIERISTAFLADYKLTDTVTLFGELFFTHRESHQIATPGTLRNLAILASNPTNPTGQNITLLQRRLAEPGPRIFSQETDTYRFVGGARGSLAGDWTWEAAANWGRNTGVDAMSNIANLERVRNSVNTSVCSTTPGAAIPCIDYLGAGDVTPAALKYILFNSRDTGGNEQKSVTADVTGTLLSLPAGRLAVAAGVVYRQEKGWRDPDALTVLGIANTNQQDPISGSVTAKEAYLELSAPLLANLPMVQSLDLDAAVRYSDYDLFGSNETYKIGLNWAVIPSLRLRATYGTGFRIPSVPELFGGVAEGNLTTTDPCSRYATSGNATLIANCQATGVPANYVQLGNTVLTTVGGNQNLQPETAKTLTLGAVIQPPIIPGLSVTVDYFDIEIKDAIRSIPGSTKLAVCYATPSLAHPFCGASNFTRSPLTGEITYLSAQPTNAGLEKMKGVDVGVRYDFDIRGLRASLDWNTTYLDSYVVTPFQGADPIVFDGHIGGGNGGYPHWRSNGSFSLMAERWTGTYSVQWIGKATDFNAAPTAIGYKTPDVFYHNAQFAYRLGGQADIAVGVDNLFDKKAPFIQSWTDGNTDTMTYDLLGRRGYVRLSYKFN

SEQ ID NO: 6319 - protein, 1003 aa, Bacteroides ovatus ATCC 8483
MEKLKLLLLALFFGFSINTWAQKTDVTGVVLDDKGIPLPAANVLEKGTSNTVTTDFDGKFRISVSNKNATLVFSFIGFEDQPVKLDGTKTNLSIKLQSGTTNLEQVVVVGYGKGSRKNLTTAVTSIKADELNRGAISDVGQLLQGKVSGLNISSSGDPTKTASVVLRGASTLNSSQGPFYVIDGVPGVDISIISPDDIATIDVLKDAAATAIYGNRAANGVIMVTTKRGSKDRTQIAYNGYYGFEEVSNELNMMNADQLRAFTTKNNLNFTPENDKGANTDWQKEILRSRRAVSSSHNISMSGGGEHGNYTASITSIQKEGVLLKSDFSRVIARLSVDQYAFDDKLKIGLNVTNSTSNYTNVPQRNTVLLQAVSHLPVSPVRNPDGSFFENFVSTGYFNPVALIEHGTDETKTNNLVGNITAELKLPWGFTYNLNVAHQRLSTSHGEFYDSYYSRYNSANFYNNPDPPQTKTLINFGVNGSALRNSYDNTNNIVESFLNWDKTLGGHKIKAVLGYSWQENTYGDGFQATATNFPVDNVGYNNLALSNYTSVNGYVVNFGDSKAYQKTRLIGEFVRLNYGYKDKYLLQGTLRRDGGSMFGANNRWGFFPSVGGAWRVDKENFMKNQNFFTDLKFRGSYGVTGNSSGFNAYTAQFISGSVGTFYYNGQQIGAYGPNQAANPDLKWEKTATANVGVDFSILKGKITGSVDVYDKKTTDMIFNYAVNPVLVPVGTIVANGGTMSNKGIEVSLGATPVKTANFSWSTNLNLASNKNRIVKLTNPLFIGGDSIRRVQPDGGGQTGSTLQIFKEGKPLGQFFTLKYAGKDANGVSQYYDKNGNLTTTPLNGVDYHYVGDAQPKLLLGWGNTFTYKKFDLSVFFRGVFGNKIFNATRADLFRPSTAMTTNILVDAQDESPNDLNSYKYSSRFIEDGSYLRLDNMTLGYNFGKVGKFIQSVRVYETINNLFVITKYSGIDPEVEQGGTAPGVDSNNFYPKTRTFMFGLNVIF

SEQ ID NO: 6320 - protein, 766 aa, Bacteroides ovatus ATCC 8483
MKNSGKPQKTSATATTQPINRTLHYALSSIIMLSTGLPGYLAAQENREQKSKEKPEKSEKVITLSTLSVIGGLNNSVSAGSSVLKKEDIERTQADNIAELLDQLPGVSMSGSPRPGGQTLNIWGMGDTEDVKVTLDDAPKGFEKYLQGSIFIEPELIKRVDVDKGPHNLLDGNGGFGGTVKVVTKDASDLLRPGEDFGGLLKYSYHTNDRQNIYSSAVYGRTIEGFADGLLYMSKRDGGNIKRPDGTRFAFSKSDQASYLLKTNFYLNDANTLTLSAIRSDSDGWQPWAAKRDEIAVPSEADIEKYGWNEAWRRKLVYRDQTDQNYTAKWNIAPEDNPLLNLTATYAYSKTEQHDKRSEKAHSGFLGSLGNESWIDYVDNLADINNKSAFITGPIEHTLLVGVRWHKNQRNTLIHDKSKDKKPEYNYGYFQPTYMPSGEQKTNSFYLQDAMVIGDVTLTPGVRYDHITNIGKPNIAAIYNNNSPNIGHDYRSVTYTGWSPHFGIMWKATQNLSLFSDISRTWRAPLVDEQYEMQYARASVTATSRNLDVERITGLRFGAILNFNNLLADQDNLQIRTTLFRNRGKDEIFTRRGIVCKSPDCGKPLSNYRNLPGYTIQGLEIETFYDSNSLFGKLSYSTIRGQRDASPRDPWGNKTWIAEIPPTSARAMLGVKIPQWQMAIGWTGDFIRKQDRSPKDGDPMATLWSIPKSKGYALHGVFASWQPNFWQGLEARVTVNNLFNRDYRPYLGESVSGVGRNIKFSISQKF

SEQ ID NO: 6321 - protein, 915 aa, Bacteroides ovatus ATCC 8483
MKERMKRKYILMGVAILSSVVAGAQDITDSIARKTQAVSTISADEISKNATPNVSNTLYGLLPGLSVMQQTGWTDDAATLLRGYNNPLIVVDGFARPLSYLNTAEIESVTVLKDGAATAVWGTRGANGVILITTKRGEYNTKMQIDASYKFGMDFPINQPKFANGYEYASALNEALYYDGLEPQYTREELDAFRNGSNRDLYADTDWMKEGLRKHTINNQLDISFHGGGKRLRYFTLLSYKNDYGILNETYAKYSDRYTAQMRKYELGLRMNIDVDITPTTLAQFSMLGQLRERKRPNTSEYDLFAGLFNTPSGAFPMQTSNGYWGSNNVLKTNPIARIADIGYFKENPRTLQADFRIRQDLSLITPGLSLEAAVAYDNNAVYKEEGYKKFQYEVNTPVRNVITDKIEADSKVYGDNSTLQVNNLDMTEQYINANLEAALKYNRSFGKHAVSALGSYRLESERGIGRNNAHKRMYVNASAGYSYKDTYLIHALVNHTGTSVLPDGDKFRTYPAISAAWVISNENFMKKATVIDYLKLRASYGRAGWDNISYELDRQYWAWGGAYWFGDANTQSEGMKEDKLAMNNLTLEVSDKYNIGLEMRLFKRLNLSVDAYMDKRSKMPVSGSNVISSAIGISIPQQNNGKTEYKGIDLGIDWKDKVGKDFTYYVGGTLNYIRTEVIENGEGYIPYDYLSGKGLPDGQLFGLEAIGYFRDEADIANSPQQMFSEVRPGDIKYKDMNGDRIIDDNDVHPIGHSSSVPEIYYGLKLGFEYKGFGLDALFQGVADYSRMMNVSSVYWPLRNNTNVSDWYLHDKIRWTEETRDIANVPRLTTLNNSNNFRNSTQWLVNGDYFKLRNLNVYYNLPQRWISKVKLEQCQIFARANNVFSIDHVKYMNCEDFSVNYPDMFSVYFGASIKF

SEQ ID NO: 6322 - protein, 668 aa, Bacteroides ovatus ATCC 8483
MRKKYARASVLCCLISPVVWAEHSSGATEDALIVTANKREEALNKVDGSVLVKTGEELVQAGITQVQDLERAFPGLQIRSRGNRTYSATTIRGISSPDFYSPSVRIYVDGVPQDHQFLTQELINVERVELLRGPQGTLYGGNAQAGVINIVTRSPQEGPWLNLSGNYSKLKQGGSFSGSIPLIEDLLYGSTSLRWVKEPGQIDAPNRGDKNIDSSKTWLGRGQLTFAPEDSSFSAELSFAHEDLDSHEELYLNDEQFRRKEYDGPIPDLTRRVNSYAFKAEYDFGDSVLTSVTSYQDRDIYRDFIGGKWKEKHHATTQELRLNSNFSNGITTVLGGWFSDEKNKHHTSGYPGYYGDAANTIKGKSLALFGEVKLPFASQWDLTLGGRLSHEKSQIDYAGRSGMAAIEAFDNQVSSKEFTPKTALGWQLTPDTRFYLSATKGYKPGGFNNIVSSANDSKPYNTETSDNYELGWHTSFFDNAVTLDSAVYYIRSKDKQIYVGPIGAQFIRNVGKAESKGIELSSQIKPMKGLKFSLGGSVGKSNFTDATDAENGINYDNKRLPYAPDVMLNASFDYLIDQTLLPGNLYLNAGARYYSKSYFNEANTLEQGGYTLYDASLSLEMAHGVNVKLYGENLGDKKYRVSSFTVGPNTLSMINKGLNVGLDVSISL

SEQ ID NO: 6323 - protein, 722 aa, Bacteroides ovatus ATCC 8483
MKNLKSLLTGCALGTLGFAGTASAQNSVDAPVTEDQAFELSGFTVFGDNYDTIGAATRLPLSDRETPQTISLIDSSRLEAESMYNMDDVMRNVTGVNVSMYDTQRPLYFSRGFQITDFQVDGIPTYSGDTNQEFDTALYQRVEILRGANGLFSGSGKPSGTVNLHRKQAGKNFAASVTQTVGSWDYIRTQVDVNTPITSEGKFRSRFVAAYTDRDSFRDRYEEEKLAYLATFSADLAENSTLTFGFQRQDNEPTASVWGTVPPLAADGTPSELPHTTNFATDWAYWHRHSSTAFVNLEHAINDRWQLKAAINHTTGDEESLSVYANAYAATWLDKEDGSGVVISGYSWDSSDERNSLDLYLNGKFDLFEREHEVVFGASHAEYESVALNTASGFAGSPYNYTIPNFYTWDGTAPEMELAYLPGQGVIRTKQTGLYSSTRLRLSDAFSAILGGRITKWDTIDYGRDDAGATSYVTSEYEIDNEFTPYVGFTYDLNESLTFYGSYTTIFEPQDNVDASGNILDPVDGHNYEIGLKSSFAEGRATFTAALFETTQDNFAVADPLNPAPLESGKYPQIGVDGTKAEGVELQLSGKVTKDLSMIFGYTHNNTSRHEGDPIWTNLPEDLVQLSTHYQFPGQWSRLAIGGGATWQSKIIGSQFIPGQGNVEISQDPYTLVNLHLNYAINENFSATLSAKNALDEIYLANLDYPQFGEPQNFLLSFKWQY

SEQ ID NO: 6324 - protein, 844 aa, Bacteroides ovatus ATCC 8483
MKKQQAKGSGMKRLALSATFLATTLAPVTTWGADGVIRGRVTDKADGEGVVGAAVSIAGTNIATATDINGNFVLRNVPASKQQKVIVTSIGYAPTTQVINLGDGQTATLNIALGQTTIMASEVVVGAALYKQDRLDVPVTANIVTKEQIREEPNPTLDEVVQDVPGVVVSRAGGTSSSNLQIRGSNTYNGGGIGTRVNAFYDGFPINSPDSGEIVWQSVNMNAADKVEVLKGAAATLYGSGAMGGVVNITGHLPDKFEVKAGSGIGFYDKTPSSDESEYRKGFTPVFWNTYAGFGNKSGKWTYDFLYSHSDDDGYRQNAWNYMNDVKFKARYDIDSRQYLQLTSFYNSTVGGYAYQWPYNATISTSTFTPILDQSYDVFVNARLFPTHTAAFSYAQTMYPTSPFLWDILANAWSTYTKYDVYTDDLISRKNALVGINYVNLLSDKLSLDTRLYYTYNASRIEYNRTDADQTYATGRIRTIGEFNETDDSRYGAGIKLDWRASDNHRLLFGVDGNIVDTRTTQVAVEYPVKNEFNNIQEKNFAVFLQDEWKITDKLTSLMSLRYDWSGVNKDEVEITPGVWIPINKKSVDALSPRVALNYRATDDMALRASWGRSFRAPSLYERFVHDAGFLTVVPNPDLDKETMTAWEAGIFKQFSDKVSLDIAGFINNYDNLIESRPTAAPLTYMYGNITKARIWGIETNLNYRPNTDWNLSVGYTYMNAKNRSFDASTATATELNNPDPEWLPYRPEHTASASVTWKATKKLTLNVNGRYVGKYKAVTLYTNPDGKWYPGDFVVFNAGLKYQFNKNVTATLACNNINNTQYSEAEWFRAPNRSFIAGIDLTY

SEQ ID NO: 6325 - protein, 285 aa, Bacteroides ovatus ATCC 8483
MESTMKKVLLAGVALVLGGAGAAAAADVLPPIVETPYIEAPVSHKVAAASGWYLRGDAGYAWNSIETPHYFQGSNANYVGFNTSDLRGSYSVGVGVGYQIRSYLRTDVTLDYFSDADFTGSTRGGCGVAVACTSRDLSTANGLSLLANAYVDFYKHGRFTFYGGAGIGGTHVSWDGLSNTSCSDAAPTLCDTTVHHSGDKSWRFTYALMAGASIDVTCNLKADIGYRYRNISGGKMFGYALNGGPGYDKGFSSHEARGGLRYSFGGCAQEEVYIEPAPVMPVVYK

SEQ ID NO: 6326 - protein, 246 aa, Bacteroides ovatus ATCC 8483
MKKYLLIILILFSTVVMANDDFKASVTVGYGTNDSVYKGKEYYRIPIFINTSYKNLYLEGTEIGAKFIDTDRFDTSVFLELQDGHYIKPSKMESGYRTIKKRKFQQTFGLKADIRIDEISKNLILSPYFSAGNRGTQTGTRLSYLYMPAENIIISPSISTKYLSKKYTDYYFGVDRDELGGNITNEYNPDGAFEFGAGLYGEYYFTKHISALAYLNMSRYSSEVRKSPITEDRIITNVGAGLKYTF

SEQ ID NO: 6327 - protein, 946 aa, Bacteroides ovatus ATCC 8483
MQNNRSLSKSSFFVGALILGKTTILLNATPLSDYFDNQANQLTTLFPLIDTLTNMTPYSHRATLFGVRDDTNQDIVLDHQNSIESWFENFSQDGGALSCKSLAITNTKNQILFLNSFAIKRAGAMYVNGNFDLSENHGSIIFSGNLSFPNASNFADTCTGGAVLCSKNVTISKNQGTAYFINNKAKSSGGAIQAAIINIKDNTGPCLFFNNAAGGTAGGALFANACRIENNSQPIYFLNNQSGLGGAIRVHQECILTKNTGSVIFNNNFAMEADISANHSSGGAIYCISCSIKDNPGIAAFDNNTAARDGGAICTQSLTIQDSGPVYFTNNQGTWGGAIMLRQDGACTLFADQGDIIFYNNRHFKDTFSNHVSVNCTRNVSLTVGASQGHSATFYDPILQRYTIQNSIQKFNPNPEHLGTILFSSAYIPDTSTSRDDFISHFRNHIGLYNGTLALEDRAEWKVYKFDQFGGTLRLGSRAVFSTTDEEQSSSSVGSVININNLAINLPSILGNRVAPKLWIRPTGSSAPYSEDNNPIINLSGPLSLLDDENLDPYDTADLAQPIAEVPLLYLLDVTAKHINTDNFYPEGLNTTQHYGYQGVWSPYWIETITTSDTSSEDTVNTLHRQLYGDWTPTGYKVNPENKGDIALSAFWQSFHNLFATLRYQTQQGQIAPTASGEATRLFVHQNSNNDAKGFHMEATGYSLGTTSNTASNHSFGVNFSQLFSNLYESHSDNSVASHTTTVALQINNPWLQERFSTSASLAYSYSNHHIKASGYSGKIQTEGKCYSTTLGAALSCSLSLQWRSRPLHFTPFIQAIAVRSNQTAFQESGDKARKFSVHKPLYNLTVPLGIQSAWESKFRLPTYWNIELAYQPVLYQQNPEVNVSLESSGSSWLLSGTTLARNAIAFKGRNQIFIFPKLSVFLDYQGSVSSSTTTHYLHAGTTFKF

SEQ ID NO: 6328 - protein, 1138 aa, Bacteroides ovatus ATCC 8483
MRCLSSSVSRTAIACALAFAPAPVLAASFTVPTGSTNTTVQTLTGTQTGAVSVGGTLSTTASSVTLGIATGTGVVLNNAGTISSGNRAVDTTSTVTGLLTVNNGGAITATDDGFRINGTLAGGTLLLSNSGTIVSSTGQALDFDKATATNAIVTITNSGSIQSSGSDAVRLGGGTISLSNSGTISTTSAGKRAIKFDTASNVDTLVSLSLTNGIGGLISGTDDAIKIAGNAGSTSAAVIAINNAGTIRSTAGGQGIDLGDLTSTSLKITITNQSTGLITASDNDGVKAGMNTVVSNYGTITSNYTTTSADAQNYSAVKFDGASGAVHNYAGGVISGAYHGIKASGLTDNIDVINDAGGTITGRNGSGVNSNGTGSVLNYGIITGSFDPAASFGDGDGVDIDHIGTIVNYGTIQALGSKGTKPGETKPSTSEGIAIGGGSITNGSATVRTALISGANNGILADDSNSGSIYGALTVTNYGTIQGLNGYGIQVVNNAGFATTITNYGTISGTTYAVAMGNGNDLFVYEAGSSVNGAVKGEGGTDTLRLGEVAGTFNLSLLGDSATYQGFEILDLAIGSGWTVTGSSSFSGATNVTGASLTLNNASLAASVVTVGGSNAVLAGTGTIGSLVANSGATISPGLTASGLGTLSVNGAARFNSGSTYAVTVTNSGASDRIAVSGATTLSTGASVSVQAIAGLYNFRQTYTILTSAGGISGTFGPVSSNFAFLTPSLSYDANTVYLALNRNDTTFASVATTRNGRQAAAAVEAGGPNTALYNAVATGSITASQSAFQLLSGEAQASFGTTAFNQNQMVGDVIDARLRQSNYAGATGAAAGLGAGGPTAYANERAVKAGPFSSAAAPAPAPQAWTGWVQGYGQWNHLSGNGNASTLDSTVGGVLAGLDTSVNNWTLGFAAGYGWSNSSVANLGSQVNSDTAQFAFYAGTAFGALKLRAGATLAYSNVDSNRVVVVGSLTERPTASYDGWSGGFFGEAGYALPVGPVAFEPFAQLAWSGVNMGSFAETGAPVTGLSSSGLSFDTWYTTLGLRAAGAVSFAGYNIVPHASVGWRHAYGDVTPALAVTYLNTGTGFTVQGLPIAEDSAVLGAGLDLALGKGFTVGVSYDGAFASSSQSNAVRGTVGFTF

SEQ ID NO: 6329 - protein, 678 aa, Bacteroides ovatus ATCC 8483
MNKLLALTPLAVAIGSSLVVPSAVASEETNSTPSATDTIQVYGHQYEGYAEHMPQSGTKTDVEWLDVPQAVSVVTKTEMQDRGAVRLVDALDGVAGVNNTLGEGSRDQFMIRGFDSLNDMYRDGMRDDGTLQSYRSLANVERVEIVKGPAGALYGRGSAGGIINLVTKRANGENFTHVKGSVGSNSQYVGQVDSSMAFSDKVNGRINLEYRQADSYVDHVDSNDFFIAPTIRVLPADGHTIDIDVEYAHQELVPYRGVPSKNGKPVDLPVSTYFGGTNDYQESDSLRVAVDYEWRLNDQWVWNNRAAFNHIELEQKGTRQGKVTGNEVSQTVNNFGYDPRTTTTLQSELIWETNDNQLMLGADFNQIDIDLTLASDKTLPPQNIYNPVVGPTPDPGFKPFRDNTTTTTGVYVQDVYTWGDLSVIGNVRYDSMELEQQKAGSGKEKLDDDKVSYRAGLVYRINYDTSVYASLARSWQLPYAGIYINPKLAEFFHTDLKEVGAKAYLLDNALMLNAALFQIDQEQPQTNVDGDVIDKIEVRHQGIELEARGQITKQWDISVGYSYLDAEDKATGKKPNDVSDHLFSLWSTYQLDDNWRLGGGVKYVGDRYAGNDEAVALGDYTTVDLMAAYTTGRHKIQANAYNILDEKYILGATNGTSGLNQIGYGAPAEFMLSYGYQF

SEQ ID NO: 6330 - protein, 694 aa, Bacteroides ovatus ATCC 8483
MKNILLGLLLFSGCVFAQEKTATDSVFVRNTLGEVIITSTPIQDKLQRIPAAVNSITAEDFQRGDQLSIANELNKNPGIQMQQGALNTSRISIRGLGARSQYSTNRVKAYIEGIPLTTGEGETTLEDIDLNLIERMEIIKGPASSSYGAGLGGAINISVIKPKPENSRIRLNGIAGAYGLFKSGITAMLGNRETGGFVSYNHLEKDGFRANSNYNRNTLTAYAKTQLNEVSSLSFFGNYTRLKAFIPSSVNAETLQNSPEDAAFTWGQAQGYESYDKALAGLAYKWDINANNSWQTSVFANYRDGYEPRPFDILDEDSFAFGIRSSLNSQFSLFNIPGKSSIGVEYFDEHYQAQLFENLYEENNGNGSLQGNRFSNQEQDRKYLNLFAQLSLQLTPKFKADLGLNYNHSRYRLDDHLNESNVDNSGVYTYPRIFLPQAGLSYEVANDKFIYASISRGFSLPTVAETLTPEGAINPEIKPEIGFNYELGLKAQWLDHRLYTELALYTVQVNDLLVAERVGNDQYVGRNAGATDHNGIEFLINYRENLTPAWSLQPYGSLALNDYSFDAFVDNDEDYSGNELTGVADQVINLGLDVAFQNRFKFNINYRYTGSIPLNDANTLYSDAYNLVNLRADYSFDLFAKVKTRIFAGVNNVFDTDYAAQILPNATGFGGAAPRYYYPGEPVNFYTGLNVKLF

SEQ ID NO: 6331 - protein, 1038 aa, Bacteroides ovatus ATCC 8483
MLSIMKNKKLLCSVCFLFTFMSALCGQNITVKGNVTSKTDGQPIIGASVIETISTTNGTITDFDGNFTLSVPTNATLKISYIGYKPVTVKAAASIQVLLEEDTQMVDEVVVTGYTTQRKADLTGAVSVVKVDEIQKQGENNPVKALQGRVPGMNITADGNPSGTATVRIRGIGTLNNNDPLYIIDGVPSKAGMHELNGNDIESIQVLKDAASASIYGSRAANGVIIITTKQGRKGQIKINFDASVSASMYQSKLDMMNTEQYGRTLWQANVNSGKNPNANSIGYQYDWGYNAEGYPVLDNIYVPKFIDDANTIATGDTDWFDEITRTGFIQQYNLSLSNGTERGNYFFSLGYYKNDGLIKYTNFDRISARINSDYKVIDNILTIGEHFTLNRTTEVQAPGNIMSDAMIALPMIPVHTVDGTNWGGPNSTMPDRQNVARIIYDNRNNRYTYWRLFGDAYVNLNPVKGLNIRSTFGLDYAQKYQRNFTLPYNTGFLNSDKDAVEMKQEHFTKWMWNAVATYELEIGKHRGDVMAGMELNREDDINFAAYREGFAILTPDYMYPSAGVGQSQASGGAGGFSLVSFFGKLNYSYADKYLLSFTLRRDGSSRFGSNNKYATFPSVSLGWRISQEAFMEKTKDVIDDLKIRAAWGQTGNQDIENYARYSIYESKYGTGNPPTYGTSYDITGSNGGSLLPSGFVRTQIGNDDIKWETTTQTNVGMDFSLFNQTLYGSAEYYYKKTTDILIKPSYIGILGEGGGQWRNAGSMENKGFEFNLGYRNKTAFGLSYDINANLGLYRNKILFVPGEVASTGDFGGDGVMNIIGHSINMRAGYIADGIFKSQEEVDNHADQTGKGVGRIRYKDLDNNGVIDTKDQTWIGNPNPDFTYGLNIYLEYKNFDLTMFWQGVQGVDVYNEVKKNTDFWSVGDMNANRGTRLLGAWTPQNPGSDIPAVCLEDLNNEKRISSYYVENGSYLKLRNLQLGYTLPTDISKKIKIERLRFYFSAQNLLTIKSKNFTGMDPENPNFGYPIPLNLTFGFNIGF

SEQ ID NO: 6332 - protein, 947 aa, Bacteroides ovatus ATCC 8483
MKKIYILTLLICLTCFGTSFAQTLKGHIYDAKTNEPLVGAAVTYKLHGNQGVVSNINGEYEIKLPEGGVDLVFSYVGYDDVLMPIVINKREVVTKDVYMKESTKLLEEVVVSAGRFEQKLSDVTVSMDVVKSGDIARQAPTDISSTLRTLPGVDIVDKQPSMRGGSGWTYGVGARSQILVDGMSTLNPKTGEINWNTVPLENVEQVEVIKGASSVLYGSSALNGIINIRTARPGLTPKTRFSAYVGIYGDAENDEYQWSDKNFWKDDKYAVKPILRGSLLSGVRNPIYEGFDLSHSRRIGNFDVSGGINLFTDEGYRQQGYNKRFRMGGSLTYHQPDMGLKILNYGFNVDFLSNQYGDFFIWRSPTEVYKPSPFTNMGREENNFHIDPFINYVNPENGTSHKIKGRFYYSADNIVRPTEGSSITDILGNMGTDANTIKNIVNGDYSSLYPALVGIGSGIINGNLDDAMNGAFTSLRNIFPNATTADYCDLISWVMDNGLPDLSGIQNGQLPSDLVPWLSNVINPSRLNPKTQTDKNFDYYLDYQFNKKWNGGAQITTGMTFEHIRYDSAVMDEVYKSDNAALFFQYDQRFWDRLSVSAGVRAEYYRVNNHRREAETKVFGTKIPFRPVFRAGLNYQLADYSFIRASFGQGYRNPSINEKYLRKDIGGVGVYPNPNIKPEKGFNAELGFKQGYKIGNFQGFVDIAGFYTQYKDMVEFQFGLFNNANNTMINSIGDVFQMLTDGKGFGIGAQFHNVSKAQIYGVEISTNGVYNFNKNTKLFYNLGYVYTEPRDADYQERNAVEGLYTDPLQMKEKSNTGKYLKYRPKHSFKTTVDFQWKRINVGANVAWKSKILAVDYLMLDERSKTQNDLMDYVRGILFGYSKGETLATYWKKHNTDYATVDFRFGVKATKEVAFQFMVNNLFNKEYSYRPMAVAAPRTFVLKMDVTF

SEQ ID NO: 6333 - protein, 949 aa, Bacteroides ovatus ATCC 8483
MKKLYILTLFICLAGFGNSFAQTLKGHIYDANTNEPLVGAAVTYKLHGNQGTVSDINGAYEIKLPEGGVDLVFSYIGYEDVLMPIVIGKREVITKDVYMKESTKLLEEVVVSAGRFEQKLSNVTVSMDLVKAGDIARQAPTDITSTLRTLPGVDIVDKQPSMRGGSGWTYGVGARSQILVDGMSTLNPKTGEINWNTVPLENIEQIEVIKGASSVLYGSSALNGIINIRTARPGLTPKTRFSAYIGIYGDAENDEYQWSDKSFWKDDKYSVKPILRGNLLSGIRNPIYEGFDLSHSRRIGNFDVSGSINLFTDEGYRQQGYNKRFRMGGNLTYHQPDMGMKILNYGLNVDFLSNQYGDFFIWRSPTEVYKPSPFTNMGREENNFHIDPFINYVNPENGTSHKIKGRFYHSADNIVKPSQGNSITDILGNMGTNAQTIQNIAGGDYSSLYPALVGIGSGLINNNLEDAMNGVFTSLGNIFPNATTADYCDLISWVMDNGLPSDLMNGIQNGQVPSDLIPWLSNVMNPTRNNVQTKTDKNYNYYLDYQFNKKWDGGAQITTGMTYEHVRYNSSIMDQVYKSDNVAAFFQYDQRFWDRLSVSAGVRAEYYRVNNHHREAETKIFGAKVPFRPVFRAGLNYQLADYSFIRASAGQGYRNPSINEKYLRKDIGGVGIYPNLDIKPEKGYNAELGFKQGYKIGNFQGFVDVAGFYTEYRDMVEFQFGLFNNADYSMINSISDAIQMVTDGKGFGIGAQFHNVSKAQIYGMEISTNGVYDFNKNTKLFYNLGYVYTEPRDADYKERNEIEDLYTDALQMKEKSNTGKYLKYRPKHSFKATVDFQWKRINLGANFAWKSKILAVDYLMMDEREKQQQDLMDYVRTILFGKSRGETLATYWKKHNTDYATVDLRFGVKATKEVAFQFMVNNLLNKEYSYRPMAVAAPRTFVVKMDITF

SEQ ID NO: 6334 - protein, 1013 aa, Bacteroides ovatus ATCC 8483
MNFLKLPVFLSGVLLTSQIAAGEVVFYVTEEGAAVNNVAVTFDGDKQLVGKNGFAVFDSQGGDHFAEFSQLGAWVGETEFSLSADQSAEVQVELIAGEALAEVQAYVPGQEETPALGNISGMVTSAETGGGVVDARISVAGTEVAAATDQDGFFALELPRGSYQLKVAHPEYGNRDIDDVRVISNVASQINLTMSMSGDSVIEEVVAVGSYIPSTATASERDSSAVLDAIGAEQLSRFGDSNAASALKRVAGVSIEGGRYAVVRGLNPRYNTVQLNGGNIPSSDPSRRVAPLDIFPSSVISGLEVQKSRSVDTPSGSTGGAITVNTRKFPADYESKLSLSLGGTFGLTGSNKELGESESGDFFGFGVSSRDMSGAVSEFERTEREGTFPTSDLERAASKDLTSRPLDLSSQKVNPDISVEYGQGNSYQNDMGELGYLFSVKFSNKWSHQDDAKETSYLLANASTGELAIDESYDYQRTLNDVDLGLAGSVGWISGDHEINSNTMLLRQSTAETEVQSGFQTEQNRDMQNYLTSWYEREFMVQQFTGEHLFFDFAETELDWRATLSKATLNIPDRASYSFQADKDQDNYRLFVSTVDRSFTEIEDDSADFGVDLSSVLLSGDDYVLKGLYGLSFFNRERDAETTRLGYQSNLGSQIPTDTFSVDELINDATIENGDYTITSKTSVTDVYDATWDYFSYYLGADLELGLNWRLNAGARIEDSDIVVNTAQTGTTFAAARSNSDLLVEGRAEDDDAYGSFSATYIQNESMQYRFGYYQSVNRPDFRELAEAQFVDIESGDTITGNSQLEKTPVDNIDIRGEYYYSETESVTLALFHKSIDRPIEKVLLPGAGNKFFFSYANGSDGVISGVELDARKEFEQGGYLWFVSGNLAFIDSEVVIETSGQTRTQNLQGQPENLMNLQVGVDDLSSGTEYTLVMNREGESIDSVSPLGVPNVIKQARIEMDFNVVKTVSDQLSMSYEVGNLLDEEVERKIGQEDFDVYTKGMSVNFGLKYQF

SEQ ID NO: 6335 - protein, 1116 aa, Bacteroides ovatus ATCC 8483
MESKHSLRKPKLFRTLLILLFMAVPLQWATAQLTLSTPRTTLGAVIKQIQSQSKYQFFYNDKLSTTAVDPLKVKDASLEQVLNKLLNNKNIAYKIDDNIIYLSEKEDLNSNQQQTNKERTITGQVLDSKGEPLIGVSILVKGTTDGAITDLNGNYKVTTKSNSPIIVYSYIGYKTQEIPLNGQTSLNITLMDDTQVIDEVVVTALGIKRATKALSYNVQEVKSDELLTNKDANFINALSGKVAGVTINSSSSGVGGASKVVMRGTKAINQSSNALYVIDGVPMFNLGSEGGQENDSKGTTEAIADINPEDIESMSVLTGAAAAALYGSHAANGAIVITTKKGKEGRLQLTVSQNTEFLRPFRMPEFQNRYGTGDLLSNTSSVEKSWGHKLNSSNYMGYSPVDDFLQTGVVTTETVALSTGTERNQTYFSASAINSDGMVPNNDYNRYNFTFRNTTSFLKDKMTLDVSANYVKQNDRNMVNQGTYSNPLVTAYLFPRGDDWNDIKMYERYDTTRKIYTQYWPQDFSGLTGQNPYWIAYRNLRETDKDRYMLSAALNYKILDWLSVSGRVRVDNSDSRYTRKLYATSNEILVENSKNGLYGISQTNDKQTYADFMVNINKTFKEVLSLQANLGASYSDMQQDVFSNEGPISDTKGIANVFNVFHLDNDKTKRSQSGYREQTQSIFASVELGYKSTYYLTLTGRTDWPSQLAGPNSVKSAFFYPSIGGSVILSELLPMPKQISFLKLRASYASVGLPFPRFLANPTYEWDQKAQKWAVKTHYPMYELKPEKTNSWEIGITARFLDHFNFDLGLYTTKTYNQTFEPNISVSSQYSTIYVQTGSVRNKGIELSLGYDNDWNGKFRWGSTVTFSANKNEILELMENYKHPETGAIITLDRLEVGGLGDAKFVLKKGGSLGDLYSIKDLQRDSNGNIYVNEKGEVASVASEDIKLGSVFPKCNLSWRNDFKWKNLNFGFMLSARFGGIVYSATQSYLDYYGVSEASAAARDFGGVTVNGSDVINAQKWYSVVGAQNGIPQYYTYSATNVRLQEASIGYTIPKNKLWGIADITVSLVGRNLWMLYCKAPFDPEAVATTGNYYQGIDNFMTPSARSLGFNVRFKF

SEQ ID NO: 6336 - protein, 1028 aa, Bacteroides ovatus ATCC 8483
MKKLFLILVAIGFSISAYAQQTVSGTVLEEGTDIPLLGVSVLVKGTSTGASTDFDGNFSFNRIESNAILVFSYLGYKTQEIQVAGQSTINVSLEVDAQGLDEVVVTALNIQRDKESLGYSISQVSSEEVNVARENNVMNSLSGKVSGLQITQSNTGVDGSSRVLLRGITTISGSNRPLVVVDGIPISNGSGGAGGGGGIDRGDALSDINPDDVASISVLKGAGAAAAYGSLGMNGVILVTTKTGTKKDGIGISLNSSFSFTDVALTPDFQNEYGAGAFGDFAPINADGRPVLDYPFSWSWGPKMEGQAYTNWLGQQDTYSPNPSKNTYKDFYQTGFTMSNTVAFEGRSDKGSFRVAITDEDGQGIVSNNTLAKQTFSIRGTTKLSDKFSVDGKMTYLTSKVRNRPQLAEGAGNTALQLSLMPRDIRLENVANNTINASGEEIKWNLDNTFNNPYWALENAGNLDEKDRFQGFLSANWDIGSKFNVTAKSGMDYIVYDFTNWGAGGAKAISNGLGSYNHDSGKSRIWNSDILATYSTNISDFKITTSVGSTYRNEFSSYRNIWGNDEKVGDFYRISNYKNSFSNEGTSKKGIYSFYGLGQFSYGGYLYFDATIRNDNSSALPKANNSYWYHSENMSILFSKMLGISPNILSQGKLRGSFAKVGNDTGPYRTQAVYNVNQTVTLPYTVASISGSLPSFDLKPETSESWEVGVDLGFLNNRITLDATYYETNTTNQIMAVPLSGTTGYSSKVINAGKIQNKGYEAQLNLIPFDSEDFTWDLGLNFTKSNSKVISLNEGLENISLGSLWTASVEARPGQEFGTIYGNDFLRDNFGRKIIGDDGYAKRGDRVALGNINPDWYGGITSKFRYKNLSLSTLVSIQQGGEYYSYGRGYRMFFGTDARSLVGRETGIIEDGINEHTGFVNDIAGNAMLKQFTDIFSNQVATDLIMDASNVKLREVALTYAFPQTMLKGTFIQSASLSAVGRNLFFIYNAAGDIDPEASYSSGPTSTAFEHSSLPSTRSYGVNLKINF

SEQ ID NO: 6337 - protein, 236 aa, Bacteroides ovatus ATCC 8483
MKRVFLSAVALTVLAAPAFAADMPARTYTKAPVYTPPQAIYNWTGFYIGGHLGGAFAGNNSLEGNNGRFLGGVQGGFDYQFAPNWVLGIEAQYSWMDRNTTNFGFPGATVVSSTGANQLGSVTGRLGYTWGPALLYAKGGYAWRDGNALGVNVAGVPAGFTTSGNTKDGYTVGGGLEYMFAPNWSAKAEYQYYNFGNTTFTGGPAPVVGSRFNSDEHTVKVGVNYRFGWSGPTSKY

SEQ ID NO: 6338 - protein, 916 aa, Bacteroides ovatus ATCC 8483
MKQNLVLLLAFLFPSFLLAQQSGTGIKGCVIGAESNRPVPGVIVTLNGEGRQTRTDVKGAFFFDKVSPGKDVLVFNSVGINPKNILVEVTEGMVTDLGEVKVVELTVTDNLSLIGVLDEAAVDDDVESSSQEISSKVILSNDVYLNKTSYQLSPMRFRVRGYENIYEQRYINGVNFNDQLRGVFNYSSIGALNDMTRNGDVVNYNRPSAFTYGSIGGAENINMRASAISPGTKATLSYANRNYYLRGMVTYSTGLLDNGWAFAASLGGRYSHEGAVDGTFYRNFSYALSAEKQWKGGEHSLSIVTFGSPVQRGQQSATYQQACELLDNYQYNPNWGYQNGKKRNAKVVLAFDPTLILSHTWKIDDESSLVTGVGMHYGRYGNTALNWYNASDPRPDYYRKLPFAIDINVSPEVAEATELLWRRNDTSVTQINWDNMYLANAMQADGKAQYMVEERRSDLLETTLNSTFNTKLGDHSWLTAGAEFRYTQSRQFKTVDDLLGASYVMDYDKYAERDIHDDLNSKQNDLNRPDRKVYEGGVFGYNFNLNIMKAGAWVTNQHRYAKMDFYYGAKFDYVQFYRDGKMKNGRYPENSYGKGRTHSFVDMALKAGLTYKFNGRHFLTANVSYGTEAPLPNNAYLSPRISDMTPEDVENGQKLESGRVFSADVNYIFSLPSFTGRVSLYQTNFYDQMERSSYFNGTNFFNHVLYGVNRIHRGIELGTTYKLDNHWSFDLAGTISEYYYSNNPMAVENYEATQGDKTSKVYMKNLYVSGTPQFAGTFGVRYFIDYWFLGANLNAFGRNYIDVAPARRMEGIYNTVDPTLPETMDTYYAMTTQERIGSACTLDLSVGKIFYLRNRQSINFNLSVNNVLNKRDIRTGGYEQARVFASDGALVNPALFPNKYYYMQGINCFANISYRF

SEQ ID NO: 6339 - protein, 1088 aa, Bacteroides ovatus ATCC 8483
MQRMSNKVENMRTLLLMLFAAISLSVSAQTITVKGNVKDTSGEPVIGASVVEKGNTTNGTITDLDGNFSIKIDGKKTLVISYIGMKTQEIAIQGKKVINVQMTDDSKALDEVVVIGYGTVNKRDLTGSVASVNSKDLAVVPVSSATEALTGKLAGVSITTTEGAPDADVKIRVRGGGSLSQDNSPLYIVDGFPVSSISDIAPSEIQSIDVLKDASSTAIYGARGANGVIIITTKSGKEGKVQVDFGASYGFKKVTKLNKVMSPYDYVAYQYETGRTEEYGLFEDMDIWKTMEGTDYQDEIFGRTGNQAQYNLNVSGGSKQLKYNISYAHNDEKSIMLGSGFNKDNVNAKINSELNKWLSLDFNVRMSYSTLDGLSGGADTNESNAANSIVANATRFRPVNPMAYDASDDEANNAYTTKNPLERLLGVYKKKTTFNQNYNAGVNWKPFKNFTFRSEFGYGWKYEDTDQVWNADGAQNSKLGYNGQPQAVFTRVTTKNWRNANTLTYDNKKLFGGRDRINVLLGHEVSSNEKKTLENTSVAFPTSMSIEEVLSTAGAGTALPNQTTLAAKENLLSFFGRANYTLMDKYLLTVTVRADGSSKFAKGNQWGVFPSAALAWRISDEQFMQNTRNWLSSLKLRLSYGTAGNNRINSGLTYTAYSLSSNTARAPFFNGDRTSMMELGSYLYNPKLKWETTVTRNFGIDYGFWNNRLSGSIDLYWNTTNDLLMKTEIPANAGYNYQYQNFGSTSNKGVELSMNAIIADKKKFGLNFNFNISYNRNRIEKLNTDNPWQSSGWGGSTIAKYEDFRVEEGGRLGEIWGYKTNGFYTAYDPVTNPEGELILNGTNWVLKDGLKDNSVNITGGSYFPGGLKVECDENGEPIKQKLGNTVAPVYGGFGFNGRAGNFDFTLFFNFSIGNKIVNATKLATSFFAGTSYGYNLNEDFCSGKRYTWIDPTTGYNLGKSISSDALAYYGGEAGIISRLNQINANASIYNPVAVTQMQLTDYAVENTSFLRVNNITIGYSLPKSWIRKCYMQNVRIYVTGYNLFCLTNYSGTDPEVDTSSKRNPMTPGIDYAAYPKSRSFVGGINVTF

SEQ ID NO: 6340 - protein, 998 aa, Bacteroides ovatus ATCC 8483
MMNESKLLSPNGIVKASALCLLMSAFSVNAAFAVPVLDREVMVIQQGRTLTGTVVDNFGDPVIGANVIVKGTTIGNITDVNGTFTVENVPDDAVLQISYIGFKTLEVPVKGQTTFNITLQEDTENLQEVVVVGYGSSVKKDLTTAVTSVSSKDFLAGAVNDPMQMVDGKVAGVVVNSVAAADPNTSGSIQVRGASSLKAGNSPLIVIDGMPGGDLRNLAQSDIESITVLKDGSAAAIYGSRGANGVILVTTKQGKAGKTTITYDGYVEHDFVASKPDVLDAEAYLDKVTGAVDYGHRTNWYDELINKNNFGHNHNISLSGGSETTIFRMSANFKGKEGLDIASDRKEYGLRGNFKHTTLEGLLEVGGNFSYRIADEDYTDYASFKQAVQLNPTFSVDEMDAFKGNSYSFNPVKNLTEQENGAKQEYSTIDLNLKLNILKNLNTELKLGRQGHNKKQSQYKFKTHKDCINGNYNGYALLKQEAWTDWTLEWLGNYSFKINDEHDFKIMGGYSYQQFDYEWFSASNRDFPSDAFLYNYLQGGEYEKVNGRLGMESHKEEEKTIAFLGRINYNWNDVFLFTGSLRHEGNSKFGEDHKWGLFPAASAAWRVSKLPVFENSSAVDDLKLRFSYGVTGRSGFDRYTAQAKYSGFGQYYSDTYGKFIMGYGPGNNPNYDLAWEKQISYNLGIDYTLFNSRLSGSFDAFIREGRDVIGEYPVPLPPYLHDKIYANVGTTTSKGFEFQVNWDAVQTKDFSYSTNLNLAYTKSKLKSFSNEKYQLGYIEGDGFPSPGNPGSAQRLEDGIEIGSFYGFRYAGVDDAGNILIWEKGEEGGVTKLGADGNEQDKVYLDGTGVPKWELSWGNTFRYKDFDLSLFFRGRFRYKVMNQYEMYYGLQVVSGDNKLSSAYEENAHIKGPKVICDYFLQNGNYLRLDNITLGWTPKLNTKWISNLRVYGTLKNVFTLTKYSGVDPTTVTTTGLWPGIGGMEVYPTARNLTFGVQITY

SEQ ID NO: 6341 - protein, 361 aa, Bacteroides ovatus ATCC 8483
MKSNMKKATLSFTCAGLSGLAAGVQAQSSVTMYGIMDAGVEYVNHASGAGGEGSAVRLVSGGRNTSRWGLRGVEDLGGGMKAVFQLESGINIANGQFDDGPDSIFARRAFIGLKSRYGQLTLGRNFTTTFDYMLPFDPMGYAPNYSWGVSSTAAAGRRDLIFVRSANAVRYDGTYSGLKFGALYGFGNVPGNMKTSSKYNVGLGYERGPFAAVATFDRQNGASDSVIPADITDYIQGIHAGVSYDFGAVKAMAGYRTYQRTFRTQQQTQRSSTYWIGAQYEVTPVVTLSGAVYYQDVKNSDGGDPTLFSVRGQYALSKHTVLYLSGAYAMTGHGKLVSVSRDLAGASDTQVGVTVGVQQRF

SEQ ID NO: 6342 - protein, 415 aa, Bacteroides ovatus ATCC 8483
MNKKNCSLLTISILFACHANAAGFQVAEHSASGLGRAFSGEGAVADNASVLARNPAAMTLFENAQFSGALSIVDPEVNVYDKTNGEQSDDVAPLQLVPAAYYISPINEKWAWGIGMFTNYGVATDYPDDISAGDMAGDTALVSVGINPNIAYRVNEALSVGAGVNFVYAHAELTRHKGSLAPLFGSTDKSENLIGMTGTTFGYGWNVGALYELSEKTRFGLGYRSKVDLDFDDGEFSSYDSGIATAPKVDGRLQISLPSIIEVSAYHEFNEQWAMHAGWQQTEWSTFTELKATSPQCNDGTAGQCFYKPEHYENNNRYSLGATYQMNESWTLRAGLAFDEQAGEATLSIPDSDRFWYSAGLTYLMSDNMTIDAGFALVKSRSGSFKETNAADEVLEFEAEGTAYISAIQMNYTFK

SEQ ID NO: 6343 - protein, 760 aa, Bacteroides ovatus ATCC 8483
MKNILGYGFLGTFCLGSLTVPSFSITITEKLASLEGKTESLAPFSHISSFNAELKEANDVLKSLYEEALSLRSRGETSQAVWDELRSRLIGAKQRIRSLEDLWSVEVAERGGDPEDYALWNHPETTIYNLVSDYGDEQSIYVIPQNVGAMRITAMSKLVVPKEGFEECLSLLLMRLGIGIRQVSPWIKELYLTNREESGVLGIFGSRQELDSLPMTAHIAFVLSSKNLDARADVQALRKFANSDTMLIDFIGGKVWLFGAVSEITELLKIYEFLQSDNIRQEHRIVSLSKIEPLEMLAILKAAFREDLAKEGEDSSGVGLKVVPLQNHGRSLFLSGALPIVQKAIDLIRELEEGIESPTDKTVFWYHVKHSDPQELAALLSQVHDIFSNGAFGASSSCDTGVVSSKAGSSSNGLAVHIDTSLGSSVKEGSAKYGSFIADSKTGTLIMVIEKEALPKIKMLLKKLDVPKKMVRIEVLLFERKLSNQRKSGLNLLRLGEEVCKQGTQAVSWASGGILEFLFKGGAKGIVPSYDFAYQFLMAQEDVRINASPSVVTMNQTPARIAIVEEMSIVVSSDKDKAQYNRAQYGIMIKILPVINIGEEDGKSFITLETDITFDSTGRNHADRPDVTRRNITNKVRIQDGETVIIGGLRCNQTMDSRDGIPFLGELPGIGKLFGMDSASDSQTEMFMFITPKILDNPSETEEKLECAFLAARPGENDDFLRALVAGQQAAKQAIERKESTVWGEESSGSRGRVEYDGRE

SEQ ID NO: 6344 - protein, 151 aa, Bacteroides ovatus ATCC 8483
MKLLKVAAIAAIVFSGSALAGVVPQYGGGGNHGGGGNNSGPNSELNIYQYGGGNSALALQTDARNSDLTITQHGGGNGADVGQGSDDSSIDLTQRGFGNSATLDQWNGKNSEMTVKQFGGGNGAAVDQTASNSSVNVTQVGFGNNATAHQY

SEQ ID NO: 6345 - protein, 588 aa, Bacteroides ovatus ATCC 8483
MKKIPPLYFFKKFKKRYLLALSLPLLSYANGFKIQEQSLNGTALGSAYVAGARGADASFYNPANMGFTNDWGENKSEFEMTTTVINIPAFKFQVPTTNQGLYSVTSLQIDKNQQNTLAILKTIGLDNIIKTLGNAALKDDGLKEAINRVQGLMNLTNQKVVTLASNPDTQIVNGWTDTTNFVLPKFFYKTRTHNGFTFGGSFTAPSGLGMKWNGKGGEFLHDVFIMMVELAPSMSYTIKNRFSVGVGLRGLYATGSFNNTVYVPLEGASVLTANQILNLPNDVFADQVPSNMMTLLGNIGYQPALNCQKAGGDMNNQSCQEFYNGLKKIMGYSGLVEASANLYGTTKVVQKSNGKGLSGGYRVGGSLRVFDHGMFSVVYNSSVTFNMKGGLVAITELGPSLGSVLTKGNLNINVSLPKTLSLAYAHQFFKDHLRIEGVFERTFWSQGNKFLVTPDFANATYKGLSGTVASLDAETLKKMVGLANFKSVMNMGAGWRDTNTFRLGITYMGKSLRLMGAFNYDQAPSPQDAIGIPDSNGYTVALGTKYNFRGFDLGLAGSFTFKSNRSSLYQSPTIGQLRIFSASLGYRW

SEQ ID NO: 6346 - protein, 1023 aa, Bacteroides ovatus ATCC 8483
MIQAKMAGRGRRRALLGAAMAALLAGAAQAQTLHAVDIPAGPLDAALLALGQQTGEQLFFRRDVVAGRQAPALRGRYTPEAALAQLLGDGELAARRTGPGVLVVQRRGEAPAEPGAEASRPFGHGEGDADALGWDSRSAGMLATAPPAPTAPTTVEELQVTGSHIRGGRSPSPLIVATRADLERTGQTTIAQALRSLPQNFGGGAAEGTALTGADRSGKNGAFSTGINLRGLGSGATLVLVNGRRIAGSGAFGDFADVSSIPTAAVERVEVLLDGASALYGSDAVGGVVNIILRRRFDGGELRLLGGAATRGEPAEGQASIVAGRRWAGGGALFAYELQRRDDLPAADRPFSASADLRRFGGADQRQANSFPGNILRTDPATGITGPGWAIPAGQDGVGLSAADFQAGTANRGEPRQGSDLLPRQTLNAVYLALDQDLGERVGLTADARYSVRRFKTQALPGTASFTVNRNNPYFVSPTGAASHAIGYSFVGDLPNPVISGAVDTLALTGGADVRLPAGWRADLHAAYAQEIDEARTTGIVNSALLSEALGTAADRPQTAFSTARDGFFNPFVGTAGANNPAVLAFVGSGFTTSRSRSAVTSGGLQLDGPLWALPGGPLKVALGAQARRETLERSGHNYANSVAPTPTTPVDVARTVLAGFVEARAPLVGPANRRPGLESLELSGSVRMERYSDVGTTTNPRLGLIWEVLPGLALRATYGRSFRAPALREVRDPISYSPSLLPFGGGRVLSLILNGGNPDLAPETAESWTATLDLAPPSWPVSLHATLFDVRFDDRIERPVQQSFTTALSDPTLAPFVDRIAPGLDEADLARINALINSPLYSSVNGVFPGEQYGAIVDNRYVNTGGLHVRGLDLSANGRFDVGRDTLSLAASGTYMLDHEQQVTPAAPVVEQRGVVGFPVRFRGRATADWTRGDVTVGAALNHVAGYRDGLGARIGDQTTVDLQLRWEPASGVLKDTAASLTVRNLFDADPPFYDNPSGLAYDPANADPVGRYVVLQLSRRW

SEQ ID NO: 6347 - protein, 1129 aa, Bacteroides ovatus ATCC 8483
MQNYFSIQFLWVIKSLWLTSKKIPLSMRLLVLFLVCSIGLSYAADSYAQKAMISIDVHNQRVEDILKEIEAQSDFDFFFNNKHVDLNRRVSVSADKSNIFSVLKEIFAGTNVKYSVLDKKIILSVEAQSPQQEKKVTVSGTVLDTHGEPVIGASVLEKGVQGNGTITDIDGIFKLSVSSSKAQLDISYIGYQSQTVAVQVGKNLKIILQEDSKQLEEVVVVGYGTQSKKTLTGAVSMVNMGDVEMNTVPNVSRALAGKAAGFRVNQISAQPGGEAKFRIRGEASTGAGNDPLFVIDGFPVSSSGNLSSGNGYYESGNIDNVLESLNPDDIESISVLKDAASTAIYGARAGHGVVLITTKRGKSQKPRVTYSGMGSVQVARSNYKMLDTRMYMDMYNKQQHEEWLKLNGMGIYKGYVEKPDTPPTQYKPAFNNDEILLASGTDWLDAVMRNGYTQQHNLSVNGGTEKTRYLASVNYMDQEGIVKNNGVSRFSARLNLDQELSKYVSFGLTATYSQNKYDNVPLGDKVNEYSGVLTGAIQSNPTIPIYDSEGNYFIDPKRPFVANPVSLLEIKDNTVKDRLIGSAFVSVKPLKELEVKLQLGADRSFQKRSSYLPKTTLQGANKNGRADISQETSTTYLMELTAQYSKSFGDHNLKAIGGYSFQKFKNDGFSAGNSDFLVDGFGYNSLGSGNYKKPSVSSWASINSIASLFARANYSYKGKYLLEATVRADAASNFAPENRWGYFPSVSAGWMISEENFMKGASKWLSMLKLRASYGQTGNSNVGYRIYDYYEVGRNAIIGGAESTGVYASDLGNKSITWETTTEFNLGVDFGIFNNRFKLAAEYFKRKITDLLVTNKPLPFYNEVNKIAGNIGSTQSQGVEITLNTVNIVTKDFEWDTTLTLSHYNDRWLKRDPNWKPRAYEKEDDPIRAWWEYEAIGILQPGEKAPDAQKDLVPGMMKLKDRDGNGVLGDEDKVYMGNGDPKIIYGLNNSFRYKNFDLNIYFYGEAGRKRGASYYEGWTRMDNGINVSTYALKAFSSNNLTATDPTYVRGGNGWGDYYVKSIYYVRCGSITLGYKVPISQKIVNNLRVYVDVNNPFVITNWTGLDPETDNGTYAYPNVTSYNFGVSISF

SEQ ID NO: 6348 - protein, 716 aa, Bacteroides ovatus ATCC 8483
MNFMLGLSLVHFVGNKKGGNMKRLYLLFALAACLPTALFAQQTESKKRSGWHLTIPEVTVIGHRPMKEIGVQKTKFDSLALKENIALSMADILTFNSSVFVKSYGRATLSTVAFRGTSPSHTQVTWNGMRINNPMLGMTDFSTIPSYFIDQASLLHGTSSVNETGGGLGGLVKLGTAPEVAEGFNAQYVQGIGSFKTFDEFARFTYGSKRWHGSTRAVYSSSPNDYKYTNHDKKINIYDEDKNIIGQYHPVERNRSGAFKDLHLLQEVYYNTHKGDKLGLNAWYINSNRELPMLTTDYGDATDFENRQREQTFRSVLSWDHIKSNWKLGVKGGYIHTWMAYDYKREVAPDNWASMTRSRSKVNTFYGQAEGEYSPTKRWFFTANVSAHQHLVRSEDKNIILQDGGKAIVGYDKGRVELSGSVSAKWQPIDRLGMSVVLREEMYGSEWAPLIPAFFIDGIISPKGNVMLKASVSRNYRFPTLNDLYFLPGGNPNLRNEHGFSYDAGVSFEVGKENAYKLNGGVNWFDSYIDDWIIWLPTTKGFFSPRNVKKVHAYGIEVKANLAVQPAKDWLIDLNGSYSWTPSINEGEKMSPADQSVGKQLPYVPEHSASLTGRLSWRSWAFLYKWAFYSERFTMSSNDYTLTGHLPEYFMSNVSLEKNLFFKPVDVQLKFAVNNLFNEDYLSVLSRPMPGINFELFIGITPKFGKNKKKSVNTNL

SEQ ID NO: 6349 - protein, 783 aa, Bacteroides ovatus ATCC 8483
MVGFFGYAQVTIKGVISDENGLPLRDAHVHIANKTTSTDANGSYVLSDIPKGKQKLYISFIGYFAIDETIDISSDLTLNRKLKLDVTKLEDVTIQQTTNSKSESSNEQVLKSATIEKFSNQTLGDALKEVSGVSVLKTGSTIVKPVINGLHSSRVPIINNNVRLEDQQWGTEHAPNFDINSAGKITVIKGASALQYGGDAIGGIVVIEPEVIKKDTLVGKTIVNLASNGMGGSLSSSLQKGNRYGWSWNALGTFKYLGDRETPDYVLSNSGNREQNFSGGIRYAQEKYNFNAMYSFYNAQIGIIKASHIGNVNDLYNSINNQQPSVIEPFSYSINAPKQEVQHHLAKINYQRWLNDNSSLDFQYAFQFNNRLEFDIRRTSANTDKAALDLQLATHTFLTDYKTSIGNWKIKSGLNLGYQNNFANPKTGVRPLIPSYQKLDAGLYGIAVYKIDNATSLESGIRYDFSTIEATKYYLKSRWTERGYDAEFSDFIVGDEGNQWLTKPTFDYHNVSANVGLKKQFHHEMEWLVNVSLASRNPNPSELFSDGLHHSTGQIELGDLRLKKEQAFKFNTTFKKDWKSFVIQLNPFINRISNFMYLQPTGFETTIRGAFPVWEYKQTEALLTGFDVNTKWTISNHFSHELGMAYVNGQNLSTDEYLIDMPPFVINNKIQYKNDSWFHFVSEIKSELVFSQNQFPNYNFETNIIVNNLLTPVTVDISSPPKGYHLLHLYSEMTFNINKKNSLTTSFSIQNIANTTYRDYLNRQRFFVDEMGRNIQIQLKFNY

SEQ ID NO: 6350 - protein, 712 aa, Bacteroides ovatus ATCC 8483
MTDHQAARRARLSVGVTAGIITTALAGAVHAQDAAPADPAQTQTQPQQAHTLPTLQVNASQYDPDDVRPEGVTTATKTYLAPKDIPQTIDTLEVNKYKSYGINDLATMLDGVPGVNTTYDMRGEGVYIRGFKADESDIYRDGVRESGQVRRSTANVERIEILKGPASVLYGRSAGGGVVNMVSKQARFDAKSSITLRGGSWDNVGGTIDINRVLNENVAVRLTADREQAHSFREGIRNRNEMVSPSILVDTRTGWRWTGQYTYDNVWRVPDRGPVYDQLPAGVSIRKGFAAPGDYVEDRLRVLRSDLSYDFNNRWSLRWVASKREASQDFDHYFAGTYRAATGKITPNYAWQQTRNTTLSNTLDLTGKFSTGSIKHDLLVGLEASEEERAPRVGQPGSTFSYDPLQPIVWPSRPVQGKPTQDNYHKGKGQALYMQDLVSLTEQWKLLLGLRYDSYDFQSTNKIANLTRKTDGNGFSPRVGVVWQPVREHSFYASWNKSYSPYGGRGILTVETAVGAVPDDEPQYSRQSEVGVKSDWLGGALSTQVSVYQLEKYNIRYRPDPENDPYTWAIRGKDRSRGIEFSAAGRVASSWYVRGGVAFMEAKVAEDAQNPANVGLYLRDTAKRNGNLFLRYAPKGPWYGEVGVTYTGSRFTNAANTALLPGYTRWDALVGWRQDAWTVTVALSNLFDKQYWRSSSMPGAPRSVLVSANYQF

SEQ ID NO: 6351 - protein, 862 aa, Bacteroides ovatus ATCC 8483
MSKTRSEKYLMGGGSTKLACFAAAVLCSINLSAANNSKQYELSQVNVDANVTKTGSLTTKTDKYQGVSTISRAMIESMPSGNGDFVQLLRTNPNVQFSNTNRQSTTMGEISPSNISINGSKFYQNNFMVDGVSINNDLDPALNTQGNSYNEFIIPGATSQGMAIDSDFLESIDVYDSDVSAKYGSFTGGVVNAKTRNPRDGFHGKFSMSHTRDQWAKVHIYKGQEQAFENSSNLENQPKFKKYSTKLNLEGFLTDDLGLMFGYVNTRSKIPLKAYKDGFGSGESETRVQRRNIDNYFLKALWYATPRLTITPTITYAPQKSKMFNDNTKNSFATMKYGGLNLALKADYDLDFMRINQTLSYNSIETSRDSEHEYFYYWFSSPARPWGNGLQSLEGGYGDIDQTQKTLAYNLDTNFDEIELLGLSHKFAAGLELKRQKAKINIAKDFTVASGLGYIMGGTHCDPNDALCSEDVIPRFGFAQFFTDKSVYSGNTSVSMKSYALYLEDEMRLGNLTLRPGVRFSGDDYMDKKTVAPRFSSSYDIFGDDSSVISFGANRYYGRNIFAYKLRDGMEGLITKYKRPPFPYSQNWMKQTQDTFGTKFTQLKIPYDDELAFGVKQRLGNLEMFGKYVNRKGRDQIVKSQRDRLGLPLLPGYSAIYQTFTNDGKSDSKIYTFGIKTIEDYAAFGTKNGLELSFEHIKSTTTSTIYDENLAQNVIEGDEFVEADGTLIRYQDIRAQQYARPWTAKLNIITKIPSYGLSINNFFSYKGSQKALMNTFNRTPAGKYAERYYIYKTIELGRSYTWDARIGYTKKMPKDTELFVNLDIYNVLNRKNKTNSALTTSKMPYVIYENGRQFWLEAGIRW

SEQ ID NO: 6352 - protein, 733 aa, Bacteroides ovatus ATCC 8483
MNRNFEKNECGNIIAAFLFFIFLLAGISGTLFAAGTETAHQWETPQKPVSQTSNGGIDTSVLDLHSSEVLWLESEGVAIATRHETPVSKAPGIVTVITAEEIKHLGYRTFAEILRTVPGFEILKLPDFGDVVPAVRGLEAANKVRLMLDGHFVNSPLKGSSFNAFDDFPVQNIKKIEIIRGPGSAVYGENAFLAVINIITKDAGDIDGARISSGYGSFNTYEENVIFGKKYGKVDISGMLHYRSTDGFSGTLERDVQTTLDEVFGTSASNTPGNVHDKRQEFAMNLKVEYDNLWFHGWYNNKNRETFVGPQYVLSNDSDIENNYVFGEIGYKKIFDGGLTIKPRIYYDQFDIRPEIEAYPEGSVLAFDTNKDGVYDTTVSFPDGFIGIGSEIERIAGAEVPFDYELFDKNILTVGLEYRWVNQGNVRYQSNFNPATYEVFDAVQNLSDTYPYLKEATRRILSVYLQDTWDLTDTLNLTLGVRHDQYSDFGGATSPRTGLTWAFMKNASLKLLYGEAFRAPDFMEMYIQNNPALQGNEDLDPEIIKTYEAGLSYRFNKYVTGGLNYFYNDIQDFIVKRPLTPGSTTLRYENYGDGHVHGVEMETNVDIGGGNYLFMNYSFQDPNDDNGNDLPYVARHKGNFGVNVRYWKYINTNVNTFVSGRRSREADDARDDMPSYALLNLSVIGKEFFRTMEIQGTVFNLLDKDYNDPGTASMSSDLPRPGRSFFIGLSYQF

SEQ ID NO: 6353 - protein, 677 aa, Bacteroides ovatus ATCC 8483
MGKPGDLPKKACNQYLERRTSIIVSGENSDCSIKFILLFIFMYRQVSKFKWVWCCLLTLVAFRAQAQSDTIIGGDVLKEVRIYGIPIEKYATGSKVHRLDSALLATVNHTTLANILQQQSPVYIKSYGNEMLSTASFRGTGAGHTAVLWNGLNINTLSNGQTDFSLVPMFVIDQVSIQPGSASAMYGSDAIGGSIHLQNDPTWRKGWQAEVQQNIGSFGQYFSAAKASVGTGKFESVSQVYRYSANNDFRVRISPTENSTQQNASVYNYGFQQALSYRIASNQYVSVQGWYSFSDKQTQATRGDNFSNDLIKQTNTRIVADYVLNDKVGFLNVKLGYIDDYLLYNENSTTATRRGIATIRYEKQLNTKLSLQVGSQWTHIKTNVDAYGRDIAEDRTAIYGSLRWQVLPRWQLSANVRQAHVTSFVAPFAPSLGSELALYKTNNKSLIFKLLASRNYRVPTLNDRFWQGAGGVGNPTLRPETGWSGETGLAYSQQNKHFSWQAELTYYQMQVTDWILWKPVGSVWSPENVSQVDGTGVEGSLRLKWQQTSGYVMLGGNYAYTQSIIAKADNADFIGKQLLYTPLHSSNVYAHWQYRGWFIQTDLNHTGLRYLENSNSSFIEGFTLFNASLGKNFRLGKHWWSLSARVNNMFNEDYESVNNRAMPGRNYQLSLRYKIGS

SEQ ID NO: 6354 - protein, 1115 aa, Bacteroides ovatus ATCC 8483
MKKNHSFIALCSKYALNLKLPLIMRISLTLLFLVVLQLSAENSYAQRMRIAISMSNVSVEQVLNKIEETSDYVFLYNDETIQKSRIVSVRSKSGKITDILDDIFKGTDISYTVIDKQIILSKSNKVNQTAKAIQIKGTVKDALGEPLIGVSVLVKGTSNGTVTDLDGRFSLNVSVGDILEFSYVGYAAQSVTVKNATPLDIVLSEDAQALDEVVVTALGIKREAKALTYNVQEIKAAGITKVKDANFVNSLSGKIAGVTINQSSSGTGGSSRVVMRGTKSLFGENNALYVLDGIPMQGLRTKQSDNFYESVEVADGDGISNINPEDIESMSVLTGASAAALYGNRGANGVILITTKKGAIGKPRISYSNSTSFSRPFVTPEFQNTYGRKEGEFKSWGDKLEKPSTYNPLDFFQTGFNTMNSIAVSTGTETNQTHISFGAVNSEGIIDNNKYNRYNFTFRNSWDIVKNVLSMDMGLFYIKQNNQNSNGQGMYYNPLVPIYLFPPSDDINKYAVYERYDADRNFKTQYWPYGNQGLGMQNPYWIINRNMFNTDRDRYIISLSMKWNITNWLNIIGRARIDNAYTDFERKLYASTDGLFAKSQGNYMNQEDKNTSTYLDFLVNVDKKFGENYHLLVNLGGSFYDEKYKSDTFEGNLVGVPNFFHPSNIPSTESNYNKSELHTQTQSIYGKAEIGYRNFLYADVTGRIDWFSTLVGTSKEYVCYPSAGLSVILSEILPLPEKIISFWKIRGSYAQVGNPPSAYLPYATVALENGNATSANFTPASHLKPEMTKAFEFGMDLRLFQNKLNIAATYYNSNTYNQLFKYELPPSTGYAFAYENAGKVNNWGIELSVGFNQDLGPVQWNSNLIYSMNRNEIKELLPEYVTDRTTGMTVKSPTEFSVATADSYRMILKKGGSMSDIYATKLKQDLHGNILITNGGVSAEENTFIKVGSAAPKYNLGFRNSFSWKGLELDFLIDARVGGEVISATQALMDQFGVSQQTADARDNKGVVVNKGKLDAEQYYGTVASGKTGLLAHYVYSATNVRLREMSLSYMLPSKWFGEKLNISLSLTGHNLLMFYNKAPFDPELTANTGTYYQGFDYFMPPSLRSFGFGVKVNF

SEQ ID NO: 6355 - protein, 667 aa, Bacteroides ovatus ATCC 8483
MKHKTITLASVITATMSIPTLVFPLTALAEDEPRDCGDRRCDDYIVITGDLMREPTKVVTDPKKPRLPLPSYDGAGFLKTIPGFSIGRKGGAGGDPSLRGMGGSRISIVDDGQHVYGTCGGRMDPPTAYIYPEAYDSITVIKGPQTVKYGPVGSAGTVLFEKDRHSFVEPGVEGRASVTGGSFERQDYIVELKAGDETHYLDLDVNQSSSDHYQDGDGNTVQSSYDRNNYNIALGWTPTDTSVIELAYGKSDGEAEYADRANKARVINNENVTLLTQFEFDSDLIREIEFQAYTNKNDHIMDQFDQGVNSGVNVRRKTSGGHFWLELTPSESLEATLGVDYMQSTHEGRGINPEFDNGLDDLLSKPFKDNMRYENMGIFIEADYALGGGNLLSGLRFDHWDSELFVAQTGKRSDDLISGFIRYEYLNGNNQYYLGTGHAQRIPDYWEIMKASPDNLSTKAFDLEPEKTTQLDIGWIYQANIEISTSLYYGKVDDYILVDSNTSKTSAYNIDATIWGGEVGITYPFTEQWSAQTTLSYSHGENDTQDTPLGQVSPMEGRVSVNYEGEEWTAGLFWRVVAAQDRVSIGQGNISGQDLAESSGFGTLAINGSWKHGDVVLVSFGIENLFDITYAEHVSRSGAGNDIPGSEPMFQVNEPGRTAWVKLDYTF

SEQ ID NO: 6356 - protein, 218 aa, Bacteroides ovatus ATCC 8483
MKIIASTLTCFAVATLSAGVHAQAFTNSPSPWSIGVGAVHLKFHPSADVSFAGNPVPGGAVTVGSDTVLGVEIGYAVTPNWTARLDVGSPVETDFGGAGTLSPLGKLGSVKGGPAILTMTYSPGMLGPIRPFFGGGLTYLRVFSTKDGAVQNLKVDDGLGTALTIGADWPLSDGYSIGFSVQKLFLKVKATGTAGGAPVRADVKLDPVVTFLSLRKQF

SEQ ID NO: 6357 - protein, 1005 aa, Bacteroides ovatus ATCC 8483
MEIKRNVVSKFLLLWVVGMLLSVQVFAQGLTVKGVVKDNTGMGVIGANILVKGTTNGTITDFDGNFTLEAKKGDVIVISFIGYKTQELPAAATMNVTLQDDTEVLDDVVVIGYGSVKKNDATGSVTAIKPDELSKGITTNAQDMLTGKVAGVSVISNDGTPGGGAQIRIRGGSSLNASNDPLIVIDGLAIDNNGVKGMSNGLSLVNPEDIETFTVLKDASATAIYGSRASNGVIIITTKKGKSGQAPKVSYNGSVSVSTIQKKYDVLNGDEYRAYAQQIFGDELPASLGTANTDWQDEIFRPAISTDHHVSINGGLKNLPYRISLGYSYNDGILKTSNFQRFTASVNLAPSFFDDHLKVNVTAKYMNGKNRYADAGAAIGGALSMDPTRPVYGGDSMYDVFGGYYQNAQSTSDFSDPDWRYTANKNTPQNPVAALEQKDDSANSNDFVGNVEVDYKFHFLPDLHLHASLGGEYADGTQTTIYSPYSFSYNYYGNTSAVTEYKYNLSYNVYAQYIKTLGAHTFDIMAGGEEQHFHRNGFTIGNGVDPYTGEIHDAVLKEQTAYATRNTLVSYFGRLNYTLLDRYLFTFTMRWDGSSRFADGNRWGTFPSLALAWKMKEENFLKDVNFLSDLKLRLGWGITGQQDVTSDFAYMPLYVVSDDYAQYPFGDTYYHTSRANAFNTNLKWEQTTTYNAGLDFGFFNGRISGNVDGYYRETNDLLNSVKIPVGTNFNAQMLQNIGSLKNYGVEFAFNVKPVVTKDFMWDVTYNFTWNHNEITKLTGGDDADYYVETGNSISRGNNTKVQVNKVGYAANSFYVYQQVYDENGNPIENMFVDRNGDGIINSSDKYIYKKPAADFMMGLTSKMTYKNWDFSFSLRSSLNNYVYYDFLANKANVSSSGLFSNTAYSNTTAEAIALGFTGKGEYYMSDYFVRNASFLRCDNITLGYSFKDLFKTSAYKGLGGRVYATAQNPFIITKYEGLDPEVKSGIDSNPYPRAFTFLLGVNLQF

SEQ ID NO: 6358 - protein, 390 aa, Enterobacter sakazakii
MMKKSTIGALLLGGFSTIAHAQSSVTLYGNVDTGIAYTSNVQGKSLWQETQGIGLGNRWGLLGQGDLGNGLKAIFRLENGYSSSSGALLNGGRLFGRQAYVGLSQQQFGAVTFGRQYDSVVDYVSLLASSKQYADQMGAHIGDNDNMFNSLRINNSVKYASSQIAGLSFGGLYAFSNQASGGNSTGFSNDSAFSVGAAYTNGPLKIAAAFLQLNHPSSGNANGSNTGGAISGDYNTLSTNIFYSQPVAKQTVGAAGANYKISGFTIGAVFSDVVFDYNDGTSLRLLNYEANVSYQITQAIATQLVYTFTDGTADGGASYGNFADGRHPRWQQVTAGASYSLSKATSLYVLAAYQLACGDAQRAAISPSGGETAWGHRSQIELTTGITVKF

SEQ ID NO: 6359 - protein, 368 aa, Enterobacter sakazakii
MMKRNILAVVIPALLVAGAANAAEIYNKNGNKLDFYGKVVGEHGFTTSGEHKNADSSYGQIGFKGETQVNDQVTGYGQWEYRARAGAAEGDQTNVTRLAFAGIKVSDAGSLDYGRNYGIVYDVESYTDMAPSFSGETWGGGYTDNYMTSRSTGLLTYRNSNFFGLVDGLNFGVQYQGKNDRNDNLNKANGDGVGLSLGYEFGEGFGLIGAYSTANRTLDQKADGKGDKAESWAVGAKYDANNIYLATVYAETRNMSILGNSGEKNTPNDDGDVYNVANKTQNFEVIAQYQFDFGLRPSVSYVQSKGKDLNGIGDRDLAKYITTGATYYFNKNFNVYGDYRFNLLDDKDADTSWVGSDNQATVGVTYQF

SEQ ID NO: 6360 - protein, 169 aa, Enterobacter sakazakii
MKKIACLSALACVLAVSAGSAMAQSTVSGGYAQSDYQGQANKANGFNLKYRYENGSDPLGWIGSFTYTEKDRTDAGEYKKGQYYGVTGGPAFRLNDWASIYGVVGIGYGKFQSTGADRAKSDFSDVGFSYGAGMQFNPIQNVALDVGYEQSRIRSVDVGTWTAGVGYSF

SEQ ID NO: 6361 - protein, 368 aa, Enterobacter sakazakii
MKRSLMTVAVLGTISAAAHAQSSVTLYGLIDVGIRYNTHQNAAGDSKIGMGNGGLLSGSRWGLMGNEDLGGGNKAFFQLESGFTPGTGSTQQSTPSGNARLFGRTAAVGLSSQTYGEIALGRQYTLVHEMAYTHDIYALSNYVGTVGFQGAGLTGGGRLDNTVRYTSPSFGGFTFKGAYTFGETAGDTKHNASPAVAASYDNGPLSVGAAFQIINNIGGLTPATTAYGSTYFGITIPDSTQKVFTVGATYKLGASKLYASYIYSNVYPAGYRNDSFSVAVSYPLTPALELKLPVYVDRLKHAGQSGTRITGGPLLDYSLSKRTDVYAGVDYTRLNGAWQTLAGTSGFTLPVSGRNSVFEATVGLRHKF

SEQ ID NO: 6362 - protein, 713 aa, Enterobacter sakazakii
MAKFTPSFSGIKGRALFSLLFAAPMIHATDTATTKDGETITVTADANTATEATDGYQPLSTSTATLTDMPMLDIPQVVNTVSDQVLENQNATTLDEALYNVSNVVQTNTLGGTQDAFVRRGFGANRDGSIMTNGLRTVLPRSFNAATERVEVLKGPASTLYGILDPGGLINVVTKRPEKTFHGSVSATSSSFGGGTGQLDITGPIEGTQLAYRLTGEVQDEDYWRNFGKERSTFIAPSLTWFGDNATVTMLYSHRDYKTPFDRGTIFDLTTKQPVNVDRKIRFDEPFNITDGQSDLAQLNAEYHLNSQWTARFDYSYSQDKYSDNQARVTAYDATTGTLTRRVDATQGSTQRMHSTRADLQGNVDIAGFYNEILGGVSYEYYDLLRTDMIRCKNAKDFNIYNPVYGNTSKCTTVSASDSDQTIKQESYSAYAQDALYLTDNWIAVAGIRYQYYTQYAGKGRPFNVNTDSRDEQWTPKLGLVYKLTPSVSLFANYSQTFMPQSSIASYIGDLPPESSNAYEVGAKFELFDGITADIALFDIHKRNVLYTESIGDETIAKTAGRVRSRGVEVDLAGALTENINIIASYGYTDAKVLEDPDYAGKPLPNVPRHTGSLFLTYDIHNMPGNNTLTFGGGGHGVSRRSATNGADYYLPGYFVADAFAAYKMKLQYPVTLQLNVKNLFDKTYYTSSIATNNLGNQIGDPREVQFTVKMEF

SEQ ID NO: 6363 - protein, 466 aa, Enterobacter sakazakii
MAFLAVLSAASTAFATNGMNLEGYGAKSHALGGTSTAYDTGNSGVTNNPATLGLREEGSSEIGIGIRGLHPDVNLGFNGVTTTESKGDSYYMPSLSYMRKDGKITWGFAVLAQGGMGTEYGENSSLFSYGMPMSKQGMVPLSGQDIRSEVGVGRLMFPVAYNLTENTVIGASLDFLWASMDLRMDMDGAHFGDMAMQGIGGKVSGSMFGTLGGMIGSSVRDIDYVRYDFSNDNAFLGEAIGYGTGFKVGITHRFGKFLTVGGSYHSQTRISDLETSKAVLSFAGKDAMNNSFTRSVNGTIKVRDFEWPATFAAGVALYPSERWMITADIKHIDWSSVMEKFSTSFTADNSLSNGPFAGQTLDVEMLQNWKDQTVISVGVQYRATDRLALRTGASFASNPVPDMYLNPMFPAITENHYTAGFGYRLSDRSSVSAALAWAPEVSETSDEGLEIGHSQLNWSLNYSHEL

SEQ ID NO: 6364 - protein, 672 aa, Enterobacter sakazakii
MSATVSYAQADDLEGMSLEELLSAEVTSVAKKPQKINETAAAIFVIDEEDIRTSGADSIPELLRLVPGVFVSEVNDSITGVSARGYTWRYSSKMLILVDGREVYLPVISGVLWDAQLLPVEDIDRIEVIRGPGATLYGANALNGVINIVSKHAAGTLNTYATARAGVTTESGSEFGRLYARRGLRLGENATARVWTTWRRVSSQVSDEGETFHAPSDRLQIGFRGDWEPNDADAFTVQGSYVHNKFDTTFFNRFEQPITQEFVTIPDNKHNEYNILSRWTRTFEQGNSMTLQSYFTSIEREDNGSLLMSDILDIDFSHALTLSDRAEAMWGVKYRHTRDGIEAKDPDTFVRLTLPNENRDLFAGFVQGDVFALDRRLRVSAGTKLENNEFTGTEVQPSLRAIYSLDKASFWGAVSRAVRTPSAIETNGNIGITVGAGLLEPPNPLPIELLISGTTNEGVAEKLIAYELGWRQQFGNQLTLDMTAYYNAYDDIGGMYETGGGFVLLPFGPGGSPVPVPISAEYGFTYDEDDEGKGIEVHALWEPHRDLRLNFIGNVYERNLEFREGVFETPTYSFDRGRDPALQLSVKADYHFSDRTDASIWSRYVGQLEDDVVPAYQDLDIRLSHRLTPSLNLTLLGENLLEPSRAEGTPILYPTAAGEVERRVSISVAVKN

SEQ ID NO: 6365 - protein, 758 aa, Enterobacter sakazakii
MARSPIPKRLALVVSMILSSSAALAEQTQEIEEVSVVAKKITYANHVIDPAMKAQQNSINSILSVIDNLPGISINEGDAFGGDDWSTSITMRGFAIDGYQQQLGMTVDSIPNGGSNYGGGAKANRYLESENMATVEVGQGTSDLASASLEALGGTFNFVSKDPSDQAATTLAYTHGDHNATRYFVRQETGEIMGNTRAYFSYSQTETNRWIGDGSNGGSDKQHAEAKFVSDFSTFTLTGRLSYDDVAEDNYNSVSIAQFKQTPDWDQLTWNWTGIPHFDQMFAEGWSTLRENTLGYLKFEFALANGSSLNITPYFHKNKGRGDWIPPYLVSAVDDNGNPTSKGGTFTKYGFTDPAGTPLVPNEGCSSEYSWPSSSGSLLHPDCYADDAVPVMSYRHTHYKKERVGLLADYQVTLDNHDIKVGFWYEDDERTESLDWHKVIDARVYYHFDHTPYWTQYSNVFNTETLKLYAQDSINFDAVTLNIGAQKYLVDLEKEDKFTNTLAGKVNSDSDLLWSLGGLYQLNQEIEIFAGFSENFAAIKNEVLEREASAFTNIEAETAQNIDLGLRFNNDIWQISATIYSIEFDNHITLIAPGSDIGGIDYTAGTKGRYINVGGIDSKGFELSARYQYNDNLSVYSSYTNNDSTYVGNAPGFESGDKVIDSVDNMFVVSSDYSKGDVRFGLSAKYTGERSEADAYTLVDLNIGYNKALNDGVFNEIDIAFVVNNILDKRYLSTGTGTGDTFFIGGPRTATLTFTAHF

SEQ ID NO: 6366 - protein, 157 aa, Enterobacter sakazakii
MPTCPIIRRSATGQLFRPVTGVQYEVGAKAELAGGRSLATAALYELTKQNALTTDPDNPLFSIQTGEVQSKGFEVDLSGRPLPGWDIYASYAYIDARYTRDNDIAVGTEVGGVPGTSLYRSVGGQTTSAGHCGWCMGRARCCDGAIVAVAPGAGWTR

SEQ ID NO: 6367 - protein, 930 aa, Enterobacter sakazakii
MDETKVREFIFNEQNNSIENIPMDNRVLNGDKVKVGVLDGDFINKKNYLENKYGNIEILERNYNPKHSNHGELVLKVLREKNKLGIIAGSIGENDDFSGKEGTTVIPKLETYEKVLEKFNPNQKVKVFSQSWGVPETIGSYISKSEEERMRAIAPGQTSSEGRKILDFYKKEVNKDTLFIWANGNTLVNNQNQVVLFNDAYYQGGLPHLYSELEKGWITVVGVKKKDGNMLNKHYTDTAHLAYPGNAKWWAISADAEVVDSKGVTHRGSSFAAPRVAKVAALVAEKYDWMTADQVRQTLFTTTDRTNIDENETYIRNIVTEPDEKYGWGMLNRERALKGPGAFINIRRQYQYSPSSNNIFKADITENKVSYFENDIFGDGGLEKLGKGTLHLTGNNSYERGSIVKEGTLEIHKIHANQINVENKGTLVLHSKAIIGYKVNSNSVIDEKEITASNITAKNLDNKGIVKVTGTTAVIGGDYIAHSGSTTEMDFSSKVRVLGKIDMQGGAITLSSNRYTTLRETATIMEASNVQGNIANVETNGMRTANVEVQDGKVVATLSRQNPVEYIGENTEASTKNVAENVENVFQDLDKKVMSGTATKEELAMGATVQNMTTMGFTSATEMMSGEIYASAQALTFSQAQNINRDLSNRLAGLDNFKNSNKDSEVWFSAIGSGGKLKRDGYASADTRVTGGQFGIDTKYKGTTTLGVAMNYSYAKANFNRYAGESKSDMVGVSFYAKQDLPYGFYTAGRLGLSNISSKVERELLTSTGETVTGKIKHHDKMLSAYVEIGKKFGWFTPFIGYSQDYLRRGSFNESEASWGVKADRKNYRATNFLVGARAEYVGDKYKLQAYVTQAINTDKRDLSYEGRFTGSAARQKFYGVKQSKNTTWIGFGAFREISPVFGVYGNVDFRVEDKKWADSVISTGLQYRF

SEQ ID NO: 6368 - protein, 368 aa, Enterobacter sakazakii
MKVKVLSLLVPALLVAGAANAAEVYNKDGNKLDLYGKVDGLHYFSDNKSEDGDQTYVRLGFKGVTQVTDQLTGYGQWEYQIQGNTSEDNKENSWTRVAFAGLKFQDVGSFDYGRNYGVVYDVTSWTDVLPEFGGDTYGSDNFMQQRGNGFATYRNTDFFGLVDGLNFAVQYQGKNGSVSGEGMTNNGRGALRQNGDGVGGSITYDYEGFGIGGAISSSKRTDDQNSPLYIGNGDRAETYTGGLKYDANNIYLAAQYTQTYNATRVGSLGWANKAQNFEAVAQYQFDFGLRPSVAYLQSKGKNLGTIAGRNYDDEDILKYVDVGATYYFNKNMSTYVDYKINLLDDNQFTRDAGINTDNIVALGLVYQF

SEQ ID NO: 6369 - protein, 1146 aa, Enterobacter sakazakii
MNNLLICKGKSRNSCSFLAFLLFTFLLVAPTAAQTLKENNITLRVQNEPVENVFNKISEQTNFKFIYDQETVNNAPHVSFDVKNATLKQILGVITTQSKLYFNRTDNTIAVSKQPLKEESAQRTRTVQGVVVDDKGEPVIGASVQIKGEGSGTITDMDGRYSLMNVPESATLTISYIGYKTVSLSAKDKNTAKITLTEDSKMIDEVVVVGYGVQRKRDVSTSISSVKAEQIAEVSASDFRQALAGKMPGVQVTQPSGDPEGSVSIRVRGISTVNAGSDPLYIIDGVPVERGFANLNNNDVESVEVLKDASSAAIYGSRGSNGVIIITTKQGQSEKMKVQYDGYYGIQSISKKLPMLNAYQFAEFAKDGHDNSYLDANPGGSPNDPNGMRPNSWERIPTELFPYLNGDQGLTDTDWQDAIFRSAATTSHNVSISGRGKTVGYFISANYYDKEGIIINSDFKKYSMRMNLDGKYKRLKFGLNFSPSYSTSNRVDASGSNGIVQSALMMPPVWPVYNSDGSYNYQGNGYWRIGNDYQHNAVLNPVAMANLQSDVVDRMAIVGKVFAELELFKGLTYNISFGGDYYGSHNDQYRSSELPLLGQKYYDIKSNPTAYSSSGFYFNWLIENKINYNTVINEDHSINAVLVQSAQKETYKGDNVTATDFPNDYIQTISGGTVIKGASDKTQWSIASYLARVQYSYKGKYMASGAIRADGSSRFGKNNRWGYFPSASLAWRVSGEDFFTKAKFLSFVDDLKIRTSYGVTGNFQIGNYDHLSLMALDNYILGTGNGQLVQGYKPNTIKNDDLSWEKNAMVNVGVDLQMFKGLLGITVDYYNTNTSNMLLNVPVPHLTGYSTALMNIGKVNNRGWEIALTSQKNFTKDFGYSFNANYATNTNEVKALGPGNAPIISTGSVDHAYYITKVGEPIGCYYLLVQDGIFSNEEELKKYPHFSNTQPGDFRFVDVDGDGVMDLDKDRTIVGNYMPDFTYGFGGKVWYKGIDLDFNFQGVYGNEILNLNRRYIDNLEGNTNGTTIALNRWKSADNPGNGQVNRANRKSKGYNGRTSTWHLEDGSYLRLQNVTLGYTLPQNLTRRFFVEKLRVYVSGQNLWTSTNYGGYNPEVNARPSNSLSPGEDYGTYPLAKTFLFGLNITL

SEQ ID NO: 6370 - protein, 465 aa, Enterobacter sakazakii
MDTSKADVSLENSVWTIIADITTTNQNTLLNLANLAMSDANVIMMDEPVTRSSVTASAENFITLTTNTLSGNGNFYMRTDMANHQSDQLNVTGQATGDFKIFVTDTGASPAAGDSLTLVTTGGGDAAFTLGNAGGVVDIGTYEYTLLDNGNHSWSLAENRAQITPSTTDVLNMAAAQPLVFDAELDTVRERLGSVKGVSYDTAMWSSAINTRNNVTTDAGAGFEQTLTGLTLGIDSRFSREESSTIRGLIFGYSHSDIGFDRGGKGNIDSYTLGAYAGWEHQNGAYVDGVVKVDRFANTIHGKMSNGATAFGDYNSNGAGAHVESGFRWVDGLWSVRPYLAFTGFTTDGQDYTLSNGMRADVGNTRILRAEAGTAVSYHMDLQNGTTLEPWLKAAVRQEYADSNQVKVNDDGKFNNDVAGTSGVYQAGIRSSFTPTLSGHLSVSYGNGAGVESPWNTQAGVVWTF

SEQ ID NO: 6371 - protein, 802 aa, Enterobacter sakazakii
MGSAFALQGGAFAQEEEPEVFTDTIVVEGSLRALPVEDVGSVFGFDKDLVETPRSASTISAEQIERFGITDIYGLVAQAPGTFTNSFFGIGGALDIRGTPGEVYFRGVRRLDNPGNYPTPIGASDRIDIVRGPASVIYGPSKTGGYMNFVPKTARVAGGELMTVPEGEITYTGGSWNKSVLSAALTGPGNILGEEFGYHLYAEVEDSGSYYRNMFTEQTILQGAFDKYMSDNLRVEFGFMYHDFYGQQNGGWNRLTQELVDNGTYVTGTAQAVDQNGDGELGRREFDAAGVFNPFGNFVCDPSDVASFGVGPEGMTDACLMNSLPGLALTDVGETTLDRRNVLTGEDDFLENKTLTFYFDSIYENDDGFELISQLFFEGYENENENDYGFSQFHDSWVMEGKLIVKKAFENDLGVFTTQISPSIRYTDFLHGDDFDYEFFHRADLSSPNPYTAQSDRLLSTEGDENYSTYVEGDYINYGLAGLFDLDFEMGLNVILGVRYDYIDAESFNHTARLDPAIIGSDYLPSASDEDDGVSWTASLSYDLPGGVVPYVTASEQSTVVAGQGAEITVDNLAAGTWFSASELLEFGIKGSFFDDRLYTALSVYEQERVDFNAQSITVNQSVKTEGLEAEFRWAATDNLLITGAYTKTEVVNLTGLEEGTLFSFFGAEDLVNVSDPSLFYGAQPIGLLTIPDEDAARRAGIPENIYSLTATYAFDNGLSLSGSVVDVEEVFSGQSQAVELPAYTLVDASASYEYENWLFQATVKNLTDEEYFRANFTELFGSTIVLPEMPRSFQASVVYKF

SEQ ID NO: 6372 - protein, 195 aa, Enterobacter sakazakii
MKISNALLKVAVLGSLACSCALAQGAFVGGSVGYNFKSGNELKDDGIKFKDSSIPLGIQGGYDFGDYRVYGEYVYGAKAKAHKTVGDVKADLKWKTHKFLVGADYTPQIAQNLRFLVGAYTGLTYLDYKLGTVGPGERVHISDNSTDWTIGGRVGGLYSFDEHNEVELGLRYDRTKFDEGKFNSYGLYAAYNYKF

SEQ ID NO: 6373 - protein, 308 aa, Enterobacter sakazakii [sequence omitted]

SEQ ID NO: 6374 - protein, 981 aa, Enterobacter sakazakii
MHSWKKKLVVSQLALACTLAITSQANATTYNTFGYHDDATTQYAGINTDTDYVTYGGYVYYNPATTDFDQSFNNDTVNGVISTYYLNNDYTADSTNTLNITNSTIHGMITSQHMWDDTAYVDHDWDDGDTFTLNIANSTIDDDYEYFYFTDDYNNADGKVTTEDWRTSELASLGTAVTLDVESNINITNNSRVAGITLSQGDTYDATYATGGDSAYVHTWDNTIVVDNSTVTSGAVTPLEGSGWFGNSSEPSDYSGNAVYDTTTGTWYHNPNDTALSFSDDPDSYYSMKNNVTFTNGSTLMGDVVFTSNFNNADDANADSNGDGVISASDGFSPIGYDTNNDGVEDTNGGWSHDNDNVDELNLKLDNGSKWVGDAYFSYEYIAPADMYDLEDGTNSLEPSSTVDKWGNVVDDKTFQSGIFTVALDNGSEWDTVNASNVDTLTVNNGSQVNVADSSSLIADTITLTNGSTMNLSSYGEVDTDHLTVDSYSKVDLTNETAYLYANTITVSNGGEFSIGAGEFDADSFGTDTLELTNAGVFNINNSDYVLDADLVNGHTNTTDTSNATYGYGVIAMTSDGHLTVNGNGDYYNGDNTADTTYSANGEADNSYTDNVVAATGNYKVRIDNATGAGSVADYKGNELIRVNDVNTDATFSAANKADLGAYTYQAKQEGNTVVLEQMELTDYANMALSIPSANTNIWNLEQDTVGTRLTNARHGLADNGGAWVSYFGGNFNGDNGTINYDQDVNGIMVGVDTKVDGNNAKWIVGAAAGFAKGDLSDRTGQVDQDSQSAYIYSSARFANNIFVDGNLSYSHFNNDLSANMSDGTYVDGNTSSDAWGFGLKLGYDLKLGDAGYVTPYGSVSGLFQSGDDYQLSNDMKVDGQSYDSMRYELGVDAGYTFTYSEDQALTPYFKLAYVYDDSNNDADVNGDSIDNGVEGSAVRVGLGTQFSFTKNFSAYTDANYLGGGDVDQDWSANVGVKYTW

SEQ ID NO: 6375 - protein, 380 aa, Enterobacter sakazakii
MKKIVLAAAVAAAIPAFAQADVNLYGSLRAGVSVTKNSTNNYSSTFGVDDFGSRIGFRGNEDLGNGLKTIWQVETGFAMDGVSGGGTASGTFANRESYVGIDSSYGKLRVGYLTDVLGDSEATDNLYGPRRDGMGTNFPLYEATDLFSYGDSRYKNSVRYDSPTWNGFNLTLQYGAGENAAVGQMKQGEQYGARLAYQNSGFFGAWAYAGVLNTKGGSNSSTNRLEGGYSANNLYLAATYQWLTTYGNASAQAKNADGTLKVDDNKQPVYVIPGIKQLSPTIGSGTNKVENTGWAINAAYTIGNFKPSIVYSKRGDAKIDGVRYSLGASQWAAALDYTLSKRTMVQVGYGELKENKDAQTINQHAKDTSSLAWAMMKHNF

SEQ ID NO: 6376 - protein, 274 aa, Enterobacter sakazakii
MKKLIVAGVVAGVSTLASAQQAGDNVATLGWLHIMPQDSTNGLTTNLASMSINGPLRLPGSFTSPGTSLTVNNADTVGLTLTHFFTDHIAVTSVLGVPPEFTLTGHGVIRPPGPAGALGNVDMDKSANQPAVKNARQWSPTIILQYYFNSSTAKFRPFVGIGVAYSWFSNIELNGNFAKDINENLGSVLAAGAGKPGATSVEGKASSSFTPVYNIGASYAIDKHWGLTATLTYMPLKTYSSLVIKAADGSTLATTRTRLKADPLITFVGISYKF

SEQ ID NO: 6377 - protein, 365 aa, Enterobacter sakazakii
MFEINPVNNRIQDLTERSDVLRGYLDYDAKKERLEEVNAELEQPDVWNEPERAQALGKERSSLEAVVDTLDQMKQGLEDVSGLLELAVEADDEETFNEAVAELDALEEKLAQLEFRRMFSGEYDSADCYLDIQAGSGGTEAQDWASMLERMYLRWAESRGFKTEIIEESEGEVAGIKSVTIKISGDYAYGWLRTETGVHRLVRKSPFDSGGRRHTSFSSAFVYPEVDDDIDIEINPADLRIDVYRTSGAGGQHVNRTESAVRITHIPTGIVTQCQNDRSQHKNKDQAMKQMKAKLYELEMQKKNAEKQAMEDNKSDIGWGSQIRSYVLDDSRIKDLRTGVETRNTQAVLDGSLDQFIEASLKAGL

SEQ ID NO: 6378 - protein, 261 aa, Enterobacter sakazakii
MKRIASTLLLGSSLLATLPSHAGEWLLWHGESLTYLYGKDFKVNPDIQQTITFEHANKWKYGDTFLFVDKIFYNGKPDASKGVTTYYGEFSPRLSFGKIFDQKLAFGPIKDVLLAMTYERGEGDNEAYLIGPGFDLNIPGFNYFTLNFYLRNTEGGRPGDDVWQITPGWSYTIPVGRSDILIDGYMDWVPDNDQNSRGTYHANLHFNPQVKYDLGKALNLGAKQLYVGFEYSYWKDKYGIDSRGNLESNQSVASALIKVHF

SEQ ID NO: 6379 - protein, 902 aa, Enterobacter sakazakii
MMITGNTMNQIFHLMTQTKHTNHTKKVLKLSMLSLCLLHITQTAMAEDTLKDVPKATDFSVILDEVVVTATNGTKKSQKPFTKASATSVRENVFNASENIDAIVRSVPGAFTQQDKSSGLVSLNVRGDSGFGRANSMVDGVTQTFYSTSTDAGRGGGTSQFGAVIDQNFIAGVELNKGSFNGKGGLNTLTGSANFRTLNADDVIKDDKNFGFIAKGLTGKNATDKNFMLAAGGRGWLDNGSISALYAYSHKDISQNYKVGGGGTHIGNVGDDLLLSKQKQVFAKEHALTYNEASRSWQKDLTKLDKETGKPLWDRKYQFGGKCYGLGCIDTKEKFDEYVADKQQQWQKHGAKEYSITPIDITALNQTSKSHLAKIRYNNDTSDVGLQLRKMDTTIGSRRISNDNYQLDAAYNPNEIIDLKVLAAHNVGVQKYPKGSTFTGWKLDKDFETKNTANLFDLNNTHTFNLPKQMDLTTTVGLNILHNEYSKNRFPDELGLFYTNDLLCGGGYDACGGRFQGTSSTLPKKSVIVQPSGKQRFHSIYLDTSLQKDKYQLDYSVNASQYRFSGEHASYYSSQKEFQDKFGEDSQIYKQHCSPSCDVYEPLVTTSGKKHAINHSVTLSAKYDTGFMPFVSFARTHRMPNIQEMFFSQIGDVGVNTALKPEQANTYQLGFNVFKRNLLTDNDTLGLKVVGYQSRINNYIHNVYGKWYDTKNPPSWVTSGALKGDTIQHRNWQMPVHKQGLELEINYDAGRYFTNLSYARQKTDQPTNYSDASESPRNSSKEDQLTQGYGLSKVSMLPKDYGRFELGVRGFDDKLTIGSAVRYYGQSPRATIEPRYIDGTHGGNTSHSDDKGAHVIKQIEMLKRQPLVHDFYVAYEPIKDLVMRLDVQNAFDKLYIDPLDAN

SEQ ID NO: 6380 - protein, 448 aa, Enterobacter sakazakii
MTVTYKRKYSLAMLSPLLLAFGFNAAADKAAWSPIVLGYEPPSPGLFGDWGGMRTTLANSGFNYALIYQTESAYNVSGGYDQNGHYAFVDQTALIFNQDLEQFTGMSDAKIEGLITNRNHDDNLTTERLQDQRVHFNDLAQEGWGTGSITRLGYLTFSRTFMDKKLTWRAGLMNYQQTFDQITPCDFQLLTLCGGKSSNSLTWNTWNIHTWGTTFAYAITPELTLKTGVIEQNPRAADTSRAWSFTTHGSKGVLLPFEAELKTYINDLPGAYNFGVLFTNAKQYSLYTPVGKDTESYNRTWFAWGGFNQQITSHDEDKTRGMSVFGNMSIADQRSDVNHIVASLGIRYRGIFDALPNDYIGFGGSWIDMSNRLAKTERQINQINGIHDYDNPLYQPVQGHSVNFDLYYRFRPVSWLDIQPDIQYWINPGAVNETKDAVVIGIKTAVRF

SEQ ID NO: 6381 - protein, 1051 aa, Enterobacter sakazakii
MLRYSALLLGVLLGALCFSPTSSAQDPATVRGVVTDSTGAPLPGANVRVQGTQTGVSADADGAYELAAVRPGRRTIVFSFVGFEKVSRTLELSAGDTRTLDITLGTGTVGLENVVVTALGVDREERSLGYSVERVSGSDVAEAPEPNVMNNLSGKVAGLNVTGGSGGLASTPRVTIRGESSLAGSNRPLIVVDGIPIDNTPNTQGSDAQTTQVDFGNGLSQINAQNISEMSVLKGPSAAALYGSRAADGVILIETKDGSETDGIGATVRTSVTASRPLRLPDYQNEYSYGNGGEFAYVDGTNAPGWNWGVRMDEGVERPQWQGPRNEAGNLVPTEVTSAPNKVRNFFNTGTNVSTDVAVRGGGENSSFRASLSRSDRTGIVPNTNLDRTSTSLSASYDVTDALTVDANANYANTTSDNLPSSGYGSESIMYYFTWGARHVENDLLKDYWQEEGTQQAHYDRNWTNNPYFQVNENTNGLERDRLYGGVSARYEFTDNLNLRARTGLDYSNQGTKQRKAFSSITAPNGWLQEADRTFTEWNSNLLLNYTREVGDFTFEPSVGANFMRQTRRNVQLTAQALSVPDVYNIGNARSNVQADERDEAQEILGVFASGTVSYQDMLFLDLTGRNDWSSTLPLDNNSYFYPSASLSVIVSDLVEVPEFLPLSFAKVRASWAQVGNDTDPFRLTNTYTFGDAWGSTQTVVSEADLANANLQPEITSSYEVGTNLRFYDGRAQLDVTYYRSTTRDQILSVPLAQSTGYNSRLVNAGEIRNTGVETRLQLSPIQDWSGFGWDVSLNWTRNRSTVVELADGIDTFVLGEGPFGGSAQAREGGRMGDIYGRVFDRVEDPSSPHTGEIIYEDGLPQLTDDVEKVGNYNHDWRGGIGSTFSYENLQLNVLFDVRKGGLLYSNTHATGIEGGSLEGTTRARNETVVGDGVVQNDDGTYSENTEEAAYVTWLRTYYDRPNVESNSFDATYVKLRELSLRYNFTPDWLTRAGVQNVGVSVTGRNLFLWTDVPHVDPETTISGGDGQIPGFEVQQIPSTRSFGMNVQLDF

SEQ ID NO: 6382 - protein, 835 aa, Enterobacter sakazakii
MSFSATQKSTNAQVKSPLKKIVSATVLSTLGTMLCFVPNTFAQQLSGVVLNKQGQPINNATVGLNGDSQQVRTNSLGLFNFTDVKKGIFELHISAKNYGHSNQHITMKEEDITDLSVVLPRSVMEVIDVHATPLHTSSIESALPINVLSEDELKMKQAATLGETLKNEVGVHSSYYGPVASTPIIRGLDGPRVLITQNGLDVGDASRVGPDHVVATETSTATQIEVLRGPATLFYGSGAIGGVVNVVDGRVPTSSDDQVDYLLQYNDVSNEQQASVNIQTGTDNIAFHLDAFWRDSKDYKLAGEADIHNEDHDEGHEDEHEEEHEEHGETRLANSSSTSSGATLGSSYLFEDGFIGFSYGFMDREYGIPGHSHGEEHDDEHEEEHSDHDEEVGVYAKMKQDRWQVLGEYNFEQQFISKIATKFAYSDYQHQEIESGEVGTTFTNKSTEARIDLFHENTAGWQGAWTIHYKSSDFKALGEEAFSPPSKSEMFAVAWLEEKHFGSVLLQLGARVEQVNIDADDSLIGFEDSHQDQHTEPSHDEHHQTLVSFDQQSFTPISASVGLVWNYQPGYNLGFSTALSQRAASAGELFSFGPHIGTNTFEVGAMFDVHQEGDEVHVELAEQAPSVETSLNFDLTFRKFNGDFGYVISAFYNRVDDYYYQRDTGLFFVEEHGHADEHEDEAGLPILVYQQDDVEMYGAEAEFVYQVSSSFKTSLIADYIRARLVNEDGNDNLPRIPPMRVGAIFNYQADKFDSELSVSHYFEQDDVAELETNTDSYTMVDANFNYYINGVGDDLTVYVKAQNLTDEHARVHSSFLKEVAPLPGRNFSVGIRGSF

SEQ ID NO: 6383 - protein, 806 aa, Enterobacter sakazakii
MRCDFPKFNVIFAPVFLKGCLTVRLRLYPLYRIRVMLKPGIYNRYDIPLFCSFNSIKVMKRIFLLPLTAAAVWCAMPVHADEPVETDSMTPDSMKLYELQQIEVTATRVDRKTPVAYADIGREAISRRNFGSDMPTLLQMTPSVVATSDAGNGIGGTAFRLRGSDASRINVTTNGVPMNDAESHSVYWYDTPDMASSVGTIQVQRGAGTSTNGTGAFGGSVNMTTAPMSSEFSGEASLSYGSYNTNKQSLQIGSGLMGGHWTVDARLSHISSDGYVDRAFTNLESYMLQVGYYDGGTAVKLISFGGVARVGLAYDGVTKEQLETDRRYNSQGLVKHADGSISFYDNQTDNYTQINNQLIVNHRFNARWTLNVTGHYTYGSGYYNQYKNGQTLSEYGIAPIPTDDPNEPITESNLIRRKSMDNHFGGVVASANYTRGRVQLALGGAGNVYDGGHWGNVMSVVDAPGFPRHEYYRNASTKYDANVFAKINWEAARGLNLYADLQYRFIRHNITGTNDNFNSTTSALQELDIHRTYHFFNPKAGVNYTFARNHKVYVSFAVAQKEPTRSNFTDTKNGEYPTSERLYDWEFGYLFHNDRFEAGVNFYYMSYKDQLVATGELSDTGQELSRNIPDSYRRGIELSASLNIARWFSLGANATLSQNRIENYTEYVSEYDADWNYLGEKELYLGTSTLSYSPSVIAGVLLDFHVKGFSALLHTQYVGKQYFTNGRNDALSLDDYCVTNLNLGYELAASKIGSVRFGVQINNLFNTEYCNNGYGYSSIVGGVREDSAFYFPQAMFNVLANVTVRF

SEQ ID NO: 6384 - protein, 193 aa, Enterobacter sakazakii
MFKKALVIALMGVSSFTFAGNWQVKFGGSVIAPSEDTTTALGVVKADHEYAFTPSVEYFFGQSPFSAELLLATPVNHDVLLDGQKVARIKQLPPTITAKYHFKNSTRFTPYIGIGATAFIPWDEQGVADKVKEDFGVAGQIGFNFQPADAKNWGVFVDVRYADISPEVTLTNGAKFDLDINPFVYTLGYSYKF

SEQ ID NO: 6385 - protein, 296 aa, Enterobacter sakazakii
MARGLQQLSTIDLLFVRQVGERANSLNSLLWGDTRMKKVLAAAAGTLALALAAPASAADLAARPYTKAPAPMVAAIYDWSGFYIGINGGGGSAHSCWDFVTPVTGTLVGEGCHNATGGTIGGQVGYRWQSASWVFGLEGQGNWADFSGDNISLLFPGSALVTGDRNRSRIDSFGLITGQVGYAWNSVLLYVKGGAAVVGDKFDIYAAPGTPGAGTLLASGRDTRWGATVGAGLEFGFAPNWSVGVEYDHIFLGHQTRDLTVPGTGLLFQTNRISQDVDMGLVRLNYRFGGPLVARY

SEQ ID NO: 6386 - protein, 277 aa, Enterobacter sakazakii
MISARTGLTPRMDNGAILFSLLETRTFQFTFLNTNITSNASVTSGSTSSMGTSGGSTNSSVSGDSSSSQQTTVDQSRNVYDDMKKTLETMVTPQKGRFWLSASTGTLTVTDTPSVLNSIAAYVEQQNRQMNRQVRLNVQVLSVSTSRKEQLGLDWNIVYKSLRSAGASLNNVSGDITNATSASVSILDSATGSAAKFAGSSLLIKALSEQGDVSVVTSQGSVTTNLTPVPIQMADQTVYVAQSSTTTTTDVGAHIPDAGYDDYRLQHDVTATDSGWW

SEQ ID NO: 6387 - protein, 139 aa, Enterobacter sakazakii
MLAFTQIHTDNVYAGIKLTYDYKDVLSLSAHYIYRNWNSDNNEYLLAVKPENEASISLNVHPTSALQLNAGFDYISHKEEATSFNMSDISDLHIGASYNVFKGVSVYAQVHNLLNKKYQYYLGYPAEGFNFLGGLSFRF

SEQ ID NO: 6388 - protein, 416 aa, Vibrio harveyi
MTQNTRLFKKTLLAVTVAFASGQSMAAGFQINAQSATGIGRAFAGDAVIADNASVMARNPAAMALFDKMELSLGFESITSMIEVKDAKYRNFMGQSVDVADTDDVGDTSIAPNIHLIVPVNDKFAWGVNAYSNFGTKTEFSDNYTATEYGGLTDVKSANFGLAGSYRLNEQWSFGAGVDLIYGQGTMKRTTSSSIPLVGGKKILDVDKADGWAVGFNVGTVYELDENNRFGLAYRYSPEFTAKDDKGQEITLPLPDMAEFSGFHKIQDTKFAVHYSIQYIGWKDFDQIDFENLNQGLLKGGYSKDYQWQDGWHYAIGGTYYLNNNWTLRAGYMYDTSAQDKVTSISVPDSDRQWFSTGFSYHIDNSSNIDFGFTYLLGDDVKVNENTQLAPGLSTGVTATTHADAILFGLQYSRSF

SEQ ID NO: 6389 - protein, 430 aa, Vibrio harveyi
MKTNKTLLSAAVAFGLLSTSSVANAAGFQLAEYSATGLGRAYAGEAAMADNASAQWRNPAMLTYLEGTQVSVGAIYVNPNVDVDGQMHVGGGTTLPASSHDFAHDAVIPNFYLSHQYNDKFAIGLAFGTNYGMETDLGKDFAAANFGNEASVMSMEANLNAAYKLNEALSIGGGIRYIIADGSIGAVMPPQMGLVKPTLPGQTLKYMEGDDTAWGWQVGAAWQINDNNRLGFAYKSAVDLTLEGHANGLAFNPMNPNAKKAGSMDLTLPATAELASFHQLNDQLAVHASINWTDWSSFKELVADFPDKSDLIKSENWEDNYRFAVGTTYKLDQKWTLRSGVAYDMSAVDDKYRTTTIPETDRLWLSVGAGYEWSKNLTLDAGFTYIFAKDASISEPRDASDKEAALLGGAFTGEVTGNVWLIGVQANYTF

SEQ ID NO: 6390 - protein, 890 aa, Vibrio harveyi
MNKRPLWRVSGVALAVTLAQTAIAQDAGLEEVIITGTRLSDRSAQDSPVPVDVISGSEMRTNGSTDLQDMLRTQVPSFDINAQPISDAATITRPPNLRGLSPDNVLVLVNGKRRHRGSIISFLGGGISDGAQGVDIASIPSLALKQVEVLRDGASSQYGSDAIAGVLNFILRDDAEGFEVVARYGSTFEGDGDNYMVAANLGLPLGDRGFVNITGEMRDVEGTVRSVVRNDVAFAAANGYSPVSDFQAINTYTGEAPQYWGQPDVDDDAKLFLNAAFEINDNLEVYAFGNYAERAVTGGFFYRNVVGGPSGQRGGVYKGPTVDPTTGLASDSGVPSVLVGDLDGGSSCIDGIPLGGSGGVIPDPGLLASVSADDNCFSFIETIPAGFVPRFGGTNEDTAFAIGARGSFDVGTGLNYDLSAQRGSNKTEFYIRNTINGSLGPNTPRDFVPGGQEQTETVYNLDLSYGFEVGLASELNVAVGAEYREEEFDLFAGDPASYALGPLASQGFSSSSNGFGGFPNDTSAEQDNTAFYVDVETDVTDRLTLQAAVRYEEFSNFDNTTNYKLAGLFHVTDSLRLRAAFSTGFHAPTAGQANITNVTTQNVNGTLVDQGTLPLFSAAGQLGADYIAATNGGAGRPELGPEEAENFSFGVGFDIGASTWTIDYYDIDVEDRIALGANVDFLAALNYTGGGTSYGTVGEALTGLDAAGVINRQDFIGLDDLAEFRFFSNSFDTRTKGVDLVGNMNFDLMSGFSTITVAFNYNDTEVTDRGSINPISEGRVEALEELLPNVKGNVAWSHTQGKWRTLLRANYYGGWKSTSNGYNVDAATLVDAQVSYQLTDSLELTAGVDNLFDEYPDKTPNPGGLGQLYPEDSPFGFNGGTWYLQGRYAF

SEQ ID NO: 6391 - protein, 182 aa, Vibrio harveyi
MDKFDANRRKLLALGGVALGAAILPTPAFATLSTPRPRILTLNNLHTGESIKAEFFDGRGYIQEELAKLNHFFRDYRANKIKSIDPGLFDQLYRLQGLLGTRKPVQLISGYRSIDTNNELRARSRGVAKKSYHTKGQAMDFHIEGIALSNIRKAALSMRAGGVGYYPRSNFVHIDTGPARHW

SEQ ID NO: 6392 - protein, 321 aa, Vibrio harveyi
MKKLAAIISATLLFASSAAVAEVYVGGKVGKSWLDDACLTGQSCEDDDQVVGAFLGYQANKWLSLEAGYDYLGKFTAAGLNDEKVQAVTLAPKLSIPLTEGIALYGKVGGAYVDYGSKDDYSYLGAAGLEFNTNHNVTMRLEYQNLTDINNDIVRARAETATLGIAYKFGGSEEPAPVVEQRPAEPAPVAAPVEKVAVTKTFTFQHLDSSTFATASAELKPATVQKLDKIVGYLNQYPQAKVEVVGHTDSTGSEAYNQKLSERRAQAVAKALEAQGIDASRISAKGLGESSPIASNATAEGREKNRRVELVIPEFQYQVTE

SEQ ID NO: 6393 - protein, 373 aa, Vibrio harveyi
MSYLKKSLLATAITGMMFSGVAFADGANSDAAKEFLTKDSFSYEVYGIIAMQAAYRDYDSGSKATDDDLGGMQLNNESRIGFRGKKQFANFDPTFIWQIEGGYVDPSFGGEGAGLGERDTFVGFESASWGQIRLGRVLTPMYELVDWPASNPGLGDVYDWGGAIGGAKYQDRQSNTIRWDSPMFADKFSLDIAAGAGDKAGLGEGDDYWGGIAAHYKIGPIQLDAAYEGNRNIKMESQTWENNTYLVGAQGWFDNGISFFAQYKYMEADASNGVSEKQDAMSAAIMYTTGDWQYKLAYAANFDLERDGKKINDTADDVLSAQVMYFVDPSAVLYVRARTLDFGDGASQLDKPTEARWKSADYDEFSVGVEYYF

SEQ ID NO: 6394 - protein, 677 aa, Vibrio harveyi
MKLKLSIIASSVVLALSSNAFAENDVSSLNEVVVTGSRAEKTDQDKTRSVAKVDLEKLDEIQPNSVAEAIKYEPNVSVVGANVPGNQSINIRGLSGNKVLQVIDGNRQNMQYGHRPTYFLDPSLLGSVEVVKGPISSLYGSGAIGGVVVQNTLSADDIVEENGLGGRVKVGYQDNGDVWTNTAALANKNDNIDWILAGSYKDSGYMKQGDGSTLYGTEATNKTGLAKFNWQINEAHKLGFNLRYADLDGRPPVVGDSSGQLNDPDGLISRRTKDQSYGVNYAFNPNNPWVNLEASLYRNDTKITENDPSIAGEDISQVNTTGFNLTNQSESGKLKLFTGVDGYLDELDATRAASVSGRPELPKDAQTSVIGAFGYINYQIVESLVADLGVRYDSFTSKAQGYDDNNQSAWSPSVGLLWQAKQWMAWSIRYDEAFRAPDTSELYMSGTHFAFGPGGPSNIFVPNPELNPEKSHNIELKGQFNFENVFADDSLDITAAAFQNKVKDFINLDVDMTPSSSCGIGGSLEGCAGTSRSSNIDNAELTGYEVAADYRWQQLLVGLSYGQTRGKDTDTDEWITNIPADKWVAHLQYGFWNIDTKIGTRATFVSAQDRVPTGYTEGPFDSYQLVDFYASWEPTSNLEGLKVDLSLINAFDENYRTAWTQVYQPGRSVRLNAQYTF

SEQ ID NO: 6395 - protein, 337 aa, Vibrio harveyi
MKKTLIALSVSAAAMATGVNAAELYNQDGTSLEMGGRAEARLSMKDGDAQDNSRIRLNFLGTQAINDNLYGVGFWEGEFTTNEQGGVDGDVNKDSSNLDTRYAYAGLGGAWGEFTYGKNEGALGVITDFTDIMAYHGNSAADKLAVADRSDNMMSYKGQFENLSVKASYRFADRKLNDAGTEYTDNGQDGYSLSAIYAVADTGLELGAGYADQDEANEYMLAASYTMGDLYFAGIFTDGEKAKTEGDYTGYELAGAYTLGQTVFTTTYNNAETNNETSANNFAVDASYYFKPNFRGYVSYNFNLIDSGDKLGKVGGNTTASKADAEDELALGLRYDF

SEQ ID NO: 6396 - protein, 1261 aa, Vibrio harveyi
MFMPFREFISSHVGRHPLFNRAPVAVINPITLAIIVAFSTLALPQTARASCNNSGGSTYICEGENNAGIILSGTDITVETQLGFGIIEPGDIDPALSLIGSGAISYLDTNSSALDTAGAYSLSIQNDTSMIGQSTSTNVQANGSIGSGIYISSQSRDNSTIQVDLSGMLSSGLNGTPALSIDSLADNDSTIILNIHAISGIAGIQSDNNSRYGTAITNVDIANDINVEYSGASIQNYSNSGTSILNLNSKSISTDFDALDINNSNYSGEVMTDINIDGDISSANSQAARIYNHTNSGLSSLRFRANNVTGEYAGLYIDNSSQNGAVTDIILTGDLTATSGSALYTNTYSEEGNVETAIKLNNVYSLYDALNIYGYNQTGNTLFDLDVSGTVTSENGTGIKVMGTTFEGNSTILINVNNITSSSQSLDINNYNSSGSALSAITATGHLAAEWGQGVTFQTYSSLGDATTLIHVNDITSMGNGIYSLTEASRGTVTTDVTVTGQINVSDGEGITLNTQTIDGNTLVNIDVNNIASEYDAIHLYNNNNTTGVDNGTGVDNGTSTIDLITRGALVSQQGYGINLETNTADTYVTVGGLVHGGNGSAIGIHRLDNIQTSATLELQSGYALEGATQSLVFTGNYVDINDAALDLANSHLVLGGTGDAVFDLTRIDNREEAILDGDPNRITGFGTLTKTNSSIWTLTGSNMADGDANAFLSANIAGGILVLDNATLGLTPDAGALTGATVNRLSAADIAADPTRVATETGALTLAEGGALSSLGDSVLSGNLISAGGILLSNTYTGGNGAATDDRLTVTGTYFGENNGSGEGAWLALDTVLGDDDSATDRLVINGDATGTTSVRVNNAGGLGDKTLNGINLITVDGLAQDDTFLLAGDYVTTDGYQAVVGGAYAYTLQADGEAATAGRNWYLSSELMLTEGVRYQVGVPLYEQYPQVLAALNTLPTLQQRVGNRYGAPGALADLNFDDNQWAWGRIEGSHQVTDPARSTSGSQREIDVWKLQTGIDVPLYQSQGGSLLTGGVNFTYGKAKADIHSFFGDGRINSTGYGLGTSLTWYGNNGVYVDGQLQTMWFDSDLSSRTAGHAVASGNNGRGYTSAIEAGKGYALGNGLSLTPQMQVTYSRVDFDTFRDPFDSEVSLQEGDSLRGRIGVSLDKETTWSAKDGTTRRSHIYSHLDLHNEFLNGSKVQVSGVEFATRDERQSVGLGAGGTYEWQNGRYAVYGNVNLLGATRNISDNYAVGGTIGARVSW

SEQ ID NO: 6397 - protein, 730 aa, Vibrio harveyi
MTHNYHQIAANSSTKELNGTLSPSRVALVIALQLGVSALPINLAHADEIESDESMTVFGEANKGYAAGKISTESSLGMLGDKDFLETPFNALGYTDKQIQDVQAQDISDVISATDPSVFTSGETGLNKESFKVRGFNLDVGDVMFNGLYGIAPYYRVSPEMFQRVDVLKGPSALLNGMAPNGSVGGSVNLVTKRAAETPTTAFTLNYLSDAQFGGHIDIGRRFGANDQFGVRFNGAFKDGDTAVNHQSSKTQLAALSLDWRNNIALVEADFYYSTERVDGANRGLSIAPGVKVPPPPSSDTLLAPDWAYNDSKDKGMMIRGELDVTDSVTLYTALGGSRTDFDSNVPQRIKIIDNSGTLEVSQGAVKLDSKRTSGDVGVRSEFDTGPVEHYLVLNGTYFREDKHDAPAGNNAPESWKPNIYDPVWGPAPSGYDNYYQLPVDSTLVSYGIADTLSFADGTYQLTLGVRHQSIDFESGIVMNGMSLPTTKLKESAVTPAVALLYKVSSSASLYGNYIEGLTNGKTAPRGSANIGEAFAPQKTKQIEAGLKLDLDDFAHTFSLFEIKKPNGYQDPVTDIYSFGGEQRNRGAEWGFYGTLLEDYTLTGGVAYTDAEITKATDVTTEGKQATKQPKFQAKLALEWNLPAMRDLTLIGQANYMSEQYIDAQNTQSLSAQTIFDLGARYNSTIADTNVVWRLNVNNVTDEDYWTSTHYATLALGAPRTVMLSATADF

SEQ ID NO: 6398 - protein, 217 aa, Vibrio harveyi
MKTKLSIALLTSLLALSPAAHANFSVNVGAINVNPDSTSSPINENSALGLNPGSDTQLGITVDYAFNEQWVLELIAATPFSHDINGAGGLAGNKIANIKHLPPSLVAQYHFLDSSYAFRPFVGVGVNYTTFFDEQPSQALKTVLGTDDVEVKLDDSFGFVAQVGANYKIDEKWGLHAMVSIMDIETDATVYADGAQALTSTVKIDPIVAMFGVKYSF

SEQ ID NO: 6399 - protein, 160 aa, Vibrio harveyi
MMKKTLLAVALLGASSAAMADSWIYGGATVGQSDYKGETDTSYSVHVGTGILPIIGVEAGVTQHGEFNVNGQDTKLTSYYAALKPSIDFGPLHVYAKGGFHQWDKKVKGGKDDDDLDLMYGVGAEYFIFGPMSVGASYMNYTAGKDDISTFSVNATLHFL

SEQ ID NO: 6400 - protein, 328 aa, Vibrio harveyi
MKKTLVALAVAGISSSALAAGNIYDNGTTSFNVKGEIDTYVSTVEVKENGATTTKRDVDVDLWAKIQIDSEHKLNEDVTLFGSFELENGEFFDKDSNADHARVRTDDLYFGANFGENWGVAVGEIGDFGDSLDAITIDNTNEGLGYVDDFVKSKESDGHAVSVKGSFDKLTVIADAYLNQDENIDTAFGLSAQYAINDMFTVGASYQDQENRDVAGTDYQVMGAAVRFNMDNFSAAVNYVAEELNKADQDTWSAVAAYQMNEARVYTSFGFTDYEGNHDQSYYTFGADYALTGNVLSFIEYTASEEDNKAVSSKTEGDLVVAGVYYTF

SEQ ID NO: 6401 - protein, 271 aa, Vibrio harveyi
MRKSLLALSLLAATSAPVMAADYSDGDIHKNDYKWMQFNIMGAINEKGPYESTHDYLEMEFGGRSGIFDLYGYVDVFNLTSDSSSDKADKDGKIFMKFAPRMSLDAITGKDLSFGPVQELYLSTLFEWDGNNGGVNTQKVDFGSDVMVPWFGKMGLNLYGTYDSNQKDWNGFQISTNWFKPFYFFENGSFISYQGYIDYQFGMKDEYSQVSNGGAMFNGIYWHSDRFAVGYGLKLYHDVYGFEDGTGLPWDSSTKSESSGVGHYVAVTYKF

SEQ ID NO: 6402 - protein, 687 aa, Vibrio harveyi
MFTKSQLALVIGAVLAAPAVAEVKTTDENLVVEGREFGYKADTNSTAMRMEMTQLETPGQVAVIDETVIDEQRASTLGQVLQNDASVSAGGTGRNRERFSLRGFTLSSSDGFLRDGRQHWSHYRQPIELLERVEVLKGPSGLLYGKSEPGGLVNMVSKKPTTETQVSLSQDIGSNDHSRTVLDVSGALNEEKTLRARGILAKESYSSWREYGDGTKPQTERFVGGVVAEYDITENVMVSAHYDRTKDDGSVDSGAYIVDGKPVRGDKYIWDAQWSKIDNDVENYGIDINAQVTDNVNVKAGYNRQDFNRFDVESYPNFETYEQNGKIKHKGNDRTDNWVFDTAYLDVTTGFSLLGSDNTLLVGANYLDYSYDKFSVKHIGASVPPGQTVPKPEYGSSSKSPTSKYETWGIYAQNMMTINDHWQVLAGVRYDEKRSKTLTENQVSPKLGVIFHPASNGSVYVQYSESFMPQGEVSNGRKLYTNDGEELEAERGVSYEVGTKWELFDERLYLTGALFDITLENVRIDVNDPNNPGMELATQDGEQVHRGAEILAQGFVTEELSLTASAMYLDAEITESADYKGNRPSDVPEFSASVWSSYKVQNNTDVNLGLIYEGERYGDAANTFKKDGYARIDMGVAYTHKYDENLDIIARFNVENVFDTDYLAGGDRDGVVVGEGQNYMATIQFKY

SEQ ID NO: 6403 - protein, 777 aa, Vibrio harveyi
MLTLVFSVIRRSFMKFKYCVIHQLVLSGSLIFPTLSFADSDSTKTTPNRASYLEEISVVATTVQHIFSSTQSTEQLRKNMVSNERDLFRYEVGIGVPESGRSGSNGFAIRGVDKDRVAVIVVGIPQAESTMSTSARYSTERHNGNINNIEYENVSSLKVQKGATSVMYGSGALGGTVEFTTKDIEDFVEPGRHLGFLSKTGYTSKNREYRQVIGVGGKGEHFFGFVQLTKRWGHETINNGKGTDILGEHRGKPNPLNYYTTSWLTKVGYDINNTHRFTLFLEDRREKKLTEEKTLGLSDAERFANDQTPYLRYGIEYRYNGLSWLETVKLFLAKQKIEQRSALQEFDINNRNKLDSTMSFVYLQRQNIARGEFSTSPLYWGPSRHRLSAKFEFRDKFLENTNKHFTFRKWQIALFQRQGRNNYTEVFPVKSREFSFSLMDDIKIGELLHLGLGGRWDHYNYKPLLNSQYNVNRTQRLPYPKTSSKFSYQLSLEYQLHPSHQIAYRLSTGFRVPRVEDLYFEDRGRTSSQFLPNPDLQPETALNHEISYRFQNQYAHFSVGLFRTRYHNFIQEREMTCSKIPHEYERARGYCTHNTYVMFVNEPEAVIKGVEVSGALNGSAFGLSDGLTFRLKGGYSKGQNHDGDPLKSIQPWTVVTGIDYETEGWSVSLSGRYSAAKKAKDAIETEYTHDKKVVKQWPHLSPSYFVVDFTGQVNLSKNAILNMGVFNLFNRDYMTWDSAYNLFTRGYTSRSIRANSPGINRFTAPKRNFAASVEIRF

SEQ ID NO: 6404 - protein, 205 aa, Vibrio harveyi
MKKVFLLTALVSSFASANDMSGFYLGAGIGNTDFDDAGYMNDVSHAIARHSGASVPLTSDSDGSAYKLIAGYQINRIVAIEAQYTKYADTDVKVQNISALKLSHDTFTVAANVGYTFDNGLRPFATLGLGSISYEVKENVTGNNFKESESGGTVRLGVGLEYAPVMLGGLAFRAGYEVDHYTLETAFKDYDQSVGSWYVGSTYKF

SEQ ID NO: 6405 - protein, 722 aa, Vibrio harveyi
MGINVQKNSVVDLGTNSSIKTSGDNAHGLWSFGQVSANALTVDVTGAAANGVEVRGGTTTIGADSHISSAQGGGLVTSGSDATINFSGTAAQRNSIFSGGSYGASAQTATAVINMQNTDITVDRNGSLALGLWALSGGRITGDSLAITGAAGARGIYAMTNSQIDLTSDLVIDMSTPDQMAIATQHDDGYAASRINASGRMLINGSVLSKGGLINLDMHPGSVWTGSSLSDNVNGGKLDVAMNNSVWNVTSNSNLDTLALSHSTVDFASHGSTAGTFTTLNVENLSGNSTFIMRADVVGEGNGVNNKGDLLNISGSSAGNHVLAIRNQGSEATTGNEVLTVVKTTDGAASFSASSQVELGGYLYDVRKNGTNWELYASGTVPEPTPNPEPTPAPAQPPIVNPDPTPEPDPTPNPTPTPKPTTTADAGGNYLNVGYLLNYVENRTLMQRMGDLRNQSKDGNIWLRSYGGSLDSFASGKLSGFDMGYSGIQFGGDKRLSDVMPLYVGLYIGSTHASPDYSGGDGTARSDYMGMYASYMAHNGFYSDLVVKASRQKNSFHVLDSQNNGVNANGTANGLSISLEAGQRFNLTPTSYGFYIEPQTQLTYSHQNEMAMKASNGLNIHLNHYESLLGRASMILGYDITAGNSQLNIYVKTGAIREFSGDTEYQLNNSREKYSFKGNGWNNGVGVSAQYNKQHTFYLEADYTQGNLFDQKQVNGGYHFSF

SEQ ID NO: 6406 - protein, 693 aa, Vibrio harveyi
MEVTVAGTRVTRTAGSAHVIKSRQLERFEHDDPHAVLVSVPGVYVRGEDGLGLRPNIGVRGVNPDRSKKVTLMEDGVPISPAPYSAPAAYYFPLITRMSNVRVIKGPGAIAYGPQTVGGTVDLVTRSAPSLASGALDLALGQYGYGKAHAYLGTSDGQMDFLVEGVHLRSDGFKELPSGADTGFYRNEVMVKGSYLVDPAARIKNELRLKLTYSEELSNETYLGITDADFEENPLRRYGVSALDRMRNHRTAVAVTHVIEPSRDLSVTTTVYRNDFSRVWRKVNGFRGANLFDVLAAPDTPQNAVYYAVLTGQLDSSTPGEALLIGPNEREFVSQGVETRVRWNVATGPVSHRVEYGLRLHHDRVERRHSENGFLVLGGALVPDGGPTVVTQFNEAWTEAVALHASDAITWRALTVTPGVRVELMRSALVDRAAGSEQTRLAQALLPGAGAYLAITEALGLLAGAYRGFSPPAPGSDEHVEPELSVNYEGGARFADGPLRAEIIGYFNDYSNITDVCTLSSGCLDADLDRQYDAGEARIYGVEAYAEHEVPLGQLKLPITAAYTLTRTEFLSSFASDDPIFGRVVKGDEMPYVPRHQASLSVGVEHERAGVAVGATYMSAMREKAGSEPMSRALATDEQLLFDASARVRVVGPLVLYANARNILGSQYIVSRRPFGARPNAPRWIQLGAKASF

SEQ ID NO: 6407 - protein, 321 aa, Vibrio harveyi
MKKIALAVATVLAGGVMSNVALADTYIGGKLGYNALNDACHLDAPCDDDSFAAGMHIGYNFNEYVAAEYGVDYLGNFTANFNKAGLNTVDGDLWALTLAPKFNLPLNDSWNLFAKVGAAYMMAGDEKDFVPTGSLGAEYQINYNWSLRAEYQRYQDMSDDIIDDMDADFFGIGFNYKFGSEPVVQEEVVETRPATRIVDHEYPAQSTTVQFGLESAELQDASAFNGTVELMNTYPQAQVEINGYSDTTGSEAYNQQLTEKRAQAVAEHFQAEGIAADRMTVKGMGEANPVASNETREGREENRRVEVVVPAFQYQTEEAAQ

SEQ ID NO: 6408 - protein, 773 aa, Vibrio harveyi
MVNVPIGNVIGARVAGFYLKRDGYTDNIFNGDDIDGRDMYAVRGSLRVEPGPDTTIDIVGYYFRENDDRLRIQKQQCQRDPTGILGCLNNRRDFDKTNANSTFTGTLASSEFFALNGIPRSFGLNSLYGPDAYANFNEPQDVRVVNTEFTPEYFADELIIQADISHDFGAINVSLNGTYQETSVDSRQDYNLGVGQIPNAAIAFPTLQAFAAGAAGPGTGAYFTPITEALFDGGDLCVSDTRLDNRGAFEGFSVCTPNGTQFDRSNQENESFSVEGIISSDLDGPFNFLVGGIYAESKVLENSYYVNAFAIDYIAGVLGSFTSLGGGLPPSYLATSFFRNNTQDFKLKSFGIFGEVYVDVTDRLKITAGLRYNDDSKRITARSTLASFLNPYSNDGDPFDSPFVGSFDADPGTPGNQLSQQREVGFDEITGRFVVDYEITPDNLLYFSYSRGYKSGGINPPLQPIFNVSESFGPESIDAFEIGSKNTFANGALQVNATAFYYKYSDLQLSRIIARTSVNDTIDAKVFGFELETVIAPSPNWLINANFSYLNAEVDGQQLFSNPRDPGGGDPNAVIIKDITNGALCAVTGGNPNAFVNAINPGLGLQGTTSFPSDSGIASNGAFSICGVLEAQAAAIGPAFGGIQVLSPGVQVNLEGNKLPQAPEMKASAGVQYTADFDNGMSLVPRFDIAFTGEQFGNVFNGRVNRIEPFVQANAQIQLNGPDRRWFVRGFVQNIFDSDSVTGLYVTDASSGLFTNIFTLDPRRYGIAAGFNF

SEQ ID NO: 6409 - protein, 159 aa, Vibrio harveyi
MKLKTIVLPLVMLTAAQQASADPYIGASYLYSEYQVESENVDMTDQNSGYNLYLGYAFNDLLSIEAGYADFVDTNKDFEHLYSNAWLTSAKVSLPITIFDIYGRAGIGHFESNLGDSNDVYYGVGAGVKIGPARVALEYTMYEAKLIENGYAISAEFHF

SEQ ID NO: 6410 - protein, 427 aa, Vibrio harveyi
MKNLTFKTTLAISAAIASPQLLANGFALNEQSISGMGTGFAGRASSADDASTVFGNPAGMSHLKRQQVSGGIAVIDSKSEISNANGNRPGTNHGDMLPSRTVPMGFYVKPLDEKWAFGLGVYSPFGLDTEYENTFQGRHFGSQSKIKVVTFQPTISYAFNDRVSIGFGPTINRISSTLKTAYTTAFSPNNDGQVQIKGDDIGYGYNFGVLAQANDTTRIGLSFRSKVDYTLEGHTSVTPGLGTPTPVLVAGRYQASFKIQTPESWDLSLTQQVSDSWILYAGTTWTRWSRMKSITVNNANVSGGALAPDAFTTITEEQNWRDTWTYAIGTSYQMNKQWLLRAGLSYDQSPSNDLDRTPRFPTGDRTTLSLGAGWSPIEDLTINVAYFYRKEEKVSVNNANPFPLGQTYSADFSNSANGLAVGATYRF

SEQ ID NO: 6411 - protein, 718 aa, Vibrio harveyi
MRLSLNLVIASTFGAVAPASANYDLDSLLEMPLCSLAETKVVSATRTSQSLADTPASVYVITAKEIKRSGARSVADALSLAPGLHVAKYSNYDWGVTVRGNNETLNNKMLVMVDGRSVFNPMSSGVDWDLIPVSMENISQIEIVLGPVGTVWGGNAVTGIINVITKEADGAAKGKVSASFGNYDYSEYQLHHAGSVGEYANYSLYGEFVDHMPWTSDEARVKPFQHFNVYTERFGGRLDYQKHEHTLSVQAGGIRSREDYNWGNFQPHFIMPGAEPMRTHEAEMTMQEYFVGGHHVFDRSNGDSWENELWLTYSSNDSTHANAQFLRTDLDSHYTFSDLWGTELTVGGNIRLIDEKFGTFSTYELVTMPYLRVAEDPDFLNQSYGLYMNWNIPVMDKTKLTLGNRWQYNNLTHDIDPQPQVRLSYELANNQRIWAGWGKAIVTPSRLELSTYMRENQYMQNVMFSDNNYYDYYYSTILKGNEDLDVESVSTYELGYRFWDENRLQFSIGGFYTRHENIRVYKTESASQIIIGEGSSPGTVGTVVEQYTSQLVDPIWSESFGGEIAVKWQPRDDLQINANYSYKRIVGHCEGAICSSNDAVKRMIENEPNHFVNAQVMWDITPQWWVSVSGQYVSESELHEDYESALHPVSVANKDYNWPEVVSFDASLSWQYNDCMPEITASVENLGANQSKEFPNNYNSFANGTQYWLTLDWNYAGW

SEQ ID NO: 6412 - protein, 413 aa, Vibrio harveyi
MNKKHCSLLTISILFACNAHSAGFQVAEHSASGLGRAFSGEGAVADNASVLARNPAAMTLFKEAQFSGALSIVDPEVNVYDTLHKEQSDDVAPLQVVPAGYYISPINDNWAWGIGMFTTYGVATDYPDDISAGDMAGDTSLLSVNINPNIAYRINEKFSVGGGINLVYAEAELTRHKGALAPLFGSGSSKSDNLIGMEGETFAWGWNVGALFELNENNRFGFGYRSKVDLDFDDGEFSSYDSGIATAAKVDGRLKISLPSIIELSAFHQLNDQWAIHYGWQQTDWSTFKELKATSNECKGGVCFFKPEKYEDNNRYSVGATYTLNTEWTFRAGLAYDEQAGEATLSIPDSDRMWYSAGLTYAMNENLSFDAGFALVQSESGSFTETNAAGQEIKFDSEGTAYISAVQMNYTFK

SEQ ID NO: 6413 - protein, 505 aa, Vibrio harveyi
MYKKRKLAILIALLTGTAAAHGQTDLNSIEARLAALEKRLQDAETRASTAESRAASAEQKVQQLTQQQQQTQATTQQVARRTTQLEEKAERPGGFEFHGYARSGVIMNDSAASTKSGAYMTPAGETGGAIGRLGNQADTYVEMNLEHKQTLDNGATTRFKVMVADGQTTYNDWTASSSDLNVRQAFVELGNLPTFEGPFKGSTLWAGKRFDRDNFDIHWIDSDVVFLAGTGGGIYDVKWNDSLRSNFSLYGRNFGDIADSSNSVQNYIVSMNNFAGPVQMMVSGMRAKDNDDRQDANGNLVKGDAANTGVHALLGLHNESFYGLRDGTSKTALLYGHGLGAEVKGIGSDGALRPGANTWRFASYGTTPLSDRWFIAPAVLAQSSKDRYVDGDSYQWATLNLRLIQEVTQNFALAWEGSYQYMDLQPEGYNDRHAVNGSFYKLTFAPTFKVGSIGDFFSRPEIRFYTSWMDWSKKLDNYANDDALGSNGFKSGGEWSFGMQMETWF

SEQ ID NO: 6414 - protein, 1046 aa, Vibrio harveyi
MNKLNSFIFQSVKPMLNKNISSLMLAGVIAPLFSISAFAQDKDNVMLEEVVVTATRQALQDALTLKRETTSISDVLASGDIGEIPSLSVAEALEAIPGATTHRLKGSGSQVSLRGLGPTLGLETFNGRTVTTGSENRSVNFQQFPSELMDKIQIYKSQSADMIEGGTSGVVELKTVRPLDYGKNVTVVDVRGKFNSYAARQDENDGFGYRGSASHINQFETDFGPVGVSVGVALYDHGNPEESYNPSSSTTACVNQGWTSQEAMLAARSTSFKEDCAPTTPAGARGTAYTDATGVLASGADLNDVYIVNNSGAYRNLNDNENRRAFMGAVQWHPSDDWEFNVDLQLSSKSYEEARSEIQADNMRRGHYDVVLDPNSYNALSWKGTSQVRLDNNMYRRVEDYVGGGFAVTFTPTDRLTLDADLSYSDTHRSRNQRYVRFRTSDYIDYSFVNASDTPELTFGGNVEGGVEFDPTDLSSFDLGATIRSRKFDQKHTMEAIRLDADYAMEEGGFITSYETGIRYSTNKRVVEADDSQETGIEVIYALYTDGDMANPAVSNTELRGRIAQECGIDFPNDNFGAGTNAAKSAPWASFDTECAISLVTNGKATEGITHEQALAAAGMSDVLGDDINVSETVTAAYIKANYSTELGSIPVYGNFGVRVLETTVESIGYKVGYTAVSCNPDDAGVSYSADLCGFTEDASGDDWYLKRDGRVETLTDTNSITSFLPSVTAIFDISDEFLIRSAIYRALSRENIDWYANGYSYGEDEFDDRNGVSGVLTDDIRSASTGNPYLKPYMSWNADVSFEWYFSPESSISTAFYYKDFEATYANERVETTQTVGVFGGDESLGAGTAAPGEIVYYEQDVAVTKFVNVDQNNSLYGLELNAQTVFTMLPSPFDGLGTRLTYNYAQTDYVTQDAVWGDAVDEDGNVIVGLPNLDEASFFGQSDHSGSLTVFWDIGDLNLQWITKYRSEYLQPNLGIAAGNRWIAPFTLMDFAASYKINKTFKVRATVQNAFDEPQVGNRVSKTGNSTLWSATGPKFELGVTAKF

SEQ ID NO: 6415 - protein, 213 aa, Vibrio harveyi
MKKTISSLAVVAALVSPSVFAHSEGDFILRVGAASVVPNDSSDKILGSQEELKVDSNTQLGLTFGYMFTDNISLEVLAATPFSHDISTDLVGKDIGSTKHLPPTFMVQYYFGDSQSKFRPYVGAGLNYTIFFDEGFNSTGKGAGLSDLKLDDSFGLAANVGVDYMINDKWFLNASAWYANIETEATYKAAGAKQKTDVEINPWVFMISGGYKF

SEQ ID NO: 6416 - protein, 709 aa, Vibrio harveyi
MRLLSSAGFTLALVLSAPAIAQGRTAGSDDDVHTGGPIIVTAPYVRSLDILGNVSVLEGDELARDIRGQIGDSLTRQAGVSATSFAPGASRPVLRGFSGERVRVLTDGIGSIDVSNTSADHAVTIDPLTVERIEILRGPAVLLFGSQAIGGAVNLFDRRIPRKVPEDHVHIDAIGGYATAADDRNAGGSIDIALSPQVVAHFDGSWRKTGDMRSGGFVYAPGLRAELLDLAAEEAEEGHADEAAELTEQAGSRGKVANTASETWTAAGGLSLINDGGQLGVSVSYYDSNYGVPSRPGTEHHHEEGEEGEEEEGHEPGEGAVTIGLKQWRADLRGEVEMGDGFFDKLRIRAGFADYEHTEFEGDEVGTIFTNQGVEGRIELAQNDRGGWRGASGVQYSHRDFNAIGAEAFVPRNLTDQFALFTLQEWQTGPLGVEAAARFESTSVRAPTLGIERDFDTFSGALGANYELAEGVKVGVSVARAVRAPSAEELFSNGPHIATQAFEVGDPNLRREASWGAEASFKLKTDRFNLSLAAYSNWFDDFIYADATGEEEDELPVFQYFQRDARVWGFEAEASARLAQIGGFNIVADATADMTRAKIRGGLDQHAPRIPPLRVLGGLEAQGERIDARAEVEWTDDQTRIAPFETPTRGFTLVNASISWRPLPDSRNLTLSLAANNIFDVEARRHASFTKDYVPLAGRDIRLTARASF

SEQ ID NO: 6417 - protein, 649 aa, Vibrio harveyi
MKLTPLCCLFLVLLPCSVIAQTTYQQSIPDVLTVWSSPIAANPDVLTQQQMLEQNKVNAAQALATLPGIVMQKSGNRNEYTLKVRGFDSRQVPVFFDGIPTYVPYDGNLDLARFTTNDLASIEVNKGYTSLLQGPNLMGGAINITTATPRKPLEGHIAYSQGFARGADYAHNMSARLGARTEYGFIQISGSQLQQRFTPIPNADENNNAVGTHGRRSHSATDDKRGMIKVGWTPRASDEYTLTYVKQDGNKNSPPNSDPNAKGRYKYWAWPDYNKESYYYSGVTQLTDSINLQSRAYHDKFENTLYMYPKKGNRVDYSHYDDHSTGAALQFGIDMEESDLLSFAVHWKDDVHRAQKEKNGDWVRFKDRTWSLATEYQWVVSNDLDVVGAISYDWRKSIDTDKKADNNKQNAINWEIMAKYSLANDDNIRFTISDRSRFPTQKERYTTEKPKDGSRGIINPNLDPERALSFDMTYEGYLNEKWGYQTSLYYNRVSDAIMAHTLYRHGEALFQNQNSGRVDYLGLDIGTKGKMTDWLELGLNYSYIHSDPKQVDHIEGLPKHKAYMWLTFIPVEQVRFTIIEEAQSWTYNRIDENNKLAGYTKTDLRLDYDVGYGISVNASINNLFDKSYQYTQGYIEDGRNYWLGAEYKF

SEQ ID NO: 6418 - protein, 684 aa, Vibrio harveyi
MFALTLSAQNQVPATKAETVQVIGKVPDSSSQNFRSNPSGFQTAIKLDETSARYTSLPEVLEREAGLRVRSFGGLGSYSTLSIRGTNPNQSRIYLDGIPLNNSQGGEVNLADLPFDSLESVEVYRSGNPIGFSGSAIGGSVNLVTKKDSQKPKTRINLGGGSFNTGKASVSHTGNYKGIGTSFLALGEKSDQNFSYKNDHGTVVLNTLDDTIDRRKNASFERAALFGSLKYQIGKTELKFLNDFNHRIHGLPGPGSNQTDRVHRKYDRNTSSFATDTKGLFVDSFRLETRGFYTAAKDDLYDPLSEFSKGTPNSRAEIRQAGFQVMPTLYLTDYHQILRGFVSLEKESFDRERLTSSNVVGRVEPKKERTYSSFRLEDEIRIWNSKILLIPSVTWDHYKDRFPSEEPWYRRQDPLSGDIKKTTFTNPKLGFVWKIFEKESWDVQFQANISKQYRIPSFLEMFGEQGSIVANPNLKPEQSENGDAGFIYKTNHSFLKTKTSISYFKKDMRDMILFLPNSQFTLRPENVDSAKIRGLEFSHRGDWKYGIKFLFNYTYQEAINTSSSPYLHGKILPLRPRHEFSSTFSWKGKKLETGIELLYIGAVFRDRTNEYINYIPERQIWNYFFTWVIDSESKDSDLNGNSKEITREVLLTFEVKNFTDKRISDLIGYPLPGRSWYTTLSMRF

SEQ ID NO: 6419 - protein, 707 aa, Vibrio harveyi
MTTHTRFKYSSLTVALLATFSVQAWAEESIPVSESTLETVTVMGKAYRNTATKSALEPEETPQGISIIDGEQLEQRGVQSLNQALRYAPGVVTENRGGSVAMFDSYFIRGFDTNNVNYYDGLSLQFLTGWNLQPQIDPIAMQQVEVFKGPTSVLYGAMPPGGMVNMIAKAPQTDQLTKVGVASGSRNLKEASVDTTGQFGDSDFSYRLIALARKQDSQVDNAEEERYLIAPSVDWQATDSTLINFNLYYQNDPSMGINSAMPLDVLKASDPSVSMGDKNWNILEREVLMVGYKVNHEFNDNWTFLQNARYTDASLHQKNTYHLSYDPSTPNQLNRALYSTDESFKGFVIDNQLSGTIDVGSLEHNLLLGVDYQNMDGDVNYSSYTSNGGGFNSFDPLNPNNDLLNLSDVKKENEYLDDTTSSQLGFYLQDQVRLDALVLIAGARFDHYKSESDYYAHASDHKQLTYRLGGLYQFDNGLAPFASYATSFEPAPGVDKAGNEFDPEHAQQAEIGVKYLADDMSKEATLSLFHIVKQDMLMADPTDIYGPKIQLGEVVSQGAELSGRWFATENFDIAAAYTYVDMEITKDSSNGLEGTTPIYVPEHTANVWANYNVFDGMLAGSRFSAGARYVGKMQMDASNTQGKVPSYTAVDLSIGYDLGAASDSLSGATANLAVNNLFNEEYYACYDQSNCWFGAEQSVELSVSYEF

SEQ ID NO: 6420 - protein, 448 aa, Vibrio harveyi
MNKYLLWGCIGLGSVSNAYAELPQEFGKLELKLNTRYWNDEGTAHPTLANPSPSSSEYEQSALGLELNYQSPYMWDWLGVDGSLYAVTKLFDSGKPSAQLLEVENNGKLDQNFATFGQLYIKAKLGDQGEIKLGRQLQDSLLLKSTNNRAVPDTFSGASGQFQLNDQLQTYIAYYDRWKPRSMDSFEKLVTENDERIDYVGLLGAKYQYKNWSVNAEYLNSKDYLKKYGAIAQYKLPMHGLVWTFNTGAFFSRDDGKLFKCGAETELDCVKGQDINNRGNGYFVDVNVAKNNIEGGIAISKFDGFWIEDNFAVHSDRNSVLTQDHGTNPFPTSATIGPDFTNNDETAVALRLKYNWKDYVKGLKTEAKYIYGFGAHQSNISSDIEGKERYFDFTVSYALPWVKNLDVRYSFLHYESKFENANLGEKINGMSRKYWDQHRVFINYRYTF

SEQ ID NO: 6421 - protein, 1020 aa, Vibrio harveyi
MQSFRITKLTPKGRVLFLLYLFFIPLLALLVPGKGQAQTKPLINSTLSGRIMDARTRTPLPGARVHIKGTTHEVSADSDGKFSFVTGQKFPYTLIVSFVGYGTREVIANGGYIDVELKELQNELNDVVVVGYVTQQRKNNIGSITKVDGAATKDIPVGSFDAQLQGKVAGVQISSNTGVPGEAINIRVRGATSINAENGPLYVLDGVFINSSSLQTLSTGGKATSPIADINPADIESVEVLKDADATALYGSRGANGVILITTKRGKFNQKPRIALNSSVGWAKAAKLWDLATGPEHATLVNENWVNTGNPFATRPFRPVSEGGRGLPEEQQTYDRLDQVFQTAGLQNYDLSLTGGSAGTKYYIAGGYNKQESILKPITFNRASFKVNLDQKINDQVQIGVSNTFGRAFRNQARAGDGPAGGLLQAALHTPTYLSPVNEQGVPVGRAGFDNVDLLLKYYDVHSTSLRYIGNLYAEIKFSPNLSFRSSVGADYNNYDESEYWNTFLISGSPNGLATSTISQSTSLINEQTLTYRKTLGKHGIGVLVGNTLQSDVSTFTGGTGRGFANNSFKQISSASTTTSSQGWSKNTLASFFSKADYNYEGKYILDFIIRADGSSRFGDNNRWGYFPSAGAAWRLKKEDFLKDVAFISDFKIRASYGITGNQNGIGDFATLGLWSGGSSYQDNPGIAPQQLANPDLQWERTKQFNIGTDLSLFNDRLALEFNYYKKYTDNGLLSLSLPATTGFGTYISNAAEISNKGFELNISSTNLKTTDFSWTTSLNVARNVNKIEKLATPLKYGSRDLILLQEGSPLYSFWLYKELYVDPETGNSVYEDVNGDNQITAADRQIYGNIWPKYFGGLTNNFTYKGFDASVFFSFSYGNKIYNHNRFFGEGGGARDAARVIFASNVDRWTSVGQVTNTPRPDGINNNNYKDGGSRWLEDGSFLRLKALTLGYSLPKYVLQKVKIDGLRFFVMGSNLFTVTNYTGADPESSVSSDQNGQGIDLGTPPQPRSIQVGINLTL

SEQ ID NO: 6422 - protein, 393 aa, Francisella tularensis
MMRLKSIVIATTVLLGSATASIAAGSDNIDTSANTNSATTQSSGFAANNFIAPFANTYSALTNKDNTWGPQDRTGQWYLGVDANGLAGTPNSPSGAGANFTIGYNINKYFAVQYNQLVGRVFAGLGEGVVNFSNNTMFTPYAAGGAGWANLAGQATGAWDVGGGLKFELSRNVQASVDYRYIQTMAPSNISGANGRAGTNMIGAGLTWFFGGKDTTNNDTGNIQDNGATTAAQTVAMPTIDESKYVLPAGIKQCEGNFNLTEDGVACYTVNGDDVTVYLDTKFAYDKATLNAKGKKAIASFVNFIKDSNIGSVTVKGYASQGQTSSEFDIYNQKLSEKRAQAVADYMKQLGLDSEKIITKGFGYDDTLGGIPKSDPRNQRVEASVSAPLKEAN

SEQ ID NO: 6423 - protein, 803 aa, Nematostella vectensis
MIDRDRTGSSFLALACIGFITSAPAAAQTAEKAPDGEKRLGGMTVSATAIDEATPKVERPESPKYTRPLLDTPQTITVINKATIQQQNLLTLRDVLSTVPGITFGAGEGGFGYGDRIILRGQDAKNDVTVDGVRSGAFLNRNEVYNIEQVEVTNGANSVMNGGGSVAGTINLVTKRPLADDQTVLSAGVGTDNYYRATVDANRRLSDLIAVRINAVYHENDVPGRDVEDYKRWGIAPAITIGIDGPTSLTLQAEHLDDKAMPQYGLRYYANNGGFLDDFDRSGYYGFANLDQQNSKTNALQAIFSHAFSDKVSIRNLTRYEKIRQNTITSQPNGTFCLASTGLQPLDINGVAAACPATVPAGYYLPTGGRGVQRFITNETHYSQTDLSANFDTGGIEHSLVIGVSALWEDYHQKQGTLPRNADGSTPAFPLVSISNPEATVQGPAGFTYGNNTYNGPINFILSSRNVGTQRSYAAYLFDTVKFADWFEINGGVRYEDVKGSSRTLSYVTTAGAANLGDLSAATGPFNFGDKLFSYRVGAVVKPTPNTSLYVAYGNSKLPSKASVDGACTAANCRLKPETTENYEIGAKADLFDARLLLTAAIFRNERNSIKVNSNDPTLPDQTLDGGQRVEGLSLGASGNITSNWTISANYMYLKSKILQGVSNFCVANPGATGCGNSAAFPDPTRGYSLTNTPKHSGSLFTTYRFDFGLELGYGLTHQGSFLLNQPTLAQLTAGNYVGYRVPSYTIHRFMAAYPITPQLKAQVNVQNFTNEKYVTTVRNSVGGSWAQPAPTRSAVFSLNYQF

SEQ ID NO: 6424 - protein, 441 aa, Nematostella vectensis
MVNNTKMSMAALAVVVGAGPSTVFAEEKPEGFIEGSSLTVLNRNLYFNRDHRNGQSSPTGNGYSEAWAHGIIGKFESGFTQGTVGVGVDAFAMIGLKLDTGDGRNGGRSSFDVLPVNSDGEARDEYTKVGGAAKVRAFDTVVKVGDVFPANPVVAAGDSRLLPESFRGVTATNTSIEGLSIQGGRLHAMSQPVSSDLRENFATFYAGPVNSPWIAYGGGDYALNKNLSFSLYSSRLKDAWNQYYAGTAWTYPLSDDLSLFGGLNYYKAIDEGKQLLGEFDNNIWSGRVGVKLGAHSVAISHQRNNGNDDFDYLRQSDSIFLDNSIQYSDFNSPKERSWMVRYDLDMTTYGVPGLSFMSRYARGTDADYSNANAVYMRRDAEGNPLTDQKRWERDIEVKYVVQSGSMKDLSLRLRQATTRATAFESDLDEVRVIVEYPLAIL

SEQ ID NO: 6425 - protein, 146 aa, Nematostella vectensis
YQNINRPNAKVTGFEIVSQISLNDLTKILNGFNLSYKYTYQKGRMDGDIPMNAIQPRTAVYGIGYVHSDDKFGLDLYITHAGAKQAKDTYNMYHKEEGKKDSSIKWRSNSYTTIDLLGYIKPIKNLTLRAGVYNLTNRKYITWDSA

SEQ ID NO: 6426 - protein, 957 aa, Nematostella vectensis
MATAAVVPAIILAPAAQAQSAATQFDIPAGPLSPALAAFARQADIEMAYDAGLTRGVSTRGLRGRYGASEGLSRLLSGTGVTYRLSGRTATLSAAPAIADGTLALGPIRVQGATEGGAGGLSATGAGEAGDPVEAPYRTTGSSAYIAQDTIERFRGASTADIIKGVAGVTAGDPRVANALDVNIRGIQGQSRVPIIIDGGQSTMDAYRGYAGQSQWTYLDPDLISSITINKGPSLEANASGGIGGVVVMETLNVDDVLSEGRDLGLRVRTGVSDASARSLPAYSDKSRTDRGDLTRPGGQFFNIAGAGRWDRFDLVAAYAWRDTGNYFSGHRNYNDFPQGRRVLATLNPTNAEVFNTSSQSESLLLKGTWRVTDHQTLEAGYRRYQGEQGEIMASQIIRVDRDQVPQWDLGTVDMDAYSLRYRYKPQGDLIDLKVNAWYTHADSLMYNGLTGITPWYYDRRTEWYDGPSFNTDPGYKEAYRNELTQKRFGGDLTNTSLLFTGAGKFTLNYGLSFSDEDIAPGPNSPIMHDDLVNNRFLRNAERQEYSAVASVKWEPDTHWELMAGGRFNRVEVKDRNRLATPATYEVIGQYRYTELLNGDPSRPAYLAKRIALLNWYPDASGQFTKASLLASPYEHGTVADIVGWNFYDADAPEDLKVPATWTWSDPIRRTDDAFMPTGSVTYHFDEDTLVYVKYAEGVKLPSLFETTLGLFSAARPTEGMKPERGRTWEVGASAIRRDLLTGGDRTAFKVAYFNTVIDDLITRDYRSISAGLIRNIDTFKVSGVELQSNYDNGVVFGDLSAHYYFEAKTCAPDIAAERRAYGASRKNAELMATPDCVDGGFVGAYTNTQNPPRFNLNLTLGAHLFDDRLTLGGRAVHNSGPISKLDKAWNVGLSAIQQLYLETTVYDAFASLKVTDQTALDLNIDNVMDEYYLDPLALGVMPAPGRTVRLALTYRY

SEQ ID NO: 6427 - protein, 347 aa, Nematostella vectensis
RVLPEPVKLTLTGGADAQGDIVATELPPIPGTSSGPLDVALASQARWTGATRAVDSLSIDNATWVMTDNSNVGALRLASDGSVDFQQPAEAGRFKVLTVNTLAGSGLFRMNVFADLGLSDKLVVMQDASGQHRLWVRNSGSEPASANTLLLVQTPRGSAATFTLANKDGKVDIGTYRYRLAANGNGQWSLVGAKVPPAPKPAPQPGPQPPQPPQPQPQPQPQPEAPAPQPPAGRELSAAANAAVNTGGVGLASTLWYAESNALSKRLGELRLNPDAGGAWGRGFAQRQQLDNRAGRRFDQKVAGFELGADHAVAVAGGRWHLGGLAGYTRGDRGFTGDGGGHTDSVH

SEQ ID NO: 6428 - protein, 917 aa, Nematostella vectensis
TVKTASQLKRQQVQDSRDLVRYETGVTVVEAGRFGSSGYAIRGVDENRVAITVDGLHQAETLSSQGFKELFEGYGNFNNTRNSVEIETLKVAKIAKGADSVKVGSGSLGGAVLFETKDARDFLTEKDWHIGYKAGYSTADNQGLNAVTLAGRYQMFDALIMHSKRHGHELENYDYKNGRDIQGKEREKADPYTITKESTLVKFSFSPTENHRFTVASDTYLQHSRGHDFSYNLVKTTYINKDEEELRHTNDLTKRKNVSFTYENYTVTPFWDTLKLSYSQQRITTRARTEDYCDGNEKCDTYKNPLGLQLKEGKIVDRNGDPVNLKLINGRHKVIDKNNKLFGLTDENSNAAFDGKQLGPSGFWFDCTVFDCYKPVKTYKYQYSSSEPKVEDVELNKFMKVNGKLFATYEDKTRSSKRRHIILPNSKGYLPLDYKERDLNTKTKQINLDLTKAFTLFEIENELSYGGVYAKTTKEMVNKAGYYGRNPTWWAERTLGQDLSGNQHNCNTNSSYNGMLCPRHEPLTSFLIPVETTTKSLYFADNIKLHNMLSVDLGYRYDDIKYQPEYIPGVTPKIADDMVKELFVKLGPPARYDWQNKPYYTPEQIRKNAEENIAYIAQEKRFKKHSYSLGATFDPLNFLRVQVKYSKGFRTPTSDELYFTFKHPDFTILPNPVLKPEEAKNQEIALTVHDSWGFVSTSVFQTKYRHFIDLAYLGSRNLSNSVGGQAQARDFQVYQNVNVDNAKVKGLEINARLNLGQFWHVLDGFNTSYKFTYQRGRLDSDRPMNAIQPKASVFGLGYDHKENKFGADLYITRVSEKKAKDTYNMFYKEEKKKDSAIHWRSDDYTLVDFVTYIKPVKNVTLQFGVYNLTDRKYLTWESARSIKPFGTSNLINQGTGAGINRFYSPGRNYKLSAEITF

SEQ ID NO: 6429 - protein, 242 aa, Escherichia coli O157:H7
MKSIATLVVCAISGIACVNLSAHAAEGEHTISLGYAHFQFPGLKDFVKDATAHNRETFSHFVNRNYFSSLGEYTDGRVSGYEGKDKNPQGINIRYRYEITDDFGVITSFTWTRSLTNSQTFIDVQSADHTRKIKNPAASARTDIRANYWSLLAGPSWRVNQYMSLYAMAGMGVAKVSADLKIKDNINSSGGFSESNSTKKTSLAWAAGAQFNLNESVTLDVAYEGSGSGDWRTSGVTAGHWP

SEQ ID NO: 6430 - protein, 154 aa, Bacteroides uniformis ATCC 8492
MNLVVLNGRLTRDPELKFGQSGKAYSRFSIAVDRPFQSSSDKNSQTADFINCVAFGKTAEFIGEYFRKGRKILLNGRLQMSQYESEGKKITTYVVIADSVEFGEAKTSSGTTETSSYGRSESKSTNNTIETPGFDENSSDDMGAPTEIDDEFPF

SEQ ID NO: 6431 - protein, 654 aa, Bacteroides uniformis ATCC 8492
MNVIRTVICTLIILPVGLQAATSHSSMVKDTITIVATGNQNTVFETPSMVSVVTNDTPWSQNAVTSAGMLKGVAGLSQTGAGRTNGQTFNLRGYDKSGVLVLVDGVRQLSDMAKSSGTYLDPALVKRIEVVRGPNSSLYGSGGLGGVVDFRTADAADFLPPGETNGLSLWGNIASGDHSTGSGLTWFGKTGKTDALLSVIMRKRGNIYQSDGEHAPNKEKPAALFAKGSVGITDSNKAGASLRLYRNNTTEPGNSTQTHGDSGLRDRKTVQNDVQFWYQYAPVDNSLINVKSTLYLSDITIKTNGHNKTAEWRNNRTSGVNVVNRSHTLIFPGAHQLSYGAEYYRQQQKPEGSATLYPEGNIDFTSLYFQDEMTMKSYPVNIIVGSRYDRYKSFNPRAGELKAERLSPRAAISVSPTDWLMMYGSISSAFRAPTMAEMYRDDVHFYRKGKPNYWVPNLNLKPENNITREIGAGIQLDGLLTDNDRLQLKGGYFGTDARNYIATRVDMKRMRSYSYNVSRARIWGWDMQGNYQSDYVDWMLSYNRTESMDASSREWLGSGNPDTLISDISIPVGHRGVYAGWRAELSASATHVKKGDPHQAGYTIHSFSLSYKPVSVKGFEASVTLDNAFNKLAMNGKGVPLSGRTVSLYTRYQW

SEQ ID NO: 6432 - protein, 983 aa, Bacteroides uniformis ATCC 8492
MQTQEVIIKPTLKVILKADAQKLDEIVVTAMGISREKKALGYAVQDVKSDVLTRAANTDLAGALQGKVSGIDITPSSGMPGASSKITIRGSRSFTGDNTPLYVIDGMPIASTADVSTSLTDGAYGTDYANRAVDIDPNDIESINILKGQAASALYGMRASNGVIVITTKSGKGANKGKPNITFSTNLSFDKISTLPELQQEYAQGSKGVFDPLSPFAWGPRISELPNDPNYGGNTNNSYTNKYGKQPDRYYVPQLAAAGMDPWATPKAYNNMKDFFETGVSWSNNVNVAQKFDKGNYSFSMGNTTTNGIVPSTGMDRYNVKLSAEAQLHPNWTTGFNGNFVTSKITKQSTANTSVVATVYNAPVSYNMAGIPSHIEGDLYTQNTYRSDWIDDAYWAVDNNQFSERSQRFFGNAFVKYSTKFGTDNHKLDIKYQIGDDAYTTNYSEIYGYGSTWAATGEDSEYHYTVNELNSLLTASYTWNINDEWALDALIGNEFVDKKTKYEYAYSMNFNFPGWNHLNNASVFSNESQYNKKRTVGNFANVSVAWKNMLYLSGSIRNDIVSSMPRNNRSFTYPSVSLGFIFTELAPLKNNILTFGKIRASYAEVGMAGDYTQSYYYTPAYGGGFYMGNPIVYPIAGAMAYVPYYKVYDPNLKPQNTKSYEIGADLTFFNGLVTLNYTYSRQNVKDQIFEVPLAGSTGASSMIMNGGKIHTNTHEVTLGISPVDTKNFKLDFAFNFSKIDNYVDELAPGVESIMLGGFVTPQVRAGIGDKFPVIYGKSYMRNNEGKIVVDQNGLPMQGEDAVIGTVSPDFRLGFNTNIELYKFRISAVFDWKQGGQMYSGTAGEMNYYGVSKLSGDMRKTDFIVENSVKETGKDTNGNPIYAPNDIKVSDAQSYFTRRRSIDESYIYDNSYIKLRELSISYPVLSKKWLNVNVNVFARNILVWSEFKGFDPEASQGNDNMGGAFERFSLPGTASYGFGFNVKF

SEQ ID NO: 6433 - protein, 597 aa, Bacteroides uniformis ATCC 8492
MKTQCISPAFTRTLVAFSVVSAVSAHAETTADSSSTLSPLVVTATSTSVSVADSLSSVTVINREEIKAQQAQEISELLAAQPGVDISSNGGYGKTTSVYMRGASAESTKFLLDGIPLYSATSGGAPFENIPTSLIDRLEIVRGPKATLYGADAVGGVIQAFLPKADDDSHMNVSVGGGSFNTKTIDATVSGSSDNTQYLLSAGKFETDGDIVKEGEGAQGYRNENVLLNVGHDFSSGARISGLIMNSEGRNHYVGDENDYQVQVIGLSVSLPVTEDWDTELKLSQTRNDSKTISSEDKYNTKTQTARWSNTISAGEHEFVLGAETSEDKVDVTSYQAPDRSNNAVFAQSQFDFGATHLQLNIRQDHNSAYGDSTTGGVAVGYKLDGIHTLRASYGTAFEAPTFNDLYYPSSGDPTLKATKSKTVELGVRADYDNMYWDAAVFDASYGDMVIWSNYTGSWAAYNVDSKVQGVELSSGLTLEQWQLKAALTWLDAKDDDTGFQLPKRAKRSARLSADRLFEKGRVGVTLIGADGRATTLGSSETLAGYVTMNLRASYDFAADWNAEISVKNALDKEYQTAKGYFNPGRGVFLTLNYSAF

SEQ ID NO: 6434 - protein, 991 aa, Bacteroides uniformis ATCC 8492
MQTQEVAIKSSVKVVMKSDTEMLDEVMVVAFGTAKKSAFTGSAKVVGTEKLEQSQVTNVTDALAGAVPGVTLTSNDGAPGAKSSIKIRGFSSINAKNDPLIIVDGAPYSGDINNINPNDVESMTVLKDAASNALYGARGANGVIIITTKRANMSGEAKVTFDAKWGANTRALQKYEVIDNPGMYYEMHYRAMNNYYKSTGMNDQAAWLEANKNLFGSNGGLGYNVYTVPDGQFLIGQNGKLNPNATLGRVTNYKGRDYLLTPDDWEDVGMRTGLRQEYNFSVSAANEKSSFYVSLGYLGNEGITEGSDLKRLTGRLKADYQAKKWLKIGGNMGYARFDSNSLSNNGTSSSTGNIWAFVTQMAPIYPAYVRNADGSIMVDNNGIGMMDYGSGINAGMQRPFIADANPILDNKLNTRNSEGNAINGNAFVDITPIEGLKVTFNGAFNLDETRHSYVYNPYYGQFDSTGGTVSKYHTRTYDYNLQQLVSYARSFGDNNFDILLGHEYYDYRYYELGASKSQMFSQGNKELDGAIIDGQGASSYKERRNNEGFFGRLQYNYDERIFGSASLRRDASSRFHPDHRWGTFWSVGGAWLINKESWFDASWVQELKLKASIGSQGNDNIGDFLYTDRFNIINSNNSLGTSFKSKGTKDITWETNTNFNIGAEFQLWNRVTGSIEYYRRKTSDMLFSFTVAPSLGYASYMDNVGNMVNSGVEMDFNVNIFDTRNFTWDVNVNISTLKNRITMLDPDKLITTEYTADGKGYKGYSNGSFFIGEDLSMFTWRLKEYAGVNEKGESLFYKNVKDEAGNITGRETTTNHAQADYYITEESSIPKVYGGFGTKLKVYGVDFGINFTYQIGGKQYDGTYAYFMSSPYGTAGYNYHKDLLNSWTPENTNTNIPRFQMNDQYSGAMSTRFLTNASFLNIQNINVGYTLPSKWTRKLAINSLRVYMSAENVFYWSKRKGFDPRQSYDETTNATFYSPMRTISGGVSFEF

SEQ ID NO: 6435 - protein, 767 aa, Bacteroides uniformis ATCC 8492
MKYFKPKTLRFLMTISFVFTFLTMSAQQNGKIKGTITTSDGEQAAGVNIILKNSKYWAVSDESGNFEFNRIKPNTYTLQVSLTGYETLESEVIVAESETTTVNLQLKVSNKELKEVVINNKKSILSKKTDYVARMPLTNLENPQVYNVIHKELLLEQVSVDIKSAVQNSPGAVPVTYPSGGVAVTFRGFTTGINARNGMETSTNRSSTDLANVERIEILKGPSGTLFGSTISSFGGVVNLVTKKPFETTATEVSYTTGSFNLNRFTADINTPLNEEKTVLFRINAAVNREKSFLDYGFNNTVAVTPSLTFKANEKLTFNIDAEYISSNNTRRTYHRYDAASGITNPGDLKIDYKKSLFYDDNDAKTSANKVFAQAEYQISENWKSTTLFSFMGENVDRSYQTYTLWLNPYQAARRVGNWGPIYDNYTNIQQNINGQFATGSIKHKLLVGANYNFNKSGFSSGATAYIDTIDVRTPFDPMRRKTVDATLKQTAYPVTTNKTFSVYASDVINFTERLSAMLSLRLDNYKLDTVEGTEGYNQTALSPKLGLVYQVVKDQVSIFGNYMNGFQNSPPATQPDATRLILDPVYAVQYEAGVKVEAFNKKLSTTLSYYNIKIDNAVQYDNNGFAYQNGEQVSKGFDFELIANPINGFNIIVGYAFNDNTIPATGKKAVGAPENVANFWTTYTLQNTVKGLGAGFGINYVGKSYMFDDNVFYIPSYTTANATVFYDQPTWRVGLKFNNLSNEKYWDFYGNSQAPTNFLVNLTLKF

SEQ ID NO: 6436 - protein, 995 aa, Bacteroides uniformis ATCC 8492
MKYTTFVFFWACLFANAQENIKVSLLDLETNLPVENATLTLRNLEQGIDKPLTTNLNGAVTFRSVPTVNGYQILFEGNEAFEASESQLFNLRSNESPAIKLYAYKKSSKAENLEEVIITSNTKLKINRRNAEVSFEINAKDIEQTPVEGRDITRILYRLPNVTQATGFFPEAPTVSINGANPLFTNYTIDGMDNNERFLGGMRFNIPAGAVKDITVLTSNYSAEYGLTSNGVIDVTTKSGTNTLKGETYFITRPGPSVDASSQFAQRDLSGNQVKNGFARYQTGLAISGPIAKDKTFFFFNYEHTTDIKDNLLNVPDLGVSETVRGNNAFNYFTLKIDHLWSDQFRSSLRANVGRIEIENQGGGLDGGVIFPSAGAAQERNSINLAFKNNYEIGNIDGETNIQYSRFRWNYANPENVGPQVTLRNPQQFTIGVLGSSGFVFDEIENTLQVQQKLKYYLNNHTIKAGLQYISGDHELFGGGNPDGNYLVDLTQNQTNTIRNSDLGSGLNINDLPSNVNVVNYGVELRPNSFGTTQNIYSFYLEDQWLVNPKLNLVYGLRYDYDDLSKGGSTSGDTDNLAPRINFNYEIGENSVIRGGYGMAYDKISYAIHSDALQQNTTSADYQLQIQELINQGILPQNTDVNRVTFNGNLTANLTDVDYLQGPSPSDLQDQRESVFSNERRILNPNGYDNPFSHQFSLGYQTQLEDDKLFFIDVFHNRGHNLFRLRNLNAAEEFPIDSDFLPNDVRSLEEADASRPIPIINGQGIIDGQAVSGVARNVVMTESKGRSEYWAASFNLQKTRGNDNYDYRLNYTLSRLENNTEDINFRAQDANNYGSEWGPSINDRTHNINGIFNYYPFENSVVTFAGLLQSGQPINRIPDATIFGTTDLNGDGSAFGDAYVGNSDRSPGESRNNDRLPWSFNFDIGIQHQFLVGETHRLEVRADIFNVFNIENLSGYSNNATQSNQIQAGPASSGRFIQRNAGPPRQFQFGVRYLF

SEQ ID NO: 6437 - protein, 387 aa, Bacteroides uniformis ATCC 8492
MLNFMTKKKNRMQDCKMVGKNFNRKESVLIAQSLEISKKGSVILGALLSSLWLTNPLNAHEKNGAFVGISLEVGRADQKTNAYRNGELFQVPFGDVSANDDGKVPNGQTGGCQPASGTPGTPGYTKANCVVNWTSRTMLSTNKNIPGRNQPMYGLGVMTGYKHFIGKKRWFGLRYYGFFDYGHTNFSNSRAANAISPFYLSDQKADMYTYGFGTDMLFNIIDKPKATAGFFVGVNFAGNTWTNNRVGYFKDGYVYGVNTDADAYMTNADGTITCGDTTPASCDVGINPNSVYTTGKLNAKVNHTIFQFLVNVGIRTNIFEHHGIEFGIKIPTLPNYFFKGSTTIRAKKQGPLENGQPTTITGAETNFSLTQTLRRQYSMYLRYVYTF

SEQ ID NO: 6438 - protein, 844 aa, Bacteroides uniformis ATCC 8492
MRMHVENPPPCAQPGRMPTAWRVSFAVDRRENSMTRPTLSMIGLAVAAALSAQAQAQQADTASNTLDTVIVTGTRASGRTVLESTVPVDVLTAEDIRKAGVVNGELGSALQALLPSFNFPHQSNSGGGDHIRAAQLRGLSPDQVLVLVNGKRRHTSSLVNIDSKIGKGTTPVDFNSIPINAIKRIEVLRDGAGAQYGSDAVAGVINVILDDNPESGELEASFGAYNTDVAPINRRITDGQTSYASAKVGTLLGDDGGFFKVGLELKNREATNRAGFDQIPPFEEQTPANLALKGQRNYVLGDGATKGLNAWLNTKIPFSASGEFYAFGTYDQRDSEGANYFRYPDSSANWREIYPNGYRPISEGENRDLQIVAGARGQWGNWDYDASLNYGRNDFTYRLRNSLNASLGPGSTTRFKTGDFAFAQTVGNFDLTRVFDAVGATHTFGTGAEFRREQYRTHAGDPASYAAGPFTDRPTGSQAGGGLTPQDEADLSRNVASAYANVSSQFGDKFSTDLAGRYEHYQDFGSQWTGKLAARYAFAPAFALRGAISNNVRAPSLSQIGYEATSTGYDADGRLTQGRLLSVNNPIARGLGATDLTPEKSVNYSLGFTSKLGDHFDLSLDFFQIDIDDRIALSENITGDALTNFVQQNFGVTGVQSASYFLNAANTRTRGAELVANWRQHTFGGDLLLTGTYSYAKTELKDIIATPSQLLALDPEYVLFGVEESNTLTGAAPRTRAALAANWSNQHWNLQTRVNRYGSATRVFDFGGGFAPHQTYGAEWQLDLEAEYHLDTQWTLAIGGQNILDNYPDRSIDDIAYFGNLPYDVLSPIGSNGAYWYGRVRYSF

SEQ ID NO: 6439 - protein, 1055 aa, Bacteroides uniformis ATCC 8492
MKNINFFMKGQIIGLLALAMSFVTAAQTINIEGVVKDAANGDVLPGVSITVKGTVRGTQTDFDGFYSLKGVEKGVILQFRYLGYKLKEVSAVVTLTNVSMQIEAESLDEIVIIGYGKQRKKESTGAVSVVDAKAIAKLNPTRIEQALQGQVAGVNITSSSGAPGSGLNIRIRGVSTNGDNRPLILVDGNPITDLSVINPSDIKSINILKDATAGIYGVRAANGVILIETKTGRKKAPLKINIENYFAFQQTSKKLDLLNGVEFANYVNEATGKGIYFIQPASGEIYNTKQSATVPLSTTDWQNEVFQTAPMFNTNVSANGGTEKLAYSFGVSYLNQEGVVGLEKSNFNRLTARTSLQYSVTDRLKISATAIYTHSKKNNLPEGGIGAILYNAVNSDPLTGVNDPTELADAGFEILRNGYGIVNTTAIEVSNPIAQISNAYNIALVDRISPTYGVEYSFLNNFTFNSKNQFNHTKVYSDIFNPLAYYGVGKSINRTTTNEVIKNVDIYEDYTLSNFITYTNSFNDAHNVTALFGYEVLNTKGQFTGNTGQTLRNGSNDFNDAQLENSEVVLPRFQPDVIERGGDIFENRLSSFFTRVQYNYKEKYLLSVVFRRDASSKFGPNNRVGYFPSASFGWNVSDESFLKDNSVISSLKLRGSYGTIGNDRISDFGFVARLDGEGTYSNNNEETIEDLLVGVAEGRLANPGIKWENQITGNIGFDMGLFSNKVRITVDAYNKKTEDLLIAAQISGLTGVAGNGASAPFINAGDVVNRGLEFQIAYNSNLSEDFNLNSSFNFSTLENEVTFVGGSSGFEQGGAFGVGTGIITSRMEVGLPIGYFYGYKTNGIFQNQEEIDVLDAASADNLYHKGAGVGDLKFVDTNKDGEITEADRTYIGDYLPDVTLGFNLGFTYKNFDFNSAAFASVGNDMVRDYERLNVYANKSSVVLNRWTPNNPSNTVPRATSGASINTDNFSDYFVEDASYLRIQNIQVGYTFSESIVSKIGLDKLRLYASANNIHTFTNYTGFDPSAGSGAPIGGGIDRGFYPVAKTYILGLNLNF

SEQ ID NO: 6440 - protein, 1070 aa, Bacteroides uniformis ATCC 8492
MKKNRSTLSPCFRKTLIASLLVPLCSPLYSWAVQTASITDGSTMVISGGYDTEANNQTAVFVQGSGSTINGGSDVVIETTGVGAIGANASEGGTLGLTGSTIKTENSVAFGVLNDKGTVNLQGGTITTKGQTAYGVYSSGLGSNTDIHSSEITTSYSLTHAIYGAGGTGLTLNNTTLNTSGSGSYGIYLNGPGGSLTGADNTINSTHATNGAGIYISSGGSNATLDNTTLNITKGAVGVNVGEGSSITMDGLIATGNITNLFKVNGNASVSNANIELAAGGLLMAQGHSASNQAVIILNNVDAISNGGGTTLVDVNKDADVTINGGAYHSKGNNAKGIWVRDNNSSLNVDNVVIITEGVNATAIENRGTAIVKNTTVITQGNNSHGLYSEQSLDATNMAISTAGIGSIGAAAAKGGNLNLNDALIETTGNSGMVLGTFADSSISAKNITGLSTGAGAYALWVDDGSSILLEESQITTQGQGAGGIYASNTGTGSHTAYTQVTLNNSQIHSEQGPGIWANGADINVDVKNGSQLTGGNGLLIYASSNAGAASNVNVNGDNHAVLLGDIHAAENSNINLALNNNSVWTGAATNAKQVDIDSSSIWNLTGDADVESMHVLGQMNFISNSSDTNSRAPYDNFSTLTINSNVTGSGSFTFNVQLGDNDSPVDRLYVIGNASGDHGVQVINQGGLGALTTGDGINLITVDGETHSGSFTMSNSVSAGAYEYFLYKIDDYRWNLQSNLINPGPGPEPEIEPEEIAYRPEVPGYIAAPWLNAFYGFTTLGSLHERRGSAEGAAEGFNQDSWGRIRGQHNNFEAGRFSYDSNIWFMQLGHDVYQAKNAAGTQVTGGMMITLGKQNSDTRDRARAINPDLSIDTGKIKTEAYGFGGYYTLMTEEGGYLDIVSQATLYRNNYESQHNTKHNGYGVVMSAEVGQPYPLAAGWVVEPQGQLKYQYLHLSPKNFNDAISEIGGTDYSVGQVRAGLRLFSDASEKRDIKPYLTTDVLHQLGRNPQVTVATVDIRPDFTKTFWQGGAGVTAKVNSQVDLYADAKYQKSFDGKLDGYLGNLGVKVSF

SEQ ID NO: 6441 - protein, 1162 aa, Bacteroides uniformis ATCC 8492
MNEDRKKRGIKNHKILMTVAICALFLGSSNTFAARSTSHENHGVTEQMQSVAVNVLVVDAQGEPIIGANVVEKGTTNGGITDINGKIRMNVKAGALLQISFVGYTTQEIKATPNLRVVLKDDTELLDEVVVVGYGSQKKENLTGAVASVNVNQTLEGRPIADIGRGLQGTTPGLSIQVPSGEVGSDPIIKIRGQIGSIEGEATPLILLDNVEIPSIQMVNPDDIESISVLKDAASASIYGAKAAFGVVLITTKKGAKSDRVNVSYQGNLSFQNMAKEMKMGQFNALEYSVEAMKRSGKTATGGISFFMTESGLERAREWQNKYGGKLGPDDPYVYGRDWYVDANGRNIGLRTFDPYDYMIREWAPTHSHNVSINGKSGKTTYNIGLGYLHQNGMMKPAKKDDFTRYNASVRLSTEINKYLTIRAGSIFSSRDKRYPYSTSFTTADPWLYLYRWGPNMPLGVNEGGNDLRSPWSETKQANTASQVDNYLNISLGTTVNVTKDWKFDFDYTYANETGVIKKPGTRYSAANAWSAGVPRTDANGNQIYVNNLGQQVDAAAEGAMPAYKLPYEEYTPHGSNPDHIYRKSSGARRHTFNATTDYNWQINDDNNFKFLLGMNLVTYDYEDNWSQITDLTDITNPQFDLAVGTQTASGNQKWEGQMGYFGRINYNYKEKYLLEANLRYDGTSKFPSGMKWRWFPSFSAGWRLSEEAFMEWAKPALNSLKLRGSWGIIGDQTVDNGLYVSSLGTGQVNWLGADGQKLFYRGTPSAVASSITWQDIATLDLGFDARFFHGDFGVTFDWYQRDTRNMIVPGSGIAYTFGAAAPKGNYGSLRTRGWEVSLDYNHRFNNGLGINAMFTLSDAQTEITEYSDTRLISDYYVGKKYGEIWGYRTERLYQKDDFVYDNNGELVTVWALNGKEVAAGTPGAKEMNKLKDPNGVYQDFLQSGDFKFGPGDVKYADLNGDGKLGNGAGTVEDPGDKEIIGNETPRFEYGIRLGADYKGFDFSIFMQGVGKRQIWGNGFLAIPGYNTADGAIPDAIASDYWTEENTGAFYARPWNQSGSNDAYNYYKQSRYLLDMSYFRIKNITLGYSLPENIIKKVRMQKARIYLALENFFTFDNLNGLPIDPEAISGYSMFNAENYNSGRTGVGTPTFKSVSVGVQLNF

SEQ ID NO: 6442 - protein, 1161 aa, Bacteroides uniformis ATCC 8492
MNEDCRKRGLSNKKILTVVAISTLLLSSGNVIATQTTIDGSLRVTEQLQTQIVNGLVVDVNGEPVIGASVVEKGTTNGGITDINGKFTLNVKPGSTLQISFVGYQTQEVKATKTVKVVLKEDSELLSEVVVVGYGTQKKANLTGAVATVDVNKTLDSRPIADIGRGLQGSVPGVNITIPTGEIGSDPLIKIRGQIGSISGNNTPLILLDNVEIPSIQMVNPNDVQSISVLKDAASSSIYGSKAAFGVILITTKSGAQTDKFEVSYSNNFSWQDPAKSIEIGGIEALQYTLDAQINRGEPMPAGGFWRISPESLEKAIEWQKQYGGKVKWNDPVVYGRDWYYDGKDKYGYRLYDAAKAMVRNWAPTMSHNLSVNGKSGKTSYNIGLGYLDQSGMSKTAKKDDFKRYNASVSVTSELNKYLTVRASSIYSDRNKRYPGIGNTSADPWLYMYRWSPLFPMGVTEHGNPLKEPSYEMAASNTDNLQNKYYNVNLGFTLNITKNWDVKFDYTYDRQTSETNSSVTQYEAGATWYAPTAWIENGSQVFVNEQGERVDTGGMPAYRFPVEKYYNSSGPGASQVGYQNKSVDNNTFNIYTTYNLQLGAEKEHAFKFMVGMNRVTSKWSLHKGWKTNLIDLTNPQFPLASGDQFIEGDRNWEAQLGFFGRLNYSFEDRYFLEANIRRDGSSKFPKNLQWRWFPSFSAGWVFTNESFMKPVENILSFGKFRASWGSIGDQTVSNTLYKAILADGQSSWLDGSGNKMPLYGTPSLVDSDISWQEIETLDFGVDLRFFKNKFGVTFDWYRRDTKNMIIEGESLPVTLGATAPKGNYGSLRTKGWELSADFTHRFSNGLGINVMASISDATTYITKGADYLTPWEDRKLGTTYSTGRRYGDIYGFVTDRLFQKEDFVYGADGQIEKITVIYNGTAHTTNKQSSPYPVYQVHYEDNNKLIFAPGDVKFVDLDGDGYITPGTGTNGNPGDQTVIGNSTPRYEYSFRLGADYKGIDFSIFFQGIGKRQIWGSGQLAIPGYNAKEGALPKTFTTDYWTEERTDAFYPRAWNLGGSNTGFSMQKQSRYLLDMSYLRIKNITLGYTFPENLLSKVYISKARLYMSLENFFTFDKLNGLPIDPEAISGYSMFRSDSNYNLGRTGMGTPVFKTLSCGVQLTF

SEQ ID NO: 6443 - protein, 1100 aa, Bacteroides uniformis ATCC 8492
MKITLFLLLFVTFQAYCENGYSQSAKISIPRSTLKVSELLTQIESQTDYLFVYNKKSVDTKRVVNVDATNQPVSEILDKAFEGTGIHYVVEGNNIVLTKNITEHASTQQQKQITVKGVVTDMRGEPIIGASVVEKGTTNGTITDLDGNFTLKVPSDAIINITYVGYQPQSLSVSGQTTFKIKMEEESMALEQVVVTAMGIKKKAASLTYSTQQLGGDELTRAKDPNMIAALAGKSAGVQISKSASGLGGSAKVSIRGIRSANEDGNNQPLYVIDGVPMLNSTTESVSTVMGGKNDGVNRDAGDGISNLNPDDIESMSILKGASAAALYGSQAANGVILITTKKGKAGIQRITYSSGLTVDHAISLPEFQNSYGAKAGSSWGEKENVKDYDNAGNWFNNGVTAINSVSVMTGNEKLQTYFSYANTTAKGIVDSNKLRKHNLTLRESASLFNDRLKLDANANLMVQTIKNSPTSGGIYLNPLVDVYGFPRGQDLSEYATNFEKFDENRNMPVQSWFTTPSEWTQNPYWVKNRILNNNKRYRALASLTANLKATDWLNLQARGNVDYVSDKFDQKMYASTSPAIVGNNGRYVYADTQNFLIYGDVMAMFNKHFGDFSVNAALGGSINVQTENSLTLDSKTASLYKPNLFTVPNIVMNTSASAEQVIDRRRTIQSVFATAQVGWKDALFLDLTARNDWSSTLSHTNSVDKGFFYPSVGLSWVINESFKLPQWISFGKIRGSWAQVGNDLPIGITDLSDIIGAGGKLQAVDVYNRGDLKPEISNSIEFGLEWRLFNSRVDFDFTYYKTDTKNQLLKVPTSAGEDYAYRYINAGKIRNKGFEITLGATPVLTEDFRWKTTFNYSQNRNKVVELAPNYTSFVYGDPGFSMAYMMQIKEGGSLGDIYGNTFARDEQGKIKVSDEGKPISESGNKTYLGNCNPDFLLSWANTFTYKGFSLYFLIDMRKGGDVMSLTQATLDGRGVTKATAEARDRGYVEVDGTRFENVEGFYSVVGDRNGISERYMYSATNIRLRELSLSYSFPSTLLAKTKVFTGIDVSLVGRNLFFFYKDAPFDPDAILSVGNTNQGVDVFGMPTTRNIGFNVKFTF

SEQ ID NO: 6444 - protein, 617 aa, Bacteroides uniformis ATCC 8492
MRKTFLAITCASLLSPTFYSQAQEVSADETVVVTANRFKQIDGAVLAQTVTVTKEDIKRLQANSLFDVFRTLPSVEVAQYGGRGQSASIYVRGGSSSQVLVLVDGVRMPRAIMGGIDFNQFPINSVERIDYIRGARASIYGSEAISGVINIITRAPINDDSGRVSAGYGSNNHKKGTFVVSKPVGEGKHFKGVLGYEKTDGFNVKPQPGLNDGDEHGFETLNLKLGYQQNFSDNLSGYVGVSAYNNEYDYDNSSIWSGHEKKTGEVEYVGTDLSLEYNKDVYSSELKLAYGQQDNYDHKSGQNKSTGDHVAIEQFNAIWLNSYSVNEELSIGGGLDYRTEKLAKGYIAPSDRGPAKDYDPEKNPRTNFGVSAIAQYAYDVWTLEASVRNDDNNQFGNNTTWQTAAGWSFYEGYELTLSHGTAFRAPSFVDLYYPGYEMPNLKPEESENTELSLSGAVSIVDWTVTGYYNEIENMLIWEGAGMQNVGEAEIKGVELEVKLDTDIVSHEFYLDYKDPVDKSGAEDTQLAYRSKRGAKWNAYATFDQWTLGSQYLYQGERFNGSTRLPSYSLWNFTASYAVNQNWDINAKLSNAFDKDYEMYVGYVTPGRQYFVSADYRF

SEQ ID NO: 6445 - protein, 1088 aa, Bacteroides uniformis ATCC 8492
MNLNFRKTALLAGICSVFSLGYAPQLFAVSSTDTVEAVQQTKKITGVVSDAMGPIIGANVLEKGTTNGVITDIDGNFALNVKPGATIVVSFIGYVSQEIKITNQTTVNITLKEDSEMLDEVVVVGYGTMKKSDLSGASVSMSEDKIKGSIITNLDQSLQGRAAGVTAVSTSGAPGSSSSIRVRGQATINANAEPLYVIDGVIVQSQGQSGSSYGLGDALGNGSVSTISPLSTINPADIVSMEILKDASATAIYGAQGSNGVVLITTKRGKAGEAKFTYDGMFAVQRQTKRLDMMNLREYATYYNDLANMGEISDPSNYYADPSLLGVGTNWQDAIFQTALQHQHQISAQGGTEKIQYYVSASYMDQDGTIIGSNFNRYSFRANLDAQLKKWLKLGLTATYTATGDDLKLADSDEGLINYSLTTLPDIPIYNLDGSYATVVREGYTNPNPIALAMMDDILLDRQKLTGNIFFEVTPIKNLVWHAELGYDISSSKGERYKPMVDLGGWVRSSNESNIQKNSSTFWQLKNYVTYSGNIGDKHHYTAMVGQECWESSYDFTSVFNSGLPSDEVHNPALGTGTPTINAGFGSSSMASFFTRLTYNYADRYLGTYTYRYDGSSNFGPENRWAGFHSLATSWRFSNETFFEPLKKVISNGKLRLGWGQTGNANIGGYAWGTSMSRMPSGLGMGYRPSNIPNTSIKWESQEQWNVGVDLGFLHDRINLTVEWYKKTSSDMLMPLQLPSYMGTSGNASSALAAPKGNYGDIENTGFEISLNTHPITGKFEWDSDFQISFNKNKLKGLAGTANAQIVGYGQWTDVVSVSSVGESLYNFYGFVCDGVYKDLEDLQTSPKPAKYPANGVFDRTNTVWVGDVKYKDISGPDGVPDGVIDDYDKTNIGSPMPKFTFGWTNTFRYKNFDLSVFINGSYGNKVYNYLSMKLTHMNSPWTNQLNAVNGRAQLVPINPNKVYEDGTMWYNDVSNVMVANPGASIPRATINDPNDNDRISDRYIEDGSYIRLKNISLGYTFPKKTIDKLGLSNLRIYANIQNLLTITGYDGYDPEIGASTSSVNVYGLDNGRYPSPTVYSFGLNVSF

SEQ ID NO: 6446 - protein, 785 aa, Bacteroides uniformis ATCC 8492
MNLNDNRFASNLTIKPLAFAIACAVSGQAFAAQEPEQAEAKQTAVKGIERVSVTAQKRISTLQETPIAITAFNAEAIENLGIEDISDVNAQAPNVKIFPPYGSTFNVGMDIRGLGTSEPSLAIDPKVGIYLDGVYLARNSGAIFNIVDLERMEILRGPQGTLWGKNTTGGALNLVTRKPSDDFQFKQKVTVGNNSLLSSTTSIDTGAIGNFTARLTYMTSEHDGWATNTFAGAKEKNLGAEDVDALRVALRYTGGDFTVNYSYDNTDGSSVAMPVQISNVRPQYTDPNVPTMDLSTGKLYAGNVFAMMAANEKAPGRQTEFELDQHGREYVDIEGHNLTFEWDFSDNHTFKSISSFRSYDSDLSEGYDTDGGAYFAPALDFSTSPPSVDTSDVLAIPAFQYTSVKSQEQKSQEFQLLGQFLEGDLKYVAGYYYFSEEGEENNPWNIGIFTGQGANVLFTGSLPWGSFYKVNAKSSALFTNVDYKLTDELNVVAGIRYTKDTKSLTNVAKHDAMLRNDLHSETDWSKTVGSLLFNYVVDQDLTMYASISQGYAAGVYNPGSIDRFAYLNPANMGEANYEGTLTPADPEDTTAYEVGVKAMLLDDRLMLNTAVFLNNNTNLQKTIFDGSIRRSLNTGESKNKGIEIDAKFAATDSLFFTTSLGYLDTKYSDITFTDNTSYSASVAMNWTIAELDFGNLALNTNYVMVDDYQFSVSDPSLVGDNYQLLNARLTLSDIKIGERSNLKVSLWGKNITDEEYIVFGSNFNFFDAQAYGTPRTYGIDVSFEY

SEQ ID NO: 6447 - protein, 498 aa, Bacteroides uniformis ATCC 8492
MKQNLKPFKTMKENLMTQSKKARFLAPLSLALILSFNQAGAEEDGGFMTFGYELGEIVQKVSNPGKIKAEELASLLNSSTTTNTSYESTGGNVVGTLGNLFMRQSALLIDAYPTLKNESASACSNGNSNSNGGSCVRGSQQNLALYKSMLATSLQQQSNLSKLVFQGLNNTTSENLSSQISQLNTLGVYVTFMNSFLNANSSQIGLFNNISQISQITDVIAKSSAILGPSGEGGSTGSFLEAALAQHVFNSANAGNDLSAKDFTNLVQNIVNTSQAALAGVSQANFSGPLISALFSNASQTLKKVTTLNDGLKSNPWLGNFAAGNSSQVNALNGFITKIGYKKFYGENKNVGVRYYGFFSYNGAGVGNGPTYNQVNLLTYGAGVDVLYNVFSRSFGSRSLNAGFFGGIQLAGDTYITTLKNNPQLVSSPTPTKFQFLFDLGLRMNFGILKKDLKSHNQHSIEIGVQVPTIYNTYYKSSGAEVKYYRPYSVYWVYGYAF

SEQ ID NO: 6448 - protein, 1030 aa, Bacteroides uniformis ATCC 8492
MKQKSNLFKTLGIMLLFVLFATQANAQNITVTGTVSDNLGPVIGASIQVEGTSNGCITDIDGNYTLPNVPSNATLVFSYIGYQTQKIAVAGKTHINVTLSEDSQLLQEVVVVGYGVQRKSDLTGAVASVKTADALKSTPTGNVSDALQGRMAGVSVLSGSGDPSGDNTIRVRGINSITAETGPLVVIDGFIGGSLQSLNPADIASIEVLKDASATAVYGSRGANGVILVTTKNPEKDKLTVSFNAFANIKTVAKYPDNLSPYEYANLVNDYGKEYFGYGDNHFYSPEQLEAFKSGKAGYDYSREIFRSPAVTQNYELSIAGGGEKTTFLASLRYQDDQGIIKESGSQIYSWRLKVDTKIKKWLKAGLNIYGHYRETSKPRITEYDGLIQQSMYFPSTIEPKNEEGEYNNSFFDGGKAYNPMGYIWESSNSNKTINNRIQGYVQFDILDGLSFRSQLGVLFDNRLNTSVENEDSYYSYKNSLTQGQARSYWNTSWLNTNTLSYVKEFNENHRINATAVFEQSYDNNYNHTGTGYNLDYIDMIGVNNLAWSDSNLAAIASDRSINTLMSGMLRVNYVFMNRYMLTASIRADGSSRLKDKWSYFPSAALAWDLKQENFLKENSFIDQLKLRLGYGSVGNQAVEAYRIYSKMTPVTVTTPNGSSSTAYKIDRPAAPFLKWERNDQFNVGVDFGILNGRVRLTADWYSKLSKDILLEVARPSHMGYTAILDNAGEIKNTGVEFTISADPFSDKEFSWHTDLTLSHNKGTFNKIPTANHRQQQAGNFQNQIFQMIEGEKLGSFWGYTFAGVWQEDDVNAPFVDANGQTNGKTNGEVYKVKPGNSKYVDVNKDGVYNDADQGIIGCGQPTFNWGWNNTFNYKNFDFSFFVVGFHGFDIYNATHQMGYNLIKSQQMAGVTPMRELLNRWTPTNTNTDIPGFVKGGTENKDFFSTRFVENGSFIKMKSITLGYTLPEATCRSLGINNLRVYASVQNPFHITKYSGLDPEATMGSPLVQGVDWGAYPNSRNYLIGLNFSF

SEQ ID NO: 6449 - protein, 1026 aa, Bacteroides uniformis ATCC 8492
MKQKSSFFKALGIMLLSVLFATQANAQNLTVTGTVTDNLGPVIGASIQVEGTSNGCITDIDGNYTLPNVPANATLVFSYIGYQTQKIAVGGKTKIDVKLAEDSQLLQEVVVVGYGVQRKSDLTGAVASVKAADALKNTPTGNVSDALQGRMAGVSVLSGSGNPTEDNTIRVRGINSITAETGPLVVIDGFIGGSLQSLNPSDIQSIEVLKDASATAVYGSRGANGVILVTTKNPSQDKLTVSFNAFANIKTVAKYADNLSTYEYANLVNDYGKEYFGYGDNHYYSAEQLAAFKSGKAGYDYSREIFRSPAVTQNYEMSIAGGGEKTTFLASLRYQNDEGIIKESSSQIYSWRLKVDTKIKKWLKAGMNIYGHYRETSTPRVNEYDGLIQQAMYFPSTIEPQDEDGNYNNSFFEGSSTYNPMGHIWEADNANKTINNRIQGYVQFDIMDGLSFRSQLGVLLDNRLNTSVQNDKSYYAFKNSNLSQGQARSYWNTSWLNTNTLSYVKEFNANHRVNATAVFEQSYDNNFNHTGTAYGLDYIDRIGINNLAWSNAELATNSSDRVINTLMSGMLRVNYVFMNRYMVTASIRADGSSRLVDKWSYFPSAALAWDLKQESFLKDNSFIDQLKLRLGYGSVGNQAVEAYRPYSKRTPIRNSDGSTSYKVDRPAAPYLKWERNDQFNAGVDFGILNGRIRLTADWYSKLSKDILLDLAQPTHMGFPSLLMNSGEIKNTGIEFTISADPFTGKGFSWHTDVTLSHNKGTFNSIPTANHRQQQAGSFQNQLFQMIEGEKLGTFWGYTFGGIWQEDEVNAPFVDANGQTNGKTNGEVYKVVAGNSKYVDTNKDGVLNDADQGIIGCGQPTFNWGWNNSFNYKNFDFSFFMVGFHGFDIYNATHQMGFNTVSGQNMAAVTPMRDFLNRWTPTNTNTDVPGFVQGGTENKVFSSRFVENGSFIKMKSITLGYTLPELACKSLGISNLRLYVSIQNPFHITNYSGLDPEATMGSPLIQGVDWGSYPNSRNYLIGLNFAF

SEQ ID NO: 6450 - protein, 186 aa, Bacteroides uniformis ATCC 8492
MIKKIACILSLSTSLALAGEVNGFFMGAGYQQGRYGPYNSNYSDWRHGNDLYGLNFKLGFVGFANKWFGARVYGFLDWFNTSGTEHTKTNLLTYGGGGDLIVNLIPLDKFALGLIGGVQLAGNTWMFPYDVNQTRFQFLWNLGGRMRVGDRSAFEAGVKFPMVNQGSKDVGLIRYYSWYVDYVFTF

SEQ ID NO: 6451 - protein, 1067 aa, Bacteroides uniformis ATCC 8492
MRKKEQMFWLASRSRMWRIPLCMAAFSLLPSAYSFASAENPATETVLAVNSVQQQRTVKGIVIDANGEAVIGANVKEPGSTTGTITDMNGEFSLSVGPKATLEISFIGYTTQKVNVGASNTVKVILQEDTKVLDEVVITGFGMAQKKATLTGAVSAIKSTDIERSAASTASGALVGKIAGLNTRMQDGRPGASTALQIRNMGTPLFVIDGVQSDEGQFNNMDFNDIENISILKDASAAIYGIRAANGVVVVTTKKGQQKSKNTVSVNAYYGWQKNSRWIQPADAKTYVNAYTAAETWAGRTDGERKFSREDYDKWMAGTEKGYTGFDWGDYIWKTSPQYYVNTNFSGGSDKANYYVSVSHINQDATVRNYGGFKRTNVQMNVDMKVNDRFKIGASMNGRIESRKNPGVPGGDDYDLPLYSNLKNWPTMGPYANDNPLYPQKVSTDINTNFALLNYENSGKMTDDWRVLQMQATAEYELLKGLKAKGMVGYYFAYREMENHEYPFKLYRYNQANDTYEVAESMNTPYRERIRHRNEDLFSNFQLNFDRKFGDHYINAIAGFEASQRKSPNFNIISTPVANNLNLIQFKEIKTFNDNGNDTQARMGYLGRINYSYADKYLVEFIGRWDGSWKFRPGNRWGFFPSASLGWRISQEKFWQESKLANIFSDFKIRGSYGVVGDDNVSDYSAFDYLAGYDYNRGGSVIDGQYVVGSAPRGLPNQTLSWIKAKILDIGVDMGFFNNRLTAQFDFFRRLRTGIPESRYDVLLPSEVGFGLPKENLRSDLHIGYDAMVRWADNINDFNYSVGANVTYSRFYDWEQYDDRRSNSWDRYRNSIWHRVGYINWGYEAVGRFENWEQIATYPVDIDRKGNRTVVPGDIIYKDVNGDGVINYMDERPIGYRQDGTPNLNFGINLSASWKGFDLSMDWTGSGMTSWMQKWETARPFQNDGNSPGEVLKDSWHLADVWDADSELIPGKYPLIRMNNAETSAYEKSTFWLHNVRYIKLRNLEFGYTLPKALLAKSGISNLRVYLSGTNLVTLTNVPIIDPEGSKDNGLIYPTPRIINLGINLKF

SEQ ID NO: 6452 - protein, 376 aa, Bacteroides uniformis ATCC 8492
MQNTRLRPCVLTAIAAALGCAASGAIAQSSVTLYGTVDAGLQYQNRSAAGGSITEVHSGGISPSIWGLKGSEDLGSGLKANFNLEGHFSSDTGTLTTGPGFSSELFRRQANVGLSGNWGAITLGRQYSPALIGTIGTEVRGFKEQFSNLYGWAYNQLPAPGNAMGAGTNPGNDVGVFIGNALQYSNNFGPVWLGVAYSFGETAGSFRRGNELSLGATYTGPATVGLGYQSTADSGTGETLSRLWSAGVAVPFGAFTGRVNYIGVTNNAPTGQRVSDVKSIGAGLDYKWSPANTATLAGYYSKYESSTHDSSTKSVVLSNDYAFSKRTTLYAQLVYVNAGAVGTVDPLESLKTSIVAGGTAPGAKTVLAGVGLKHSF

SEQ ID NO: 6453 - protein, 1048 aa, Bacteroides uniformis ATCC 8492
MKQVNLGFYRMVLFLLLGLFTSVIAYSQQISVKGIVKDQIGEPVIGANVLVRGTTNGVITNVNGEFILSASKSDVLVVSFVGYTTQEIPVSEKQMTIVLKEDTELLDEVVVLGYGANTRKQDLSASVGIISNTDELAARPVTSTESMLQGQLPGVTIQADGGDPTSTPNIVIRGQGSQNGDNVLWVVDGVPGAPITSMNDIESIVVLKDAASAAIYGAQSGAGGVVLVTTKKAKEGAPTLTYDGTFGFRQATNLIEPLNAEEQVEMRRRSYENAGQALPDGWNVTKNPWVGTTRTDWMDAIFRTAFYQRHNIALNVGTDKSSSRLSLSFDNDQGTLINTYKKNLALRYNGKMQLNKWITISEDLVWKNTTSRSKETDNDAYTGPILSAVYMPASATIYNPLDGSYGGTTTEDPAYIEKYGSNFADAHGDAVNPVRLLEAENLYNKTSDVWSTTSLEIGNVLPGLKFVSRFTYNLQNYYYKKFNPIRDEVGKPNLSNNVQEQSYRMDAWKTENTLTYDNTFGKHTVGALFSTTADHYSKRGLEAIGKDLSSEAVYLQYMAYANSTEVLDYLTGPDANVSMIARLAYSYDDRYFVTASWRRDYAGRLPKEHNFGDFPAVTLGWKISNEKFFKKNDIVNLLKLRASWGRVGNLGSIDYNYKSPLLSKNTYSEQAQYGVTSNQLWNNFAYYSTALNPNLTWETSEQYDLGLDMEMFNNRLSLSMDYFDKRTFNLIQPQPMNWPSTMGLDAMLVNLGEVRNRGFELSIGWNDRINKNFSYFVTGNFSYLKNWVSDIGVKNEDGTPGVWTDDKSFRSVKDIYQTTEGEPLNSFHLIQTAGIFQSDEEAAAYVDKNGKRIQPDAKKGDLKFVDYDGDGTIGFGDRQYMGSATPKTTFAWTLGFTWKKLSFSAMFQGVGGAQAMNVSKYMLLSDVEGNFNRSREILNAWSPDNRGSNIPILSKNDNNGNFSTASDWYLEDASYLRLKNVTLSYDLSDVFCKWSHLNDRNSRLSVFLSGENLATITRYSGMDPECGGWDALKYPVSRVFSLGVKLTY

SEQ ID NO: 6454 - protein, 744 aa, Bacteroides uniformis ATCC 8492
MRRILFPLLALLFADAAAQQADSIQSGNTPLQPTIPLDEVILEAKVIFGSKFQARNRTGSSYYISPEEIRKFNYTDVNRTLRTVPGVNVYEEDGFGLRPNISLRGTSPERSAKITLMEDGVLIAPAPYSAPAAYYFPTIARMQAVEILKGSSQVQFGPYTTGGAINMISTEVPDQFGARLRTSYGSFQSGQLHALLGDSKKHFGYSVEYLNYNSNGFKNLDGGGDTGFDKNDLVAKFQVRINPEARLQQRLEFKFQYSDEVSDETYLGLTQEDFDASPFRRYVASAADRMDTEHSQFMLSHILDLGRSLRITTTGYRNQFERNWYKLNDVTLGGEREGIAGILENPQQFQPYYEVITGVADSPEDALGVKANNRAYLSTGVQTKLDYHWNGENTFHDLEAGLRYHFDEEDRFQWVDGYAIQSGTLVQTTEATRGTDANRISDARAFAAYAMYKFKTGDLTLTPGLRYENITLSRVNYGSSDPGRTGSDLSERENQVDVWIPGMGFNYNLGDVSVFGGVHKGFSPPGNQDGQDPEESINYELGTRFSLGGLSGEVVGFFNDYSNLLGSDLAATGGTGTLDQFNAGEVDVAGLELLLNYNFLPGNQNYQLPVTFGYTLTDSEFRNAFGSEDGLWGEVAEGDEMPYISRHQFHTSLGLEHSRFELHFNARYNGAFRTQAGQGSIPEDERVASNFILDFTGKYHITPNVSLQANVVNLLDETYAVARVPAGLRPGHPFGIYGGITLQY

SEQ ID NO: 6455 - protein, 687 aa, Bacteroides uniformis ATCC 8492
MKKRVFIGAICSLASVGALTSTLAYADTDTTETESTSAVEKISVVGAATNLSITAEDIEQYQASDLADIFRYSPSVSVGGSVGVAQKIYIRGLEDAFLNVTVDGAQQTSTLFHHIGRVTIDPDLLQQIDVQAGAGEATSGPGAIGGSIRFKTKDAQDMLKPEEQFGGRVKANYFSNDGTRYSGSLYGKLSDSWGVLGYYSTIDRDNMEDGNGNEIYGTAADQDMAFLKVSGDIAENQFLSLSVEQRDEEGEFSARPNWAVQEGDALYSSEAQRDTYVANYRFAHSALVHIEATAYQTDSSFRGGRFDWLAEIDTYGFDLRNTSETGQHKFVYGLDYRHDEVTSGSAQGATENAEEGSVLGIYAQGYTDLTPELLLSYGVRYDDYDFEQNILIDEYYGEPVTDVASTLDDSEVSFNVGLAYDLTQEWTVGLGYAQAARGKQIGDGFTIDGYLYDGSDIPVVANDLVPETVENIEASVEYNTHNLNAKLSVYRSSLDDVIFEGYEGNAVFNNIGTLDTSGVEFDVAYRVNGIDLFLGFSSADTELKPRDDLYSVSYSSIDINGYEFVGLGNSRGNTWVAGADYDINPDISIGVSVAKVDSIDIDTLHQAVDLGWTDALYRLNKPSYTTVDIYGKWHITNNLMVNLAVSNLFDKLYIDHSSVGDYSEVFATVIGPYEAGRDVRLSVSYDF

SEQ ID NO: 6456 - protein, 1085 aa, Bacteroides uniformis ATCC 8492
MDIGINAKKVCLFLAAGSCSFYAFAQEKTVTGSVKDAQGEPLIGVSILVKDTRVGTVTDIDGNFRIPNVKSGQTLVLSYVGYKTQELTLKGNLNTPLSIVLKEDTEILDEVVVVGYGTVQKRDLTGSVASVKAEDLAVVPVSSVSEALTGKLSGVSVTTTDGAPDAEVNIRVRGGGSLSQDNSPLYIVDGFPVSSISDISPTEIESIDVLKDASSTAIYGARGANGVIIVTTKSGHEGKTQVDFGASFGMKKVAKMMKVLSPYDYVAYQWELDSQDYGNYSDIDIWKSVEGQDFQDEIFGRTGTQQQYNVNVSGGGKDVTYNVSYAHNEEKSIMLNSGFVKDNINAKIKATLSKWITLDFNARMSYATVDGLSGGADTNESNASNSIVANAARFRPVNPLSYDSSDTEDNNTTTQKNPLERLEATYKQKRTFNQNYNVGLNWKPFKNFTFRSEFGYGWKYENIDQAWGADATQYTNLGEKGKPEAVFTNATTRSWRNANTLTYDNKKLFGGRDKINVLVGHEVSSSQKTSLESTSIAFPTSMTVDEILASSGIGTPLANQSTIGAKENMLSFFGRVNYTLMDRYLFTVTVRGDGSSKFAKGNQWGVFPSAAFAWRLSDEKFMKSAQNWLSNLKLRLSLGTAGNNRINSGLIYTTYTLASNTSKAPFFNEVRQSMLELSDNLYNPNLKWETTITRNIGLDFGFFNNRLSGSLDLYWNTTKDLLMRSEIPSNTGFNYQYRNFGKTSNKGVELTLNAALVEKKNFGLNFNLNLAYNRNRIDELATDNPWQSSNWAGSIISKYEDFRVEQGGSLGEIWGYKTNGFYTAYDPVTNPTGELILNGTTWVLKDGVKDNSATLTGGQYYPGGLKLVCDENGDPVKQKLGNTIAPLTGGFGLDGHVGNFDFNVFLNYSVGNQIVNGTKLATSFYAGSSKGYNLNGDFALANRYTWIDPATGSNLGKLSTSTLQAYGGELGVIARLNEINSNASIYNPAAVTLMQLNDYAVEDASFLRLNNVTIGYTLPAAWTKKCFMQKVRFYVTGYNLLVFTKYSGSDPEVDTSSKKNAMTPGIDYASYPKSRTFVGGVNVTF

SEQ ID NO: 6457 - protein, 1429 aa, Bacteroides uniformis ATCC 8492
MKRNVRNNRMQHTVLALALLAAFGHASDTMAINLTVETPYDLGDSNMSNSTITVNNGGILTGDGASVSGSAYDLILVNTGGQLALDNVELSNDLDSPSGSNGRTITASGNGATATLNNATISISAHSTNPGADYAHAFTAGAGATGGGNVTLNGGTVTASGSKRTVGIQANDGGSINATDVEIVTNNHFGHGVVAYRTPAAEELATEIDLDDVSITTHGENYSVGIQSANKGAHVTARNSQIVTDGVGSFGLESFNGAAIDYTGGSITTSGAGAAAVRVYGGELGAGTIHVDGTQILTTGDSAAGVVAADMVERTSGTAEIDNASIETRGAASSGLESSYGSTLNSTGSSVQTSGEGSHGAYAHDGGTIVLNGDSLSAGGNHAYGMYAKDPGSAIDATNVTVNTEGLYGFGARAENGGAITLKGGSISTDNATGQGTQDGDGSRAYALSADGANSSISAQDGVVISTKGQRAYGAYATNGGHIELGGGSVTTQGFMAYGLYASGNGSTVDANGVDITTSGGVGDGVWAYQGGTVNLNGGSVTVNGEPNANSPHETANGLVAVGGTGSAAAGTINASDLSIVTRGANSAGAKAGATVDTDNTYGVINLERSTITVQGQAAVAAEINYGSTLTATDSTLVSEQGDGIVLNDNASVSLASTRVEAAGASLVSNLNAAGQTQNITVGSGSNLTQNNGTLLQVNRGQEGMDGIVNLTLAAGSSSSGDVVDLDGLDQDSGLRDGGGKTNFTVAQGASWIGIVRGINDLAAEDGGEIINVGGEPIAGNVTGGQDSTIVFQNGADIGGGFSVESGSQASFNGNASIEGNVEATGSTVTFSGPATIGENASFASSSVAFGGPTQINKDLAGGSGSALAFSDAATISGNLSGNNASFAFSQRDDVASRISGNVGLDNNATLKGGSLAAPILIEGNVDVTGGATLGGNLTVNGSLNASGGTISPGNSVGTQTYASISNFGSAYVAEINAAGNSDLVIAQTGDVDLAGTTLAVRQENGNGGYLVNHDYTIVQTIDGEVIGQFADAGLDDSFANTLVSLDPVKYAAKDVKVSLSVDQAKVAGKRENLSSNQNHTLDGVISVAGRNSAADAALTSTDSQAALNQLSGEIHASTQSALLYSGNLVRQTLSDRLLANLGAGSAQGTYPLWAQVTGGEFSLDSDGNAAKARTTSGGLFLGGDAEVGKGWRIGAALGYTDSSTKVKDRASSKADVDSYTAALYGGKSWARSNGKVEFLAGAAYTHHSIDTRRNVNLGGNQTLKADYDAQSFQAFTELGYAFSVGPDSQIGPYLGVAWLNQHTDGFSESGGDAALRGDSRTDTTVTTTLGVRGKTSFELAGTQAYLNGGLGWRHANGDVDTRRTVAFITGAGSSFSVAGAPIAKDAAAVNLGLGVALGKRATMGVSYNGQFGDGQTDNNGSLYLNIGF

SEQ ID NO: 6458 - protein, 1051 aa, Bacteroides uniformis ATCC 8492
MKKLLSVLFLLSFTLASVYAQDIQVKGTVISGADNEPLPGVNVVVKGNATTGTITGIDGEFALSVPSDAILSISYIGFKSLEIPVNGKRELKIVLQEDSEALDEVVVIGYGTQKKSVVTASIARVSSEDLANTAPVRMDNALKGLAAGVTVTSSSGQPGAAAQIRVRGVGTIRTENGAADPLYIVDGMPIEGGLDYLNPSDIASIEVLKDAASGAVYGARAANGVILVTTKSGKIGKTKVTYDFSYGWQSAWKNRDVLNATEYALMMNEGAINAGIAPKYNDPYSYGMGTDWQNEVFNDNAPVMNHQVSVSGASDKVNYLFSAGYYTQDGIVGGNFNRSNYERLTLRSNTQYTLFDESKNRNWLNSLKVTSNLSYARIKSTGIEANSTWGSPLGSALALSPMLTVYDEGDAAQAQLDKYANTTDYTPIFDPRNGKLFSIPGSEFGEMTNPIANLSLPGAKNWSHKFVANFSAELQLWDNLKFKTSYGADLSFWGNDGYTPLYYLRSGGASSRSTAYSEKHDGTVWQLENVLMYDKTIDKHTFSVLLGQSAKKNTGSYLRGTRNNIINYSRPYINASTGQAADGDQTAAGAPSEIATLASLFARASYNYDERYMFQVTIRRDGSSRFGSNNHYAVFPSFSLGWNLTNEKFMERRPEWLTSTKVRFSWGKNGNENIGNFKYTVLTSTGNNYIFGAGEKVINGVKASGLANPDLKWEESEQLDFGIDFGFFNNALTFTADYYKKTTNGMLMEMNIPSYVGESKPIGNVGKMENSGIELEAAYRFRVSDWNFRIGGNLTYLKNKLIEYGNESGWANLDSFQGTGTISRAQNGKPFPYFYGYKTAGVFQNMDEVNAYTNSKGELIQPNAVPGDVRFVDVDGSGSIDADDRTDIGKGMPDWTYGLNLNVSWKNFDLSMMWQGTMGNDIYDATRRTDISATNLPSWMLNRWTGEGTSNRIPRFMLGDNTNWQSSDLYVYDGSYLRLKNIQIGYTLPAALTQKVFVSSLRFYVAAENLFTFTKYHGFDPEISSGGTSLGVDYGVYPQARTWTIGANLTF

SEQ ID NO: 6459 - protein, 578 aa, Bacteroides uniformis ATCC 8492
MKKKSLKLTALFLALSCFPAFAEQTVDIEVQGIRGFRAVRNTDLNVNLINKEEMDGSERYQHLVTKAVDRGLRVFGYYESSVRFERKQRQGKRDLLIAHVTPGEPTKIAGTDVQIEGEAAQDENFNALRKNLPKDGVLVEHQTYDDYKTAISRLALNRGYFDGNFKISRLEISPETHQAWWRMLFDSGVRYHYGNITFSHSQIRDDYLNNILNIKSGDPYLMNNLSDLTSDFPSSNWFSSVLVQPNVNHKSKTVDVEIILYPRKKNAMELGVGFSTDGGVHGQIGWTKPWINSRGHSLRSNLYLSAPKQTLEATYRMPLLKNPLNYYYDFAVGWEGEKENDTNTRVLTLSALRYWNNAHGWQYFGGLRMRYDSFTQADITDKTLLLYPTVGFTRTRLRGGSFATWGDVQKITFDLSKRIWLSESSFIKVQASSAWVRTYAENHRVVARAEIGYLHTKGIEKIPPTLRFFAGGDRSVRGYGYKKIAPKNRNGKLVGGSRLLTTSLEYQYQVYPNWWAATFADSGLAADNYTAKELRYGTGVGVRWASPVGAIKFDIATPIRDKDNSKNIQFYIGLGTEI

SEQ ID NO: 6460 - protein, 1051 aa, Bacteroides uniformis ATCC 8492
MKRKLTLMLALLFVWTGVAWSQGVTVKGVVTSEEDGLPIVGASVLVKGTTQGTITDVDGNFMISGVKADSKTLIVSFVGMKSKEVAIKNTPMHVVLKSDAEVLDEVVVTALGMKRSEKTLGYAATTMKSEDIDAGKSGSVMGGLSGKVAGVQISSAGNTGTSQKVLIRGISSLNNNSPLYIVDGVPIDNSTFRGSPTDDSSTTDFGNAANDINSEDVESVTILKGASATALYGSRAANGVVMITTKKAGVEKLTVTYDGSFTASKVLRVMQTQDLFGQGWGSWNRSENGSWGPRLDGTIHEWGSDQLETPMTKPFSYVEHNLRNFYQTGFEKNNNVSIRYGNDKVGVVASYGNLSSNGILPNNGDQFSRNTFSLRGYMNINKFSLDMTMNYVRKDISRSNDMYMELLQHAVDVDYSQMKDYNDERYNLDNYYTFYATNPYYMIDNYRSNYQDDRVYGRVEMSYEIMKGLKATGRLGGDFSNNRTNSQEPKTTFSNGSYSQLGGATESLGYYSEYRYNRSQIDATALLNADYKIRDFSINAVAGWNLNQRSYGYSGGYVDGLAVADWYSLYNTSSSAVSVTYKELRRLIGAFAQAELGYKDMMFLNLSGRNDWSSTLPAGNNSFFYGGANVSFLITEMLPSLKEHQVDFLKVRAALGQTGNDANVYKTTSWYQIANFKDINGYYTSMPIGGVMGMTSNNTLPSSSLKPEMTTEYEFGLSGSFFGNRLTVDASYYNRMTKDQIISASLAPETAYSYETKNIGKIQNQGVELMVNLTPVRTKDWTWDLGFTFTKNMSEVKELWEGTDEYSYTNWRGVYYVLKVGEPVGMFRIPAANKVMDENSPYYGYNIVNNNGYLSDSNTEYEYVGSSEAKFNMGFNTTLKWKGFTLSASADWRKGGYMLSNTSYISHFNGNSTQTVFNERNSFIYPHSVKVVNGQYVENNIPVRADEMYNALGNYSYSPEVRRHFIIPKDYFRLREVSLSYSFPKSMLAKTPFQQVSLALVGRNLLLFTPKENNYVDPEVSNLGNDLLSEFGETTGTSSTRNIGVNVKVVF

SEQ ID NO: 6461 - protein, 767 aa, Bacteroides uniformis ATCC 8492
MKKYIFFLVSLCCALLPAMADQPEHPELKASDANIIGHVLDKKTGEHLSYITIALKGTTIGTVTDATGHYFLKNLPEGNFVLEASSVGYKTISRNVSLRKGKTLEENFELEEDAVALDGVVVSANRSVTKRRLAPTLVNVVDMKMFENTNSPTLSQGLNFQPGVRVETNCQNCGFQQVRINGLDGPYTQILIDSRPIFSALSGVYGLEQIPANMIERVEVMRGGGSALFGSSAIAGTINIITKEPLRNSGQLAHTLTSIGGSSSFDNNTSLNASLVTDDHRAGLYVFGQNRHRDAYDHDGDGYSEMPKLKNQTVGFRSFLKTSTYSKLTFEYHHLQEFRRGGNLLNRPPHEADIAEQIQHSINGGGLKFDYFAPNEKHRLTVYTSAQHTDRDSYYGSKKDQNAYGKTTDLTFIGGSQYVYSFGKCLFMPADLTAGLEYNRDNLKDDMWGYNRYTKQTVNIGSAFLQNEWKNEKWSILLGGRLDKHNLINHVIFSPRANLRFNPSEDINLRLSYSSGFRAPQAFDEDLHIENVGGTVSMIERAKNLKEEKSQSFSASADMYHRFGAFQVNFLVEGFYTRLSDVFVLENIGERDGILIKERRNGSGAKVLGLSMEGKMAYLSLFQLQAGVTLQQSRYDEPEKWSETAPAEKKIFRTPNTYGYFTATYTPIKPLSLSLSGTYTGSMLVQHMAGYIDKDVAVNTRDFFDMGVKVAYDFKLYKSVDLQLSAGVQNVFNAYQNDFDQGVERDSGYIYGPAAPRSYFAGIKISY

SEQ ID NO: 6462 - protein, 999 aa, Bacteroides uniformis ATCC 8492
MQKYKMPIRLRIMVCLIGMLLPMCMFAQQITVQGVVKDQTGETVIGASVVQKNTMNGTITGIDGDFSLNVPSDAVIVVSFVGYKSLEVPVKGQKQIMVTLSEDSEMLDEVVVIGYGTMKKSDLTGAVSSLGSKDIKDAPVSNLGQAIQGRISGVQVVDAGKPGDNVSIKIRGLGSINNCDPLVVIDGVPTDLGLSSLNMADVERLDVLKDASATAIYGSRGANGVVMITTKRGTEGKGKLSVSANCAFQNATNVPSLLNASQYADLSNDMMVNSGRNPNPNWANPSELGAGTDWMDELLRTGVMQNYTVSYSGGNEKSHYYVSGGFLDQSGTVRSVNYRRFTFQSNSDAQVLKWLKFSNNITFSTDTKDSGSYNIGDALKALPVLPVKNEDGSWSGPEGNSEWYGSIRNPIGPTQLNKSQTKGYNFLANLTAELTFTKWLKFKSTFGYDAKFWFIDNFTPKYNWKPIPTEETSRYKSDNKSFTYLWDNYFLFDHTFAEKHRVGVMAGSSAQWNENDYLNAQKNVFMFDNVHEMDNGQEMYAIGGSSNEWALLSYMARINYSYEDRYMLTATVRRDGSSRFGKKNRWGTFPSVSAAWRISQESWFPKNDVVNDLKIRAGYGVTGSQASVGNYSYLASYNTSVYPFGTTSGNQTALVSSTLANPYIHWEEVAQTNIGFDASLFNSRIVFSLDAYLKETRDMLVKASIPITSGFEDTTTTYTNAGKVRNQGLEMSLHTINLTGELGWETNVTATYNKNKIKDLNSAVPYYINQINNSYVTMLAKDYPINAFYGYVTDGLFQNQAEVDAHAVQPGAEPGDIRFRDLNNDGVINDSDRTVIGNPNPCWFFSMNNNLSYKGFELSVFFQGVAGNKIYNANNIDNVGMAAAYNQTTDVLNRWRGEGTSYSMPRAVFGDPNQNCRVSDRFVEDGSYLRVKNITLSYTFPKQWLQKLQIENARLSLSCENVATITGYSGFDPEVDINGIDLSRYPISRTFSVGLNFNF

SEQ ID NO: 6463 - protein, 782 aa, Bacteroides uniformis ATCC 8492
MKKNSYTRLSIAILSTLYSVSSLADLKSQCLAGVPHFTGELITGNPNDLPVYIEADQARLNQSVSASYEGNVEIQQGNRQLRAQRADISQQKQPNGLQRLAHVRGGFEYQDHQIQLKGEEAQVQLNTKNTDIKNADYQLVDRQGRGKAESIALREDYRLMTNAVFTSCLPQDNAWSIEAKEMRQHIQEEYAEMWHARFKVHGVPIFYTPYLQLPIGDRRRSGLLLPNFGTSNRDGYFYEQPFYWNIAPNLDATMTPKYMSKRGWQLNGEFRYLSPIGEGKIAGEYLKQDRLTDYRNRDRSRHLFYWTHHSSFLQNWRLNLDYTRVSDQRYFSDFDSAYGSSTDGYADQKFRVAYYQPHYNIAISAKQFQIFNEVDIGPYRALPQVDFNYYQNALFDSPLNFKLFSQVVHFDNKSPLMPKAWRFHAEPSINLPLSNRYGSLNIETKLYATHYQQTQGRAAEAEQVERKINRVLPQVKVDLQTVLASQQTFIEGYTQTLEPHVQYLYRPYKDQSNIGSKLNNAYLGFGYDSSLLQQDYFGLFRDRRYSGLDRIASANQFTVGGTTRIYDKKGNERFNFSAGQIYYLQDSRIDNSKENSTYGRSSSWSLASNWKINDQWRWQGSYQYDTRLNKSSLGNFTLEYNPTGNNIIQLSYRYASQQYIDQNLTSAANRYGQDIKQLGLTVAWALTDQWAVVARHYQDLALRKPVEQYLGLEYSTCCWAINVGARRSVTSKENQTANQIFYDKSIGINIELRGLGRDDHKGNIEKMLQRGKLPYLQAFSLY

SEQ ID NO: 6464 - protein, 679 aa, Bacteroides uniformis ATCC 8492
MKQWYLYAAVLGALVLSRPAVSPAMEQTETAETAEEKRSNLARKKEADAKLDEIVVTATRTAESRKDIPASVHVINEETIKSSSAKDVGELLAEAGIGHVHKYNMALATRIEIRGLTTDSSNEVGNRIMVLVNGNRAGTSNIAKIPVADIERVEVVKGPASVVYGSQAMGGVINIITKKGKGELSGSILAEGGSWGYWKTAAELGGTKHNVDFYATASKSEAKDFSSPGHGRIENTHYDTEDLSTRLGYTFLKDHRIAVGFQHWETEHGSPGYWWKPELKNHNDKERNAIDVEYANSTLTAKYYLTLNKDTYNYPSSTPYYQYFSRTRSQGASLQNVFPIGNHRILVGAEWARIELESRRTDGKKLNSPDTRNDNYAVFTEGKLDLFSNRLILTAGMRYDYFDNSMLATANAINATEDVSKTMDHLTFRGGVVYKVNDALSLRGSVGTAFRAPAPLEIAADYNSTGTKHVVGNPDLKPEKSITYEAGIDFNYKELKSSFAFFHTDFSDKIYQYRVSGIDWSYKNVPGAIIQGVEMDVSYDMGWLTGLDMVFQPYANVTYKTRYESSDPAEIAATKSSRLLYIPEWTGAFGIRAARENWEGRMVFNYQGTERILSYENNANGEYTDKGGFLTASIKGSYRPVKSLELSLAVNNLFDRRYEYVNGYAMAGRTFIGGAKWLF

SEQ ID NO: 6465 - protein, 824 aa, Bacteroides uniformis ATCC 8492
MNAHRSRTLASSLPHFRSSTIAYAISRALLGGAVALPLSLTVNSAYAQEAAVRTYTVPAGSLTSALNRFGRDAGIMLSFSSETTNKLQSKGLNGSYTITAGLQALLAGSGLEAVRQANGGYTLQASLQSSQQDAVLAPVTVRAQADETTEGSGSYTTRATGAGTRMSLSLRETPQSVSVISRQQMDDQNLVTLTDVLRQTPGIVVDRVDERVLFTSRGFDLSPMINGIPTLAFNSVAGESGLLSTAIYDRVEVVRGAAGLLNGVGSPGGSINLVRKRPTSDFSGRATVGLGSWNQYNTEIDLSNKLNAAGTVRGRVVGSYTDGDNFIDYKQRRENVFYGAVEADIAPDTIASVGYEFQKNSIKGGNFGQAPLFFSDGSRTNLPRTFNSSTPWSSWDVQQDRFFLNLEHKLNNGWSIKAEAAQTKNKRDRVGGDIWLYPSDVDAATGNASIDQGADQARGTNKSFDVFASGPFELFGRTHSASLGLNVNRYSYSVAGALSVPAWPDQIIHSIYDLRGLPRPDFKYSNGAFGADTTQTAVYGSTRLKPTDNLAILLGGRLTWYRNTDWNMSPTGEKTSAEPNRESSVFTPYAGIVYDLNKEYSAYASYTDIFQPNTVRDSSNSVLDPKRGRNLELGLKGEHWDGRLNTSLAVFQTDEDNVAVVDAGAPLLPDGTAPSRAVKGARSKGFELTASGELARGWQVMGGYTYFAKRDAEKIMLNTTLPRRLLRIATSYRLPGSWSKLIVGGNVSYQSEISYDEYYGLGSSTQGGLTLLGLMARYEIDKNWSAALNIENVTDKYYYSGLGGYNGYTYGNPRNAWLKLSYKF

SEQ ID NO: 6466 - protein, 905 aa, Bacteroides uniformis ATCC 8492
MRKHLIQFLLVAVLLVFTSAAWAQTTVHGQLVDAETGEPLVGAAVMVEGTTQGSVTDIDGYFKQSVASNATLLFKYIGYKDQKKKITQKGASVELGTIKMQPDAVMLSDVTITSSVAVARKTPVAVSTVDPVFIEEKLGSQEFPEILKSTPGIYTTKDGGGYGDAQTRIRGFKSENVAMMINGVPMNGMENQKVYWSNWAGLSDVTRSMQVQRGLGAAKVSVPAVGGSINIVTKSTEAKRGGFVSYGMGNDGYNKILFSVSSGLSKDGWAFTLLGGKTWGDGYIQGTDFEGYNWFASIAKRFNDNHQLSLTAFGAPQWHNQRNNQNGLTIKEWQRVQKYMGEKSPYRYNPTFGYRNGQAYNSSRNSYHKPQISLNHLWQIDRKSSLSTALYVSIGRGNGYSGSGDAANRSRWYGASNGLVNNDFREADGTFAYDEVEALNETSTTGSKMIMGKSMNNHMWYGLLSTYTTKFGENFDFYGGIDLRYYKGLHQNVIVDLFGGDYFIDAENRGKILAENNPAAADPNFKNQKLGVGDVYYRDYDGFVMSEGAFAQLEYNRDKLSAFVSGGLSNTGYWRYDRMYYSKDKAKSDTKNYLGGNIKGGVNYNLNEKNNVFINAGFITRAPMFDTSFVNSQNSHARNEDAKNEKIMSFEVGYGYRSGIFTANLNAYYTRWMDKALYDSGDFDYNVDGQNIKDRYTLNMTGANANHLGVELDFAIRPLRWLDINGMFSWGDWRWNGNASGYYYNAAGQLMTDFKGGTLADMSQASNYKANIKMDNVYVGGSAQTTAALGVNIRPMKGLRISADWNFFARNFADYDIDAGNAGFGDEIVVVSPWEIPSYSTFDLSAGYSFDFGKVRATLSGNVNNLFDQEYIADARDGGSHNWETATRVLYGFGRTYSVRLKFNF

SEQ ID NO: 6467 - protein, 878 aa, Bacteroides uniformis ATCC 8492
MKYSITLLSSAIALSLAFAAQAQDGAGTQATDLDAVQVVGIRASLEKSLDTKRNNTGISEAITAEDIGKFPSTNVAEALSQIPGVTLDRRFGQGERVSIDGTDPSLNLSFLDGHPVAQAIWLYGEQPSRGFDYTLLAPQILGRAEILKSSEARLTEGSLGGTVLMHTRQPLDLKANEVAASIGYSYSDQASQGKPNAALLYSWKNAAQTFGIAVSAQHYEERVDRRGMEVFGYAPASTFANAAGGVPADADVPNSINAAWFQQDRERDSAVVNLQLKPSEALEFNLSGLYINENFDNYNQSMYSFLTWNAGTVAAVDQLGGVRNGVVTSGHSSANAIPLGGTVIYDNNVRESEVTTKGLDLRGAFRGEGWGLNGQVGQSKSENNDLSQYFIEPFYNGGFSWDTRRGIRFDDPAAARNPANWGSAGGWFGNNGIFSTESKDTYGQLDFNLQFDGVFNQLLLGVRHGKHDERFELNVYGGVTPGTLADVGTIGLTDLQGFYPDHGRHIQAGRNNLLNWIRNSPVDYGAPDPASYLNNSWALEQTNNAAYAQLNFSGGGLRGNLGVRYVDSKTEGSGFVYSGTPSLADAGSVWQTRTRKEDFLLPSLTLSYDTSDDWVFRFAAAKVIAWAPYNQMVNNTFLNDTTLTGSGGNADLSPYESWNFNLSAEYYFAQQAVVAWSVFYKKIDNYIDTSASVERQYNALRDTAPQSWAQLLGSNGCTADGYCDYSIQRPRNAGDGKFKGFNISFQQPFGDSGFGLTANYTYAAGENNTGDALPYQSRNSLAFSPYYEKGPLNARLTYNWRDSYLAGGYVAGAAPASVDDYAELGASIGYAFSPNWSLQVDAQNLLDEQYLQYLGDKDHLAGRYKSGRRYMASLHLKF

SEQ ID NO: 6468 - protein, 856 aa, Bacteroides uniformis ATCC 8492
MLKRVGCALQSVFVLNRLHIMKKNKSTFTINFITYSLMLSLAGVPVYAVDFNTDVLDAADRQNIDFSRFSRAGYIMPGQYQMEIRVNGQDISPSAFQIAFLEPPFSDSDNEKPLPEPCLTPEIVSRMGLTEASQEKVTYWNNGQCADFRQLSGVEIRPNPAEGMLYINMPQAWLEYSDASWLPPSRWDNGIPGLLFDYNINGTVNKPHQGKQSQSLNYNGTAGANFGAWRLRADYQGNLNHTTGSAQGTDSQFTWSRFYMYRAIPRWRANLTLGENYINSEIFSSWRYTGASLESDDRMLPPKLRGYAPQVSGIADTNARVVISQQGRILYDSTVPAGPFTIQDLDSSVRGRLDVEVIEQDGRKKTFQVDTAYVPYLTRPGQVRYKLVSGRSRTYEHTMEGPVFAAGEASWGISNTWSLYGGSIVAGDYNALAVGLGRDLSKFGTVSADVTQSVARIPGYDTKQGKSWRLSYSKRFDEVNTDITFAGYRFSERNYMTMDQYLNARYRNDFTGREKELYTVTLNKNFEDWKASVNLQYSHQTYWDRRTSDYYTLSVNRYFDAFSFKNIALGISASRSKYLNRDNDSAFVRLSVPWGTGTASYSGSMSNDRYTNTVGYSDTLNNGLSSYSLNAGVNSGGGQPSQRQMSAYYNHNGSLTNLSASFSAVENGYSSFGMSASGGATVTMKGAALHAGGMNGGTRLLVDTDGVGGVPVDGGRVYTNRWGIGVVTDVSSYYRNTTSVDLNKLPEDMEATRSVVESVLTEGAIGYREFEVLKGSRLFAVLRMSDNSYPPFGASVTNAKGRELGMVADSGLAWLSGVNPGETLNVGWDGRTQCVVDIPAHPDPAQQLLLPCRQVK

SEQ ID NO: 6469 - protein, 932 aa, Bacteroides uniformis ATCC 8492
MQTQEVTIKPHVKVILKSDSELLEEVVVTGYGTFKKASFTGAASTVNTSTLEDVPVLSVADKLSGNVAGVTFGSSSSNPGSVSSIRVRGMGSINAGNNPLYVIDGTPVTSGDLSEFTYSDAGTDILSSLNTNDIESITVIKDAAAASLYGSRAANGVVVITTKSGKQGKTNVSFRSDWGFSNMAIDYRPMLDGDSRRELLWTGLKNYGLYTGNMSDADAATFADQNIEDFASKPSTGWTDWKDLLFRNGSHQNYQLSVSGGNDRTKFYTSVAYTNQEGIIYKQGLERFTGNANLTHKFGDFEVQVTSQFSKVRQNKTNEATSYDGPVANYAFFQSPSSTPYNEDGTLNNGCGVFGVNPLYEREHSSDVYTLMKAFNTIKLTYNIWDKLNLSEKIAYDYAQGTNDVLWDRHSNNGAPGGVMQRIVNRNDQLNTQTQLSYINSFGLHNIDALLGFETQDTEYAFNYMAGQDYPGDLYELTNAGSTSAETNRQSYRMTSFLGRANYNYADRYYLGLSYRTDGSSRLARENRWGSFWSVSGAWRFIDESFLNPVKSVLTDGKLRVSYGVNGTQPSDYYAYMNLYKYGIIYNGQSGMSIVGIANPDLKWEKNKTWNIGLDLSFIDRISVTFDYYQRKTSDLIYDLPVSQVGGYYDGNYGYTTPQNIGSLKNSGFELTITSTNFRNKDFTWTTSLNMAHNSNKLTKLDGQQNEIVSGPLIHRVGEPYYSYYVYEYAGVDAETGKEMFYLNDGTENARKTTTNISEANKTIVGKHQASIEGGLTNNLKWKFIDLGFTFTYSLGGDAFDYSTWQHSNGGSYLYGGAVPTYYDISKMWTGPGDTNATLPKFEYGSAASLSSRWLMPTDYLRLKNLTLGVSIPQNYISKLGLSKARIYFSGSNLLTWKSKDLFVDPEMRVDGLCTFETPALRTYTFGIELNF

SEQ ID NO: 6470 - protein, 781 aa, Bacteroides uniformis ATCC 8492
MKRHALRRRARSSVAVAALMLPAAAFAQSDQPAGEGQYGGDIVVTATRQSESLSKVPLSVSAFSQEKLDSRGVRSFADVIRQTPGVVFEATSITTNISIRGIKSTAGAATTGVYIDDTPIQFRSLGFSGGNTYPVIFDLERVEVLRGPQGTLFGAGSEGGTIRFISPQPSTTRSSGYARTEFAMTEDGGPSYEAGLALGVPLIQDKLGVRVSGYYRRDGGWIDRVRFEDKGVVADDSNYQDSYVGKIAFAWEPVPDLRITPSFTYQKVYTNDSPATWDNVRADFTVPDAPFSDYDDGRFLNGNRVQEWTRDRFYLPTLNVQYGLGPVDLTAIASYFDRRQTLASDYTIFAQSIFTGISLPLFPDQRAVTALKNTQKITTGELRLASSDRDAMLTWQVGGFYQKAKQTSFQQVDDPSFFKYAPFLAPVLPPLIDGRLVYDQFAKSKDEQIAAFGQVNFKPVDRLTLTVGLRYGQTRFTINSFAQGPVVGPSVTDLGRQKEKPFTPKFGAEFQVTPGTLVYASASKGFRPGGYNPQVGVPCQASDLDPLGYPNGRPQTYDSDSVWSYELGLKTRTGRFSAQGSVYQIDWKNIQQVVSLGGCGFQFTGNLGTARSRGFDFQLDYRLTDDFTFQAEIGYTDAKFLKTFFGGPLAARPLVTKGDHVVAPPWTVSVHGQYELSLREHHDSYVRADFDYRSHQSDPTPGIDPRNGGSDPTLDNAPALKALSMRIGHRIDGIDMSLFVNNLLDQAVWQGRRARDNNNATIYKSHIVRPRTFGATIGYRF

SEQ ID NO: 6471 - protein, 390 aa, Bacteroides uniformis ATCC 8492
MNRYLLAGCAAAALALGAGAANAQAKFEVKVGGDAYFEGGYVNEDRDEGARSVDFRNRFRVIVTPTAKADNGLEYGGRIRMRANSGAGNARTMDADRGYIFAQGAFGQVQMGVTNSFNDATYVTAPQDYLPLAIYDGVTAWIGQTSDIGGGLAGLNGSILNQSLVVENNATKIVYFSPRFAGLQVGASYTPRNDDSHASVNRADLTPVTATGRGFSTTFEDLVEVGANYSNTFGGVALKASAGYYWGNAAGTTTVGASVEDLNAWQVGAQVGYAGFSLGGSYTDFGESGQIQTATSDNEKSRLWVVGAQYTAGPIVVGANYKNGKDAGSLYTAGSRKLEVYEFGAGYTVAPGLTLQAQYDYFKADSDLSTAAADLDNDGHVVLLRTVLAF

SEQ ID NO: 6472 - protein, 775 aa, Bacteroides uniformis ATCC 8492
MKDNRWSPGYRRQLLAVTCLAGSALVAFGTDARAAQTTKHPVSRHHAPVRSTARNTAAPARPAAAPRPHALDASAAETVSVTSSRRALNGGGGMMRVETAPHAVQTVTKEFINMRAPTSTALDLIQNLPSLNVTTPDSSGMEGGQIQSRGLTDLDMGLMVDGAPAAAAKYLSENVDSENLESVSVTPGSSATDLPVMSAAGGVMAEETRTPSQKRGGLIDFSYGTNNLSREFIRLESGEIGHSGVRGYFSFSNTHARSWMGAGINQRKHIDFGLQKDWKNGSNAKFFLSWNSADFIIDNYPTSDQFFRYKHTGQGYGRTNDKTSNNYWGNNNDHWNQIFISAPVHIALPSRLSLDIHPYFSFGQGWDASPDGTTTDSSGATRGLTSYFLQNEYRSVGTVAKLNWEIDRHNTFSVGYWYENTQTIQSYPTSYQMPDGNAASPNNAAYLISAGDKQTAGYEIHSLFVHDTAKYFNDHLTVDAGFKFVMTNIWNKDYYGRQEANRTAPLPQLSIGYRINNHHQVYLNVEGDYRQPSAVDLGWLYTSVAIPKNQYSIKEELGYRYHDDHIIADVAFFNYNVTNRIVDQYVGMNSYKPFNIGSQQMRGFDVMVAARPIHGFSPYASVEYLHATQDSNVFDPYLNTMLHSKGTQAVMAPHVIANFGLTYTYKGFFANGSVHYTGPQSVSIAGDQRIPGYVTDTLSTGYHFKPFLFAQSPTFRLNFTNLTGSVVRTGAMGAVYSAKDPSTVYSGNMASYTGYGNSFMVAPRFTMTGTVSTAF

SEQ ID NO: 6473 - protein, 100 aa, Bacteroides uniformis ATCC 8492
MANLFVDLHTQGPITPYFGGGIGFASLHIDDTYDFENDFYIDDDDTVFAYQAGGGLEVALNRQMSLDLGYRYFRTSEATFANTEFEFESHNATVGLRLKY

SEQ ID NO: 6474 - protein, 377 aa, Bacteroides uniformis ATCC 8492
MQRHLTSQSIRNVCLYKPIPNMEEKVKLKRKSLVVATVSAMFAASAQAQSSVTLYGVADAGIEYVSHAGLDGTGSAYRVSSDNTSGSRWGLRGKEDLGGGLSAVFVLESGFSIDTGTMAQGGRLFGRQAFVGISSHLGQITLGRQNNTLFDLFAGLDPLRYATYSLLSQDAQFAGRPDNSVKYTGNFGALTITGLYSAGYDSNIANGTEVPGSPRVGQEMGAGASYTSGNLGMAIAYDQRRGTSVLNASAVERRYVASLIYTTGPFSAVAGYRYLQGGLTPTTGIRSNLYWVGGGYAITPALRLNLGVYYTDRRDSPSDSASYVLQTQYAFSKRTDLYVNASYMNNKGKSNLGVVTSTTVAPGVSQTGIVAGVRHIF

SEQ ID NO: 6475 - protein, 1033 aa, Bacteroides uniformis ATCC 8492
MKRHLIILTAYLCACLSLFAQQRTLKGKVTDQADNSPIPAVTVTTFDKNGTRHGVLTDMEGNYSIQIPEGATTLKFSFIGMKEVTEKIGNRTIINVIMEEDAITTDEVVVTALGIKREAKALSYSTQGVNMDGINDAKSSNIVSSLSGKIAGVQITPPGMNNGSARIVIRGNNSVTGNNQPLFVVDGMPIDNSDGENGNLDYGNGAADINPDDIENIEVLKGANASALYGSRAANGVILITTKKGGEKFKVNINSNCMFQTLTEFPEYQNAYGVGTSFYIDNKNNPPLSKTNYRSWGSPMMGQPVIGLDGKLKAYLPEPDNVKDFYQTATMWTNSISVEGGNNKNQYRISYTNNHSNSVVNNFNIDNKSTFNLRLNNQFTSWLSLDSKITYIDDRVTNRQYSKSDNKNPMNSYIHMARSTSLSELYTWKDANGNEIGTHRNFSNPYWIINENENKDTKKRVIGSFVLKIDFSKDLSLQAKAGIDTYNWNGYTFNNKGSMNDADGQMQTFQRELENYNIEGLLTYNKRLKKFSVMANAGIIMYSTNQTRYTQKINSLLQPGLINISNSAEYPTDTQELSEKKINSIFGAVSLGFNDYIYLDITGRNDWSSTLPAKNNSYFYPSVGSSFIFSEAFKMDKSIVSFGKIRGSYAIVGSDTSPYRVYDSYSFNGIFNDATLASLSTTMNNPDLKPEKTYSWEIGADIRFFKNRLGIDFTYYNTTTKNQIINAQLPTSSGYQKRYYNAGEIQNKGIELMVYGTPVKNKNFSWEVNLNWAKNNSKVISLIEGVDRFQIGNYSSYIYVYAEVGKPYGYMRGLGVKRHENGKMIMEDGGGLLMKDPDKEFGTSTPDWVGGITNTFRYKNFDFSFLIDVKKGGIIYSASTGKMLTNGMTSETLFGRDDYYIRKEIWGESDSELSGGAWFDAVYSDGTPANKFMSPQSYAYCKPNYAEFTIYDASYVKLRELTLGYTFPNQWMSKIKIQRLRLAFVGRNLWTIHKKTPQGFDPEASQTSGNGQGIENGSLPPNAVYGFDIKLTF

SEQ ID NO: 6476 - protein, 191 aa, Bacteroides uniformis ATCC 8492
MRFIPTLLLTSGLGLIAMNAQAQDAQGNPNTTVSIGYSHGKISGADKLNGVTAKYNYQFDQQPWGVMTNLTYMGGKQRNNITSSNQLYENDVDVDYYSAGVGPSYRINPNVNVYGVVGVAKADTKGTQKQNRTGRIYNIDNIDTNVMYGAGVQYNPAPNWSVDVGYESSRVNDGYDKRSMNAFNVGVGYRF

SEQ ID NO: 6477 - protein, 266 aa, Bacteroides uniformis ATCC 8492
MVCSAAVAADMPIAPPPAYAPPPVEDFGGWYLRGDIGFSNQQVKDLRYGRESAYSQLTSFDQQTSFDAAGIFGVGVGYQFNNWFRADVVGQYRGNSNFKGTDRFTGTAGGVAYNGIDNYGASKSEWLVMANGYVDLGTWWCVTPFIGAGVGAARVTMANFTDTGINNLPFSTTSFASAPTASKWNLAWAVHTGLAYKVNPNLTLELAYSYLNLGDGYTGALSAFTGATTNNSFKFKDITSHDVKVGVRWNLDSAPAYYPPPLMRKG

SEQ ID NO: 6478 - protein, 1026 aa, Bacteroides uniformis ATCC 8492
MIESDYKDVEVSGTVVDAQGLPLPGVSVIVQGTTTGVATDLDGKYSLTVPGPESVLVFSFIGFNSQEVTVGNQTSINITLTENLANLDEVLVVGYGVQKRGTITGAIGEVKADDLIRTPAVTTSGALVGKIQGVTARQTDARPGASTTIQIRNMGTPLFVIDGIPSDAAQFNNLGQSDIESISILKDASAAIYGMRAANGVVLVTTKKGSQNQKAEISLSGYYGLQNFTRYPQPANAFQHVRANAESEVNLGGSPTISPEDLARWEQGTEKGFQSFDYYDFIMKPNVPQSSINASATGGSENTKYFFSLSHLDQDAMIDDYLFQRTNFQSNIDMTLADGFTVGTQLSGRLENREQVGVPGLDDYFNPFLSIFTMWPTERPYANDNPNYVNGDVHNINVNPATYTKDITGYIDEVNRAIKANFYAQYEFDFGLSLKGTYSYSFNNFDFDGFEYTYDGYIYNEDTDVYETRPEWGNQNPWRERRKRNTIDQVAQFQINYGKNWGDHYVSAIAAYERWSNNSHNMVVHTVPPNNYIPLMSFADQDLLIDQIYQEAREGYLAKINYNYKEKYLLELFGRLDGSFLFDEENRYGFFPGVTAGWQISDEGFMDGVKGNFLSGLKLRASWGQTGSDRFIGSNNFIVDPFSYYSGYNFIPTAGGSAILNGSFVPGVDPRGIPVTNLSWITNTNINFGIDSYFFKNKLFVQADIFERRRTGLPAGRYDVLLPTEVGYTLPSENLESDAHRGIEGIITYAATVGDVNFSLSANGTISRLKIVERYKPRFGNSWNEYRTDQEGRWANINWGYQVEGRFESQEEIDNYPVNIDGQGNRNLLPGDFIYKDVNGDGVINGMDERPIGYATGANPYMSFGLNGSVNYKGFDLYFSFAGASMQTFTRNWELRYPFQNNGTSPDYMFEDRWHREDLFNTDSDWVPGTYPAIRRFGANHLYNNNTFWLTNVKYIRLRNLEVGYRLPAPVLDKIGISTLRVYASGTNLFSLDNVKDFGIDPEIGAANGLVYPQQRLFTFGFNITL

SEQ ID NO: 6479 - protein, 1208 aa, Bacteroides uniformis ATCC 8492
MGTYVCEGENTDGIILSGTDIAVETQPGFSIIVPENGDPALSLVGSGTISYLDTNSSALDTTGADSLYIQNDTHTTGQSSSINVQTNGSMGSGINISNHSGADSTVQVDVSGTLFGDLNGSPALLIYSSAENNSTILMNINTIFGDVGIRSDNTSFNGTAITNVDIANDINATYSGATINNSGSGGTSVVNFNSKSIITELDALNIYNTNYSGAVITNVDIDGDVISTTSQATSFYNDAYNGSANFTFRANNVTGEYSGISINNSSHNSANNNHDNAVITDILLTGDLTSTSGSGLQINSYMDDGDIKVSAQLENIYSYYEALSVRADTLTGNLQFNIDVSGNIVAENGLGFMVMGGASEGNSTMIINANNISSGSQALNIYNYSGLGSAFTAVTATGHLVSEQGIGAMFSTYVSQGDATAVINLNDITTAGSGVKIDTIANGGNSTTYLTVVGQINSSLYDGIDLRATATEGNTLVSIDVNNIASEYDAIHLDNKNYTTGADNGTSTIDLITRGALVSQQGYGINIETNTADTYVTVGGLVHGGNGTAIGIHRLDNIQTSATLELQSGYALEGVTQALVFNGSYAEINDAALDLANSHLVLGGAGDAAFDLTRIDNREEAILDGDPNRITGFGTLTKTNNSIWTLTGANMADGDANAFLSANIAGGILVLDNATLGLTPDAGALTGATVNRLSAADIAADPTLVATETGALTLAEGGALSSLGDSVLSGNLISAGGILLSNHYTGGNGAATDDRLTVTGTYFGENNGSGEGAWLALDTVLGDDDSATDRLVINGDATGTTSVRVNNAGGLGDKTLNGINLITVDGLAQDDTFLLAGDYVTTDGYQAVVGGAYAYTLQADGEAATAGRNWYLSSELMLTEGVRYQAGVPLYEQYPQVLAALNTLPTLQQRVGNRYGAPGALADLDFDNNQWAWGRIEGSHQVTDPARSTSGSQREIDVWKLQTGIDVPLYQSQGGSLLTGGVNFSYGKAKADIHSFFGDGRINSAGYGLGTSLTWYGNNGVYVDGQLQTMWFDSDLSSRTAGHAVASGNNGRGYTSAIEAGKGYALGNGLSLTPQMQVTYSRVDFDTFRDPFDSEVSLQEGDSLRGRIGVSLDKETTWSAKDGTTRRSHIYSHLDLHNEFLNGSKVQVSGVEFATRDERQSVGLGAGGTYEWQNGRYAVYGNVNLLGATRNVSDNYAVGGTIGARVSW

SEQ ID NO: 6480 - protein, 688 aa, Bacteroides uniformis ATCC 8492
MSEKSLLIRKPLLVRKHLIVRKPLMIRKPLSVAVAVICTSLSANVLAQKEAQATDEQMVVTATRTEMALKQVPASMSVITAQDIEDSPGITLADIVAESTSVESDFDSTRAGRQMISIRGMDSDYTLIMVNGRRLSSASAIIRGNDFDLSTIPAESIERVEIIRGPMSALYGSDGMGGTINIITKAPENDWSSTINMDTSSPLDGNGGEEYSVGFTTSGALIDDELFARFSLNQTSRDAWQPYTGNGRENITALEERDTLSLLANLTWNMTDNQTIDLDLGYSDDKRDGLAEHATGSNLVDSSVVRNSQAITHSGFWNWGDTQVRYSRENVTDNDAADLGNNYSSDVEELTQIVEASATTYLGDSHTVTFGMDYQLSELTNKENLINGTSEAYQGALFVQDQWLMTEQLTATIGGRLDKHELYGEEFSPRVYLVHQTTNDLIIKGGVGKAFKAPSLTQNQADYTVNSCKGACDLYGNENLKPETSLNYEIAAIYNQPRWNVEGALFRNEINDLIDRNETYCENGGVFESGKGCADTSSSTGYVKGKRTYTNVSEAVVQGAELTGQFQITDEWGVSGNYTFLDTEDKSTGEELLERYKHSGLVKLNWSPTFDLNTFISARYRGERNIESDLTQDAYTTLNIGTVYNVNDSVRLRAGITNLTDEAVSQELESMGYVEEPRTYYVGMTADF

SEQ ID NO: 6481 - protein, 754 aa, Bacteroides uniformis ATCC 8492
MKNFSKLLIALPVFLIFTMSTIAQDTETGLSSNVLIEEVVVTARKKEESAQDVPVALSAMSQEQLEILKFRDFNDLAVGMPNVAMDDIGTTKGTQNFSIRGIGINSSIASVEPAVAIVVDGVYMGVSAGMVFDMFDLESIEVLRGPQGTLFGKNSTGGVILVNTALPGDETKQKARLAVEGGGPGGNNNIMQYSYSGPVSDNLKAKISIHRSDDSGYFKNSYDGSNHGQFEQDTVRLAFLYEPSDSFDMALRIENSDQDGSGPAAQCHLGANGTGCQADDGAAVPAPNSTFDRNSLDFNIDNPGFQKSETDFVTVTMNWHGDNGTWTNVFGKREYSLEVDLDVDARSISFFDAPGSSSMEQISNELRYSGSLTDKLDITSGLFMYEGDVMVWDNRALRGALYAAAGSPGIYLWQSGGGLHNVEQTALFTTLDYAVSDDLSLNIGFRLTDEEKEIHLASINRNVSVGASPPCSVPAGTCPFDYIDNDSWKTTSPKIGFTYNTGESSMMYGYWTRVFKSGGYNLRNSVDLATFPDASPKADDETVETLEFGMKTDFEKGRLNWAFFNTVVDDSQRMTNIQDPVSGVAQVVKNAGDIEYRGFEIDGVYTMTDTVTMVASLGYVHSKYKNLISDLTGDFIIDALDYALEVPRAAPLTYSLGFNIDGNLGTWRSITRISYYHRDKSYYNENNQGFINEQDILNFGYDIYSPDGKINIGIYGKNLSNEVKHGGDTNLSFGGTFAPLAKGKIVGAELVYKF

SEQ ID NO: 6482 - protein, 490 aa, Bacteroides uniformis ATCC 8492
MDIQSFAVLSGNIYMIRKSATGVIVALAVIWGGGTWYTGTQIQPGVEKFIKDFNDAKKKGEHAYDMTLSYQNFDKGFFNSRFQMQMTFDNGAPDLNIKPGQKVVFDVDVEHGPLPITMLMHGNVIPALAAAKVNLVNNELTQPLFIAAKNKSPVEATLRFAFGGSFSTTLDVAPAEYGKFSFGEGQFTFNGDGSSLSNLDIEGKVEDIVLQLSPMNKVTAKSFTIDSLARLEEKKFPVGESESKFNQINIINHGEDVAQIDAFVAKTRLDRVKDKDYINVNLTYELDKLTKGNQQLGSGEWSLIAESIDPSAVRQFIIQYNIAMQKQLAAHPELANDEVALQEVNAALFKEYLPLLQKSEPTIKQPVRWKNALGELNANLDISIADPAKSSSSTNKDIKSLNFDVKLPLNVVTETAKQLNLSEGMDAEKAQKQADKQISGMMTLGQMFQLITIDNNTASLQLRYTPGKVVFNGQEMSEEEFMSRAGRFVH

SEQ ID NO: 6483 - protein, 681 aa, Bacteroides uniformis ATCC 8492
MRQMSVFSLLAASASLATCAHAAHIELEDSTVVAREQRDATAPSIAEKRAEFARIPGGAGIVDADTYKIGRASSPQDALGHATGVYIQSRSGAEESRLSIRGSGLQRTFHQRGILLMQDGAPLNLADGSGDFQSIEPIALDHIEVMRGANAWRYGAANLGGAINFVTPTGKSAPKAQLRTEAGSFDYRRVFGAVAQDFGDWDAYLSVSDYSQDGFRDHARQDNQRYFANIGGRINERLSTRFHVSHVETDSEIPGSLTKAQLRRNPEQAASSAVTGDNKRDFTLNRFGNITTLQLDGGHSLELSSFYSEKSLWHPIFQVLEVDSEDLGVRLTHKWHNAEGWHWSAGVEALQGRNQTKNYVNVAGRRGNLVDRQLQTARSLNAFSELEVPLAEDWALIGGLTWLHSERDVDDKLKSSFNFAGLPSGFRDDSFTRSYSARIGRIGLRHELAEGVQLFGNLSQSFEPPTFSELTGGAIVTENDAQKATTLEAGMRISRGHLDLDLAVYRSEVRDELLGYANPLNPTQVVTTNADRTVHQGIELGAAWQLGNLLLRGQYLLNDFRFDDDPAYGNNRIAGVPSQFLKGELLWQQGGWYVGPTLEWVPLHYAADHAESLYAEAYAIWGMKGGYRPREGLGFFVEGRNLSDKTYIATTGVVANANGRDAALFMPGDGRSLYVGLEWKL

SEQ ID NO: 6484 - protein, 1010 aa, Bacteroides uniformis ATCC 8492
MKQVNLRIYRMILPLLVGLFLSVGVYAQNITVKGHVKDATGLEVIGANVVEKGNTSNGTITDLDGNFTLTVPKGATLTISFIGYQTQEVAAASMVMVTLKDDAELLSEVVVVGYGRTKKDDLTGSVTAIKPDELSKGITNNAQDMLVGKVAGVDVITAGGTPGAGAQIRVRGGSSLNASNDPLIVIDGLTIDNNTPKGMSNPLAMVNPNDIETFTVLKDASATAIYGSRASNGVIIITTKKGKSGSAPKVSYNGDMTISMIQKKYDVLNGDEFRVLVNDIWGDKAGEVGMGNANTDWQDQIFRTAISHSHNVSVSGGLKNMPYRLSLGYNSSDGIVETSWMRRANIGLNLSPSFFDNHLNLKINAKYMYEKDRYADAGGAIGSALSMDPTQPVYFDADDARAPFFDGYFQHTQSPKDFNAEWKYTNNPNAPQNPLALLKLKDVQAAANDFTGNFDVDYKVHGFEDLRLHASYGGQYTESKQDDIISKYSYSNNYFGWNGITQTYKYSVTANAYAQYVKEVGAHNFDIMVGAEESHFHRSGYDYGQGTDPYDGTPHDAKLREEQAWATHNSLVSYFGRLNYTLLNRYMLTATFRADGSSRFSSDNRWGYFPSVALAWKINEEAFMKKLTWWNEFKLRLGWGMTGQQDINSDFGYETHYTSSDSFAQYPFGDTYYGTMRPSAYNPDLKWETTTTYNAGLDLGFLNNRISANIDGYYRETKDLLNSITIPVGMQFGSQLTKNIGSLKNYGVEFSINAKPIVTKDFTWDVSYNIAWNHNEITDLVDGDAGYYAWAGDKISRGNNTLIQANTVGKATNSFFVYQQVYDENGKPIEGMYVDRDGNGRIDNGDRYFYKKPSADVIMGLTTKFLYKNWDLSMSFRASIGNYVYYDFLSNRAMVSQSGLYSNSALHNSTAEAVALGFTGVGVGNDNYLSDYFVRNASYLKCSNITLGYSFPALFKVAGHETCSGRAFLTAQNPFIISKYKGIDPEVASGIDSNPYPRPFSIQIGLSLNF

SEQ ID NO: 6485 - protein, 968 aa, Bacteroides uniformis ATCC 8492
MCVMGVVNPVHAQEQETKELEEVIVTGMRQSILSAQQIKRDSNVVVDSIVAEDIGKLPDRSVTEALARIPGISVSRYEDLGDPEHFAGEGSGVLVRGMSQVRGELNGREIFSADGGRGLSFDDVPAELMSGVDVYKSPSADMIEGGLGGVVNLRTRLPFDSDGQLISATLKGNYGDLIDEANPEYSALYSNRWDTDAGEIGFLVDVSSSKLASRADNIYTRAFLPRTDLDVDGFDTVYVPKGVDWRRNDYERKRTGAYVAVQWAPNADVEFTYTGFTSTHKSRWDENAFFIDSGADSNLFLTSQSTSEGAQPWVFDDGGSLVSGTITTAHNNFGSTDFTTDNTFGVPFGTSSRYSASDATTTDHSLAAMWQVSDRLKISSSLQMVDSTADVDDNTLGLITFPDEITVSGLNGTPSITAGGFLDNLNNYSHGQSMVMRKKNEAKSKALRIDAEYDFEDSIVSSVKAGVRFTDKSAYNAGGDYNWSARYQPWQIGSEDWRPFNHTDDFPRLQNENFVKYIEFDNFQRGGTAVPSSAYLIDHSLLQDMEATTAAIDAITPNGCCSNDFSVFDFTNVDNSNTQNEKTSAIYAMANFNFDDVVDGNIGVRVVKTENVADGYIRFPNSFEVKTGEVDGEGNDVTITPFAADDLPYDAKNDYTHVLPNLNVRWKLTDEVILRFAAAKTIWRPEFNRLKAVMNLSADWAQGQSEVLADEFDPSLVRFSLSADGNPNLVPMESNQNDLSLEWYFDENGGMAHLNLFRKNISNYFRDVPDGNIPSFGGYTNIATSGAANIGSGKIKGAEVGVTKFFDELPKPFDGLGLAANYTYIDSQEDIAEGLGSVDTDGSAFNDIPLAGLSENSYNFVLMYDIEGFYSRLAYNWRSEYLVAVAPNGWNGTDNGITWGLPIYNKDYGQLDLSLGYNFNDNISVNFEASNIGKANTEGVMRQNGAGDHTAYVYSQDVRYGLALRVTF

SEQ ID NO: 6486 - protein, 1142 aa, Bacteroides uniformis ATCC 8492
MFNLKKNLFLEGKMQSLCPGKYLRTLVFLGLSAAPFQLVSAQFNLSLANPSLGSVIKEIQAQSDYQFFYDDKLASVQLESLNMNDSSLQEVLSKALSGKNISYKIDDKVVYLSMDNSTVKKSPAQETTKKTITGRIIDATGEPLIGVTIMEKGTTNGSITDYDGNYSLSVPGNAVLQFSYIGYKSIEMKVEGKEVIDLTMHEDTEVLDEVVVTALGIKREKKMLGYAVQELKSDELNKTGDPSVTSALQGKVAGLQMNTSATGLGGSTKITIRGNSSLSDNNQPLWIVDGVPFSDNNTSDASFYGGVDRGGSAMDINPDDIESISVLKGPNAAALYGSRAGNGVILVTTKKGSKKDGFGIRYTGNFTWSSVAETLEQQERYGQGQIGANGGASYTKETSGSWGPVLDGSPFEAWNGETYAYSKYGNKLKDYFDTGFSQNHNVSISNGTETSHFRASFGASDNKGVFPNEKLNRINIDLNAGTELNKWMSIDGKISLSRTKAEDRPEYGTYGAINQLMGIPHNVRLDDLKQYSTEDAVHVNWYGPSAEIRNPYYVLHQRHNSDERWRAFGYYSTKINFTDWLHLSAKYAFDYYRTRVQNTNAGDAYNNETVPSAITDDKMDRGEENFFESNAEFILMGDRQLTENFRLGFTLGSNFMYQKFESLSAGVGNMLTKGEWMFNAANLLRTAAETGKERAMNSVFGSVQMAWKEYLSLDLTARNDWSSTLPKQNNSFFYPSANLSFVISDFMKSIDKSLPSWVTFAKLRLSAAQVGKDTEPYQLYNTYAYKFDNGILTPDKSNVKLNDNLKPEIATSYEAGLDMKFFDNRFGFDFTYYYSKTKNQIMKVPAAAPWSGGQWVNAGLISNQGVELMLYSTIVDTKDFTFDLNVNMAHNVSTVKELAPESNVNYMFFNGDGNFPVKVGARAGEKLGEIYATTLYKRNDNGDIIIGADGMPMTVTDEAEYVANPIGNIQPDLTMSVSPTFTYKGVTLSAMFDMKFGGDIFSYSEMMATGRGLAKRTENRGEADNYMMVFPGVTENGQPNTTKITASQYYGALLAEDFLYDASFIKLKELSLGYSFPSKMLKKTPLTSLNVSFVARNLCYLLKHTPGTSPEGGYDTTMFSQAIDYAALPYTRTFGLSVSLGF

SEQ ID NO: 6487 - protein, 480 aa, Bacteroides uniformis ATCC 8492
MKTHYLSIALSVALSGCSLIPDYQRPPAPIQAGWPQGEAYAKLKAGTHRPSQTRDAELNWQVFFRDPVMRELIATALNNNRDLRQTALNVEAYRALHRIERSALLPRANTGVGATRQRLPADLSPTGEAGIQSQYDTTLSMSYELDMFGRLRSLERAALQEYLAAAETQRSMQIALIADVAIAYLSWRSDQAQLDLARSTLASYENSLNLIKSSREVGTASALDVRQARSLVETARVQQTLYTRQVAQDMNALQLLLGTKLPADLPISDVLDQPLAALSTGLPADLLLHRPDIRAAEHRLLAANANIGAARAAFFPSITLTAAAGTASHELDGLFEGGSGLWAFMPRINLPIFTAGRLRGNLDYRNVIKDINVAEYEKSIQTAFREVADGLAARGTFGEQLQAQRDLVDNNQAYYKLAYQRYDEGVDNYLPVLDAQRELFAAQQQFLSDRLNQLSSEVRLFKALGGGWDNISSQPLTAQN

SEQ ID NO: 6488 - protein, 375 aa, Bacteroides uniformis ATCC 8492
MKKFLTGGALLLAFPLVHAQSSVTLYGLMSTAIEYINNEGGHSNFKMLSGTMQNNRWGLRIVEDLGGGMSAVATLENGFDGTSGAFQQGGRMFGRQAWVGLSSTQIGRVTLGRQYDMFWDYMQQFEAATAANGLAVHIGDNDNAFGGFRYNNSVKYLSPNWAGFTVEALYAFSNQAGDFSLNRAMSFGASYSHGPIRVAVAYLDIDKPGVSNPSGAATDDYSGTPPFILFHTSPLSKTVGVDRQRQFGAGGAYSLGPVTWNLLVTDVRFRYLDTTSLHLDNYDTSLTYQLTPSVQLGAGYIFTTGNYGNVGDNSSMHWHTGQLSVDYSLSKRTDVYLFGDAVFASGARAVAVTWLNSPSSTKRQINAMAGIRHKF

SEQ ID NO: 6489 - protein, 806 aa, Bacteroides uniformis ATCC 8492
MKELTYSLGIASGMLVALAPAVVAQTVISNIRINPTSLGVEVFLESDQAIAPEVNQRLEGDRLILEVENAQLTDGAILPDFAPQAGLEAIEITQISENTVEIILVGETAAPFVDVLSQPSGLLVQVTPDDFVDNLELIVTATRTEAEEAAVPRSVTVISQAEIARQADLNRDLSSILAKLVPGLSPSTETTSIFGQSLRGRNISVLVDGIPQSTNRNAQRDLRTIDPGVIERIEIVRGPSAIYGDGATGGIINIITKQGAATGAESRSTIGFEFSTTNPEDSFGYSLQHSVSGTEDKFDYVADFAISKTGGFFDADGDRIPPDPLGQGGLADLRSINLFGKLGYNIDENQRLQFSFNYFSDDQDSDFALNPFPSGDKAEARPGLVLPDQPGTENTLVSLAYSNDDLFGSQLNSQLYYRDYSTRFYPFDDDFGTFGGKLYQSEVESEKIGARVDLNTPLAAGDRLSLLWGVDYFYEESAQPADLFDEPTFEASNGLVFERIGTEFLSPPTEQKNLGLFAQLNWNVTDQLVLNGGIRQEFIDVSVDDFTTLAGNDVTGGELNYDATLFNVGAVYALNDNVNIFGNFAQGFSIADVARSLRTSPDGSSVENLRPEAQRVDNYELGIRGNWGNVQASIAGFYSYSDLGTTFDSAFTTIRDPQRIYGVEADLRTQLSEQLALGGTFTYTDGERDANNDGDFESGLPSFQIPPVKLTGFVEYEPIEGWENRLQLLYSAGRDPKGDGFGLGEVESYLTADFISSYDTGAGKIQLGVENLFNAEYFPVIAQVYGGRNQFAGRGRTISLSYSLDW

SEQ ID NO: 6490 - protein, 152 aa, Bacteroides uniformis ATCC 8492
MTKEFLLGLGADYGFIPSSGSNGTNSNGTLQTKVSNRYNVFLAPGYALDKDKLVYLKAGYSSQTIKVTDQSNAGSNSSEIAGGIANGFVVGLGYKQMVTSGFYGFGEANYYSYSGLSSSAKILTDNAGTWNVTGYSPKSSAYQFLVGVGYKF

SEQ ID NO: 6491 - protein, 853 aa, Bacteroides uniformis ATCC 8492
MSMKIAIFLAGALALVAIQPVWAESINQMEVEEQKSLTASVKKRLRTVKEKEWLAQANTAVIQVTGVKANPTDKGVEILLETSQGEKLQITNRSAGNSYITDISNAQLRLPSGESFTFRSDKPIAGITEITVTNQDANTIRVSIVGETILPTAELFDSDEGLIFGLTSVTASLPPQQPETQSEQPSPAAEEPIELVVTGEKDGYQVPNTATVTRTNTPIIDIPQSIQVVPRQVLEDQQITRVDDALRNVPGVLGSTNAFIGNQITIRGFSTSNLPILRDGFRIYENFSFQETSNLERIEVLKGPASVQYGQLDPGGVINLVTKKPLSEPFYEIQAQFGSYGLIRPSFDVSGPLTDDGKLLYRLNATYQREEGFRDFNTETERFFIAPSLTWKISDRTNVDFSLEYLDSTRPFDTSLVAFGRSVADVPYSRVFNDPDDFIDTKSFSIAYNLEHRFSDNWTLRNSFRYLQQDLFTQATLAGSLNETTGILTRTYAQREYKSDDYSLQTNVVGKFTTGSIKHTLLAGVDFNRGLLDDLVFRGTRTTLNIFNPVYGVPPRTDFSTLPPATPFKNETTRLGFYLQDQIALNNQFTVLAGLRYDTVDFKDTFTDESKYDSAWSPVIGLVYKPVENLSIYTSYSRSFVPSFSRDANGDFLQPERGAGYEVGIKAELLQGNLFATLAYFDITKQNVSTADPDVLGASVATGEQRSRGIELSAVGTIAPGWNIIAGYAYTDAEISKDNTIAVGNRLPGTPKHSANLWTTYEIQKGSLQGLGFGLGVNYVGKRFGNFQNDFEVDSYFLTNAALFYRQNNWRVGLNFNNIFDINYISSAATLTRTRSIEPGQPFTVVGSISLEF

SEQ ID NO: 6492 - protein, 676 aa, Bacteroides uniformis ATCC 8492
MLLLSKLAPALMICTIPFIGLIDPSWGSEHEDLNLSELGLEDLMNIQVTSVSKKQQKLSDAGAAVFVVTREDIRRSGATSIPEVLRMVPGIQVARLDANKWAVSARGFNDRFADKLLVLMDGRTVFTPLFSGVYWDVQDTMLEDIDRIEVIRGPGAALWGANAFNGVINIITKHAQETQGGLLSAGAGTEERGFGGVRYGGRVGDDTYYRLYTKYFNRDGGVDVAGNEGNDDWSVLRGGFRVDSDLTAHDSLTVQGDMYHGKEEETFSVPLVVPPYSRTFNSDTDIAGGNVLSRWTRKFSDTADMALQLYYDRTERDMAILGETRDTIDVDFQNRFRWGSRQEIMWGLGYRFSHESITNRIPISFVPDKRSDNLYSLFVQDDIALIEEKLRLVLGSRFEHNDFTGLEIQPNARLIWTPDYRQTVWAAVSRAVRTPSSAEEHFRNDISVYPPGTVNQTLPVLFSGFGSRDFKSEDVIAYELGYRVAPAEHFSVDIATFYDNFSRLRTLEFGTPYLEVSPSPHLVLPGITANKMHGESYGIEVAADWLALEWWRLQAAYSFLEMQMRLDPDSNSLFYLGFTQGTSPRHQGSLRSSMELGRSVELDVWVRYVDKLPEFDINRYVTLDARLAWKPTRNLEFSLVGRNLADSHHPEFNSAIIATAPTEVERSYYGKITWRY

SEQ ID NO: 6493 - protein, 1011 aa, Bacteroides uniformis ATCC 8492
MKKQILLLCLALISLCGYAQNITVKGVVTSAADKEPMIGLTALIKGTTNGTVTDLDGNYTLNNVPKDAIVVFSMIGYKTQEIKVNGRTTINVVMQDDTQALDEVVVIGYGAVKKGDLTSSIAAIKGDELKTLSSGNAMNSLQGKINGVQISSAGGPGTVPRVIIRGVSTVNGSNPLYVVDGMPVGDNINFLDQNDIESMQVLKDASASAIYGTRGSNGVVLITTKKGTKGATKFTFTASAGFQTLEKPDMAKASEYEYVLKSRYINDGNVPMYVGYNGITDAEGTDWWDETMRKTALIHNYNLSFSGGTDKLLYSASIGYFGQDSQYKIGNWQKFTARFSMEYTFNNIVKAGIDFTPKYENWKDTPDLIGSIMAMDPTTPVMRPESEWTDNEYDNYSRSHNSQVWNPVANMARMAKNTDEYGLLATPFINIEPIKGLIFRSQLGLNARFRLYDEFTPTFDIDNLERAETSVAKREMKNWIDWNWTNTLTWIKSFNQKHNLNIMAGYTMERFQHYWLTGSRDGIPTNDELLQYVSAGTKNQQASGTNSYSSLISYLGRVMYNYNDRYYLTASVRVDGSSKFVKGNKYATFPAVSGAWRVTGEEFMKDQHIFDNLKIRAGWGRVGNQSIDDSAYASTVGTTDYVFGQEGNREIGTSVTAIGNTKVQWETVEDFGIGVDMGFLNNRLTVTADWFQKKSHDMLMKRDNLLILGYPMWNGQMWENIGSMKATGWELSIGWEDRQGDFTYGVGLNLSSVKNKAEKLMGQPLYTGGFNGDYIIRNEEGGEISRFYGYVVDGIFQNQTEVNAHTDEHGKIIQPNAVPGDFRFRDLNHDGELDDKDKTYIGSAFPDLMVGLNAHLSYKNIDFLANFYGTFGNDIFNTTLGRYSGAGGENVYAGTYNKVWHGEGTSNFLPRLSVNDSNMNYKRPSSFFVEDGSYMRCKLLQIGYTLPKNWTKGFSLRLSFSAQNPFTITKYSGMDPETASLGTKGNVTESGIDWAGYPNPRTYLFGLNLNF

SEQ ID NO: 6494 - protein, 916 aa, Bacteroides uniformis ATCC 8492
MQTQEVAIKRNLKIVLKADAAMLDEVVVVAYGAAKKSSLTGSVEIVKADQLSKVPVNSVDQALQGKAAGVQVTAATGRPGASANIKIRGTSSISAGSDPLFVIDGVPVSSADFAALNSNDIEYMSVLKDASATAIYGSRGSNGVILITTKKGQSGKTTIDLKAIFGISTRTLSDSDFTMMNAQEKLTYERQLGIGRGSSGGANGGAMTDAEIAAAKNTNWADEIFRTGTTQSYELNVAGGTDATRFYLSGQYFDQDAIVPGSYLRRSTLRANLEHKIKDVVKIGFNSSAGISKEGLLRTDRNALNPFNYIFNANPYDAPYNEDGSYNTDMKVAGNQINIFENIANNPASLSKLKIIAAFNLEWRIWDQLKYTTVAGVDFTQYQNYQFNKPESQLSQILGSPYGYRNDRIQQRSTWVWTNMLSYDKTFNDVHEVKAAAAMEAQSSHYRTLTASVSGFATGKLDAISVGATDKDVAGNTTDWRMLSYLATAGYTYDSKYIIDAAIRWDGSSRFGADNQYGMFWAVGLGWNMERESFLQDVSWLTRLKVRGSVGTSGNNNIGDYAAQGVYGYGSYNGASTAYPARLPNPDLSWEKSMQASVGLDASLFDSRLNVTFDVYQRKTTDLLLSTRLSMTSGFSSRIDNVGELMNKGYELSISGDLIRTNDWKLTLNGMISQNKNEIKKLYKGNDISVGWNNLIKEGYPINVYKMVRWAGVNPANGDALYYTADGRITNTYNSNDAVVLDGKTPDPKYFGSFGANLSYKGWELAADFYFSGGNYIYNHIRFFTESDGAQYGNNQDKSMLYDQWKNPGDITNVPKQSINNSSYQSTRYLEDASYLRLRNLTLAYTFPKQWLKVAHVEKLRLFAQGLNLFTVTGFKGLDPEVGDSPAGTGAGATGGVLDFSYPASRTIMFGIEIGF

SEQ ID NO: 6495 - protein, 1026 aa, Bacteroides uniformis ATCC 8492
MLLLACLFVGISLVTAQTQKVTGVVISEEDGQPVVGASVLVKGTTQGTITDIDGNFNLANVPSSAKTLQISYIGMQTQEVAIKPMVKVTLKSDAQNLDEVIVVAYGTAKKSSFTGSAAVIKADKIVSGSKESFDKALSGKMAGVRTASATGDPGSMAEINIRGVGSISASKSPLYVIDGVVTKADDDMNYYGKTQSVLSTLNPEDIESMTVLKDAAAASLYGSRAANGVIIITTKKGKEGKTNVSYSGEVGWNKMAVNAFNMMGSADLIDYTRESLANCLVTYGITDSKQAALNNIDNGGDMFIPLLDSPATVADFIHDPSGKVNTNWKKEIYRTAFTQDHQISINGGSSKTQFYAGVGYNKSEGIVLGSDFERISGRLNVNHKVNNWLNVALKQMIAATSQDGFRDQGDQAQGMGTSSPIGILFAMDPTAPVKNEDGSYNKNAAWGKVTNPHLMLGGKDSDTALEWIQTKMFRSMTNADVTIKFCDKLSLNSIFGYDYVDNKHFEYWDRNSVNGGSVSGMGSRYTFESRVATSSSTLNYTDTFKDMHNLNLMAGFEVENRDLLQIVTVAKRYSSHYPELANGQPDQAASSTLGAGMMSYFASGNYNYDNKYYLSASFRRDGSSRLSEDNRWASFWSVSGAWRMSKEGFMQDMPLFTDFKIKASYGTNGNLPSDYYGYMDLYTGSGYGSAPAIYWSRMANDKLSWEKSKNFNMGIEWNMYDRVNLSLEYYNKKTTDLLFEVPTSLITGFDSRWENLGALKNDGFELELNSKNISNKNFTWTSNFNLTYQRALVDKLPEGKDIQYGDGEMYLHREGESMYTFYLPEWKGVNPETGLGEFWLDPEDHSKGVVNDYSEAGKGIVGKALPDVIGGFSNTFTYKDFDLSFLITYQFGGDMFDYPGYFSHHDGVRIGSMNLSEDVAGNYWKNPGDKVDNPMPIYANPYRWDRFSSRTIKSTDNIRLREMTVGYTLPVLKKHISNFRIYFRANNLAMLWSKTKNIDPDVAINGYRQADTPALRSCVFGINIKL

SEQ ID NO: 6496 - protein, 385 aa, Bacteroides uniformis ATCC 8492
MKTIVLASSAAAALALSAGAASAEPNGWYGAIDAGYHMIDDINAESSTTGANWNYEVNDGWAAFARLGYRFNPNWRVELEGGYRSGDIGTVRAVSGTQGLCNLTPATGGCFSPEGDIESATLMANVIYDFGYEAWGIRPFVGLGAGVNRVTTDTNGNLRANRGATFTADDDSTEFAAQAIAGLAWAVGDRTNIDLTYRYLTGDASFASTTVGTGVGATSFGEWDGDYDQSHTVTLGLRYSFGAEEAAPPPPPPPPPPPPPPPPPPPPPPAPVKPAAREFVVYFDWDRSDLTAEARSVVTQAATYAKSGAATRVLIVGYTDTSGSAAYNLGLSNRRSRTVADALVAQGVNGGVIALDGKGETALAKPTADGVREPLNRRATININF

SEQ ID NO: 6497 - protein, 712 aa, Bacteroides uniformis ATCC 8492
MKLGSCRKRNWFKPAVLSALVLATNFGSTGTLRAEEKELDPIPEKDGDEIVVTATRMADSSFNVPVSIEQISQKQLQSSAPESIGEVLRDVPGVSMAGSGLWDVSPIIRGFSGNRVLVLIDGNRENNLWAGRDPLTPFLDVSQIERIEVLKGASSVLYGTDALGGVINIITKKNFPNLSEGWVFKPSAQVGYSSVDEGKFGKLSVQGGGHGFDFQIAASRRETDSYTDGDGNTVANSQFEAGNYTVQAGYMISNQHQLSFSYRRSDIDDKGIPQKENASYSHFTKFDTDAYNFSYQGCDLGFVKELQVKSWVISQERAYDGNIASTTQPMYTLKTNQIETGAVGSSMQVQFVSWNQHTLVAGIEFVHEDAESDELQIKKKTANNLTAKTITFPPVSDAIRNHFSLYAQDKYQFESGALLLAGARYDFFSSDAEAAAFKTVTYGSDGETVTKTTETESNFHETQDHAVTFNLGYLHPLSKQLHFTANFASGFRAPDIFERFSTRGGSYIILGDPDLDAEYSYNIDLGLKLKSQHFNGAVSVFYSWVKNYIDLVDTGEQLDGFDTKTYVNVDATNLYGADASIAYRLNEQLSFFANAAYVLGKNTESDDHLNDIPPLNGMLGTRWENQLNETWRYWFEFNTELYAQQNDPAPGEASTPGYVLLNLRSGIRFSENATLSLAVDNLLDKAYRSHLNEADFLYEPGINFKTTLSVGL

SEQ ID NO: 6498 - protein, 354 aa, Bacteroides uniformis ATCC 8492
MKKNLLTTAIAASLAFCSFNSLADGPEFYGHVDLSITDSEKGYATQNQKDGTVLENNFSWVGVKGSESVSPYFDIIYQMEFGVENFDNSNKTFNARNTFLGVRSVAGTVLAGRNDTVFKASEGGFDLFGNTNADIDLLLAGQTRSADGISYYSPKIADLITLNATYLMSDNYDQRDSQGNEVYNQDQMYALSATLGDKTFKTHNYYVAAAYNDGIENIEAYRGVAQAKFGDFLFGAIYQHSEHIDDRFSNLSGETYFVNAAYLMDNLKLKLVYGKDDSGLGKYVSRFVGSQDSGNLEQVSDVDLQQLTVGADYRLSTKTMVYGHYTRFDGDLMLAGTKQDLDDNVFTVGLRIDF

SEQ ID NO: 6499 - protein, 1018 aa, Bacteroides uniformis ATCC 8492
MRTKTLKRNRFRYLCFLIAFIGFSSFAQNTVTGVVKSSGDELPLMGVNVIEEGTTNGVVTNMNGEYSIDVAQDAVLLFSYLGFEEQEIEINGRSTVDITMVNNLETLDDVVVVGYGTQRKSDLTGAVSVLDADEVQKVSNSDVSQLLQGRTAGVTVTADGQPGAGANVRIRGVSTFGDSQPLYIVDGVPVGTSIRDFNPNDIETIQVLKDASAGAIYGSRAANGVVIITTKQGTKNTPLQIQYSGYYGIDEVAQRIPVLGREDYQMISNEKRMNAGQPLIPGNDPSSDLYVDNIDTDWQSVGLKSGSRQNHNIGLSGGGENITYNASLDYFKNEGVFVGNGPDYERYSGRINTVMEKGRFKISPSLYYTHSFENSLTFRGDVLTGGRPPLINDLVNAIPTLGVYDPENEGGYAGTSSEIHQEIVLNVPGINSLFTNNVEVDRIFAIINPEFKIIDNEDHQLTYKLNTSYDKTHVRSFSFVPEFEMGYFFGSGKSLLDDNSAIYTVGLVENTLNYNTSLGQHTFDIVLGQTFQKNTTVLRSAHSEDLPKPYYPVLSNGVNQTVGGQEIESSLASYFGRLNYNFDDRYLLTATVRRDGSSRFKEENRWGTFPSLALGWRINNEEFFNVSEDVVSNLKLRASYGELGNQNIGDYLYQAVINRNIPYNFNLDRVLGGLQTSVVSEDIVWETTTSLDIGLDATLFSRKIDVTLDYYERETVDILVGVPIPWSTGSVNVNPLVNAGSIRNSGFEAEVTYHHNNSEDFNFDLSANVSTINNEVLALGGNQEPISGAGSRTQVGREVGEHFGFVYDGIFQTQAEIDEHAFQPGAAPGDVRFRDLSGDGEINADDRTFLGSALPSVTYGLNFTANYKRFDFTLFTSGAAGYYINSRLYRSLMLSTGYINAHEDILNRWTPENTDTDIPRVVADDPNGNARDSNRPGWLQKGDYLRINTISLGYSLPEDLFGNSLNSLRVYGTVQNLHTFQYYKGYNPDFNSGILEPGFDNGTYPRPRTFMLGVDVSF

SEQ ID NO: 6500 - protein, 720 aa, Bacteroides uniformis ATCC 8492
MKKRILPGQKTRIACPAVFAKRSMARRSRFLPLGAAVVAGLLGAADGAFAEEDKTLSAVTVTATQDGPDGYRATKTRVGKVVQDPHDVPQAITTVTRALIEEQEANSLREALRNVSGLSFNAAEGGRSGDNMNLRGFYTFGDMYLDGIRDTAQYNRELFNLEQVDVLRGAAAMLFGRGQAGGVINQVSKTPMLYGINKVGIGIGTDGFQEVKADLNQRVGDTTAFRINVMNRDEGSARSNPYTGTEPEIHRMGFAPSVSFGLGTNHEVTLSHLWVKTQDRADYGVPFVNRKPNEDMAKAGNYYGVDANFDDSETNISTLNYLFKISPDTQWRTVMRAANYKRSYWAVAGQGVLTANSTAGQAKTREFETDNYVLQSDLNTAFTLFGLKNELITGVEYLNEDSIRWALRNLGTANNPLYKPGQYTTAAPATYKGETYSAYVQDSLEFIPDWKMTLGIRRDIMQSEYFTTTAFSGNFAENSYRAGLSWQPTAAQHYYAGWSDSFSPTADLYQLSGNQYPAERSKVFELGSKWLLADGNLSLRTSLYRAIKDWERNTDLESTATILTRKRQSDGVELEVAGRITDNWEVFSGLSLIHAEILEVAPGNGNVNFIGQMPRNTPKKTFNLWSTYQLPYGFKVGGGMEYKSQRYGGAPTGTAVFNPNWVPSYTRWDAMVSYDQPKYTVKFNVQNIFDKLYYDALYDNGGFTVPGQARRFILSTEYKF

SEQ ID NO: 6501 - protein, 423 aa, Bacteroides uniformis ATCC 8492
MKHVLALGSAALLAVGAAGRARAQAPDDGFWDGAGVDVTALNFYYNRDFRSGEGQGKRAEWAQGFVVDAKSGYTRGPVGAGLDLLGIGDFKLDGVRAEGGTGLLPNNDDGTAQHALMRVAPTLKLRASQTELKWGSFIPNEPLVRASITRIMPETFQGVTLESKDVPKLDLLLARFTSAWYRDGDSRVPITLTNKNRRFLGTPDADALNLVSATYSVAPGTQLRYQGALMEDIYRQQLYNLIQTHAFGKDQLRVDLRYFRTDDVGQSRAGPIDNRMFSSMVSWRTGGHEFGAGYQRLSGPSAMPWPGGTDGNVFNWTFINDFLERGERSWQLRYSIDGKSIGIPGFSVMARYIHGDDARPATYAGEGREWARDVLTTYRFQSPRLKHFSVIWFNGTFRSNYQRNVDENRLILQYKRQFDTPGQ

SEQ ID NO: 6502 - protein, 767 aa, Bacteroides uniformis ATCC 8492
MSKSNRVRIMLLGGAALWLGASMAQAQVAADSADDAAGGLQEIVVTAQKRAQNIQRVGIAITAVTPEQIANRNIASSADLAGKVVGLESYSPYGPGTSSNVVIRGIGLNDFGEGHEAPVTSYVDEFYIVAVPAVDFALFDLDRVEVLRGPQGTLFGRNSTGGLINYITKRPSQTAEGYLSASYGRFNDLKLEGAATAPLSDTLSMRLSGTSRHSDGFQRNINPALERGGQAGSDAARLQLRYQGDDGWDILLKGEYGRTKTTHAYYESKTGFVDANGLVVADPTIVDAVGYAERNTPAAKKNVVNTNDAAFLRSSGYSGLLRIEKKFGDTTFTSLTGYQSYKRRMQEDSDGTPNPLVFASFPYQGKQLTQELRLYHDGQSTRWTVGLYGMRALGKDQPTAVFNFPLDGPTAVDPATGLYNGTYFPISLNADWRLRTNSGAVFGQIEQDFGKFTAIGGIRVTRDRKTFADRDNAALRDCGGGAVGDCFLVGDGGTGTPVPFRLKYRATLWSGKIELDYKPDSNNLLYASISRGTKAGGFNNGFYPTGVSLARIPYGDETLISYEVGQKSTLFDRKLRINTSAFYYDYKDYQAFNYVGLAGLITNQDATAYGIETDIEAAVTPELRLYAAGAYLHTDIEDVAKVTPVGTTVVADRPMAFAPKWSASGGATYTIALPNDQSLALDWNFEARSARYSGNFGDPGTQLEGYFKHNASITYEAAEHWQLRAFVDNISNRLNTTYGGPSFASLGIIQVRYAMPRTYGAAVRYRW

SEQ ID NO: 6503 - protein, 629 aa, Bacteroides uniformis ATCC 8492
MKKNLLGILLVCAFLSSSLQAQVRKDTTQAGHNYEIDGVVVTGTRNETDIRHLPMTISVVNRETIRQRSEPSLLPTLTEQVPGLFTTSRGVMGYGVSNGAAGGISLRGIGGSPTTGLLVLIDGHPQYMGLMGHPIADAYQSMLAEKVEVVRGPASVLYGSNAMGGVINIVTRRQREDGVRTGVRLGYGSYDTWMTEATNQVKKGRFNSIITGSYNRTNGHRPNMEFEQYGGYTRLGYELDHSWNVSADLNLTHFNASNPGTVSTPVFDNDSRITRGMTSFALENRYERTSGALKFFYNWGKHHINDGYGTGEEPLDYRFNSKDRMMGISWYQSASLFSGNRLTAGIDYMQFGGEAWNRFIADKHKEGISDKSENEIAGYLDFRQAIGSYLTMDAGLRIDHHTVTGTEWIPQVGLSVQLPQDASLKAMASKGFRNPTIRELYMFRPANPDLLPERLWNYELSYSQRLLKGTFYYGVNLFYINGDNMIQTIRTDGRPLNVNTGKVENWGAEADIAYHIHPMWRLTANYSWLHMEHPLIAAPEHKLYTGIDFTQKKWSFSTGIQYVTGLYTAVVPQEKKENFLLWNLRGSYRICSIADLFVKGENLLAQRYEINAGYPMPKATCMGGININF

SEQ ID NO: 6504 - protein, 986 aa, Bacteroides uniformis ATCC 8492
MKKIQVLVFALLCALASFGQELGTATLTGTVVDPSGAVIGGAKVSAQNKATGMQREALSTKAGIFVFNDLAPGEYDLTIKADGFAVTTATVRITVGQQANLRAEVRVAQSEQHIDVSGAIPLVETSSSVVDGVVDSKQIDALPLNGRNFLELALLMPGNAPAPLYDPTKSDTVLVSSTGQLGRGQNITIDASDNNDDVVGGMLVNIPQDAVQEFQIATNRFSAELGRSTSSVVNILTKSGTNDLHGTAAIFARDAALQAKPNSFGQSVGDTPPFRRDQYTGSIGGPVVKDKAWWFTSFEYRDQMGGILVGERDLATQSIHTTFAAAPLTDALGTAKFDWAISSKDTLSTRYSTESFEGTSNSATDRALGTASQTQASTNRFHDINTNWTRVISAALVNRAQFAVNLFQNDTVANGTGPQINFPSIEAGSSYRVPQATHQQRLLWGDTLDWTHGKHNLKFGAQMQRVGSDFNLGVFQQGIVNAVEDFPDFDRNGDGVVNDNDLLFAVGLVSHTPTRPLIIPDADNNYVALFAQDDWRVHPQLTLNVGLRWELDTDVKNVGHYDEINPLAKPFLHGDRSADYTNFGPRIGFNWANKPGTLSVHGGYGMYYDRIVLEIVSLERGEDGRALAIDVHAGNVFPGYMNPDGTFIPGVTPTLADPFTGFILPGAGAGGIYAISNQMQNPMVQQFNLGVQWEFLKNWVVRADGMHDFGQHFIIGVPVGTVYNPVVGGPDTVKILESAVNTHYDALFLTVDHKFSNHFNLHSAYTLSKSLNYANDDQIPFANGPIDPTDLHREYGPTPNDQRHRWVTAATVSLPYGIQFSPLWTLASGVPMDIQLPDGSSRVPEMQRNAGGREFHNAAELNAFITQLNAAGGSNGTLLPLVSPNAKFGDSFNSFDMRLSKTFRLGDRMSLEVLGECFNVFNTTNVLGVSNTNYSGYNNVLVRDSNDPTSAGYLTSSTFGMPKTTAGGVFGSGGARAFQLAARFNF

SEQ ID NO: 6505 - protein, 939 aa, Bacteroides uniformis ATCC 8492
MNRKFIYIGCTVFAMSLLSMTGVQAQEESKDSLVNVAFGKVAQEDLTHAISTVNTSELTKKTANNNSLVGLESFVGGYNGSSLWGQGPLVLVDGVPRSASSVKASEVESISMLKDAAAVVLYGSRAAKGVILITTKRGKDSPMHIDVRANVGVNVPKAYPKYLDADCYMTMYNEACRNDGIAERYDAGTIYNTAMGTNPYRYPDIDFYSSDYLRKFYTNSDVTGEVYGGNEKTHYYLNFGMNYANSLLKYGESKKAYDMSFNVRGNVDMALASWLKATTNAAIIFDNSYQGRGDFWGAASTLRPNWFAPLLPIDMMDPNVAYIQEYITNSNHLIDGKYLLGGTSADTTNPFSELLAAGYTKEKARRFMFDVAVMADLGGLLKGLSFKTAYSVDYTSYYSEAYAEKYAIYEPKWSNVNGKDMIIGLTKFNDDTKSTNEYVGKSTYDQTMTFSAQFDYNRTFKTFHNVSATLLGWGYQTQSSADEGHESSDYHRTSNVNLGLRASYNYDHKYYADFSGALVHSAKLPEGNRNAFSPSVTLGWRLSKEKFMESVGFVDDLKITASYAKLHQDLDISDYYMYKGYFSDKGGWFQWYDGTVGGNTTGSKRGDNPNLDFITREEVRAGIDATLFNRLLRINANYFTQKTSGLLTQGASTIYPSFFDLGTDLSFLPWINYNEDKRTGFDFSLSANKKIGDFDVTLGFNGMVFSSKASIRDEVANESYLLRQGRALDATYGYVCEGFFQDQADIEKHAKQTFGTVRPGDLKYKDINGDGVINSDDQIDLGAGGWSTSPFTFGLNLTLKYKNFTLFAMGSGQTGAVAFKNNSYYWNRGTSKFSEVVMGRWTEETKGTATYPRLSTSNGDNNFRNSTFWMYKNNVFRLSNVQLTYDFPTDTFNGTFIRGLSLYCGGSNLLTIAKEREYMEMSLGAPQYRNFYLGFKAAF

SEQ ID NO: 6506 - protein, 697 aa, Bacteroides uniformis ATCC 8492
MKIRLSIFTLMALSSLSAQEVILDSISVTATKISTKTKDISQSIAVVDEKTIEDKNVLNIQDAIGDIPGVIAESSTNSPSPRLIIRGAGLKARYGVREIMIMKDGVPMTDPDSFTRFDFIDMQDVSSVEVQKGPGSINAVNATGGVIQLVTKSVFKDDKNRIKVGAGNDNQRNVNLKLRGALSKDDFVAFTFSKRTIDNSWRDHNKFDSTQATLKYGHMFEDDSTFETEFSYTESNMELPASMTASEFETFKNTGSQHNTSDQWQNSGRDSKIFSINAKYEKEVGSTTFKPRVYFNTWEHFHPVTGMINDSNDNSVYGTDLELNNLHKLFGQKATFVAGVTLKADITNGAKKYKYADYETKVATSWPFAPYISKTLSDNKGALAQTEDSKTILYGGYLMETFSPSNDFIIDVSTRVDELSFDISGNEVTAYSYSLKNYTAGKGLYNVDKSYTLFSAKLGAVYKITDTTNMYASVATANQAPTTSELGENEQLNMATSVNYEIGLKTRAKNISADIAIYQNDVDDEIIQIKDANGNSIYDNAGKTQKRGLEVTAVYKPIESVQLGANYAFSEFKFIKFSENVGSSSVSRDGNYLPYIPKNQYSLFATYNMKNGFKSRVTTKTWGKYYMDNANTQEYDGYQFVTDIMLGYEKDAHNIQLNINNITNQYYAMEALKDVYGNESYKAAAPINGMLTYIYKF

SEQ ID NO: 6507 - protein, 810 aa, Bacteroides uniformis ATCC 8492
MKQIFVVLALFFSIIITAQQKQDFNYKQTSLLKVIKDFQSKNDISFSFATDVIEDIQITINVKQVTWIDFLQLLEYETGLLFKKISDTQIIITPINSEYIEALDGVIILGYVTNGIDKKNDGSIAVDNKRLGILPGMLNTDISQSIQLIPGVSTLDESATGIQIRGGSPDQNLVLYDNIKLFNTGHFYGMFSLFNPFATDKATIYRSGTSARYGDRISGILDISSGNKIHENTKGGFEIDGLSLNGFVKTKLSDKTGLYIFARRSYADLIQSPTYSSYVDKIFTNFGVARDRNGNILQLETDDDFSPETSNNKFSFADINTKLILKPNDKNSIEVSALYTRNRLDFDFNGGDEVLVDSLITQNKGLSFNWKHKTTEKQKEQISAYYSEYNSFYQNDELKDETEDGNLDLSEINIRENNIVDVGVNFTSYRQITESQRLTLGYQLSYTDLDVTISKEEPFDSEKEILEQDDYNLKNALFGEYAIELKNKGLINSGIRLVHYSSLNKFLIEPRINFEYPISKRIRAKIAFEKRNQPISQLIEFNHTELRLENNLWRLSDNIQYPLLSSNQISGGFLYHYRNLNIDIDAYYKELKGLTTFTNGFSNPLENLEEGESTIKGIDILLKYKLSNYKVWLGYTFNDITFQFPNLTDTPSKFPGNNDITHQFRISNALKLNNWQFALGWQIRTGNPITPVNSYEIKTDADGEAAGVVNFGSINSTRLPSFHRLDASILYDFSIKNLDAQLGISFLNIYNRVKPLNIIYKAERKPLDDGGIAIEGTTGSTPEELEIILEQVIQKFSLGFTPNLSLKLFF

SEQ ID NO: 6508 - protein, 462 aa, Bacteroides uniformis ATCC 8492
MVFKAFALDLQFVPTYSLIQRTNIMKTNKTLLSTAVAFGLLSSANLANAAGFQLAEYSATGLGRAYAGEAAMADNASAQWRNPAMLTYLEGTQVSVGAIYVNPNIDVKGTTTLQHPATGQTVAVTDSASDDFAHDAVIPNLYISHRYNDQLAIGFALGTNYGMETDLGKDFAASHFGNEASVISKEANLNLAYQLNEQFSIGGGIRYIIAEGSFGATAPKTNILNLPQGTTLKYMEGDDTTWGWQVGSAWQINKNHRVGFTYKSEVELKLEGHAEGVGFGFGTTIPKSRDNGYMYLTLPATAELASFHQLTEKIAMHASFNWTDWSSFEKLEAHMETAGTQMVKVENWEDNYRFAVGATYQLQPKLALRTGIAYDTSAVSDKNRTITIPETDRTWLSIGATYDWTQDFTLDAGFTYIIAKDAPIKESRGYESDDKAQAIGGQFVGETTGNVWLIGVQANYHF

SEQ ID NO: 6509 - protein, 329 aa, Bacteroides uniformis ATCC 8492
MKQILLATTALVMTAGVAAAEISFSGYAEMGVVGGGDNAPLPAGRDTNETQFHNDFNLIVTMTSETDTGLAFGASVEISKDEGDSNGNFSADNEAAFISGAFGTLTMGEIDGAMDWAMTENVGNPGSIGDDETTHAGYFGAYGDGKYDNQIARYEYSFGDFGVAISAELDDTDTNGDGYAIGAKYKGDFGGFGMGFGLAYQTFETLGTGLGSQGAAIVGGDVELLGASVNADFNNGFVAGLAYTDITSDLQDGNHIGLSAGFTTGAFQIGANYGVFDMDIQDDVKGWGVAAAYDLGGGLKLHGGYGESDFGGGLDNDTETYSVGLSMSF

SEQ ID NO: 6510 - protein, 1045 aa, Bacteroides uniformis ATCC 8492
MTGTVIDEAGIPVIGANILVKGTTNGTITDMDGKFTLINVPENAILVVSYIGYLDREIPVAGKSTLEIRLKEDTQKLDEVVVVGYGVQKKVNMTGSISNVKADDLSVIPSTNLSNSLAGRAPGAMITGNSGLMGAKSEIRMRGGFGDPLFVIDGVIRDKEAFDLLEPYEIDQMSFLKDAATASIYGSAAGNGVVLVTTKGGTKNQKPIFNYQGSYAFSKPTQELFADRWDAIDDLDYQNAVARFQGTPLPNGEEEYAYFRDNKINYNVNDYIWQNPWNTKHSLSVNGGTDKVKYYVMGSFLAEEGSYVSLENKKFSLRSNLSVDLTKYITMNVNLDANQSNDKRFYWPFSDDDDQSVYDLYRCTFNAMKTTPFYSYLDGTPANTITDYPIYQDYGSWQGWNPVDQVVGNRYLKTRRRNLNGIVSFNINLDFITKGLSTKVMASYLGHDYNRKRFMTFQKNYKFQQADPQGNRFLPAPLNLNEYNTFNFSQNYENLEYKTKQLWTEQFNWFVNYANTFGKHDVAAMVVFEQASNGGEEVSAKGESPLTNLDQMFNYSSDALRRWGEAKEKNGGRLSWIGRFNYTFDQKYIAEFSFRYDGNTLFPDGKRWGFFPSVSAAWRISQESFMEPTSDWLSNLKIRASYGTTGNDMDLSKDPIDKVDAFSYLQKYQLGEKYIFGNNLANTIVAGATPNYALTWATSTTYNGGLDFGFFNNRLSGTFDAFYRKEVDILGPRTVTLPSTYGQALAPENYAERSWRGGELALTWMDKAANGEITYSAYLNLGFARDRWDVLDEDATYREGGNLHALSKQGKAEGILTGLIADHLLTDPAEVEALKAKGFKQFGRDPYLGGILYKDTRGDGYSEGPDGRIDSNDEYNLLSENGTPRINYGFGGSIKWKGITLDVHFQGVGKYDRFVGGVDGGFYQHGGTIRPYFPIWTSDKVYDPELNPDGVYPRITGTSWYESGAGNTSYWMRNGAYLRLKNLNIGYDLPMAILRPLGITHAQVFANATNLFCISAVTEFLDPEQEYYDSYPLMRTFSFGLNFSF

SEQ ID NO: 6511 - protein, 387 aa, Bacteroides uniformis ATCC 8492
MNKKILTAATLALFATAAHAQSSVTLYGLIDAGISYANNSKTATGHDNIFKYDDGVAQGSRWGLRGTEDLGGGLKALFVLENGFNSGNGTLGQGGALFGRQAFVGLSKDGAGSLTFGRQYSFSTDYLGGSYSNGGQTVAGNYAYHINDVDQLTSSRINNAVKFSSANFAGLTFGAMYGFSNQAGAFGGAPATGPAAAPVAGSSRAYSFGANYANGPFGVGAAYTDIRFPGQASPTFSTALANVTTGTVRDLRTFGVGGRYSIGAATLWALYTNTRFEPISGSSTTFTAYEAGAKYAFTPALTAAAGYTYMHLSDANTGHWNQADLSVDYALSKRTDVYALGIYQIAAGRNKGQDLQAQIGSSTSYFNTSGTGADNQLAFRVGIRHKF

SEQ ID NO: 6512 - protein, 626 aa, Bacteroides uniformis ATCC 8492
MHRAAMGALAGALTGVAVGPVWAQSDTQAAAVPVGELNPTVVTASRSEQKLADALPHTTVITRADIERSQAPDAVSLLRREAGIEIAQAGGPGATASLFMRGAGSNQTLVLIDGVRVSSGTAGTTQIEQLMADQIDHIEIVRGNVSALYGSDAIGGVVQIFTRNGRGHAPLANAQIEYGARNTKRAQAGISGELDARGDTSFALSVSEFRTTGFSSINPQQAPNANPNDNAYTNKSVSAQLQHRFSADWQAGLTWFQTWSNVSYDNAFGSPTDDNYSHNQVRAMSIYVDGKLTPDWKTRLTLSQGDDRNLNFTNGQVQVPGRFNTQNQQASWQHDWTFLPDQMLKVGFEHLQQTIDTDAYAPPTRRVESGYVGYEGKFGPHQLQLNLRRDRYSDFGGATSYYAGYGFAFTPQWRAVASLSNAFRAPSFNELYYPFFGNPNLQPEKARSVEGGVEYQSTIGLVRVTAFETDYSNLITSVFDPVSGNFLAANVNRARVNGLETSWRGTLYGVDVRASFTMQNPQDLSANQLLLRHARHFGSVSAYKSFGPFSAGIEWNAAGERQDSARTLGGYGLLNLTGRYQITRDWALSARVENLLNKNYQLIAPYNTASRGVFFTLSWQQHAPQR

SEQ ID NO: 6513 - protein, 1072 aa, Bacteroides uniformis ATCC 8492
MNENRERGTLHYKFLTTIAIVALLIGSNTALAIGTNSEGLSEIAEQLQSQVVNGTIIDQTGEPVIGASVLEKGTNNGIITNIDGKFSLTVKRGATLVISFVGYKTLEVKATPKMEITLTEDSELLEEVVVVGYGVQKKKLVTGATVQVKGTDIAKLNTTDVLGGLQSQAPGINITSNGGFLGQGFKVNIRGLGTNGNFSPLYVVDGVVNGSIDGLSPADVESIDVLKDAASAAIYGSRAANGVILITTKQGKTGNFEVTYDGYYGIQNLPKIATLLNAKEYMMIEDEMHMMDGTSLLNWEKWLPAADYKAIQEGTWNGTNWIKEILNNDAPIQSHSLNFTGGTERSNFSIGFTYFNQEATMGAPGRIASMDRYNARINSNHIVKKIGNLDVLKIGQTLNYKYQQTAGSFATTGIYWNGTRDMLTTPPLMHAYNSKGEYYLYDDAQEEGYGENTTNPIAYMDYYTSHALSKSHYLQSSFYAELQPIKNLRIKSQFGYILSASSYRSYIPSYRQLSQSLTTQEDRVTQSMSLNHRWSWENTASYNFTLKDHHFDAVIGQSLEKYGMGDSMSANAEGSEFSDFKHAYLSNIKYDDKNKIKTLTGAPGAAGQMASFFGRINYNYKEKYMATAIMRADGSSIFARGHRWGYFPSFSAGWVVTNESFMPELNWLDFLKLRASWGQNGNNAVNTFEYISRITANNGNGGYSFGDSMDQVSIGSYAYKLTNPDLSWETQEQLNIGLDARFFNGRLALEFDWYRRLTKDWLITPPVLYSFGSSPAAINGGVIRNTGFEIGLHWNDNIGKDWNYGINLAPAFNKNRITELPNEDGILHGPSGNLWNASDECARGEIGKPLGYFYGYKSLGIFQNQKQIDEYKGAKENGAQTQPGDVIWADIDKNGIIDSNDRTEIGNPHPDMTLGFSFNVSWKMIDLSVTTYGAFGQQILKCYRDYASSPLQNFTTDILERWHGEGTSNKLPRLASTGGSNWSKVSDIYVENGDYLKIKNITIGVDIKKIFKKIPLQQLRLYATVQNLYTFTGYSGMDPEIGYGSDFGWVQGIDLGYYPEARTCMLGLNVKF

SEQ ID NO: 6514 - protein, 903 aa, Bacteroides uniformis ATCC 8492
MRKFQINPLVLAMAVTALPLGAMAQSQSSNGDVVEEVLVTGSYRASLASALDTKRNSANAVDSIKAEDIADFPDNNLAESLQRIPGVAITRSGGEGRAISVRGLGPDYTRVRINGVEAISTTGGTDATGGTNRTRGFDFNTFSSDLFSSLTVNKTAMASIEEGSLGATVDLKTAQPFDYNDFVFTASAQAGYNELSEETDPAASFLISNVFADGKLGALFSLSYSERTVRDEGSSTVRWSNAANQRFGSFSDGTPILATDNITTAFHPRIPRYDSFNHEISRLGASLSLQARPTDTTEVSLDVLYAKHEANRQEVFWEASMNGTQNNSVVVNDYEIQGNSLVYADLSNVRLLAENRYDEMTTDFHQITLNVKQDFTDQLKGNLVIGSVKSDFDNPLQNTAIMRADGMDFSYDFRDGKKGNFVFGDTAYNASSWTLTEMRQRPQASVNEYQNVLADIAYEINDVLTLKAGVNYKKFEFSTTERRLASEAAPAGINLNDYLLTYDSGLGSGGAWLIPDRGAIATDFDIFSRGYNIQASNTYETKEETTGGFIQLDFNSSIGETPVRGNIGLRQFSTEQSTSGVLAGSQVWVDHKYDDVLPAANLSIEPIEDVIIRLAYSEGIARAGLGSIKADTSVSVAGTNMSVTGSNPFLEPTKAKSYDVGVEMYFDNESALAMTLFRKDLESQVQSYRATRNFQDIIAGFSPEQQASLSQQATTQCAASSLSTADCNTNAVWNYTVPVNSPGGDIYGFELSYQTPFTFLPGFWQDFGFIGSFTYVKGQIAYLDPNTGNVEFVSDLENMSVNTSSATLYYEKDAFQARISLASRSGYLTNARGRDGNSAEGTHSTHNVDASASYQLNDNWRFTFEALNLTNEADDQWVDSNDYRLSYYHETGRQYYLGVQYKY

SEQ ID NO: 6515 - protein, 379 aa, Bacteroides uniformis ATCC 8492
MMKSKMKLMPLLVSVTLISGCTVLPGSNMSTMGKDVIKQQDADFDLDKMVNVYPLTPRLIDQLRPRPNVARPNMTLESEIANYQYRVGPGDVLNVTVWDHPELTTPAGQYRSSSDTGNWVQPDGTMFYPYIGKVHVVGKTLAEIRSDITGRLATYIADPQVDVNIAAFRSQKAYISGQVNKSGQQAITNVPLTILDAINAAGGLTDTADWRNVVLTHNGREERISLQALMQNGDLNQNRLLYPGDILYVPRNDDLKVFVMGEVKKQSTLKMDFSGMTLTEALGNAEGIDMTTSNASGIFVIRPLKGEGGRNGKIANIYQLDMSDATSLVMATEFRLQPYDVVYVTTAPVSRWNRLINQLLPTISGVRYMTDTASDIHNW

SEQ ID NO: 6516 - protein, 417 aa, Bacteroides uniformis ATCC 8492
MKTELAVTALALSCASAFAQAPGTLEVYGLLDVGINHVTGIAGGSKTSLASGIMDGSRLGVRGNEDIGGGWRSLFVLESRVEVNSGTFSNRPASGSQLPDRLAQAGLLSPSAPLPQLPVTGAANAIGSRIGVNLANSIWDRQVYVGLVTPVGALLAGHQYTPAYEVFATFDATHTSSSLSAGQINSTPTGVDIRADNALAYRIQSGGLTASLMRTFDGGTISKANRLMGLGVTYKSERFSVGAGYNTHNNELGQTALKSGLVGASLALGPGTLSGLAAAIKDDHPAGLSTLSAQLQAAPTPTPAFVADAIQAAFVTGLKQDARLFNIGYTLVTGALTSTVAYSRYDDRRSFDADVSSYGVTYSYALSKRTDINAVLTRFENKGLAQAAPGGGGFLGGFTATAGTDSNNVALGIRHRF

SEQ ID NO: 6517 - protein, 403 aa, Bacteroides uniformis ATCC 8492
MLGVLGAPVEAGLLQPLLGLPDWVDFSIQFTSEPMGGIQGGLNPSASSWFQNTVVGLSLGSGLNKPEKNWKELDHWQVNLELTNQAGNPNLNTELGSAFPLQTLVNPVGTWITAASVERNRGESWWSASAGLLSMDPDFLVTPAMNSYINSTLNNTLNLLVVGLPINPFVTPGVKVAAHSETMGSLAYGYFHLDPETSIAASLGVNPEQPQVQGGVQALQWSINPLRSRQDLLEPIRLNNSHVTVERMLPAPEAQLGSYLASTKLPSAQTPGMGSGLNRGIYGSLTWPLDVPLGMDNRLWAAGSLSLDPDNNPFPTFLGGGWLSQGVLPNRPLDVLALGVSRTSFSPTLSPGATYEGVIELNYSIHVSETVQLQPVMQWIINPGGEGQVQGIWAGGVQLNLNL

SEQ ID NO: 6518 - protein, 96 aa, Bacteroides uniformis ATCC 8492
MKRESLAVAGIGIGAAVPPALAQSSVALYGIVDSGITCSRNQKGRSAWPATSGNERARVWGLLGREDLGGGTSALFSLRTGGAGRFNHFEGSVRTA

SEQ ID NO: 6519 - protein, 369 aa, Bacteroides uniformis ATCC 8492
MENNMFPYRILRQTHLAKQFILLSLLCYGVTHAAEQQNPAQLIDEDKPQTLITLPEAYLYMGSEIGINHYQHGCESWSIDCDKNSTMASFFAGYQFNHHLAFEVAYIDLGKAEATYLEASKQNIYQGSMRGLNLSSVASIDFGADLALFAKAGVFNWHGENKGPFSTIKADDWSPSFGVGMTYQLSDSWQARLQYEYFHHLGNDDIGGTNAHATSLGISYQFGRSRPEVITSTVINSVTNTVIKATPIELEEVTFPVLFNFDSSELFFVDSLQIIINRLIQFPQATVILRGYSDSQGSSEYNLALSKRRTDSITQYLTEHGVKPQQIIAEHYGEQYPVTDKISEQHKHLNRRVQVLLPQTIIQPQQEQR

SEQ ID NO: 6520 - protein, 698 aa, Bacteroides uniformis ATCC 8492
MKKHVSILTAMTVLLTSQGLHAQNASSEINTITIQDDQAQEPLEAFGFPEVPAQNLPLSTSQISDKTLRENRIHRLSDITLIEASVTDSYNASGYWDYMSIRGFTLDNRANFLREGLPINAQTSIPLENKERLEVLKGLSGLQTGASSPGGMINYVVKRPTARRQLLLETEVGSYGDWLIAADAAGPVKGSEQFGYRLNVAHENLSPAVQDSKGERSVLALANSWRISESQLLESDIEWSRKSQPTQAAFSLLGNALPSVSDPRLNLNNQSWSQPVVFTGLTGSLKYTHRLNQNLIWHTAAGAQELHTDDRLAYPFGCSAENNYDRYCSDGTFDMYDFRSENERRSTQAVKTSLQIKAETGSISHDINVGYLGHVSRERYDKQAYNPVGVGNVQGTAKLPADPALTDENTNRDSEVNELFAFDSVKLGAWGAWLGLRFSDVHRSSVRTDASRATDYRENFVLPWLALSYQFPAWMTYVSYGEGVETYVTPNRSGYTNPGQFVPDVISKQVEVGVRGGETVTWNLAAFQIERPQVEDQRPDYKIDGLSRHQGIEAELTGETGRLQWAASAMWLKARRLDSNLNPAVNDQRPTNLPEHTLRAHVNYLIPAVQGLSVNSRVSYEGERAVTADNSLMLSAWTRWDAGASYEFGKKDDKTVVRLSVENLTDERYWKESPTQYGHIYLYPGEVRSVFLTLQTNL

SEQ ID NO: 6521 - protein, 330 aa, Klebsiella pneumoniae
MATMKDVARLAGVSTSTVSHVINKDRFVSEAITAKVEAAIKELNYAPSALARSLKLNQTHTIGMLITASTNPFYSELVRGVERSCFERGYSLVLCNTEGDEQRMNRNLETLMQKRVDGLLLLCTETHQPSREIMQRYPTVPTVMMDWAPFDGDSDLIQDNSLLGGDLATQYLIDKGHTRIACITGPLDKTPARLRLEGYRAAMKRAGLNIPDGYEVTGDFEFNGGFDAMRQLLSHPLRPQAVFTGNDAMAVGVYQALYQAELQVPQDIAVIGYDDIELASFMTPPLTTIHQPKDELGELAIDVLIHRITQPTLQQQRLQLTPILMERGSA

SEQ ID NO: 6522 - protein, 212 aa, Brucella microti
MFKRSITAAALGAAVMAFAGSAFAADMMGGTDYTYNDPVAAGLHDWSGNYVGAQVGGSSSKFPSPFASRTGALGGIVVGKNMQNGNIVFGAELEGNFAEAEHRIGHGGTLQQSWNGNAKGKVGYAFDKTLVYGTAGYGVTRFKAKDNTTSAPGWEGGVLIGAGVEQALSGPLSVKAEYDFQRFNDVKSQVNGIEQRNNLKNHSIKAGLNYKF

SEQ ID NO: 6523 - protein, 213 aa, Brucella microti
MRTLKSLVIVSAALLPFSATAFAADAIQEQPPVPAPVEVAPQYSWAGGYTGLYLGYGWNKAKTSTVGSIKPDDWKAGAFAGWNFQQDQIVYGVEGDAGYSWAKKSKDGLEVKQGFEGSLRARVGYDLNPVMPYLTAGIAGSQIKLNNGLDDESKFRVGWTAGAGLEAKLTDNILGRVEYRYTQYGNKNYDLAGTTVRNKLDTQDFRVGIGYKF

SEQ ID NO: 6524 - protein, 162 aa, Brucella microti
MNIFQTSLKCCVGLVLSVGVLLGDSKAFKVRVDKSLTPPFLNVLSLAFKQDMKKEVIFVITKSNKLSKKVLCDFDAFLLPETLMSGMPKKALFHKEFLFQSKENKTLYAFSLIDSQYCSKGGNYRYELEKLERWFVQKAPELAESYRVNYKNQYNKTQISQK

SEQ ID NO: 6525 - protein, 240 aa, Brucella microti
MKSVILASIAAMFATSAMAADVVVSEPSAPTAAPVDTFSWTGGYIGINAGYAGGKFKHPFSSFDKEDNEQVSGSLDVTAGGFVGGVQAGYNWQLDNGVVLGAETDFQGSSVTGSISAGASGLEGKAETKVEWFGTVRARLGYTATERLMVYGTGGLAYGKVKSAFNLGDDASALHMWSDKTKAGWTLGAGAEYAINNNWTLKSEYLYTDLGKRNLVDVDNSFLESKVNFHTVRVGLNYKF

SEQ ID NO: 6526 - protein, 696 aa, Brucella microti
MFSKSQLTLLIGAVLSAPVAYAESTEVDEHMVVTGRDYGYKADTNSTAMRMEMTQLETPGQVAVIDEQLIDEQRASTLGEVLQNDASISAGGTGRNRERFSLRGFELGSSSGFLRDGHQHWSHYRQPVELLERVEVMKGPAGLLYGKSAPGGLVNMVAKKPTHETQVNFSQDVGSNNHTRSVLDVSGSLNQDESLRARAVVAKEDYDSWRKYGNGSTPSTDRFVGGLFVDYDFNEDVTLSLHYDRTEDKGSVDSGAYIVDGKPVLGRDHVWDAQWSKINNEVENYGFDVKAQLTDVWALNTGFNYQDFIRHDVESYPNFSNFEESGLVKQGGNDRHDHWKFKTAYADFVGEFDALGMQHQLLVGSNWLGYSYDRFQRSFNSVEVATNQSTAVPSYKSGKPKESHSSYNAWGFYAQDMVTINDYWQVLAGVRFDRQTQEGKAAEEAVSPKVAAIFHPAENGSIYFSYSESFEPQGTVSSDSTNYVNDGEQLDPLRGKQYELGTKWELLDNRLFVSGAVFNIRQENSTIDVQVSKDLYEKTQAGERVHNGAELALQGSVTDKLSMSASAMYLDAEYTKDQNYQGNRPVDVPEFAASVWSTYNVTPSTDVNLGVIYEGSRYGDAANTFKKDGYTRVDLGMAHTYKYDANLDIIGRINVENVFDTDYMAGGGSTSKDYVGATGVTLGEGRNFMATVEFKY

SEQ ID NO: 6527 - protein, 233 aa, Wolbachia endosymbiont of Anastrepha amita
FDQLKWRVSYGLNYNSGGIRQTLGMPFYDFTNSDTYRGNRMINLVEFYNPDLKFEKTKQWSAAVDFGLLDHRLYGTLEAYVKNTDDLLSTIDIPASNGYTSLLQNIGALQNKGIELTLSGVPIRTDHFRWTSRLNVAYNINEITDLYGQDEIRVGSEGYFKVGEPINSAFVKHWAGVNPVNGVPIYYTRSRELVGGSNAPQMIGFGTYNHPYTGGLTNIFNYKNLEVSMLLTF

SEQ ID NO: 6528 - protein, 194 aa, Wolbachia endosymbiont of Anastrepha obliqua
FEILPLFTKVDGITYKKDKSDYSPLKPSFIAGGGAFGYKMDDIRVDVEGVYSYLNKNDVKDVTFDPANTIADSVTAISGLVNVYYDIAIEDMPITPYIGVGVGAAYISTPLEPAVNDQKSKFGFAGQVKAGVSYDVTPEVKLLYAGARYFGSYGANFDGKKTDPKDSTRQVTDAGVYKVLYSTVGAEAGVAFNF

SEQ ID NO: 6529 - protein, 189 aa, Wolbachia endosymbiont of Anastrepha serpentina
FEILPLFTKVDGITYKKDKSDYSPLKPSFIAGGGAFGYKMDDIRVDVEGVYSYLNKNDVKDVTFDPANTIADSVTAISGLVNVYYDIAIEDMPITPYIGVGVGAAYISTPLEPAVNDQKSKFGFAGQVKAGVSYDVTPEVKLYAGARYFGSYGANLDGKKTDPKGSTRQVTDAGAYKVLYSTVGAEAGV

SEQ ID NO: 6530 - protein, 193 aa, Wolbachia endosymbiont of Anastrepha sororcula
FEILPLFTKVDGITYKKDKSDYSPLKPSFIAGGGAFGYKMDDIRVDVEGVYSYLNKNDVKDVTFDPANTIADSVTAISGLVNVYYDIAIEDMPITPYIGVGVGAAYISTPLEPAVNDQKSKFGFAGQVKAGVSYDVTPEVKLYAGARYFGSYGANFDGKKTDPKDSTRQVTDAGAYKVLYSTVGAEAGVAFNF

SEQ ID NO: 6531 - protein, 188 aa, Wolbachia endosymbiont of Anastrepha sp. 2
FEILPLFTKVDGITYKKDKSDYSPLKPSFIAGGGAFGYKMDDIRVDVEGVYSYLNKNDVKDVTFDPANTIADSVTAISGLVNVYYDIAIEDMPITPYIGVGVGAAYISTPLEPAVNDQKSKFGFAGQVKAGVSYDVTPEVKLYAGARYFGSYGANFDGKKTDPKDSTRQVTDAGAYKVLYSTVGAEAG

SEQ ID NO: 6532 - protein, 191 aa, Wolbachia endosymbiont of Anastrepha sp. 2
FEILPLFTKVDGITYKKDKSDYSPLKPSFIAGGGAFGYKMDDIRVDVEGVYSYLNKNDVKDVTFDPANTIADSVTAISGLVNVYYDIAIEDMPITPYIGVGVGAAYISTPLEPAVNDQKSKFGFAGQVKAGVSYDVTPEVKLYAGARYFGSYGANFDGKKTDPKDSTRQVTDAGAYKVLYSTVGAEAGVAF

SEQ ID NO: 6533 - protein, 187 aa, Wolbachia endosymbiont of Anastrepha sp. 3
FEILPLFTKVDGITYKKDKSDYSPLKPSFIAGGGAFGYKMDDIRVDVEGVYSYLNKNDVKDVTFDPANTIADSVTAISGLVNVYYDIAIEDMPITPYIGVGVGAAYISTPLEPAVNDQKSKFGFAGQVKAGVSYDVTPEVKLYAGARYFGSYGANFDGKKTDPKDSTRQVTDAGAYKVLYSTVGAEA

SEQ ID NO: 6534 - protein, 766 aa, Wolbachia endosymbiont of Anastrepha striata
MKETAPSKRRVAACRARIALCCGGAFGGLLIAWPAHAAPDDSRDATTLAPIVVVGTTPLLGLGTPLSRVPSNVQTVRSAEQERQHRSTLTDYLDKNATSVDIAEAQGNPYQPDVNYRGFTASPVVGTPQGLSVFVDGVRINESFGDVVNWDILPPSAIDTLQLIPGSNPTYGLNTLGGALAITTKNGSTSPGGAVEVGAGSWGRKTVQFEQGGRVGDRVDYYLNANVANDNGWADHNASRVRQIFGKLRYTDADTTLSLSAGGADNTLQGTQTIPRSFLDNPRQAYTYPDLNRNRAGYLTLSGDHAFGDRVQLSGNVYYRRYRNTNVSSNVNEDVGRADDDDAADGAQATNDRSTIATERYGASLQLTLLGKPAGFDNQLVLGASADLANARFEQASQPAAFTDSRATIGIGEFQQTTRAKTRNANYGFYFDDTLQLAPQWSLTLAGRYDWARAAIEDVSGLQPLLTARHTFSRFNPAIGVTWNPAPGLTAYATYNEGMRSPTAIELACADPAAPCSLPNDFLADPPLKPVIAKTVEFGARGRVGAATTWSAALYRTTLDDDIQFVSSNGGAGTLGYFQNVGKTRRQGIELAAHTRVGPVGIGVSYSYVDASYRSTWTEHSASNSSADARGNIVVRSGDRIPGIPASTAKLRLDYAATPTWSLGTNLTYRSGVFARGDENNRDAGGKLPGYLLIDVDTTWQATKHLQLFASITNLLDKRYASFGMLGRNFFNGPNHMFDGAAAVDETFVGPGAPRGAWIGMRYAWD

SEQ ID NO: 6535 - protein, 171 aa, Wolbachia endosymbiont of Anastrepha pickeli
FLLTEVDGVTGAKKKNARSDVTTDLYKASFMAGGSAFGYKMDDIRVDIEGLYSQLSRNTFETAPTPAIADNLNALSGLVNVYYDVAIEDMPITPYIGVGVGAAYLSNPLATKVTGDKEYGFGFAYQAKAGVSYDITPEIKLFAGARYFGSYGAKFDKPVAESGQQPAKDGI

SEQ ID NO: 6536 - protein, 201 aa, Wolbachia endosymbiont of Anastrepha serpentina
GEFLPLFTKVDGITYKKDKSDYSPLKPSFIAGGGAFGYKMDDIRVDVEGVYSYLNKNDVKDVTFDPANTIADSVTAISGLVNVYYDIAIEDMPITPYIGVGVGAAYISTPLEPAVNDQKSKFGFAGQVKAGVSYDVTPEVKLYAGARYFGSYGANFDGKKTDPKDSTRQVTDAGAYKVLYSTVGAEAGVAFNFYQAKAGNH

SEQ ID NO: 6537 - protein, 179 aa, Wolbachia endosymbiont of Anastrepha obliqua
GEFLPLFTKVDGITYKKDKSDYSPLKPSFIAGGGAFGYKMDDIRVDVEGVYSYLNKNDVKDVTFDPANTIADSVTAISGLVNVYYDIAIEDMPITPYIGGGVGAAYISTPLKTAVNGQNSKFGFAGQVKAGVSYDVTPEVKLYAGARYFGSYGANFDKSGGEKDKGGHTVLYSTVGAEA

SEQ ID NO: 6538 - protein, 174 aa, Wolbachia endosymbiont of Anastrepha pickeli
LPLFTKVDGIAHKSGKDNNSPLKASFIAGGGAFGYKMDDIRVDVEGLYSWLNKDADVVGDTVAESLTAISGLVNVYYDVAIEDMPITPYVGVGVGAAYISTPLATAVSSQNGKFAFAGQARAGVSYDVTPEVKLYAGARYFGSYGANFDKTDKDGKGELKVLYSTVGAEAGVAF

SEQ ID NO: 6539 - protein, 188 aa, Wolbachia endosymbiont of Anastrepha grandis
GEFLPLFTKVDGITYKKDKSDYSPLKPSFIAGGGAFGYKMDDIRVDVEGVYSYLNKNDVKDVTFDPANTIADSVTAISGLVNVYYDIAIEDMPITPYIGVGVGAAYISTPLEPAVNDQKSKFGFAGQVKAGVSYDVTPEVKLYAGARYFGSYGANFDGKKQILKIQPDRLLMQAHTKFFTALLVQKLE

SEQ ID NO: 6540 - protein, 193 aa, Wolbachia endosymbiont of Ceratitis capitata
FEILPLFTKVDGITYKKDKSDYSPLKPSFIAGGGAFGYKMDDIRVDVEGVYSYLNKNDVKDVKFDPANTIADSVTAISGLVNVYYDTAIEDMPITPYIGVGVGAAYISTPLEPAVNDQKSKFGFAGQVKAGVSYDVTPEVKLYAGARYFGSYGANFDGKKTDPKDSTRQVTDAGAYKVLYSTVGAEAGVAFNF

SEQ ID NO: 6541 - protein, 192 aa, Wolbachia endosymbiont of Anastrepha grandis
FEILPLFTKVDGITYKKDKSDYSPLKPSFIAGGGAFGYKMDDIRVDVEGVYSYLNKNDVKDVTFDPANTIADSVTAISGLVNVYYDIAIEDMPITPYIGVGVGAAYISTPLEPAVNDRKSKFGFAGQVKAGVSYDVTPEVKLYAGARYFGSYGANFDGKKTDPKDSTRQVTDAGAYKVLYSTVGAEAGVAFN

SEQ ID NO: 6542 - protein, 329 aa, Francisella tularensis
TADVTLYGTIKAGVQTYRSVEHTKGKVSKVETGSEIADFGSKIGFKGQEDLGNGLKVVWQLEQGASVAGTNTGWGNKQSFVGLKGGFGTIRAGSLNSPLKNTKDNVNAWESGKFTGNVLEISGMAKREHRYLSVRYDSPEFAGFSGSVQYAPKDNSGSNGESYHVGLNYQNNGFFAQYAGLFQRYGEGTKKIEGYTYNIPSLFVEKLQVHRLVGGYDNNALYASVAAQQQDAKLYGTWRANSHNSQTEVAATVAYRFGNVTPRVSYAHGFKGTVDDANHDNTYDQVVVGAEYDFSKRTSALVSAGWLQEGKGADKIVSTASAVVLRHKF

SEQ ID NO: 6543 - protein, 741 aa, Campylobacter concisus
MKRVLLSAAASIAAIATAGTGTAFAQNVVDAQDADGVPDIVVTATRMGETQLQSTPIAVTALGGDQLDARGVRDVQDLKAYVPSLQVSDLSGYTQLFIRGIGSNIVFIGSDPSTTIHSDGIYLARPLSYLTDFLDVERVEVLRGPQGTLYGRNSVGGTINVVSRKPSDTLQAQAQFGYGSYDRYAAQGYVSGPIAGGVRASLAVDVSGHDAFRKNISTGNDAEDLKSRGVRGQLLIPVGDGEWTIRADWSRQSGAFGAYPKLIRPTGNPFDDAILGDFDKVSMNRDNFTVLKNYGAASDLVLPLTDSIKLRSLTGYRAFRGSIETDADASSIDILRNLISPIRQHQFSQEFTLLGDTGPLEWVLGAYYFNERNREPLTLALFPFGASHIQRPLLKARSIAGFAQGEYKLSDQLSFIAGLRYTRERKAYAISDYFTASTDLDPAVAEKGFVLAGIPGLPDPFTVDARRHDDAFTPKFGITFKPTEQVLLYASATRGFKSGGFDYGSSNAADAAAGYGPEKLWSYELGLKSDWLDRRLRVNLTGFYYDYTDLQVQSYVQIGASFGARTQNAATARVKGLEAEIVARPVRALELSANVAWLDAEYRRYPNAFVSSFGAFDASGKRLNNAPRWSATFGAAYSFDLAGSGKLTLGADAHVQSSIYFTAANDGVGAVSGYAEQQKGYGIVNARIGWTSPDDRWKAQLIASNLFDKDYIVGTANYTAAIAARQGRPREVLVQIGYAFR

SEQ ID NO: 6544 - protein, 204 aa, Campylobacter concisus
MSYKHLISACIFSSLCLGQVNAVLAEDKLPPSNTSTGQHSELSVDNDNLWQRLLRNISLAWDSPNQELYIPLNTWHNRWTYDDDKIESYNERPWGIGYGKYRYDENNNWHAVYAMAFMDSHNEVEPIIGYGYQKMWIPAEMDGWRFGVGFTASITARHEYHYIPIPLPLPLISIEYNKFSLQTTYIPGTYNNGNVLFTWMRWQF

SEQ ID NO: 6545 - protein, 723 aa, Campylobacter concisus
MKNNLLTIPFKDIAKHKITYHSLFCVVISLFYPNTLFAKSDNKLSKDSIIVSAKGNNNLQPNLFSSRSMQAGLLGDNDIMDIPFNITNYNSAYLESQQAQQISDILSHDTSIQISSSKGGLLDSLYIRGFPITEGNIGEFALNGIYGVSPNFQLLADYAERVDILKGPASLLYGMSPEGGVGGVINVVTKRASAQPITRLTAQYLSDSQLGGKLDVGRLYDLGNNQYFGIRVNGSYTNGNTAVDHQDRRLGVGAIALDYSSERFRASLDLITQNQNMNATNRPFFLGENGVVPSAPSGKTNLASPWTWWKSNDDSALLHMEYDVLSNTSLFMDIGGARTRIDRVNEQTYTVLNDQGDISTYIMNFQSKTQRYSVGTGIKSEFMTGNTSHQLALQWNRYFDRYNVGTNAGTPYNTNLYHPTYIDKQIPDYPEITKRSENTLSGVSLVDTIGFFNDSFMVTPGIRYQNIKSDSFTLGALSTTYDESAITPLVGLLFKPTDNISLYANYVEGLSKGSTAPVNAKNSGEMMKPFRSKQYELGVKYEQPVAITTLSLFQISKPSGSLDPNSLIYSANDEQRNRGIELSVSGKPFDSLRLTGGVTYIQAELTKTASGQNKGNEPIGVSPWVANFGAEYDIPSVSGLSINGNINYHTRQYVNKENTHSIPSWTTVDIGSAYKTKISNTPVTLRLNITNILNERYWSGVASYSTFAQGSPRTVLGSISVDF

SEQ ID NO: 6546 - protein, 786 aa, Campylobacter concisus
MRFITGLLFTFICLLPAGSMAQNKVTLSGKVIDQHGTPIAQATIAVENTTSGTYTDDRGKYSLQVAPGKHTFVVSFLGYQTVKQSLDIRQDKKQNFTLQESAVALNSVEVYGKTQTQKVKEGAFAVNALDIKPIVNSLNNLNDLVNRTTGIKVREEGGVGSDFDLSINGLSGNSIRYFLDGMPLDTKGSGVSLANLPINIIDRIEIYKGVVPASLGTDALGGAINIITKQEKKNYLDVSYGIGSFHTHKTDLNTQFVEKGTGLIVRPTVGINYSKNDYRMKNVQMRDESGDNFIYGNPKRFHDGYFSLLAQVEAGFVNKSWADAFFVSASYSKTDKELQTGSVQNKVYGMAERNSDSWNISARYQKYNFILKNMQLNASLSHTWDHSLTVDTAYRKYYWDGGYIVSQRNEIMGKEPSMRHYKRPLTIMRTNLDYQLNTHHSFNLNYHLSRTGNDRFDDLDTSFEPSKDVVTKHILGLSYNQSLLDGKMENVFFIKDYINHPNIRQTDQSSVTGSKDVQGSTTKNYLGYGAGLRYTIVEPLSIKVSYEHSVRLPIARELLGNGTTIYANVALKPENSNNFNASLFGTWHPGNGHTFYYEMSGFFRKVDNYIQTSIAEKEGTMQYTNVPAVHVKGAEGEMRYDWQGRLQLATNVSYQDTRDQQKYKGDGKPSATYNNRVPNRPWLFGSVEAYYTFRNIALPESRLRLGCTYQWVHWYFLTWEAYGAYDNKARIPAQHICNADITYSWRRGRYNLALECTNFLDKTAYDNYKLQKPGRAFFAKFRLFIN

SEQ ID NO: 6547 - protein, 1364 aa, Escherichia coli O139:H28
MNKVFSLKYSFLAKGFIAVSELARRVSVKGKLKSASSIIISPITIAIVSYAPPSLAATVNADISYQTFRDFAENKGAFIVGASNINIYDKNGVLVGVLDKAPMPDFSSATMNTGTLPPGDHTLYSPQYVVTAKHVNGSDIMSFGHIQNNYTVVGENNHNSLDIKTRRLNKIVTEVAPAEVSSVGAVNGAYQEGGRFTAFYRLGGGLQYIKDKNGNLTPVYTNGGFLTGGTISALSSYNNGQMITAPTGDIFNPANGPLANYLNKGDSGSPLFAYDSLEKKWVLIGVLSSGSEYGNNWVVTTQDFLNQQQKHDFDKTISYDSKKGSLQWRYDKDAGVGTLSQEGVVWDMHGKKGEDLNAGKNLQFTGNNGEVILHDSIDQGAGYLQFFNNYTVTSLTDQTWTGGGIITEKGVNVLWQVNGVNNDNLHKVGEGTLTVNGKGVNNGGLKVGDGTVILNQRPDDNGHKQAFSSINISSGRATVILSDANQVNPDKISWGYRGGTLDLNGNNVTFTRLQAADYGAIISNNNKNKSELTLKLQTLNENDISVDVKTYEVFGGRGSPGDLYYVSASNTYFILKSKAYGPFFSDLDNTNVWQNVGHDRDKAIQIVKQQKIEESSQPYMFHGQLNGYMDVNIHPLSGKDVLTLDGSVNLPEGVITKKSGTLIFQGHPVIHAGMTTSAGQSDWENRQFTMDKLKLDAATFHLSRNTRMQGDISAANGSTVILGSSRVFTDKNDGTGNAVSSVEGSSTATTAADQSYYSGNVLLENHSSLEVRENFTGGIEAYDSSVSVTSQNAILDHVGSFINSSLLLEKGAKLTAQSGIFTNNTMEIKENASLTLTGIPSVGKPGYYSPVISTTEGIHLGERASLSVKNMGYLSSNIIAEDSAAIINLGDSNATIGKTDSPLFNTLMRGYNAVLQGNIMGPQSSVNMNNALWHSDRNSEIKELKANDSQIELGGRGHFAKLRVKELIASNSVFLVHVNNGQADQLNVTGKLQGSNNTILVNFFNKAANGTNVTLITAPKGSDENTFKAGTQQIGFSNITPEIRTENTDTATKWVLTGYQSVADARASKIATDFMDSGYKSFLTEVNNLNKRMGDLRDSQGDAGGWARIMNGTGSGESGYRDNYTHVQIGADRKHELNGLNLFTGALLTYTDSNASSQAFSGKTKSLGGGVYASGLFESGAYFDLIGKYLHHDNRYTLNFASLGERSYTTHSLYAGAEIGYRYHMSENTWVEPQMELVYGSVSGKSFNWKDQGMQLSMKDKDYHPLIGRTGVDVGRVFSGDTWKVTARAGLSYQFDLLANGETVLQDASGKKHFKGEKDSRMLMNVGTNVEVKDNMRFGLELEKSAFGRYNIDNSINANFRYYF

SEQ ID NO: 6548 - protein, 747 aa, Escherichia coli O139:H28
MARSKTAQPKHSLRKIAVVVATAVSGMSVYAQAAVEPKEDTITVTAAPAPQESAWGPAATIAARQSATGTKTDTPIQKVPQSISVVTAEEMALHQPKSVKEALSYTPGVSVGTRGASNTYDHLIIRGFAAEGQSQNNYLNGLKLQGNFYNDAVIDPYMLERAEIMRGPVSVLYGKSSPGGLLNMVSKRPTTEPLKEVQFKAGTDSLFQTGFDFSDSLDDDGVYSYRLTGLARSANAQQKGSEEQRYAIAPAFTWRPDDKTNFTFLSYFQNEPETGYYGWLPKEGTVEPLPNGKRLPTDFNEGAKNNTYSRNEKMVGYSFDHEFNDTFTVRQNLRFAENKTSQNSVYGYGVCSDPANAYSKQCAALAPADKGHYLARKYVVDDEKLQNFSVDTQLQSKFATGDIDHTLLTGVDFMRMRNDINAWFGYDDSVPLLNLYNPVNTDFDFNAKDPANSGPYRILNKQKQTGVYVQDQAQWDKVLVTLGGRYDWADQESLNRVAGTTDKRDDKQFTWRGGVNYLFDNGVTPYFSYSESFEPSSQVGKDGNIFAPSKGKQYEVGVKYVPEDRPIVVTGAVYNLTKTNNLMADPEGSFFSVEGGEIRARGVEIEAKAALSASVNVVGSYTYTDAEYTTDTTYKGNSPAQVPKHMASLWAGYTFFDGPLSGLTLGTGGRYTGSSYGDPANSFKVGSYTVVDALVRYDLARVGMAGSNVALHVNNLFDREYVASCFNTYGCFWGAERQVVATATFRF

SEQ ID NO: 6549 - protein, 351 aa, Escherichia coli O139:H28
MKKSTLALVVMGIVASASVQAAEIYNKDGNKLDVYGKVKAMHYMSDNDSKDGDQSYIRFGFKGETQINDQLTGYGRWEAEFAGNKAESDTAQQKTRLAFAGLKYKDLGSFDYGRNLGALYDVEAWTDMFPEFGGDSSAQTDNFMTKRASGLATYRNTDFFGVIDGLNLTLQYQGKNENRDVKKQNGDGFGTSLIYDFGGSDFAISGAYTNSDRTNEQNLQSRGTGKRAEAWATGLKYDANNIYLATFYSETRKMTPITGGFANKTQNFEAVAQYQFDFGLRPSLGYVLSKGKDIEGIGDEDLVNYIDVGATYYFNKNMSAFVDYKINQLDSDNKLNINNDDIVAVGMTYQF

SEQ ID NO: 6550 - protein, 1327 aa, Escherichia coli O139:H28
MNKIYRLKWNRSRNCWSVCSELGSRVKGKKSRAVLISAISLYSSLVFADDVIVNQDKTIDFGKENQSIDYRITVTDNANLVINTTDTSRPRLTLASGGGLDITGGKVTINGPLNFLLKGTGFLNVSNAGSELYADDLYESNSGMRHDQGYFNVSNGGKIHVKGTSRLTYTQGNVSGEGSQVNAGTFFMGVYGGYGGNQFLSVNNGGEVNAREHISLGYYDQRSDTTLVVSDGGKISAPKISLSTNSELALGAQEGSAAKAAGIIDAEKIEFVWAKTSDKKITLNHTDKNATISADIVSGSEGLGYINALNGTTYLTGDNSAFSGKVKIEQNGALGITQNIGTAEINNRGKLHLKADDSMTFANKISGNGTISIDSGTVALTGNNYAFSGYIDVASGAVAVISEDKNIGRADLDVDGKLQINANKDWVFDNDLQGRGIVEINMGNHEFSFDEFAYTDWFQGSLAFQNTTFNLEKNAEFLQRGGITAGQGSQVTVGKGAHSISTLGFSGGTVDFGALTAGAQMTEGTVNVSKTLDLRGEGVIQVSDSDVVSSVSRDIDSALSLTEVDDGNSTIKLVDAQGAEVLGDAGNLQLQDKNGQILSSSAQRDIQQNGQKAAVGTYDYRLTSGVNNDGLYIGYGLTQLDLHATDSDALVLSSNGKSENAADLSAKITGSGDLAFSSQKGQTVSLSNKDNDYTGVTDLRSGTLLLNNDNVLGNTHELRLAAETELDMNGHSQTVGTLNGSADSLLSLNGGSLTVTNGGTSTGSLTGSGELNIQGGTLDIAGDNSNLTANVNIANSANVLVSHAQGLGSANVENNGTLALNNSAEKRAAASVNYTLGGNLTNNGTLMTGMSGQQAGNVLVVKGNYHGNNGQLVMNTVLNGDDSVTDKLVVEGDTSGTTAVTVNNAGGTGAKTLNGIELIHVDGKSEGEFVQAGRIVAGAYDYTLARGQGANSGNWYLTSGSDSPELQPEPDPMPNPEPNPNPEPNPNPTPTPGPDLNVDNDLRPEAGSYIANLAAANTMFTTRLHERLGNTYYTDMVTGEQKQTTMWMRHEGGHSKWRDGSGQLKTQSNRYVLQLGGDVAQWSQNGSDSWHVGVMAGYGNSDSKTISSRTGYRAKASVNGYSTGLYATWYADDESRNGAYLDSWAQYSWFDNTVKGDDLQSESYKSKGFTASLEAGYKHKLAEFNGSQGTRNEWYVQPQAQVTWMGVKADKHRESNGTLVHSNGDGNVQTRLGVKTWLKSHHKMDDGKSREFQPFVEVNWLHNSKDFSTSMDGVSVTQDGARNIAEIKTGVEGQLNANLNVWGNVGVQVADRGYNDTSAMVGIKWQF

SEQ ID NO: 6551 - protein, 147 aa, Escherichia coli O139:H28
MSGDSGGQSSNYAFIRPGTIISNGVKIGFATEIKNAVIEAEATIGPQCFIADSVVANQAYLGAQVRTSNHRLDEQPVSVRTPEGIIATGCDKLGCYIGQRSRLGVQVIILPGRIISPNTQLGPRVIVERNLPTGTYSLRQELIRTGD

SEQ ID NO: 6552 - protein, 294 aa, Escherichia coli O139:H28
MKKTLLAAGAVLALSSSFTVNAAENDKPQYLSDWWHQSVNVVGSYHTRFGPQIRNDTYLEYEAFAKKDWFDFYGYADAPVFFGGNSDAKGIWNHGSPLFMEIEPRFSIDKLTNTDLSFGPFKEWYFANNYIYDMGRNKDGRQSTWYMGLGTDIDTGLPMSLSMNVYAKYQWQNYDAANENEWDGYRFKIKYFVPITDLWGGQLSYIGFTNFDWGSDLGDDSGNAINGIKTRTNNSIASSHILALNYDHWHYSVVARYWHDGGQWNDDAELNFGNGNFNVRSTGWGGYLVVGYNF

SEQ ID NO: 6553 - protein, 746 aa, Escherichia coli O139:H28
MNKKIHSLALLVNLGIYGVAQAQEPTDTPVSHDDTIVVTAAEQNLQAPGVSTITADEIRKNPVARDVSEIIRTMPGVNLTGNSTSGQRGNNRQIDIRGMGPENTLILIDGKPVSSRNSVRQGWRGERDTRGDTSWVPPEMIERIEVLRGPAAARYGNGAAGGVVNIITKKGSGEWHGSWDAYFNAPEHKEEGATKRTNFSLTGPLGDEFSFRLYGNLDKTQADAWDINQGHQSARAGTYATTLPAGREGVINKDINGVVRWDFAPLQSLELEAGYSRQGNLYAGDTQNTNSDAYTRSKYGDETNRLYRQNYSLTWNGGWDNGVTTSNWVQYEHTRNSRIPEGLAGGTEGKFNEKATQDFVDIDLDDVMLHSEVNLPIDFLVNQTLTLGTEWNQQRMKDLSSNTQALTGTNTGGAIDGVSATDRSPYSKAEIFSLFAENNMELTDSTIVTPGLRFDHHSIVGNNWSPALNISQGLGDDFTLKMGIARAYKAPSLYQTNPNYILYSKGQGCYASAGGCYLQGNDDLKAETSINKEIGLEFKRDGWLAGITWFRNDYRNKIEAGYVAVGQNAVGTDLYQWDNVPKAVVEGLEGSLNVPVSETVMWTNNITYMLKSENKTTGDRLSLIPEYTLNSTLSWQAREDLSMQTTFTWYGKQQPKKYNYKGQPAVGPETKEISPYSIVGLSATWDVTKNVSLTGGVDNLFDKRLWRAGNAQTTGDLAGANYITGAGAYTYNEPGRTWYMSVNTHF

SEQ ID NO: 6554 - protein, 186 aa, Escherichia coli O139:H28
MNVSKYVAIFSFVFIQLISVGKVFANADEWMTTFRENIAQTWQQPEHYDLYIPAITWHARFAYDKEKTDRYNERAWGGGFGQSRWDEKGNWHGLYAMAFKDSWNKWEPIAGYGWESTWRPLADENFHLGLGFTAGVTARDNWNYIPLPVLLPLASVGYGPVTFQMTYIPGTYNNGNVYFAWMRFQF

SEQ ID NO: 6555 - protein, 468 aa, Escherichia coli O139:H28
MRTFSGKRSTLALAIAGVTAMSGFMAMPEARAEGFIDDSTLTGGIYYWQRERDRKDVTDGDKYKTNLSHSTWNANLDFQSGYAADMFGLDIAAFTAIEMAENGDSSHPNEIAFSKSNKAYDEDWSGDKSGISLYKAAAKFKYGPVWARAGYIQPTGQTLLAPHWSFMPGTYQGAEAGANFDYGDAGALSFSYMWTNEYKAPWHLEMDEFYQNDKTTKVDYLHSIGAKYDFKNNFVLEAAFGQAEGYIDQYFAKASYKFDIAGSPLTTSYQFYGTRDKVDDRSVNDLYDGTAWLQALTFGYRAADVVDLRLEGTWIKADSQQGYFLQRMTPTYASSNGRLDIWWDNRSDFNANGEKAVFFSAMYDLKNWNLPGFAIGASYVYAWDAKPATWQSNPDAYYDKNRTIEESAYSLDAVYTIQDGRAKGTMFKLHFTEYDNHSDIPSWGGGYGNIFQDERDVKFMVIAPFTIF

SEQ ID NO: 6556 - protein, 365 aa, Escherichia coli O139:H28
MKKLTVAISAVAASVLMAMSAQAAEIYNKDSNKLDLYGKVNAKHYFSSNDADDGDTTYARLGFKGETQINDQLTGFGQWEYEFKGNRAESQGSSKDKTHLAFAGLKFGDYGSIDYGRNYGVAYDIGAWTDVLPEFGGDTWTQTDVFMTGRTTGFATYRNNDFFGLVDGLNFAAQYQGKNDRSDFDNYTEGNGDGFGFSATYEYEGFGIGATYAKSDRTDTQVNAGKVLPEVFASGKNAEVWAAGLKYDANNIYLATTYSETQNMTVFADHFVANKAQNFEAVAQYQFDFGLRPSVAYLQSKGKDLGVWGDQDLVKYVDVGATYYFNKNMSTFVDYKINLLDKNDFTKALGVSTDDIVAVGLVYQF

SEQ ID NO: 6557 - protein, 760 aa, Escherichia coli O139:H28
MENNRNFPARQFHSLTFFAGLCIGITPVAQALAAEGQTNADDTLVVEASTPSLYAPQQSADPKFSRPVADTTRTMTVISEQVIKDQGATNLTDALKNVPGVGAFFAGENGNSTTGDAIYMRGADTSNSIYIDGIRDIGSVSRDTFNTEQVEVIKGPSGTDYGRSAPTGSINMISKQPRNDSGIDASASIGSAWFRRGTLDVNQVIGDTTAVRLNVMGEKTHDAGRDKVKNERYGVAPSIAFGLGTANRLYLNYLHVTQHNTPDGGIPTIGLPGYSAPSAGTAALNHSGKVDTHNFYGTDSDYDDSTTDTATMRFEHDINDNTTIRNTTRWSRVKQDYLMTAIMGGASNITQPTSDVNSWTWSRTANTKDVSNKILTNQTNLTSTFYTGSIGHDVSTGVEFTRETQTNYGVNPMTLPAVNIYHPDSSIHPGGLTRNGANANGQTDTFAIYAFDTLQITRDFELNGGIRLDNYHTEYDSATACGGSGRGAITCPAGVAKGSPVTTVDTAKSGNLVNWKAGALYHLTENGNVYINYAVSQQPPGGNNFALAQSGSGNSANRTDFKPQKANTSEIGTKWQVLDKRLLLTAALFRTDIENEVEQNDDGTYSQYGKKRVEGYEISVAGNITPAWQVIGGYTQQKATIKNGKDVAQDGSSSLPYTPEHAFTLWSQYQATDDISVGAGARYIGSMHKGSDGAVGTPAFTEGYWVADAKLGYRVNRNLDFQLNVYNLFDTDYVASINKSGYRYHPGEPRTFLLTANMHF

SEQ ID NO: 6558 - protein, 171 aa, Escherichia coli O139:H28
MKKIACLSALAAVLAFTAGTSVAATSTVTGGYAQSDAQGKMNKMGGFNLKYRYEEDNSPLGVIGSFTYTEKSRTASTGDYNKTQYYGITAGPAYRINDWASIYGVVGVGYGKFQTTEFPAYKHDTSDYGFSYGAGLQFNPIENVALDFSYEQSRIRSVDVGTWIAGVGYRF

SEQ ID NO: 6559 - protein, 362 aa, Escherichia coli O139:H28
MMKRNILAVIVPALLVAGTANAAEIYNKDGNKVDLYGKAVGLHYFSKGNGENSYGGNGDMTYARLGFKGETQINSDLTGYGQWEYNFQGNNSEGADAQTGNKTRLAFAGLKYADVGSFDYGRNYGVVYDALGYTDMLPEFGGDTAYSDDFFVGRVGGVATYRNSNFFGLVDGLNFAVQYLGKNERDTARRSNGDGVGGSISYEYEGFGIVGAYGAADRTNLQEAQLLGNGKKAEQWATGLKYDANNIYLAANYGETRNATPITNKFTNISGFANKTQDVLLVAQYQFDFGLRPSIAYTKSKAKDVEGIGDVDLVNYFEVGATYYFNKNMSTYVDYIINQIDSDNKLGVGSDDTVAVGIVYQF

SEQ ID NO: 6560 - protein, 348 aa, Escherichia coli O139:H28
MKKTAIAIAVALAGFATVAQAAPKDNTWYTGAKLGWSQYHDTGFIPNNGPTHENQLGAGAFGGYQVNPYVGFEMGYDWLGRMPYKGDNINGAYKAQGVQLTAKLGYPITDDLDIYTRLGGMVWRADTKANVPGGASFKDHDTGVSPVFAGGVEYAITPEIATRLEYQWTNNIGDANTIGTRPDNGLLSLGVSYRFGQGEAAPVVAPAPAPEVQTKHFTLKSDVLFNFNKATLKPEGQAALDQLYSQLSNLDPKDGSVVVLGYTDRIGSDAYNQGLSERRAQSVVDYLISKGIPADKISARGMGESNPVTGNTCDNVKRRAALIDCLAPDRRVEIEVKGIKDVVTQPQA

SEQ ID NO: 6561 - protein, 729 aa, Escherichia coli O139:H28
MLSTQFNRDNQYQAITKPSLLAGCIALALLPSAAFAAPATEETVIVEGSATAPDDGENDYSVTSTSAGTKMQMTQRDIPQSVTIVSQQRMEDQQLQTLGEVMENTLGISKSQADSDRALYYSRGFQIDNYMVDGIPTYFESRWNLGDALSDMALFERVEVVRGATGLMTGTGNPSAAINMVRKHATSREFKGDVSAEYGSWNKERYVADLQSPLTEDGKIRARIVGGYQNNDSWLDRYNSEKTFFSGIVDADLGDLTTLSAGYEYQRIDVNSPTWGGLPRWNTDGSSNSYDRARSTAPDWAYNDKEINKVFMTLKQRFADTWQATLNATHSEVEFDSKMMYVDAYVNKADGMLVGPYSNYGPGFDYVGGTGWNSGKRKVDALDLFADGIYELFGRQHNLMFGGSYSKQNNRYFSSWANIFPDEIGSFYNFNGNFPQTDWSPQSLAQDDTTHMKSLYAATRVTLADPLHLILGARYTNWRVDTLTYSMEKNHTTPYAGLVFDINDNWSTYASYTSIFQPQNDRDSSGKYLAPITGNNYELGLKSDWMNSRLTTTLAIFRIEQDNVAQSTGTPIPGSNGETAYKAVDGTVSKGVEFELNGAITDNWQLTFGATRYIAEDNEGNAVNPNLPRTTVKMFTSYRLPVMPELTVGGGVNWQNRVYTDTVTPYGTFRAEQGSYALVDLFTRYQVTKNFSLQGNVNNLFDKTYDTNVEGSIVYGAPRNFSITGTYQF

SEQ ID NO: 6562 - protein, 851 aa, Escherichia coli O139:H28
MAYLSISKNQCKSFLITLVTIFIMTSIPQLAEAVEHFANGVPTVVQDVNVPADSYFGGADSAVGPNPIASTHLTISTTQGFGQNALEFVVGGSLANGNGNPANINGDIVLIVENTNTQNSIIGGSMANAAPVTIGGSIFMTLRNVTAVDPIFGGSVDVRFFAQQQPNEDQLVGGDININLENVTTPEFYGLGYANGVIPVNVLNRNFLVAVQGNITTNISNSNIATVMLGSHYDTTMAVGGNGTINVDNSTIGYLSASNSSDFVNPDLTNTVTFNIGPNNRIANIFASNNGVIPHFIVNMDGSGTEIQELTLGNVIRGGLVLTSELNLSQGTINNLITGNEYYDRSGLRTTVNVRGGTIGVLTSGGSDYSELNFIPGEISTILATNSIGNQDFASLSQVTIHQGAETLWGMRDEVFELQTNNLQLGGELFIPADGTGGVALITNHIIANSGVITPVNMSPERMTPIIGFLEPTGEVAQLTIYGPLTVNLSHSPEILGKIITQPIPIAVTNSDVFGTSKLFVEHNTKGLIWSDIIFNPQDKTWYLTNFRGSEDFYGLSAAREASNWLRQQHIWSLQRRSNKLLDHGVDGLWMNVQGGYEKLDAAIGDAKMPWIMASLGYDFMHKLSDFYNLKALYGFGFGFATGKNKWNTINSTTNDIYMGLVGAYVGLMHEATGLYGTVSGQFATNRTKTKCTGFDETYNWKENVPTEAIEIGWKWSIDEFKINPRGQVIFEQLSKHHFSLSQEGDTAILDKEFLTTTVIGISGEYDLDLRSKIIKLQASVDWIKGISGDFAAKSEVLNMKFKDKNDTSTFRGTLGASAQLLENFEVHLDIFGDLGNDKGIGGQVGATYRF

SEQ ID NO: 6563 - protein, 175 aa, Escherichia coli O139:H28
MRLNDRADETRYIDPVTEQERSSRFWLRQIGGHNAWRDSNGQLRTTSAQAIWMGVDHNVHTEANGSRIENDANNNIQTRLGFHTFIRTQEKNSGPHGDDFEPFVEMNGIHNSKDFAVSINGVKVEQAGARNLGEIKHGVNGNLNPAASVWGNVGVQLGDNGYNDNAMMVGLKYKF

SEQ ID NO: 6564 - protein, 317 aa, Escherichia coli O139:H28
MNPLLTDSRRQALRSASHWYAVLSGERVSPQQEARWQQWYEQDQDNQWAWQQVENLRNQLGGVPGDVASRALHDTRLTRRHVMKGLLLLLGAGGGWQLWQSETGEGLRADYRTAKGTVSRQQLEDGSLLTLNTQSAADVRFDAHQRTVRLWYGEIAITTAKDALQRPFRVLTRQGQLTALGTEFTVRQQDNFTQLDVQQHAVEVLLASAPAQKRIVNAGESLQFSASEFGAVKPLDDESTSWTKDILSFSDKPLGEVIATLTRYRNGVLRCDPAVAGLRLSGTFPLKNTDAILNVIAQTLPVKIQSITRYWINISPL

SEQ ID NO: 6565 - protein, 955 aa, Escherichia coli O139:H28
MGIKQHNGNTKADRLAELKIRSPSIQLIKFGAIGLNAIIFSPLLIAADTGSQYGTNITINDGDRITGDTADPSGNLYSVMTPAGNTPGNINLGNDVTVNVNDASGYAKGIIIQGKNSSLTANRLTVDVVGQTSAIGINLIGDYTHADLGTGSTIKSNDDGIIIGHSSTLTATQFTIENSNGIGLTINDYGTSVDLGSGSKITTDGSTGVYIGGLNGNNANGAARFTATDLTIDVQGYSAMGINVQKNSVVDLGTNSTIKTNGDNAHGLWSFGQVSANALTVDVTGAAANGVEVRGGTTTIGADSHISSAQGGGLVTSGSDAIINFTGTAAQRNSIFSGGSYGASAQTATSVVNMQNTDITVDRNGSLALGLWALSGGRITGDSLAITGAAGARGIYAMTNSQIDLTSDLVIDMSTPDQMAIATQHDDGYAASRINASGRMLINGSVLSKGGLINLDMHPGSVWTGSSLSDNVNGGKLDVAMNNSVWNVTSNSNLDTLALSHSTVDFASHGSTAGTFATLNVENLSGNSTFIMRADVVGEGNGVNNKGDLLNISGSSAGNHVLAIRNQGSEATTGNEVLTVVKTTDGAASFSASSQVELGGYLYDVRKNGTNWELYASGTVPEPTPNPEPTPAPAQPPIVNPDPTPEPAPTPKPTTTADAGGNYLNVGYLLNYVENRTLMQRMGDLRNQSKDGNIWLRSYGGSLDSFASGKLSGFDMGYSGIQFGGDKRLSDVMPLYVGLYIGSTHASPDYSGGDGTARSDYMGMYASYMAQNGFYSDLVIKASRQKNSFHVLDSQNNGVNANGTANGMSISLEAGQRFNLSPTGYGFYIEPQTQLTYSHQNEMTMKASNGLNIHLNHYESLLGRASMILGYDITAGNSQLNVYVKTGAIREFSGDTEYLLNNSREKYSFKGNGWNNGVGVSAQYNKQHTFYLEADYTQGNLFDQKQVNGGYRFSF

SEQ ID NO: 6566 - protein, 212 aa, Escherichia coli O139:H28
MKKLTVAALAVTTLLSGSAFAHEAGEFFMRAGSATVRPTEGAGGTLGSLGGFSVTNNTQLGLTFTYMATDNIGVELLAATPFRHKIGTRATGDIATVHHLPPTLMAQWYFGDAGSKFRPYVGAGINYTTFFDNGFNDHGKEAGLSDLSLKDYWGAAGQVGVDYLINRDWLVNMSVWYMDIDTTAKYKSGVTTVKDSVRLDPWVFMFSAGYRF

SEQ ID NO: 6567 - protein, 377 aa, Escherichia coli O139:H28
MKSKVLALLIPALLAAGAAHAAEVYNKDGNKLDLYGKVDGLHYFSDNSAKDGDQSYARLGFKGETQINDQLTGYGQWEYNIQANNTESSKNQSWTRLAFAGLKFADYGSFDYGRNYGVMYDIEGWTDMLPEFGGDSYTNADNFMTGRANGVATYRNTDFFGLVNGLNFAVQYQGNNEGASNGQEGTNNGRDVRHENGDGWGLSTTYDLGMGFSAGAAYTSSDRTNDQVNHTAAGGDKADAWTAGLKYDANNIYLATMYSETRNMTPFGDSDYAVANKTQNFEVTAQYQFDFGLRPAVSFLMSKGRDLHAAGGADNPAGVDDKDLVKYADIGATYYFNKNMSTYVDYKINLLDEDDSFYAANGISTDDIVALGLVYQF

SEQ ID NO: 6568 - protein, 700 aa, Escherichia coli O139:H28
MKIFSVRQTVLPALLVLSPVVFAADEQTMIVSAAPQVVSELDTPAAVSVVDGEEMRLATPRINLSESLTGVPGLQVQNRQNYAQDLQLSIRGFGSRSTYGIRGIRLYVDGIPATMPDGQGQTSNIDLSSVQNVEVLRGPFSALYGNASGGVMNVTTQTGQQPPTIEASSYYGSFGSWRYGLKATGATGDGTQPGDVDYTVSTTRFTTHGYRDHSGAQKNLANAKLGVRIDEASKLSLIFNSVDIKADDPGGLTKAEWKANPQQAPRAEQYDTRKTIKQTQAGLRYERSLSAQDDMSVMMYAGERETTQYQSIPMAPQLNPSHAGGVITLQRHYQGIDSRWTHRGELGVPVTFTTGLNYENMSENRKGYNNFRLNSGMPEYGQKGELRRDERNLMWNIDPYLQTQWQLSEKLSLDAGVRYSSVWFDSNDHYVTPGNGDDSGDASYHKWLPAGSLKYAMTDAWNIYLAAGRGFETPTINELSYRADGQSGMNFGLKPSTNDTIEIGSKTRIGDGLLSLALFQTDTDDEIVVDSSSGGRTTYKNAGKTRRQGAELAWDQRFAGDFRVNASWTWLDATYRSNVCNEQDCNGNRMPGIARNMGFASIGYVPEDGWYAGTEARYMGDIMADDENTAKAPSYTLIGLFTGYKYNYHNLTVDLFGRVDNLFDKEYVGSVIVNESNGRYYEPSPGRNYGVGMNIAWRFE

SEQ ID NO: 6569 - protein, 1036 aa, Escherichia coli O139:H28
MKLKITLLFLLSLITLGVQAQETKTVTGTVRDTRDVPLPGAELKVVDKNEYAVTDFDGNYSLEVVVGDQVRITYLGFQTQTFSITNDDVYNIALQDESSELDEVVVVGYGNQKKSDITGAIVSVDNEEITKQPATSALTSVQGKVAGVNIIANDAPGSTPTVLMRGLGTAEGGRSPLYIVDGQPLSDITSINPNDIESIDFLKGASYANIYGIRAANGVILITTKRGKQGKTTFNFESYYGAKTILNPVKMANAAQYTQYFNEESAANGGFLLQQNQRYDTDWYDELLQTGTINNNSFSVSGAGESIDYFLSYNLYQEKGILEGQQYNRGTIRSNNTYHLFNDRLRFVQNLNVAYTNETPKPFGAFSTAYRQSPLVPVRYDNGLFGQSFVNQTTGVVDFNTQPGETLGRLNSHGNPVSQVYYQDQQINTTSLQGQIAAELDITDDLMLTTRFGATKYYATSKSFTDIRSQWLNADPNRTEAFFDAQRVPNDDGVVSTEYANNSYTIRRTESYRWNIESFLTYDKSFDKHNLSATVGISRENYQGGEFTESQAYDVEADPNLRNFNLRTSQLFNDNVDGDTYQSTNLQSYFGRVEYNYDQRYYVRAVLRRDGTSDFATGDNNFFGYFPAVSLGWTMTNEAFMEDNGVLDNLKLFAGWGKLGNQAIPFNVQSINAGSGSRNTNYVFGPTQSLIVGAALGTPAIPLSWEVTEEFEAGFDFALFNRKLSGTIDYYSRLNTNAILNVRPLLNSEFSSNFFDEAAEISNSGFEFLVNWRDQIGSDFTYNIGVNLSTNKNRVQNVRPAYDGAIGGSLGNGRITKRLAEGQPIFAWWMYEADGVWQTQEEIDNNTSLGSAAPGHLRYVDQNDDGVIDDRDKKYFGSYIPTYNYGINIGANYKNFDLSVSGFGVGGNKVYNGLYSTRLGGENISEDIFNKRWTGPGSTNVNPGADRDVEASSYYLEDGSYFRINNITVGYTLPEISSFVSSARVYVTLQNPFMFTDYSGFTPELNQNGDPTNTTGIELSAYPNTRSFIVGANFKL

SEQ ID NO: 6570 - protein, 790 aa, Escherichia coli O139:H28
MKRVLIPGVILCGADVAQAVDDKNMYMHFFEEMTVYAPVPVPVNGNTHYTSESIERLPTGNGNISDLLRTNPAVRMDSTQSTSLNQGDIRPEKISIHGASPYQNAYLIDGISATNNLNPANESDASSATNISGMSQGYYLDVSLLDNVTLYDSFVPVEFGRFNGGVIDAKIKRFNADDSKVKLGYRTTRSDWLTSHIDENNKSAFNQGSSGSTYYSPDFKKNFYTLSFNQELADNFGVTAGLSRRQSDITRADYVSNDGIVAGRAQYKNVIDTALSKFTWFASDRFTHDLTLKYTGSSRDYNTSTFPQSDREMGNKSYGLAWDMDTQLAWAKLRTTVGWDHISDYTRHDHDIWYTELSCTYGDITGRCTRGGLGHISQAVDNYTFKTRLDWQKFAVGNVSHQPYFGAEYIYSDAWTERHNQSESYVINAAGKKTNHTIYHKGKGRLGIDNYTLYMADRISWRNVSLMPGVRYDYDNYLSNHNISPRFMTEWDIFANQTSMITAGYNRYYGGNILDMGLRDIRNSWTESVSGNKTLTRYQDLKTPYNDELAMGLQQKIGKNVIARANYVYREAHDQISKSSRTDSATKTTITEYNNDGKTKTHSFSLSFELAEPLHIRQVDINPQIVFSYIKSKGNLSLNNGYEESNTGDNQVVYNGNLVSYDSVPVADFNNPLKISLNMDFTHQPSGLVWANTLAWQEARKARIILGKTNAQYISEYSDYKQYVDEKLDSSLTWDTRLSWTPQFLQQQNLTISADILNVLDSKTAVDTTNTGVATYASGRTFWLDVSMKF

SEQ ID NO: 6571 - protein, 3634 aa, Escherichia coli O139:H28
MNRIYRLVFNRALGVMQVASEVARNPGGSAVSAGRVPRLRAHQLAVALAATLASGSAFAACTTAGTTVTCATGSNTNSLTNSINGVTLNIQTGAELSVPPIVGGSAVNLSGNGITVNNQGTVDPTINGGLSLAASGMVLGNNTVGGNTMSVNNQAGGAIKGLVNIGSILGFGGQALVVQNASGGVSNIVNAGNVDMSIFGAGLLTTADAASIVSYGGAQTTLNNTGTITGRIGFQGSATAGAGNTFLNAGTINGSVNLGSSVAGNTFTAVSGSSVNTAGIGVAGQVGALAVNLAAAGIVDGGSASNNSLVLQNSATGPGSGTGGAVTTLGWNQYINFQRLTVNSGTWNLQGAWAGAGTTTLNDGLVNFNNAGSFGTGLFTANGGAIAASTAGLNLTNAFNLGGNLSLGGTNAFSLGGVLSGTGGLTVNNTGIVTLGGANLFSGGVNLNAGGLLLGNAGALGSGNLTVGGSASLDTTSGFTLGNNLVINGGGSLNLLGSNALSLSGSISGAGNVTKNGAGTLTLNGANSLTGAFNLAGGALALGAGGSLSPTGAITLGVGTSLDLSAATNQTIGSLAGLGGSVNLGSHTLTLGGLGNTSYSGTFAAGTGGLIKLGTGVQTLSGVNNLSGGVALNAGGLLLGNAAALGSGTLSVGGNATLDGTTGLALTNAVNLGAGASLNLLGNQALTFNGVIGGAGGLIKNGAATLTLNGANTFGGGLALNAGSLVLGNGGALGTGALNVGGAVSLDASAGLTVGNGITLGAGGSLDVLGSNALTLGGVIGGSGSLVKNGASTLTLGGANTFTGGLAVNAGTVSLASGGSLAATGAVSLAGAGSALDISLGGNQTIGALSGVAGSTLSLGSSTLTFGDATNQTFAGVIGGTGGLIKQGTGVQTLTSASTFSGGVNLAAGGLVLGNAGALGSGALTVSGNGSLDATAALNLGNAINLGAALTLPGSQNLALAGNVTGTGSLVKNGASTLTLNGTNTFSGGLSANAGSLLLGNSGALGTGVLGIGGSVSLDGGAPLNLANNVSLGAGAALSLPGSQAITLGGVVSGAGRLVKNGATTLTLNGANSFGGGLTVNGGGVFLGNAGALGTGALSVGANATLDSSVALNLANDLNLGAGAALDLLGSQNVSLGGLISGTGSLVKNGTATLALNGANTFSGGVGLNAGLLQLGNAQALGTGQLDVGGNASLEATTALALGNTIGLAAGANLSVLGSNDLTLAGPVFGAGGLIKDGTARLTLSGANTYNGGTTINAGTLALGAGGSLAAAGAVNLAVAGATLDISAAGAAQTIGALNGVAGSQLALGAQSLTFGGAGNGSFAGVIGGTGGLVKTGTGVQTLSGANTFSGGVALNAGGLILGNASALGTGALGIGGTTTLDSTVALNLANAVNFGAGTQLTLGGSNDVTLGGVVAGNGSLVKNGAGLLTLNNTNTFGGGLTLNGGGLVVGANGALGTGALAVNASTTLDAGTAVTLGNAVTLGSGVALTLPGSNALTLSGVVGGNGSLIKNGGTTLTLSGANTYTGGTTINAGTLALGTGGSLAAVGDVTLGAGAGFDISGAGGNQTIGALNGAGGSTLTLGGNSLTFGTAGNAAFDGVISGGGGLVKVGAGVQTLSGANTFGGGVTLNAGGLVLGNDAALGAGALTVGGAATLDTTGLATLANNIALNAGLTVIGTNALTLNGVLSGTGSLTKNGSATLTLNGANTYTGGTNINAGTLALGAGASLAASGTVNLATGATLDLSAGSGTQQFGTLVGNGTVNLGANSIEVGGATDGTFSGSIAGTGGLTKVGAGIETLTGANTYTGGTFINAGTLAIGPGGSLAATGAVTLTAAGTGFDISTTGANQTIGALNGVAGSTVSLGAQTLTLGGVGNSIFDGAISGTGGLVKNGAGSLTLGGANLFSGGVALNGGALVVGNNAALGSGALTVGSNATLDASTGVSLANNINLASGANLDLLGSQALTLGGVISGTGGLIKDGAATVTLSGANTYTGGTTINSGTLAIGAGGSLAAAGAVNLAGAGTFDISAGNQAIGSLAGVAGSTVALGGSTLTLGGTVDSTFSGAISGNGGLVKNGAGVQTLNGASTFSGGVALNAGGLVVGNNAALGTGAVTVGGAATLDSNTAVTLANNFTLNNALTVLGSNNLTLNGILSGTGSLSKEGAATLTLNGANTYTGGTFINAGTLALGAGASLASSGTVNLATGATFDLSAGSGTQQFGTLIGSGTVNLGANTLTIGGPANGTFSGSVAGSGGLIKEGSGTQTLTGTNTFTGGTTINAGTLAIGAGGSLAATGAVTLANAGTTFDISAGGAQAIGSLAGVAGSTVALGGSTLTLNGVGNTTFAGTIGGAGGLVKNGAGIQGLTGVNVFTGGVTLNAGGLLLGNGGSLGIGALTVGGNASLDGTSALTLANTVQLASGTLTLAGSNALTLNGPISGAGGLLKDGAATVTLGGASSYTGTTTINSGTLAVAAGGSLSGASTVNLAGAGTLDISAGGNQSIGGLAGVAGSTVALGGATLTTGGNNASTVFAGVLSGTGGLVQGGTGTLTLSGDNTYTGGTTINGGSTLQIGNGGSTGSVLGDITNNGSLVYNLGTTATVGAVVSGNGGLTQAGSGTLVLTGNNTYTGGTTINAGGTLQIGNGGATGAIVGDITNNGALVSNVAGNTTLGGTISGSGGLTQSGSGTLVLTGNNTYTGGTTVNAGGTLQVGNGGATGAITGNVANNGSLVFNVGGNTTVGGAISGSGGLTQAGSGVLTLVGNNTYTGGTTINTGGTLQVGNGGATGAIAGDITNNGALISNVAGNTQLGGTISGTGGLTQAGSGSLVLTGTNTYTGGTTINAGGTLQLGNGGATGSIIGDVTNNGTLLSNVAGNTTLGGTISGSGGLIQAGSGTLTVTGNNTYTGPTTINAGGTLQVGNGGATGAIGGNVTNNGNLVFNVAGNTTVGGAISGSGGLTQAGSGTLILGGNNTYTGGTTINTGGTLQVGNGGASGAIAGNVSNNGSLVFNVGGNTTVGGTISGSGGLTQAGTGTVTLTGNNTYTGGTTINAGGTVQVGNGGASGSITGNITNNGGLVINTGGTTTLGGTISGGGSIVQAGPGGLNLGGNSGGFSGTGQVTGGGLNVTGNIGGQWTIGSGTTLSGTGTIGGTGGGVTVSSGGVLSPGNGPGNGSGAGNGTGTITVGGNLTLSPGSTLGVDLGASGSDTVQVGGSANVGGSTVQVNTISPSTSYQQGQQYTVVNAGGGVSGQFASATSPSAFLTITPVYTANTANLQIDVAQTAAFTTAAKTRNQYNTAAALDSLPQSGPALGLYNTLLMYDAGTARAAFDQLSGEVHAASRAVLLYDNYLEEGIRQRLGSELPTVRGERASAWLAGSGKVFRQDGDGNGDDIRSNRNALMAGVDWQLGEHVVLGAAAGNERLDTRLYDRSSRARLRGNTFGLYAQGQWNNGFAVGGSVSRGDYRTRTTREVPLLGQTLYSRQDSDVTIAQVEGSWTWTHGRTQLQPYVQFTRHWVDSDRAVEQGGTAALVLEGGKDTLNVSTVGVRGRWDVGSGERFPAQLTVGLGWQHASGDTDVASRNRFAVGGNAFDVYSAVMARNALVSQVGVAVGLGRNSQLSMFVQGQHGDGRRDVGGQINLRVGF

SEQ ID NO: 6572 - protein, 421 aa, Escherichia coli O139:H28
MRKIVAMAVICLTAASGLTSAYAAQLADDEAGLRIRLKNELRRADKPSAGAGRDIYAWVQGGLLDFNSGYYSNIIGVEGGAYYVYKLGARADMSTRWYLDGDKSFGFALGAVKIKPSENSLLKLGRFGTDYSYGSLPYRIPLMAGSSQRTLPTVSEGALGYWALTPNIDLWGMWRSRVFLWTDSTTGIRDEGVYNSQTGKYDKHRARSFLAASWHDDTSRYSLGASVQKDVSNQIQSILEKSIPLDPNYTLKGELLGFYAQLEGLSRNTSQPNETALVSGQLTWNAPWGSVFGSGGYLRHAMNGAVVDTDIGYPFSLSLDRNREGMQSWQLGVNYRLTPQFTLIFAPIVTRGYESSKRDVRIEGAGILGGMNYRVSEGPLQGMNFFLAADKGREKRDGSTLGDRLNYWDVKMSIQYDFMLK

SEQ ID NO: 6573 - protein, 214 aa, Escherichia coli O139:H28
MKRKVLAMLVPALLVAGAANAAEIYNKDGNKLDLYGKVAGLHYFSDDASSDGDMSYARIGFKGETQIADQFTGYGQWEFNIGANGPESDKGNTATRLAFAGFGFGQNGTFDYGRNYGVVYDVEAWTDMLPEFGGDTYAGADNFMNGRANSVATYRNNGFFGQVDGLNFALQYQGNNEKSGLFDQEGSGNGNGRKLAKENGDGSVCPLPMTLTLV

SEQ ID NO: 6574 - protein, 663 aa, Escherichia coli O139:H28
MFRLNPFVRVGLCLSAISCAWPVLAVDDDGETMVVTASSVEQNLKDAPASISVITQEDLQRKPVQNLKDVLKEVPGVQLTNEGDNRKGVSIRGLDSSYTLILVDGKRVNSRNAVFRHNDFDLNWIPVDSIEGIEVVRGPMSSLYGSDALGGVVNIITKKIGQKWSGTVTVDTTIQEHRDRGDTYNGQFFTSGPLIDGVLGMKAYGSLAKREKDDPQNSTTTDTGETPRIEGFSSRDGNVEFAWTPNQNHDFTAGYGFDRQDRDSDSLDKNRLERQNYCVSHNGRWDYGTSELKSYGEKVENKNPGNSSPITSESNTVDGKYTLPLTAINQFLTVGGEWRHDKLSDAVNLTGGTSSKTSASQYALFVEDEWRIFEPLALTTGVRMDDHETYGEHWSPRAYLVYNATDTVTVKGGWATAFKAPSLLQLSPDWTSNSCRGACKIVGSPDLKPETSESWELGLYYMGEEGWLEGGESSVIVFRNDVKDRISISRTSDVNAAPGYQNFVGFETGANGRRIPVFSYYSVNKARIQGVETELKIPFNDEWKLSINYTYNDGRDVSNGENKPLSDLPFHTANGTLDWKPLALEDWSFYVSGHYTGQKRADSATAKTPGGYTIWNTGAAWQVTKDVKLRAGVLNLGDKDLSRDDYSYNEDGRRYFMAVDYRF

SEQ ID NO: 6575 - protein, 367 aa, Escherichia coli O139:H28
MKVKVLSLLVPALLVAGAANAAEVYNKDGNKLDLYGKVDGLHYFSDNKDVDGDQTYMRLGFKGETQVTDQLTGYGQWEYQIQGNSAENENNSWTRVAFAGLKFQDVGSFDYGRNYGVVYDVTSWTDVLPEFGGDTYGSDNFMQQRGNGFATYRNTDFFGLVDGLNFAVQYQGKNGSVSGEGMTNNGRDALRQNGDGVGGSITYDYEGFGIGAAVSSSKRTDAQNTAAYIGNGDRAETYTGGLKYDANNIYLAAQYTQTYNATRVGSLGWANKAQNFEAVAQYQFDFGLRPSVAYLQSKGKNLGVINGRNYDDEDILKYVDVGATYYFNKNMSTYVDYKINLLDDNQFTRDAGINTDNIVALGLVYQF

SEQ ID NO: 6576 - protein, 1244 aa, Escherichia coli O139:H28
MRIIFLRKEYLSLLPSMIASLFSANGFAAAIDLCQGYDIKASCHASRQSLSGITQDWSIADGQWLVFSDMTNNASGGAVFLQQGAEFSLLPENETGMTLFANNTVTGEYNNGGAIFAKENSTLNLTDVIFSGNVAGGYGGAIYSSGTNDTGAVDLRVTNAMFRNNIANDGKGGAIYTINNDVYLSDVIFDNNQAYTSTSYSDGDGGAIDVTDNNSVSKHPSGYTIINNTAFTNNTAEGYGGAIYTNSATAPYLIDISVDDSYSQNGGVLVDKNNSAAGYGDGPSTAAGGFMYLGLSEVTFDIADGKTLVIGNTENDGAVDSIAGTGLITKTGSGDLVLNADNNDFTGEMQIENGEVTLGRSNSLMNVGDTHCQDDPQDCYGLTIGSIDKYQNQAELNVGSTQQTFVHSLTGFQNGTLNIDAGGNVTVNQGSFAGTIEGAGQLTIAQNGSYVLSGAQSMALTGDIVVDDGAVLSLEGDAADLAALQDDPQSIVLNGGVLDLSDFSTWQSGTSYNDGLEVSGSSGTVIGSQDVVDLAGGDNLHIGGDGKDGVYVVVDASDGQVSLANNNSYLGTTQIASGTLMVSDNSQLGDTHYNRQVIFTDKQQESVMEITANVDTRSTTTEHGRDIEMRADGEVAVDAGVDTQWGALMADSSGQHQDEGSTLTKTGAGTLELTASGTTQSAVRVEEGTLKGDVADIFPYASSLWVGDGATFVTGADQDIQSIDATSSGTIDISDGTVLRLTGQDTSVALNASLFNGDGTLVNATDGVTLTGELNTNLETDSLTYLSDVTVNGNLTNTSGAVSLQNGVAGDTLTVNGDYTGGGTLLLDSELNGDDSVSDQLVLNGNTAGNTTVVVNSITGIGEPTSTGIKVVDFAADPTQFQNNAKFSLAGSGYVNMGAYDYTLVEDNNDWYLRSQEVTPPLPPDPDPDPTPDPDPTPDPIPAYQPVLNAKVGGYLNNLRAANQAFMMERRDHAGGNGQTLNLRVIGGRYHYTAAGQLAQHEDTSTVQLSGDLFSGRWGDDGEWMLGAVGGYSDNQGESRSNMTGTRADNQNHGYAVGLTSSWYQHGNQKQGAWLDSWLQYAWFNNDVSEQDDGTDHYHSSGIIASLEAGYQWLPGRGVVIEPQAQVIYQGVQQDDFTAANRARVSQSQGDDIQMRLGLHSEWRTAVHVIPTLDLNYYHNPHSTEIEEDGSTISDDAVKQRGEIKVGVTGNISQRVSLRGSVAWQKGSDDFAQMAGFLSMTVKW

SEQ ID NO: 6577 - protein, 446 aa, Escherichia coli O139:H28
MSQKTLFTKSALAVAVALISTQAWSAGFQLNEFSSSGLGRAYSGEGAIADDAGNVSRNPALITMFDRPTFSAGAVYIDPDVNISGTSPSGRSLKADNIAPTAWVPNMHFVAPINDQFGWGASITSNYGLATEFNDTYAGGSVGGTTDLETMNLNLSGAYRLNNAWSFGLGFNAVYARAKIERFAGDLGQLVAGQIMQSPAGKTPQGQALAATANGIDSNTKIAHLNGNQWGFGWNAGILYELDKNNRYALTYRSEVKIDFKGNYSSDLNRVFNNYGLPIPTATGGATQSGYLTLNLPEMWEVSGYNRVDPQWAIHYSLAYTSWSQFQQLKATSTSGDTLFQKHEGFKDAYRIALGTTYYYDDNWTFRTGIAFDDSPVPAQNRSISIPDQDRFWLSAGTTYAFNKDASVDVGVSYMHGQSVKINEGPYQFESEGKAWLFGTNFNYAF

SEQ ID NO: 6578 - protein, 108 aa, Escherichia coli O139:H28
MESKSVDTRSIYRELGATLSYNMRLGNGMEIEPWLKAAVRKEFVDDNRVKVNSDGNFVNDLSGRRGIYQAGIKASFSSTLSGHLGVGYSRGAGVESPWNAVVGVNWSF

SEQ ID NO: 6579 - protein, 948 aa, Escherichia coli O139:H28
MKRHLNTSYRLVWNHITGTLVVASELARSRGKGAGVAVALSLAAVTSVPALAADTVVQAGETVNGGTLTNHDNQIVLGTANGMTISTGLEYGPDNEANTGGQWIQNGGIANNTTVTGGGLQRVNAGGSVSDTVISAGGGQSLQGQAVNTTLNGGEQWVHEGGIATGTVINEKGWQAVKSGAMATDTVVNTGAEGGPDAENGDTGQTVYGDAVRTTINKNGRQIVAAEGTANTTVVYAGGDQTVHGHALDTTLNGGYQYVHNGGTASDTVVNSDGWQIIKEGGLADFTTVNQKGKLQVNAGGTATNVTLTQGGALVTSTAATVTGSNRLGNFTVENGNADGVVLESGGRLDVLEGHSAWKTLVDDGGTLAVSAGGKATDVTMTSGGALIADSGATVEGTNASGKFSIDGISGQASGLLLENGGSFTVNAGGLASNTTVGHRGTLTLAAGGSLSGRTQLSKGASMVLNGDVVSTGDIVNAGEIRFDNQTTPDAALSRAVAKGDSPVTFHKLTTSNLTGQGGTINMRVRLDGSNASDQLVINGGQATGKTWLAFTNVGNSNLGVATSGQGIRVVDAQNGATTEEGAFALSRPLQAGAFNYTLNRDSDEDWYLRSENAYRAEVPLYASMLTQAMDYDRILAGSRSHQSGVSGENNSVRLSIQGGHLGHDNNGGIARGATPESNGSYGFVRLEGDLLRTEVAGMSLTTGVYGAAGHSSVDVKDDDGSRAGTVRDDAGSLGGYLHLVHTSSGLWADIVAQGTRHSMKASSDNNDFRARGWGWLGSLETGLPFSITDNLMLEPQLQYTWQGLSLDDGQDNAGYVKFGHGSAQHVRAGFRLGSHNDMNFGKGTSSRDTLHDSAKHSVRELPVNWWVQPSVIRTFSSRGDMSMGTAAAGSNMTFSPSRNGTSLDLQAGLEARVRENITLGVQAGYAHSVSGSSAEGYNGQATLNVTF

SEQ ID NO: 6580 - protein, 232 aa, Escherichia coli O139:H28
MIIKKSGGRWQLSLLASVVISAFFLNTAYAWQQEYIVDTQPGHSTERYTWDSDHQPDYNDILSQRIQSSQRALGLEVNLAEETPVDVTSSMSMGWNFPLYEQVTTGPVAAFHYDGTTTSMYNEFGDSTTTLADPLWHASVSTLGWRVDSRLGDLRPWAQISYNQQFGENIWKAQSGLSRMTATNQNGNWLDVTVGADMLLNQNIAAYAALSQAENTTNNSDYLYTMGVSARF

SEQ ID NO: 6581 - protein, 230 aa, Escherichia coli O139:H28
MKKINAIILLSSLTSASVFAGAYVENREAYNLASDQGEVMLRVGYNFDMGAGIMLTNTYTFQREDELKHGYNEIEGWYPLFKPTDKLTIQPGGLINDKSIGSGGAVYLDVNYKFTPWFNLTVRNRFNHNNYSSTDLNGDLDNNDSYEIGNYWNFIITDKFSYTFEPHYFYNINDFNSSNGTKHHWEITNTFRYRINEHWLPYIELRWLDRNVEPYHREQNQIRIGTKYFF

SEQ ID NO: 6582 - protein, 774 aa, Escherichia coli O139:H28
MTPLRVFRKTTPLVNAIRLSLLPLAGLSFSAFAAQVNIAPGSLDKALNQYAAHSGFTLSVDASLTRGKQSNGLHGDYDVESGLQQLLDGSGLQVKPLGNNSWTLEPAPAPKEDALTVVGDWLGDARENDVFEHAGARDVIRREDFAKTGATTMREVLNRIPGVSAPENNGTGSHDLAMNFGIRGLNPRLASRSTVLMDGIPVPFAPYGQPQLSLAPISLGNMDAIDVVRGGGAVRYGPQSVGGVVNFVTRAIPQDFGIEAGVEGQLSPTSSQNNPKETHNLMVGGTADNGFGTALLYSGTRGSDWREHSATRIDDLMLKSKYAPDEVHTFNSLLQYYDGEADMPGGLSRADYDADRWQSTRPYDHFWGRRKLASLGYQFQPDSQHKFNIQGFYTQTLRSGYLEQGKRITLSPRNYWVRGIEPRYSQIFMIGPSAHEVGVGYRYVNESTHEMRYYTATSSGQLPSGSSPYDRDTRSGTEAHAWYLDDKIDIGNWTITPGMRFEHIESYQNNAITGTHEEVSYNAPLPALNVLYHLTDSWNLYANTEGSFGTVQYSQIGKAVQSGNVEPEKARTWELGTRYDDGALTAEMGLFLINFNNQYDSNQTNDTVTARGKTRHTGLETQARYDLGTLTPTLDNVSIYASYAYVNAEIREKGDTYGNLVPFSPKHKGTLGVDYKPGNWTFNLNSDFQSSQFADNANTVKESADGSTGRIPGFMLWGARVAYDFGPQMADLNLAFGVKNIFDQDYFIRSYDDNNKGIYAGQPRTLYMQGSLKF

SEQ ID NO: 6583 - protein, 948 aa, Escherichia coli O139:H28
MKRHLNTSYRLVWNHITGTLVVASELARSRGKRAGVAVVLSLAAVTSVPALAADTIVQAGETVNGGTLTNHDNQIVLGTANGMTISSGLEYGPDNEANTGGQWIQNGGIANNTTVTGGGLQRVNAGGSVSDTVISAGGGQSLQGQAVNTTLNGGEQWVHEGGIATGTVINEKGWQTVKSGAMATDTVVNTGAEGGPDAENGDTGQFVRGNAVRTTINENGRQIVAAEGTANTTVVYAGGDQTVHGHALDTTLNGGYQYVHNGGTASGTVVNSDGWQIIKEGGLADFTTVNQKGKLQVNAGGTATHVTLKQGGALVTSTAATVLGSNRLGNFTVENGKADGVVLESGGRLDVLEGHSAQKTRVDDGGTLAVSAGGKATGVTMTSGGALIADSGATVEGTNASGKFSIDGTSGQASGLLLENGGSFTVNAGGLASNTTVGHRGTLTLAAGGSLSGRTQLSKGASMVLNGDVVSTGDIVNAGEIRFDNQTTPDAALSRAVAKGDSPVTFHKLTTSNLTGQGGTINMRVRLDGSNTSDQLVINGGQATGKTWLAFTNVGNSNLGVATSGQGIRVVDAQNGATTEEGAFALSRPLQAGAFNYTLNRDSDEDWYLRSENAYRAEVPLYTSMLTQAMDYDRILAGSRSHQTGVNGENNSVRLSIQGGHLGHDNNGGIARGATPESSGSYGFVRLEGDLLRTEVAGMSLTTGVYGAAGHSSVDVKDDDGSRAGTVRDDAGSLGGYLNLTHTSSGLWADIVAQGTRHSMKASSDNNDFRARGWGWLGSLETGLPFSITDNLMLEPQLHYTWQGLTLDDGQDNAGYVKFGHGSAQHVRAGFRLGSHNDMSFGEGTSSRDTLRDSTKHRVSELPVNWWVQPSVIRTFSSRGDMSMGTAAAGSNMTFSPSRNGTSLDLQAGLEARVRENITLGVQAGYAHSVSGSSAEGYNGQATLNVTF

SEQ ID NO: 6584 - protein, 347 aa, Escherichia coli O139:H28
MKKVILTASVFAISALPVLADESPSVYGRLDLSVTHSELSSTVYSGTSGVKVGESGTYLENNSSNIGVKGKSAISDGINVVYKMEFGVNNTSNRANDSSKVFSARNTYLGVETAYGTLLVGRNDTVFKTAEGKVDIFGTTNADINQLVSGQTRSADGVWYYSPKLFGLMDINATYLLQDNYGADNELYALSTTLGDKDLKKNPYYFAAAINKGIANIDAYRFVTQVKLGDMKLGGIFQHTESLKFSNMEGDSYFINATYDLWGATLKAEYGQDSSGLGGYFSKLVGPNEQITDVDISQFTLGADKKLTKSTRVYTHFSMYEGEYQMSGITQDIGDDKVITVGVRYVF

SEQ ID NO: 6585 - protein, 729 aa, Escherichia coli O9:H4
MARSKTAQPKHSLRKIAVVVATAVSGMSVYAQAAVEPKEDTITVTAAPAPQESAWGPAATIAAKHSATATKTDTPIEKTPQSISVVTNEEMQMHQFQSVKEALGYTPGVTVSSRGASNTYDFVIIRGFSSVGLNQNNYLDGLKLQGNFYNDAVIDPYMLERVELMRGPTSVLYGKSNPGGIISMVSKRPTTEPLKEIQFKMGTDNLFQTGFDFSDALDDNGEFSYRLTGLARSINEQQKNSESQRYTIAPSFSWRPDDKTNFTFLSYFQNEPETGYYGWLPKEGTVEPLPNGKRLPTDFNEGASNNTYSRNQKMVGYSFEHGFNDTFTVRQNLRFSEMKTSQKSVYGTGIAGDGHTLNRGTVVDNERLQNFSVDTQLESKFATGDVEHTLLTGVDFMRMRNDINASFGSAPSIDLYNKYHPEYFAFGSAEPYQMNESKQTGIYVQDQAEWNKWVFTLGGRYDWSKQATTVRENSYTPTEGYIERNDHQFTWRGGVNYLFDNGISPYFSYSQSFEPSAFDLWSNPRISYKPSKGEQYEAGVKYVPNDLPVVVTGAVYQLTKTNNLTADPTNPLAQVPAGEIRARGVELEAKAALNANINLTASYTYTDAEYTKDTNLKGKTPEQVPEHMASLWGDYTFNEGPLSGLTLGTGGRFIGSSYGDPANTFKVGSAAVMDAVVKYDLARFGMAGSSLAVNVNNLLDREYVASCFQTYGCFWGAERQVVATATFRF

SEQ ID NO: 6586 - protein, 351 aa, Escherichia coli O9:H4
MKKSTLALVVMGIVASASVQAAEIYNKDGNKLDVYGKVKAMHYMSDNASKDGDQSYIRFGFKGETQINDQLTGYGRWEAEFAGNKAESDTAQQKTRLAFAGLKYKDLGSFDYGRNLGALYDVEAWTDMFPEFGGDSSAQTDNFMTKRASGLATYRNTDFFGVIDGLNLTLQYQGKNENRDVKKQNGDGFGTSLTYDFGGSDFAISGAYTNSDRTNEQNLQSRGTGKRAEAWATGLKYDANNIYLATFYSETRKMTPITGGFANKTQNFEAVAQYQFDFGLRPSLGYVLSKGKDIEGIGDEDLVNYIDVGATYYFNKNMSAFVDYKINQLDSDNKLNINNDDTVAVGMTYQF

SEQ ID NO: 6587 - protein, 765 aa, Escherichia coli O9:H4
MKNSKAFYRSALATAIVMALSAPAFAADNAVSTTPVTLDKDKTTLDQDVVINNTADKQITAVTINAADEDLNVDFAGHDITAESTADNKFAEGVKVSGDKNVVINATGSTITAQGEGTYVRTAMVIDSTGDVVVNGGNFVTKNEKGSATGISLEGARGNNVTLNGTTINAQGNKSSSNASTAIFAQKGSLLQGFDGDATDNITLAGSNIINGRIEAIVIAGNNTGTHTVNLNIKDGSVIGAANNKQTIYASASAQGAGSATQNLNLSVADSTIYSDVLALSSSNSSVGTTTNVNMNVARSYWEGNAYTFNSGDKAGSDLDINLSDSSVWKGKVSGAGDASVSLQNGSVWNVTGSSTVDALAVKDSTVNITKATVNTGTFASQNGTLIVDASSENTLDISGKASGDLRVYSAGSLDLINEQTAFISTGKDSTLKATGTTEGGLYQYDLTQGADGNFYFVKNTHKASNASSVIQAMAAAPANVANLQADTLSARQDAVRLSENDKGGVWIQYFGGKQKHTTAGNASYDLDVNGVMLGGDTRFMTEDGSWLAGVAMSSAKGDMTTMQSKGDTEGYSFHAYLSRQYNNGIFIDTAAQFGHYSNTADVRLMNGGGTIKADFNTNGFGAMVKGGYTWKDGNGLFIQPYAKLSALTLEGVDYQLNGVDVHSDSYNSVLGEAGTRVGYDFAVGNATVKPYLNLAALNEFSDGNKVRLGDESVNASIDGAAFRVGAGVQADITKNMGAYASLDYTKGDDIENPLQGVVGINVTW

SEQ ID NO: 6588 - protein, 1327 aa, Escherichia coli O9:H4
MNKIYRLKWNRSRNCWSVCSELGSRVKGKKSRAVLISAISLYSSLVFADDVIVNQDKTIDFGKENQSIDYRITVTDNANLVINATDTSRPRLTLASGGGLDITGGKVTINGPLNFLLKGTGFLNVSNAGSELYADDLYESNSGMRHDRGYFNVSNGGKIHVKGTSRLTYLQGNVSGEGSQVNSETFFMGVYGSYGGNQYLSVNNGGEVNARKQISLGYYDQVSDTTLAVSEGGKISAPTISLSTNSELALGAQEGSAAKAAGIIDAEKIEFVWAKTSEKKITLNHTDKDATISADIVSGSEGLGYINALNGTTYLTGDNSAFSGKVKIEQNGALGITQNIGTAEINNRGKLHLKADDSMTFANKISGNGTISIDSGTVELTGNNYAFSGYIDVASGAVAVISEDKNIGRAELDVDGKLQINANKDWVFDNDLEGRGIVEINMGNHEFSFDEFAYTDWFQGSLAFQNTTFNLEKNAEFLQKGGITAGQGSLVTVGKGAHSISTLGFSGGTVDFGALTAGAQMTEGTVNVSKTLDLRGEGVIQVSDSDVVRSVSRDIDSALSLTEVDDGNSTIKLVDAQGAEVLGDAGNLQLQDKNGQILSSSAQRDIQQNGQKAAVGTYDYRLTSGVNNDGLYIGYGLTQLDLHATDSDALVLSSNGKSENAADLSAKITGSGDLAFSSQKGQTVSLSNKDNDYTGVTDLRSGTLLLNNDNVLGNTHELRLAAETELDMNGHSQTVGTLNGSADSLLSLNGGSLTVTNGGTSTGSLTGSGELNIQGGTLDIAGDNSNLTANVNIANSANVLVSHAQGLGSANVENNGTLALNNSAEKRAAASVNYALGGNLTNNGTLMTGMSGQQAGNVLVVKGNYHGNNGQLVMNTVLNGDDSVTDKLVVEGDTSGTTAVTVNNAGGTGAKTLNGIELIHVDGKSEGEFVQAGRIVAGAYDYTLARGQGANSGNWYLTSGSDSPELQPEPDPMPNPEPNPNPEPNPNPTPTPGPDLNVDNDLRPEAGSYIANLAAANTMFTTRLHERLGNTYYTDMVTGEQKQTTMWMRHEGGHNKWRDGSGQLKTQSNRYVLQLGGDVAQWSQNGSDRWHVGVMAGYGNSDSKTISSRTGYRAKASVNGYSTGLYATWYADDESRNGAYLDSWAQYSWFDNTVKGDDLQSESYKSKGFTASLEAGYKHKLAEFNGSQGTRNEWYVQPQAQVTWMGVKADKHRESNGTLVHSNGDGNVQTRLGVKTWLKSHHKMDDGKSREFQPFVEVNWLHNSKDFSTSMDGVSVTQDGARNIAEIKTGVEGQLNANLNVWGNVGVQVADRGYNDTSAMVGIKWQF

SEQ ID NO: 6589 - protein, 412 aa, Escherichia coli O9:H4
MAIQINRGSGRNMHIRTWIAAGVAGAAVAPACAQSGVTLYGTVDTGVIYSTNQQVTHADGSTSGGHAWQMGGGNLVPSRWGLQGTEALGGGLKAVFALEQQFLSASGQALQGGAAFSRQAWVGLRHDRYGTLGVGRQYDSYTDTLGAYVSSNSWATPYGSHLGDVDNLNAAFNFNNAIRFTSADFHGLTFGGTFGFGGQAGDFSARRGYALAVAYNRAPVSFGIGYLNLRQPLDAALGGANGYIGDFACGNAGAMYCLLQDAVSMKAFGVGGSIAFGEATVALTYTHTRLGDSAYFAAAARAQRASIAFDIAELNATYAFTPMLRGGIAYVFNRAKADSRGVTRFHQLNVGVNYSLSKRTALYAVAIGQIASGRGLGSDANGDPVNYAQIPVLANSNSNRQLAMMAGVKVDF

SEQ ID NO: 6590 - protein, 746 aa, Escherichia coli O9:H4
MNKKIHSLALLVNLGIYGVAQAQEPTDTPVSHDDTIVVTAAEQNLQAPGVSTITADEIRKNPVARDVSEIIRTMPGVNLTGNSTSGQRGNNRQIDIRGMGPENTLILIDGKPVSSRNSVRQGWRGERDTRGDTSWVPPEMIERIEVLRGPAAARYGNGAAGGVVNIITKKGSGEWHGSWDAYFNAPEHKEEGATKRTNFSLTGPLGDEFSFRLYGNLDKTQADAWDINQGHQSARAGTYATTLPAGREGVINKDINGVVRWDFAPLQSLELEAGYSRQGNLYAGDTQNTNSDSYTRSKYGDETNRLYRQNYALTWNGGWDNGVTTSNWVQYEHTRNSRIPEGLAGGTEGKFNEKATQDFVDIDLDDVMLHSEVNLPIDFLVNQTLTLGTEWNQQRMKDLSSNTQALTGTNTGGAIDGVSTTDRSPYSKAEIFSLFAENNMELTDSTIVTPGLRFDHHSIVGNNWSPALNISQGLGDDFTLKMGIARAYKAPSLYQTNPNYILYSKGQGCYASAGGCYLQGNDDLKAETSINKEIGLEFKRDGWLAGVTWFRNDYRNKIEAGYVAVGQNAVGTDLYQWDNVPKAVVEGLEGSLNVPVSETVMWTNNITYMLKSENKTTGDRLSIIPEYTLNSTLSWQAREDLSMQTTFTWYGKQQPKKYNYKGQPAVGPETKEISPYSIVGLSATWDVTKNVSLTGGVDNLFDKRLWRAGNAQTTGDLAGANYIAGAGAYTYNEPGRTWYMSVNTHF

SEQ ID NO: 6591 - protein, 468 aa, Escherichia coli O9:H4
MRTFSGKRSTLALAIAGVTAMSGFMAMPEARAEGFIDDSTLTGGIYYWQRERDRKDVTDGDKYKTNLSHSTWNANLDFQSGYAADMFGLDIAAFTAIEMAENGDSSHPNEIAFSKSNKAYDEDWSGDKSGISLYKAAAKFKYGPVWARAGYIQPTGQTLLAPHWSFMPGTYQGAEAGANFDYGDAGALSFSYMWTNEYKAPWHLEMDEFYQNDKTTKVDYLHSLGAKYDFKNNFVLEAAFGQAEGYIDQYFAKASYKFDIAGSPLTTSYQFYGTRDKVDDRSVNDLYDGTAWLQALTFGYRAADVVDLRLEGTWVKADGQQGYFLQRMTPTYASSNGRLDIWWDNRSDFNANGEKAVFFGAMYDLKNWNLPGFAIGASYVYAWDAKPATWQSNPDAYYDKNRAIEESAYSLDAVYTIQDGRAKGTMFKLHFTEYDNHSDIPSWGGGYGNIFQDERDVKFMVIAPFTIF

SEQ ID NO: 6592 - protein, 760 aa, Escherichia coli O9:H4
MENNRNFPARQFHSLTFFAGLCIGITPVAQALAAEGQTNADDTLVVEASTPSLYAPQQSADPKFSRPVADTTRTMTVISEQVIKDQGATNLTDALKNVPGVGAFFAGENGNSTTGDAIYMRGADTSNSIYIDGIRDIGSVSRDTFNTEQVEVIKGPSGTDYGRSAPTGSINMISKQPRNDSGIDASASIGSAWFRRGTLDVNQVIGDTTAVRLNVMGEKTHDAGRDKVKNERYGVAPSIAFGLGTANRLYLNYLHVTQHNTPDGGIPTIGLPGYSAPSAGTATLNHSGKVDTHNFYGTDSDYDDSTTDTATMRFEHDINDNTTIRNTTRWSRVKQDYLMTAIMGGASNITQPTSDVNSWTWSRTANTKDVSNKILTNQTNLTSTFYTASIGHDVSTGVEFTRETQTNYGVNPVTLPAVNIYHPDSSIHPGGLTRNGANANGQTDTFAIYAFDTLQITRDFELNGGIRLDNYHTEYDSATACGGSGRGAITCPAGVAKGSPVTTVDTAKSGNLVNWKAGALYHLTENGNVYINYAVSQQPPGGNNFALAQSGSGNSANRTDFKPQKANTSEIGTKWQVLDKRLLLTAALFRTDIENEVEQNDDGTYSQYGKKRVEGYEISVAGNITPAWQVIGGYTQQKATIKNGKDVAQDGSSSLPYTPEHAFTLWSQYQATDDISVGAGARYIGSMHKGSDGAVGTPAFTEGYWVADAKLGYRVNRNLDFQLNVYNLFDTDYVASINKSGYRYHPGEPRTFLLTANMHF

SEQ ID NO: 6593 - protein, 357 aa, Escherichia coli O9:H4
MMKRNILAVIVPALLVAGTANAAEIYNKDGNKVDLYGKAVGLHYFSKDNGVNSYGGNGDKTYARLGFKGETQINSDLTGYGQWEYNFQGNNSEGADAQKGNKTRLAFAGLKFADAGSIDYGRNYGVVYDALGYTDMLPEFGGDTAYSDDFFVGRVGGVATYRNSNFFGLVDGLNFAVQYLGKNERAGIPERSNGDGVGGSISYEFEGFGIVGAYGAADRTDAQEAEFRGQGKKAEQWATGLKYDANNIYLAANYGETRNATPIEGGFANKTQDVLLVAQYQFDFGLRPSIAYTKSKAKDVEGIGDVDLVNYFEVGATYYFNKNMSTYVDYIINQIDSDNKLGVGSDDTVAVGIVYQF

SEQ ID NO: 6594 - protein, 356 aa, Escherichia coli O9:H4
MKKTAIAIAVALAGFATVAQAAPKDNTWYAGGKLGWSQYHDTGFYGNGFQNNNGPTRNDQLGAGAFGGYQVNPYLGFEMGYDWLGRMAYKGSVDNGAFKAQGVQLTAKLGYPITDDLDIYTRLGGMVWRADSKGNYASTGVSRSEHDTGVSPVFAGGVEWAVTRDIATRLEYQWVNNIGDAGTVGTRPDNGMLSLGVSYRFGQEDAAPVVAPAPAPAPEVATKHFTLKSDVLFNFNKATLKPEGQQALDQLYTQLSNMDPKDGSAVVLGYTDRIGSEAYNQQLSEKRAQSVVDYLVAKGIPAGKISARGMGESNPVTGNTCDNVKARAALIDCLAPDRRVEIEVKGYKEVVTQPAA

SEQ ID NO: 6595 - protein, 729 aa, Escherichia coli O9:H4
MLSTQFNRDNQYQAITKPSLLAGCIALALLPSAAFAAPATEETVIVEGSATAPDDGENDYSVTSTSAGTKMQMTQRDIPQSVTIVSQQRMEDQQLQTLGEVMENTLGISKSQADSDRALYYSRGFQIDNYMVDGIPTYFESRWNLGDALSDMALFERVEVVRGATGLMTGTGNPSAAINMVRKHATSREFKGDVSAEYGSWNKERYVADLQSPLTEDGKIRARIVGGYQNNDSWLDRYNSEKTFFSGIVDADLGDLTTLSAGYEYQRIDVNSPTWGGLPRWNTDGSSNSYDRARSTAPDWAYNDKEINKVFMTLKQRFADTWQATLNATHSEVEFDSKMMYVDAYVNKADGMLIGPYSNYGPGFDYVGGTGWNSGKRKVDALDLFADGSYELFGRQHNLMFGGSYSKQNNRYFSSWANIFPDEIGSFYNFNGNFPQTDWSPQSLAQDDTTHMKSLYAATRVTLADPLHLILGARYTNWRVDTLTYSMEKNHTTPYAGLVFDINDNWSTYASYTSIFQPQNDRDSSGKYLAPITGNNYELGLKSDWMNSRLTTTLAIFRIEQDNVAQSTGTPIPGSNGETAYKAVDGTVSKGVEFELNGAITDNWQLTFGATRYIAEDNEGNAVNPNLPRTTVKMFTSYRLPVMPELTVGGGVNWQNRVYTDTVTPYGTFRAEQGSYALVDLFTRYQVTKNFSLQGNVNNLFDKTYDTNVEGSIVYGAPRNFSITGTYQF

SEQ ID NO: 6596 - protein, 955 aa, Escherichia coli O9:H4
MGIKQHNGNTKADRLAELKIRSPSIQLIKFGAIGLNAIIFSPLLIAADTGSQYGTNITINDGDRITGDTADPSGNLYSVMTPAGNTPGNINLGNDVTVNVNDASGYAKGIIIQGKNSSLTANRLTVDVVGQTSAIGINLIGDYTHADLGTGSTIKSNDDGIIIGHSSTLTATQFTIENSNGIGLTINDYGTSVDLGSGSKITTDGSTGVYIGGLNGNNANGAARFTATDLTIDVQGYSAMGINVQKNSVVDLGTNSTIKTNGDNAHGLWSFGQVSANALTVDVTGAAANGVEVRGGTTTIGADSHISSAQGGGLVTSGSDAIINFTGTAAQRNSIFSGGSYGASAQTATAVVNMQNTDITVDRNGSLALGLWALSGGRITGDSLAITGAAGARGIYAMTNSQIDLTSDLVIDMSTPDQMAIATQHDDGYAASRINASGRMLINGSVLSKGGLINLDMHPGSVWTGSSLSDNVNGGKLDVAMNNSVWNVTSNSNLDTLALSHSTVDFASHGSTAGTFATLNVENLSGNSTFIMRADVVGEGNGVNNKGDLLNISGSSAGNHVLAIRNQGSEATTGNEVLTVVKTTDGAASFSASSQVELGGYLYDVRKNGTNWELYASGTVPEPTPNPEPTPAPAQPPIVNPDPTPEPAPTPKPTTTADAGGNYLNVGYLLNYVENRTLMQRMGDLRNQSKDGNIWLRSYGGSLDSFASGKLSGFDMGYSGIQFGGDKRLSDVMPLYVGLYIGSTHASPDYSGGDGTARSDYMGMYASYMAQNGFYSDLVIKASRQKNSFHVLDSQNNGVNANGTANGMSISLEAGQRFNLSPTGYGFYIEPKTQLTYSHQNEMTMKASNGLNIHLNHYESLLGRASMILGYDITAGNSQLNVYVKTGAIREFSGDTEYLLNNSREKYSFKGNGWNNGVGVSAQYNKQHTFYLEADYTQGNLFDQKQVNGGYRFSF

SEQ ID NO: 6597 - protein, 212 aa, Escherichia coli O9:H4
MKKLTVAALAVTTLLSGSAFAHEAGEFFMRAGSATVRPTEGAGGTLGSLGGFSVTNNTQLGLTFTYMATDNIGVELLAATPFRHKIGTRATGDIATVHHLPPTLMAQWYFGDASSKFRPYVGAGINYTTFFDNGFNDHGKEAGLSDLSLKDSWGAAGQVGVDYLINRDWLVNMSVWYMDIDTTAKYKSGVTTVKDSVRLDPWVFMFSAGYRF

SEQ ID NO: 6598 - protein, 301 aa, Escherichia coli O9:H4
MKKLLPCTALVMCAGMACAQAEERNDWHFNIGAMYEIENVEGYGEDMDGLAEPSVYFNAANGPWRIALAYYQEGPVDYSAGKRGTWFDRPELEVHYQFLENDDFSFGLPGGFRNYGYHYVDEPGKDTANMQRWKIAPDWDVKLTDDLRFNGWLSMYKFANDLNTTGYADTRVETETGLQYTFNETVALRVNYYLERGFNMDDSRNNGEFSTQEIRAYLPLTLGNHSVTPYTRIGLDRWSNWDWQDDIEREGHDFNRVGLFYGYDFQNGLSVSLEYAFEWQDHDEGDSDKFHYAGVGVNYSF

SEQ ID NO: 6599 - protein, 2330 aa, Escherichia coli O9:H4
MQRKTLLSACIALALSGQGWAADITEIETTTGEKKNTNVTCPADPGKLSPEELKRLPSECSSVVEQNLMPWLVTGAATALITTLAIVELNDDDDHHRNNSPLPPTPPDDDSDDTPVPPTPGGDEIIPDDGPDDTPTPPKPIAFNNDVILDKTEKTLTIRDSVFSYTENADGTISLQDSNGRKATINLWQIDETNNTVALEGMSADGATKWQYNHNGELVITGDNTTVNNTGKTIVDGKGATGTEIAGNNAVVNQDGELDVSGGGHGIDITGDSATVDNKGGMTVTDPDSIGIQIDGDKAVVNNDGGSAISNGGTGTQINGDEATVNNNGNTTVDGQGSTGTEIAGNNAVVNQDGELDVSGGGHGIDITGDSATVDNKGGMTVTDPDSIGIQIDGDKAVVNNDGDSAISNGGTGTQVNGDEATVNNNGKTTVDGKDSTGTEINGDKAIVNNDGDSTILDGGTGTRITGDDATANNSGNTTVDGQGSTGTEIAGNNAVVNQDGELDVSGGGHGIDITGDSATVDNKGGMTVTDPDSIGIQIDGDKAVVNNDGDSAISNGGTGTQVNGDEATVNNNGNTTVDGKDSTGTEINGDKAIVNNDGDSTILDGGTGTRITGDDATANNSGNTTVDGQGSTGTEIAGNNAVVNQDGELDVSGGGHGIDITGDSATVDNKGGMTVTDPDSIGIQIDGDKAVVNNDGDNAISNGGTGTQVNGDEATVNNNGSTTVDGQGSTGTEIAGNNAVVNQDGTLDVSGGGHGIDITGDSATVDNKGGMTVTDPDSIGIQIDGDKAVVNNEGDNAISNGGTGTQVNGDEATVNNNGKTTVDGKDSTGTEINGDKAIVNNDGDSTILDGGTGTRITGDDATANNSGNTTVDGQGSTGTEIAGNNAVVNQDGLLDVSGGGHGIDITGDSATVINKGNITVTDKDSVGVLINGDRATFANTGHIDVNNSATGMSITTSEGAISQAGSMNVGDFSTGMALSGNNNSVTLAAKDLNVIGQKATGVNISGDNNAVDITGNILVDKDQTATNAVDYFYEPSIGVNVSGNSNTVSLDGKLTVVADSELTSRIYADFDGSQENISGLVVSGDDNTVYLNGGIQLVGEENQLTDGSTVASNRNGYGKTPVITVDGKSSVYLNGDSTINGDLPLAYSGMIRLKNSAMIEIGADATINMQVDIYDHYARSESQMIFVESGAELVNKGDIDTRNIGFAAISGENSTGSNSGNITLSQYNYGLLANAGVGYFTTKGGSAVNNGTITAKVMEQESVINLGASLGLNEANTFYSDANSMMGLDAFDHGYVSNESGGSIEMYGRGNVGMLAIDESTAENAGQITLDALWVDADDTTTLRSNIGNDARSYGVGMAVGTNTYSGPRKNATAVNKQGGVITVYNAGIGMAAYGASNTVINEGIINLEKNANYDSSLGADSLIGMAAYKSGTAINEQSGVININADNGQAFYSDGSGTILNYGTICVNTNCLTGNDYNETDSYTSLLYTGGDVITAQNETQNLTQKASINDKKEGNVVNSGSLSGADIAISSGELVNTSTGTINNAIIINDGELSNEGSVAKVTLNAGTFGNTGTVNSRMFQTGGTFNNQQGGVVQNGANLSKTAITNNEGTWYLGASSSSDSNNASMMEIYNTAVFNNSGDFILNNSRNAIHLYQSGSFYNTGHMLISGANYSGNAINYWNANNNGRFINSGTVDVTAKALATSGVDASTNHAYFWNQNSGIVNFDKDSGVAVKFTHSNYVAQNDGTMNISGNNAIAMEGNKNAQLINNGTINLGAQGTTDTGMIGMQLDSSATADAVIENNGTINIYANNSFAFSMLGSVGHLVNNGTVTIADGVTGSGLIKQGNSVNIEGVNGNNGNNSEVHYANYTLPDVPGSSVFVSTDNVSDNGGQNNLNGYVVGTSSDGSAGKLKVSNASLKGVSVNTGFTSGTSATSVTFDNVVQGNNLTDADTITSTSVVWSAQGNTDANGNVDVTMTKNAYTDVVTDSSVNNVAQVLDTGYTNNDLYTSLNVGTTAELNSALKQISGSQATTVFNEARVLSNRFSMLSDAAPEVANGLAFNVVAKGDPRAELGNDTQYDMMALRKSLTLTEHQNLSLEYGIARLEGNGSDTAGDNGVTGGYSQLFGLKHQMAFDNGMNWNNALRYDVHQLDSSRSIAYGDVNKTADANVKQQYLEFRSEGAKTFELREGLNVTPYAGVKLRHTLEGGYQERNAGDFNLSMNSGSETAVDSIVGLKLDYAGKEGWSANATLEGGPNLSYVKSQRTASISGAGSQRFNIDDGQSGGGFNSLATMGVKYSSQESALQVDAFHWKEDGISDKGVMLNFKKTF

SEQ ID NO: 6600 - protein, 700 aa, Escherichia coli O9:H4
MKIFSVRQTVLPALLALSPVVFAADEQTMIVSAAPQVVSELDTPAAVSVVDGEEMRLATPRINLSESLTDVPGLQVQNRQNYAQDLQLSIRGFGSRSTYGIRGIRLYVDGIPATMPDGQGQTSNIDLSSVQNVEVLRGPFSALYGNASGGVMNVTTQTGQQPPTIEASSYYGSFGSWRYGLKATGATGDGTQPGDVDYTVSTTRFTTHGYRDHSGAQKNLANAKLGVRIDEASKLSLIFNSVDIKADDPGGLTKAEWKANPQQAPRAEQYDTRKTIKQTQAGLRYERSLSAQDDMSVMMYAGERETTQYQSIPMAPQLNPSHAGGVITLQRHYQGIDSRWTHRGELGVPVTFTTGLNYENMSENRKGYNNFRLNSGMPEYGQKGELRRDERNLMWNIDPYLQTQWQLSEKLSLDAGVRYSSVWFDSNDHYVTPGNGDDSGDASYHKWLPAGSLKYAMTDAWNIYLAAGRGFETPTINELSYRADGQSGMNFGLKPSTNDTIEIGSKTRIGDGLLSLALFQTDTDDEIVVDSSSGGRTTYKNAGKTRRQGAELAWDQRFAGDFRVNASWTWLDATYRSNVCNEQDCNGNRMPGIARNMGFASIGYVPEDGWYAGTEARYMGDIMADDENTAKAPSYTLVGLFTGYKYNYHNLTVDLFGRVDNLFDKEYVGSVIVNESNGRYYEPSPGRNYGVGMNIAWRFE

SEQ ID NO: 6601 - protein, 366 aa, Escherichia coli O9:H4
MKLKIVAVVVTGLLAANVAHAAEVYNKDGNKLDLYGKVTALRYFTDDKRDDGDKTYARLGFKGETQINDQMIGFGHWEYDFKGYNDEANGSRDNKTRLAYAGLKISEFGSLDYGRNYGVGYDIGSWTDMLPEFGGDTWSQKDVFMTYRTTGVATYRNYDFFGLIEGLNFAAQYQGKNERTDNSHLYGADYTRANGDGFGISSTYVYDGFGIGAVYTKSDRTNAQERAAANPLNASGKNAELWATGIKYDANNIYFAANYAETLNMTTYGDGYISNKAQSFEVVAQYQFDFGLRPSLAYLKSKGIDLGRYGDQDMIEYIDVGATYFFNKNMSTYVDYKINLIDESDFTRAVDIRTDNIVATGITYQF

SEQ ID NO: 6602 - protein, 790 aa, Escherichia coli O9:H4
MKRVLIPGVILCGADVAQAVDDKNMYMHFFEEMTVYAPVPVPVNGNTHYTSESIERLPTGNGNISDLLRTNPAVRMDSTQSTSLNQGDIRPEKISIHGASPYQNAYLIDGISATNNLNPANESDASSATNISGMSQGYYLDVSLLDNVTLYDSFVPVEFGRFNGGVIDAKIKRFNADDSKVKLGYRTTRSDWLTSHIDENNKSAFNQGSSGSTYYSPDFKKNFYTLSFNQELADNFGVTAGLSRRQSDITRADYVSNDGIVTGRAQYKNVIDTALSKFTWFASDRFTHDLTLKYTGSSRDYNTSTFPQSDREMGNKSYGLAWDMDTQLAWAKLRTTVGWDHISDYTRHDHDIWYTELSCTYGDITGRCTCGGLGHISQAVDNYTFKTRLDWQKFAVGDVSHQPYFGAEYIYSDAWTERHNQSESYVINAAGKKTNHTIYHKGKGSLGIDNYTLYMAEHISWRNVSLMPGVRYDYDNYLSNHNISPRFMTEWDIFADQTSMITAGYNRYYGGNILDMGLRDIRNSWTESVSGNKTLTRYQDLKTPYNDELAMGLQQKIGKNVIARANYVYREAHDQISKSSRTDSATKTTITEYNNDGKTKTHSFSLSFELAEPLHIRQVDINPQIVFSYIKSKGNLSLNNGYEESNTGDNQVVYNGNLVSYDSVPVADFNNPLKISLNMDFTHQPSGLVWANTLAWQEARKARIILGKTNAQYISEYSDYKQYVDEKLDSSLTWDTRLSWTPQFLKQQNLTISADILNVLDSKTAVDTTNTGVATYASGRTFWLDVSMKF

SEQ ID NO: 6603 - protein, 199 aa, Escherichia coli O9:H4
MRKVCAAILSAAICLAVSGAPAWASEQQATLSAGYLHARTNAPGSDDLNGINVKYRYEFTDTLGLITSFSYANAEDEQKTHYSDTRWHEDSVRNRWFSVMAGPSVRVNEWFSAYAMAGMAYSRVSTFSGDYIRVTDNKGKTHDVLTGSDDGRHSNTSLAWGAGVQFNPTESVAVDVAYEGSGSGDWRTNSFIVGVGYKF

SEQ ID NO: 6604 - protein, 421 aa, Escherichia coli O9:H4
MRKIVAMAVICLTAASGLTSAYAAQLADDEAGLRIRLKNELRRADKPSAGAGRDIYAWVQGGLLDFNSGYYSNIIGVEGGAYYVYKLGARADMSTRWYLDGDKSFGFALGAVKIKPSENSLLKLGRFGTDYSYGSLPYRIPLMAGSSQRTLPTVSEGALGYWALTPNIDLWGMWRSRVFLWTDSTTGIRDEGVYNSQTGKYDKHRARSFLAASWHDDTSRYSLGASVQKDVSNQIQSILEKSIPLDPNYTLKGELLGFYAQLEGLSRNTSQPNETALVSGQLTWNAPWGSVFGSGGYLRHAMNGAVVDTDIGYPFSLSLDRNREGMQSWQLGVNYRLTPQFTLTFAPIVTRGYESSKRDVRIEGMGILGGMNYRVSEGPLQGMNFFLAADKGREKRDGSTLGDRLNYWDVKMSIQYDFMLK

SEQ ID NO: 6605 - protein, 1069 aa, Escherichia coli O9:H4
MYNLNHIIKKITGAGKALLLVTLLLATGAVWAQNTQTLKGRIVDTEGNPIAGAVVNVAEESRIVLSDENGYFSLKNVRASDEICISSVGYKNAQVAVDFNEGFKIELESDLDEYLHTTPIAFGRKAKKLVTESTSVVTGEELQKHPITVLQNAFTSTVTGMETYEWSSEPGWTETAMYIRGIRTMNTGARAPLVIVDNMERDLSFLDAFPIENITILKDAAATAIYGMRGANGAILVTTKRGSAGKTNIDFTQEVGFQMLSNKMENQNSYNMALTRNRVKYLDGQDPMYTDEQIEMYRRVCNGETLEGIDQYRYFNTSWADELYRETAPMYKTNLQISGGNERARYYVSFSYLRQEGMWNDKWTNYNKNYNTGHTLNRWNLRSNIDIDVTKHLNVSLDLGGRIDNITQPTESVFNLATFGVVEANPMEPVYTPNGQIYASSTANNAGRYLAASGQEKNRRRNLYSTLNVNGDLSPILKGLKVNATISFDSYETFESTQRNSVNSYNYDYMNMDVTDPSQFKYTQYTTYSALSDPTPNQREFYYNLNLMGGLGYSNKFGQHTVEARAFARAYRNQSNGYASSNRYLSYNGQVTYDYANRYIFSGNISRMGCDNFREDQRWGTFYGASAGWVASEEPWLKNKNINLLKLRASYGRAGQSTTGGGRYAYQNTYGSATGYGFGYSGSYINGFAETMAGNANNKWEISDMLNIGLDFDFWNKKIYGSVDAFQEWRSNILVTRTSVPSLLGISVAKDSYGKAETKGFEVTLGHRHHIGDFNYYIEGMLTYNTNKITEMDETEPNVEWQRKTGNRIYDYTSVAGLYESSFNNGVGGWNRYKFIQWASDANLIATSQQDAIDHPEKYPYNAASNGTQKLGTAVFKDLNGDRQIDSNDMIPDTYTIIPELIPTLNFGFEWKGFDARAVFTAYLNRDVFLSPAVAWSGWGNQGTHEVVKTWGYYTDDPLDPRNVNATYPRPTYGSYNAIDSDRDTGTYQNDIWIVNGNFLSLRNVEVGYSLPKRLIAKANLTKCRLYFSGYNLCTWSSVPDGCDPEKPMSYVWWYPKTRTFTFGINIGF

SEQ ID NO: 6606 - protein, 663 aa, Escherichia coli O9:H4
MFRLNPFVRVGLCLSAISCAWPVLAVDDDGETMVVTASSVEQNLKDAPASISVITQEDLQRKPVQNLKDVLKEVPGVQLTNEGDNRKGVSIRGLDSSYTLILVDGKRVNSRNAVFRHNDFDLNWIPVDSIERIEVVRGPMSSLYGSDALGGVVNIITKKIGQKWSGTVTVDTTIQEHRDRGDTYNGQFFTSGPLIDGVLGMKAYGSLAKREKDDPQNSTTTDTGETPRIEGFSSRDGNVEFAWTPNQNHDFTAGYGFDRQDRDSDSLDKNRLERQNYSVSHNGRWDYGTSELKYYGEKVENKNPGNSSPITSESNTVDGKYTLPLTAINQFLTVGGEWRHDKLSDAVNLTGGTSSKTSASQYALFVEDEWRIFEPLALTTGVRMDDHETYGEHWSPRAYLVYNATDTVTVKGGWATAFKAPSLLQLSPDWTSNSCRGACKIVGSPDLKPETSESWELGLYYMGEEGWLEGVESSVTVFRNDVKDRISISRTSDVNAAPGYQNFVGFETGANGRRIPVFSYYNVNKARIQGLETELKIPFNDEWKLSINYTYNDGRDVSNGENKPLSDLPFHTANGTLDWKPLALEDWSFYVSGHYTGQKRADSATAKTPGGYTIWNTGAAWQVTKDVKLRAGVLNLGDKDLSRDDYSYNEDGRRYFMAVDYRF

SEQ ID NO: 6607 - protein, 863 aa, Escherichia coli O9:H4
MHQSGSVSLCRSAISVLVATALYSPIALASTVEYGETVDGVVLEKDIQLVYGTANNTKINPGGEQHIKEFGVSNNTEINGGYQYIEMNGAAEYSVLNDGYQIVQMGGAANQTTLNNGVLQVYGAANDPTIKGGRLIVEKDGGTVFAAIEKGGLLEVKEGGFAFAVDQKAGGAIKATTRVMEVFGTNRLGQFEIKNGIANNMLLENGGSLRVEENDFAYNTTVDSGGLLEVMDGGTATGVDKKAGGKLIVSTNALEVSGTNSKGQFSIKDGVSKNYELDDGSGLIVMEDTQAIDTILDEHATMQSLGKDTGTKVQANVVYDLGRSDQNGSITYSSKAISENMVINNGRANVWAGTMVNVSVRGNDGILEVMKPQINYAPAMLVGKVVVSEGASFRTHGAVDTSKADVSLENSVWTIIADITTTNQNTLLNLANLAMSDANVIMMDEPVTRSSVTASAENFITLTTNTLSGNGNFYMRTDMANHQSDQLNVTGQATGDFKIFVTDTGASPAAGDSLTLVTTGGGDAAFTLGNAGGVVDIGTYEYTLLDNGNHSWSLAENRAQITPSTTDVLNMAAAQPLVFDAELDTVRERLGSVKGVSYDTAMWSSAINTRNNVTTDAGAGFEQTLTGLTLGIDSRFSREESSTIRGLIFGYSHSDIGFDRGGKGNIDSYTLGAYAGWEHQNGAYVDGVVKVDRFANTIHGKMSNGATAFGDYNSNGAGAHVESGFRWVDGLWSVRPYLAFTGFTTDGQDYTLSNGMRADVGNTRILRAEAGTAVSYHMDLQNGTTLEPWLKAAVRQEYADSNQVKVNDDGKFNNDVAGTSGVYQAGIRSSFTPTLSGHLSVSYGNGAGVESPWNTQAGVVWTF

SEQ ID NO: 6608 - protein, 86 aa, Escherichia coli O9:H4
MKVKVLSLLVPALLVAGAANAAEVYNKDGNKLDLYGKVDGLHYFSDNKSEDGDQTYVRLGFKGETQVTDQLTGYGQWEYQIQGNTS

SEQ ID NO: 6609 - protein, 1250 aa, Escherichia coli O9:H4
MRIIFLRKEYLSLLPSMIASLFSANGVAAVTDSCQEYDVKASCQASRQSLSGITQDWSIADGQWLVFSDMTNNASGGAVFLQQGAEFSLLPENETGMTLFANNTVTGEYNNGGAIFAKENSTLNLTDVIFSGNVAGGYGGAIYSSGTNDTGAVDLRVTNAMFRNNIANDGKGGAIYTINNDVYLSDVIFDNNQAYTSTSYSDGDGGAIDVTDNNSDSKHPSGYTIVNNTAFTNNTAEGYGGAIYTNSVTAPYLIDISVDDSYSQNGGVLVDENNSAAGYGDGPSSAAGGFMYLGLSEVTFDIADGKTLVIGNTENDGAVDSIAGTGLITKTGSGDLVLNADNNDFTGEMQIENGEVTLGRSNSLMNVGDTHCQDDPQDCYGLTIGSIDQYQNQAELNVGSTQQTFVHALTGFQNGTLNIDAGGNVTVNQGSFAGIIEGAGQLTIAQNGSYVLAGAQSMALTGDIVVDDGAVLSLEGDAADLTALQDDPQSIVLNGGVLDLSDFSTWQSGTSYNDGLEVSGSSGTVIGSQDVVDLAGGDNLHIGGDGKDGVYVVVDASDGQVSLANNNSYLGTTQIASGTLMVSDNSQLGDTHYNRQVIFTDKQQESVMEITSDVDTRSDAAGHGRDIEMRADGEVAVDAGVDTQWGALMADSSGQHQDEGSTLTKTGAGTLELTASGTTQSAVRVEEGTLKGDVADILPYASSLWVGDGATFVTGADQDIQSIDAISSGTIDISDGTVLRLTGQDTSVALNASLFNGDGTLVNATDGVTLTGELNTNLETDSLTYLSNVTVNGNLTNTSGAVSLQNGVAGDTLTVNGDYTGGGTLLLDSELNGDDSVSDQLVMNGNTAGNTTVVVNSITGIGEPTSTGIKVVDFAADPTQFQNNAQFSLAGSGYVNMGAYDYTLVEDNNDWYLRSQEVTPPSPPDPDPTPDPDPTPDPDPTPDPEPTPAYQPVLNAKVGGYLNNLRAANQAFMMERRDHAGGDGQTLNLRVIGGDYHYTAAGQLAQHEDTSTVQLSGDLFSGRWGTDGEWMLGIVGGYSDNQGDSRSNMTGTCADNQNHGYAVGLTSSWFQHGNQKQGAWLDSWLQYAWFSNDVSEQEDGTDHYHSSGIIASLEAGYQWLPGRGVVIEPQAQVIYQGVQQDDFTAANRARVSQSQGDDIQTRLGLHSEWRTAVHVIPTLDLNYYHDPHSTEIEEDGSTISDDAVKQRGEIKVGVTGNISQRVSLRGSVAWQKGSDDFAQTAGFLSMTVKW

SEQ ID NO: 6610 - protein, 446 aa, Escherichia coli O9:H4
MSQKTLFTKSALAVAVALISTQAWSAGFQLNEFSSSGLGRAYSGEGAIADDAGNVSRNPALITMFDRPTFSAGAVYIDPDVNISGTSPSGRSLKADNIAPTAWVPNMHFVAPINDQFGWGASITSNYGLATEFNDTYAGGSVGGTTDLETMNLNLSGAYRLNNAWSFGLGFNAVYARAKIERFAGDLGQLVAGQIMQSPAGQTPQGQALAATANGIDSNTKIAHLNGNQWGFGWNAGILYELDKNNRYALTYRSEVKIDFKGNYSSDLNRAFNNYGLPIPTATGGATQSGYLTLNLPEMWEVSGYNRVDPQWAIHYSLAYTSWSQFQQLKATSTSGDTLFQKHEGFKDAYRIALGTTYYYDDNWTFRTGIAFDDSPVPAQNRSISIPDQDRFWLSAGTTYAFNKDASVDVGVSYMHGQSVKINEGPYQFESEGKAWLFGTNFNYAF

SEQ ID NO: 6611 - protein, 232 aa, Escherichia coli O9:H4
MIIKKSGGRWQLSLLASVVISAFFLNTAYAWQQEYIVDTQPGHSTERYTWDSDHQPDYNDILSQRIQSSQRALGLEVNLAEETPVDVTSSMSMGWNFPLYEQVTTGPVAALHYDGTTTSMYNEFGDSTTTLTDPLWHASVSTLGWRVDSRLGDLRPWAQISYNQQFGENIWKAQSGLSRMTATNQNGNWLDVTVGADMLLNQNIAAYAALTQAENTTNNSDYLYTMGVSARF

SEQ ID NO: 6612 - protein, 238 aa, Escherichia coli O9:H4
MKKAKILSGVLLLCFSSPLISQAATLDVRGGYRSGSHAYETRLKVSEGWQNGWWASMESNTWNTIHDNKKENAALNDVQVEVNYAIKLDDQWTVRPGMLTHFSSNGTRYGPYVKLSWDATKDLKFGIRYRYDWKAYRQQDLSGDMSRDNVHRWDGYVTYHINSDFTFAWQTTLYSKQNDYRYANHKKWATENAFVLQYHMTPDITPYIEYDYLDRQGVYNGRDNLSENSYRIGVSFKL

SEQ ID NO: 6613 - protein, 900 aa, Citrobacter koseri
MNIIFQGRFPVRTIVLIGVALLITTQIYAQNAEARLSLTLRNATLKEFVKRIENSTGYSFIYGEEIIIKHKINLQVKDKPLREILDLVFKNEQISYQFTGRHILLQKKKESKTVGRKFTISGYVTDGTSSETLIGTNIIESHQNQGTTTNPYGFYSITLPEGETELRFSYLGYATEAHHFTLSQDTLLNIRMQGNTQLQEVVIVSDKTETGTVATQMGSIEIPMTQIKNTPSILGEADVMKAIQLMPGVQAGVDGSAGLYIRGGSPDQNLILLDGTPVYNVDHMFGFFSVFTPEAVKKVTLFKSSFPARFGGRLSSVIDVRTNDGDMQKYHGTLSIGLLTSKINLEGPIVKGKTSFNISARRSYVDLIAKPFMPNDEEYGYYFYDINAKINHKFSDRSRIYLSVYNGKDHFAANYDGDTDSKDGSTMNWGNTIVSARWNYIFNNRLFSNTTVSYNNYLFDVNSYNNNKYANSMGASIINRYSADYRSGINDWSYQIDFDYNPSPTHHIKFGTGYIYHRFRPEVMTSKISEKTGDKVDRDTTYHSIANSRIYGHELSAYLEDNIKVNDRLRLNLGLHFSLFQVQKQSYFSLQPRVSARYQLGKDVTLKASYTQMSQYVHLLSSMPIAMPTDLWVPVTKKIKPMRSHQYSLGGYYTGIEGWEFSVEGYYKDMYNVLEYKEGVSFFGSSAGWENKVEMGKGRSAGIEFMAQKTLGRTTGWLSYTLSKSDRQFAKGGINNGERFPYKYDRRHNINLTINHKFNERIDIGASWVFYTGGTSTIPEEKTAVIRPSDGTNNGFGGGYGYGDYFDSGITSPTIGEASYVEHRNNYRLPASHRLNVGVNFNKKTKHGMRTWNISLYNAYNAMNPTFVYRSTSKNDPYKPIIKKYTILPLIPSFTYTYRF

SEQ ID NO: 6614 - protein, 392 aa, Citrobacter koseri
MKRTLKSIPQPPAKRPLRACLARLAPLAMLAAAGGAQAQTGSSVTLYGHLDTGIEHLTNVQGGGSLTRMPGLTGTAPSRWGLRGSEDLGGGLSAVFALESGFGPDAGTFNQGGRGFGRQAWVGLSGGWGSVSLGRNYTMLYWALFDADLLGPNAFGLSSLDSYIPNTRTDNSLAYRGRFGAWSLGAAYSLGRDAVNAGPSPAGTNCAGESATDRQACRQWSAMLKYDTAPWGFALAVDEMRGGAGAFAGLTRSDLKDRRIMLNGYAALSPTIKLGAGLMRRDNDAAQAASASNGATPRSTLAWGGLSWSPSAAVVVDGQLQQLRYAQGGDRSTLLALRATYRFSKRTAVYAQAARIDNGQRLAISVSSAAAGGSPLAGASQTGLMLGLRHSF

SEQ ID NO: 6615 - protein, 347 aa, Citrobacter koseri
MNKVDTTILLEQEAKQEMQTQISENAPTLNQVKVINTIVNNMIRNRLDTSINMVVVGASAEEESNIKRGLWMRGMYGTNNHGRVDNMTGYRGINKGATVGFDAEINNNIIGIAYSNVHSVFKFKNGKNNDKELIGSKVISIYGQKELQQNFTLQLLVSASKNFIKDKINYSYGDTQIKSHVKHHNHSYNAEALLNYNYLVKNSIIITPNIGLKYGKSRDGVYNETGINVQEIALTMKENNILSGILGAKVKVSLIDVLKFNNLGLTFQTAVEHNFKEKTQRINRVIKIFDNIFKQDYLIPKQPKTSYNLGTGIICGINNTNIAVDYNYYLNKHYRSHQGSLKIKVNL

SEQ ID NO: 6616 - protein, 437 aa, Citrobacter koseri
MVMSQKTLFTKSALAVAVAIISTQAWSAGFQLNEFSSSGLGRAYSGEGAIADDAGNVSRNPALITMFDRPTFSAGAVYIDPDVNISGTSPSRRTLDADNIAPTAWVPNVHFVAPINDQFGWGASITSNYGLATEFNDTYAGGSVGGTTDLETMNLNLSGAYRLNEAWSFGLGFDAVYARAKIERFAGDLGQLVAAQNPALAPVAGRIPSDTKIAHLNGNQWGFGWNAGILYELDKNNRYALTYRSEVKIDFKGNYSSDLPIAINRFNLPIPTATGGATQSGYLTLNLPEMWEVSGYNRVAPQWAIHYSLAYTSWSQFQELKAKSTAGDTLFEKHEGFKDAYRIALGTTYYYDDNWTFRTGIAFDDSPVPAQNRSISIPDQDRFWLSAGTTYAFNKDASVDVGVSYMHGQSVKINEGPYQFESEGKAWLFGTNFNYAF

SEQ ID NO: 6617 - protein, 103 aa, Citrobacter koseri
MKVKVLSLLVPALLVAGAANAAEIYNKDGNKLDLYGKVDGLHYFSDNDSVDGDQTYMRLGFKGETQVTDQLTGYGQWEYQIQGNKPENDNNSWTRVAFAGLKF

SEQ ID NO: 6618 - protein, 688 aa, Citrobacter koseri
MAFCVILAFGGFSVFGRDDLDIASLSLDELMEVEVTTPGKVPEAIRDTPASVYLVSRDDIETFGYSNLTEVLENVPGFYNIDNYTGVSGNFGVRGYWNGRSQNSSVAILVNGVPQMRPDLFATPMEGINVPVEAIDRVEVSRGPNSVVYGNGAFFGAINIITNDSYSDDQLSVTSGTNGTSRVVGRLSEFGDDFHVIFNAGFSTTDGHGHDLLDLVSENRRFLLPSYGVEEGNSSLAGRLEQQSGFVQLSGAWRDLYFDYSLNDAEVESFSGFPAVVDGNLRSSSSSRFLVGGNISFSDQLSLDTRLTYLSFLSEEDYDALHPDFVGVNTRDFDNWELESLMTYDRSESLRFIAGVNLQRMQNFYEFTDVPDVGLIRESVVIDERDLRSLFGQVSYQFAEPFRLVAGYRVEEMLGFDRFVFEAEPVDGTPLPGWEKGNFNNGTPRVSLIYQPNESQVLKVMIGDATKIPNFNDPGFNTEKSRTTEINYTWTTESVLISASVFRNELSDLLIQTLDIEVSGLIDTDLLSGGEVETEGIEILVRKSFSDTIRGELGVTWQDSENAQTPNQLLSYSPELVAHGKISYHKGDFSASGLARFVDEMSSFYNLDTDSSPLFVGGFFGDAVDSYFVADVNMRWDNVWEDVYLNLRISNVFDTEIRYPNNPINGLLLDRGNIGLDRRVALTAGIRF

SEQ ID NO: 6619 - protein, 723 aa, Citrobacter koseri
MKLKPISLAIFCALSMATMPGHAENQTAPLDNDSQQDNLNIEKIEVRGRYVQGYNAHSVGGASRLDLAIIDIPQSVSVITDAQLDDFQLNDINSALDSATGINVERIETDRTYYTARGFDITNFQIDGVGLPLTSGNNHADEDTAIYDRIEVIRGANGLMTGVGNPSATVNFIRKRPTSDNQLKLQASYGSFNNARVEADASGRLNDNFAARVVAVKQQKDSYLDRYETDKSVLYAFIEANLSDDTSLSVSHSYINNDATGNNWGALPLYYTDGSPTNYDRSTNTSANWSNWQVIKNNTVVELSHYFADDWRLRATYSHKSTDEDTELFYVYGTPDRETGLGLTGYGSEYDLDESHDLVDLYVDGEFSLFGRDHQLVAGVNYAKVDYIDTSLYDYTTGNGFPAMPDLNDWDGNTPKPVFADSPRGSDVSAKQQAAYFTGRFNLFDGFHFIAGGRFNKWQAEGVSYDKVQDVEDSQFIPYLGAVYRITPELVAYASYTETFKSQTEMDIDDNLLAPVTGESKEIGFKSELFDGRLIASLAYFDIQQVNLAVPDPRTADLPPTDQRYIGADGINSKGYEFEVAGEVFDGLNLSLGFTDFDIDGNDDNAKIVAAYTPSRLLKFAATYDVAAIEGLSVGMNMRWQDDIYRDQGVVGDGFANAGEAIITRQGAYAIVDLMARYQFNDNLQLSLNANNVTDEKYLNSLYWAQAFYGAPANYSATITWKL

SEQ ID NO: 6620 - protein, 673 aa, Citrobacter koseri
MKMTRLYPLALGGLLLPAIANAQTSQQDESTLVVTASKQSSRSASANNVSSTVVSAPELSDAGVTASDKLPRVLPGLNIENSGNMLFSTISLRGVSSAQDFYNPAVTLYVDGVPQLSTNTIQALTDVQSVELLRGPQGTLYGKSAQGGIINIVTQQPDSTPRGYIEGGVSSRDSYRSKFNLSGPIQDGLLYGSVTLLRQVDDGDMINPATGSDDLGGTRASIGNVKLRLAPDDQPWEMGFAASRECTRATQDAYVGWNDIKGRKLSISDGSPDPYMRRCTDSQTLSGKYTTDDWVFNLISAWQQQHYSRTFPSGSLIVNMSQRWNQDVQELRAATLGDARTVDMVFGLYRQNTREKLNSAYDMPTMPYLSSTGYTTAETLAAYSDLTWHLTDRFDIGGGVRFSHDKSSTQYHGSMLGNPFGDQGKSNDDQVLGQLSAGYMLTDDWRVYTRVAQGYKPSGYNIVPTAGLDAKPFVAEKSINYELGTRYETADVTLQAATFYTHTKDMQLYSGPVGMQTLSNAGKADATGVELEAKWRFAPGWSWDINGNVIRSEFTNDSELYHGNRVPFVPRYGAGSSVNGVIDTRYGALMPRLAVNLVGPHYFDGDNQLRQGTYATLDSSLGWQATERMNISVYVDNLFDRRYRTYGYMNGSSAVAQVNMGRTVGINTRIDFF

SEQ ID NO: 6621 - protein, 733 aa, Citrobacter koseri
MMISKKYTLWALNPLLLAMMAPAVAQQADDETLVVSANRSNRTVAEMAQTTWVIENAELEQQIQGGKELKDALAQLIPGLDVSSQSRTNYGMNVRGRPLVVLVDGVRLNSSRTDSRQLDSIDPFNIDHIEVISGATALYGGGSTGGLINIVTKKGQPETQMEFEAGTKSGFNSSKDHDERIASAISGGNDHISGRVSVAYQKFGGWFDGNGDATLLDNTQTGLQYSDRLDIMGTGTLNIDETQQLQLITQYYKSQGDEDYGLNLGKDFSAISGSSTPYVSKGLHSDRIPGTERHLISLQYSNSDFFSQELVGQVYYRDESLLFYPFPTVNANKQATAFSSSQQDTDQYGMKLTLNSKPLDGWQITYGLDADHERFTSNQMFFNLAQSSASGGLNNQKIYTTGRYPSYDITNLAAFLQSSYDINDIFTLSGGLRYQYTENKIDNFIGYAQQQQIAAGKATSADAIPGGSVDYDNVLFNAGLLMHITERQQAWFNFSQGVELPDPGKYYGRGTYGAAVNGHLPLTNSVNVDDSKLEGVKVDSYELGWRFTGDNLRTQISTYYSISDKSVVANKDLTISVVDDKRRIYGVEGAVDYLIPDTDWSTGANFNVLKTESKVNGSWQKYDVKLASPSKATAYIGWAPDPWSLRVQSTTSFEVSDAKGYSIDGYTTVDLLGSYQLPVGKLSFSVENLFDRDYTTVWGQRAPLYYSPGYGPASLYDYKGRGRTFGLNYSVLF

SEQ ID NO: 6622 - protein, 383 aa, Citrobacter koseri
MKRKVLALVIPALLTAGAAHAAEIYNKDGNKLDLYGKVDGLHYFSDDSSKDGDQTYMRVGFKGETQINDQLTGYGQWEYNVQANTTEGEGANSWTRLAFAGLKFGDYGSFDYGRNYGVLYDVEGWTDMLPEFGGDSYTYADNYMTGRANGVATYRNTDFFGLVDGLNFALQYQGKNESQSADDVNIGTNNRNNGDDIRYDNGDGFGISTTYDIGMGFSAGAAYTTSDRTNEQVNAGGTIAGGDKADAWTAGLKYDANNIYLATMYSETRNMTPYGKTDAGYAGGVANKTQNFEVTAQYQFDFGLRPAVSFLMSKGKDLTYNNVNGDDKDLVKYADVGATYYFNKNFSTYVDYKINLLDDDDQFYKDAGISTDDIVALGMVYQF

SEQ ID NO: 6623 - protein, 466 aa, Citrobacter koseri
MIIHRSLAAGVGLAALATSAFAQSSTPTAEEIAALRAQVQALSARLEQLEAQSQVQAQTAAAAPAAAGTPAPAAAAAPRPVVQAASAPSSVDWSSGLPELRSPDGGFTFKPRIRVTADLSNTFGSDFDGRNLTTTELRGLRLGAQGKTPGGFSYWIEGDIADNAMSVANAFIAYSRKVGGRDLEVSVGQRLNDRCFECGTAEDVVPFLERSMAISTVGPERGSYGVGVTSKLIGSVWHASLSLTGDAISSGTTNDSVTLMGRTHWSPFKTDDGFLHIGGWGFIEDLTPNASVASRSLVVSSRGNDNLRLSAGTYADPKGSKGLGLELGGVHRSGWLMAEGGRRLLETAARDFDQDGYSISAGFFITGEKPPLSPRTGTWARPKVLKPLGVDGYGAVEIVGRYDTADYSDNPTGGEADTWLLGVNWYPTNNTRVSTHWSAWSVDNRTGTFVGDDSGNTATIRVQTAF

SEQ ID NO: 6624 - protein, 1371 aa, Citrobacter koseri
MKTTFRLTQVATSISLLLGSSVVIPGTALANSCTTFSPAGTCGLTEYQMTSPLNPLPTAWYFTSPTQDAAINATAKAQNIYFASGSSSRQANDIQQLLVDGANLGGHYINASKTGSAAITLANNAVVDWIEAGGALTNTRIIIDHSTLNGANAAVDYDKTNKATYSKNYARGNAIYLAPADNGNTYIDIINGSHITGRVYAGGAGTHDVSLENSAIQAGGILLYSTKNRNDIHVVNSEISTTGAVMATSNAIEITNLARTESTNTIAIEDSQITGSVAVSSTGSNNILAVNHSAITKTNQTNGNAISLKNGATTQLTLNNAQIAGHALLSGSGSTAATIDQSQIDGNVIANNAAQIAFDITHSVLNGNIDASTGSGIVALHLTDSSVSGDVNLNGTSVKESDVWLNRSDVQGHLYGGGENSTLHLDGFSQFNGEKFSQFSALNIAGNLNLAGGFTDTNVGAGLSVKGETLTAPIKLTAGNLTFDKTKLIADTLSLSNGATLALADRSQLQTRSDQLFKRASSALLPEGYNETGERISLKDSTLILTDNTYHLDYVKAVNQLISPTDGNSLVMLGTLLNADNVAGTASVTDASITQAVLANTQVTVGKNRLIIGAENATTADYIAVSNGFGAAQLQFEGEGKPSVEIGNGQALTLTGALGGALIHVAGSPATAVDVAVNNGTLNLGSTAVENVTAHLNGNVSVAPEGSLNVVAGDHTITSGSSTAGVISSGTVTIHHDATLHSDVEMRDAGQLVVNGSLQASNLTASQEAEITVGDAAAAGSLVVDRMDLQGARLFIDPSWVDGGTLADASRVASGGTDINGRMTVGQNALLVLGGTATAPAEQRFAATGLKWGSDGITAALSIQAPQTLSATQGGLRVDGSLTRNATSRDATFNTAEFANRSLLMVDSQDMTQGKAALSAENGTLNVADSAALYVANAKANQTYVVAKGFSDVRIEGNGWQKNNLLLNKLLNATTQENHGEVTVSTRARAAQDVLPGIVTPHALDRLIATGENSITATHAGQRFLSVAIDAPEASVEQVVKTVNSAAQMAFAGGVQSSTLAVGSSAVDAIFDRNSVSSTARLSVEPDASVWVQTLYGNQRSRDLSAGSLQYGHDTDFYGLMLGADKAYETAHGVMRSGAAFHAGNGNVDSRGDFNATHNDFSFWGVSLYQNWRQKSLSVTGEISLTQSSNDLYQKQPGWMNIGDTLKANIDSRLFSAGLRGEYLIETNAVDIIPHAGVRYNQLTTQSFETKNKQGENVFHTDKGTQNIWQFPVGVKMNKTFALDSGWNMTPQADIAVIAVAGDKSAENTLHTVGIQSRDVISADIMDDTSFNGQAGMKFQKGNMTFGVGYSINASRHDTGQTVSASYKLAF

SEQ ID NO: 6625 - protein, 797 aa, Citrobacter koseri
MKFTPRCVPLWFGLCTLPALALAPQALAEQQRQAYAFAQPSQPLAQALNAFSRVTGQSVVYTLELPQQQAPALNGTFSAEQALQQLLGNAGLAWRRLDARTLTLEPVDTSGALNLQATTINSQMDDYSYQPPASASIMRGQGSTLDIPQAINVVPAQVIRDQAPRNLDDALYNVSGITQGNNFGGTADTVMKRGFGDNRDGSIMRDGMPVVQGRALNASTERVEVLKGPASLLYGIQDPGGVINVVSKRPQLQQYNALTLRGSTYGSGKNGSGGGFDSTGALGDSPFAYRLIVDHEDEDYWRNYGVHRESLVAPSLAWYGEDTQVVLAYEHREFLSPFDRGTAISNRTNHPLDIPATRRLDEPFNDMEGRSDLYRLEVDHQLADDWKLHVGYSFNRETYDASQVRVTGVNDARGTLTRSIDGTHGAMSRDQFATFSLNGSVQLAGMQHDLLVGVDHEDRKVYRADLIRQASRSTFSYLDPVYGREVEGSTVRASDSDQTDKLRTDALFFQDALHLDEHWILVAGARLQQYDQYAGRGRPFSANTDTRDRAWVPHAGVVYKVDEQLSFYGSYSESFKPNSSIAPLTGGLVLDASVAPEEGKSWELGAKLDMPGRLSGTLALFDITKRNVLVSNFDTNTGETLYSNAGEVSSRGVELDLAGQLSERWSLIGAYAFTDAEVTKDPDLKGNRLQNVARHSGSLSAVYDYGSLFGGDRLRMGAGARYVGERAGNPTNDFELPAYTVADAFASYETKLDEHKVRLQLNVKNLFDKVYYSSAVNRYFVAIGDARQVSLSSTFEF

SEQ ID NO: 6626 - protein, 212 aa, Citrobacter koseri
MKKLTVAALAVATLLSGSAFAHEAGEFFMRAGSATVRPTEGAGGTLGSLGGFSVTNNTQLGLTFTYMATDNIGVELLAATPFRHKIGTRATGDIATVHHLPPTLMAQWYFGDASSKFRPYVGAGINYTTFFDNGFNDHGKEAGLSDLSLKDSWGAAGQVGVDYLINRDWLVNMSVWYMDIDTTANYKLGGAQQHDSVRLDPWVFMFSAGYRF

SEQ ID NO: 6627 - protein, 1064 aa, Citrobacter koseri
MLLLISCHLNILAQGKIITGVILDKTGETVIGASVLVKGTTNGTITDVDGNFTLNNVQENAVLQVSFVGYKTQDIALKGQSNVKVTLEEDTEVLDEVVVIGYGSVKKSTLTGAVAKMDTKGIQDRPLARPETALQGQLAGVTVRTTTGEPGADMQIRVRGAASVNANSDPLYVVDGVPMTTLSGINPADIASIEVLKDAASAAIYGSRGSNGVVIVTTQKGKTGKPKVSFNASVGFQTLEKKIDLLSATEWMEFRTRWNDAYYLSEAQKKGITNASIRDDNATRLANVGVKVGTDNAYLYILDDRWFNYLSQDMRDSHTYTPTSESLSLLDWQDEVYRTAIVQDYSLNVSGATDNVSYLFSGGYMNQEGLATGTGYKRFSFRANVESKINKYLSIGMNLAPTYIVTDGSGRANGKDSQAHKTLSSAPVSEPGVGYMTYVQPNGRYGWADTTSSPSYILNTDISQNRTLRMVGNAFLRITPFQDFRVELSAAANYYDLDGNKYSFSSSGKGWAKGEGQSSSGSHSTSRIWNTLLQAVANYDHTFNKHGVSAMLGFSSEQSSLGYKTEQGFKAPFPNDAITGSFDGSKVAAGTNTVTEQTPNKLLSTFGRLQYNYDERYMLSGSLRFDGGSVFGVNNKWGVFPAISGGWIISNEKFFKNWDQKWWNTLKIRASYGVTGNNSISNTAAYATLTSSVYGGAAGYYTSSLGNADLGWEKTHSTDIAVDLGFLNNRIQLSLDWYTKNTTDLLYQVPVEGASGFSTIWDNLGDIHNEGFEIELNTHNLTGNFKWDTSFNMSYNKNEVKKLGTDNTPIYSGFSGSNYSNILTVGKAVNTYYMYDAIGVWKNQAEIDAYSAAHNGQPVTFEGKQIQPGDIRYRDVNNDGKYDKDNDRDYLGSPTPKFVFGMTNRFSYKNFDLSILLTAQTGGKIYGILGRAIDRPSMGAKSNIMGHWRDAWWSEDEPGNGSVPYILSQTTGTTLDSRWLYSSNYLRIKNLTLGYKLPINPKFISYARVYLSIENLAKWDSYYGGYSPEAANVGSGPGGASALGLDYGGYPNARTFTFGINVNF

SEQ ID NO: 6628 - protein, 384 aa, Citrobacter koseri
MKRKVLALVIPALLAAGAAHAAEIYNKDGNKLDLYGKVDGLHYFSSDSKKDGDQTYLRFGFKGETQINDMLTGYGQWEYNVQANNTETSSDQAWTRLAFAGIKVGDYGSFDYGRNYGVLYDVEGWTDMLPEFGGDSYTYADNFMAGRANGVATYRNSDFFGLVEGLNFALQYQGKNEGQNAQDINVGTNNRSSDSDVRFDNGDGFGLSTSYDFGMGISAAAAYTSSDRTGDQQHYTHTERYAKGDKADAWTAGLKYDANDIYLATMYSETRNMTPYGSTSSTNGGGIANKTQNFEVTAQYQFDFGLRPAISYLQSKGKDLYNNGRYADKDLVKYMDVGATYYFNRNMSTYVDYKINLLDGNDKFYEDNGISTDNIVALGLVYQF

SEQ ID NO: 6629 - protein, 701 aa, Citrobacter koseri
MKIISVRQRLYPALLLPLTFSPVLQAASASNEQTMIVTATPQTVSELDTPAAVSVIEGEDMRLATPRVNLSETLTSVPGLQVQNRQNYAQDLQISIRGFGSRSAFGVRGIRLYVDGIPATMPDGQGQISNIDINSIQDVEVLRGPFSALYGNASGGVINVTTETGIEASSYYGSYGSWRYGLKATGAMGDGTQPGDVDYTVSTTRFTTHGYRDHSGARKNLANAKLGVRLDDVSKLSLIFNSVDIKADDPGGLTESEWKADPQQAPRAEQYNTRKTIKQTQAGLRYERQLSAQDDISVMAYAGERETTQYQSIPLVAQLKPAQAGGVITLQRHYQGIDSRWTHRGELGVPVTFTGGLNYENMSENRKGYNNFRLNNGPPEFGHKGDLRRDERNLMWNVDPYLQTQWQLTQKLSLDAGVRYSSVWFDSNDHYIAPGNGDDSGDASYHHWLPAGSLKYALTDAWNLYLAAGRGFETPTINELSYRADGQSGFNFDLKPSTNDTVEVGSKTRIGNGLLTAALFQTDTDDEIVVASSMGGRTTYKNAGKTRRQGAELALDQRFAGDWRVKASWTWLDATYRSNVCQGQNCDGNRMPGIARNMGFASLGFIPDEGWYAGTDVRYMGDIMANDENTAKAPSYTVVGLNTGYKFNYSQLTVDIFGRVDNLFDKEYIGSVIVNESNGRYYEPAPGRNYGVGINLAWQFE

SEQ ID NO: 6630 - protein, 614 aa, Citrobacter koseri
MIKKATLLTVFSVTAFSAWAQDTSPDTLVVTANRFQQPRSAVLAPVTIVTRQDIERWQSTSVNDVLRRLPGVDIAQSGGAGQNSSIFIRGTNSSHVLVLIDGVRLNLAGVSGSADLSQFPVSLVQRIEYIRGPRSAIYGSDAIGGVVNIITTRDNPGTELTAGWGSNSYQNYDISTQQQLGENTRATLIGDYEYTKGFDVVAKGGTGMQAQPDRDGFLSKTLYGALEHTFSDRWSGFVRGYGYDNRTDYDAYYSPGSPLIDTRKLYSQSWDAGLRFNGERIQSQLVSSYSHSKDYNYDPHYGRYDTSATLDEMKQYNVQWTNSVVVGHGNVGAGVDWQKQTTTPGTGYVPEGYDQRNTGVYLTGLQQLGDFTLEAAARSDDNSQFGRHGTWQTSAGWEFIEGYRFIASYGTSYKAPNLGQLYGYYGNPNLNPEKSKQWEGAFEGLTAGVSWRISGYRNDINDMIDYDDHLQKYYNEGKARIKGIEATANFDTGPLTHTVSYDYVDARNAITDTPLPRRSKQMAKYQLDWDVYDFDWGVTYQYLGSRYDSDYSAYPYRTVKMGGVSLWDLTVAYPVTSHLTVRGKIANLFDKDYETVYGYQTAGREYTLSGSYTF

SEQ ID NO: 6631 - protein, 970 aa, Citrobacter koseri
MPFFGILKLSLFREGATLFFICFVPATLAFGQPSPGNVSGHVSHSGSASRESGNSVVYGTVSSSRKNTPLPNVPVVLQHLETGTVLSLRTTLQGAYIFTNLIPGHYRISVGGGRYSLQTKAGMLGPGTVGRIDFVVTVLSRGSANVTGHVFTGKRGHQTPLSTKILFKNLRKNEIYTVRSDPEGKYSLNQVPDGTYVVQILERGYAPFLKEIQVHGHTTQNFHLINRRIASAEINAVGNSTVRDSTGAITVVGRKNFADNPSTGLGYVLEQTPSVQYYSRSGANGLTGGMNYFMCRGYTDGGDNTAPSSGSNVEFSVEGVPMNNNKDGGLVYDLNLMNTDIQSVDIQRGVTTSQQLGNYASGCAVDIHLVQPSKDPGIQLTSGYGSYGLQYDSFATNTGLSRTYNTAAYNNFTFLNMNGFQEFTSFQEFQDYANLTKYLSNGDVKLLFTGAYKNYDRGSSMSLTDFNTFGPTYNGLPNSENATYPSGVNTPDSPYYHNWISQRYMVSVQSENQITPSISVKNNAFALLDPESVVQVPVVSTGTTPIPGGNGATFNNLVPDYSGSAGSQYGNPFNFSYIAGEGYKVGDIVKSDIKLWSRDTLHLGFRLSYAEALYENQPLLTPNVALDYEQDAENEFLTVGGYLEDHWRPTDQLLLSAGFREMAVSEQYVEQLSGASLNDITSLGGKEGGVTAGENFAVFLPHIGINYYPSEHWKIYASGGQSYSAPAVQFWSGLTSGELPLTIHPEIIDDYQVGSRYETPKGFVALDLYSDYITNMFTTSLVTLPSGATNILPTQAGAANNQGVETEFRYVIGHGFSVDGNYALIHAYYLSAVYGAGTAQEFSNTGDLLPLVPNQLANLDLNYTGGPWHITINERYTGQMNVIDTSGGPSGTCNCQMDAPGFFVTNLLVSYDLPKTALYKKATLFFDAYNLLNTNYYEPAFLTPGAGNVDALFVYPGEPINVFGGVTLTF

SEQ ID NO: 6632 - protein, 1013 aa, Citrobacter koseri
MKRQRQKLFRVVLAGVLMIFSFMVYAQERIVTGKVYDSSGESIIGASVMVQGTMQGVVTDIDGAFQLKVQPSQSLVISFLGYQDVILPVGSKNNFKIILEEDSKKLDEVVVVGYATQKKVNLTGSVASVSAKDIQDIPVANTTTLLQGRLPGLVLTQNGAQAGNDNPEIRIRGIGTFGNNNPMVLIDGVEGSISQIAEIPSADIESISVLKDAASAAIYGVRAANGVILITTKRGQASSKVKVSYSGSYTLQTPGIVPDYVDGYNWALMKNEVSTGTFSPEALQKLQDGSDPDHYANTNWLDAVLRNASMHQHHLSVSGGNENTRFMTSVAYSNQDGIMMKTGVERFSFRSNIDTRYKRFTFGLNLSGNKNNVTTPAVAPSGEGGIMRYVSWFTRPTVPVMYSNGHYGYVDGSSLSAELMKNPVESMSLGHRSNEYWRFNGKVFAGIDLWDGLKFQTSFAYAFDLNATKSYSPKSPARYDAEGNIRKAAGETNKEEDYWYRNATWTSENLLTYNKQFDKHNVNVLLGHSVIGSRFYKTTASIQGFPTENIYELDGGTINPGAKGNSEEYKLQSFFGRVNYGYDDRYLFEFNIRHDGSSRMPKANRYATFPSVSGGWVFSNEELMKDYKNFSLGKLRLSWGKLGNQEIGNYAYAATLGASGNYFFDQGGDKQAGMVQTSVPNEDIKWETTRSINVALDLGFFNNRIQTTFEWFDKKTSDILMQLAMPGIFLGSLNAPYQNVGAVRNRGWEWNVNYSDSKGDWVWNVGFNLSHVKNEILEMGGLEETISGQTINRIGNPIGAYFGYKAIGMYRTEADLQRTNSKGEVIKQNGVAPKLGDIMYADLNDDGNITADDRDIIGNPFPKYSYSFNLGASWKNFDLSTFWQGVGGIYRYSWETSTDIRGNLTERWLDRYSAGNVNASMPALGNTMNDSYSSFWLENSSYLRLKNLEFGYTFRQPGLVKMGVSSVRVYFAGSNLLTFTSLKNWDPEKTSGDARNDVHPNMRTYSFGLNIQF

SEQ ID NO: 6633 - protein, 358 aa, Citrobacter koseri
MDDNEAQKMKKTAIAIAVALAGFATVAQAAPKDNTWYTGAKLGWSQFHDTGFIDNNGPTHENQLGAGAFGGYQVNPYVGFEMGYDWLGRMPYKGDNINGAYKAQGVQLTAKLGYPITDDLDVYTRLGGMVWRADTKANVPGGASFKDHDTGVSPVFAGGVEYAITPEIATRLEYQWTNNIGDAHTIGTRPDNGLLSLGVSYRFGQGEAAPVVAPAPAPAPEVQTKHFTLKSDVLFNFNKATLKPEGQAALDQLYSQLSNLDPKDGSVVVLGYTDRIGSDAYNQGLSERRAQSVVDYLISKGIPSDKISARGMGESNPVTGNTCDNVKQRAALIDCLAPDRRVEIEVKGIKDVVTQPQA

SEQ ID NO: 6634 - protein, 374 aa, Citrobacter koseri
MMKRNILAVVIPALLAAGAANAAEIYNKDGNKLDLYGKVDGLHYFSKDKGNDGDQTYVRFGFKGETQITDQLTGYGQWEYNVQSNHAESQGTEGTKTRLGFAGLKFADYGSFDYGRNYGVLYDVEGWTDMLPEFGGDTYTYSDNFMTGRTNGVATYRNNNFFGLVDGLNFALQYQGKNQNDGRDVKKQNGDGWGISSTYDIGEGVSFGAAYASSNRTDDQKLRSNERGDKADAWTVGAKYDANNVYLAAMYAETRNMTPFGGGNFTNTCAATENCGGFASKTQNFEVTAQYQFDFGLRPEVSYLQSKGKNLNVPGVGSDQDLVKYVSVGTTYYFNKNMSTYVDYKINLLDDNDFTKATGIATDDIVGVGLVYQF

SEQ ID NO: 6635 - protein, 171 aa, Citrobacter koseri
MKKIACLSALAAVLAFTAGTSVAATSTVTGGYAQSDAQGQMNKMGGFNLKYRYEEDNSPLGVIGSFTYTEKSRTASSGDYNKNQYYGITAGPAYRINDWASIYGVVGVGYGKFQTTEYPTYKHDTSDYGFSYGAGLQFNPMENVALDFSYEQSRIRSVDVGTWIAGVGYRF

SEQ ID NO: 6636 - protein, 194 aa, Citrobacter koseri
MNKPSKFALALAFAAVTASGVASAQTVDNWRNPYGNVWKNGTNELCWRDAFWTPATGIPGCDGVPVAQQPKEKPAPMAAKVVFNADTFFDFDKSTLKPEGRQLLDQVAQQARAIDLETIIAVGNTDSIGTEAYNMKLSERRAASVKAYLVSKGIDPNRIYTEGKGKLNPIASNKTAEGRARNRRVEIEIVGSRK

SEQ ID NO: 6637 - protein, 396 aa, Citrobacter koseri
MQSKINLNGNVSVSAGKALQGQGASGQPITEEATQKNIVPGALIPNMYFVAPINDKFAVGAAMNVNFGLKSQYKSNYEAGVFGGTTELNSINLNLSGSYRISKGLSIGVGLNAVYAKAKIERRAGILDKGVNKLASLPKLKKIFSPLASMVDANSPIVQLQDNNAWGLGWNIGAVYEFNQGNRIGIAYHSKVDINFKDSDALRYRLAGSGSIEPYRNRGKLTLHLPDYLEISGFHQLTEKFAMHYSYKYTKWSRLQSLHAVYDNGQVAFHKDENFDDSSRVALGATYNVNDKLTLRAGIAYDESAEHPSASIPDTDRTWYSLGATYHFTPNLSVDVGFAHLRGKKRQFKEGYEIGNTVSYPGNRGQVTNVQLAVVSADYQSTARANLYGLNLSYRF

SEQ ID NO: 6638 - protein, 467 aa, Citrobacter koseri
MRTFSGKRSTLALAIAAVTAMSGWVVVPQASAAGFIDDSTLTGGIYYWQRERDRKDVTDGDKYKTNLSHSTWNANLDFQSGYAADMFGLDIAAFTAIEMAENGDSGHPNEIAFSSRNKAYDEDYSGDKSGISLYKAAAKFKYGPAWARAGYIQPTGQTLLAPHWSFMPGTYQGAEAGANFDYGTAGALSFSYMWTNEYKAPWHIEMDDFYQNDKKTKVDYLHSVGAKYDFKNDLVLEAAFGQAQGYIDQYFAKASYKFDVAGAPLSTSYQFYGTRDKVSNGGVNDIYDGTAWLQALTFGYKVADVLDLRLEGTWVKADGQQGYFLQRMTPTYASSNGRLDIWWDNRSDFNANGEKAVFFGAMYDMKNWDMPGWAFGASYVYAWDAKPGRMSSPDAYYDPDYRLKESAYSLDALYTVQEGRAKGTLFKLHFTQYDNHSDIPSWSGGYGNIFQDERDVKFMVIAPFTIF

SEQ ID NO: 6639 - protein, 700 aa, Citrobacter koseri
MIVAGRAWSQFTLGDVLLLRDFLEMRRAVEVGTAARFGATLLGGVMLLAWFESPAQSQTSQGANSLPPVTVDAPTQQTIHRTPSKRDASRVRSTSRRVTAPGALQAEAVAAQSQPSRSGVVPAFAGGQVAQGARLGLLGNTGTMKSPFNVTSYTDKFIRDQQAATGADALILDPSVRSSHPTGGVLDSFYIRGFPVNEGNNGEFAFEGLYGIAPTYRIFTDYVERIEVLKGPSAALSGIAPNGGVGGVINVVPKRAGEDLTRFTVDYGSAARFGGHWDVARRYGDSKEWGVRASGSLRDGDTPIDRQSETTGVGSLALDYQGERYRSWLYLIAQTDRFDAPSRPFLMAAGVPVPKAPDGRLNVTQPWEWSRINDQSVLWRNEYDVTDQVTLFADVGGSRTNVERFFGLPTITNTRGDTTSTPQFFGLSIDRHTYDGGVRARFDTGFVRHAVTFQASVYHDELYRRLTNGTLVTSNIYSPTVAPTQFANEIAGRPRLSDSQLTGLSIADTLSVLDERVLLTLGVRRQGVEANNYVSNVGTLANSYDKSATTPVVGLVVRPRDNVSLYANYIEGLSKGDIAPQQTGVSNGGEILPPYIAKQYEAGVKVDFGRVATTFSAFEISKASGETLAGRFGATAETQVRGLEFNVFGELRPDVRVLGGVSLLDGTLTKSAITSRVGNTPIGVPNVQANVGAEWDLPWA

SEQ ID NO: 6640 - protein, 738 aa, Citrobacter koseri
MNNKGFKLSLLTLAMTGALSSASVWAQDNAKQEEQQASDKLERIEVTARRTNESLQEVPVAVSAFGEQELERDGIEDITELQYKMPNTTFQVSRGTNSTLTAYIRGIGQQDPLWGFEPGVGIYIDDVYVARPQGAVLEVLDVQRVEVLRGPQGTLYGKNTIGGAMKYVTRDLTGYDEFEIKGTIGTYNQTDLKVSGQTALSNNFYVGGAFATLNRDGYGEFVNLGADNYNKELMTGRFNARWLAAKNVDVKFAADWTQDDSNARGGHRLMPSLLSDEPYLDDVFDSYTAMPIDNSVETEGYSLTVDWDVNAQWGFKSITAYREGSTDTNIDFDSTVNPVLLVPAYYDDDQTTQEFQLTYSDGRLDFIGGLYLYDGTACGVFGTVLGLLDLTIDNGGCVDTTSEAVFGQASYQLDEQWSVTVGGRYTRDEKDADVYRYTYAGVKFLDRGDYSADPIVVNSDFNTKEDWSKFSPHASVSYQMTPELMWYASYSNGFKSGGVDMRADVSLNPDAANPYDPEIVDTFEVGVKSEWLDSRLRLNGAVFYSDYQDMQVTVQRAVETGGVASQVLNAADSTVQGFELEGTFAATETLNFTGSLGYIDAEFDEVAFFNPQTQQVEDVSNTWSFANTPKLTANLGFTKEFILDSGSLIWSTSVSYRDDTQIFEVPSPLDEEAYSLANTSLVWYSTSGQWNVGLHAKNVFDKEYRLAGYNFGSTFGENIVTGYYGDPRTVSLSVGYRF

SEQ ID NO: 6641 - protein, 762 aa, Citrobacter koseri
MIFKKLFSSEEGHIFSGNRKMDKAATSSFRVRHLLFSVLAIGMAQGHAWAEENLPTIKVNAAPADTQAADCTVVGKDEVKSKSIATSDTAGLLKNTPGVNLQSGGGVSSLPTIHGLADDRLRIKVDGMDLVSACANHMNPPLSYIDPSNVGSATVFAGISPVSMGGDSIGGTILVKSESPEFAKPGEGTLLKGQIGAFYRSNGNVVGGSASATAATETASVRYNGSTVKAKNYKAAAAFKPAGLAAVDRGWLAGDEVGSSMYEATNHALAVDVLNGDNMIDLKLGLQDIPKQGWTNQRMDMTGNKSIQANLGVTSEFDWGNLESRVYFENTKHSMQFGQDKQFLYGGVARGMPMDTEGKNLGASLKANIDLSSADLLRVGAEYQQYRLDDWWNPSGGAMMAPNVFWNINGGKRDRMAVYSEWESQISSSWLSQLGLRFERVDMNTGAVQGYNTMMAFQGAESAAFNATNRKKVDNNIDATALVRFTPDENKTIEFGYAMKTRSPNLYERYTWSTAGMMMRMVNMAGDGNGYVGNLNLKPETSHTISATVDLHDAGKKQWGVKVSPYYTYISDHVDAARCSSANANCGAANQTATNSFVYLQFVNQSAHLYGVDLSGDLLVSDNSYGSVTAKGLMNYVRGKNKVTRENLYNIMPLNGHMILEHALGGWSSSVDVEMVAAKKKVSKVRNEMVTGGYTLVNLHSTYQWKQVRLDVGVSNLLDRFYNHPLGGAYLGQGATMGTAVPWGIAVPGMGRSIFAGVTIDL

SEQ ID NO: 6642 - protein, 854 aa, Citrobacter koseri
MPVTVIRIDDLTRQGITQIEQALAWVTANQSHMGIGNAVGAVTGGKAEVDLRGLNAPFATSANKTLVLLNGRRLVNHPFDGAAVDLYALPMAAVDRIEILRDGASAIYGSDAIGGVVNVILKREQRYSQISVDTQGSEQGGGAVRRFSLVGGAGVPDADGFHVQGALDVRRQNRLAARDRPFASTGVLRGNSVDWTSGTSFPGDLDGFEPSLPTCDKSPSLPNDDASACRYDIVSDLDAIPANEQRTALLRAELKLLDEWSLGAEYLWARNQETSLIAAAPAYHCMRAGSAFFPLEAPTQLVPELCSGAEGVPMVPGGLVDWREVPAGKRKRQNTSIANRALLELKGALGQNWDLRSAVGRSQGRSTERVLAGYVDDASMQLAVWNGLVNPFGPQTAEGQAAIDAAQIVGPVQIGRSRSDFADLQLRGELAHLDAGPLALVIGLEHRDERSSFDTLDVTASLPSLGLDPSGDASGSRRVDAIYGEIGWPVTRALEMTVAARLDHYSDFGSTLNPKLAMRLQATPEILFRGSVGSGFRAPNLYDIHRPQSFGFTFGSYDDPRYCPGGEAVDGANAGAVCAQQFNVRVAGPAADGRSLDSLRPEKSKNLSLGILVEPVRSLSVGLDLWTIRVRNLIGGLPEQAVFDDPAKYAARYVRCSQLEAGGGTTVSREQLDTCLNTSIDPIAYIDLPTENLGTLQTSGLDVSMAWQDVQQAWGRISIGLDGTYVHSYRYQRERNGSHIEAAGRYADNAPIFRWQHAFAVNWSLDAWSVTLAQRFKSGYADQAPENHVSSYALHDLMAQWSGIRGLTLSAGLRNLFDRDPPQTLQLSLFQAGYDPRFTDPLGRVLALRAAYRF

SEQ ID NO: 6643 - protein, 312 aa, Citrobacter koseri
MLPRIRHNNFIGAVELFVKSSYTKTHSNNFFNNIHHAFKKKDWISNYDSLLTLREFFRCATQIDKSGYQVLSSKNETVHAMDKFLISFSLKDNGAEYTMTLRGSGFEYEEIPITINEYNSFMDFKNREFPLEQNRRLYAWDILQKKQSDIPKRIKGYIHQAIGDVSLGYALLEDIVSKLKRGKFELQIPGGGIKECDGWYIYEKIIDDNFAIVIESLGFALKIYGGDERFRNGSSVVLEDEDYSLIYNFLVNAGCQQVELAEQVDAIVSANLAADSDITKEKICEKYKSTIEAFKKEQLALPVLVRRKNSET

SEQ ID NO: 6644 - protein, 294 aa, Citrobacter koseri
MKKTLLAAGAVLALSSSFTVNAAENDKPQYLSDWWHQSVNVVGSYHTRFGPQLRNDTYLEYEAFAKKDWFDFYGYADAPVFFGGNTDAKGIWNHGSPLFMEIEPRFSIDKLTNTDLSFGPFKEWYFANNYIYDMGRNKDGRQSTWYMGLGTDIDTGLPMSLSMNVYAKYQWQNYCAANENEWDGYRFKVKYFVPITDLWGGQLSYIGFTNFDWGSDLGDEDFTDLNGNKARTNNSIASSHILALNYDHWHYSVVARYWHNGGQWNDDAELNFGKGNFNVRSTGWGGYLVVGYNF

SEQ ID NO: 6645 - protein, 962 aa, Citrobacter koseri
MHSWKKKLVVSQLALACTLAITSQANAATYNTFGYHDDAATIYNWGDSTKIDHDYLTYGGYVYDHAADGYFDTTFSGDTVNGVISTYYLNHDYGTDTGNTLNISNSIVHGMVTSYQVGYGDYVWTNGSDYTGHDWVDGDIFTLNIANSTIDDDFDAFYFTDTYLDADGKTSKTDYDRLVTAGLGTAVTLDVESNINISNNSHVAGITLVQHDLGNATYNTEGHQWDNNIVVNDSTVTSGSWTEDEQSDRGHFGNSVEPSDYGNGASPADDVALAFIDDDTSDYRMVNNVTFNNSQLLGDVVFDSTWNANFDATGHLIDNSTTAYTHGGWATDDQNVDHLNLTLNNTKWVGSANIDYDVVVADEAFYDVAPNSLNPYASYSEDGWNRVDNANAFQSGVFDVVLNNGSDWETTKTSLIDTLAINSGSQVNVSADSSLTSDTITLNGGSSMEVNGEVNTDHLTIDTFSTVNFGEDTASAWAYAPLYANTITVTNGGVLDVNTNMNDISSVFATDTLELTSGNVKDNNGNVYAGVFDIHSNDYILNADLVNDRTNDTSKANYGYGVIAMNSDGHLTVNGNNDINNGDEVDNSSADNVVAATGNYKVRIDNSTGAGAIADYAGKQLIYIDDTKTNATFSAANKADLGAYTYQAEQRGNTVVLQQMELTDYANMALSIPSANTNIWNLEQDTVGTRLTNSRHGLADNGGAWVSYFGGNFNGDNGTINYDQDVNGIMVGVDTKVDGNNAKWIVGAAAGFAKGDMNDRSGQVDQDSQTAYIYSSAHFANNVFVDGSLSYSHFNNDLSATMSNGTYVDGSTNSDAWGFGLKAGYDFKLGDAGYVTPYGSVSGLFQSGDDYQLSNDMKVDGQSYDSMRYELGVDAGYTFTYSEDQALTPYFKLAYVYDDSNNDNDVNGDSIDNGTEGSAVRVGLGTQFSFTKNFSAYTDANYLGGGDVDQDWSANVGVKYTW

SEQ ID NO: 6646 - protein, 1082 aa, Citrobacter koseri
MKGRAKSFISSLFCFGLGIIPVMADAGANHTGNTLQVTQQAKRSLSGTVTDAATGEPLIGVSILVKGTQGGTITDTNGNFSLPVNNGDILEVSYIGYKKESIVVKGQQTLNIAMQTDSEILEEVVVVGYGSQKKVNLTGSVATVDFNDKTLSRPVTTVSSALSGMAAGLNVMQTTSKPNSESSSVLIRGNGTLNDSSPLILVDGMEMPLNEINPNDIATISVLKDAASCAIYGNRGANGVILVTTKRGSDGKINVTYSGKFSYNTPANLIHMVANYANYMELMNEASINSGQTQIFNGSTIKKWREADKNPNGLSESGYPNYVAYPNTDWYDEVYNPKLMQEHSITVSGAEKRTTYSLSATFLNNPGLVENAGMKKYYVRSDIESRITDFLTVGMRAWGYHTDQERNDVDNLNGLQMQKSIPGIYPRYDGKYGVPEATEEDPSASNPVYFINNAEGYYKQTKFFVNPYVKVNFLKHFTASYNFYYDHFRNEHKWNSSDYREQFSFQAGEVKNAPPTSDALQEYHVALWYDGDQSWKSSTVLNYSQMFGKKHDVSAMIGYEEYRKWRSTTDIDKKGMVDTSLTDFDALTDPRYIKGSTTEFASRSVFGRATYAYDSRYLLEANMRYDGSSRFAPESRWGLFPSFSAGWRLSEERFVKKLGWFDNLKLRASWGQLGNNSIGNYEWQAVYAATQYVFGNKKVSGLGMSSFSNYDLEWETTSITDFGLDFSVLNSRLTGTIDYYNKVTDGILYNPTLSPTLSYFGSPRQNIAEVTNRGFEVTLGWQDHIKDFTYGVSANFSFNKNEVSKYKGKLVREWKQDANGKWTYHTNLGEVSTGGNERIVEGHMINEYYVLNLYKGTGNSFNTDGTVNPVGGPTDGMIRTEEDMKWLKAMMTAGYQFYPKQGVGKDKIWYGDIIYDDLDGDGVYGDDDDRAFQGYSRTPKYYFGLQMNAAWKGFDLSMNWSGAAGFKINWYEKAQNSSIVTYGYGIGREVAYDHYFYDPENPDDPRTNLTSKTPRLTTDQAGQVSTASAWHLHNGNYLKLKNLTIGYTFPKTWVKKAYMQNVRLYASGENLFTITKFKGMEP

SEQ ID NO: 6647 - protein, 353 aa, Citrobacter koseri
MKMKKSTLALVVMGIVASASVQAAEIYNKDGNKLDVYGKVKAMHYMSDNASKDGDQSYIRFGFKGETQINDQLTGYGRWEAEFAGNKAESDTAQQKTRLAFAGLKYKDLGSFDYGRNLGALYDVEAWTDMFPEFGGDSSAQTDNFMTKRASGLATYRNTDFFGVIDGLNLTLQYQGKNENRDVKKQNGDGFGTSLTYDFGGSDFAISGAYTNSDRTNEQNLQSRGTGKRAEAWATGLKYDANNIYLATFYSETRKMTPITGGFANKTQNFEAVAQYQFDFGLRPSLGYVLSKGKDIEGIGDEDLVNYIDVGATYYFNKNMSAFVDYKINQLDSDNKLNINNDDTVAVGMTYQF

SEQ ID NO: 6648 - protein, 516 aa, Citrobacter koseri
MIKKSRTLFLSLALCASISYAEDDGGFFTVGYQLGQVMQDVQNPGGTKRDELAQALNSDVTNNINGNNTGGNVVGALSNAFSQYLYSLLGAYPKGISSNSSDVAANTLFQSAVGNGTCAAAGTTSDSYIRTQEECTAAGYYWLPSLSDKIFSTIATSFGTTATITNGTDTTFPNMQQQLAYLNAGNAFFDTVNNVLGSSSTSTTNDGYSAGAIAYLKGQQSILNGAAYSLKEDELLLEAFNSAIAANIGNKEFNSEVFTGLVQGVIDQSQKVLNQLYGNTINVANAIANGISNQDTISNLSNRVNQLPSALLNVRETLNKISTLNDQVKSMPYLPQFRAGNSRATNIMNGFYTKVGYKQFFGTRRNLGVRYYGFFSYNGASVGFQSTLNSVGIFNYGVGTDILYNIFSRSYVNRSVDMGFFGGIQLAGESINSTLKDDINVKKFGKVTSTHFQFLFDFGMRMNFGKLGEKTKRHNQHTIEFGVVVPTIYSTYYKSAGTTVKYFRPYSVYWSYGYSF

SEQ ID NO: 6649 - protein, 760 aa, Citrobacter koseri
MKSSRHHNHRHASLASAVAIALLASSTVAQAQQLVLEEVIVTAQKRSESIQDIPSAVNVIDGDTLKDFNALKFEDLEALTAGLQITSLSGRSGRMSLRGISHTPVSAAEAAVTTYWNDAIVDSNAIYQQMFDIQRMEVLRGPQGTLAGRTSPAGAINIHTARPNMDEIEGEIRGTFTDNNGVNTQLAASFPLIPGKLALRVAAVYDDSDSDEIENDLTGEVSGDETSAGRFSLSWLPTDSLTVNLAVQYLEREIDNIQVVDGVPSGIPPLDPDGVLRELDTFDRRDARVGIDGVSDNTDADFLNTSLVLEWGLDSHTVTWVTGYHETDSILTYDASRGNANPLLVRRIDAIDDRTDWSQELRIASDGNDTWDYMVGAYYENSEILFSQENHIPDISPLAPGSTQLLFPAEGDRWGVFTHNQFYLTEEWTLQVGLRYQENDLDRDMSLAAGRNGIGPAPPGFVIEQVLSEDNQQYEDDSVTGQITLKYALGDDVNLYGLVGTGWRPGGVTVTGTLLPEDVLLFDSEDSTSYELGFKSTLMGGAMRLNGAVFFQVFDDYISRVGAINVREPNGDITRTGITTNGDAEVWGAELEMNANLSENWYIGGALSYAKGEYDDGTTNPCNVFDDRGAAIIPPGQSTALCDVGGEPIGRAADWSASINSEYSMSFGSFDGYGRVLYAYTGEQYTPDLGDLDTYHTLDAFLGIRTEKWNVELFASNLFDEEAIVTGSANTAPVANRPTGYATRYPIPSRRIGLSASYRW

SEQ ID NO: 6650 - protein, 726 aa, Citrobacter koseri
MDSFIAVKDDNTMKLNKISLAVLCAISLSQQAIAADTVPDENTKKENIETIEVKGSYIAGYNAHSASGASRLDLAITDIPQSVSVITDAQLQDFQLHDINAALDTATGVNVERIETDRTYYTARGFDITNFQIDGIGLPLTSGNNHADEDTAIYDRIEVIRGANGLMTGVGNPSATINFIRKRPTADNQLTVNGTYGSFNNTRLEADGTVRINDTFAARAVAVTQSKDSYLDRYQTDKNVFYVFLEANLSDDTSLSLSHSYMNNDATGNNWGALPLYYTDGSATNYDRSTNTSADWSNWQVVKNNTVLELSHHFNDDWRLRATYSHKTTDEDTELFYVFGTPDKDTELGLTGYGSEYDLDDKHDLIDMYVDGNFSLFGRDHQIVAGVNYSKMSYTDSSLYDYTTGNGFPKMPDLNTWDGNTPKPTFKDSLRGSDVSREQQAAYFTGRFNIVDDLHVIVGGRYNDWQAEGVSYEVDQEADYQKFIPYLGAVYRFMPELVAYASYTETFVQQDEVDIDNRFLDPITGESREIGLKSELFNGRLIASLAYFDVVQTNIAVLDPATEGLPIDLQKYYGSDGISSTGYEIDIAGEIYSGLNVSIGYTDFDIEGDDIVAAYTPSKLFKLAATYDFEAIEGFSVGMNMRWQDDISRNQGVVAVGFDNAGADIVTKQDAYTVIDLMAKYQITENLGLAVNANNVGDEKYINSLYWAQGYYGAPANYSATLTWKM

SEQ ID NO: 6651 - protein, 703 aa, Citrobacter koseri
MARLFLLSTLALTTTGLVSFQPALAKEAYQGQPKTEREGDKKLLRKQKEEIKKQNLEKGQDKKQEVKASDPDADALAVASNDQPSLVVTASRTPEKADQVSSQVTILDKAAIDHSQGMAISDILVRTPGVTVARNGGYGTATSVFIRGAESGQTMMVIDGVRMTDASSTNNGYDFGTLMTGDTSRIEVLRGSQSILWGSQAIGGVVNIVTAMPTKPLGGSVDLEMGSHSTINARAAIGGKSDRITWRLAGNNFYTKGISAISPRYGGHEQDGYHNRSATGRVNIKLIDEVSVDLRGYYSKAMTDLDSSYGTPDTSDYENKEQWMGYAGLNVALFDNRLRNRFGYSYTQTKRNDISPSMEPYNTDTFVGNGHTRRFEYQGSLALVKNWDLVFGYENERSGIKSSSPAYGGSDTRGTININSVYGQIKGKIIKGFSVDGGVRYDHHSKFGGNVLFSGGGVWAFNNDNTLFRAHYGEGFNAPSLYQIYSEYGNQNLKPEKSHGWDAGFQQRFFHKHLTIAADYFQRTSNNLIAYLSCPYYGALPSICYVPNTNTPRYGYYDNINRSTAHGVEVNASLDIKRVSLSGNYTWTSVKDRSEGVDYGYQLPRRPKNTANGSADYHWKFGLVTGIAVRWASKSWDTVHSEYSLNPHMNRGYTLYDLRVEMPVSKHLTVFGRVENLTDKYYETAYRYGTLGRTFYGGIRARL

SEQ ID NO: 6652 - protein, 200 aa, Citrobacter koseri
MHPYLTKQTEVGVKYDFGTFIATAAVFEFEKQNTIVVPDGSSGPGRLAIDGKQRHRGVEISFFGEPYEGVRLLGGVTYSDARMIATQGGTLDGTFVTGVSRWQGNLGAEWDTPFLDGLTFTGRMIATGSQYASTNNTLRMPGWTRFDVGARYTTTALGNPLTIRGGIENVLGTKYWSQVSGSIFSLGAPRIFKLSATIDF

SEQ ID NO: 6653 - protein, 439 aa, Citrobacter koseri
MKIKMFFLTTAFITQSTYASELPVIPLRDLVNAALTHQPSVAVSYYETEKKNSDLDLSRAALYPTLDLTSGLNNNRKESSGTERNVENKVSLSYRITDFGVRGANIRKSEYERDNSKTDYEKTKNIVSQEVVTTYYNISKYREMIDGVNLEKEFYKKMLEPFSLLVSSGVAMQSDMRKVQVSIDALNTRSIMYQSMLDDEMYKMQNMTGLNLSPVQIQSDEKFNLFKKYIFVESPEKLMDMVMKYNDDYKMLVNTRKAATEDINAAKSSYFPTVDLVSSYVQNNPSGSAKKSDYEDEFKTGINVSFNIFNGFRNSAQERKMVASYSQAKLQIDDFLIKTRYNIDSQLSRYAAAKETYSVAERSHTNALQLTELYEQEFQLGQKSLLDLISSRNEAFQAYVSMIDSKYSLYILKLQQLSLIFHLMDYLKGNTESELNVMK

SEQ ID NO: 6654 - protein, 1094 aa, Citrobacter koseri
MMKSNSFRLPSKATAVLLLCTGLVASHPLALWAEDGVTTVQAVQQQQVIVKGTVSDAMGPVIGANVIEKGNRGNGTITDIDGNFSLKVKPGATLEIHYIGYKTVEVKAVPGKPLNVTLTEDSEMLDEVVVVGYGTMRRKDVTGSVVQIRPTAMQNEAPKTVQDVLRGAPGLKVGLDTSAKGGGSLEIRGDRSLSSLTDGSPMIILDNMPFYGELSEINPEDIGQIDVLKDASAAAVYGARAANGVVIITTKKGKMGKPVINFSAKVGFVTKANYKEVYDGDGYMKYREDWYKTATYGMNPETGRYEAYQTGTIKPGYYDRPDRLPADVSIEDWRNYSVNAEGQSDLGIYADRVLTQTDQLIRDNFLAGRTYDWYNSAYQTGINQDYNASVSGAGEKMNYYMSVGYLRNEGVIRGTEYQAIRANMKLTTNITDWLEVSGNVNFQSRSDGDLALNEGSTLANSPFANYCDADGNLAVHPMGEKNTYNMGYNYDFNHQYEQLEKGYYVLNSIFTAKLKLPFNINYSFNASPRLQWFYDRWFQSSEHPDWDAVSHGANRNTASKFDWSINNTLSWDHTFVKKHHVMLTLVQEAEKHQSWSEGIAARNFQPTDVLGFHYVNTAGKLESSFSSSDSYRTAVGLLGRLFYSYDDRYMITASIRRDAYSAFGEKEPWATFPSVALAWTFTNEKFFKWEPMSMGKLRLSWGLNGNRAINDPYLALATLDIGAKMFGYLDASGNLKEMEYLKIGRMANPNLKWEKSEAYNVGLDFGFQNNRITGSLEGYVIKTKDMIMGRTLPPFTGFNDIATNLGEVQNKGVELIINSQNMATKNFEWNTSFSFAYMDNKVKHLYGEYEDVLDANGNIVGSKEKDEYGKWWIGRPIAAIWDYRVTGIWQPDEIEEAKKVGQLPGDPKVANNYTEDDIINSDGSRTPVYNDKDKEFLGQTTSPYILSMRNNFTILKNIDFSFNLYSCIGSKMKDTSYLNQVNASEIDYGLNQSIKEYWTPEHQSNTYARLNSKGPTGVNSPARYIDRSFIRLENISIGYTFPKSIVSRWGLSNLKVYGTIRNAALWTMSHWKLNDIETGGLAPRTYSLGINVTL

SEQ ID NO: 6655 - protein, 215 aa, Citrobacter koseri
MLRLQGIPGKRRKEMRKLILSLFLVGLICAVPPVHASQGNALGFGDAAIKIDWFRFTDNGLADMDLENGVYVGLEVYYVIGCISPNLYFGAEIGWAGTSTSVDPYSLDLNVDYVPVEFNLKYVFDITPCVKFDLGAGISANWFGFEADFGNVSYSSDDWLFGGQFFADVNYRLAPNWFVGANIKYQITQDIELDGVNTHTSADNFRLGAQVGYTF

SEQ ID NO: 6656 - protein, 782 aa, Citrobacter koseri
MAFHGGEIGLKQRGFLIHWSHLSVITLPCLAMEAHAQTAIVDNGLELPVVHVQAASNRPVLAGTIPDTPETAYEVSNKAINILSPGGSANAFRAVSILPSVYAPAIDPYGLANIPGSNKGIRIRGEASSHGNSISTVEGIPLGGVNPGPGFQWLFPTENVDSMQVYQGPIAPDKGSFFTTAGAINTQLRWGEDKPGAEITQGFGSFNFFRTFARVDSGALFNGTTHAFASGSWTDAENWRGPGKAANGNTTASFGLSTKITDQFDARLYFSYANMQQNTYRPLNYMQTQNLGLYRFYDYSANPNAGIAYFNNNRQSFEDWVILSELTYHFNENTQLTVKPYYFSEKGAYYDGMANGMVRNWLLDHDSYGLTSEISTRLLETDMKLGYWWTTMQLPGPPNAWKMYMPNAYGGLNFNMWSILAQATTRNEFQSAYAMMDKKIGPLHLQAGARYMWENIPGINAFNTMGVSDTSYNAAIGMAPGINGMRSVSSHVFGAFLPYMAASYDLTPNLQANMSVGANYGAPSFDIFPAYQQNAATFQAKGISADQLWSTLKAETSTNIDVGLRWTYESPDIGTALLEPRFYYAKYANKGVSFDPGIGVAYSQNVADTHAIGGQLMAHWLPRPELDLFASVGYTRNVFDANLPTLPGASAATIMAAAVKGTQFPDVPNWTMAAGLNWSTRDPWLGDGQLTISPIINYISDRWGDTTRTQHLSGYATVDLNIGYDYQTPIGLFNASLTVTNLFDTSYIGYLNTSYYQQAMGTNAYYYPGAPRAFLGRLALKI

SEQ ID NO: 6657 - protein, 778 aa, Citrobacter koseri
MKKEFLTLALFLGVANAAEIEKIIIKGNKYIPDELIRGLLSVRKGSEFSLERIRKDIRKLYRTGLFTKVEAYEEDQNKNGKPEVILVVEDLPVIYKIEFEGNEEFSDDDLKEYLGIETELGEVEVEETIEGYTSSPAIEERLAVMKQLKLGRILTFQEIESLRRRIEEVYKRHGFVGTKVEYKLIPKKGASKLVFVIHEGKKIYTSDIEIEGNKHFSDRKLKGLMELKEPNIFLFRLHPAFSEETLKEDVKKIEEFYKNEGFLEVEVSYEVKEEGPARKVIVKVKEGPRYKLKEIKIEGNTLFAYSELVDNILKKNERKGRYFRREVIEKIKNRIREKYAEIGFLNTSVEERVNVNPEKKEVSVLLKIIEGKPVYVKKIKIKGNYETRDYVIRREMRVQENELALKKGIERSKTRIMNLGYYEDVQIEPVPRRDAWWDLLVKIRERFTGQFSVGLSYNEVTGLAGFIELRKGNFRGTGDIAGISVSYGSLYRNNAISYTRKWFLKKPVDLDLSAFDRRIEYDTYTVERTGFSVALSKELSEYWRASIGTSIQRVKYSDIDPEASTYVKEQAGRRDSRKIFFTLTRDTRDYYLLPTKGSLFVFRNSVGVGLLGGDEKFYKFEVEGAKYFSDTYFDTGIILSLKGEVGFVEGYGGKKVPIDERFFVGGDFSIRGYEYGYAGPVDPNTLDPIGAKKKVITSLELMYPVFKKMLYFAGFFDYGLGADKWSDFKLSNFRGGYGIGVRIITPFAPIRIDWAFKTKTVPGDTNRSRIHFVLGTFF

SEQ ID NO: 6658 - protein, 87 aa, Citrobacter koseri
MATLTYANKGLLVGLTGRYDSGKRRFGSNVFVPSWATLDLAVEIPITSFFTLTGNVFNLTDTQFEFLDGNPAPGTTFRVGGRFEIGG

SEQ ID NO: 6659 - protein, 232 aa, Citrobacter koseri
MIIKKCAGCQALSLLASVVTSFLFLNTAYAWQQEYIADTQPGHTTERYTWDSDHQPDYNDILSQRIQSSQNALGLAVNLAEESPTDATSSISMGWNFPLYEQVTTGPVAALHYDGTTTSMYNEFGDSNATLTDPLLHASVSTLGWRVDSRFGDLRPWAQISYHQQFGENIWKSQSGLSRITATNQNGNWLDVTVGADMLLNQNIAAYAALSQAENSATNSDYLYTMGVSARF

SEQ ID NO: 6660 - protein, 1637 aa, Candidatus Rickettsia hoogstraalii
MAQKPNFLKKLISAGLVTASTATIVAGFAGSAMGAANRNINAHVNLNAVGMPGIVTGDSLTYVVQAGGPFIATADGGNDNVGNPTVLFGSMNMLQSGVFAVNGAADMAIGSVSGTAGQLLTLNIIAGNTLTLNGAPGVAALPVNTYTNLGPVNFTDANSVFKVNLAANGADGTKTAVFGNTATFNSIVPGGKGHINIDDGNIAIFNGTIGNTNGIQGFILGANAQVTLNANAKLDGTVGADGIVLGNDAVLNVADRVNITGITAANNINICGVAANNGTVNFLGDSTVSTDIGNKNSVAAVNVAGTLIFQGGNNGNGSNFAAQAINLTSADSFIKFTTQDHQVAGNILNTSGTNNQGGFSVNGGDVTVAGNVGANGNSLATINFETDNTLVVHKADTNAIFVQNVDTATANTGILKLQGANFAINGNIGGNNALKIVNLEDNDNGAATNFTLKQGSKINAQNIYLSSAFDNSLTLEEGTTVTGNIINKLAAGNGTIALTGNAAINGNIGVDAAIGGNVGNAIKNINLAGNNLSYGGSSILLVNNPANAITFGANETLTLTNTTDAALQIKANLAITTDKQGILDASSLTNAQTLTISGNIGTIVPGANKTLGQLKVGSSKTILNAGDVAINELDIGNNGSVQLGHNTYLITKTINAAGQGKIIVAGDPANPTTTLSAGTNLGSAANALAEINFAVPVAQNDSILEFGKGVNLYATNITTAVADTGSFSFTAGGINIVSGIVGGQQGNKFNTVELDNGTTAQFLGSAIFNGKSTIDGNSTLQIGSNYTASFIKSADNTGIVEFVNADNITVTLQTQAAAVDALKQITVSGPGNVVFNETGNLAEHGINTTKIAFENASLGTRLFLPSKIPFDGLTITSTVGNGLVGDFSVPAVIVSDIDSKIVPGQVIGDQNNIVGLGLASDDTITVDDITLNAGLFTVHDGQGTIELNGGIPNTPGTIYGLGIKPEGEAALKLKLVTVATDYKNLGSTFVNNLIVNDGLTYQAGGVVGKDFDGTITLGSANGNSNVIFADGTNSTSTSTVATVKANNGVVTYLGSAFVGNIGCSNTPVASVQFTGPVGSLEKLQGNIYSTATNFGNVNLNVAASNVILGGGTTAINGNIDLATNILTFASGTSTWGDNTSLSTTLTLASGNIGHIVIAEGVQVNATTTGTTTINVQDSANANFSGTQTYTLIQGGARFSGTLGDPKFNVTGSNIFVRYGLIRADNKDYVLTRTNDVANVVTKAIGNSQFAGIGQNVLTFVNSNTAAYNNLLLAKNTTDAANFVGAITTDTSAVVTNAQLDVAKDIQAQLSNRLGALRYLGTYDSSKMAGAECGLVSTPQSPVTAGEEAIDNVAYGIWAKPFYTDAHQSKKGGLAGYKAKTTGVVIGLDTLANDNLMIGAALGITKTDIKHQDYKKGDKTDINGFSFSLYSAQQLVKNFFAQGSAIFSLNHVKNKSQRYFFDANGNMSKQIAAGHYDNMTFGGNLIVGYDYNAMEGVLVTPMAGLSYLKSSDENYKETGTTVANKQVNSKFSDRTDLILGVRVMGNTMNFSDLAVYPEAHAFVVHKVNGRLSKTQSQLDGQVTPFISQSDSSAKTSYNLGLSASIRPDSKMEYGIGYDAQIASKYTAHQGTLKVRVNF

SEQ ID NO: 6661 - protein, 147 aa, Candidatus Rickettsia hoogstraalii
FTKVDGVTYKKDNSDYSPLKASFLAGGGAFGYKMDDIRVDVEGVYSYLNKNNVTDARFTPDTIADSVTAISGLVNVYYDIAMEDMPITPYVGVGVGAAYISTPLKDAVNDQKSKFGFAGQVKAGVSYDVTPEVKLYAGARYFGSYGA

SEQ ID NO: 6662 - protein, 273 aa, Helicobacter pylori
MEFMKKFVALGLLSAVLSSSLLAEGDGVYIGTNYQLGQARLNSNIYNTGDCTGSVVGCPPGLTANKHNPGGTNINWHSKYANGALNGFGLNVGYKKFFQFKSLDMTSKWFGFRVYGLFDYGHATLGKQVYAPNKIQLDMVSWGVGSDLLADIIDKDNASFGIFGGVAIGGNTWKSSAANYWKEQIIEAKGPDVCTPTYCNPNAPYSTKTSTVAFQVWLNFGVRANIYKHNGVEFGVRVPLLINKFLSAGPNATNLYYHLKRDYSLYLGYNYTF

SEQ ID NO: 6663 - protein, 854 aa, Helicobacter pylori
MVKQPVSNPIIAMQGRVPGLFINQSAGYAGANVSVVIRGQNSINPLPGSSSPLYIVDGVPFGSDPVERSIGGFSPSFNFSPLNTINPADIESIDVLKDADATAIYGSRGANGVILITTKKGSSNGTDFTVDFSQGFGAASNLVEMLGTKEYLDIRRQAFANDNITPTAANAPDLTVWDQNAYTNFPKLLIGNTAHQTNAGVSVSGGNMYTQFTLGGTYRRESTVYHSATDDKATQLRLSVQHKSVDSKFSTAASISYNTDNNRIPSYNLNLTNYGLPPNYPLYTGDGNLYWGPGYDNPLAAFNSSISLKSSNLNATAVMRYSILPGLDIKANGGYNLIDVKGMIISPSRASNPAYNSPSLVTMNNNYIRTYLAEPQLTYQLSAGKSNLKLIAGGTWQRTETVQPYWLLGTYTNEKLVSSLGATNVLAKASDYADFRYTSVFSRAEYNWNEKYLISANIRRDGSSKFGANYRFGTFGSAAMGWIFSKEDFVSENLPWLSFGKLRASYGTIGNDKIRDYSYQSNYQAGATYGPLVTLGPDRIANPYLKWEQTKKFDLALDLGFLRDKILFTAIYYRNRTTDLLGEVPLPGQTGKDFYTANLDAIVQNQGLELELNTVNMDNGKFKWISSFNLTIPENKLVSYPGLMISTYNNRYVVGESLNLRTVFQSGGIVDGIATVVDVNGDGVITNGVNANGKGDFIVYGSNDPKYYGGLNNTFTYKGFQLDVFLQGTNRTATRGDLNFGAYPGTGYNLPKSMVNTGLLYSSTTSSDAGSKYYYFANSDASVESAAYVRLRNVSLAYNVPVTFSKKIGISSLQIYARGQNLLTFTGYKGIDPETLTNQVPPLKMFTAGFRTTF

SEQ ID NO: 6664 - protein, 821 aa, Sphingomonas sp. LB126
VNNQVGGYALAGSSANFEFKAGVDTKNGTATFNNDISLGRFVNLKVDAHTANFKGIDTGNGGFNTLDFSGVTDKVNINKLITASTNVAVKNFNINELVVKTNGISVGEYTHFSEDIGSQSRINTVRLETGTRSIFSGGVKFKSGEKLVIDEFYYSPWNYFDARNIKNVEITKKFASSTPENPWGTSNLMFNNLTLGQNAVMDYSQFSNLTIQGDFINNQGTINYLVRGGKVATLSVGNAAAMMFNNDIDSATGFYKPLIKINSAQDLIKNTEHVLVKAKIIGYGNVSTGTKSISNVNLEEQFKERLALYNNNNRMDTCVVRNENDIKACGMAIGNQSMVNNPDNYKYLIGKAWRNIGISKTANGSKISVYYLGNSTPTENGGNTTNLPTNTTNNARSANYALVKNAPFAHSATPNLVAINQHDFGTIESVFELANRSKDIDTLYTHSGAKGRDLLQTLLIDSHDAGYARQMIDNTSTGEITKQLNAATDALNNVASLEHKTSGLQTLSLSNAMILNSRLVNLSRKHTNHINSFAQRLQALKGQRFASLESAAEVLYQFAPKYEKPTNVWANAIGGASLNSGSNASLYGTSAGADAYLNGEVEAIVGGFGSYGYSSFSNQANSLNSGANNANFGVYSRFFANQHEFDFEAQGALGSDQSSLNFKSALLQDLNQSYNYLAYSATARASYGYDFAFFRNALVLKPSVGVSYNHLGSTNFKSNSQSQVALKNGASSQHLFNANANVEARYYYGDTSYFYLHAGVLQEFAHFGSNDVASLNTFKINAARSPLSTYARAMMGGELRLAKEVFLNLGVVYLHNLISNA

SEQ ID NO: 6665 - protein, 328 aa, Campylobacter lari
MKKIIGLVSLASVLFAFDASKIEITPTFNYTTPEGNLDLKNYGGVGLRFGYHYDDLWIDQAELGLEYYDNAKYNNPNDNTHTDTSVSRFYVNAIKGIDLANHVYLYGLLGTGYEYLSHGAYKNKSGMFAQYGAGFKFALGEDLALRLEARDQIKFNNGEHNLISSVGLSFYFGNKAPKTPQTTTKQIEEKPQTKQIDKSCPEPRKGALLDHIGCEKTIALEGHFGFDQTSINPEFAQKIQEVGKVLEENPQYYTILEGHTDSTGSKTYNQKLSLERAKAVAKELEKSGVAKEKIATKGYGFDKPKASNDTKEGRAQNRRVEAKFFIKE

SEQ ID NO: 6666 - protein, 328 aa, Campylobacter lari
MKKIIGLVGLASVLFAFDASKIEISPTFNYTTPEGNLDLKNYGGVGLRFGYHYDDLWIDQAELGLEYYDNAKYNNPNDNTHTDTSVSRFYVNAIKGIDLANHVYLYGLLGTGYEYLSHGAYENKSGMFAQYGAGFKFALGEDLALRLEARDQIKFNNGEHNLISSVGLSFYFGNKAPKTPQTTTKQIEEKPQTKQIDKSCPEPRKGALLDHIGCEKTIALEGYFGFDQISINPEFAQKIQEVGKVLEENPQYYTILEGHTDSTGSKTYNQKLSLERAKAVAKELEKSGVVKEKIATKGYGFDKPKASNDTKEGRAQNRRVEAKFFIKE

SEQ ID NO: 6667 - protein, 328 aa, Campylobacter lari
MKKIIGLVSLASVLFAFDASKIEITPTFNYTTPEGNLDLKNYGGVGLRFGYHYDDLWIDQAELGLEYYDNAKYNNPNDNTHTDTSVSRFYVNAIKGIDLANHVYLYGLLGTGYEYLSHGAYENKSGMFAQYGAGFKFALGEDLALRLEARDQIKFNNGEHNLISSVGLSFYFGNKAPKTPQTTTKQIEEKPQAKQIDKSCPEPRKGALLDHIGCEKTIALEGYFGFDQISINPEFAQKIQEVGKVLEENPQYYTILEGHTDSTGSKVYNQKLSLERAKAVAKELEKSGVAKEKIAAKGYGFDKPKASNDTKEGRAQNRRVEAKFFIKE

SEQ ID NO: 6668 - protein, 214 aa, Campylobacter lari
MKKIIAVLFVGMLISTSAFANEFGFGFKLGATQKKTNIDKFKDSIQPYMRSTDLTENNFVYGLEGFYEYSLNNDASIGVKLGFEGISKDELEGVSLSNLKYDVEITSSVLPLTVYYKYNLNEKFNVWGGAGVSMVFAKLKDGMESYKENKVFPHINAGVEWRISQMMGLGFDARYSFSSKIDKWDGTTFYATASEKVMLDLDGINAGLTLRFYF

SEQ ID NO: 6669 - protein, 328 aa, Campylobacter lari
MKKIISLVSLASVLFAFDASKIEITPTFNYTTPEGNLDLKNYGGVGLRFGYHYDDLWIDQAELGLEYYDNAKYNNPNDNTHTNTSVSRFYVNAIKGIDLANHVYLYGLLGTGYEYLSHGAYENKSGMFAQYGAGFKFALGEDLALRLEARDQIKFNNGEHNLISSVGLSFYFGNKAPKTPNVETKQIEEKPQVKQIDKTCSEPRKGALLDHIGCEKTIALEGHFGFDQTNINPEFAQKIQEVGKILEENPQYYTILEGHTDSTGPKAYNQKLSLERANAVAKELEKTGVAKEKIVTKGYGFEKPKASNDTKEGRAQNRRVEAKFFIKE

SEQ ID NO: 6670 - protein, 660 aa, Campylobacter lari
MKKIISLSLIATAILGANETTTLKDINVVEKANSELIKDISNEELKSADLADALMKNSPNISIVRRNGIANDIILRGQKKDNINILIDGAKIYGACPNRMDPPTSHIVTNNIESVKIIEGPYDVENFGTLSGLVKVDTVEPKEGFNGEINLNAGSFGYKKASTTISGGNNFVKALISASTEKGEQYKDGNGDNFLQQQIKRGVPKVQQYKNKDLDGFEKKSVLSKLQFNLTDDQDLKLSYTANRSDGILYPAGPMDADYDDSDIYTLGYTIRELGSLSKQLDLDYYYSKVDHPMSTKERNFFLNSNAMMRNMYMTNQLKTSVWGTTVKNSLDVGDSLVTVGLDTSVRNWRGGMYSTNINTGVTTPSDTNRMYSTDTTNKAVFTKIEKSFGALDLEAGMRYDYTDVETQRPNVDDNKYSSLNGYVFGAYNIDDESKVFAGIGKSSRVPDARELYQQTTASNPNLEDTKNYEADLGFEKTIGSFFIKPKIFYSELKDYIYNSGSFENIDAKIYGLDVSGFYYLTEDLSFDYGVAYLKGKKDGKYTGNDKDLAEITPLKANFAVNYEYAKSKFKAEVIAVDRWDSYDASAKEQELAGYAVVNLKYTQALFKHFEVTLGVDNLFDKVYNSTNTYQDITYVEVAGDRVLFNDPGRYGYVNLKYSF

SEQ ID NO: 6671 - protein, 328 aa, Campylobacter lari
MKKIISLVSLASVLFAFDASKIEITPTFNYTTPEGNLDLKNYGGVGLRFGYHYDDLWIDQAELGLEYYDNAKYNNPNDNTHTDTSVSRFYVNAIKGIDLANHVYLYGLLGTGYEYLSHGAYENKSGMFAQYGAGFKFALGEDLALRLEARDQIKFNNGEHNLISSVGLSFYFGNKAPKTPNVETKQIEEKPQVKQIDKTCSEPRKGALLDHIGCEKTIALEGHFGFDQTNINPEFAQKIQEVGKILEENPQYYTILEGHTDSTGPKAYNQKLSLERANAVAKELEKTGVAKEKIVTKGYGFEKPKASNDTKEGRAQNRRVEAKFFIKE

SEQ ID NO: 6672 - protein, 328 aa, Campylobacter lari
MKKIISLVSLASFLFAFDASKIEITPTFNYTTPEGNLDLKNYGGVGLRFGYHYDDLWIDQAELGLEYYDNAKYNNPNDNTHTNTSVSRFYVNAIKGIDLANHVYLYGLLGTGYEYLSHGAYENKSGMFAQYGAGFKFALGEDLALRLEARDQIKFNNGEHNLISSVGLSFYFGNKAPKTPNVETKQIEEKPQVKQIDKTCSEPRKGALLDHIGCEKTIALEGHFGFDQTNINPEFAQKIQEVGKILEENPQYYTILEGHTDSTGPKAYNQKLSLERANAVAKELEKTGVAKEKIVTKGYGFEKPKASNDTKEGRAQNRRVEAKFFIKE

SEQ ID NO: 6673 - protein, 328 aa, Campylobacter lari
MKKIISLVSLASALFAFDTSKIEITPTFNYTTPEGNLDLKNYGGVGLRFGYHYDDLWIDQAELGLEYYDNAKYNSPNDNTHTDTSVSRFYVNAIKGIDLANHVYLYGLLGTGYEYLSHGAYENKSGMFAQYGAGFKFALGEDLALRLEARDQIKFNNGEHNLISSVGLSFYFGNKAPKTPQITTKQIEEKPQTIQIDKSCPEPRKGALLDHIGCEKTIALEGHFGFDQTDINPEFAQKIQEVGKVLEENPQYYTILEGHTDNIGPKAYNQKLSLERAKVVAKELEKTGVTKEKIATKGYGFDKPKASNDTKEGRAQNRRVEAKFFIKE

SEQ ID NO: 6674 - protein, 1102 aa, Candidatus Chloracidobacterium thermophilum
MNQIHKFFCNMTQCSQGGAGELPTVKEKTCKLSFSPFVVGASLLLGGPIAFATPLSGTQELHFSEDNYEKLLTPVDGLSPLGAGEDGMDAWYITSSNPSHASRTKLRINSDIMISAGHGGAGDNNDGNSCGGNGGDSITGSDLSIINQGMILGGSGGSGADHNGDGGEAVTGDNLFIINGEIISGGHGGDSYSDSDGGNGGDAVTGVNLPIINKGTISGGNGGNNYGEGDGGNGGDAITGSSLSVINKGTFAGGNGGAAYGYGYDGYGGNAITGDNLSVINNGAILGGNGGHWGDAINGSNMTIANSGYIISGKEDDGTQNVAGNAIHITGGNNSLILHEGSVITGDVQVNNSSILKIINNDYTGTTPTIEGDLCAGDCTTVSLSGNKFTVSGDVSFGENSSLNLAGISSLEASGNMSFGNNVKVEAIINNWAQKDYKLLSADKGITGFSVSNISIINPLLTTGAIDYTKSYISDQNKLIYGLSWNDTDGDSHGEFNLKENAELTVSTILADNLSHHNINSWDGKSLTKSGEGTLILAEKNTYSGFTNINAGILKMGTVEAMTRTAGVIVNKGATLNFSGMNQTVNTLLNSGTVLINNINAPFLPDPVIVTGNMTLEKNGHVILNNSSSNVGQTYVQKGNWHGKGGILSLGAVLGNDNSKTDRLEIAGHASGITYVAVTNEGGSGDKTLEGVQIISTDSSDKNAFIQKGRIVAGSYDYRLKQGTVSGLNTNKWYLTSQMDNQESKQMSNQESTQMSSRRASSQLVSSLNLGEGSIHTWRPEAGSYIANLIAMNTMFSPSLYDRHGSTIVDPTTGQLSETTMWIRTVGGHNEHNLADRQLKTTANRMVYQIGGDILKTNFTDHDGLHVGIMGAYGYQDSKTHNKYTSYSSRGTVSGYTAGLYSSWFQDEKERTGLYMDAWLQYSWFNNTVKGDGLTGEKYSSKGITGALEAGYIYPTIRWTAHNNIDNALYLNPQVQITRHGVKANDYIEHNGTMVTSSGGNNIQAKLGLRTSLISQSCIDKETLRKFEPFLEVNWKWSSKQYGVIMNGMSNHQIGNRNVIELKTGVGGRLADNLSIWGNVSQQLGNNSYRDTQGILGVKYTF

SEQ ID NO: 6675 - protein, 249 aa, Nematostella vectensis
MKKTLALLVLLAVTGVASTPVQAATHYISGMGGISRMNNMTPEESYQGAGGNSNSNFDLGSGVNALGAIGCDYGNYRLEGEVGYQQNTLKSGISNMDNVLQYYPQEGSRYDMRGDVSTLSLMGNGYYDVHLGGGVDFYATAGVGIAQVSFHDMNFSYNYDPVTNALYDNPNPGYNDHATTLAYQLGAGLAFPLSQNVKLDLRYRYFATTDFTYTNDWVDASSSSNTPVASGINSNIVSHSALLGLRVEF

SEQ ID NO: 6676 - protein, 754 aa, Nematostella vectensis
MPKESASMPSHAPLRRNLLALLVCASLPSLAVAETAPATDAQSATTLDSISVIGRGEARQVQRVTAEDMKVLPPGANPLKLLAAKPGVHFESADATGAYEWSTSISLRGFNQNRLGYTLDGIPLGNMAYGNSNGLHISRAVISENLGGAEVSTGIGALGTPSTSNLGGVFQFYSIDPSTEYGVVLAQSFGSDNARRSYARLDTGDHQGFAAYLSGVYSEGDKWKGKGSQELKQFNGKATYNFGTDSRITALSNASRRVEADYQDLSLEMIDRLGWDWDNYAPDWDRAVAAARGKYSGGVNSPWDAYYSGHGLRNDDVSSIAGDFGLNESMRLKVNVYNHSNRGQGHWFSPSNPSNPGTSREIPISIRTTEYAIDRTGVTSAFTWNVAGHELEAGLWYEDNGHSVQRNFYYIDGPITDDFFLRNPDQRVWHQRYTTITRQFYVQDRFRLFDDRLTIDIGAKSPHTRTRVRTPLGSYANNSSLTSKKGLLPQAGFNFKLNEGNEIFGSFAKNVAAYALGVGSPFNVPQAAFDASAKNLKPEQSRTIELGWRGYGQGYEASVAVYDVKFDNRLLAIAQCVGILGCPALFSNVGSVTSRGAEATLQLKPMQDLTWSNALSWNDSTYDNDYVNNGVVPTRGKKTVDTPEWMFASTLAWTPGPWDLRLAANHVGKRYVTYTNDVSVPSYWLVNASVAYDFGKLGPAQNLTVALNLTNLTDKRYLSSINTNGTYAADPTRSLATMQVGAPRQVMATATVHF

SEQ ID NO: 6677 - protein, 782 aa, Nematostella vectensis
MSVPSNRFLAIARLGVVSLPVLGVMAMPDEISAQTALPGIVVNAPSPIVHRARPHQARPARTVRRGTTTRPSAAPQPEVASAPTPPSPPPANLPGTLPIVTDQFATVTVVPSDEIRRNGAATLGDLLNNKPGITGSSFAPGASSRPIIRGLDVNRVGIVENGIGSNGASDLGEDHFVPIDPLSTNQVEVIRGPATLRYGSTAIGGVVSASNNRIPETSPCAPPLTTQTYGYAVKAPQLSTPPGCVNFETRGALSSVDNGREGGVLLDAGGGGFAIHADAFARRTEDYAIPGGVQKNTATDSNGGSVGGSYLFDGGFVGAAITQNNSLYHIPGKEGEEFGTRIDAHQTKFTAKGEYRPDAAAIDAIRFWLGATDYKHNELGLADAADLSSDGVRQTFTNKEQEGRMEVQLAPFNLRFAALTTAIGVQASHQELTAPGPSDPFSPLNGLWDPNSNGRLAGYIFNEFKFSDTTKAQVAGRIEHVNLNGSTPSVIPELFDLAADPGAIGVATPRALNFTPASASVGLIQNLPWNLVASLTGQYVERAPKPAELFSRGAHDATETFDIGSPNLGIETAKSVEAGLRRATGPLRFELTGYYTRFNGFIYRRLTGNTCDETACAAGPGLELNQAIYSQTDATFRGGEFQFQYDVLPIWNGLFGIEGQYDIVRATFTDGTNVPRIPPQRAGGGVYYHDANWLARVNLLHAFAQNDVSGVETTTPGYNRLRAEVSYTTTLPKNDWWGAQKVTVGLVGDNLLNEDIRNAVAYNKDQVLLPGLNVRLFANVKY

SEQ ID NO: 6678 - protein, 778 aa, Burkholderia pseudomallei
MFHQLAAPGARRRLAAACAAALAWPAAHAASTAAAVPADSTPAAAAEMTASGKTLDTVKVAAQRAAFAPDTPGVVEALTREQIDSHVNVTTEDALKYAPNLMVRRRYIGDRNSVFAGRDFNELQSARGLVYADGILLSNLLGSSYSYPPRWSLIQPDDIARVDVLYGPFSALYPGNAIGSTVQITTHKPQRLEASVSTQFFTQRYRDGYGFADSFGGNHQSARIADRVGRFWYALSLDRLENDSQPMQYASPNGAFDPRLGAPVPVTGAVSDIGPNGRPRTIVGAQTIERTEQLNETLRFGYAFTDHVDATVTLGHWENHYRQHGDTFLCDAAGNPVYGGNVSFGGRNHTVSPGAFAPQTGDQENWLYGLGLDARLASGWKLSATASAYEVSRDVLRSASGAPPGAWDGGPGTVFHGDGTGWRTVDLRAESPDVRGHRFSFGYHFDTYFLRNATYNTADWQNAVPTTLVNRYRGNTRTQALYAQDAWRVAPGWLATLGLRYERWDAYGGELGGATATLGYAERGATAFSPKLSLEWQPASAWRLRLSFATGTRFPTVAELFQGTISNNAIVNNNPNLQPEKAIDWDFTAERDVGFGVVRASVFQSDLRNSIYSQTTLAGASTYTNVSNVDRVRVRGVELAFSGQDVALKGLDVDANVSATNAQTLADAANPNYVGARWPRIPRMRANLLASYRFDEHWMTSVGVRYSGRQYNALDNSDVNPGVYGGTSSFMVVDLKARYRFDRHWLASFGIDNVTDRRYYVFHPYPGRTFYGELKWSL

SEQ ID NO: 6679 - protein, 990 aa, Burkholderia pseudomallei
MKSSATRSIAFRASSIGAIALALAGQSALAQDVAAGDAEQSGEIVVTGIRASLSKALDIKRTAQGVVDAISAEDIGKFPDTNLAESLQRITGVSIDRSNGEGSTVTVRGFGPEFNLVLLNGRQMPTSSLGDGASAPSSRSFDFANLASEGISGVEVYKSGRATLPTGGIGSTINIKTPRPLDRPGLSGSLAVRGVYDSSRNEGNPITPEVSGIVSDTFGDGVFGILVTGTWQKRKASVNQANVGWRDGYLGSENNWGSLPQEGDPRYGSITNRPGPNDVYQVQQNASYDLNDIDRERLNGQVVLQARPTDSLTATIDYTYSRNTVQVRNSNVGVWFNFNDVSSAWTDGPVAGPIFYSEKFGAGEGKDLSYSGSLTENRSENKSIGGNLQWKGPGGLRLELDGHHSTAESGANNPYGTSTSVGTAVFGIKQQTVNYENDLPVISVVMHDGIDPLNAANIQATGNAFRNAYFKDTINEVQFRGGYDFDNSILDSLDFGVTYVENKVRSAYGFIQNDTWGGSTTKEQLPDDLFTLESLPDKFKGVSGASDPAMIQSFYRFNFEKMVGFLDDLNGICGGDGDCRAPFTVDRRIRERTLAPYAQANLTFDLLENPAHFRAGIRYEKTKITSSALVPIPTGTQWVAANEFNLTYGSGSDFTTFKGEYENWLPAFDFDFEPIENVKVRASYSHTITRPDYASMQGGRTVDQLFRIGGGFGSQGNPGLLPFKSKNIDVSAEWYYAPASYLSVGFFDKRVRNFISSTRVDTEAFGLTNPADGPRYQAAVAALGPNASTTAIRNYIFANYPSSVVVDSYDPVTGNYTGKILGLPEDNKVNFQITTPINSDQAAHLYGFEFAVQHSFWDTGFGAILNYTVVKGDAKYDNSQPSSVPQFALTGLSDSANAVLFYDKNGLQARVAYNWRDKFLAGTGPNPYYVEAYGQVDASASYEFRKGYTVFVEAINLTGSSRRGHLRSTNNVFFSSPGYARYQAGFRFNF

SEQ ID NO: 6680 - protein, 147 aa, Burkholderia pseudomallei
ADHDMKKGDIAVVWDPNWTWWEIGGWHFAFVAEGHLSYWRYTGDRAINSSIWEVGATPIIRFIKSAGYVRPFVELGAGVRFLSHPTISQNYSMSTSFQFADMVGVGAQFGNHQQYQAGFRFQHVSNAGIKDPNPGINFSQLYVQYNF

SEQ ID NO: 6681 - protein, 373 aa, Burkholderia pseudomallei
MKQTIRLAAIAGGAALAFASQHAAAQSSVTLWGVADVSVRYLTNANANNDGLLSMTNGAITNSRFGIYGTEDLGGGLKALFNLESGVNLQNGAFADSGRLFNRAAYVGLQSPYGTVTLGRQRTPLFDLLADTYDPLTVGNYLENAWLPVALGGGLYADNQIKYTGKFAGLTAKAMYSTGTNYESTGPGGFSGQIPGSLGKGNAWGVSLSYVMGPLSIAAGAQQNSDNSARKQTIYHANVVYAFSKAKVYAGYLRSKDDTGFVDSLLAQQTIPVAKGTGRIDDGPFAGVSWQVSTPLTLTGAFYYDHMRNAMTANGTLASGNRYAIVGIAEYALSKRTEIYGTIDFNKTNGAANVELPGRSNQTGIAIGLRNIF

SEQ ID NO: 6682 - protein, 994 aa, Burkholderia pseudomallei
MTTLKAMLIVFLSFFVVNPSFANPKLQQNISIAYEDATLLDVLKDIKSKSKFNFFYDINEIDENKKVSINTENEAFENILDQISKQVNFDYTFNGNQVVLTAGITNAKIVTDAIQDREVTGMVVGPEGNPLPGANVIVKGTSVGAQTDFDGNFTVQVPEGSKFLVISYVGFKEEEVNVEGKSKVTVQLKPDAGQLDAVVVIGTRGKPRTSFDSPVAVDNFKIKELQKTGKTTVDQQLMLRVPSYNATEQPVSDAAAHFSPAGLRGLFPSRTLVLVNGKRKNASALVYSYVTPGRGEVGVDMKAIPSAALESVEVLRDGAAAQYGSDAIAGVINLVMKEDVDPFINTGYSSTTRGDGEQYQVESGFGIDLGPEGYANFTLSHMDSKATQRAGTITSVEDEAGYWGVTDDSAFNTSDLTSFLERNPSAGFQVGLPNMTITNFAYNLGFTLDKETNTEIYSFGTLTDREGSAPQFARVPYWVPGFEAIYPDQEFFLAKMAPQIRDHTFALGLKTTFNEWNFDVSSILGKNRIDYYIEDSFNQSFAGSSPSDFYNGAHEFSHVVNNLDINRTFYDAGLEALSVAFGLEHRTENFVTEEGEFASYGDGGSPDAQGGRTGSESFGGFSPENASNDYRSNIGFYTDITADFTESFLVSGALRYEDYSDFGSNVSWKLSSRYKLADDKLVIRGSVSSGFRAPSLHQVYYTATTTTLTTDGVQQNGILNNANPALRALGIPELDAETSFNLSGGFTYRFNRNSGITIDAYQIDVDDRIALSGQVTATGDPNSPIDRTLENVGVGSAGFFLNAIDTRTKGIDIVYSYSNIELGRGFLSGSIAANFNETEVQGTNFPAFIEDNNLGDAIFSREDISRVESWRPQEKVVATASYEIDKITANLSLMYYGSVTYRHPNDPINDATYGGKTLTDLSVNYAFTDNINFTLGVNNLFDVFPDTFAEAYASTGGTPQDRNLDFVGRFKYPWQTTQFGIDGTRIFSQLNISF

SEQ ID NO: 6683 - protein, 867 aa, Burkholderia pseudomallei
MSAAVVGAAVFGFAGIAAAQEAPASVDDIIVTAQKREQSLQDVPIVVTTLSQEVLDGAGVQDIKDLQILTPGMTVTSTQSEASTTVRIRGAGTVGDNPGLESSVGVVIDGVYRSRNSVGFGDLGELSRIEVLKGPQGTLFGKNTSAGVINIITERPSFDPSVSAELTAGNYGAMGGSVSATGPLSDIIAGRIFVAHRERDGFYDVNVGDGPRTLTEDNTQDYWTGRGQLLILPSDEVSIRLIADYTKRDEFCCSAVQTRVGPTQAFIAALAAPNGPGQRPPVAGFGTVPFSRTAYSNRETPQEIEDMGLSAEATIDLPSLNATLTSQTSWRDWSFQQGMDLDYTGADILHRENDGSNGYGVDNLTQEFRLAGATDKFDWLVGLFATKEGVYRDDSYSYGADYNGFASFLLTATLPAAVGGPSPSRLGCFTNPQGFLVTAAAPNTPLCVVGAVAPSAAAPTFAAGKAYEDHYSQRSESVALFTNNTWRVTEAFDLNLGLRYTYDSKRLLGVQDNLGSNGAACGGALANQNPANRAPSAIPGTVNVGTPAAAVGLLCLPWSNPLYDNRRIQEKFSDTDISGTFKGSYRFNDAVMAYASYARGYKGAGYNMDRVQTGVTPDASLFFDAETVDSYELGVKTTLFNRSMLLNLTYFDQKFENFQLNTFLGTAFVVESIPELTSRGVDADMVWFTPVEGLMFQGGVTYTDAKYNDFTAADLSNPARFPALSLLPGARASFAPEWSLTGALAFDRSLGGGLRGGFNLSAKYSTDYNTGSDLLPYKDQEAFTVVNGRITIGSEDERWTIDVWGQNLLQEEYTQVGFAAPLQGTAFTNTTTPQANGTYYNIATDTATYNAYLGAPRTWGVTLKVKY

SEQ ID NO: 6684 - protein, 737 aa, Burkholderia pseudomallei
MEWATSTRVRAIAAGVAFYAAAAGHAQAQAAQPGADARQPGGEAKADTAAGGTLPAISVSGVAERDASVGLVARRSMTGTKTDTPIIEIPQTINVVTAQQIEATGATDINQAFRYIPGFSSYGSDNRSDWYAALRGFTPTVFVDGLQVPNTINLSSWRVDPYMIDSIAVLRGPTSVLYGQGDPGAIVDVQSKLANGERIRELGVQVGNYARKQLMFDIGDTIGKDGTLSYRIVGVGRDGNAQTGPLADQRVSFAPSLKWQPNADTSLTLAATYLQDWGDTSSNFLPSRGTVLPNPNGTISDDLYTADANFDHYRKKQWSLGYQFEHKLNPVWTLRQNVRWMHLSLDDASVYGGGLDDADPTMATMTRYAGLFQFNYSRFDVDNQAQAKFTTGPLSHTLLFGFDYNRQTTTDSEWLAKGPSLNLYRPVYTPIPSDIFSGPNAYPRTDTKTTLNAFGLYVQDQIKWRRWVLTLGGRQDWTRTSQDDIANAASFRQNDHAFSGRVGLTYLGDYGLAPYLSYSTSFNPQIGLKLAGGGLATPTKGRQIEAGLRWQPPGKNLMLNAAVYQINQTNVAMSNPNDPTSSTFVQVGEVRSRGVELSAVGNLSRELSVIAAYVYQDVKNVRANDNTLNKWPVDVPRPRQIASLWADWTWRTGPLTGFGVGAGVRYMSAAAGAADNSLTVPSYTLFDAALHYELRNWRFALNATNLFNRRYVAGCQSDAVCMYGNQRTVIATAKYNW

SEQ ID NO: 6685 - protein, 685 aa, Burkholderia pseudomallei
MRTPFVRAALAALSGLPCIALAQGDASASSASFASSVSYAPAAASPADADSALSTAPAAAAASPASGAARGAEAVSADAASAVASGAPSASPARAASAAQLAPIVVTARRGPQRLADAIPQTTLFDARDIADSGATDLPGLLALAPGAQIVRNGGPGASASPFLRGAQPTQSLVLIDGVRVDSASLGQSQIAQLPLDQIERVEVVNGNVSSLYGSGAIGGVVQVFTKNGGNHPPRFDFSAGYGSYHTQTQSAGASGRLDPDGRTTFSVSLARLKTDGFSALDPARKPQANPNANGYLNESASASLRHTFSDKWNAGVTYFQANGRNSYDDAYGSPADLNDLYSRVQQLSAFANGALADGWTTRVSVSSGKDRNQSALNGAYTDHFNTDNRQYTWQNDFAIARGHKIQAGYERLDQSFESNKYSAPERHVNSGWLGYTGRIGDSRFQANVRRDQYSDFGGANSYYLGYGFDVTEHWTVSASYSSAFRAPSFNDLYYPNSGNLSIRPERSHSVEAAVQYASDDVGVVRVTAFQTRYTNLIDYRPGASGPYYVAQNVGRAKVQGVEGSWQGHVGGTDVRIAATLQNPVNETAGRDLNRRARRFASISANRSFGGWRVGGEWLASGARDDFGDRLGGYGIVNLSARYDITKSWYVSARIDNLFDKDYELAYAYNTPRRGAYVTLGWQQR

SEQ ID NO: 6686 - protein, 364 aa, Burkholderia pseudomallei
MEEMMKKALVAAALMAAGVVTAHAQSSVTLYGRLDAGLEYMNGLQDGHRFRAESGDWGTSLWGLKGSEDIGGGNKILFHLEGAFNTMNGGLGTSGSIWDRFATVGISNERYGTLLLGRELAIANGVWDFDPFGQSSWSTASLVRGRNWNKTSNNVSYQSPSVYGLDFYGQFSFSNSTSFNGNTTAGQPGRAAGAQITYTNSLFQLRGIYDETRDSNGRFSDVFNYSREYFAGVNVFLGQFKVQAAYQASRADGSGGPAANAGVTGTQQVWGGVTWQATPAAALIAAVYHVNANHGGGNANIYTVGGSYNISKRTLFDVQVATVRNSSTANFGLNANPAGTAVSTGNPHPGGSQTGVYAGIQHLF

SEQ ID NO: 6687 - protein, 404 aa, Burkholderia pseudomallei
MAVRHTKHGPFTNLTSNRHRHFTRVSPRCHPPCLAWPPSFTTKLATQGIKMKKLTVVALALTAAFQAHAVEVYKNDTTTLDLYGRIYAGQFFGDKKEGVDSTHPNGTQEYSDKQGANQFVRFGAKVDSQINSQLKALAQYEVQMYINDSEKTISENSDNLRTRLAFAGVGADWGNITFGRQKGAPGFLADWTDVSLSDGYGNDALGAKTDTFATNRAGSVLKYSGLFNGFQVDTSYKFDGGDTEETTSKDSDAAYGAAVAYTFPFNLALGTAYNVGIRDKNGEEDAKLWLLSAKYDNKAVYAALSYADGTDFLATGKDHTGWEGALGYNFENGFGLMALWNKQKVEQDGKADYDSIDYYTLGAQYKFNKNLRVIGEYRINNLDSKESGKLNVKDDFQLAARYDF

SEQ ID NO: 6688 - protein, 756 aa, Burkholderia pseudomallei
MSRAPHAPSRRRAFGRGFAAAARAAHGAPVAHGVHACFAAASRRSTAVERCVTALACAVTASGALAAEAEPADAARGPHRELPTVRVTSDGAHASPLSTPLAAGSRLKLASLDTPASVEAITSAQIAARGDRTIVDAVTRATGFSTAAAPGNGGTALSVRGFAGQESVTTLVDGVRLYPGAGTVTFPFSTWSAERIEVLRGPASVLYGEGAIGGVANVVTRRPRRERSTTLQAGIGTQGEKRVALDTTGALGPRLSYRFHLSDERARGFVERGDAHVTAVGGALKLDVDSRLSITLDYDYGRQKPATYFGVPATNGVLERALRERNYNVGDATIAYHDTWTRLAATYRAGNGVTLDAQLYYLATRRHWRNAESYALDPAARTVARSDYLEIFHRERQFGERFTARIDSRVFGRANRLVLGAEFNQIAFDGANNAPYRGESTVAAAGFDPGAFASPDPTLPRFRTRTHQAAALIENRLEVLPRLAWVSGLRYDHLSFHRDDLIAGGAFDKTFAHTGWRSGLVYEIAPGLAAYAQYTTGAQGVGSLVTLSASQANYTLATGRQWEAGIKHEIDGARAYWTLAVYDIVKRGLVSVDPLNPARAQQVGRQSSRGVELAGGVRLPGGVTVDANAALLRARYDAFDQRVGDTVVQRAGNVPHDIAQQSANLWIGWAFAPGWRANAGLRYVGPRYGDDANRVPVPSYTVFDASLAWRATRDVDLAFYARNLANRTYAASTSNGGAQWLLGPSRSAELVATLRF

SEQ ID NO: 6689 - protein, 399 aa, Burkholderia pseudomallei
MKKGAAAWLVAGSMCAGAHAQGTVTLYGIVDAGLGYTSEQRVAQTKGALGSPVGYRNESSYGFASGIWSGSRWGLKGKEELGGGLAAVFQLENGFNIGTGQAGQGGRMFGRQAWMGLSSERYGTLTMGRQYDPIVDFVGTIGAGAFLTGMGAHPGDLDNIDNQARENNSIKYVSPKFGGLALGALYGFGNQAGSVKNQNTWSVGGQYVNGPFSLGAAYLYATNAYGANGGAWTGSYDGTFASSINEGFASAKSMQIVAAASTYQIGAVTLGLSYSNTRYKSGAFSTFNGTATYNSIGGTVSWQATPELRVAAGYDFTRGSSIDGQSAPKYHQVNFASYYYLSKRTALYGLVDYQKASGKTLDAYGNVVAATASVGDVGNGISSAGDTQTLVRIGVRHTF

SEQ ID NO: 6690 - protein, 764 aa, Burkholderia pseudomallei
MARRPLRAALFGAFGLYAAAARAAGPASEPAAAAPPAAASAASTSQVRHAAIAAARKDAPALDPITVTATRTASAASRTAASVSVITDSDLEEQQADNIKDALRYEPGVTVRRTAYRPANAALGGGRDGDSSINIRGLEGNRVLLMEDGIRLPSAFSFGPLEAGRGDYADLDTLARIEILRGPASALYGSDGLTGAVNFITKDPSDLLSIHRKKTYFSFRPSYDSVDRSIGATVTAAGGNDRVQAMLIASGRRGHELDTHGDDNSASTRRTRANPQDVYTESLLGKLTITPTARDTIKLAAETVRRRIDTNVLSAINPPTTLGLTANDRLERNRFSIDYDLRDAAARGFQTAHVQFYYQESTQDQDAFETRGGRLQSRSRSNHYSERALGGSAFAESGFATGPLAHKLLYGVDGSIDRIKSLREGTVASPGESFPNKAFPDTDYSLFGAFVQDQIGFGKLLVTPGLRFDAYRLSPSSGDPLFTGKTVSSSDHELSPRVAMLYEASPALIPYAQYAHGFRTPTPDQVNNSFSNPIYGYTSIGNPNLKPETSDTLEAGLRGTLGTGYGPLRYSVAAFAGRYRNFISQRTVGGSGRPNDPLVFQYVNFANARIHGFEGRAEWVMPNGFTLKTAMAFTKGTTQDNGAASEPLDTVNPFSAVFGVRYEPSERWFAQADLLWQAGKRGRDVSSAACQKKTCFTPPSSFVVDLRGGYRFNKHVSAYLGIHNLFDRKYWNWSDVRGIAADSNVLDAYTAPGRSVAVSMKVDF

SEQ ID NO: 6691 - protein, 209 aa, Burkholderia pseudomallei
MAGGFANDRLYGAALQYQRGGLTVGASYPKMNRARSADAAGAVTGDNTFDASSQRNVGIGATYAFSKALIGFAYSHVDVYDPTSNAYFTGTTRPAGEHWQSWKFDHFEINGRYRVTPAFYAGAAYTYTQARADSTAGAFHPKWRPLSTKLDYDLSKRSSGFAEGVYQHAQHAMNARTGTGFDHAYIPGAANIASGPNRYVVRLALPHPF

SEQ ID NO: 6692 - protein, 719 aa, Burkholderia pseudomallei
MLIAAHPGAAALAGTAAKSGAQKNDMQRNENVREDTRRLAAGAPPAGGELKAISVSAPKDAADDPSVATVGKMPLALREIAQSVSVTTRERIEQQNLFSLDDVMQQSAGVTVQPYVLLTTAYFVRGFKVDSFEFDGVPVVLGDMASAPQDMSAYERAEILRGANGLLHGSGNPAATVNLVRKRPQHRFAASASASIGSWGRYRAQADIGGPLNPAGTVRGRLVAAYEDRGFFYDRAKQDTRSIYGIAEIDVARDTLVTVGAQYQSVASVPDMSGVPMARDGTSLGLPRSTFLDVGWGHFDWDTTRVFGSVERELGGGWKAKVSGEYQAVRSDLKYAGAYGAIDRATGAGGTLMGSAYQFSSYSRSVDANVQGPVRAFGLTHELLFGATYASSSSGQLTAPLLAGAGTPVNVYRWNPDGVPEPGVGPYRQDMQNDISQKGVYGLGRIKLAQPVTLVLGGRLSWWNQDSLGAHYNAGRQFTPYGGLIWDVARDWSWYASYAEVFQPQTKPTWDGGILTPVKGRTYETGIKGELAGGKLNVSLAAFRIDLDNNPRIDATRPCAGRSCYYVNGGSVRSQGFEFEANGRITPWWSVWASYTFDTIRYAKDVANGGAFAAELTPRHLLRVWTNYDLPWQERRWSVGGGVQVQSDFSAASSGVTMRQGGYALASVRLGYRYDRHWRAALNINNLFDRTYYQSLSQPGWNNRYGEPRNVMLTVRGQF

SEQ ID NO: 6693 - protein, 2001 aa, Burkholderia pseudomallei
MAGNQGRCAALCGNCRDDYWGRDQIGFYVYGKDSAIHNTGSGVMDVSTENSTLFRIASGATFQGTADASSALTASGKNSYALIATGKSDGGVASTVTSGGMTINLTGEGATATLIEGGAQGTIESNAIINMDNASAIAGIADGNGYDISGKLINPKDKTTLLTAGAQLSSTQDKVTGYIARNGATLNNTGNIIFTGKNTVGVRVEEGAVGTNSGNITVQDGGVGLIANATQDVTTINNSGNLVLKGGDNANRTTGIKASGTTTTVNMTAGTISLQGQGAIGVEASNKGTVNLDGSAVPNFAADGSGITDQIAFRIIGDGATIKTNIAPGTLLDASGERSVLFRIEDGAKQAGSLLMKTSGTGSRGIWATGKGSNVLADAGSDFQILGAQAQGLYVTGGATATLKQGASVNLVGDGAVVAEVDGNEYALDGSITQTNTGSVITNEADISSPLNNAKGFITRNQGLLINNGNIDFTTGTDNIGVWVDNGRFENTGSRIAVNGVALFVEGAQSQITSTGGDIVAVDGEAAIKLGAGASLNLAGSGLGTIEGQKNAHGILLDTGAVGLVIDGAKINVNAAGAVGHGIENRAEIEGIQLTNTTEINVADGIGVRTSASLAKTNSGTINVDGSGIALAFQKADGSETDNNLDMSDSAGLVINLKGTDGTGIFANTKDGAVVKSGASVNVIQADGGSALVVNNAASEVVQSGNLISASLSHAVVDASKAQSFTNKGQIKAASTTGTAMAFDDAVNTTVLNDSGAEIQGVVALNGGDNTFTNKGSITGTVSAKEGNNTFLFDDGSTLTGEVTAGNGNNNVTLNGKTHVDQVTAGTGKNTFTIKGEGATWNLLDGGQGDSDSLIFDNAIHTLDSVVKLQNFEHVGLKNSSLVTLKEALVLTDGGNGPGSVDIESGSELAIIPAVAGNFTFDPLLTGKGTLSARLDADTSAFEFSHNVGDQFAGTLKLGTSSFALEGLNTSGLTHAMLMSETGNITTVGSGVQQIGGLGFNGGTLIFGSVMPGDTIASNSIETSAAGTLDIRGKGTIQVTMPDEVINDIPAVDTRKNLLEQDDAQTLVTLVNAAGTVTGTGGQLQLVDENGQAISHSQTFDVTQGGEVVAQGNYDYKLLGSSDGIKGDGLYIGYGLKSLDLQGTGDKALVLTPRANAQGLQTDLGAQLTGAGDLAIEAAGQVVTLSNGGNNYTGDTLVRSGTLQMANDNVLGATGNLNVASNAVFRTNGYSQTVGALQTETGAHIQLDSGSVLTVSGTQRQPGDDNGGIIENNVLSGEGTLAVTGSNLTVHGTNIGFTGNASLTQGALVEMNGAQGLGSQGSISFESLNDRLAIDIADGSGVSSNLSKSLSGEGSVGILNTTDLTLSGDNSNFSGEFRVQKDAALRASDEKHLGTGLIDSDGVTWLTASGNWLLKNDITGSGALVKQGAGNLIINHELTYTGDTTVESGVLIVGDDSVTRAAGATLSGSKNIHVLNGGTLSGLGTVSGQVNNQGTLASLNALSGYETAEVGNFTVGSLTNTGVIRLAGGKTGNTLTVNGDYTGGGTLIINTVLGDDTSTTDKLIVTGNTSGDTGVVVNNVRGQGAQTADGIEIVHVGGQSDGNFRLQNRAVAGAWEYFLHKGNAGGTDGNWYLRSELPPEPQPQPQPQPQPQPQPQPQPQPQPQPHPTPDKPVQKVYRPEAGSYIANIAAANTLFNIRMHDREGETYYTDVFTGEKKATSMWMRHIGGHNRWKDSSSQLNTQSNRYVVQLGGSIAQWTDGQDRLQQGIMAGYGNEKSSTTSSLSGYKSKGAINGYSTGLYGTWQQNDGNDNGAYVDTWIQYGWFNNTVNGEKLAAESWKSRGFTGSVEAGYTFKAGEFTGSQGSHYDWYIQPQSQITWMNVRASEHTEKNGTKVQLSGDGNIQSRLGVRTYLKGKSASDDNKAHQFEPFVEVNWIHNTRSWGVKMDNTALSQDGATNIAEVKTGVQGKLSDNLNVWGNVGVQAGDKGYSDAQAMLGIKYIF

SEQ ID NO: 6694 - protein, 379 aa, Burkholderia pseudomallei
MRHSARLLACGALCATAAHAHAQSSVTLYGIVDTGIEFVSHASAKGGSAWRMPAVTGELPSRWGLRGVEDFGGGYRALFALESGFNLRGGELGQGGRLFGRQAYVGLRAPFGTLAFGRQYMMTYVALQGADIIGPDIYGLGSLDAYIPNGRADNAVTYVGSYRGVTLGAGYSFGRDSAGTGNSPGQGTCVGSVPGRAVECRSGSAMLKYDAERFGVAASYEEQRGGANAAANFFDGAAPMPITSSADKDTRAHVSAYANAGPVKLGAGWIGRRVSTDAPAAPDVRTDLFFVGAAYRATPFVTIDGEAYRIVDARHDARATMATLRASFSLSKRTAVYAQTAYLWNSVHARYSVSGGGGGTTPAAGVGQLGAMVGVRHMF

SEQ ID NO: 6695 - protein, 1131 aa, Burkholderia pseudomallei
MLMTRHKKRKMMKRSGAKLLAPVVVAAAAAVAARPGWAQAAPYPDPGRRGDPASWRTPEFTNAWGLGAMHAEYAYAAGYTGANVAIGVLDSGYYAQHPELPDSRFVPVTAAGVSGVLNPNNNNHGTLVSGVVGGARDGVGMHGVAPDATVYEGNTNATDGFRFGVSDPKFPASDAKYFAEAYDALAAKGVRIISNSWGSQPANENYSTLNKLTDAYKLHEAVRTATGRGTWLDAAAKVSRDGVINNFSSGNTGYDNASLRGAYAYFHPELEGHWMTTTGYDQLSGQVYNQCGIAKWWCVMAPTGVPSTSYSGGAAAPTGATYANFNGTSAAAPHASAALALIMERFPYMTSEQALSVLFTTAQNMEPDPSRPDYTNNGLFSTVHPAKPGASGVPNAFGGWGLVDLRRAMNGPGQLLGTFDAALPAGTADVWSNDISDVALAARKREDDAEHRAWLDTLRTKGWEHGLPAGASDGDRIDYALGVARETAYQAREYQGSLVKSGGGTLTLAGASTYRGPTTVDGGELRIDGSIAARAVVNPAGRLTVNGRAADIAVNGGVATIAGTSANLSIDRQGRAAVTGTTADVRVASGFASLGGTSGNVAVGALGVAAITGRTADVAVDGGRASLDGASGNVAVGNGGVVSGSGTVRTLTAAANGTVAPGHSVGTLTVSGDVRFAPGSIYAVEVSPGGAGDRIVAGGRAQIDGGALALALENTPPPLTPEQSRSVLGRRFEILNAAGGVAGRFDAPSGYLFVNPVLAYGPTTVSLTIDRNATPFASVARTANERGVADALETADPGSAVYNSVLFAASAQAPQAALAQLTGEIYPAAYAALVNESRQVREAALERLWTARGAPGRAGAWARLLGAWGSARGGDVNGYTSSTGGFLAGADAALLDGVRAGGFAGYSHTGVNLRNQPSSASFDSFHLGAYAGWQPGALGVRIGAAHAWHRGGVDRAVQYGAVAENETTALHAETTQVFGEAGYRFALDGAATLEPFFGVAYVHLKNQGTTETGGAAALRVRQGNHDVTFSTLGVRGETRLGLTSRLQLTLQGSAGWQHALTDGQPSGTLAFATGSDTFTVSSVPVAKDAAVLNVGAGLELGKNGWLRVGYSGSLASRQSEHAVQGSLHWKF

SEQ ID NO: 6696 - protein, 771 aa, Burkholderia pseudomallei
MSLLKKSLIAPSLAILLATNLYSANYTVDTTNATKAIEKISELSNIPFIVDTNILNGKNTNKIQNVQNLDEALKLMFEGTGLEAVVKNNTIVIKKIEGKGTVLEPISVNESYKNGTAENGYLSEDITGIGLWGKRSLQDTPYSMTVIPKDLIENTQANDMAQIFKMNPLTQDGGDQMSGNYYNVIRGFSSNNAIVNGIPLADWYSFTTMEDLERIETISGATGFLYGGGRVGGAVNYVTKKPTLEDKRSITLGNYGGEQYYTHIDLSGQIDEKKVFGYRINALYQDGDSVANVGKEQKFVSLAFDFKPTDNFTMDLNYAHRELDRKNQKPFFNIGANTFRPILDISKGYTSDLNSIEEKNDRVTSSLKWNLNDIFTLRSSFLYEETDREVVGETLIYTRNDGLYDALLYRYPKGGQGHKSYAGNLYLDSKFETFNIDHLLTIGYSQNYQNYKRDKNWWQPRYWLDGVTLEQIKNTVIPRNPNEHGGRIPLSKTEYKNTLIGDDIVFNDQWSALVGFNYATVENWSSWGGSYDKSELTPTLSLMYKPFEDLTTYVTYMESLETGEIVADTYSNAGEILDPLVSKQYEIGAKYSVNESILLTSALFRIEKANQYSNNETPMPKYVQDGEQVHQGIELTFTGKVTDDLTLFGGGTLMDLSIEESNDKNLEGKKPTNAATKMAKLYAEYNIPQINGLTLTGGAYYTGEKYGDDLNTDKIPSYTLYDAGLRYKTKLDKYPTTFLLNVANLTGKDYWASSSYLGDPRSVAFSMKMEF

SEQ ID NO: 6697 - protein, 749 aa, Burkholderia pseudomallei
MTSTFLRHAPTARGDHARRRRRAITLTVPALAAGAFHLAPAVAQTSEAVHGHGTLGASGVASRADTDAASAKSDGAVREAASAAASRTTTGAAPDATTLPTIEIVAAPESTPLVVVTDPKTPRQPLPASDGADYLKTIPGFASIRSGGTNGDPVLRGMFGSRLNILANGMPTLGACPGRMDAPTSYIAPESYDKVTLVKGPQTVLYGPGASAGTVLFERVTPRFKTPGMRFDGSVVGGSFGRNDQNVDVTAGTPDFYGRVSANHAHSQDYEDGNGRTVPSQWDKWNADAALGWTPDDNTRLELTAGTGDGYARYAGRGMDGAHFRRETFGLKFDKKHIGDVLDRIDAQVFYNEADHVMDNYTLRMPDPTSSMPMRMASEVRRRTLGARVAATLRLTDAFKLVTGVDAQSNRLDSRSAMGMQNYGDKPWNPQANMWNAGAFGELTWYASDASRVIGGARIDYAAARDKRATTGGMKMSMRNPTFDDLRSRVLPSGFVRYERDLASLPVTWYAGIGHAQRFPDYWELFSAKRGPNGSINAFSAIKPEKTTQLDIGAQYKSDKLDAWVSAYAGYVQDFILFDYATGPMGQITQATNVNAQIMGGEVGASWRPLAPWRFEGSLAYAWGRNVQSGAPLPQMPPLEARFGVEYTRGPWSAGGLWRVVAPQHRYALNEGNVVGKDFGPSAGFGVLSLHAQYNVSKTVQISVGVDNVLDKAYAEHLNLAGNAGFGYPANLPVTEPGRTAWVRLSTKL

SEQ ID NO: 6698 - protein, 222 aa, Arcobacter butzleri
MKKITFSLISILSLSGLSFGGGNVVPIVPVEEPIVETPVNSAFYVGLGYSYLSSNRTAKLNKPGDPRHGQVVKDTDSNADNILLQVGYQFNPYLALEGRYTFSVGDHSLTHNHLGGIKEDVDIDISNMALYIKPMYPIGDFSIYGLLGYGKVERERHEEPYRSWDGSGFQWGAGVQYAIGDDFSVFVDYTRWYDEEGEPHERLPRLLDTDFSVLSVGISYRF

SEQ ID NO: 6699 - protein, 367 aa, Arcobacter butzleri
MKPIFSRGPSLQIRLILAVLVALGIIIADSRLGTFSQIRTYMDTAVSPFYFVSNAPRELLDGVSQTLASRDQLELENRALRQELLLKNSELLMLGQYKQENARLRELLGSPLRQDEQKMVTQVISTVNDPYSDQVVIDKGSVNGVYEGQPVISDKGVVGQVVAVAKLTSRVLLICDATHALPIQVLRNDIRVIAAGNGCTDDLQLEHLPANTDIRVGDVLVTSGLGGRFPEGYPVAVVSSVKLDTQRAYTVIQARPTAGLQRLRYLLLLWGADRNGANPMTPEEVHRVANERLMQMMPQVLPSPDAMGPKLPEPATGIAQPTPQQPATGNAATAPAAPTQPAANRSPQRATPPQSGAQPPARAPGGQ

SEQ ID NO: 6700 - protein, 937 aa, Arcobacter butzleri
MILTENRNNNILMRKSIKLLVACMLCSPVAIVAQEQDSLFARKSKVAIEYGRGISFNLKESTTATAVASEEELSHKKSINNSNMLYGLIPGLQVLQNSDNAWNDAATLRVRGYGTSSSTTPLVLVDGFERSLDQISADEIESVTVLKDAASTALYGMKGANGVILVKTKRGRMGKPEINFSYQFNMATPQRLPEFVDGYTYAKALNEGLTNDGLSARYSAKELEAFRTQSNPDVYPNVDWWDEALRDHSYGNNVTFSARGGGEFVRYFTQLNYLNDNGILEPTSDNDGYSTQFKYSKLNIRTNLDITVSPTTTVQLNLFGNFSEHNRPGETTSNIFSALYQVPSGAFPVKTSRNVWGGTTVYSNNPIASISGRGYARSQTRNMYADMKLNQDLSALVKGLSVGFQVGLDNSASYWDNNTMNFGYEQATMNWETGETTYNTLRNEGTLSFSKSVGSSVNHFNFGAYANYAKDWNKHSLVATLQYNMDKTNAKGQNNSKAFMDVVAQAHYVYDHRYVLDASLSGSAASILEPGHRWGIFPSVGAAWIMSEEAALKSDWLNLLKLRASYGISGRADYGTDLYLDVYGTGGSYYFGKNPASISGMKITQLGITDMTYEKSHKLNVGFDFIAFNKLSVTIDGFYDHRTDILVSGDNAVSSIFGLTAPNINNGVVNSYGVETSVRWADKIGDFNYQIGGMLTFNRNKIINQNEEYRPHDYLKRTGKRLGQFFGYEVEGIYQSQEEIDNRGVKQNLSDVRPGDLKYKDQNNDGVIDAYDQVALGYSAMPEIYYSFDLNLEYKGFGIYALFQGTGNQSRLLNTSSVYWPLISNSTISTEYYNNRWTPDTPNAKYPRLTSEGSANNYTTNSLWVADASYMKLRTLELYYNFSQEMMKKSKFIKGAKVFARGHDLFCVDKIKVLDPENIGTNHPTMTQYTFGVNLSF

SEQ ID NO: 6701 - protein, 248 aa, Arcobacter butzleri
MLKKIVIGVTATAAFGIGAGALAGGSVDQSYNNTSGAGFYVRGEAGYGLVDKKSGTSKVNFTGVTLTENSHTNTKKSRGLNGRVAIGYAFNPYFSLESGFTYYHPAYRDVNIAGSALPLFSSVQAEGRQKINLYSIDLMGKATLPIDNFYAFIEGGVAYVHTKFAAFTETGTAVSPLLPPVTSSVAVKVPSSSKGYIRPKAGIGVGYNITQNIGVDVSYSRVFGQGKINNTNYLPNLNAVTLGLTYKF

SEQ ID NO: 6702 - protein, 1108 aa, Arcobacter butzleri
MKSNFYGNRKSLLAVFICAAFLSGSHVAYAVNESLLVSAYQQPSKIKGTVIDANGEVVIGASVVVKGTANGTITDIDGNFILSDVPTNGTIQVSFVGYKTLEIPVKGQTSFSLTLMDDTEVLDEVVVVGYGTMKKSDLTGSVGSISSEKLAARGTTRLEDALQGAVPGVNITQSNSRAGGGFNIQIRGQASINKQAAPLYVIDGIVCSSMDFLNPEDIERVDVLKDASSTAIYGSRASAGVIMITTKGAKGAGKPQHVSISYDGYYGIRKVVRMPDFMNAQEFIDYRFARHTLLTSDVFDGSSRKGVDANGIPHYEIKQSDLETTFLKRDGGTNYRDSQIYEMMMSGTDGYDWTDLVTRTGNQQNHYISANGATEKINYRLGVGYQGEENVFKHNDYSRFNIKGAFDGKISKVFEAGLSVNMAYTVQDDFSTDGTYCPYENAFYFNPFVAPYDENGNIINNPGSKDAFGSTGQFTSTVSPLNDLEDENYTNQTRKFHVFGNVYLRTNIMDGLKFATTFSPNFYHGRQGKFNATGVNDRNPLGSNYYQVNGTNSAEVETTDRMDWTWDNQLDFNKTIGDHTFGAMGLFSIYRSDKEIYRLKGFGISDDMLSFHALDKASGDKEIASSYTASTLVSGALRLNYSYKGKYMATATARADGSSRFAEGNRWGWFPSVALAWRMSEESFLKGTHWLDNLKLRLSYGVTGNNNVDDYVTIATASGPSYVVLGGSEIQGYYPNGLVNTGLIWEKVKEFDLGLDFSVLSNRINLTADFYHRLSDGQIMDRIVPVETGETKATFNVGSVRNTGIELGMQFGIIRSKDFIWDLSVNYSRNWNKILELSNGKVDEIASNRFIGEPLNVLRDYIHTDVITDKGVTMHTKDGDIHYTLQELYAKYGSKYKWYEGQIAVNDWNNDGKITDEDKQIYGCTDPKWVGSLSSNMYYKGFDFSVMIYTKQGQWARSYFHDKYMKWSDRGNQHMAMDFYIPKGAPVIDHTTGDIVYATETHYGEYPYPNNSDTSAGGYFSDKGSAKGEGFQYQKTSFVKVKNICLGYTFPKKWITKAGLQHLRLYINVLNPFCFTDYDGFDPEWANAKLTDGGPASVTYQIGANIKF

SEQ ID NO: 6703 - protein, 199 aa, Arcobacter butzleri
MKKVLLSAVALLAFGFANAQEEKSTNGGFAKGDVFVTGAFTFGSTNDKDSDVKTNGFEIAPQVGYFLTENIAIGGKLGFASMKEKSSGVDTYDMSGLTLGAFGRYYFTPANQFSLFANLGLDYSSMKNNLAGGGKLNGFDAGLGAGLNYFVSSNFSIEAGVAVLGFSSEKSDASGAKGTSSFGFGGDWRAVTFGVNYKF

SEQ ID NO: 6704 - protein, 182 aa, Arcobacter butzleri
MKKIISITALVLFTMSTLIAQDSTDVKNKGFNFGVRIGYSAYSFNTNNRAPYGSGYYGGLFFEKRLSEKWALQFETNFNYTGSSTLQFPILLKYKISGKFEIFGGPQLDYSFEQTTMSIESRNKRFGASLVIGAQYNINSKWFVEARYIYGLTDQFPVYEGANPTSAFTKKNSFNFGVGYKF

SEQ ID NO: 6705 - protein, 827 aa, Arcobacter butzleri
MKEAIPRKNKYIKLNGIYRLSFILLCCLLCSQAAMAQGVRVSGYVLDRGEKPIPFAGVKVRGTGTGATTNLKGYYEFRMKATTDSITIEFSSMGYQGVSRSFPSLTKDTRLNVRLAEAEMELSSVTVQATKRRLNTMERVNTRDLRVNAGPTGGVESLISTYAGVTQNNELSSQYSVRGGSYDENMVYVNGVEVYRPLLVRSAQQEGLSFVNPDLTQSVQFSAGGFTADYGDKMSSVLDIRYKQPQEKEGAVLLGMLQSSAYYGSSAGAFSQITGVRYKSAKSLLGTTDTKAEYDPIYADGQTFMTYRFSPKLSVSFLGNISQTRYKFVPQTRETSFGTLSDAKKLKIFFDGQEQDRFLTYFGAFSMNFVPDDKQRHTVTLSAFNSNERETYDIQGEYFLNDVQLGADGTASMASGSENSNGLGIGRNHEHARNRLSYRVLNMGYRGEMKLNEKHRLQAGVSAQMEKIADHISEWERRDSVGYNLPHSETVLLMYNNLYADTQMRGTRLSAFVQDRFNFSMGGGTFSLIPGIRASWWSFNKELLVSPRISVGYSPESNPALVLRAAAGLYYQAPFYKELRQTHKDAEGNNVVVLNEKIRSQGAFHILAGADYTFEMGGRKYKFTAEAYYKSLFNINPYIIENVKIRYLGENIGSGYAAGIDLKLFGELVPGVDSWLTASIIKARQKLDGYGSLPLMNAPTYNFSFFLQEYVPGNKRITATLRAALSGGLPQLNPSKGLSSPAFTAPAYKRVDLGVMYKWLDPDDSFAGRSKWLMGVKGAYIGADLFNLFDMTNVNSYYWVSDAYQQQYAVPNYLTRRQFNLRLLVEF

SEQ ID NO: 6706 - protein, 1054 aa, Arcobacter butzleri
MKNYASKGKRIGLLLAMLFITSWMFAQVTVTGNVRDERDEGAIGATVLLVGSQKGTITDSEGNFKLSVPNAQTAVLQISYVGYETQTIPLKGKTRIRVILKEEANALNEVMVVAYGTQKKETLTGAISSVKTDVLLRSPNASIATSLAGQITGLSSVATSGQPGKEDPAIYIRGVGSLTESASAPLILVDGVERSFFQMDPNEIESVTVLKDASATAVFGVRGANGVILVTTRRGEEGKAKISISSSVGIQQPTRILEMADSYTYAQLFNEMNDNDKKPKHAFDEYTLERFRLGDDPIMYPNVNWRKYIMKSSSIQTQHNLNISGGTERVRYFISMGFLWQDGLFRQYKELDYNNNFNYTRYNYRGNLDLDITKSTLLKVGLGGIVGITHEPNDNNYEYGLFSLINMAQPFNSPGIIDGKLVTINPGKYEGILMNNNALARYYGQGYDRNTSNTMNMDLSLTQKLDFITKGLSVEVKGAYNTSYSFLQQRHGSVESYTPYYQSELENPDLDIKDPAYNKTIVYRVDGQNKRLGYAEKTYRGRNWYFEASLRYNRKFGDHNVGGLLLYNQNKRYYPSEFTDVPTAYVGLVGRLTYDYKTRYIAEFDFGYNGSENFAPDKRFGAFPAGSVGYVLSEEPFMKKQKVVDYLKLRASVGLVGNDNMNDNRFLYLPNGWTVDQLGNVVDNWGAYQHGYNFGYNNSNTMFGAIESRIGNPNVSWETALKHNYGIDVNFLNNRLKVSADLFFENRKDILIKRKTIPIFTDLNSNIMPVVNMGQVKNHGYEVDIKWEDRIKGDFHYYINANVSYSKNKIIFQDEIEPNETYLWRTGQPVGSIFGYVADGFYGEEDFTKEGALKDGLPVPDADVQPGDIKYKDLNNDHVINEDDQCKIGHPTRPSYTFGLNYGADYKGFFFSMNWTGAAERSLLLEEFFRIPFGINSNNALMQFHADNRWTPETAETATVPRFATKTMTHNSKTSSLWVKNGNYLKLKTVTLGYNFRNVAALKRIGISELAIKLSGYNLLTFDKFKIMDPECTPGLTDSYPINKIYNLGVNITF

SEQ ID NO: 6707 - protein, 350 aa, Arcobacter butzleri
MIKIITVIYIKRDNKPISVGINYNDLGQFNTSRHRLRYFLNTHNIFGLNESLDFSYQNKLQRQYKERDTKNFSFGVSVPFKYWTFSYSYDSSEYLRTIKIQNTKYRATGKTKNQTFGIRKMLHRNENHKIDLGAKITLKDSKNYIDNVRLVSSSRKLSVLTVDTTYTGRIFSGLLSTNIGVSFGLERFAANKDKEEWFRNEYTPKAQFRKYNVNISWYRPIDKFYYKINLGGQYSKDILYSQEKLGIGDDTTVRGFKDESTQGDKGFYIRNEIGYKGNEFLEPYIAYDYGRVFNNKVNEDKVETLQGVAIGIKAYFKGFEESFTLAKPIDKPRYFKNNRPVAYTTITYRF

SEQ ID NO: 6708 - protein, 809 aa, Arcobacter butzleri
MKFSASMNKVVFMILLLFFATVKGQEIQVLDANTKEPIVNVAIFNSDKSKTTLSDFNGKCDLTAFSTNERITFKHISYEVFKASKAQLIRNSSRALMVLKPEQLDEVVMSISKWEQQKKDIPHKIASLNARSIAFANPQTSADLLQNSGKVFVQKSQLGGGSPMIRGFATNRLLLTVDGVRMNNAIFRGGNIQNVIAIDPYTIKNTEVIFGPGSVIYGSDAIGGVMNFYTQKAGLSNTDSLSFSGNANYRFATASSENTAHIDFNLGKKKWAYLTSITYNSFDDLKMGKNGPDSYLRNNYVRTTNGIDELVTNKDPQKQVSTGYNQLNLMQKITHRPNNNWDMNVGLFYSETSDYSRYDRLIRPASTGEGLRSAEWYYGPQKWFMGNVQVNKKGKGKFYDGLKITTAYQYFEESRNDRGFQDPMLYSTKEMVNALSTNIDFENKKIGDLRLYYGAEYVYNYVNSEGSHKNINSNTTLEGASRYPDGSSWQTTAGYLNGEYKAKPNFTLLSGLRYSHVWINADFDKTFYPFPFDDANLSTGALTGSLGFSWFPRANLQVTFNGSTGFRSPNIDDVGKVFDSEPGSVVVPNPDLEPEYAYNVELGIQKNFKDKIVFKGAAFYTYLVDALVRRDYLFNGQSQIEYNGEMSNVQAMQNAAKAYVYGFEFGLEAFLSENLSLVSNLTLTEGIEEDEFGTDTPARHVAPTFGDLHLIWKNQNLKMDAFINYNGEIENYDLAHSEQNKAYIYAKDANGLPYSPSWYTLNIRSQYNITHSLKLSCTVENITNQLYRTYSSGIAAPGTNLILGLGYKF

SEQ ID NO: 6709 - protein, 713 aa, Arcobacter butzleri
MKKISQSCCWAALAIALGASGQALAEAPATVGALAASDGAGADEATSPGDIVVTALRRDQRLQEAPAAMSVLTSATIEAAGVKNLDDVSKLVPSLRFEAGLRAGVPSISLRGISAVQGGDAPFSLLVDGVQVPFLELFNQDLLDISTIELLKGPQGALYGRGAIAGALLINTRAPDNEFRGSLHLSAAEGRDYRASATVSGPIVEDVLAAKVTAAYQNRRGLIHIRTLDRPGDYVDQGTFKGQLRFTPGPNTTVDLFGTYIKGNSGWGMLAQIPVGVPGAIEDFHTYEANLNFLGVTKRKLWNTALKIDQKLGIGTITSVSQYAYGKSNNINDFDYTPAAQYVNYNPIVDKAFNQDLRFTSNLDGAFNFIVGAFYQKRTGDNDVNVLTDPAAVPALPPRLISYQDYKSEAYAAYGQVSLDFDNGLSFLGALRYDIDKREDSLEQDPTSFVKHKFKAWQPSATVKYQVNRQLMTYATFGRGFRSGGFNAANLTVPSIGAQRIYPKEMSTNYEIGFKSQFLDRRLTFNAALFRTDFDNAQFQQTIVVPVPARFITSIDKTRVKGAEADLSLSITRDLVLTGSLSITDSKIREFSPMPAYDGNQAPNVYKDNEQVSLEYRPAFNDTYRGLFRIDASRRGRISYDLSENFTYKPVTFVNARIGIETDAWSLSVFGNNLTNERAPTFFSALAYRVASARLANVPFNAGVDFTYRFGGR

SEQ ID NO: 6710 - protein, 494 aa, Arcobacter butzleri
MKNRFEPARTRRLDALTALLLSLAAAPAFAQSASPAAAESTAGATASDTAPAQPADAATPAPTGFWDRSNLFGNMGGLRDVLGDHGVTLSLQETSEYLYNTAGGTNRGGAYQGVTQFGFNVDTEKAIGLPGGTFNVSGLQIHGTNLTQRYLQTLQTATGIEANSTTRLWELWYQQAFLDGKADVKVGQQSVDQEFMVSQYAATFMNATFGWPVLPATDLPAGGPAYPLSSLGVRLRVKPADAWTAMVGVFDGNPAGRSDGDAQSLNAHGTNFNLRSGAFVIGELQYALNAPPADPKAPQPAGLPGTYKLGFWYQSQHANDPRFGTDGLSLANPDSNGIAATHRGNYGFYAVADQMVWRPSADSPRSVGVFARVMGSPGDRNVVDFAANAGITLKAPFAGRDNDTAGIAIGYAKIGSHARGLDGDTGAYTTPGYPVRRAETVIEATYQYQVTPWWQLQADLQHFFRPGGGIPNPNAAGARIGDETVVGVRTTITF

SEQ ID NO: 6711 - protein, 1080 aa, Arcobacter butzleri
MSLLEVVREIEETTDYSFFYKSSDLEGSAKKNYNLNGDIEEVLTEVFEGSGIVYKVNGKEIILSKASAKSVKQQRTISGVVTDATDGSTVIGANVVVKGTTNGVITDLDGNFSLTFSGKSCTLEVSYVGYKKQEVYITDQGLVNVKLVPDNEMLAEVVVVGQGTQKKVSVTGSIATVKGSTLKVPSSSLTSSLAGKLAGIMSMTSSGEPGSSSEFYIRGINTFGGRSTPLILLDGVEISSSDLNRIPAESIESFSLLKDASATAIYGNRGANGVMLVTTKSGTENSKAKINVSLEASYFRPMNVVEFADGPTFMRTYNEAAQARSLTPITNPKYTEEQILNTEKGLNPYVYPNVDWYDLIFKEGNYNQRANINLQGGGSRVTYYMSLQANHDTGLLDAPKNYYYDTNINNWEYNFQNNISYKVTNTTTIDLRMMAQIGNRQGPNYSVSDMYQTVMRANPVAFPAYFPSQEGDDGFIRFGNAEIKPNVLGKNPYAEMLGSFKETNYNTLNTSISLNQKLDFITEGLSLKALVNFKNWSESSYNRSIKPYYYKVKDGSYLPDTDEYELQLLQTGDQYLSQSGISRNSDQTFYFDARLDWKRSFGDHNLSAMLMYMMREYRNDVLPNRNQGYSGRLTYDFANKYLLEFNFGYNGSERLAKGERFEFFPAASLGWVVSSEKFWEPISNYVSHLKVRTSYGLVGSDEFNGGAPHFLYQNNISIGSANDFWTGLPTSEINRRGPAFYVLAVQNAGWEHVKKFDIGFDMSLFNQLNITFDYFHDKRDRILMARASWPYMLGYWGSLPWSNIGEVVNQGYELSVNWSKQFGKDWSIDLRGNFTYNQNEYKYVDEPNYPYTWQTKTGKPLNTLTGYVAEGLFTSQEEIDQWADQSQLGSNIMPGDIKYRDINGDGQITTEDQVMLSPYNGVPRIQYGFGLNISYKKFDFGVFFNGSAKRKIMINSGYTPFLAGGGDGITVETLERNLMQWIADDHWSVDNPNPNAEYPRLGITEADVSNNTQPSSYWLRNGNFLRFKTLEIGYRFPYCRVYLSGDNLAVFSPFKLWDPELSWNAYPLQRTFNLGVQLTF

SEQ ID NO: 6712 - protein, 371 aa, Arcobacter butzleri
MKRKSIHRAGQGFLALAALAALPAVATAQSVTLYGVVDTGVEYVGSIGAKKDSVVRIPNVTGTVPSRWGLRGTEDLGGGLKSVFVLESGFAADSGTSGQGGRLFGRQALVGLSGNWGQVALGRQYTMLFWAMLDADILGPQVYGTGSLDSYIPNARADNAVSYKGTFGGLTLGATYSFGRDTVNAGPSPVGTNCAGENPADKSACREWSALIQYATANWGVSAAYDSLRGGPGAFAGLTSSGLKDDRLSVSGYALFDRTKIGVGVLSRNNEGSPTARSELYYAGAAYDVTPAFTIAGQVNYLRYRHSDNKALLYALRGTYALSKRTSVYGTAGYINNDGQLALSVSSGAAGGNPTPGGSQFGFMAGVKHVF

SEQ ID NO: 6713 - protein, 1047 aa, Arcobacter butzleri
MNLFGMKKHRIRSLWLLLLLLTCSVTVWAQGSSVTGRVSDEKGELLIGVSVQEKGTTNGTITDMNGQYTLKLSTGNPILLISYIGYKPQEVKVAKQKIVDVVLVEDVSSLDEVVVVGYGNQRKVSVVGAQSTMDVKDIKMPAASLSSAISGRIAGVVAVQRSGEPGHDESDIWIRGLSSLLGQSSSPLVLVDGVERSFNNIDPEDIESFTVLKDASATAVYGVRGANGVVIVKTKPGKVGKPQFSVDYYESFTRLTKKVDMADAYTYMDARNEAQMNTSGTLKYSAAYIEATKKANGLLPNDNPRLYNPYLYPAIDWADNLFNDWGHNRRGNINIRGGVPNANYYASLSYYGETGMTRNFKLENYNTQMKYDRYNFTSNLNLKPTSKTTVDLGFSGYLGQGHYPQSSTSSLYAACMDVNPVIYPLLLPNGTVSGINSQQKFNPYGLLARGGYYDEFSSQLNSNIRVKQDLDFWKWSKGLSASAMVAFDTYNSRKRKYNRNEPMYTFAGKTDENGIWIEDTLFDEETGDYLYSVLKEADGSLSLQTPEQWSSRTVYTEASLNYDRSFGAHRVGGLLLYNQKVYWDLNATDVIGGMPYKQRGFAGRATYSWNDRYFAEFNLGINGSENFSPGKRYGVFPAFGLGWAVSNESFWNPVRKYISFLKFRYTDGWVGSDTATGRRFMYQGVFTGLTGTMFGTNYTSANGYGEEKYGVNVTWSKSRKQDLGIDIKFLNDNLSFVVDFFKERRDNIFLQRSTIPSYAGWIENPYANLGVVENKGIELAMDYTQRLGKKTFLTVRGNLTFNKDKIIENDEPPVDYPWMETRGTNVNATWGFIADGLFTSQAEIEDHATQFGTVHVGDIKYRDLNGDGVIDNYDKTVIGRGDVPRIYYGFGADLQIGDFSISALFQGTGQADRYLDGICIKPFWDDEGRDNVFANIHDRWSPDDPTNQDVFYPRMYVGSDANTNNVQKSSWWVKDVSFLRLKQLNISYNIPKKLLDRCFLKSASVYLMGTNLLTFSNFKLWDPELNTSNGTAYPNVSSYSVGVKFSF

SEQ ID NO: 6714 - protein, 787 aa, Arcobacter butzleri
MYKSTPSAAWCKKRLLVTSLLAAIYQTSAIAADTSAVSGEAVDDTSEQMTVTAPAPVQKAGSEHSISAQELEDKGANDFGSIMRYEPLISATGASGGSGNGKSGFDRGGYTGYNIRGMESNRVGIDVDGIAQPNATGRGYVGRAGLNTFGIGRDYIDPYMYGSVDIQSGATSTETANSAIGGNVSFRPKSADDYLRPGKTSAFGYRSGYDSADRSWHNGVTVAGGDEFLRGILVYSRRDGQETENNSGTVDAYPANWHSDAFLASGIWQPNDEHKLTSTFDYYHKTNHTHYDTWDSSGNSTIGTANQTSQTRRWGLSLKDDWTPMNDYLDSVSTKIYYQHTEAHDWTYMPDSVTRRMQTVNSNYDTDTWGLQTALAKTLGRHDLSAGFNASTTKTQRPFSQSPIPSVYSEIMQPEADSRSYTLGGFVQDKINFDLDSHNFAIIPGVRVVHQSTKPENLSDLAANSSVLTESSVANLYGKNSDTQVLPSLTFQYDLTPRLMTYLQYQRGAQFPNASQLYGSWNLGSSYAGSQQYALIGNTDLKTETSDNLEWGLKGEVTEGITVRTALFYNSYKNFIAYTRYTRANNPGQFTNVPSNIYTIYQAENRDKAYIYGGEISTKFNFGTWFEQVNGLSTTLALGYSEGKSKSSYSGDKYVDLDSVAPMKAIVGVAWDDPAKRYGTALTATFVKGKQATTTNRESYSNSGSAITDASSDYMRVPGYGMLDWTAYWQVAKNVRLNGGVYNLTDRKYWDYLSSRNIETGTNQDANDKALAVMPGRTWQLGVNVDF

SEQ ID NO: 6715 - protein, 198 aa, Arcobacter butzleri
MNKKFLLSIAMMSVFSANNLMAADSGFYLGGAIGTSGIDDGGLYKNTQAPITVDAEDPTYKIIAGYQFNRIVALEAQYTKYGDVVAKNALSQFTYTWSPTAFSISANLGYTFDNGIRPFGIIGLSSIDLDQSLPMLDDDRGEGIRYGFGVEYTPRQLGNVSFKLGYEADAFVIESDSAFENDKDIVIDSFYAAVAYRF

SEQ ID NO: 6716 - protein, 206 aa, Arcobacter butzleri
MKRIFLPLLISTLSFHTFANDNTDVSQPKISGFYAGVGFGSFGYSEEDSWGYSNNPISAEADGNSTKVYLGYQFNKIVGIEGTYTNYGEAKAKVGNYSMKPSSISLAANLGYTFKNGIRPFGLVGMSSLDLNQSEELLTDDSGAAFKFGFGVEYTPKALGGVQFRAAYEMDMYAVEYLDYQSGSGLTTETNLYALDSLYLGASYKF

SEQ ID NO: 6717 - protein, 789 aa, Arcobacter butzleri
MKNCVKFACSASLLVLAMQSSAVAAQDVQGNAGVAEETTPVFGDIVVTANKRQENAQKVPIAITAYSGDQLKALGVTDATQITQQVPGLQLNAWSPNVTIFNLRGISQNNFTDYLEAPIAVYVDDAYMGSINGLSGQLFDVQRVEVLRGPQGTLFGRNATGGLIHYLSTDASKAEFNGYLTASYERFDRRALEGAVGGALADGIRARVAGRVVKADGYIKSAAALPGVFEANGQDLGSENGWALRGTIQADLGPDGKLDLWVKHSEDNDVATGGYVFDNCNLQDNGYCGTDAAGLGNGSGGVINGITGEPASPFQNFSDTPGVFNRNTNIYQGKLTYDLGGVNLTAITNYTDLRKDYQEDGDALPVEVIVFRTNARYRQFSQELRLAGESERFRWQAGAYYLDMKIKGGMDTVGAPAIGAALAAGLPGVAPTIAETYNLHSKNWSVFGQAEYDLSDKLTVIGGLRYSKDTKTVDYRSAVVEGAASSLIATDETFSATLPGADRISDGDIAARVTLNYKPADDTLVFASWNRGIKGGNFTLNGYVTAQTFQHRPETLNSFEAGVKWSNPSRTLRVNATAYHYIYNDYQAFALIGGVPQVGNSDANATGFELETFFQPTDHLNINLGATWERTHVDTVQTAGSQFLSVLVPGASVPQYCTDQNDGTYFCDYPTKSVSGAQFPNAPKLSLNYVLRYNVDAFGGNVVAQVDGVWYDKQFLEVTNGRSSIQPAYNVTNASLSWTSDDDRLSVQVFGRNVFDKAYRAYALNLGPLGTTSVYAKPATYGVSATVKW

SEQ ID NO: 6718 - protein, 820 aa, Arcobacter butzleri
MMHHPILSSRAAQRKLPAATPISRNVYCAVLAMGLTLGTALLNAPAHAQENTNATNARKAYSIAPGALGETLADFASKAGVTIQIDSSVVEGRRSQGLNGSVSVAEGFARLLAGSGLEAMERSRNIYVLRTAQIESTLPAVTVSAAVAEDATSYTSRTISIGKTDQKLKDIPQSVSVVTRQRMDDQNMTSIYDVLENVTGVVTTASPMAGKYFFARGFPITSIQYDGVPLTRQFYSQASSLTENMALYERAEVLRGAAGLWQGADSMGGAVNLVRKRGQAEKTISATVKAGSYNHYGAQLDVGGPLNESGTVRGRAVLDYDTQDSFIDFVGSKNTTLYGAIDIDLTSQTTLGFGLSYEKTNATPSFAGLPRYADGGSLGLRRSTFLGSDWNELNNQQTRVFADLTHRFNDDWHLKVGAVYMNERNDSVYSYGEGAISRATGTGANMIGVGTDFRGEHVGLDAAISGKFQAWGRRHEVIVGANYSNYTSDDKYAIATGLGPVNVFNPNPYSPRQSMASLAARSGLLATGAYDVTSKGLYGTTRLALSDPLSLIIGGRVSWYENKYDSVSRWGANTTSTKSSAEFTPYMGLTYAITPQWTAYGSYTEVFVPQAQRTAAQQTLDPIVGSNYEIGIKGELFDQRVNTSLALFRYIHKNRAVPDIESGMVCDGDYCSRASGKVRSQGLEAEIGGKLTSRLNLSAGYTYNTTRYLEDTENEGLVFNPQVPKHLMRAWADYRVSESLSAGLGMTTQSDTQGRTKSVVQGGYTLWNARAAYRIDPRWTLALNVNNLFDKHYYATIDRTNFGSVYGNPREVMMTLRGTF

SEQ ID NO: 6719 - protein, 1647 aa, Arcobacter butzleri
MLKNKKFKLNFIALTVAYALAPYTEAALVRDDVDYQIFRDFAENKGRFSVGATNVEVRDKNNQSLGNVLPNGIPMIDFSVVDVNKRIGTLVDPQYIVSVKHAHQYMNDFYFGHYNGHRDVSDDENKYSVVTQNNVNPSEKWDVNKRLDDYNMPRLNKFVTEVAPTTPTLAGGDLETYKDKEKYLSFVRVGAGRQLVYEKGSHHVEDKEHGEDLKDLSAAYRYAIGGTPYKGINIDPSQSKKGLIGFGDSRKDHVINSKTLLSQDPLTNYGVLGDSGSPLFAFDKQQNKWVFIGPYTYWAGYGKKSWQEWNIYKKDFADTIHSRDNAEAVPFSTTEYRWTTTGNSSQITNNQKTISVKLPNSEEKLVNYQQKEKENTGQNVIFEGNGNSKNTLVLENNINQGAGGLFFKGNYEVKGKTDDITWVGGGIDVAEGKEVVWKVRNPEKDHLAKIGKGKLIVEGKGDNKGSLKVGDGTVVLKQQTTKGQHAFASVGIVSGRSTVVLNDDKQVDPNSIYFGFRGGRLDANGNNLTFEHIRNIDDGARVVNHNMTNASNITITGESLITDPKKINPYYIKAREEDNPYAFRWIKDGEQLYFNLENYTYYALRKGGKANSQLPYNDKESNENWLYMGKNADEAKRNVMNHINNERMNGFNGYFGEEDGKNNGNLNVTFKGKSEQNRFLLTGGTNLNGDLKVQQGTLFLSGRPTPHARDIAGISSTKKDPHFAENNEVVVEDDWINRNFKATTMNVTGNASLYSGRNVANITSNITASNNAQVHIGYKTGDTVCVRSDYTGYVTCHNSNLSEKALNSFNATNVSGNVNLSGNANFVLGKANLFGTIHSTGNSQVRLTQNSHWHLTGNSEVHQLNLANGHIHLNSADNKNNVTKYNTLNISNLSGSGSFYYLTDLSKNQGDKVVVTQSAKGNFTLQVADKTGEPNHNELTLFDASKATRNDLKVTLANGSVDRGAWKYKLRENNGRYDLYNPEVERRNQIVDTPNITTPNDIQADAPSAPSHSEEIARVEAPVPPPAPSAPATESAIASEQPETRPAETAQPAMEETNTANSTETAPKSDTATPTENLNSESVSSETIEKVAENSPQESETVAKNEQKATETTAQNDEVAKEAKPTVEANTQTNELAQNGSETEETQEAETAHQSEINSTEETVVEDAPTISEPKSRPRRSISSSSNNINLAGTEDTAKVETEKTQEAPKVTSQASPKQEEPEMAKQQEQPKTVQSQAEPETTTQQAESARENVSTVNNVKEAQPQTQPTTVAAKETTASNSEQKETAQPVANPKTAENKAENPQSTETTDENIHQPEAHTAVASTEVVTPENATTPIKPVENKTTEAEQPVTETTTVNTGNSVVENPENTTPATTQSTVNSEAVQSETATTKAVVSQSKVTSTQETTVDNSVSTPEPRSRRTRRSVQTNSYEPVELPTENAENAENVQSGNNVANSQPALRNLTSKNTNAVLSDAMAKAQFVALNVGKAVSQHISQLEMNNEGQYNVWVSNTSMNENYSSSQYRRFSSKSTQTQLGWDQTISSNVQLGGVFTYVRNSNNFDKASSKNTLAQANLYSKYYMDNHWYLAVDLGYGNFQSNLQTNHNAKFARHTAQFGLTAGKAFNLGNFAVKPTVGFVIVTYQTLILH

SEQ ID NO: 6720 - protein, 245 aa, Arcobacter butzleri
MNFRWTTSFAGVAICICSPLLVDDVQAQTAGSITTSVGWLHIAPQGSATPLVVQSVGGVTVNQELTGSSAHASSTDTLGITNEYYVTDNFGVAMLFGMPLKVNLIGDGTLQKYGTLGTTRPMPPAIELRYHLFSATSKFRPFLGIGANYTWFTQVRATNSRFVSDSFGPGGSAHATLSASWNPVFEIGANYAVTRHWSVGTSVSYMPVKTHLTLYGQTATGTQIVSKSTLRLNPVSVFLNVAYTF

SEQ ID NO: 6721 - protein, 820 aa, Rickettsia canadensis
MSTLHTMRLHALACAVVSCLCAPVALAQDTAAAAPATPPAADSAAVNLDSVFVTGTSTATATTKLKSSVSVSTVGAEAIEQSAPRSTAEIFRNIPGIRSESSGGEGNANIAVRGLPVASGGAKFLQLQEDGLPVMEFGDIAFGNSDIFLRSDFTLDRIEAIRGGSASTFTSNAPGGIINFISKTGDTAGGSVGVSRGLDYDNTRIDFDYGAPFAEQWQFNIGGFFRQGDGVRDAGYTTDKGGQLKANLTRLFDNGYVRLYGKYLNDRAAGYLPVPTSVRGRDGSPDLGGFPGFDPGNDTLYSRNFRTDVGLDGNNQTRRTDLGDGMHPISRTIGAEAWFDLGNGWNLSEKFRVADNSGRFVSPFPAEVTDAASLAASIGGAGAQLVEAGGPNAGQAYTGNAIRTHLFNVAINDLGNVTNDLSVSREFGGDGRTLNLRMGYYSSRQTIDMDWTWNSYVQSLGRNSRLLNVVDAAGVSRSQNGLYAYGTPFWGDCCVTRSYDVRYDVNAPYVALTFDSGKFSVDGSLRYDMGDARGSYNGTAIAQNLDVNGDGVIQPVEQRVATVDTANSRPVDYDWNYLSYSLGGNYLITDDLGAFARISRGARANADRLLFGVVRDDGSVSSEEGVNVVRQAEAGLKWRRDGLSLFATAFSARTQEQNFEITSQRFFNRSYEAHGVELEASYRYQGFTLNGGLTWTDAEISRDQITPENTGNVPRRQADVVWQLTPSYRGDSYQFGVNLIGTTDAYTQDANQLKMPGYTQVNLFGDYRVTDALTVALNVNNLFNTFGLTEAEEATIPANGIIRARSIAGRTTSISLRYDF

SEQ ID NO: 6722 - protein, 244 aa, Rickettsia canadensis
MLRIVKKLGIILFVSTISINSFAKSMYDDVDSASDYDSTPYYENEGSLVFKMRLGGVVSSAKQKGLPTPTSPQPVSVGEVAKNGYGGDASTTIFFNNYLATELSLGFNVLRTKYTSLAAVAHNYGVDNVKLGKNKPIHMIPATITGQFHIAPYGGIRPYIGIGYHGSYMLTQATGLKIRNGHGAVGQIGVDFYAKDDTLINIDVRQFFLNPKLEYKPNLVGNKTMTSKVKLNPLIVSIGIGFTF

SEQ ID NO: 6723 - protein, 770 aa, Rickettsia canadensis
MNAQAQRKVKLKVLEKGTEQPVIAATVVYADNEALQNLQGSVTNVDGLAELKIPSKKTYYYKISYVGFVPATGKIEATETEKTVYLEEDHLGLNEVVVTGSRTARPIKMSPVTTQVLGGKQLVEAGYSNLQQALQQETPGLNIQKVGFGNEISMQGLDARHVLFLMDGERMTGDMAGNLDYERFNLHAIDRIEIVKGASSTLYGSRAAGAVINLITKKTTKPLSIDAGVRYGQMNERNYKNPQPKDFLYMFEKNADRPNLQGWVSAGFKAGKVTSQTDAWYSSSDAFYMYQAENDKKVYTQEANPFLPHDITVVNSSSRPPMGIEGKEHITVSQKLYYDPTDDLSVLVYGSTFFMNTYDLIQDMTFSQARDWTAGAKLTYHVKDWFSVTGSLHADFYDRFKRHERIDTRNKDYESSIWQPRLTITSNYFDGHSLIFGVEHTSDELTSDRFSGNANHDLKTRALKETEYFLQDEWTINPKWMVSAGLRTNFSKAFGFMGMPKIAAKYSPNERWSIRANYSMGYRSPSIKELFFNWDHLGMFMIRGNENMQPEKNNYFSLGAEYSNDRLFLSGTAYGNYFRDKIEGVWRIYDMQYNFEYTNLSKQRLLGLEALLRWHVLDCLTLNGTYSFVNVSKNEGIQVNTTSPHAATASLDYKFTKKNYRLNAVFSASYMGRKKFDVQDRVFVEEDNKSYDAYFRCDLPQYVLCNLSVSQTFYNKVKLTLGVDNIFNYVPKTLGSGITMFNVPATPGTRGWVQLEFMLDDVINSLRKKK

SEQ ID NO: 6724 - protein, 1658 aa, Rickettsia canadensis
MAQKPNFLKKLISAGLVTASTATIVAGFAGSAMCAATQQNRTTVGAATTLDGVGFDQDAANANLAVVPNAVITANVNHGIDFNAPAGSLNGLLLNTANDLAVTVSENTTLGFVTNAANQANFFNLTLAAGKTLAITGQGITAAQAGATKNAQNVVAQVNGGNAVANNDLSGLGTIDFGGVPSALVFNLVNPTTQNAPLILGGNAKIANGANGTLDVTKGFIQVSDKSFATVKTINIGDGQGFIFNTDATNGNALNLQQVAGSTINFNGTDGTGRLVLLSKNGTTDFNVMTGSLGGNLKGIIEFNTTAVAGQLIANAGPANAVIGTNNGAGRAAGFVVSVDNGNAATVAGQVYAKDIVIQSANAGGQVNFNHIVDVGIDGTTTFKTADSKVIIAENSNLGATDFCNLGVQITVPDTKTLTGNFTGDASNKGNTAGVITFAANGTLASGNSDANVAVTNNIKAIEVAGAGVVQLSGTHTAELSLGNAGSVFKLADDTVINGKVNENALIGGAVAGGTIQLDGSATITGDIGNGAGNAALHGITLADDASKTLTLGGAKIIGVNAGGTINFQANGGTIKLTSTQNDILVNFNLAIAADKTGVVDASGLTNTQTLTIAGSIGTIAANNKTLDQLKIGSSATTLNIGDVAINELVIGNNGSVNLGHVNYLIAKTTNASGQGKIIANSTIVGNIGGNNCNVTRLMAGTNLGSAEAPLSEFNFAAPTGGAIGTVLEVLGGASIHANNITTIAPNNGFFRFVGGGTSIISGTVGTPANKIGGVYLDGNSTVQFAGNSVFDGHTFISGNSTLQIGGDYTADFIASDDNTGIVEFVNTSPIAVTLNKQAGLVDDLKQITVSGRGNVVINEIGNAGNNHAIKTNTISFENASLGAGLFLPSDTPLDGLTIKSTVGNGTPGNLNAPIVVVSGIDSVIADGQAIGDQNNIVGLCLGSDNGVTVDATTLYAGIGTTKNNQGTVTLNGGIPNTPGTIYGLGVGSDSPKLKQVTFATDYNNLGSIVATNVTINDGVTVTTGGVVGTDFDGTITLGSVNGNANVRFVDSTFSSPASMIVTTEANNGTVTYLGDAYVGNIGASDANIASVKFTGNHNGAGLQGNIYSQVTDFGTYTLTVLNSNVILGGGTTAINGAIDLLTNTLTFASGTSTWGSNTSIETTLTVANGNMGHIVIAENAQVNATDTGATTINVQDNANANFSGTKTYILIQGGARFNGTLGGPNFAVTGSNRFVNYALIRDANQDYVITRTNNAANVVTNDIANSPFASASGVGQNVTTFVNATNTAAYNNLLLAKNSADSADFVGAITTDTSAAVTNAQLDVAKDIQAQLGNRLGTLRYLGTHETAEMAGPEAGAIPAAVAAGDEAVDNVAYGVWAKPFYTDAHQSKKGGLAGYKAKTTGVVIGLDTLAHDNLMIGAAIGITKTDIKHQDYKKGDKTDINGFSFSLYGAQQLVKNFFAQGSAIFSLNHVKNKSQRYFFDANGKMNKQVAAGNYGNITFGGNLMVGYDYNALQGVLVTPMAGLSYLKSSDENYKESGTTVANKQVNSKFSDRTDLIVGAKVAGGTMNITDLAVYPEAHVFVVHKVNGRLSKTQSQLDGQVTPFISQPDRTAKTSYNLGLSASIRPDAKMEYGVGYDAQIASKYVAHQGTLKVRVNF

SEQ ID NO: 6725 - protein, 610 aa, Rickettsia canadensis
MTNIRDKSLVFSSLALWACLLPTAVGAVEPTALEEVQADTTAIPSLELALNSDANDSEESQVFLAPSDLQTELDANSDKANSTVAELETLRLADHSVSTSPSVADLMEETKTDSVGQVTSVSQLSDVQPDDWAFQAIQSLVERYGCVAGYPNGTFRPSRAMSRREAAALVNACLDNLSNRFATKEDLDALKALQDEFAAELATLRGRVDGLEARVATVEAQQFSTTTKLSVDAVFTAQFGDSDNQAFDNSSDGLTPGVNQLADSRASAIGSVYMSFNTSFSGDDLLQTTLFFGNNGQDLFSNAQIGSTATLPFAQSAPLFNPGQYYFAGLPNNATLYRLAYTFKPVEDLAVTVAPLYYPTDIIDGNSYTSPFTGFSTWFLINNPLITPYITNFLGGAGAGFDWNFNGGPVSLRGAYVAVNGFSAVNTGPPNDGGLFGDPYQATAELEYAGELGDDSNFAIKLQFTNSETFGVQQNVVGVNAEAKFGQFGVFGRYGYSFADGQGVANPIPFAAGTVGRFDAQTWQAGAGIHDLLVPGSLFAVSAGMPFINNVASPGVGINDEDQINLEAFYRFPVNDNITISPIFSAILNPNSSSIEPNLYQGLLRVVFSF

SEQ ID NO: 6726 - protein, 717 aa, Rickettsia canadensis
MKKLLLILCLCLQSVVYGQTTISGIVTDSSNEPILGANVYLEGTFDGASTNEKGAFSFTTDETGTQVLLVSFLSFETKKVTLDVSKMQNMTIKLRENVDAFNAVILSAGSFEAGENAKVTALKPLDIVTTASALGDVVGALQTLPGTSTVAEDGRLFVRGGRAEETQIFIDGIRVFTPYTNTTNNIPARGRYSPFLFKGITFSTGGYSAEFGQALSGVLELNTINEPDQEKTDISVMTVGGALGHTEKWEKGSVSFSTSYINLAPYLELFPDRNEWIKPFQGGQGESVFRHHFENGTLKFYTAFDITDFELDQESINFDELVRFKLNNNNLYMNGSYKGVFGENWSVTSGLSYTRDNSKVRIIDDRINSLENSFHFKTKLKKNFNNRIKLSFGAEYFTTDFDEEFENPFVEKIDYGFKSNLIGAFAETDIFFSKNFAAKAGVRLDHTSLLEETTISPRLSLAYKTSEKDQVSFAFGQFYQNPNNNYLKFNSGFKPESATHYILNYQYVHDGKTFRAEAYHKEYNDLITFSGQFPQFGTDFANDGFGQATGLDIFWRDNKTIKNVDYWVSYSYLDTQRKFENYPVEAMPNFATKHNFSLVTKHWIDKLKSQVGFSYNYSSGRTYTNPNTTGFLSEKTKDYHSLSVNWAYLISPQKILYFSVSNALGLRNVFGYEYANQPDINGTFQRMVRRPAQDQFFFVGFFWTISDDKTSNQLDTL

SEQ ID NO: 6727 - protein, 820 aa, Rickettsia massiliae
MEIEAMTKTRIGVSALALSVAMGTAAAQDPAGDRPILDTIVVTATKTETTAQDAPLALQAVNGDTLDELNAQTFDDYVRYLPNVSFGGRGPGQSTVYIRGLAVQPISVLLSGAQGTTPNVALYLDEQPVTAPGRNLDVYAADLDRIEVLPGPQGTLFGASSQAGTVRLITNKPELDTFGAGFDASIATTKDGEMSNALEAYINLPLVDEKLAFRGVVYDVTQGGYIDNVPGTFTTDPAINPQSAATPSAVSYETADNNLLAEEDFNDASYKGFRGSFLWEITPETTAYLQYTHQKIEADGVFDYDPEVGDLDVTRFFPDALEDDFDQTAWTIESRLGMLDVIYTGAYLDRQINQSVDYTGYNNAGGFISYYTCTYDNPAYITAYDIDPQFITPGGRECLNPAKGVVIDQGQKRTTHEFRVTTPQENRLRATLGVFYDNFEIETVDDFYYLATPDLGFARNAPISDAVQIDPSLRPAGVAFFNDIRRTEEQLAFFGEVTFDLIPDVLSVTGGLRVYEIDSDFEGSSNFADGIFQGSENTDRGRDYDVSGGHTPEPLETDGTVFKANVSWTPRPDTLIYGTYSEGFRPGGFNRGGGLASINPAFPTVETTYDTDEVTNYEFGWKAELFDNSLRWNGAVYFVETSDLQVSRFDPENVSILTFIENAADAEIFGTEGDLTWAATPELTLFGAYSYNDTELTAVNAEVIELAPVGSELPLVPELQLTSRARYELPLGTYNAYAQMGIQYASESFSSLADEIREEQEAYTTADLAFGAGKDGWNAELFVENLTDERAELFINEQDDIRRITTNRPRTIGLRMSYNY

SEQ ID NO: 6728 - protein, 244 aa, Rickettsia massiliae
MLRIVKKLGIILFVSSISINSFAKSMYDDVDSAPDYDSTPYYENEGSLVFKMRLGGVFSSAKQKGLPTPTSPQPVPVGEVAKNGYGGDASTTIFFNNYLATELSLGFNVLRTKYTSLAAVAHNYGVNNVKLGKNKPIYMIPATVTGQFHIAPYGGIRPYVGVGYHGSYMLTQATGLKIRNGHGLVGQIGVDFYAKDDTLINIDVRQFFLNPKLEYKPNLVGTKTVTSKVKLNPLIVSIGIGFTF

SEQ ID NO: 6729 - protein, 1813 aa, Rickettsia massiliae
MNLQNSHSKKYVLTFFMSTCLLTSSFLSTSARAASFKDLVSKTPAWEKHNSTQQQNIWKDLTPNEKIKKWQEAALVPSFTQAQNDLGIKYKETDLSSFLDNTRHKARQARAEILLYIERVKQQDFDTKKQEYINQGVVPTDIEAATNLGISYDPSKIDNKVEHDQKVRRAEKDKKAVIELYVSSINRGIKYKHYVDNDIIPEMQEVRTALNMNKDDAQSFVASIRTEIMENAKGQYIADSHIPTEKELKKKFGISRDDNRDGYIKSIRLKVMDKEKPQYIADSHIPTEKELEQKFGVDKGEATNYIASIATQMMLGKKSYYIDNNIIPNADELMNEFKIGPVKATSYINQIKAGIEANQFLNNNDTTKPSTGRLSTKERKQKQPWYMSNQSIHNTETSSQISTGRDKKQRYFFDSISTFKTQFNAKANKGNLTLSQQNINKLIEQEENIEQFKDLIKTNPIAALLLQVDSSYKNQAVKIILKDRNDNTIQRLLFTNDTGQLDFNTNIKVKNRPILQTFLNNSTSKDKTKFAEIIQDYATRNISNSQFEEKARLDLIKIAASKDKSSVENFLTLQLELKNRMQPYIVNSVYILTPEIVKEINIELKNKGLIRDSLTKDYMIKLAKEVNNHTLNSVIKVILSDSNILSNEANKILGLAVGNNANNLEQTQSDIPNPPPLPLNGGIPNPPPLPLNGSIPPPPLHSQGFISNSQHFDLNQLQTEYPHIHSLYIQFTHNTTVQSKAPLQPTASSTTSTVRSTPETAYAKLYAEYRTETGGTKANDLQDQLIKRQADLTNVIRQILTESYANQGADEKTLLNLFSISTPEIAEKAKKLLHPCSRPVYKRYNRNGKKTITSEEIIKNLFNEDTDDAVKRILLSSCKISEELKRPIKLKFNQSELIRKLQGKQNPFKQLEFAYINAKNFDQDIFGNRVDELINNPNILTIVQQATFLITEDTNLRKTINSDQAQAKLDDLRTAILSTIKFEELITANLPQHDFIAIVKEKDPELLKEFLKATTLKVTGNNNLDQLRLALPSFTGMSNEQIRILSNKLNLSIILQALQECSQEKATKYIHTGNMPPPPPPPPLPNSQDLESAYLASLGITKSTSTFKTKTTPKTYHFRSDIALKYKEFTLSGQKSAGYKAAYSDADLLKKAIVESVAFEHSKIYLKLIKILIILNKSKKQSTLCTQFTGPRTEMGQIIHNIYISKLLELTKDKEFIKYVEDNIILNKKLTKAFILLARFIDSRTRLEQKIHDIYIQQLTKYPEEEAVKEAFNTATLDFIGPRTEIGQEVHNIYKSQLLELTKDQELFLFTQQILAESTELEQKYGSDIQSENSDNEKTVGRLDNEKTVGRLDNEKTVGRLDNEKTVGRLDQEKLQSFKQENEATNDESSTKDDTQPEDSNKKSEQSDSKTALSPRLLSSNDSKNDKSSDDKKSLLALRSSDEDDTGYATDEEELEESNSTTDEELKKDVVLESEDEAIDVSFKTEAITEQDEVTQRQQVSDYTSGKVAILVQATSTLHKPVHYNINDRLTIAAIGAGDEETSINRGVWISGLYGINKQRIWKNIPKYQNRTTGITIGTDAEFINSHDVIGIAYSRLESQIKYNKKLGKTTVNGHLLSIYSLKELINGFSLQTITSYGHNYIKNRSKNINNIIGKYQNNNLSFQTLLNYKYRTKYDLHFIPNIGFQYDYSRASNYKEYNVDIENLMIQKKSNQLFESSLGGKIVFKPIVTTNNIVLTPSLYGNIEHHFNNKNTKVNAKATFKGQTLQETIITLKQPKLGYNIGSNILMSRKNINVLLEYNYYTHRKYQSHQGL

SEQ ID NO: 6730 - protein, 1014 aa, Rickettsia massiliae
MMAQGSLTVTGKVIDGTNNEPLIGVNVSIKNEPGLGTITDINGKYIIKNVKPYSILVFTYVGFATEEIQVKDKSKIDLVMKEDVNNIIDEVVITGTGLKKKVNLTGAITNVNVESLKSNPGGSISTSLAGVVPGVQAITTSGKPGSTSEFWIRSISTFGANASALVLVDGFERNLDEINVEDIESFSVLKDASETAIYGSRGANGVVLITTRRGKSGKININVKGETFYNQPTKLPDFVDGYQYASMANEARITRNQDPLYSPEELEMFRLQLDPDLYPSVDWLDVMMRNGSWSGRGSISMTGGGNTARYYVGGSFLSQQGLYKTDAVMKDYDTNANYNKWNYRVNVDIDVTKTTLLKLGVAGALDTQKDPGTGTWNIWNALMGYNPILVPVMYSNGYVPTYKDEGGGGFNPWVQATQTGYRESWNNNMECTLELQQKLDFLTKGLSFKFRFGYDTYNSNWKNFIKWPNQYRATPHYRDENGELLFTRIVEEKKMEQTSGSNGSRKEFLEWQFDYSRVFFSNNYVNAVLKYNQQAEIKTQNVGSDIQNGIDRRNQGFAGRFDYNWKHRYYVNFNFGITGSENFHKDNRWGFFPAASAAWNISEEPFMKRLFPWLDLFKVRYSWGKVGNDNIGQRFPYLYTLNTMGGFNSGDFGYSRGWEGRKYDQLASTDVSWEVSTKQDVGIDFAIFNDMFTGTIDYFKEHRTGIYMSRNYLPYYVGLQSNPSANVGEVKAHGMDGNIAFNKEFGDVSVTLRANMTVSKNEIVERDEMSDVYEYRLQKGHRVNQAKGLIALGLFKDYEEIRNWPNQGDVMPGDIKYKDVNGDGNINSEDEVAIGATTKPNLTYGFGVTAKWKGFDVNVHFQGVGKSSYFINGSSVWMFTNVNGDDNTAWGNILSAMASGNRWISHEISGTMDTEDPNADYPRLSYGGNSNNYRNSTFWLRDGSYLRLKTLDVGYSLPSNVVRKIHCNSVRFFFIGTNLLTWSKFDLWDPEMGSSDGKNYPLNRSYSLGVSINL

SEQ ID NO: 6731 - protein, 930 aa, Rickettsia massiliae
MAMTAIALVHAAPSLAQDAGAPQESAAAGTADQIIVTGTRIARDGFQSPTPLTVVTQQEILNQSPTNNLADFINQIPALAGSTRPANSRLAISSGLAGINTMNLRNLGEVRTLVLLDGRRSVGSTITGLVDINTFPQALVKNVEIVTGGASAAYGSDAVAGVVNYVLDKKYTGFKVNADVGITDRGDGFNYSFSGAAGMDFADGRGHILVAGEYAHKDGIFEVDRGWNQIGYRTLSNPDYTADNGQPANIVVRGAGTWNSTPGSIIRSQVGGTTALRGTYFAQGGVAQQYQFGSITDSSQTVGGDWQINDTSRRIGLDATDDRRGVYGRLSYELADWIEVFAEASYNWNKTLFNAGPQAATFTLQSDNAYLIQALGPAALAGVTSVSLGTSAADLPYRKNNSTREVQRYALGAGGEFAAFGNKAVWDVYAQYGQTDTHEQLRDIMNTARLGLATDAVFAPDGSIVCRSTLTDPGNGCIPLNRLGIGVANPAAVDWIMGDPYRNQRFKQTVAGANLSVTPFATWAGDVSVAVGGEYRKEEVSGFVPPEFSSGWSVGNFRPTFGSYNVKEAYLETLIPLGLGAEFNGAVRATDYSTSGYVTTWKAGLTWQPIEDIRLRGTRSRDIRAPNLNELFQSGTSRTNTFATNTAVGQYAGATFRELTTGNLNLDPEKADTLTLGAVLQPRFLPGFSFSVDWFRTKVSDAISQFYADDIAQRCTEGFQSFCAAIVPDPEGVRDYFVSASPFNFARVKVRGIDYEASYRVPLDKIFNGSSSNLTLRGTATNYLENTVDNGISVPVDTVGQNSGQSSTPDWIFRMSATFDTPTYSVTAVGRGVSSGTYNNTYIVCTTNCPTSTATNPTINSNHIDGTFYTDLNFTAKINVGGADGQFFLNVTNLFDTNPILLPETGLSANSTYSDLLGRAFRIGVRFKTN

SEQ ID NO: 6732 - protein, 246 aa, Rickettsia massiliae
MKKLLLIAAASTALLTSGLSFADCDMNSSVASSTNSSMSSSVENQWYLKLNAGGVIFNKTKPKGADFKLNNIKKSNTGFTGEIGAGYYIMDNLRTDLTIGTVASSNLKKSKTYPDGNSFSVKNKPTIVSVLLNGYVDFVDLSMFKVFAGAGVGAAFVKEKINSKDIKGGVTDTFNGTTKNKTNFVYQLSLGTSFEVAQGVKAELVYSWRDYGKTKNTTKTIDGDKVKFGGTRYKGHNLIAGLRFDM

SEQ ID NO: 6733 - protein, 803 aa, Campylobacter jejuni
MEQFISFANKRETKFQSRFVIGSSIVLALLCSSLNAIEADFTTDYTLNLSGSSLDGDTIKVGTPSSKKSFELDKITEANGVAYMAGASKNNDITDYTLNANINSVVYLQDTVVSLIGAFSENGNVFKNKINVTQTPKTYKRYLDVYGGYTMRANKSANKNIVTILNSNITGGVLGGYSKLGSANLNKVIIKASSVDRDVAGGNSSIGNSNSNEVYIEQGTAVAGDVFGGGQYYNKVFIKSSSINGEVYGGEVDNGDTTKNSVTINSSNIVNNIYGGYSNNGNAFLNTVTVASSNINSIVGGASENGNAINNTVNISHTGGRNKTKLGKYFLVKGKIYGGNSDKGKISGNTLNVKGKDLIAGNIANFENANFYLPKDITTNDIVLQLTNDEDTVLNNVKVIPNEEDGKVVIKNFLPNNKIYIIKKAHIDSELKATDNAEGKLIINGTQELTKNKYISELGASATYDLKLQNDGSNLLLLSAEGTVEPSNPGTVEPSNPGKPIVPNINAKINHALIPNLASTAVVNKSDNDIIKNISNINAIIDNNVSTNTDNLISFAYIEGYKSNIDKNDIDIDGVNVTAGVASRSDNILGGVFLEYAYGDYDGKANSYKSDGDINAYALGALARFDLPYNLFIDSYAKIGRLNNDYTLKGYDNLNVDKDSTFYSLGVFLGHNAYFDSFNLENRIGYAYANVNGYDININGETLKLKDITSQRIKYNGTAYYQTNENTNVYATAKLEYEFDNESELYAPNINKNISSKNDGFSAGGEVGAIYAINPLSNISFGLGAMGGKVDELSANLKFVYEF

SEQ ID NO: 6734 - protein, 690 aa, Campylobacter jejuni
MTQIKNMKFKKSLLCFLILSGALLKAEEKYQLNDVVVSASGFEQDLVDAPASISIITKEELEKKPIKDIGEAIGDIPGVDVTMNKTGTYDFSIRGFGSSYTLVLIDGKRQSVANGFYDNGFSGSESGYLPPLSMIERIEVIRGPASTLYGSDAVGGVINIITKKNPDKTEANIEFNTLLQQHSNHYGNAGGFNAYVATPLIEDTLSISARLKYYDKAASDLKWPTPVWNNGNQRPDNYQIASHSPGAFTSLGFGSRLNWTVDDKNNIYFDIERYINEISVNSTSSRAIKSERQLFKDNIVLNHDGNYDFGSTNSYLQYGSTKDKELHSQIWVGEGKVVLPWNLGQYGNLVNTFGARIDYEILKNDQASAGSQIRGKNLDQTTVALYGENEYFITDDLIFTTGLRYIYSDLFDSEFTPRVYLVYHLNDNIALKGGVSKGYKTPAAKQLTNGYYNYANNNAYFGNPDLKPEESINYELGVDFMVFDFAHYSITGFITDFTNQISSEDLTGMQNDINCSNGIVCKRPINLGKTQTKGIEFAFNTKTYNGFSLNSSYTFMDNRYKDGQKNWFGGDRIENLPRHIAMLKLNYERGKFSSYIKTRARLDTIAKAKGGGNGSLPWQKYKPFYIVDLGINYKINKQSSLSFAVQNLFDKNFFNPQVTRWDGANPAGYANRYQDYTEGRSFWLSYKYDF

SEQ ID NO: 6735 - protein, 912 aa, Campylobacter jejuni
MKKMYMAMAAFLVTAIAFSQGTITGTVVDGEMGGPLPGASVVVQGTTNGTSSDFDGNFSIDVDSDSGTLVVSYIGYVTQSVPFSSTGNIGSISLQPDAQELEGVVVTGIMDIAKDRETPVAVSTITASVIQEKLGSQEFPELLRSTPSVYATKTGGGFGDGRINIRGFDSQNTAVMINGIPVNDMENGSVYWSNWAGLSDVTTAMQVQRGLGSSKLAISSVGGTINIITKSTEREEGGAVTASAGNDGYLKTNVAYNTGKMENGFAASVLLGRTAGDGYINGTAFEGYNYFIGLGYEPNDRNNFQFMFTGAPQVHNQRTSSFFNTATVAQYLDYGAKYNFNQGTLNGEEFGIRRNFYHKPVASLNWENIVSDKSTLSVSAYASFGRGGGTGDIGRLDGKFASDSRLRDNQGNMLYDAISASNGGTFTDFNGFSYGNSLDPYTNSYIVNDDSLRDEVDPSNPNALPGVVRRNGMIRRASVNSHNWFGAIANFHTDVNENWSHDFGIDIRKYKGIHYRRVDNLLGADGYRDNDNVNNRFHVVTQENPSEISNLWNVFKSIDNDKKIDYYNDGLVRWYGAFGQIEYKNDITSLFLQGSVSQQGFKRIDYFNYLDSDPAQETDWENILGGNIKGGLNVNLNEANNVFVNAGYYSKQPNFDAVYIDFQNNLNPELTNEKVLGIEAGYGLNLGDFRTKVNVYRTSWKDRFISVGIEDNGNANINGVEQIHKGIEIEADWRANEFVSFKGMLSLGDWEYGGDATGKAFDDSQTFIRDVTLYLDEVKVGDAAQFTSNIEMIVRPCEGLKLSANWYTASDNYAFISADDFDSPDHDGSLRLPTYNLFDAGAYYRFNLGGTNTVSLAVNVNNIFDSEYLAESLTNYFPGDRGNASTYQGINTSNKAFFGFGRTWNASLRYNF

SEQ ID NO: 6736 - protein, 319 aa, Campylobacter jejuni
MKKIFLCLGLASVLFGADNNVKFEITPTLNYNYFEGNLDMDNRYAPGIRLGYHFDDFWLDQLEFGLEHYSDVKYTNTNKTTDITRTYLSAIKGIDVGEKFYFYGLAGGGYEDFSNAAYDNKSGGFGHYGAGVKFRLSDSLALRLETRDQINFNHANHNWVSTLGISFGFGGKKEKAVEEVADTRATPQAKCPVEPREGALLDENGCEKTISLEGHFGFDKTTINPTFQEKIKEIAKVLDENERYDTILEGHTDNIGSRAYNQKLSERRAKSVANELEKYGVEKSRIKTVGYGQDNPRSSNDTKEGRADNRRVDAKFILR

SEQ ID NO: 6737 - protein, 806 aa, Campylobacter jejuni
MHPFPTRSCHRMNCKTSPLAVAVVLALSFSASTAVAQSQAPTQKTLDTLIVTGTRVADRTVAESASPIDIISPQALESTGTTELATALSRAIPSLNFPRPAISDGSDAVRPAQLRGLSPDQVLVLVNGKRYHSTALINLNDTQGRGSSPADLNTIPIAAVERIEVLRDGASAQYGSDAIAGVINIVLKGSGEGGSVNGRYGKYSAGDGEQYQLSGDAGFSFAGTGKVHLAAQAGHSDQTNRALPFQGRVEQRYGDPEIDQGAVSFNGEYSPTDYLTFYSFGMVSRREVLSNGYFRFAGDNRNRPEIYPDGFLPQIYNVSKDVSWVGGLKTSTEGGLNIDLSYNYGQNNLTFDVRNSLNNSLGLASPTDFHAGTLEVTQNVLNADFTKTLDWGLAYPVALAFGAEWRGEKFNQSPGDAASSANGGIPSANGALIPGAQVFPGFKLSDAGYYNRNSHSAYVDLEADLTEKLSAGLAGRYEKYSDFGDTATGKLSLRYALTDKVALRATASTGFRAPSLQQQNFQSIATQFLNVAQPNGGVSAIPFEIGTFRTDNPAAIALGAEPLKAEESKNYGLGVVLQPVENLYITVDAYRIDIDDRIVLSENLTSIAARNYLQANGFPGIGGGRYFTNAVDTKTQGVDGVGTYRWNLDSGSVELTTGYNYNKTEVEQIAANPPALEAIDPGAVRIGRAELGRITEGTPRDKFFLGGTWSPGNWSFTGTATRWGEFTTFGTNAGSDQTYAAKWTLDLAASYKLGSWNFTVGGDNVLNEYPDRQEAGLGTRTYLPYSSASPFGFNGALVYANVNYKW

SEQ ID NO: 6738 - protein, 956 aa, Shewanella sediminis
MKVQKRPALWVLSAVVALLAPAAVSLAQVGDAELAGVVTDPSGAPVASAKLSLLNEDSGVNRALLTDAEGHYHFPALAPGRYSLKTEASGFRSSSLTGIVLNVGTHLETNVALIVGNVQEQVTVTAETPPIDTSKGDVSGVVTQQQIDTLPVNTRQYLNLALLMPGTTQDASRTFYNNVQIGGGGRFYANGFVVDGVTNTWAEQGEPRQNFPEGAVQEFRINTNQFKAEQGLAMGGLVNVVTKSGTNHFHGEGFEYFRDSALNHDNKFTEQAFQSVGRTGKAPFRRNQFGGDIGGPIVKNKTHVYVAYERTQVDDSFTIFAAGSHQFYGANEGVIDKPSHDQMFNVRVDHSISNTQHAFARYSQEWNKQTWQGCGGTVESNCYDGLIPRHSFVGGHTWTAKPTLVNEFRFQYALASYLLGPSGQPIFTSLGQYPAERLAELQTVYSFPSYRYGQGYGELGTEKRWEFKDDISYVRGNHTLKFGFDFSRIPFADDTVINYQGTWTFATDQPFNPKDPSTIANLTKPTQFTAAIPGQYTSVPVNQYGAYIQDDWKVTPRFTLNLGLRWDKETGSYNEGVNPTSFPRAIPYLGNPGDRGQSRNFGPRFGFAWDITGEAKNVVRGGYGIYYNNIQTLLNFPENRNISQCNVLIVNPTYPDPYGGKSPSSFCSSAAPTVTVLDRNFAMPYSQQFTLGYSREIVRDFSIHLDGVYMHTLKDWRTVDVNYPNAAGVRPLPDFARILDHESISQYKYRGLYVRAEKRFAKRYQFLVSYTLASNRDDNPQAQVTNQASYNLDWGPANIDRRHALVASGSTNLPWKFNLGVIWQARSSLPFSAFSTVQVDGITQFIPGLARNMGNRNNGAVLAAVNAYRASLPTPLAPFTASQIDSSRFDSFDIVISRPIYVRESFRVEARGQAFNLFGTTNLTGGTTTSASSANFGKILNASNLQQAELALRVAF

SEQ ID NO: 6739 - protein, 923 aa, Shewanella sediminis
MKYLNVLRGSAVSKKALLGAATLSLIATPSFAQEEEQSEEEVKTYTVTGSRIRRIDLETPSPVLVISREELDSTGFATVGDALRALPITNGQSLNSADAGTSFTPGVSSLNLRGLGNNNTLALINGRRAALYPSPGFDGFQSVFDYNSIPVSAIESIQIQKDGASAIYGSDAVAGVVNIELRKDFEGLQTQISFGDTWDTGSFEKKFFGIVGTSNERTSIVYTVDFMQKDALFARDLDYTDSADASDLGSFDWSSSAPPSANVRGLPYNGGADPIYADDGETITGYLPITHPQLLLPGVTTGEAANLASNQLFPSGWATAGGNNLLPYTSPIGLNDFSDGNSYYNFQEEQVLFPEMKSLGFYSFITHQVSDTVKAFAEASYRRLEMNVVAAPTPAFFFNEIGDSPTGLLQLPADNPYNPFGVDLDTLRWRMVESGPRENDLVIQYPRLVAGLEGEIGFDWTWETSVAYSKSSQVNYNRNSVVDDLLQDALNGVVIDGETLYANPFGTNDPRVIDYFTVENPNEDSYEALILSANASGVLMDMPAGPLGVAFGLEYREDSLETIGTILNETSQIVGGSAGTNTFGYRNVTSAYSELSIPVLENLEFQLAARYEDYSDFGDTTKPKAAFKYRPADWLLFRASYGQSFRAPDLSYLYADQSTSFSASQIIDPKNPDVPAQQIRQITGGNPDLGPEETDVTYAGFIISPKDIKILKDFEFSAEFFQFEQSDLIDSLGAAEAISLEDVLPNVVVRAAPAPGQQFGQILYVNSNFQNIDSAEYKGYDFSIKYTKETDNWGDFRAAMDATVVDSFTYDGSELSGTDNRPKWRGTTRFAWNKNDWAASMYVVYVDSYPSLYDIYGVPDTESQWLFNPQVSYSGWYDTRVTLGVRNIFNSEPPRDKDESMTVNTSVNSIEPAFWYMRLTRDF

SEQ ID NO: 6740 - protein, 676 aa, Shewanella sediminis
MAKAEDDGENDTEAVPASDADASRVFEPAYFAQFAPRNALDMVSRIPGFTISGGNNNGQRGLGQADQNVLVNGERFSSKSDSLRDQLRRIPASDVVRIELVDGNTLDIPGLTGLVANVIYTRSGASGQFRWDSGFRPHNTEAQLYGGEISLTGSKGALDYTVSLSNDNDRFGADGPTIITDAEGALIEEQYTKFSGAFDNPKLSTAFAYDFGGETVANLTLSYGEDFLFRNEPETGFRASGPTRFRDVEVRENGPEYEIGADIQLPLGPGKLKLIGLERYERDNFSITLVDSFDDGSDAVGSRFRQTNGIGERIGRAEYGWAMLGADWQLSGEAAFNRLDRVSSLFELAPDGQFVQLAFPEGTGGVTEDRYEGSLSVSKALSSTLSVQAIGAMEFSRIEQTGAAANSRSFKRPKGSLATTWKPADDFDVSLTLARRISQLSFGDFLASVSLNDDNENGGNNELVPYQSWNVELEANKRLGPWGSVTFTARQAWFEDFIDWFPLEGGGEARGNIGDAERLHLEANATINLDPLGVKGARLDLRGVKRWMSVIDPFTGEDRPFSYDQRGLLDFGYRHDIPKTDWAYGAGIFSQDDAPYSRLYEAGRSWEGPTFASVFVENKDVFGLTVEASVANVLGARNKFYRTVYDTPRPDGEIAFVEETDRRIGPIFRFSVSGDF

SEQ ID NO: 6741 - protein, 287 aa, Shewanella sediminis
MTLKKQSALAAASGALVAGLLFSSAASAVEVPEDIHAADYHWMNWHLYRGIDQRGGPYKFDDTYFEIEFGGRSGALDFFGYVDFLDILGDSGNSDKNRGDNFFADIEPRLSIDYLTGMDLSVGPIKEWYLAFDLLMADTGPIGGLQVLWSGIGTDTELPWLGKTGIAVYARYVGENYGAKNEGSWDGYVAHINWFKPFYHNGDDFVAFQGYADYEFASDLGDDDPARSSDSFQSYLGVWYHSKQWAVGYGAKVYRNMTQFEDGAPGFAGPDQDTTGVGHYFNLTYKI

SEQ ID NO: 6742 - protein, 250 aa, Shewanella sediminis
MNKKWLALALFTTPPAMADDLIQWWDMSITAIHGDNYDLAPSEKQTTFTFETAGAWRYGDWFAFQDLVYFNGDNAGKDSTTYGEISARFSAGKITGNNIELGPITDLSLALTLEEGEGPVKSFLYGLGMDINIPYFSYFNLNTYRREALSSDNISDGWQVTPAFRMDFPVGSSNIVFDGFFDWVFSTDDANYEKNFHFNPQLKYDLGAVILGEHKKNKLFIGIEYDYWKNKYGVKGIAQSTYSVLAKYHF

SEQ ID NO: 6743 - protein, 381 aa, Shewanella sediminis
MKKQLAGLALLAGATGVAHAQSTVTLYGVIDVAIGYQTHTNPSGDRTIGLQQGNEGFLSGSRFGLKGNEALGNGWKAGFTLENGFLANNGKLDQQGQLFGRQAFVKLGHERWGELALGRQYTTGNTMLYYVDPLGVGAAPTNSWQVYLVGQRYDNAVSYTGTYGPMQVIAEYAFGGIAGDTRARSSMSLGVEYESGPVTLIGDAQQTRDTQSRRARIYLAGAKAAIGSVNVFANYLHSDRDAGFDSSNGGADTASITSMASGSPTAAVTINSVFDSHRRDDFFTVGASWRATPVWNFVVAGMHNRTLADGFNGARSTVYGVADYSLSKRTDVYVATSYEWTRGGWSGLFGNTTTNAAAAKGSALNGRNEQLSVLLGLRHFF

SEQ ID NO: 6744 - protein, 700 aa, Shewanella sediminis
MKPQHIFALSSLVLAMGFLVQPFALAAEQQNADNNDQNIEKIQILGVRYKRVSQGATGLTMEIDETPQSISVVTNEQITNFGANNLNDVLRLATGINVEEWETNRTQYTSRGFEIKSTQIDGVGLPNDWGIVTGAMEAYGYEKIEVIRGANGLLTGIGNSAGTINYVRKRPTNENEGEVGVSYGSDDFKRVQADYSALLTESGSWAGRVVAVVEDKGSYLDGLENDRGYIYAVVDGQLTDNSTLTLGFSYQDANTDGNTWGGLVFNYTDGTQAEWDTSATTTQEWTMWDTSNTTAFVEYTYILPNDWDLKVAYNHQGLEDESKLFYASGTIDKDTGLGLNGWPGRYDTEFSADIVDITTIGHYSLFGQDHELTLGLSGSQSKKYMYQHPFDFAATPAYGPTPAFPYDLNAIPEPEWGDKVEYSDIDVSLLRAYGSTKFNINDSLFVVAGFNAIKYTREGINSGVDIDNDESEFSPYAGVVYSITEDINTYFSYSDIYQPQEQYDYDGYFLDPTKGVNYELGLKTLWLDNDLMATFALFSAEQNNLASYAGLNANGNYYYKGVNVESKGFEVEVTGYITDNLNAVLAYTLLDVEDDNGAEANEWAARNVVNFSMDYTIPQLPEVSVGFGGRWQSETKNVDSNVEQDAYLVVNAFASWDVSEDLNLRANINNLTDEKYINSLATIGYYGAPVNGSVNLTYRF

SEQ ID NO: 6745 - protein, 690 aa, Shewanella sediminis
MRSDLPLSSCLGLLAALAATQPALGASSVELGRVLITDEEQNELTAASERLREIPGASNLVDMQRVGQGRVASNQDVLAYQPGVFAQSAGNDGIKLSIRGSGLNRAPGAHGSGVYTMFDGLPLTGPGGTPYELFEPLWLSRAEVLRGANGFDQGSLALGGAINYVTHTGYDAPALQVRYEVGSRGYQHRHISSGQVLGNLDYYVALTDTEYDGYQAHSSGSAKGIAANVGYRFNPDLETRFYLRYRETENELPGRLTKDQIKHHPRAANPNYLARDDSRPQPGSTWVGNKTTFYLDDEARLEAGVVYHDYPMDLREGPMRLKVAYTDVSGTLNYFRRDTLFGRESKTTVGWRTTKHLPNSGASQFTRNGDVFGERTRDFTYQGSDTVLHVGNDLELVPNLWLSTGLAMIYTRRESDVTYPAEGGKVSMHDWDYAPRLGLRYDIRPDLQVYGNLSRSVEPPHPWSLIWSAPSTGGKQIQPIEMQNQTATTLELGARGDSALGRWDLAWYYSQVRHELLAVEVVPNFTSEFNASATVHQGVEAGLDSTLWERAGTGKLSLRQAYTFSDFHYRDDDTFGDNRLPGIPMHYYQAELRYDWPSGFYAGVNTQMASKVQVDYANSYHADEYALLGARVGWDSPKQDWQTWLDLRNLTNQRYAATVTPAYNDAGQDNARSTPGEGFGVYAGVSYSFR

SEQ ID NO: 6746 - protein, 926 aa, Shewanella sediminis
MRPSLYKILISSTLTLPISFHFSQLHAEVALTQESILDANGAFSPQSTSTAGGTIYNVESDISIVDVGQTAALASSAFVQTADNLTFKGNNHSLSITNANAGANPAGINVNTADKILTLTDFSKLSFKECPSSLVNTGKGAMKSGGALNLANNASILFDQNYSAENGGAISCKAFSLTGSSKEISFTTNSTAKKGGAIAATGIAHLSDNQGTIRFSGNTAVNSGGAVYSEASMTIAGNNHVAFSNNAVSGSSDGCGGAIHCSKTGSAPTLTIRDNKVLIFEENTSSAKGGAIYTDKLILTSGGPTAFINNKVTHATPKGGAIGIAANGECSLTAEHGDITFDNNLMATQDNATIKRNAINIEGNGKFVNLRAASGKTISFYDPITVEGNAADLLTLNKAEGDKTYNGRIIFSGEKLTEEQAAVADNLKTTFTQPITLAAGELVLRSGVEVEAKTVVQTAGSLILMDAGTKLSAKTEDATLTNLAINPNTLDGKKFAVVDAVAAGKNVTLSGAIGVIDPTGKFYENHKLNDTLALGGIQLSGKGSVTTTNVPSHVVGVAETHYGYQGNWSVSWVKDNNSDPKTQTAIFTWNKTGYVPNPERRAPLVLNSLWGSFIDLRSIQDVLERSVDSILETRRGLWVSGIGNFFHKDRNAENRKFRHISSGYVLGATTNTSREDSLSVAFCQLFAKDKDYLVSKNAANVYAGSVYYQHVSKFDDLTRLFNGPNTCCSGFSKEIPIFLDAQITYCHTANNMTTSYTDYPEVKGSWGNDTLGLTLSTSVPIPVFSSSIFDSYAPFAKLQVVYAHQDDFKEPTTEGRVFESSDLLNVSVPIGIKFEKLSYGERSAYDLTLMYIPDVYRHNPSCMTGLAINDVSWLTTATNLARQAFIVRAGNHIALTSGVEMFSQFGFELRSSSRNYNVDLGAKVAF

SEQ ID NO: 6747 - protein, 383 aa, Shewanella sediminis
MRNGRLAARAATTRFHQVGESGDQMVKHAVAAAVIGMSAASGASAQSSVTLYGSLDAGIAYVNNVGGHAKWAMIQGNTQPDRWGLKGKEDLGGGLSAIFQLENGFYTNNGQFATANTIWNRAAFVGLGSDRYGTLTLGRQTPLSFDYLDPLSTAYLALSWYAFHPGNIDGLAATGNVPYNNAVKYRSPSFAGLSAAATIALGNTTNFSTGKSVGVALNYANGPFKASAVYSNEHDRSILIGQTGIASFQGQNTANGYVANKVENIGAGASYQFGDFLVHGLYTRTKMQSNGYSDTFQSYDAGVNYRSSAFNTIAGGAATTTLAGRRWTQFEIGDIYALSKRTQLYANVLYEHASGGAKAAFFTAGASSTANQVIVLTGIHHSF

SEQ ID NO: 6748 - protein, 412 aa, Shewanella sediminis
MMNKSYLSVLVLSALAVPAIADTSIDQMFSQGTLKGEFRLFDFTRDFDNTTNTKHDTSFGGLFYYNTAKVNGISFGTSFASANPVWTNDSDDVYGLVARDAKGDHDNVNRLQEYFVQGEWWNTKLKLGAQELRTPMMNPHDIRAIPRTFRGFSAENKSVDNLTLSALYITDSMGWSDNSFISVKDAVQNELARAGVIADVADNPVYALGAKYQLPFETIKTEVDLWHYRMEDVFNQTYAKVKLSSQLGATNVYLTPSYLTQEATGDKTGGSLDTYQYGFHLGAKFAGTDITYIYAKTGDDTVLTPWGDEKVVIQQVNQSARADEEVNALKVAYDFEKVGMSGLEAYAFYGQYDVPTGTAKDFNETNFSITYKFSGALSGLGLRARYAMIDVDQGEDYDDLRLYITYKFVLGQ

SEQ ID NO: 6749 - protein, 980 aa, Shewanella sediminis
MPFSLRSTSFCFLACLCSYSYGLASSPQVLTPNVIIPFKGDDIYLNGDCVFASIYAGAEQGSIISANGQNLTIVGQNHTLSFTDSQGPALQNCAFISAEEKISLRDFSSLLFSKNVSCGEKGMISGKTVSISGGDSIVFKDNSVGYSSLPSVGQTPTTPIVGDVLKGSIFCVETGLEISGVKKELVFDNTAGNFGAVFCSRAAQGDTTFTVKDCKGKILFQDNVGSCGGGVIYKGEVLFQDNEGEMLFRGNSAHDDLGILDANPQPPTEVGGGGGVICTPEKTVTFKGNKGPITFDYNFAKGRGGAIQSQTFSLVADSAVVFSNNTAEKGGGAIYALEVNVSTNGGSILFEGNRASEGGAICVSEPIAANNGGLTLHAADGDIIFSKNMTSDRPGERSAIRILDSGTNVSLNASGASKMIFYDPVVQNNPATPPTGTSGEIKINESGSGSVVFTAETLTPSEKLNVINATSNFPGNLTVSSGELVVTKGATLTVGNITATSGRVTLGSGASLSAVAGTAGTCTVSKLGIDLESFLVPTYETAKLGADTTVAVNNNPTLDLVMANETEMYDNPLFMNAVTIPFVTLVSLQTTGGVTTSAVTLNNADTAHYGYQGSWSADWRRPPLAPDPSGMTPLDKSNTLYVTWRPSSNYGVYKLDPQRRGELVPNSLWVSGSALRTFTNGLKEHYVSRDVGFIASVQALGDYVLNYKQGNRDGFLARYGGFQAVAASHYENGGIFGVAFGQLYGQTKSRLYDSKDAGNITILSCFGRSYIDVKGTETVVYWETAYGYSVHRMHTQYFNGKTNKFDHSKCRWHNNSYYAFVGAEHNFLEYCIPTRQLARDYDLTGFMRFEMSGGWSSGAKETGALPRHFDRGTGHNMSLPIGVVAHAVSNGRRSPPSKLTINMGYRPDIWRVTPHCNMKIIANGVKTPIQGSPLARHAFFLEVHDTLYVRHLGRAYMNYSLDARHRQTTHFVSLGLNRIF

SEQ ID NO: 6750 - protein, 398 aa, Shewanella sediminis
MKKTLVASALAAVIFFPSVSAIEIYKDDKNAVEIGGWMDARIINTQGATEVVNGSSRINFGFTRDMGNDWKTFVKLEWGVNPFGTSDIVYSSESNFESQSDEFLNNRLGYAGLAHDKYGSLSIGKQWGVWYDVVYNTNLVNTWDGNTSGTYTYNKADGAINGTGRGDNTVQYRNTFGDVSFGLQVQLKQDSFDLNDNFGPFSTADNSVMIGSPVAITGDSLGTIEYNNTVGGSITYAATDMLTLTAGVNLGEFDGALESGEGISETDYIYGAGLTWGGFEQAGFYAAININKNEFHDTDNIGRLMPDAVGLESLFSYKFDNGLKPIFAYNYLKAGDAYEALYNDGEFKRQFIVVGLHFVWDEQTMLYIEARKDMSDFNIANDTPDESDGVAIGIRYYM

SEQ ID NO: 6751 - protein, 912 aa, Shewanella sediminis
MYKNSFLTNSVRFALISGAAATAVISAPAAFAAEEEAKDVERISVTGSRIKRTDMENAVPLTSFTAADIMASGAPTLEQFVQALPLANGGQYGSNVNNGGTGTVTMNLRGLGDTRTLVLVNGRRYSGDISTVPMAAVKRVDILRDGASTIYGSDAIAGVVNFVTNDDFEGAQVDVRYQQSSEGDGETKSVNFLTGTSSDKGNIIFSGTYETREAIYGSQRDFSSCPPSEVDNDGDGNNDGLVCGGSGTTMPGSAWSPSHGFGQLDGNGGIRPLTDEDKFNYAALSILYQPLEKHSFFTQGNYELIDEGFSTVNFFTEAAYTNRISNQQMAPVGTFWGVEVPTTNPGNDLGETAYAYRRLAETGGRTWEREVNEFNLTMGFNGEFANEWYWDVSYMRSQRRTDTNAGGRVHQERAGILTSPELCAANDECPGVWNPFASNTLTQEMQDWIIVPMTSNSKGEDTQLQVNIAGDFGDLELPAGPISWAAGYERLTTSYVSIPDGAAGLGAIYGVSAEGTEGAYSTDAYYAELNFPILADLPFAKSVNLTVAARNTDVSVIKDNEVTTKFGLEWRPVDDILVRGSLSEGFRTPSISTLFAPRANSATSYSDPCENYGTNAGASATLKANCAADGLAPDWSPITDQASAWVGGNPDIGPEKSTSLSVGVVYSPDYLEGFSVTLDYYDIEITDVIGSLGMGTIATECYNSENFSSPMCDQIKGPAAYGEQGGERRNSLGNLSGVDLSTQNLGFFNASGIDFDINYAFDVANGTLDFNLEGTRALTLEHLEAEGLEKTSLAGYYGNDVANGGKGSFPEWKAAFRTSFSADDWTVTYNMHYQSSVDDYAPIETNLSNSVGTMLYHDINASYYFSNITLSGGINNLTDEQPPYVSNGTNGYLIQSHRLTGRQYYVSASVKF

SEQ ID NO: 6752 - protein, 1072 aa, Shewanella sediminis
MKYFKRNGFVALVSMLSLAAYAEDILPLSVAGSETKEFIQASGYGIDTSNMIQQERIIQGTVLEEGTNEPLIGVNVVVKGTTIGTTTDIDGKYSIKIPSDKAVLVFSYIGQKTEEYSVKGLSLLNVVMKSDATMLSEVVVYTGYMTQKKADLTGSVAMASASDLKKNASANAMKSLQGKMAGVHITTNGGNPAEGATVQIRGLSSLSGGVKPLIVLDGMPTENLNLRDINAGDIESIQVLKDAASASIYGARASGGVILIQTKKGQAGKTSIEYNGSVSINTVLNKPALMNAEQYGRAAFQAQAYDERVYGTSISLPSAYDYTWHRGDNGMAVLDGVKVAEFLNADQTVRGSDTDWMGEVFQTAVSHNHQLTISNGSEKSKSLFSLGYFNNEGTQIHTFFRQYSVRANTEYSLIKNRLKVGENLAVSYLQYRDQSETWWAMINPPASPVYDENGGWAGAPGFDDFTNPVRLLKMNKDNINNYVKIIGNIFLDLNIWKGISARTQFGLDYGNAYNRAVDGVWSETGGRNSDGENYVGSYQSHPLSYVWTNTLSYTLSTGKHNLDVVLGTEATRFVQEGFSARREGIYLEDRDFAHIGVTTGEKYNLGSSADEYTYFSLFGKANYVYNGKYLLSATVRRDGSSLFGENNRYATFPAFSAGWRIKDEAFMEDFDFLSDLKLRASWGANGSVQGLPRGYTTTPFTTDYFGTSYPIQGNESGPLYSGYSRTWLGNPDLKWETTTQTDLAVDFGFFDQRLTGSLGYYFKKTKDVLVQTPYIAVMGEGGEPWINGASMNNRGLEFEVSFRSDPSAEFQYTISANVGTYKTKLTELPENVINKYPGDGVRDFVIGRSPNVFYGLVADGIFKTQEEVDNHAEQPGKAVGRIRYKDLDGDGRVDELTDRTYIGTADPDFFGGITFDFRYRNFDLNMFFQGVFGNQVSNDWKRQSDFWHISGSVPVGKNHPTRLLDAWSFDNPDSDIPAMTNVMTNNEQRMSTYYIEDGSYLKLRNIELGYTFPAKVTNKMMMKNLRVYASARNVFTLKKFWGGDQFTSFDPEMSGYGYLTPFTMTFGLNVTF

SEQ ID NO: 6753 - protein, 557 aa, Shewanella sediminis
MSKLIRRVVTVLALTSMASSFASGKIEAAAAESLATRFIASTENADDNVFQATAKKVRFGRNKNQRQEQKHTEAFCDKEFYPCEGGQCQPVDATQESCYGKMYCVRVNDDCNVEISQSVPEYATVGSPYPIEILAVGKKDCVNVVITQQLPCEVEFVSSDPATTPTSDSKLIWTIDRLGQGEKCKITVWVKPLKEGCCFTAATVCACPELRSYTKCGQPAICIKQEGPECACLRCPVCYKIEVCNTGSAIARNVVVDNPVPDGYTHASGQRVLSFNLGDMRPGDSKCFCVEFCPQKRGKVTNVATVSYCGGHKCSANVTTVVNEPCVQVNISGADWSYVCKPVEYTIVVSNPGDLKLYDVVIEDTAPSGATILEAAGAEICCNKAVWCIKEMCPGETLQFKVVAKAQSPGKFTNQVVVKTNSDCGTCTSCAEVTTHWKGLAATHMCVIDTNDPICVGENTVYRICVTNRGSAEDTNVSLILKFSKELQPVSSSGPTKGTITGNTVVFDALPKLGSKESVEFSVTLKGIAPGDARGEAILSSDTLTVPVADTENTHVY

SEQ ID NO: 6754 - protein, 543 aa, Shewanella sediminis
MLPNSAGYSRNDYNDRDLNTNTKQFNFDFDKSFSVIKTDHALRYGGLYSETEKSMVNDQGYKGGNVQWWANNFICNKLENGIRTPSPQYYPTSDCTGKLRESNLGKTSYLIPVKTKNHAFYLGDNFTVTNWLGFDLNYRYDNVRHLPHYRLGQDPEIPRGLLAGTMIPIPDSALTGGSGWYNYNHPDYIKNVQDNLNAIQKSTAFKHHSYNLGLNLDPTDWLRIQFKYSNGFRAPTPDEMYMTFKHPQFSILPNTNLKEEKAKTKEIAFTFYRERSYFTTNLFQTDYKNFIDLAYLGERPIDQSKSSYYPFYQSLNRDKAKVNGIEISTHLEIGDLIEKLEGFHLGYKLTYQKGRIKDSKPLEGYKKLLKHNPKYMNMVLQDQPMNALQPTTSVYNLGYDSPNKIWGLDFYITDVSAKKAKDSFNPQWHSMIERQAENINTGVIETVPAKTVNGNEKVIDRRALWRNKHYTVIDAIAYWKPIKNLTFTAGVYNLTNQKYLTWESARSIRTIGTINRIDTETGIGLNRFYAPGRNYRMSVQFEF

SEQ ID NO: 6755 - protein, 191 aa, Shewanella sediminis
MSAAICLAVSGAPAWASEHQSTLSAGYLHASTNVPGSDDLNGINVKYRYEFTDTLGLVTSFSYAGDKNRQLTRYSDTRWHEDSVRNRWFSVMAGPSVRVNEWFSAYAMAGVAYSRVSTFSGDYLRVTDNKGKKHDVLTGSDDGRHSNTSLAWGAGVQFNPTESVAIDIAYEGSGSGDWRTDGFIVGVGYKF

SEQ ID NO: 6756 - protein, 843 aa, Shewanella sediminis
MIRTSQHSRNKLATAIKLGLIASVSSTTFTVSNTAFAEEAGADVERIAVTGSRIQRQDMETASPVTVIGADEIRAEGFTTVDELLQAQTSMGGKAVGSSTNNGADGVAQVDLRGMGSQRTLVLLNGRRMVNSGSGANSSVDLNSIPVAMIARVEILKDGASAVYGSDAIAGVVNIITKKDFEGFQVDVQGGMTDKSDGENGEISALYGFNTDTGNYTFGAAYSERKGVIQSDRDWTDPGNSSFIPNGSLGGKVKDENGNWVDRSEGYDFTQDSFYQTPSKRYSLFANMTQELGDDIVMTGDILYTKRKSNQQLAPQPANIMLDVCAPGDDPMTCLELDQDMIDAGISPDKNGQVNYRKRMNDVGPRIYNQDTDTWRISAGLEGSLDINTGMNWDASYTYGNNKAKTGVENSINANLMADAIYADQDPWLTGKPMTDQDVLNSVSYDEEADGGNEQHVFSAGLNGELFDLDAGAVAFAIGAEYRYESGYYNPDPIVVAGESTAAQQDPTDGSYNVISVFQEVSVPFTDKLTGEFALRFDDYSTFGNASTWKIGLTYEATDDLMLRTVAATGFRAPSVSELYGGNSGSYDYLVDPWGNEKDPQILVNRTSDEDLKPEESESYTAGLVYSPSYVDGLSLTVDYWRFKVENAITRLDTQAGIDACYGGDASACETFNIGADGDLSNLTNSLTNVGFQDTSGVDFNLAYNFEALNLDWVVSNDTTYLLNFEQDGKEYTGTIDGNFGAYAEVRNNFSIKAGQDDWSVMYFNRYIGEMDDLATGDTVDSVLYHNLSATYFINDDWMLSAGVKNFTDEDPSKVSNGSDGGTVPEVYDVIGRTYFAGVTMKF

SEQ ID NO: 6757 - protein, 604 aa, Shewanella sediminis
MSFKLRLSVLSIAICQSFYAFAAAPANPDIEVITVTGDRFDSTADQQLTVINTIEREEIARLNPKSVVDILETLPGVSVIRSGGAGQSASISIRGTSSGHVLVLIDGVRIGSATKGSVSFNALSPENIERIEVVKGPRAAIWGSDAIGGVIQIFTRKLEGGEWFASVEYGSDAYMRASAGAGVSHGDGQTSISINREKSDGYDVKNDGEDDDDGYDRLGISIKGQQTLNQQWLLSWTGQLETGSYEYDNSRANEADYDNYLWNLAAQYQNDKLTSKFSLGQSRDHNENFRATDRQGTKVYETTRDQIHWSNRYAASDDLTFIGGVDWSQESIVGDYAVDQRDLTGLYALARYQYGKLLIEGVIRYDDVENIDSETSYNASLGYRLNDSWRVTASAGSGFKAPSFNDLYWPGSGNPDLVSETSENMDLTLSYSGENIRGYLSVYQNDIDNLIAWAPTGEQDDNGWDIWQPANIKDAEISGVELSLTYDTWGVEHQLGYSYIDAVDGKTDEQLVGRSEHEFDYSVGYIWSEVDLLVSYHYQGERKENSVDYLDAYHRVDLSLGYKLTQAWQLRLKANNLLDEEIISNQNYFSPGRELFFSVSYQAF

SEQ ID NO: 6758 - protein, 767 aa, Shewanella sediminis
MLMKPQAFDVARWRHFVLSGLCAAIVTVPVLAQTATPSSDSAAPRADDEVITLPQFTVSGEAADRYRAADAVSAVRVRAPLLETPSTITVLTRDMIDDLAPSRLFDVTRYAAGVQEGRGIQFQDRMILRGFESNGQRVVDNFLQPDDADNITEVVIDRLEISKGPNAILSPAGGPGGAVNVITKSPLYRRQRSVTGVIGLFDAQKLTLDMTDAFSPGSKAAYRFIGSIQDTRRYWSDDARMRNKALAPMFTYKISDRTQLTVKLIGSTQWIFREPLLIIDPRVGPQTDDPYLAPGLSKKGRNGIQPWSHTAVDTADLFALLTTSFNENISLRVAANGRYYFTDSVQEFITLPGLNNTRYQPLTGEFTQDYVWSMVNGQPVSTFSPLFQPGNIPVRGDAQWTRLRYANLQSDLAARYNFPGVTTQTVGGVAVSRRLSVNKVKSGTLPGIDLSRPYVAATPIWDSNLYANNVGNFTNWQAYVNERLGFLDDRVQATGGILHYDTYTYARNAINATNAPSILDDAKNVWMASLLVKVQPNASVYYSHSTNSSPVIANNQPLWRDGVQDEVGFKTEWFNQRLAFNAAYFEISQTNVTTPNPERQTNPSAPEQIVQDLNNHGYEFELTGGITNNLSVLAAYSQLKMRDSLGRHVRAVADRNASILLNYRFTEGAPKGLSLSLGVSYSGRRAGDAPPAYTIASVPAKTSFFLKPYYVTNFSASYTWHDYVFRLYVDNVLDDSGYIQQAGGRVSGTGITTAPGMNVKFSTTWNF

SEQ ID NO: 6759 - protein, 1041 aa, Shewanella sediminis
MKTFSRYTPTLNHLALALASTLLLIATYTANATAAESEHSTNEDSKAAPHESKTTELDRVVITGSRIPRAGFDTLEPATVVNRQYIDSFGFTNVADALFSQPGFDSGASVRGNQAGFGAGVSFLGRFGLGSNRQLTLVNGRRLVTSNPPTVFGPGSGGTQVDLNVIPTSLIERTETIGVGGAPTYGSDAISGVTNIILKKNYEGAEVNIGYGLTERGDNARYNYSALLGSNFANHRGNVTIALDADDNAGVLAEARRYYRNGYSTQTNPNAAAIAQFQPGRQYATDGRVNPTIPFNTSNTDGIPGRVLIRNRRINNMTWGGLLYPSTGRYIRDASQQPRGFGPNQDQFLQFDTHGNLVSYNPGVNFGNSSSSGGDGLDLNQTTQVTSQLDRKSVFMLGNYDVTDTISSFFEGSYYTSKALELTDQSMYNAAGFGTGNVNGSGDQSGALNFNIGNPFLSEQNRQTLRQLGITDFRLSRASRDLVIGNSSTDTRLWRAVAGLNGHFDAGGHPFTWETSLNHGEGNFDYYKTGLIQQHFINAINVTRNSAGEIVCNSSAAGTTVDPNCVPLNLFGEGVASAAARNYVTTPTHAKAQMKQTVFNANLSGSFIDLPGGKLGFNVGYERRREEGRFTPDEYQRLGLGRTVPTTGSHGTFTTNEYFGEILAPLVNPDAHLPGLHRLDLTAKLRRVNNTVNGWFTAYTYGLQYEPFQGLQLRGNKTRSFRAPAIVELYTSQQSSYFFITEPCTSANITAGNRPELRQRNCEAFFAHYSGVNPGTFQEAPSSQLGSVSGNPTLENELAKSWTAGIVFQPEWAHGLRVAADWYDIKISNVITQLDSGDITSGCFDNETFNRNDVPNANRFCSMITRDPSTGVASSVRTEYTNGPYINFRGWTAEVNYRFDLKELRWGGSGILDLGFYGYFPKNLKYTAALDIPAEESVGTIDYSKRQFQWNVRYLTGPWNLGVSANYKSAALYSLTNTVETRDYLGIPSYTSYDANIGYTFDKHSSLNLAILNATDKIVAFPYVYDGLGRRYMLTFNYKFH

SEQ ID NO: 6760 - protein, 364 aa, Shewanella sediminis
MKYNKLTVLVTTLMVAGTANAVEVYNQNGNKFDVYGQIDVRHYIADSKSGEDGDDSRVRLGFRGDTQITDQLIGYGRFEWETPTNKSESDNENQNRFAYAGLKFGDYGSLDYGRNYGVIYDTNAWTDVLPLWGADTMDQEDNFMTGRNRNLLTYRNNNAFGYVDGLSFALQYQGKNGDQNLSSSDDALTNNGDGYGFSTAYELGYGVTLGGGYTNSNRTPAQKNQSTGATGKRAEAWNVGGKFEWESLYLAAMYGQALNTTRFGGDDEESVANKSENLEVVALYELDFGLTPSIGYNQSKGKNLGEFGNKYLVKYLAVGAAYEFNNNMSAVIDYKINLLNKNEFTREYNINTDNVLGLGLVYQF

SEQ ID NO: 6761 - protein, 97 aa, Shewanella sediminis
MSIDRTSPLKPVSTVQPRETTDAPVTNSRAAKTTASTSTSVTLSDAQAKLMQPGSSDINLERVEALKLAIRNGELKMDTGKIADALINEAQQDLQSN

SEQ ID NO: 6762 - protein, 841 aa, Shewanella sediminis
MNSLTCVPVAAARALAFSTGLAVPRNALRALLIGTTLGAAITAPAFAQARDYAIGPGRLSDVLARYAAASGVQLVYEPSDLAGIRSAGLQGSYTVEQGFSVLLAGSGYRLQQAGPGSYVLVRPPVQGAAVPAGEGAVVLDTVTLRGGGATTEGSGSYASGAASIARGADSLKEVPQSVTVVTKQALDDQNLTTMSEAMAKAPGIVATTDGMGQPVFYSRGFVIDNYQIDNLGTSYDSTFKPDFDMAIYDRLEILRGAEGLFSAAGEPGGTINLARKRPTDELRSAVSLAYGSWNNRRLEADIGGPLGFDGKLRGRLVGVWQDREYFYKPADEEKRVLYGILEYDLTPSTTLSAGVSYQRQYGTMWQRGLPTYADGSQLGLPRDVALTVDWAKREQTIRELFASVEHRFDSDWTLKFSAARQRFDFDYLNLSLGGPIDPLTGSFGAPDAFSEDDGNHSDGVDLSLSGRFDAWGREYKLTMGADWRRSYGKQMRNRVGTAFPDGEIGVDDFPGLDLPAPVRGRAGSGWPTFGSKQQGIYARLDMQATDRMHVIVGGRYGSYRHSEIEERYDEDGNVTYRDTSWRWSENGIFTPYAAVTYDLTPDWTAYASLTEIYKPQGNTFAGPPDNPTQLDPITGRNYELGAKGAIMGGALNVSAALYRIERKGEKVVDPRYEDEPRDYYLPLGEIVSQGIDLEVSGEVAPGWQVFAGYTYNHNENKSENDVYHALTPKHMFKLWTDYTLPGDYSKWTVGGGVTVKSRHANSGTYWFMTPDGWTQPEFEIRQGGYSVWDAHVQYQIAEQWALALNVNNVFDKTYYATIGTPGGGNWYGEPRNATLTLRGRF

SEQ ID NO: 6763 - protein, 387 aa, Shewanella sediminis
MMNTQAKLSLLSVAICMTTFNASAALEIYENDGMSFSADGLVNAFYANSSIEKTDAEGATSERDQSRVRTGFLPNNIGFNFSNQLSDMKIGMRSSFWVSISDADNHRDASPADLGTGSLIDIRQFYGTVSGDWGELLVGKDFGLLNRANILGDELLLGFGQTSDFFGLVDGGNVSFGNISTGYTYPFPKSQITYRSPDLNGFKIAVGLMDPNKVAADSSEELPRAEAELIYSTEMDKVNLKAWVSGATQSSEVDDVKQNQSGVGYGANVKFSGFSFTASGFQTKGLGHIAGLDHLVGDESIKSDGYLLQAAYTLDSNRFVLTYGESEVENTDSILDAKHSNIGIAYFRTIRPGLTAVVEYNQTEADVANSLVGEENNTLSIGAVFTF

SEQ ID NO: 6764 - protein, 917 aa, Shewanella sediminis
MNQFLRKLIVFLVILFAVNLQAQDKKEITFTAVNEPILDILSEIEAQFNVQFYVIEDWIKDQKTSVVKDTYTLEALLKEVLDDTPLNFYKYSEDKVVLVKNNSIVSELPKGFVVDSLKRNNTQANPIFAEEFNQDITDGNVITIGKRSSARVGSEYELTGYIRDSKTNAGIDNLVISANDKSIYTTTDANGFYTLRLPAGQHRVETSGLGYGLESKTIVLYGSGSLNFNLVEDAQLLKEVIIESNKSENIREATVGISRINLKEIKTIPLVLGERDVLKVAVTLPGIQKAGEGSIGYNVRGGRADQNLILLDDAVIYSPSHFLGFFSGINPFTTGSVDIYKGNIPAEFGGRLSSVFDIETKAGNKEKISGEGSIGPVTGNLTLEVPVVKDRSSILVGGRATYSGWILRSLSEESLKDSEASFYDGIINYNDKINDKHQVKASVYYSDDKFSITSDSLYRYNNALASVNYTHQWNDKKKGELILSHSNYQFEIDFDANSDKDFLFDYTINESQLKYNLNHKIDPKHTLLYGGAAKYYNIDPGNIEGKGDSSTIQPLSIQSERAVESAIFLSDEYEVNKKLQLNLGLRYSHYANLGPSVQREYQDGAPKNESTVVSENTYDDNEVVETYGGLEYRFSGRYFLTPELSLKAGYNRTLQYIHLLSSNTTISPTDTYKLSDLNIKPQKASQFSLGVFRNFDDQDLEVSLEGYYKSLDDILDYKTGANLTLNENIETELLQGEGQAYGVEFLLKKKKGNLNGYFGYTYSRTFIKLDSENPDERVNNGEYFPANYDKPHDFSLVANYKITQRYSVSFNASYQTGRPITYPVGKFEFAGEEQVVYSDRNDFRIPDYFRLDIGFNIEGNHKKMKLAHSFWNISIYNVLGRNNPYSVYFVNDNKEIKAYQTSIFSVPVPTITYNFKF

SEQ ID NO: 6765 - protein, 316 aa, Shewanella sediminis
MMNVFCKTLLASALATATLASAHAAEPLTVYGKLNVTAQSNDVDGDATTTIQSNASRFGVKGAFELSSSLEAFYTVEYEVDTGDAAKENFLARNQFVGLKGNFGAFSVGRNDTMLKQSQGKVDQFNDLSGDLKHLFKGENRIEQTATYMTPSFSGFKVGVTYAAEGASSQYGQDGFSVAAMYGDAKLKKSPIFASIAYDSDVKGYEVVRATVQGKIAGLKIGGMYQQQEETYKKDGTAVVGADSKTGYLVSAAYTIDAVVLKAQYQDMEDKGDSWSVGGDYKLGKPTKLFAFYTNRDFEGVDTTDKFFGLGLEHKF

SEQ ID NO: 6766 - protein, 277 aa, Shewanella sediminis
MKNVKTIALATALTATMAAPAFAADRSDLRGGDYGWMQFNAMYAVNELPRDGSTDNGHDYLEMEFGGRAGIVDLYGYVDVFNLTNRDYGDKGAGKGSSKIFMKFAPRFSIDAMTGWDLSVGPIQEVYFSTLFNWDDRVGEGVNSTFWGLGADVMVPWLGKTGMNLYGYYDLNNKEWNGYQFSMNWFKPVVNFDNGTFIAFQGYVDYQFGADAVDDEFVPTTSSGGAAYFGLHWHSDNYALGYGLKGYNDVYLLKDDGGIVGLETTGFAHYFTATYKF

SEQ ID NO: 6767 - protein, 233 aa, Shewanella sediminis
MKRLLLSSALVIAIAAPAAAADLATRYPVKAPVAPVAPVFSWTGFYIGANAGYGGDKYNYDFGVPTTATASTNSSGFFAGGQIGYNYQFANNVVLGLETDLQWSGIDGTLNTVTPGASTNIKSSLDYFGTVRARVGYAFDRFLPYITGGMAYGKTKTEGSQFSRTGFTTFDDSDTKVGWTIGGGVEYAITNNWTFKTEYQYVDLGNSDYGIGTNAVSVDNKFHTVRAGVNYKF

SEQ ID NO: 6768 - protein, 652 aa, Shewanella sediminis
MGTNPTKIALLIGSLCSFSVIAPAMAADDTSTAKVNEHLVVIGRSDNTPLNIAANVNVIDAAAIEMSGATSVTEVLRGQSGIQISDNNIGTSFAMRGFSASTAVNNTLILLDGRRLNNIDIAAPSLNAIPLNQVERIEILSGSAGVLYGDQAVGGVINIVTKSPENTGGSVQLSGGSFDTYEGRGDVSGAINKDWRYFFTGSYNQGDNYRKHNANETGSILGRIQYKTATDSFFVETSYYDNDRENPGSLTEKQFKDNPRYSGNDKQYSHEMTTAARTGYQHQLNPNWALAADLDYSDTLVSSLNWGQSRNTRSLLMFSPKALANYSTRQGELNLVTGLDISRGKADFDTMARSNVQQMQSAYLQATVPLSHTLSYVVGGRYARVTDELVDGNVYPNGMDLDENAHAFELGLNYRPTAEHRLYVRADDNFRFAKVDEQAYTSPGVLGLKPQTGRSYEAGWDWTLASQTLRVSLYRLDLEDEIVYDSSATKPIGGNFDGANVNADASRRYGASADWDWQVTKAVQLGLEYNYIDAEFTDGNNDGKELSWVAKHTGRGYVSMDFAEHFQVFAEAIYTGDHFVEGDNGNEGDKLASYVLGNLALNYNRDAWLASLRIDNLFDKDYVSAGYYGGLWGDSYYSGRGRDIRLTLGYRF

SEQ ID NO: 6769 - protein, 766 aa, Shewanella sediminis
MKYAWLALLPVSVMAQEPIEIIEVTGEGETLVLPSEEPVEGVFGLSDALQEIPRSATMISRSLMDQAAINDLHDIARFAPNSFAAAGFGNPSLPSMRGQLGELFEAGMRRQAGNNGLGVPMSFNSIEGIAVVKGAPPVMLGTTQRVGGFVNLLPKKALTDKERSRVRGEWGQWSQYRLQLDHNEVLKRDKHGLRVSAEFVDHDSFYDYTSTRSDDVFVAYRFTPNSRTEWDIGLEYYDVEWTDNAGINRPTQALIDDNLYITGQGVQPNGSTVPGAYAVVSPTGQVEIDRSRVLTDPADINNAKTTLVHSTFQQQWSDALIFVNRTYYQYLEREGINQNSFVEIIDGAHTFENRAELHINDHTIVGINLRVNDVLGYSQFSTEADLPTDLTGPISNRRIPLTAAQQAQLVELRPGLFVSPGTNYDNDGDGVGDYILSDTTDSLSQQWGLFAQHELALTERWQVTAGARLDYYDVTAKDPLPPAGFEAAEDSYNDWLSAVSLSSQYQLSTAVMVYASAYESDSTSNSMAGGTVLNGNQVIDSQNFATENTLYEIGIKIAPVNSRWYTDVVVFDQTRSLRNRDGSNSGIATQGVEAQWNYRNENGFWATLAASYLDAHYDNSAAFQDTRQVADLFDNSRPDIINGTGVGAPNFAAFAASNQRLQGVPEVQASAVAGWQLTPQWSVGGDLSYTQSYPLDYLQTVIIRDQYMLNLNATYQVTAQLSARLDVFNATDEENWSPVFEGGYFGSTLASPSLPRHAQLTVDYRF

SEQ ID NO: 6770 - protein, 185 aa, Shewanella sediminis
MKKLSLVAVTLLSALVAGQASAATDNTGFYVGGALNRVTVDAFDDSETGTGFGVYGGYNFNEWFGLEANFFATADLGDSDVDISAGALTFTPKFTLQINDMFSAYAKVGVASMAVNVDGLGFDEDFTGFGWTYGVGVNAAVTEHLNVRLSYDITTGDLDADHSYLNMKDIDTDMKQLAIGVHYQF

SEQ ID NO: 6771 - protein, 357 aa, Shewanella sediminis
MRKMRHIPSTSLVAGALVLASIPAHAQSSVTLYGITDVGIEYANHVPSGKTSSSAVRQQSGNLAGSRWGLKGAEDLGGGYKAIFVLEGGFNLNNGTLGQSGRLFGRKAYVGVSTPYGTVTLGRHQNLLYELMYKYDALTFNPSYSAQSMDSQFVNRADNSIRYGLNIAGVTFAMLYSNGFDSTIPNGAQVPGATKVGREMSAAILYDRGPVSIGLTYDQLQGTSIATQSNTQSRALLGASYDFGMVKALAGVRWLDTRNTDTPPSSMLYWGGLTYHVSAPLFVSASVYHTQFRNPHGGPTMGALLVDYFLSKRTELYAEGAYVNNRSYSNVGIRGTGVDITTGADQTGVTVGIRHTF

SEQ ID NO: 6772 - protein, 248 aa, Shewanella sediminis
MNKLQSYFIASVLYVMTPHAFAQGTVTIYLPGEQQTLSVGPVENVVQLVTQPQLRDRLWWPGALLTDSAAKAKALKDYQHVMAQLASWEAEADDDVAATIKSVRQQLLNLNITGRLPVKLDPDFVRVDENSNPPLVGDYTLYTVQRPVTITLLGAVSGAGQLPWQAGRSVTDYLQDHPRLAGADKNNVMVITPEGETVVAPVALWNKRHVEPPPGSQLWLGFSAHVLPEKYADLNDQIVSVLTQRVPD

SEQ ID NO: 6773 - protein, 655 aa, Shewanella sediminis
MPHPFRSALRSVLALSCAGPALLATPAAHAQQVAAPFADLPRGGEAAVSLAEISVSATGVPTPVTQTGSSVTVLTSDLLRAQQVRTVPDALQQVPGLNVVRTGGAGGQTSVFIRGTNSNHVKVQIDGIDVNDPSTPNRAFDFSQLLTEDLSRIEVLRGPQSGLYGADAIGGVISFVTKRGEGPARATAFVEGGSYGTANQGARISGSEGIFDYSVSVQHLRQAALPVTPFELLPVGVPLRTAFTDIKTVSTKLGAQLTDTFRLNYVLRFSDSAYLDQADGGFPYRPLPYRNLNDQQQLLMRGEAEWTPVPGFHNVFGANYATFDRLFAGPLDPLSVPTPTTYFGERTRFDYRGDVQLAPGNLLLFGAQREDERIETAGLNRANGNTGGFAELQSAVTDRAFLVANIRHDANDQFGGATTFRVAPSYILPGTETRLKGSVGTGFKPPTLSQLYQDYPGFRFFGNPALRPEESFGFDGGFEQPLGERVLVGATYFETDFRNLIQTAYFPTYSTNVNVGRAVAYGAESFVSVKLTNTFSARADYTNTVTKDEVANQELLRRPRHKVSFTGIWTPLPNLTLTGTLISIGSFVDGNRDFSVTRLKNPGFTLVNLSANYVWSETTTLFTRIDNLFDQRYQNPTGFLGPGFAVYGGVRLTTF

SEQ ID NO: 6774 - protein, 413 aa, Shewanella sediminis
MMMKKSYLSLVVLSALAVPAIADTSIDKMFSEGTVKGELRLLDFTKDFDEGTTTQHTTSLGGLFYYKTAKVNGLSIGTSFGSANPIWVNDTDAVYNLVGRDANGDHQSVNRMQEYYVQGDWWNTQFRLGAQELRTPMMNPHDIRAIPRTFRGFSAENHSIENLTLSALYITDSMGWTDERFNSVSEAVKAEVKRNTGNVVDVEDNPMYAVGAKYQLPFDTVKTQINLWQYYMEDVFQQTYAKVNLSTQLGSTNLYFIPSYLNQQATGNKSAGELDTYQYGFHLGAKFAGVDATYMYAKTGDDTVLTPWGDDKVVIQQVYQSALADEEVNALKLEYDFGQVGAKGLSAYAYYGDYDSPESLNDFTETNFSVTYKFAGVLEGLGVRARYAIVDFDQKEDLNDLRLYLTYKFAIGH

SEQ ID NO: 6775 - protein, 696 aa, Shewanella sediminis
MNRSKIINPIFKFCAALAFLPISAFSDSTIDEIIVTSDFRDSTLLQTPASVTVIDSAAIAQRQARHLEQVLNLAPNVNFSSGASRGRFIQIRGIGERSQFIEPLNPSVGTLVDGIDFTGIAGAATTMDIAQIEILRGPQGTLYGANALAGLINVRSNQPSEQLQGNMQVSVGDYGTGTVSAAVGGPISESLGYRVAVQQHSSDGYIENDFLKRDDTNNIDELSLRTILDWQASDDLDLKLTLFHVDADNGYDGFSLDNTRHTLSDTPGHDRHKATAAAVESRWQGAENFQLVSLLSFADNDLEYGYDEDWAFPDICTGQPCEGWEYNSADNYSRQRDNASVDIKLVSEPKARILNGSSGWVVGMYWRDQDEQLLREYTYAGGDFTSDFDTTNKALYAQLDTELSESLTLVSGLRVENRDAYYSDSDSVAHSVGESLWGGRLALQYQITADQMIYGLVSRGYKAGGVNSDPALVSEDREFDTELMWNFEAGLKGRWLEDRLQAQVAAFYQKRDDIQIKQSLVQSRVDSNAVDFTDYFGNAASGANYGIEVEFNWLASESLTWFGSLGLLSADYDIPKSEDLDSRPQAHAPDYQFALGGSHQISDTLSISVDVEGKDKFYLSSSHNEQTQAYELVNARINYFLNGWDLSLWGRNLTNKDVIVRGFGGFGNDPRKFYATEAYYQFGEPRMFGVSGQYDF

SEQ ID NO: 6776 - protein, 1012 aa, Shewanella sediminis
MNNIKAFIYKDMKRNATFKVLLMFIVGLFLSVNTFAQQIVVKGIVKDTTGEPIIGANVIVKGTTNGTITDFDGNFLLNANKGDIIIISFIGYRSQEAQAAASMNIILKDDTELLDEVVVIGYGSVKKDDLSGSVVAIKAEEMNKGAVTSPQELIMGKVPGLSVSQGDGAPGAGSTIRIRGGASLNASNDPLIVIDGIPVSNDAAPGTPNALATINPNDIETFTVLKDASATAIYGSRASNGVIIIQTKKGTQDKIKVSYSGTFTAKDPYKRIETLDAQSFREVMQAQYPEGTAQSADIQRILNVYPNQSTDWQDAIYQTGLSTDQNIGIAGKAGFMPFRISLGYNTEKGTLKTSKYERYTGAVNLSPKFFDNHLSVDINVKGTINKNRFADSGAVGAAAFFDPTKPIYDEENRYNGYWNWGIVQGAQADLATQNPLSLLYDRNNHGTTKRSLGNIQLDYKIHGLEDLHANLNLGYDVAKTTGRNFVNSNSVQSSLDKTFTGLGQGNTWNNLRRNHLLDFYMNYAKNIESIKSNFDIMAGYSWQHFYYANHDITYSNPTEDLGAKEGYTYDENERHYIRDDHRRIPYENYLISFFGRLNYNFMDRYLLTATLRRDGSSRFSENNRWGLFPSAALAWTISNEPFMKATENVLSKLKLRLGYGVTGQQEIGDYQYITSYSFSTNPNTTYLGTTLLKPNGYSPDLKWEQTTTYNVAIDFGFLNNRINGSIEYYQKHTKDLLNTISAAAGTNFINLITANVGKMKNKGVEANVNAIAIQSKDFTWEVGYNITWNDSKITKLTTTFNPDYQGIDAGTNQKHQVGEMPGTFYLYQQVYDENGKPIQNAFVDRNNDGQITEADRYLTHKSPMAKVYMGFSSQFSYKKWDLGFNLRANFGNYVYNGVASGNSTSNNYGGKGFITNLYNGFQDTGFTLLNTSEQMASDYFLENASFLKMDNLTLGYSFQNLFAAKLSGRISASVQNVFTISKYSGLDPECGAIDSNIWPRPRTYTIGLNLNF

SEQ ID NO: 6777 - protein, 274 aa, Shewanella sediminis
MKKTVLGFMAASSLFAGSFEYGQGDFKIKYKLYNQQASVSTDIKTYSLVEQHKNIFESTYYYKYNISWMKLDRFTTPQQNIRPPFPTIDMPSISHELEGLDASIGIGKDLYHHSEHDYIGFGVDVGLSVPYSDSNQNSNGSFDLKDFKIDITTYKIGPHITFSKSFHEVLSIYGSVNYCYQTFRFKSDVLTSSVDVDGYSYGVDLGLRFDLLHKNYETKLLTIKPRFFGVLGYRYQKWDVDDITVKLLTFSEPLQFEDMNFRSSYFYGGIGYSF

SEQ ID NO: 6778 - protein, 361 aa, Shewanella sediminis
MKKTLISASVASVMALASFGALAEGPQFYGRLDLSVTNTDVGTTVQSGTKGINTNDFANENNSGTYIENNFSWLGVKGTENISSGIDIVYQMEFQVENTSGSGDTFKPRNTYLGIKTSAGTVLVGRNDTVFKQSEGGVDLFGNTNADIDRLVAAQTRSADGIWYYSPVIADLVTLNATYLMEDNNGSDDAQYALSVTVGDKGLKKHNFYLAGAYNKGISNVDAYRAVAQVKLGDFKVGGLFQNTEKVDSGNDNNTYFVNVAYNLNGVNLKAEYGYDESGMGKYYGNVVKYTEVVDGKVVNKTLSGSDIEVTNITLGADYRAAKSTLLFAHYAMYEGSHVTAGQRVDLQDDNVFTVGVRYDF

SEQ ID NO: 6779 - protein, 993 aa, Shewanella sediminis
MSGSNALKRFSPKKTLAALAVGSVLFMSAPAAMAADGLGVMQGRITTEAGSNLSNAKVIIKHESKGIVRETTTGANGSFSLKGLPIGKYTVTISKDGYYQVREQHIAVTMGNALTFDVALDLEGSGVERIAVSGARISRVDTSSTTASQVISMSELNQLPVELDATAIALLTPGSVAGDDGFGGVSIGGSSVAENGYYLNGLNITDLRKGMGDIDLPWEAIAQTEVQTGGVSAEYGRFIGGVVSLVSKSGDNEWQFGAKAEIAPDSLAEPSLRMKDDGTIEEAKDGYWQETEYNIWASGAIIEDKLFFYGLWNPFEEETTGYGENQINDNEWKTNRWFTKVDWFIHEDHSLGVMAFSNEGDYTGNEYQRDDNGGRGDEIGLTESTYGGIGWNALYTGYLTDDITLTAMYGEITQSTKDNSGTLDQSTYWDLRSGSWERLGDWVGYGSSETEDKRITYRIDLDWVIGDHTLRAGYDYERLEIADIYTPHGDGWYEYFAAGPDNSYGLAEGTEYADLRIWGKNSETENVHTALYVSDTWEVTDTVTINAGVRYSEFSNTTGSGDKYVDLDGQFAPRLGATWDVLGDGASKLYASYGRYFQPVSPNTNLRMASAAYDSHIVSHLDGVNADGSPILGDEISRRVVADGSVPDADQLFNNKAGSMYSDEFAIGYQQQVNDDWAVGVRGVYRDLKQSIEDVSFNYGMNQWILENYDANTWHAGNGETSAEDYFVGGWFPTLTNPGIGTEIYYDVDGDGVKETVNVNADQMGFPEAERTYKAIELSFSGNVTDDFTLNGSYTWSKSEGNTEGLVRSDNEQADPGWTTSFDYPELMDNGDGYLPNDRRHNFKLYGVYNVTDDFSVGFNSYLQSGRPINAFGVHPEDQGYCVQAVAIDGTCYGRDWYGASSFYADGEAAPRGSMGRTDWIYNIDLNMSYTMDFNEAGRLNFKLNVFNLFNFDGVTGVDEQYEFDSGAKNIRYGYADSFQTPRYVRASVRYDF

SEQ ID NO: 6780 - protein, 914 aa, Shewanella sediminis
MKHKTHTSKLQRLTLTPITLAVTAAFFSCAPMAQEQSQKADKTEVISITGSRIQRTELVSSSAVASVDQVQIKLDRAVNVEEITTKLPQAAAGANSTGSTVGDSFGSSTIDLRGLGQNRTLVLIDGTRAVPFSFRNSVDVNMIPTGLIKRVDVLTGGAAAVYGADAVSGVVNFILNDDFTGAEFSSSYETADGGNETLNFEGIFGGDIADGLGHITGYLGYSERKELLAGERDYAMQNANAIINTGGYYTDVATGNAFAIGGGGNVLDERQTTSSTADLYLTQPMKRLSSGLLFDFDLTDNATAYGRVMYSQVTVEGAGASGQAPISVNQAVTLTADNAFLTDDIRNRLTFDTDGNAQVNVERNLGLGVQHTEAERDSIQLQLGIKGDITDYLRYDVYGQYGKTDETATLYNNAYTVDGAGNNRFAALANSVDLFDPNLDLSNFSDPLIYTTRERTQNVLAATLSGDSSAIFELPDGPIDFAVGYEYRKETGEQTPGDAFRNGTSFATVSAFDMDASFDSEEFYAEVLIPVVSDVAFAKEVSIEGAYRVSEYSNTEAEDTYKIGLNWAINDDIRLRANKLTAFRAPNLGEFASPISGLSLALFDQTSDQFVARFAGRYNGDPCLLGTGDTAQCERYGAPAIGTAYDSSTAEYTYGGNPDIKPEQAESETLGIVYTPEYIDGFDISIDYYHIDISDAVSQIQPGAALQSCYIDNPDANNPLCGAVLRDSTTGFITTAIVNDFNLASIEQSGIDIATNYIMDAPDAIGGKLKFSYQGNLVTKQTRQNNATVAAIDCKGTYGSACSGDFASVLQADYKHRATLDWQLDTINMQLGWRRIGDVDYASDRSTSISAQDYFDFAASWQATEQVVLNFGIDNLFDKQPPTPSAGANHFNTVSDYDVIGRTVGLAIRYSPSL

SEQ ID NO: 6781 - protein, 204 aa, Shewanella sediminis
MNTLTRTALAIALAASAAPALAQSAGHWTTGYGAGYVSPKSNSGTVGGTQAEIKGAPALSFTYEYFLRNNLGVEVHAAVAGKHDLELQGIGKVGSYWSVPPSVLLQYHINGYGTVSPFVGVGINYTTFLGEDTEPTIGSGDLRFDDSIGATAHVGVDFIFNDRSGLRVDARWTDSRSNVDLNGTRLGKARIDPLTFGVSYLVYY

SEQ ID NO: 6782 - protein, 182 aa, Shewanella sediminis
MKLNSLLTAGILLAVSTPAFAAKDLGFYLGGQANQTSLEDNIGVLDESAKGLGVYGGYNFNDSFGIEAGFFATDSFVDEVDVRMAAFSLSPVIRHAFTDSVTGYLKAGLVLNRIYSDDDEVDESYQGTGWLFGAGVDVTITESLALRVFYEINETEPENSELDNYYADISLVQYGIGLHYRF

SEQ ID NO: 6783 - protein, 1070 aa, Shewanella sediminis
MSFKPIVMLKILQLTCILSVLLCSGVTQGLYAQDTNDSTPVDSTSQKGIEVTGIIKNAATNTGISGINIAVKNFSAAISNEDGTFAINVPHLNTLLTISGQEFQTKVFPLNNKSSNLEIELFETSYSQFYQESELPGGKQLQYTNPKAATTVDFSKGQWGNPVNESVGDFLQGRVAGLHSTRKSGVPGAGANLTLRGFNSLYATNKPLLIVDGMIYDDEDYGSGIIQYTSSSPLSMLEVKDIEDVTVLKDGSSIYGTKGANGVIIITTTRPVDLSTKIDFTMYGGINQKPDDLPVMRAGDYRTYLSQLIATRGDSQQQIANMPWMIDDRQNEAYYQYHNQTNWQDQVFKSSANQNYFLKIRGGDDIAKYGLSVGYLRSEGIIRETDLERYNTRLNAALRLTEKLSVNANLSFIHNTENLRDQGLAYKTSPMYLALTKAPFTAINAINASGEVSPNLSDVDLFNVGNPVAILDNGIGINKNYRFYGNLDFNYKISDNLEANMLAGLTYNKERESFFIPDFGVADVILPTAIGNNRSGSEVQRLYTLYTDTYLNYGKRFNYKHGLDLRLGLRTQSNESESDLGLGFNSATDDFTTVGAGSNLLRVVGGSLGEWNWVNAYLSAEYDYLNKYFLTFNGSIDSSSRFGDNIQNGGFSIGDSQFAALGSASGAWLISSEEFLKDASALDLLKLRASFGVSGNDDIGNFTAQQLYVSQNLLGIQGLVRGNIGNPELKWETVSKLNLGLDLALFNERFNASVDVYQNKTSDMITYEPVNTTSGFDYVVSNSGDMKTQGIDLSLNTRLIHTADINLDLGLNLSRYVNEVTGLPDGPIVTEFGGATYITHEGQDANLFYGYETNGVYATTAEAQAAGLSRRLDNGALEAFTGGDVIFTDVNNDGVIDNDDRVVIGNPNPDLFGSFSANFKWKRLSISGLFNFSVGNDLYNGVRNNLEKMSGYENQSIAVRNRWVAEGQQTTIPRAVWGDPLGNASFSDRWIEDGSFLRLKTLVVAYDIALDLEYIKSVKLYASANNLFTLTDYLGYDPEFSATSSIFGQGADLGLMPQFTTIQMGLRLGL

SEQ ID NO: 6784 - protein, 765 aa, Prochlorococcus marinus
MKKQNFIITSLFLFWIIGTTAAQTITGKVINIHAQAIDGATVILQTIDSTFVDAVITDTTGCFRFNRQPASYRLIFQHIMYETLLLTTTGEDTGTITLKSKDYALDEVIVKGERPLVKVEEGKLSYDLSQLTTHRIVNNAYEILQQLPGVQEINGNLSLAGAHNLSIILNGRPTTMSHEQLAILLKNTPASRVEKVEVMYSTPPQYHIRGAAINLLLKVYRPEESGLQGEVNAGYLYNYRNGTQGGISLLYTTPKWNIDLLYNTHYEQNRQTTDTYSHHTLKNNVYDICQHNNIDRKGITHYVRTGAEYKFNGSAHINLAYTGIFNPNNDNHSYSDGNITTADNRTKKEAQMHNLALDYLSGFGMKAGINYTSYHSESHQQFTNKDNKKQTSEFHTTSGQIIDRWKIYVDQSHTLPREWTLNYGTSLTYASDHNTQFYHTQNGTDMSELNTDNRYNEYTYDFYVGFSKNMGERLSFSASITGEYYKTARYHAWAAYPTAELTYVMTPAHILQLAFTSDKTYPSYWDLSESTGYISGYEEVQGNPMLKPSTDYSVNLNYILKNKYIFSLAYDYEPDLFQQLAYQSTERLTLIYKTLNWDYQQSFSATAIIPFKIGHWLDSRATLQAEYRQAKCDKFFDLSFNHSKWIGLGMLQNNLTLSTQPDIRMELTGLYLSPSIQGNYDLSNVWAIHAGLRWNFANQKASLQLKATDLFNSMQGDIDVTLRNKGQYMDMHINSYSRNVTLSFTYKFGGYKEKQHKPIDTSRFK

SEQ ID NO: 6785 - protein, 659 aa, Serratia proteamaculans
MPLKITCMPRPAALAVALLCSVTLPAQAYDQLYVFGDSLSDTGNNGRFTYDGSQHLLYDEALAQRIGAALVASDNGGENYAAGGAVAVPGLNPADNTQDQVQSYLNRVNGQADGDGLYIHWIGGNDLAAAALNAATAPGVAYNSAAAAAAQVHSLLNAGAGTVIVPTVPNIGSTPQLMELIIQQALSPVQGAAIQAAYATLNSVATPDNASRTQAIHAALAAAAKQGSAIPQVQQAIATQLIAAYDSLSAQAAQLTDFYNQSEDRLLAQGGGNIVRVDVNKLFAEAIANPAQFGFANTAGMACPPGISSASRSDMPASTSASLSVLDHFHPERQAHLLIANYIQAVLDGPAQVVALNQGDGGGMRQGAPRSNSPSKQLPRDNRRGSLGVFGGYAGQHYDYADNRAAGDGNATTHNLTVGVDYQLTDGWLIGALIAGSNDDQHPSSRFDYKARGLLLSAFSSLALFEHGWVNADLHYATMDYDDIRRSMRLGPLTRTENGSTTGKQWGARVTAGYDFPIASYLTTGPVAQFAWDYSRVSGYSEDGDDSTAMRFNDQTYHSQIGALGWRLDTQFGVFNPYAEVSYQHQFGDDVYRAGGGLKSTQTSFTRDSAGQDKNWVDVTLGANMPLTDRVSAFATVSQTGGLSSGEQFMYNVGVSARF

SEQ ID NO: 6786 - protein, 440 aa, Serratia proteamaculans
MKSFNKTLLTVAIALASSQTFASGFQLNSQSATGMGRAFAGDAVIADNATVLSRNPAAMALFDKDAISFGLTYADITVDVKDVNFNLPNGAVDLGSIDDAGSSKVIPNIFYIHPIDDKFAVGFAAFSNFGTGTDASSLSKNLPKGSPAPYDLLGETEVTTVNFNASVSYRINDIFSIGAGVDAIYGEGRLTRNASTTPLVDVDADGWAFGGILGATVELDKDNRFGISYRFSPTVNVEGDINTISTKDLSAAGLGSKTALATNFDSLDVPLADIFQVAGFHQITPKFALHYTAQYTQWSKFDQITAKDGVATIIPGQAGAGIKLPAGDIALKEYQWKDSWLFSLGGTYTINEQFTVRAGYMHDQGVVDEISSISFPDSDRNWYTAGMSYHINPQNTVDFGIAFIKGEEVHLIENSAITGPVNAITESSGMYYSVQYSYQF

SEQ ID NO: 6787 - protein, 705 aa, Serratia proteamaculans
MMKRFALAPLALAVLSAFASTQVVAADTSLAEVTVTATREGQLVSETPATVGVIKEKTLREVKPTHPSEIMGQVAGVWVNVTGGEGHQTAIRQPLTTNPVYLYLEDGIPTRSTGFFNHNALYEVNLPMAGGIEINKGPGSALYGSDAIGGVVNVLTRKPPTKPEIEGSLEGGSYGWARTMVSGGSAFGDHAFRADLNLSHTDGWRDKTAYDRQSGTLRWDSAIGDDATLKTVATFSKIDQQTAGSSAISKNDYDNNPKANYTPISLRKVDAFRLSTAYEKEWGNSLLSITPYYRNDSMDLLANWSLSYDPTIYTTENQSFGAQIKYRHDFEPLRTRFIVGIDLDHSPGSRIENRINTTSTGSGYTKIYTGYTTGARVYDYDVTYQGISPYVHGEISPIEKLRITAGLRQDHVSYRFDNRYGTSPVVVGSAYYGQVADGDLSFNHLSPKLGATYAFSDSLNAFAAYNHAFRAPSEGQLFRPSVAASAAAANAAAIAASNLKPIKVDSVETGLRGNINRSVNYEVSVYYMTKTDDILSYRDPVTNITTSTNAGKTLHKGIEIGLGIQIASAWRLDTALSHAKHTYGEWRVGTIDYTGKEMELAPRTIANTRLTWGDAKTGMVQAEWLHFSSWWSDQANTTKYDGHDLLNLRGAYPLYRDISLFGNVHNVTDRRYAESTGTQTAGGVIYPTFAPGLPRTFTVGIQAKW

SEQ ID NO: 6788 - protein, 754 aa, Serratia proteamaculans
MSKHLYALRLTVASGALALGLMSTDVALAQQSSTTIAGESALPPVVVNSQKPRRAAPTRHVRAAPAAAARAPQAKPAPTLVENPRGPIQGYVASRSMAGTKTNTAINRTPQAVSVIGAEQIRDQKPGKLDEALRYSAGLVAGTFGTDTRSDWFLIRGFKSNDNSTFLDGMQLFSTAYATWKLQPFNLERIEVLRGPSAILYGGSSPSGIVNAVSKMPPAEPIRYIESGVNNYGNRYVAFDVGGPVATAAENGKLFTRLVGQFQGGDTQVDHTVDNNYFIAPSVTWKPDADTSLTVLASAAKNVTNGQNFLPYEGTVVAAPFGRISTKLFTSEPSLDTFKRTQATIGYQFERNLTDDLTFRQNARFAHVDVTEATDYGFGYSGASSSANLTRFNFYAHDVADQATLDNQLEYRFATGALSHTALFGVDLKHYSIDDVQHFSFGTPLNLVNPVYTPTAVASGAFKDQTLTQKQLGLYAQDQIKLDRFTLVLSGRNDWVKTENADRIGADLSRDDSKFSGRAGLIYNFDSGLAPYVSYATSYDPIIGTNTSAGLPGSLYVPETGQQTEIGVKFQPVGFNGHFGVALFDLKRQNVLTTDPNVAVLSTQTGEVTSRGLELEAVANLAPGFKVMGSFTTTNIFVSKDGNAALIGTVPTNTPRQLTTGWADYTFQDGALAGFGFGGGVRYVGSSFADQANTLTVPAVVLGDAAIHYERQNWRLALNVINISDETYVASCQSASVCFYGDRRRVTASVGYKW

SEQ ID NO: 6789 - protein, 452 aa, Serratia proteamaculans
MMEYKIIPCKLCALAILTFSSLSMAQEWNGTVLGFEAPPDPILGDMLGIRTILNDNGFTYNLGYLNEIASNGGGGYNHDTHVAYIDQFALTFNQDLARWTGIPDARIEGNIVNRNHNDDLTTKRLQDPRVNFNDLTQESWGGQSITRLGWLTFARSFDDRRLTWRVGMMNKVQTFDQIIPCDFQMLSQCGGKSANSLTWNNWNVHTWGTTLEYKVTPTVTLKGGVMEQNPNAASRSHAWSWSTKGSKGVLLPVEIDARPLINGLPGAYNLGVVFTNASQTDLYRGKSGRAGATDPDGYDHHNRTWFMYAGLNQQLTQHHDDPNRGLSTSVSMSLADQRSNYMHQVYAASLRYRGLFDARPEDWIGFGLTWIDMSNQYARNQREMNALNGVADYNDPAYHPVPGHSLNGEFYYRFRPVAWLELQPGIQYWHHPGGVSRTQDAWVTELKTVVTF

SEQ ID NO: 6790 - protein, 180 aa, Serratia proteamaculans
MNNTPKILLASLFTLALTPSVSASIFEDNEFSGHRIGGGYSNTELVFDNRGADWGDGIKLEYGYDINQIFGINASYQNNNGSKYGVDLDGSTLKIDSDIGYTFKFEEWSVKPYGAVGLARVNEKLSYDGISDSFKEISLMGGMGVRANLNMGLYTDLRYDFFNIDNQDQDQLSLTVGYRF

SEQ ID NO: 6791 - protein, 344 aa, Serratia proteamaculans
MGTGILEPSRWGLTGNEDIGGGTTVKFTLENGFFAQNGAQFQGGTLFNRNAWVGVANANYGTLTLGRQYDPFSDNMGAYVSSTNWSTLYGSHFGDVDNLNEAFNFNNSIKYLSPSFGGLTVGGLFSLGGVAGDFSQNRGWSIAANYTRGPLSLSAGYLQLRNPLQAALGGESGYIGDFSCTNADASYCELQNAQKIDIWGAGGSYVLDQVTLALSYTHTRLSQSQYFESTAGPRGADISFDIAELNTVWQYSPALQFGFAYIFNNAKPDQGASTRIHQVNLGAMYNLSKRTAVYAVAIGQKSSGAGLGVNAAGGGTQNLAQIPTLVNSDTDKQLAIIAGIRHNF

SEQ ID NO: 6792 - protein, 726 aa, Serratia proteamaculans
MSAARIDVVDRIKYCRSRLNFCSTGLATSLLLLAPTEIRAQSEPVADEVVLSELSVAGTGPVSERADGPVVGYRATRSATATRTDTPVRDSPQSINVVPRSVITDQQDLRLTDAVTNVSNVVLGSTVQGRSQNYLIRGFSTQVFAVDGVLVDPAINFYPVTRDLVDAERVEVIKGPASVLFGRGDPGGVINIVTRRPTFEPTADASVQGGSFGFRRFQGSVSSALPAVEGLAARLSFAAQEDPTFRNYGGDTNRRVFVAPAFSWTPSADTRVYVNSEFTNQHTQYDEGLVAFRGRVPLDNIGRFYGEPSSRYFGAFNTITMRAEHDVNENLTLRQVIAGQWGTFDVFAARALSVNNAGTLLSRREATVNSRFAAVDSQTEAVMKFDTFGFAHTALLGLEYSNGFRHAFSQQGNLAPVSFLNPMFGAAFQPLQFQADLKQKLEVFGLYAQDQIVLAPGLQLVVGARFDLGSQYYFNRQPASRTQPPEQTLFGASPRVGLIYRPFEPLTFYASYATSFLPQTASVLNVASPPPSTGEQVEAGTRVDLTPGLTLSAAAFQIVRDNVAATDPRNPTFSVITGQQRSRGVEADLAGEILPGWSIIGSVGLIDARITKDTTFAVGNRLAGVPVFSGSLWTTYAFQDGPLRGLGLGLGVTHVGRRYGDLDNSFTVGAYNRLDALVYYDFDAHWRLSVNMRNLTNARYIEAPTNATNNTPGAPFTVLATITARL

SEQ ID NO: 6793 - protein, 992 aa, Serratia proteamaculans
MKRNLLAGFIAAISASGALAGEAVFYVTEQGQPVDTLSITVNGDRKLVGKNGFASFELGGGTHQVELSEFGQWAGEFEFDASAQQNAEIQVEMIGGEAVPEISVYTPGQEEAPVYGQISGYIESDETGGGVEGATITVAGAGVSVQTDGEGYYELELPRGEYNLSIEHPTYGARDISDLRVIGNYATAMNVNMSMSGDSAIEEVVAVGSYIPSTATAQQRDSSAVLNAIGSEQLARFGDSNAASALKRVAGVSLVGGQYAVVRGLQGRYISSTLNGASMPSTNPMKRDVPLDLFPSSVLKGIEIQKSYTPDLPGDTTGGAIRMTTKGLPAGYTNKLSLSVGANSQITGKDVISYDGGDTDSLGFDDGTREVPSSVASITNDGAPGALGDRCEIGCEFSFDDVSSYIGEFENNYNSKQVTAKPNVGFAYSYGDLIESTSGDFGYYGAIQYSSKWSSRENAYIDDMGGQFDYERSKYNIDLTAYLAAGMETFDGTLLNSKTILLRKSDDTTRFETGVDDEGITVDELTLQWVERQLISQQFSGSHTIGDGDQLDWRIGLSQSNRYEPDRRTYQYRNKTLAPATLERRFSELTENAIDMGADMQHEFYFNDMVSMTLKYGAMLSIKDREVDLSRYGVDKNNNVSVPNNSDLEVLLSEDNLDQNAYFLATRTTDTDSYDAQDEMFATYVSSEFDINGEYKILAGARLEDSNQELTYPNSNNADSELSATEVLPVLSGTWVANEQLQFRLGVSNTLARPGLTELSESSTYDPETDDELFGNPDLEISNITNLDLRTEYYFSEDENISVAVFSKSIDKPIEKSVPNASGSSADGFTYVNSDSADVFGVELDFRKNIFNGEDWTGFLSGNFAWVDSEVELNAQSKQLEGRDTRQLQGQSEIIGNLQLGFDQFSNAQSITLLVNYFDDRIDKVTRNVDLEMEKGRTVIDLVHSWDVSDTMTLKTKFNNITDSKVEYSQGGRIIESYEEGIEASVGIDWIF

SEQ ID NO: 6794 - protein, 174 aa, Serratia proteamaculans
MKKIACLSAVAACVLAVTAGSAFAGQSTVSGGYAQSDYQGVANKSSGFNLKYRYEWSDSQLGYITSFTHTEKSGFGDEAVYNKAQYNAITGGPAYRINDWASIYGLVGVGHGRFTQNESAFVGDKHSTSDYGFTYGAGLQFNPAENVALDVSYEQSRIRNVDVGTWVAGVGYTF

SEQ ID NO: 6795 - protein, 360 aa, Serratia proteamaculans
MMKRNILAVVIPALLAAGAANAAEIYNKDGNKLDLYGKVDARHSFSDNNKQDGDKSYVRFGFKGETQITDQLTGYGQWEYNIQANNAEESGAQEGNATRLGFAGLKFAEFGSFDYGRNYGVIYDVNAWTDMLPVFGGDSISNSDNFMTGRSTGLATYRNNNFFGLVDGLNFALQYQGKNDRSEVKEANGDGFGIGSTYDIGNGINFGAGFSSSNRTLDQKYGSTAEGDKAQAWNVGAKYDANNVYLAVMYAETQNLTPYGSFSDTIANKTRDIEITAQYQFDFGLRPSLGYVQSKGKDLNDVDANHDLLKYVSVGTYYYFNKNMSTYVDYKINLLDEDEFTIANGLNTDNVVAVGLVYQF

SEQ ID NO: 6796 - protein, 359 aa, Serratia proteamaculans
MKKTAIALAVALAGFATVAQAAPKDNTWYTGAKLGWSQYHDTGFYGNGYQNGIGNGPTHKDQLGAGAFLGYQANQYLGFELGYDWLGRMPYKGSVNNGAFKAQGVQLAAKLSYPIADDLDIYTRLGGMVWRADSKANYGRTGQRLSDHDTGVSPLAAVGVEYALTKNWATRLDYQFVSNIGDAGTVGARPDNTMLSLGVSYRFGQDDVVAPAPAPAPAPVVETKRFTLKSDVLFNFNKSTLKAEGQQALDQLYTQLSSMDPKDGSVVVLGYTDAVGSDQYNQKLSEQRAQSVVDYLVSKGIPSDKISARGMGEADAVTGNTCGYKSGRATKAQIVCLAPDRRVEIEVKGIKDVVTQPQG

SEQ ID NO: 6797 - protein, 368 aa, Serratia proteamaculans
MKKIAIAVAVAVAAFTTATQAAPKDNTWYTGGKLGWSQYHDVNFYGNGYTSAIGNGPTHKNQLGAGAFLGYQANPYLGFEIGYDWLGRMPYKGSVNNGAFKAHGFQMATKLSYPIMDDLDIYTRLGGMVWRADSKATYSATNTHLKNHDTGVSPLAAIGVEYAITKDWATRLDYQWVNNIGDAGSVGARPDNGLLSVGVSYRFGQDEAAAPIVAPAPVVAPTPAPAPVVENKRFTLRSDVLFEFASSELKAEGKHNLDQLYTELANIDPNQGKVLVLGYTDRIGKDVYNQKLSQKRAQSVVDYLVSKGIPSGSISAEGHGKANPVTGSTCDKVHKPNLINCLAPDRRVEIEIQGTKEVVTQAQSQSAQ

SEQ ID NO: 6798 - protein, 867 aa, Serratia proteamaculans
MPLHTRRPHFPRLSTASLSLLALSIACAGLPLAHAAEPTPATQQHNQGGYHFAIERQPLVSALNSFSDITGWQVGLPAQLADGVYSPGTSGRLSAELALARLLEGTGLSYRSVGERSVILVRNPSQSIALQPMTVTATRREQSVSEVPSSVSVLGREQLDRQNVEDIQDLVRYEPGVSVGGTGQRAGLTGYNIRGIDGNRVLTQIDGVEIPASFFYGPYAQTHRNYVDPEIVKRVEILRGPASALYGSSAIGGAVSYFTLDADDIIKNGREVGARLKTGYSSADDSWLKSATLAGRHEQFDALLHLSRRDGHETESYGDTGGSGLNRTRANPEDVRTTNLLAKLGWNYNDSDRLQLTYEKYKDDRDSNQLSAVGGPFNAGSGFGYYRSRNANDTITRERFGLEHRLALHSPVADTLKWSLNYQLAKTDQSTVENYVPTNFFTGAVTRDVMRYRDTYYKDRQWLFDAQLDKAFALGATDHLLTYGLTLKHQEVRGLRTGYGICNAAIGAACSGGVGSPSSNASDNLTPQSDFPDPTVKTYALFLQDDIRWDQWTFLPGLRYDRTHLDPTITERYQATAIGGGSEPSGASRTWQRVSPKLGVTYAFDDHYTWFGQYAEGFRTPTAKEMYGRFQNSNPSYIVEPNPDLDPEKSRGLETGLRGNFASGSFDLALFYNRYRDFLDEDAAGSRGAIPVFQSRNVSRASIRGVELKGRLDLDSFGAMDGLYTQGSIAYARGRNEETGEALNSINPLTGVFGLGYEQERFGALLSWTLVKRKTRIDDSSFNSPDGSGSQFASPGYGILDLTGHYRLSDDLTVNAGLYNLTDKKYWLWDDVRGYDDVGEAGVTSPANLDRLTQPGRNVSINLVWDI

SEQ ID NO: 6799 - protein, 169 aa, Serratia proteamaculans
MFGKTEVQYKPYLNLKSEANRNPNVNSLVFSGEMEENGKVVSIYKKNGNLIYVYGIEGEKPEITIVGVAGKNLFSNYGKWSIGANYDKVKANFLVFKNSNYTYVLSFYDSNGKVANLYLLEVYKRGECCPVFSKNLDNFSIYDEIFTSTSNKDILNKIPEDSDESYVSY

SEQ ID NO: 6800 - protein, 749 aa, Serratia proteamaculans
MITTNTLFRVSSLALAIGLSFTVQADEIARDPRLNINEVIVVHGDGGEASEMATTHWSISEEEIRATGAQSLDQVLKNVPGVYIRVGGDGTPRVDIRGFKTRHVTLLVNGVPMSSADDGQFDPSIIPTSQIASVEVSVGPTSVLYGPSGAGGVINIITKQGSTVPALAGRLEAGKDNTFNGDISAAGSGDDWQGLVSVSRQQTDGFPMSNDFEPTQYQDGELRVNSDKEVTNVYAQGSYWLSDKTQLIANMALRSGEWGKPARDGTGSGKLKFERTDDYDAHTFQLGLAHQFDDTFTLRGFGYHNQSDTLEASYADETYQAVTLSQDGRSVVQGVNLQLITDLHTAGLFTTSVIAEKQSWKSVVDTYTANTGSNNGGTTGSGGGTGTGGGTGTGGGTGTGGGTGTGGGTGTGGGTGTGGGTGTGGGTGTGGGTGTGGGTGTGGGTGTGGGTGTGGGTGTGGGTGTGGAENLNDSAWLYTAAAEYQYQSELQYGFTLGGAYHSLDTTDSTDGNYSAMASSYWQAAQDSRLSLSVARKVRFPSMVNLYSQLSGNRDLEAEESKHVELGLEQNLPASTDFSLYGYYTDAKNYIAKDVDGFYQNMGRYKFKGVDFQINNHTIEHLDLSFSYSFLDSEEIDGDDTLDALQYRPRHQLRWQMSYEFPFETQVHLNVERILDQVYATQVKVGGQTQYQQQSLDNYTLVDVNLVQPLIRDKLDVYLRATNLLDENYYQSEALPQAGRQIFIGVNWQI

SEQ ID NO: 6801 - protein, 203 aa, Serratia proteamaculans
MQMHTMIPAAFAATLALLAAAPVAAQSAGDMTFGIGLGSVMPKSDNGTLAGLGAEVGNDVQPTITFEYFIRDNLGIEILAATPFKHDVSLDGLGKIGSVKHLPPTVTLQYHFPTGGAFAPFVGAGVTYVTFFDEETPLGDLELDDSWGLSVHAGFDYWLNDRNAIRADVRWMDIDSDAKLNGASIGTAEIDPVVVGVSYIWKF

SEQ ID NO: 6802 - protein, 269 aa, Serratia proteamaculans
MMKRSIVFDALLILCISFFPIHANESCSNDGQFVENLMLADESTCHKSRKYNGREVISVKDKKLDFYVSANSGKIYSDNSETFVNGIKAIGERVPTLVESRYGTIIKNMVADEIESVKKFDDEIDFQWLNSISLGYYAGENGRIDFETMYSKVNIKNGNSFPIFDRSAGIFAFLLNFYYNPSIQDTQIAPYVGLGIGPTVFRLRKINGSPQNSMPLNVPWFAYQVKLGVSYSIIPEIKTFLGYRYFSIPIPIADDISTHNIEIGLIFNF

SEQ ID NO: 6803 - protein, 369 aa, Serratia proteamaculans
MKSTFNRDQLAITIAISGIALVPWCSTAHADENFVQMYGIVDAAVGYVSDVSGHSSVREIPGTVADRFGLRGQEALGGNSYAIFTLENGFNVNDGTIGQGSSGTTRIFGRQAFVGLQFPALTVTAGRQYDMMYDMFSYSAASYLSPYWYRPGTAANLVGANGSSADFDRLGGVRVDNSVKVSTSAIPGWTFSSMVGLGGQPGTLSDGSTVSAGVRYQGKALGVGAAYTNFKEADGTSNYVTWAVGSNYVIRSLTLTALYTSTQYSRTSDSVKVFEAGVKYQFTPAVYVGAAYAFMLPNHDASNVILRGNHNQAGIDIDYSFSKRTDVYAMAIYQRASGGNAAQIFILPSTGIGGGSTQTLVAVGIRTRF

SEQ ID NO: 6804 - protein, 412 aa, Serratia proteamaculans
MASEITVEGGSVTGLSGDDADYTITIEPVMGATVTVTIIANAAQDEANNGNIVSNTYTIQAGSPASAFEENEEEILAVVAAEALRGVRSTVSSNVRMTSAAQERFISGRQQAGTDSQMVSRAATPLDITGSAELSNGRFSTQGTFFGETGSDESGQTRLFFGDFDIQRDTDGSVSAQINGKLAWERQISNTAMYGYYLGAELGRATLEGAFAGEQDSFGASVGAYFVTEIQPNLYVDGFASLGVGRNSLELDNGTLNVASDYKTTTGTVGASLTGVVEGDGYELWPQLQLTYGQTHIGKMTFSGEAYSLVDDTLSLDAGTVSMASGTFTAEFKVPLDGLSVSDSHALFTFAPRVICERIMATDTTSNCGGGAEIGMVSRSSDGLSNLTVNIRRDRVGDTTTTGLGLNFERAF

SEQ ID NO: 6805 - protein, 756 aa, Serratia proteamaculans
MEKPLKSLDSYSASTLANSLAAAIAVPALCLMPGAQAQTSAGVTQLAPVQVEGEASPYQATTVQSSKMTAPLLDTPRTVQVVPQQVIQDQAATNLQDVLRNSPGITMGAGEGGRAGGDLPIIRGQNAAGSIFVDGVRDPSTQIRDTFNLEQVEIIKGPDSVYSGRGGAGGSINLVSKTPKARDFAEGSVQIGTDSNYRATADGNWLLGDNAAFRLNLMGNKGDVPGRDHAVDFSRWGVAPTLQLGVGTPTRITLGYYHYQDDSMPDYAIPYDPKSGQPVTETQGVSRKNFYGLTGRDFMKSRDDVATLAIDHDFSSKLRLRNVTRYGRSVTDYAATNPDDSKGNVPNGLVYRALKAGYYTNKTFTNQTDLSGEFETGSLQHSFDVGFEYSNIKQDKDSYTQTIAKGAMPCKVGANDASNPALCTSLWDPDPHDYYPGHLSRNDNPARYSTDTIALYGFDTIKFNEQWQASVGLRWDNYRVSGSNIARGRNDPASTPAFYSTSREDNLFNYQLGLAYKPVPNGTIYASYGTSSTPSAVAGSNVSDAVTVSNESLAPEKSRTVEVGTKWQLFDDRLTLSGALFQDIRKNTSVAVSATETEQIGKAKVRGIELGFSGSITPKWNVYGGYTFMDSELVEGAYNSGAVGQDLPNTPRNAFSLWTTYKLVPQLTVGGGAYYVDKVYGNADNGRNADGTPKARWVPSYWRFDAMAAYEFNDHLTAQLNVMNIFDKTYYTKAYAAHYAALGTGRAAVLSFNIKY

SEQ ID NO: 6806 - protein, 371 aa, Serratia proteamaculans
MKLRVLSFIIPALLVAGSASAAEIYNKDGNKLDLYGKINGLHYFSDNKNLDGDQSYMRFGLKGETQITDQLTGYGQWEYQVNLNKAENEDGNHDSFTRVGFAGLKFADYGSLDYGRNYGVLYDVTSWTDVLPEFGGDTYGADNFLSQRGNGMLTYRNTNFFGLVDGLNFALQYQGKNGSSSETNNGRGVADQNGDGYGMSLSYDLGWGVSASAAMASSLRTTAQNDLQYGQGKRANAYTGGLKYDANNVYLAANYTQTYNLTRFGDFSNRSSDAAFGFADKAHNIEVVAQYQFDFGLRPSVAYLQSKGKDIGIYGDQDLLKYVDIGATYFFNKNMSTYVDYKINLLDKNDFTKNARINTDDIVAVGMVYQF

SEQ ID NO: 6807 - protein, 1126 aa, Serratia proteamaculans
MSQINSRRIIFTIMRTFLLFIAIGITTLQANDSYAQTRLDIDVEKVTLKTLLNEIQGKSEYIFFYKDGVLPESEIVTVRKENATLMNILDPVLPRWNLGYKISDRQVTIFALPLAKAPGIEEANVPQGFEISGTILDQEGIPLPGANIVEKGTTTGTQSDFDGNYSLVVSGQNATVVVSYIGFSTKEVAVNGQATLNVTLEESAAALDEIVVVGYGTQRKSDLTGSVTSLSQDDLNPGANASVDQLMLGRAAGVQITQASSAPGGGLAIRIRGASSLNASNEPLYVIDGFPIDNSPNLSSGGAAQTGDNQSPRNPLNALNPADIQSIEILKDASATAIYGSRGANGVILITTKKGRDGKVNLTYDAYAGMQTVAKQIDVLSTSQYITAINELSQAQGNGVVFSPEDISAIGDGTQWQDEVFRSAPISSHNLSISGGSEATSVYASVNYFDQEGVVKNSGIKRYTGRINVDTRLGENAQIGINFNTSLVKDQNNVDGIQTNENAGPIYGALLYDPTEPIFNADGSYAQSPNLTVNNPVTTLNGILSENETNRTFGSAFLNYNFTDELSGKFNFGTDRQTSRRDIYNSSRTIYGSAAGGIANINVLERNNYLFEYTMTYNKTFNENHILTVLGGTTYQKFSTRFVSANISGFPTDEIGTNNLSLGNTNNDDLNSGKEENTLLSYLGRVNYTLFDKFLLTASIRADGSSRFGENTKWGYFPSFAFGWKLQEEEFIPEIFDQLKLRASWGQTGNQEIGNYASQLTFGTGPFVVLGGNIQSTVVPQRIANPDLKWETTEQFNVGLDASILSGRFSTTLDYFTKSSKDLLFNLPLPVASGYSSILTNVGEVRNSGFEFLFSSTNISTEDFSWKTTLNFAAIKNEVVDLGRIDNIVTGNIQSVGNTAVIREGDPLAAYYGYVVTGIFQEGDDIANSAQPTAEPGFPIFEDRNGDGAITPDDQTIIGSPFPDFTYGIQNSISWKNFQLDFFFQGQEGADLININVIESLYPANFRRNRIADQILNRWTPQNPNAPWPSSTNPNAYGAGKVNSLTVEDASYLRLKTLQLSYNVPVNNLDFINALRVYVTGQNLFTITDYAGFDPEANSLGRSNVRVDYSSYPLARTFLLGLTANF

SEQ ID NO: 6808 - protein, 895 aa, Serratia proteamaculans
MTYKIKLLSAQIIAASLLGMSGSVFAQMKSIADEPVLEEVITFAKLKSAADDVIVERLESDVVADIIDAETIGRIGDSTVASALRRVPGVTLVDDKFVFIRGLGERYSNSLLNGAVIPSPDLTRNVIPLDIFPTSILKSIAVKKSYSAEMPAAFSGGLIDIRTRSIPDQFMFTVEVGYKQNIDSRGDVLSYRGGSDDSLGTDDGTRSLSGELISAVNMYGGSLSPIDILNRINLGDGTKTLADAEAINRNLALHLNRNVDISEQSDDLSGSIESNIGNNFYLDNGMEVGFMLGGVYGSEWANKDSIDRSYGDPEDIFAAKKESTYSVNMTGNASFGWRWYDDHRIETTSIFLRNTDDKASITDSHTSSFPLSDGQGFRQYKTRFEERNLTVNQIRGFHRFGGITRDLIGFEKFDWLDELTFDWFYSDAMSRTDIPNQTNILFKTAVDSDSAEVSAQNLQASASAADFRFTDLNDDVESYGYDFKLPLMMSFGDLTLTGGYRYSQKTRSYEQLQFGLGTDDTAVAQSAIGTVSEIFSDANIVDADNGFNVAVIGSNGESYLAALTNTSAYGTIDLLYDETWRLMLGARWEDYNQVGIPWNPLKFEGCQISCNETTLMNSVFKEDDFYPSVSVTYIKPDFWAEDFQLRFGYSETLVRPDLREITPSSYLDPITGARVSGNANVIPATVTNYDLRAEWFFSDGDNFTASLFYKDIQNPVEFFEAAAFEEALATEIVNAESSTVYGLELEWLKGLGFISSDFESLFVAGNMTVLDSELTAGEFADAPTNATRPMAGASDYALNFQLGYDSEDGKHSAMLIYNVFGERLYFAGRNGSPDAYEQPFNSLDATYFFYPTEQFTVKFKLKNLLDEKIEITQNAVVTHEEQPGTMVALDVKWSF

SEQ ID NO: 6809 - protein, 783 aa, Serratia proteamaculans
MNRKKHQILKILLLCLISSKSSASEKELNLQFIRHKFGQNTEDIELFFNSSTVLPGNYTVDVKLNDEVIGRAKLEVSQDDKESYCLKDEWLSDLGIIINRDFYNKYFNIKRECYEIGKEKNSITTFDNNSQIFSLYMPQAAYIKKGNTEHKWSYGDPGFNLNYDAYLSKNDEDSSIYGNLEGNVNIDKWVLYGRGYKYEHDKFTTDDVTLSRAIKSLEGDLIIGDTYTNTSLMDNISFYGVQLRSNNAMTPERRGDYSPIISGIAKSNARVTVKQNGVVLHSELVSPGPFHINNVRGIRSGELVMTVTEEDGSEQQTRIPVTFIANLLSPGNYNYDFGIGNKEATWEPDNIFAYGSFDYGLNLLTLNASLLFEQHYSNAGIGAVGSIGSLGAVSVSGNISRAKNQLETDQGYSTSANYSKNVGANGNLQIIGYKFSSEGYTQYANFDYRAPRKDKKEKERYEVTLTQQFPASNVFLSVTGWKKFYWNDNSVTGANVSYTQNFGTVNASVNGSYSRGDGAKSDYMLGFNINIPFRHNDRQFYSNSGVTYNRNSGIGFNAGFSEDVTKNFNYNVNAAASKDNESVSLSTNYTSSMFRTSASVSKNRNSTNASAQIGGAIIGVKDGGVMLTSMSSNSVAIVQMEGLAGYAFTNGVESDWRGRIAYPMTTYMDNDIQISTDKLPSNIELTDNVETIVPTNRAIKLQKIKYKNMSRHVLKVYDKNGFVIPMGTAVKNSNGEIISFVNNNGISLLNIDKNDERVFFGSCTISTSGLKDNLSEIQEVNCE

SEQ ID NO: 6810 - protein, 679 aa, Serratia proteamaculans
MKIKLIPLNVFVNLPLLFSASSLLLPFISFEALSASEPSDLFELPLEDLLDIEVLSPSQTVKKIGQAPNIITSITAKQIASMGARTLSDVLKMVPGVQVLTRRNGQDMVWIRGIPTGRNSKVMLLIDGVPQREGLIGGWSSDEQTQINNIERIEVIRGPGSALYGGDAYSGMISIFTKHKVPQYNTVTAGIASFDKQWLNFEAGKEVGQSKLIVSGRWQQSEGYAQQYDRAGLDSTHNNNVKAKSLSGTFLSGNWQLGANFDDFTTEYPHYSSAQYKSQRYEILSAYLKHVFNFDKLTIENQLYTYQVTRTFERTIKDLDASINFYSDSDLDSDSNGLRSQWSYAFNSQQHTVFGLIYQQRNVSQYHETISLKNGIAVNEIESRVLKNGDSSPASHNRAVYIQHESLWMANQLGVTLGARVDDYPEFDTEISPRVALTYQSNQDWSGKVILGTAFRPPTFLQQYEIRNDNNVSGNPALTPEQIETIEAEWVYHFSTNNNLAIRGFRSQLSDFIQSIDGKPYENSEAQLAVPGYEIEWNKKYQTTWSFFNRISTSFNYTRVNSDQASLAKNTLNWLVFAEDTQFSFYFGLNYLGRRNESDTYHSAVKVAQLAEQDNKRSYWTLDSHLSYRPHLESPWLLTLSAKNVLNKQHYNPTLAPDSYYDVRKEPRSLDLSLSYQFK

SEQ ID NO: 6811 - protein, 684 aa, Serratia proteamaculans
MCASGAVHAAETATLPATQVSAAATEGREGYSAESTSTASKSDVPIKEEAQSVNVVTPQTIADYNVRSLDDAMKFVSGVSQGNTLGNTKDSVIKRGFGTNDDGSILRDGVRSVVSKNFGATTERVEVLKGPASLLYGAMEPGGVINVISKQPQYVQSTTLSGSAYSEGGGSFDIDTTGPLGDSGLAYRLVAERQSEDYWRNYGVDQHTLIAPSLSWTGERASLTLAYEYNDYISPFDRGTVFTGGHPADISYDKRLDEKWANTVGISETATARFEYQLSDDWKTRLTYGWNNDRYSLSIAQPSTLSSSGVLRRQANGGHYDYETRYASWDFIGKQEILGQQHDLLIGAEQEDSDKYRGKTYRNTAQNGFNIFSPSYGSLAEPSVVSTTTSNLSNQLTSSSIYLKDNWHLDDRWILVLGGRYQHYDQYIKQGLGASRVTNLDKNDDVFLPMAGLVFKVNEDLSLYGNYSRSFVPNDDVNDDGTTFDPEEGRSYEVGAKYALAPALNLNLAVFDIEKKNVVTPTGVTGVSEAAGKVGSQGMELDVTGRIAERWDMIGTYAYTHTEVLDDPSNKGNRLSQAPKHTASLYLTHHLQVPSGLGDWHAGGGARYVGERAGDDANTFYMSSYTVADAFLRWDVPMASYKTRLQLNVDNLFDKQYYPSSTGSQLQVNVGEPRTARLSASVTF

SEQ ID NO: 6812 - protein, 747 aa, Serratia proteamaculans
MTSFLSAAQTSTIPSTEPAPQVQNQAESNPSGDTMVVTAAEQTRQAPGVSVITAEDISKRPPANDLSELIRTMPGVNLSGNSTSGQRGNNRQIDIRGMGPENTLILVDGKPVSSRTAVRYGWRGERDTRGDTNWVPADMVERIEVLRGPAAARYGNGAAGGVVNIITKQPTQEWHGTWNTYLNAPEHGAEGATKRTDFSLMGGLTDSLSFRLYGNLNKTEADARDINEGHQSARAGNQSASLPSGREGVRNKDISGLLRWDMTKQQSLEFEAGYSRQGNIYAGDSQNTNTNPLVVSNYGKETNRMYRQNFAVTHRGYWDSGVSSTSYLQYERTHNTRILEGLSGGLEGIFDTTSPNQYGTIKLDNFTAHNEVNLPLNVWVDQVLTFGVEWNEQKMKDPVSNSQTTTEAGSVGSLSSGGRSERSSARLASAFVEDNIQLTQSTMLTPALRVDNHSTAGTNWSPSLNLAQELGDDYTLKLGIARAYKAPNLYQTNENYILYSRGQGCSGGTACYLIGNEDLKAETSLNKEIGLEFHRDGLIAGITYFHNDYRNKIESGNNVIGNAVGGNNTGRNNANIFQWGNVPKAVIQGLEGNLTVPVTETINWRNNLTWMLESKNKTTGDYLSITPEFTLNSSVDWQATEKLSFLADVTWYGRQKPKMYNYKGDRVTGSATNELSPYALFGLSSSYKFNKNLSVTGGIDNLFDKRLFRAGNAQDVVNNNVVTIAGAGAATYNEPGRTFFVSVNTSF

SEQ ID NO: 6813 - protein, 920 aa, Serratia proteamaculans
MKDKIAILAFLFILAVNGQEIAPRFSFDFQDISLENALLQLQSESGKSMYLADEWIKGKTVTKHYTNVLLEDILSDLLKDTQLNFFISKDHRIIFTQNNRIFGELPENFFGREELINEENEDDDPAASIFLSDKASESKLKVATVRIGKEQKNNQRKRFRLSGTIRNIADNRPVPNFAVVVRALGIGTTTDNSGRYAINLPVGLNVVETSSLGFEDTKTNIIIYNDGNYNIEVEESYELLDEVVLKADAVSNVDDATTGNTKIGAEETKNIPLVLGERDLLKVATTLPGVTTAGEGSAGFNVRGGKTDQNLILLDNAVVYNPSHFFGIFQALNPFAISDLNIYKGAIPAEYGGRLSSVFEISTKNPDTEEFKGEVSIGPVTANAVVEIPLVKEKSGLMIGARGAYSDWVLRSLNDVSLKNSSASFYDVMGKYNHQINENNGLSVSGYYSKDAFSITSDSLYGYSNRLFSLKWDHKFNEKNAGSLVLTNSQYNFDIDFDGSVNDNFLQKYKIDETELKLRMKYLLNDRHNFDYGFSTKLYGVQPGQIDPKTSQDLILPLKIPKERGIESALFLTDNLKVNDKLLLDLGLRYSFFTALGSSQQLVYEDGLPKSTETVVDTLNFKKNEVIKTYGGPEVRISARYFLKEDFSIKASFNNMYQFIHTLSNNTTVSPIDTWKLSDYNIKPQQAKQFALGLYKNIDNDNYELSLEGFYKRQKNLLDFKTGAKLILNETIETEVLQGDGKSYGLEFFVRKNAGKLNGWLGYTYSRSLLKLDSGFREERVNDGRYFPSNFDKPHDFSLVLNYKFTKRYSVSTNFLYQTGRPVTFPVGNYTFNDIEYVLYSDRNRYRISDYYRLDIGLNIEGNHKAKKLAHSFWNISVYNVLGRNNPYSVFFVSDSGEIEALQSSIFSIPVPSITYNFKF

SEQ ID NO: 6814 - protein, 1023 aa, Serratia proteamaculans
MKRKVLLSTLFLMLHMTVVLAQQVTISGQVLDEKSEPLIGATVNIEGTTNAVITDLEGKFTLKALPSEKIVISYLGYKPKTVAIGKNRKFNITLDPSVTEMDEIVVVGYGSQRKSDIATAVASVNIKDIAKSSSAQTLQALQGKISGVQIIPTDGSLSSGMTFRIRGVNSITGGTQPLFVIDGVPMPTQQITNEDTETVNNPLLGLNPNDIESMEILKDAAAAAIYGAKGANGVVIITTKRGAASTKPKFSFSLTGGLDMNPNIPLEVLSPEEYAKKMLDYGTYDSPNLINFWQNVIDNKGWNDPSVHNWMDEITRTARKYEANASISGGTKGTTYMLSLGYLNNTGIIKRSAFDRFTSRLNLNQEVNSKINIGINLSYSTSKDKNPVSDWSQSGVILNALQISPFLFYPGLADIMNYSNVNIMSPLVAVDQVNINNQYSELNGNIYFNYKILKDLTFSTSASYRQYSMDQDKLWGSDTWYGQSERGRMEISNREENSWVYEARLQYAKSIKKHSFSLMGAFEASKWSMKDIYNKSTNFEDMAVGIWGIDKGLVTYAPKYTYDSNQMVSYISRGTYTFDNKYVLNASLRVDGSSKFGANNKYGYFPAVSVAWRASEEEFIKKFDFISNLRVRTSFGMTGNNQIPSYQSLSQLENNKVVMNGSTVEIGRYPSNVTNDDLKWESQKQYNIGFDFGVLDNRFSITADFYYKRIDDMLLQVNIPSTSGYTKAWKNAGSMENKGMEFAINANWFKGAFNWSTDFNISFYKNKILSLDKGQYQQFYDRGINAKITSDVLLRVGMPVGIYYGYISDGTYNNDTEVINGYPGPNLGLGQLKVVDVNKDGVIDSNDRTPIADVNPKHTGGIGNTFSYKGFDLYAFFRWSYGNDVVNGNAYYLVGTTSINNVLKSVYKDVWSANTPTNNYPLYGRGTWGESVLRSDLVEDGSFLRLQTLTLGYTFPAKLTGKMGLSKMRIALTGTNLWLWTRYSGFDPEANTGYGTVARLAPGLDMSPYPRPRSFSLSIELGF

SEQ ID NO: 6815 - protein, 956 aa, Serratia proteamaculans
MSTKPLFKLKPITLAISTIFLPFTEAVADTESPSSNTEAVLELEAIQVQAKHEISRHDNEVTGLGKVVKSSEDIDKELILNIRDLTRYDPGISVVEQGRGATSGYAMRGVDRNRVAMLVDGLGQAQSYSTLKSDANGGAINEIEYENIKSIELSKGSSSAEYGSGALGGAVGFRTKEADDVIKEGQNWGLNSKTAYSSKNSQFTQSVAGAFRVGGFDSLAIFTHRKGKETRVHPAAEEIQHTYQPLEGYFNRYDVDQRNGTPVRANAYYILADECSNLSDPSCRHAKAKTNRVGAPENNPNWTPEEQAQAAKMPYPTRTASAKDYTGPDRISPNPMDYQSRSFFWKGGYRLSPNHYVGGVLEHTKQRYDIRDMTQRAYYTKEDICRSGSSCQTLDKNDTDKGNFGITLTDNPLDGLVYDAGNQARGVRYGRGKFFDERHTKNRSGIFYRYENPDKNSWADSLTLSIDRQDLKLSSRIHWTYCTDYPHVARCRASLDKPWSNYRTEKNDYQEILNLGQFNWEKTFNLGFTMHKVNIAAGFGTHRSTLQHGDLYAEYVTLPPYEEIKAYDQNTQFGNGSYNRPRVYRRKNTPELKTVNGCNETAGDNRDCSPRVITGRQYYLALRNHIAFGEWADLGLGVRYDNHTFRSTDPWTKGGNYHNWSWNAGVSLKPTRHFVVSYRVSSGFRVPAFYELYGVRTGASGKDNPLTQKEFLSRKPLKSEKAFNQEIGLAVQGDFGVIETSFFQNNYKNLLARADKHVEGLGYVTDFYNTQDVKLNGINILGRIYWEGISDRLPEGLYSTLAYNRINIKARKLHDNFTNVSEPTLEAVQPGRIIASIGYDDPEGRWGLNLSGTYSQAKQRDEVVGEKVFGKGGSIKRTINSKRTRAWYIYDLTAYYTWKEKFTLRAGIYNLTNRKYSTWESVRQSSANAVNQDLGTRSARFAAPGRNFTVSMEMKF

SEQ ID NO: 6816 - protein, 386 aa, Serratia proteamaculans
MKQATFPILTIASLMVAGAAHAQTSVTLYGTIDTSLTYVNHADGSKNLWALGNSSAGNLSGSRWGLKGSEDLGGGLSAIFQLENGFNPSTGGLGQGSRMFGRQAYVGVASNQYGSLTLGRQYDPLIDLVQPITADNYFGSAFATAGDVDNYDNSFRVDNAIKYTSPVFAGLQFAAMYSLGGVAGSTGSKQSYSAGVSYTNGPLSLAGGYFYAANANPSAGTRTTWSSTSDGTFDGAINTGYQSAHSIGIARVAGQYVFGAFTVGAGYSNSQYRRDGASVFASNEHYNTAQGFLNYQASPALLVGVGYSFTKSGGDTAANYHQASLGADYNLSKRTDVYMTAAYQHASGTTADGAGGSMAAEASIGSYGYNGTKSQTMVNLGLRHRF

SEQ ID NO: 6817 - protein, 744 aa, Serratia proteamaculans
MLFATQFTTAQTTIKGEVSDPKGPLPFVNVYLANTTLGASSNNDGSFEILNVPDGTYTLIASFTGYESVKKNITVNGGTITANFFLKQNTSLEEVVISGTLKPVVRKESPVPVEVYSQAFLKKNPVPSVFEALQNVNGVRPQLNCSVCNTGDIHINGLEGPYTLVLIDGMPIVSGLSTVYGLSGIPTSLIERVEVVKGPASSLYGSEAVGGLINVITKIPEQAPRFFIENQLTSWGENNLDIGASFKAGKANSLVGVNYYNYSNPIDNNNDNFTDVTLQGRISVFNKWSFDRKDDKVFDLAGRFFYEDRWGGEIQWTPAFRGGDEIYGESIYTRRFEILGNYQLPTTEDFLLRFSYTDHDQNSVYGNEAYIAQQRIGFTQLTWNKKINKHDLLLAGGVRYNYYDDNTTATFNAGANAEEEVVIPSFLIQDEIKFTDKNTLLLGARYDYDSRHGSIFTPRLAYRHKFNEDNILRINAGTGFRIVSLFAEDHAALTGARDVIITEELDPEQSYNVNLNYLKKIYNRNAILTLDASTWFTHFTNQILPDYDTNPNQIIYSNLNGYSQTYGASINLDATLTNGIKGSLGVTYQDVSQTEDGVRERQILTESYSANWSLSYKIENLNLNIDYTGSLYGPMRLPILGELDPREEYSPTWSTQNIQLTYDGITNLELYGGVKNLLNYTPNRNNPFIIARADDPFDENVVFDNQGQVVPTADNPNALTFDPNYIFAPNQGIRGFFGIRYTLN

SEQ ID NO: 6818 - protein, 955 aa, Serratia proteamaculans
MTITKNGTLMNSGSTVNPSSAIVLKPSNSSTPTLTLINEGTINSRIDIENNNGFSGTITVKKFENKGTINERVFMGGDGSGTISIENFNNEGFIKGYESGTDSYQGVRFEGNVHVGTFENKNKGTIEGKNGNYAILLIGTNSSTPTLENFNNEGFIKGEIGIGGTQGFRGTVTVKTFENKNGGTIDGGIYIPASTGTISIENFNNTGTIKGGNYQGVYFQGDKVHIKTFENKGFISGSAYDMIYKNFNVSGGVSMAGGTIDTFINKGTIQSTGTNHNPAGVKLNYATVKTFENTGFISGTIGVLATQGTIETFKNSGTIEATGKDGHEAAIQIRSAFKNSSSITHFTNEGIIKSKSHGVLIESGDKIETLTNKGTIETELNGIGFYNYTGSEETHLGKIILESDSSIKAGKNGIDIDNQTTARSIRVGGIEVQKGASVSGDEAGIYLGKDKEITAPITISGTVSGGNAGIVNEGRMARGITHNGEAELVISNQGLVGKDDKGNTVTNNKGSVTIKDWVVTTNEEGKLDTVVIGGEKTENVQVSNITVDQSGLELEELNEIKNLISGVSTNNIANVKTNGGGEISLSYDPISARLSTDVQLNASIAGANFRSSVATASKRATFIDNVMANAMQSFSLDSSGKSQKIALSEKGNLYADASDYIKNDYIKNDYIKSDLTQANYGLNKEHALFILPYLSSQSVELSLNEESKGHTKGTIIGYSTLKDSGIYGVYAGYEDTKMDSTYFDVNNISYYTGLKYFNTLFTTAKGQEVYIKAQAQAALIKNDFTKRIGKNEAKAKAHSYTYGIHTALGMNFIADKNIFSPEAGFAYEGSYTEAFSMQDTRGQATVRGGERTYANHLNLFSTKTSFTWFRDWLPNLKTSVELGAKFNVNPKVKARARFGNMKVNDEFHLPRVRKFASTSLIVPVNEAFYFSLNYNGMFDEKGNTHTGFAQFNYLW

SEQ ID NO: 6819 - protein, 766 aa, Rickettsia akari
MISLSMGQNADESDVIVSEREKVELVQDSNVSEAIERRPDLQFNNITIDGEASGSSLSDLPSEAVDSLEVMRAITPDLDADARGGSLNVESKPIFLLEESVNKLEASLEYDEEGSSWGQDFSISTSRTTGNFGYRLGFSIDHYNSYNEASFSDWIYHEEQMHFAPEFLTVETEESEESEYKFNSRIDYKVSDSLYLFTRVDLGQEDREETNPSIVYRFDSGDYSNLTANSGQSANARIDRNLLDFSSEDTERFWQVGAVHDKDAFHLDAKVSIEKNRYYEPDWYIIEFEQNDVDLAYQWNDPQSIEVTTGESQASDFAFDEIVDERWHNDQDDLIATLNLKRSFETDRFKGFLKGGLKYRNREKRQNSDSHLHDQYNGAFDLSDVAIDGGTSSELDKAYDIGPVAGASESHDFFEQNYANFPLNIRRTREHSDGNSYFVSEDITSAYVMLNTEWGAFRSILGGRVEETTISYEASEVVIGENGEYIESLPRAGDRSYSNFFPSAHLRYFLNDRTTLIGSWTQSIKRPNYGSVVPFRSINYGNRSIEEGSPELKPTLFDNLDLSLDYELTENSTVSLELFRRDISDLVFWENTRIDSGEFAGFDLGRNRNGPSADRQGLNLIWNQSLQDWSQKLEGISFNLKASLIDSESEYPNRPHDTLPAVYDSDFSLQISATYDREKVFAQLTYSDRDDYLKSVDDLIWRDRYDRGREQLELSASYQINKNTRIFFEAENLLVSHNQDYLGDTSRPMFFGVSRKEYTLGARMNF

SEQ ID NO: 6820 - protein, 1130 aa, Rickettsia akari
MNKLTEQNLLKKSRFLKYSLLASISVGAVMAMPVEGIAMGIDKKAFCTELNTKLLLKFSQSSVNKDTISTTQETNNNLSNNVQSNKSDMTEEVANVTTESLCKVSKMQAPEFKASENKFLNTLDFQTLSQELDRNSYTTKPIPQKPEIMLTTSSTTTSMGSNSFVNISSASSLKPVTPQQSAPDFKPNYSLGSNTPINIKELSFSSEQQQIAQHSNSTIPLMPTTSLVLPVKKSSVEIAPEMVNNISRVDDTVSIKSSEVTEDIKGTKGKKNKKILANQFNKSIGSWSKKTGKNKYELNKDSSKIEKFRKDLTTKNKDTDRLSAEIDISETKVSAFQAQQARIDEAHRDLLNPNQQKAPGKRLEENKTKGKVIKAAVDGVQKIFNNAKKKISRTKLKKLQDQVGNHVIIGTSTIPNPLLISKPTMQFSNKLNGTLLEDEDGYLVPCEAQPQIYTVILPGQEIENHKSMDSDLLSLSTKTLGKEIDEVHPNIGLSSEKEIEAKLVEDETTYSQDVQNAINILNTTNDKNTARLFGQHNNKLTLDLHDNDRKKYYETHKQLSNSIRSPKSDLTTNSSLASSLNIFGSNEDLSWDNAGDIGVGYRYGDEYSCPTPDDKSSSKLIDISDKNTTKVKGLEEGITMYDSIDLVADSLKSNAVSFKERNEALKQLSTAISETVISLSESNVQEDAEDILDGSILQAMLNSNNDKSIESLSLGSKEQEETEAGIRKAGDKQLLPVPVLLSDCKENEYLSLDNYNKGEKNYDSDFKEEEETIEQLSNSDWYKMTKADTAILLEQEAKQEMQTQISENAPTLNQAKVINTIVNNMIRNRLDTFINMVVVGAGDEEESNIKRGLWMRAMYGTNNHGRVNNMTGYRGINKGATVGFDAKINNNIIGIAYSNVHSVFKFKNSKNNDKELIGSKVISIYGQKELQQNFTLQVLVSASKNFIKDKINYSYGDTKIRSNVKHHNHSYNAEALLNYNYLVKNSIIVTPNIGLRYGKSRDGIYNETGINVQKIALTMKENNILSGILGTKVQVSLRDVLKFNNLGLTFQAAVEHNFEEKTQRINRVVKIFDNIFKQDYLIPKQPKTSYNLGTGIIFGINNTNISVDYNYYLNKHYRSHQGSVKIKVNL

SEQ ID NO: 6821 - protein, 243 aa, Rickettsia akari
MLRIVKKLWVILFISNISINSFAKNIYDNVDDANYDSTQYYENEGSLLFKMRLGGIFASAKQKGLPTHSSIQAVSVGEVAKNGYGGDASTTIFFNNYLAAELSLGFNVLRTKYTSLAAVAHNYGVDNVKLGKHKPIYMIPATLTGQFHIAPYGGIRPYIGIGYHGSYMLTQATGLKIRNGYNIVGQIGVDFYAKDDTLINMDVRQFFLKPKLEYKPNLVGNKKVTSKVKLNPLIVSIGIGFTF

SEQ ID NO: 6822 - protein, 704 aa, Rickettsia akari
MSITANQKTWFIPACFALAMTAQAEPIQRQDSDRDASDPARARGSSMPPAVRADASVGADSTFVLGTIDVSGARTGSLTSKNILTSVDRVDADHIENQNVRSPWELFGQMPGVLLTDFNQGTTSGKLAFRGFNGEGEINAVKLLIDGVPSNGNDGNMPFMDAVFPLEIDSLETVRGTNDPRYGLHNIAGNASISTLTGGTYARGRIGYGSDNTFDAETVAGHETDTFSQNYAFGYRQSQGYRDHSDMDKFGLAGKWFYSPTGNTRFGFSARYARVAADEPGYLTDADARTHPTESYAFNATDQATRETGQYALYADVDLTNRLSWSTTAYLNTFRERRWVTFSASTSQQERFSDERHLGFLSTLTFRPRVDWLRDLALEAGVSGEWQDDVSRRWLTNRHVRTSQTRDQAFSYDTWGAYVQAVIKPTDTLKIVPAYRVDVLNGQLTNNLTGTRYDMNDYGVIRQPKISAVYTPWRGYSFYGNYGRSFQVGVGAGAYKIPPRTTDLAPSINDGWEVGMKFQPADWIDGRIAYWEQLATNEVRRKLNDPTGDYDNLGKTKRHGVDLQANLRVTRDVGLWFAYTYQVARIVDPGPTSPASAGKQVDHVPNHLLSAGLDYQATPDLRLSTWANAQSAYYLEQTNTKGKFGDAVTVNAGAAYRLSKSMTVDLQITNLFNRYNEYVWYDGTQALHSPAPGRAAFASLTVSY

SEQ ID NO: 6823 - protein, 656 aa, Rickettsia akari
MSTATRTASDPRDVPQTIDSVPVEETLSYGGRTLADALAGVPGVSNTSDTRFDSFRIRGFSAAGDLLLDGMRDDAQYVRSLSNIERVEVLKGPAAALYGRGSGGGVINRITKQPLPENFGHLSAATGSYGRLGASVDLNRMLSSAWSVRLNAGREHAGSFRDHVDSTRQYVAPSIKWHDARRSWLLQFEYDAYRRVPDRGMPAPVAALDAAGKPFAFSLPSAPRATFFGAAGRDTIRDENMNWRSVFTHALDGDWELRHTLGVLNLRSTFDNTYVTQSYVAKPRDYRHVQRARYLQDMTHLNVQTGVELGGKVATGPALHHLLFGIEYGWQKRAPTLWQADAAPIPVTGPDRFALVGSTPRPYAMNRHRVSDYAIFAQDRVDLGRAWKLLGGLRGERFDVDSTNALNGLHARRTTAAWSPRLGVVWSPVGTHSLYASYSKNFAPVGGDLIGITPDARGNANDLGPQYTRQYEIGVKSDWRDGALSTTLALFQLDLYNRRIADPVRPGFFDLTGLERNRGLELGVAGRLAGDWFVRGGIGWQHARVVDAEPKYAGKRSAGVSASNGSLFVGHAPLRGFFAELGLVYEGARYADRDNLLELPAYVRWDGKAGYRTRDFEVTLAAVNLTDRDYYANATGLAQIMPGTPRTFTLTAAYKF

SEQ ID NO: 6824 - protein, 1634 aa, Rickettsia akari
MAQKPNFLKKLISAGLVTASTAAIVAGFAGSAMGALLATNGNTALNAPANWNPAQAPATGDTLRIANNGDRVTLDSVGFNVAALIIDTGGNAEAVTLSKSLNIGSIVGVAGADLANITVNQAGQVLTLTGTQGLGAAANQVNIYSGLGAIDFANLAFTLNFNPADTTNGIILGANAKIANAANAGAVLNVTNAGSGIGNQAKGLEVQDNSFVAVKTLNVNDGSLLRFNSNSDGAGNVNLTLQNGGNVINLQGSGTLHLLAKAGGNGNAANFFVLNGTTLGGGAGDGGDNNGIIHFDTTAVVGTFGTTAPGLTAVVGTNNANRAQQFIVTAVGGNNATITNQIFAKNVTVNGGTSTFQQQVDVGNGGSTTFKAASTTTMTISSTLGAVDFGNTASQIIVAAANAPTLTGNFTGDASNAGNTAGVITFLGAGTLNSADANTPVTNKITAIEASAAGIVNLSGTHTAELRLGNAGSIFKLADGTVITGNVNQTALIGGALAGGAIQLDGSATITGDIGNGGGNAVLQGITLADDASKTLTLGGANIIGANVGGMIDFQANGGTIKLTSTQNNILVGFNLAINTDQTGVVDASSLTNAQTLTIRGGIGTIGANNKTLGQFNIGSSKTVLNGGDVAINELVIGNNGSVQFAHNTYLITKTTNAANQGKIIFNPLVANSTTLAAGTKLGSAAKPLAEINFAPAINTILNVGQGVNLYATNITTAVADMGSFSFKAGGTNIVRGTVGGQQGNKLNTVTLDNGTTAKFLGNATFSGGTTIENNSTLQIGGNYTADFVASADGTGIVEFVNTGPITVTLNKQAVPVNALKQITFSGPGNIVINEIGNAGNEHGAVTDTISFENASLGAVLFLPSGIPFNNAVNQVPLTIKSTVGNGPAGNFNVPVVFVSGVDSVIADGQVIGDQNNIVGLGLGSDNGIAVNATTLYAVIRTTKNNQGTVILSGGIPNTPGTIYGLGIENGTLKLKQVTFTTNYNNLGSIIATNAIINDGVTVTTGGIAGTDFDGKITLGSVNGNANVRFADGTFSDSTSMIVTTKANSGTVTYLGDAYVGNIGASDTPVASVKFTGNDNGAGLQGNIYSQVTDFGTYNLGVLNSNVILGGGTTAINGEIDLDTNILTFASGTSTWGSNTSIETTLTVANGNIGHIVIAEGAQVNATTTGTTTINVQDNTNANFSGTQTYTLIQGGARFNGTLGGPNFAVTGNNRFVKYGLIRDANQDYVITRTNNAANVVTNDIAGSQFAGAPGVGQNVTTFVNATNTAAYNNLLLAKNSADSANFVGAIVTGTSAAVTNVQLDVSKDIQAQLGNRLGALRYLGTPETAEMAGPEAGAVPAAVAAGDEAVDNVAYGIWAKSFYTDAHQSKKGGLAGYKAKTTGVVIGLDTLANDNLMIGAAIGITKTDIKHQDYKKGDKTNVNGFSFSLYGAQQLVENFFAQGSAIFSLNQVKNKSQRYFFDANGNMSKQIAAGNYDNMTFGGNLTVGYDYNAMQGVLVTPMAGLSYLKSSDENYKETGTTVANKQVNSKFSDRTDLIVGAKVVGGTMNITDLAVYPEAHAFVVHKVNGRLSKTQSVLDGQVTPFISQPDRTAKTSYNLGLSASIRSDAKMEYGIGYDAQIASKYTAHQGTLK

SEQ ID NO: 6825 - protein, 454 aa, Rickettsia akari
MKKLLVGAALVGSAVSAQAADLAVRAPYVKAPVAAIYDWTGFYIGGNVGVGVGRNLQSHVFPAGGVANSSYLQPQGVIGGGQIGYNWQTNSVFGPLLIGVEADIQGSGMSDGRTTLNTLNGVLGTVNYNQKLDWFTTVRGRIGIARGPVVSYFTGGFAAGDVKTTVTEVGLVPFNLSGTRTGWVIGSGVEAALGGNWTGKIEYLYLDLGNRTDVFGTQSLRTELRENIFRVGLNYRIGGTGAYIAPPPANWAGLYIGGNFGGSATARNRTTATIGGFTEQFNLSPEGFIGGGQIGYNWQAANWVFGAEADFQGSTQKDDRTAVFGSTVAYNQKLPWFGTARARLGYSVGSTLLYATGGYAYGNVKTNIVTPLSNETSNRSRSGYAVGGGVEMPFSLFGLLGPNWTSKTEYLYVDLGSTTDVFAGGLGVSTSKVTEHMVRTGINYHFNQPVVAKY

SEQ ID NO: 6826 - protein, 363 aa, Rickettsia rickettsii
MNKLSTALGLGLLVAPPALLAQNTVTLGGQIKLGMDHISLNSRSAERSAARLTNNTSFWYLDGKEDLGGGKSAYYRLEWDFAADTGTFGAGRNFFVGLGDAQLGRLQLGRQSVYFSHHWFQGDFHGAFDAAPNAANSLNVLGTVNGAYFAGGFLNNTIRYQAPSIGGFSGMASYTFDAESAETKRNKTWYLSPTYTKGPLRVGYYHLSRRSQGSMPGQTVGSLDQDADRFAFSYLQSGFRFGLLVDRNKVTDRASGTSQHRWAYAIPLTYGMGPHLLSATWGQALSTHINGSRLASSGAKMLSLSYQYSLSKRTALDLSVIELRNQKNGRYNFWNGGMGGLQLAASDAGGKSRMIYAGMKHTF

SEQ ID NO: 6827 - protein, 611 aa, Rickettsia rickettsii
MSLFRRTGSGAANPTTQGLSLRSIAPSGAGRALVTLDGAPQNDPFGGWVIWSALPPEGLDGATVVRGAGAGPYGAGALTGVVALQERGARDGLAAFDISAGERDSYRAAIAGGTEHVLLTAAASKTDGYYAVRGLQRGAADERVSLEDVSGALRVQHEIGGVEAAARVSAYREIRGAGLVGARSVASGQSATVTLARSAEAGVGGWRLQAWVRESDLKNSSAAVAAGRTGTTPANDQYETPATGYGVNAALQGRMAAVAWEVGADLRWTDGRVRERFRNLGAGFTRHREAGGETFVGGAYVEAAYDSGPWLLTGGARIDRSESSGAIRRERDLQTGEVLLDLRPDGSSETTPTARFGARYDLADGRYVRAAAYAGFRPPTLNELHRPFRVGNDITEANAALKPETLQGLEAGVGGEGPVRWSTTLFWNRIKDPITNVTIGFGPGAFPTAGFVPAGGVLRQRRNAGEIEAWGVEGEASGDLGATASWRLAAAYTDAEVDGGGAAPQLTGLRPAQTPKWTVTAGADWRPLARLTLAADLRYESARWEDDLNSRRLNAGVQLDARAAWRLSDTAEVYLAAENLTDEELEIGETADGVESYLAPRTIRVGFSIRR

SEQ ID NO: 6828 - protein, 244 aa, Rickettsia rickettsii
MLRIVKKLGIILFVSSISINSFAKSMYDDVDSAPDYDSTPYYENEGSLVFKMRLGGVVSSAKQKGLPTPTSPQPISVGEVAKNGYGGDASTTIFFNNYLATELSLGFNVLRTKYTYLAAIAHNYGVDNVKLGKNKPIYMIPATVTGQFHIAPYGGIRPYIGIGYHGSYMLTQATGLKIRNGHGAVGQIGVDFYAKDDTLINIDVRQFFLNPKLEYKPNLVGNKTVISKVKLNPLIVSIGIGFTF

SEQ ID NO: 6829 - protein, 4603 aa, Rickettsia rickettsii
MTSSASGTANAGSINFRGFGDQVVTTGNDAPAILLQSVGGGGGWIGDVGGNANLGATQIGSTNAGSIDAAINYTAIQTTGINSTGILTQAIAGGGGFTGRTTGNVLTLGSTIAANSTSNAGDVNLTNNATINTFGLSTAALVAQSIGGGGGASATSDGDTIRLGAISTAAANSSLPIIQSGNVSVTNTQNLSTNALGSVGLLAQSIAGGGGYVAQSGNNNEYAVVYGSNGRINAAAGDVTLRNTSAQIITTANSSPTLVAQSIGGGGGFALLTGSGTGTTQLGSRNNSGTSTAGNVDLTVNSLLQTQGDFSTALTAQSIGGGGGYTGSAFGDAVFGALQVSGNLNAGNVKASLTGNVTTTGNNSSALVIQSIAGGGGFGAQVIGNATLGMTSSASGTANAGSINFRGFGDQVVTTGNDAPAILLQSVGGGGGWIGDVGGNANLGATQIGSTNAGSIDAAINYTAIQTTGINSTGILTQAIAGGGGFTGRTTGNVLTLGSTIAANSTSNAGDVNLTNNATINTFGLNSAALVAQSIGGGGGASATSDGDTIRLGAISTAAANSSLPIIQSGNVSVNNTQTIATNASGSAGMVVQSIAGGGGYISETEGDGQYEVVFGADGEFIASAGSVDVTNNGESLSTQGENSPAMIVQSIGGGGGFALLNASSDGTTRIGDRNNNSGSSNSGNVTVNNNSILFTKGNNSTALTVQTIGGGGGVIASAASSLALGTGNHKGAAYAGAVDVVNTAAVATEGDYSNAILIQNIGAGGGFVAGSGGGATKLGAINGISETEGSSGDVSLISRGSSVSTQGEASNAILVQSVGGGGGFVGSSKGGVTLGGTSLKNISAGNVTVRNSSTISTSGNAAAGLIAQSIGGGGGIVSTTSDEKINLGGKELINAVSGDISLTNTGDIATTGITSPVLMIQSIGGGGGFTTLDESAVGTGGENTIRLGDKNSISSKGGNITVINRGDLASLGRSSSALVVQSIGGGGGNIRRINISDIDSNMMLGSTDNQNGASGDIDIESIGSTIETAGDYARPILIQSIGAGGGWLAGSTTANVSTTLGAINPSGKGDSGNITLRNTADITSEGLSAGGIFVQTIGGGGGLIGMKTGQIQMGLRDGVGSANSGEVDVINTGDIIAKGNDSPALLLQSIAGGGGRADQYYGNVHLGLSGNTGVLTAQSGNISLSNTSETISTQGNSSPGITVQTIAGGGGFLGEQLTLPDTNNADLVGNLGAGDYSKDESERIQEDVKDDFLNSGNINILNRATISTQGNISPGLLAQSVGGGGGYAGGMNTPVLNIGTTGAVSANSGNVNVENFANITTRGYGSGALLVQSIAGGGGIVSSEFIEEMQMGAAYVDSATSGNVSLTNTGDLATQGKGSIAILAQSIGGGGGINAFSKVDTAVNDDNVTGSYQLYLSGYNAKNSGAGNITVKNTGDRVSTVGDGAPAMLAQSVGGGGGWAALESAFNSDLRLGSEGGSEGSGGDITFTNTADVATEGIYSQAIRVQSVGGGGGAVSARANEVRMGSLSMSGDSSGGDIEFKNSGSIYTKRDGSTGISIMSQGGGGGTIFGVSTAIARFGTLARNLSINAKGGNINAENTGEFITTEGEAASALTAVSGGGGGGFIAGIGGDLLSGSNTNGDTSAGNVTLTNTANLTTKGDGSIGLNAASHGGGQAVTGPISSGDQLISIGNIGGSDGSGGDVVVTNSGVIQTEGAAAPAMLVQSIGGGGIYAPVASDPDFFWLGNASTNTDGNNSGSVTITTSGNILTQGIGSQALIAQSIGGGGGFLGDVAPNLSGNSAALLGSQGPQGFNKAITAADWNKEWREIVNKNEQTNDADYFRYLDNLDDVDDLIIKNKNFGIGGGGNGGSIDLTINAETYATTNNNASVVLAQSIGDGGGWLLLDQGNNYSFLGSIQSNGGRGGAITINSAADLTSLGINSPALVAQSIGGGGGATGNSRKFARVGTVKGRGDTSAADVTVNQTGDITTTGIYSSGLIAQSIGGGGGLVGIVSGAVSMGSVQSVATQTSTAGNVAVNMSGTITTSGNNSPALVAQSIGGGGGWVGQADGEVDMGTYRTGASNNQAGSVNVTTNGDIGTTGLNSTGLLAQSIGGGGGFIGINTADNYRSVLGSTFSSGLGNASDIDLDVNGDIQTTGNNSAALIAQSIAGGGGSGAVDWSEANDIDGEPENAIILLGSVDGVTTNSGNVSVNNQSNLTTTGLASPALLIQSIAGGGGALQSLNDSSAGLIYFGGEYTASNNNASASAGFINFTSTGGSTIATSGERSAAAILQSLGGGGGWTLVNSKSDTRLGIESSTINRTSEASTFNATGGAITANVNGTLQTTGNTSPGFVVQTIGGGGGFAGNVSGNATLGGRNLSGANGIAGSSDALMPIACRFGSCEVQTVDQAVLVDIQGDLTTTGSTSPVMLVQAIGGGGGRLGTVTGNATLGMSLSSGDNDGGAIRVVSNAGASLSSIGNDSAALVIQSIGGGGGTVNSIGGNATLGGTGTGTLRAGAITLNGPFAAATQGINSPGVVLQSIGGGGGLAADVDGDLISFGTSSTADTSASDVTAISANWQISTQGLNSPGLILQSIGGGGGVAYTSSASVNLGGAVIGNTSSGDLSLTSKFNSRIQTTGVSSPALIAQTIGGGGGYVGGDGTGIGETVTLGGTGQQIGSSGSIDLFFSGGSTLITTGLQSQGVIAQSIAGGGGFTSQNGKTMRLGVSGGTGNAGSVLITHQGTISTSGNYSEGLIAQSISGGGGNAGSSTLALAMGGINAFGDASDVTVDNTGGTIATAGDYSAGVVAQSVGAGGGRIGSASGLITLGGDNASGDAGNVTINNTAGTIATAGDYSPSYLMQSVGGGGGMVGLGDSTASGTVILGGGTNGTAGSGGTLTLVEGGGILQATGLFSPGVIHQSIGGGGGWIGSVPAGTVQLGGLTTGKSTGADLELTLPFAVATFGANSPGAILQSIGGGGGIVADVGGDVVIGGTQQLGVNASAGDLNYTQLSRTISTAGNDSPGVVLQSIGGGGGLLGAVDGSVTTGSTSAEGSDVRGGAITATSAAPISTSGISSPGFTIQSIGGSGALIGSAPTSVTAGGSGFGDSRSGSINFTNSGAISTAGINSSGVILQSIAGGGLYTTAAGGNAIRLGGSVIGTNDSAAISFSTTAPIATASSNSAAVVAQSIAGGGGAVFGLADASATTLTLGGNGATDNQASTIDLAITGDLSTFGDFSPALIAQSIGGGGGYAPLPSSSATLGSTSSLNLDAGAITVDLNADITTTGFGSDGLLLQSIGAGGGVAGATTTALTMGASALANGDAADITINTTGTITTTGDQSIGISAQSIGAGGGRAGSAAGSVTLGGNGATGNAGNVTLNLAANGGNGSILTSGTQSPAFVLQSVGGGGGLVFPSTDTSSGDLLLGGGDLGTSGSGGTVAFTAGGSSSILTTGAGSSGLTYQSIGGGGGYTGSTTANAQLGGLYRATSTGAALTLASQIDSATNGIDASALLIQSIGGGGGRAGDIGGTAVLGGTSTNALLTAPEAQAGALSITLNSNLSSAGDRSAAAMLQTIGGGGGTAGAIGGDATLGGLGSGNRSAGNLTITADNRISSAGSFSPALLAQTIGGGGGSVDTVGGNLTLGRTTALTEPNTGNTSAGALSLTVNSAAQILSTGDTSPALIAQTIGGGGGYAASTTGTVQLGAGGAGTTAANAAAGAISWSNAAGGSTDTEVAEVGIVSTPTAGIATSGNLSPAVVLQSIGGGGGYTTGGTSVSFSSPGHAGTSTSSGDIEATNTGIISTTGDNSFGVLLQTIGGGGGVAGSSTGAVSLSNTNANSSSGNITFTNSGTIATSGTGSHAVVAQTIAGSGGFVFGGARKENAISLLGNPTGSSGDITVNNSGTISASGDGATALLFQNAAGGAYLYQNAGGFVSNITQGATDGLAPAGEVVVNNTGTIVATGQGGVGITKSTSDLSGNLRIENAEGAVIQGGDGGSAINLPTDDVERINNYGTIIGGTDGSSDAITGPGGPDEIRNYGTISGDIIIPGITNNIYNAPDARMESYLVHANGNVTVTQRGIVNPGGEYRIGNMKVIANYITTDTSLYEADLVLRSGETDNLTTHYEANLDGTVELLANQVGQAMPGTFISDGIINAQEGITIGDLKLIAPKSAVASFGFDLIENRTDLAFKYTVDYAPKGLDPNSTAVGKAVNTIQAAGSTSDFNSTAALIFAQETTKELNALYRQLSGATSAAFPQVALATGQAFQAEVQDTLDSAVLSQLQRCILNVQSLKPGDTYTGDPADCGKWRTWVNAGGSDATTPGSGTSDQSGYSTNAFNTSVGADTLVGDNTLIGIAGRFDNLWTTTTEPTTFGKTEGWSGMLYAKQRLTPATWLSGSFSAGGFSTDITRQVNIPGYPSTEQGSSSSTAIGGSLRLSHLIATGNQGSLTPSLGLSWLQLNQAQYSETTTSNNTAYIQPGNPLIKTPNPGKASYALTYDAATYNSIPLEIGLSYKQPFKSNGDLTLIPRISLGYAWDLGDTNRSLTARFNSAPKGSFTVDGTPAPSSWFNLGLGLDVAFNDRFSVYINGLGQLSPSSTQSINYGGGFRWSF

SEQ ID NO: 6830 - protein, 1654 aa, Rickettsia rickettsii
MAQKPNFLKKLISAGLVTASTATIVASFAGSAMGAAIQQNRTTNGAATTVDGAGFDQTAAPANVGVALNAVITANANNGINFNTPAGSFNGLLLNTANNLAVTVSEDTTLGFITNVAHNAHSFNLTLNAGKTLTITGQGVTNAQAAATKNAQNVVVQFNNGAAIDNNDLKGVGRIDFGAPASTLVFNLANPTTQKAPLILGDNAVIANGVNGTLNVTNGFIQVSNKSFATVKAINIADGQGIIFNTDANNANTLNLQAGGTTINFTGTDGTGRLVLLSKHAAATNFNITGSLGGNLKGVIEFNTVAVDGQLTANAGAANAVIGTNNGAGRAAGFVVSVDNGKVATIDGQVYAKDMVIQSANATGQVNFRHIVDVGADGTTAFKTAASKVTITQDSNFGNTDFGNLAAQIKVPNAITLTGNFTGDASNPGNTAGVITFDANGTLESASADANVAVTNNITAIEASGAGVVQLSGTHAAELRLGNAGSIFKLADGTVINGKVNQTALVGGALAAGTITLDGSATITGDIGNAGGAAALQRITLANDAKKTLTLGGANIIGAGGGTIDLQANGGTIKLTSTQNNIVVDFDLAIATDQTGVVDASSLTNAQTLTINGKIGTIGDNNKTLGQFNIGSSKTVLSNGNVAINELVIGNDGAVQFAHDTYLITRTTNAAGQGKIIFNPVVNNGTTLAAGTNLGSATNPLAEINFGSKGVNVDTVLNVGEGVNLYATNITTTDANVGSFVFNAGGTNIVSGTVGGQQGNKFNTVALENGTTVKFLGNATFNGNTTIAANSTLQIGGNYTADCVASADGTGIVEFVNTGPITVTLNKQAAPVNALKQITVSGPGNVVINEIGNAGNHHGAVTDTIAFENSSLGAVVFLPRGIPFNDAGNTMPLTIKSTVGNKTAKGFDVPSVVVLGVDSVIADGQVIGDQNNIVDLGLGSDNGIIVNATTLYAGISTLNNNQGTVTLSGGVPNTPGTVYGLGTGIGASKFKQVTFTTDYNNLGNIIATNATINDGVTVTTGGIAGIGFDGKITLGSVNGNGNVRFADGILSNSTSMIGTTKANNGTVTYLGNAFVGNIGDSDTPVASVRFTGSDSGAGLQGNIYSQVIDFGTYNLGIVNSNIILGGGATAINGKIDLVTNTLTFASGTSTWGNNTSIETTLTLANGNIGHIVILEGAQVNTTTTGTTTIKVQDNANANFSGTQTYTLIQGGARFNGTLGSPNFAVTGSNRFVNYSLIRAANQDYVITRTNNAENVVTNDIANSPFGGAPGVDQNVTTFVNATNTAAYNNLLLAKNSANSANFVGAIVTDTSAAITNVQLDLAKDIQAQLGNRLGALRYLGTPETAEMAGPEAGAISAAVAAGDEAIDNVAYGIWAKPFYTDAHQSKKGGLAGYKAKTTGVVIGLDTLANDNLMIGAAIGITKTDIKHQDYKKGDKTDVNGFSFSLYGAQQLVKNFFAQGSAIFSLNQVKNKSQRYFFDANGNMSKQIAAGHYDNMTFGGNLTVGYDYNAMQGVLVTPMAGLSYLKSSDENYKETGTTVANKQVNSKFSDRTDLIVGAKVAGSTMNITDLAVYPEVHAFVVHKVTGRLSKTQSVLDGQVTPCINQPDRTTKTSYNLGLSASIRSDAKMEYGIGYDAQISSKYTAHQGTLKVRVNF

SEQ ID NO: 6831 - protein, 664 aa, Rickettsia rickettsii
MANIPISFANIDDQKERRAIIDQLKNLSLEDLIQVETFNLKAGLAGRKVQKLTETAAALFVITQEDIRRAGITHLAEALRMVPGLQVARINAHEWAISARGLNETNASKLLVMIDGRTVYSPLRSDVIWNLQDLLIEDVERIEIVRGPGASLWGANAVNGIINIITKSTKDTQGNLASFHLGKGEEKSIISLRHGGSLTNNGHYRIYGKFYQHDNFKNSQGQEQPDEWEMKWAGFRIDWDSSQDDTLTLQGDIFDGFIQNTNTFFTPVIQTITNQHEKKGLNLLARWQKNLTHGEMILQSYYDVSQQNRGLFDYFRGIYDLDFQHRWQRNEQHEWIWGLGFRYIHDDIDGSSNTTYTPPKRQDRLFSAFIQNEFKIPLNSSLEEDKTELRLIVGSKFEHNDYSGFEFQPTARLLWNLNDRHNIWAAISRAVRTPSRSESDIRLNVPSPQFQILIQGNPDLQSETLLSYELGYRFNLTNQFLLDTSLFYNEYDKLRTLEQVDFRPFPPPSLLALQVDNQMYGEIYGLELATHWQVKDNWKLITTYSYLDTQLHLQTTSLDGNNSESIENNSPHHQANIRSLLTLAHEVEFDTALYYVDNLSNQNVAHYTRFDVRLGWQPGDNLTLSLGARNLLDKQHNEFSGEERTETNSEVPRTFYLQLKYQFE

SEQ ID NO: 6832 - protein, 841 aa, Rickettsia rickettsii
MKKLLLGCMLLLLMSGALPASAAEAEQKGGPAAGDRPGNAVQLEPARKNGGPAANATGPAAHNGTVYRLAPVDVQEETRETGRATIGGKALRSMPSHTGSLTEALKGMPNVQFSNDMISGQTAGEIAPPRISISGAKPYENNFMIDGMSITNRINPSGLGDSASQNDLTVGGGDQTLFYDTQLLDNITVYTSNIPASFGGFVGGVVDGELRDPKMDEWHFSVTGKHTRSKWFTLRGVDENSEKPSSQPRFSINTVSATAEGPVSDTAGLLLAVSRKHSVIPLKREENDGTINDGDQHRISDNFMAKMVVRPSDDLTLKIDATYAPYEEKRWREKWPDSDWFLQNDAYRLGLQAEYETQHGTLSGKTSYMLHGYNRESSSAHRYSNTSTDEQRGGVGDLKQDTQELDMRFDFDSVDYTAGMLTWNVSTGVLWHNTLVDFTAGAAEVDVDVLMAGNRRILTNSKYLEHSQELSLNTLGYYAQTELTLGNFTLTPGLRADYDDFSTNLDIAHRLKAEYDTFGDGSLRLTAGLNRYYGGQLSAYALKRYRPQIVFQQRDMDGDGVFESSKTTYGTDKKHTMSGLDTPYTDEISAGVQGDFLGFEYGVELVKRDYKNQLVSKSDDKKSYYMTNEGKSEYEGITLTLARAVQTQSMGDHVFGLGITKSKRKTFNGSYDEDVYDEANGVRLDYDKVYYNGELTDRNALPADDYNAPVVLTFSWQGHFMEDTLRLNTVTRWRDSATGLMADSRFSDDTPHGTTSGSNTNKSDKWMGEGTEYHNAYKHGVISGGFVTDLGVEWDVLKEEEYTLTMLMDVNNVFDESQEVSVTEGEASRGRSFYAGFRCEF

SEQ ID NO: 6833 - protein, 646 aa, Rickettsia bellii
MIRMALKPLVAACLLASLSTAPQAAPSPYSTLVVFGDSLSDAGQFPDPAGPAGSTSRFTNRVGPTYQNGSGEIFGPTAPMLLGNQLGIAPGDLAASTSPVNAQQGIADGNNWAVGGYRTDQIYDSITAANGSLIERDNTLLRSRDGYLVDRARQGLGADPNALYYITGGGNDFLQGRILNDVQAQQAAGRLVDSVQALQQAGARYIVVWLLPDLGLTPATFGGPLQPFASQLSGTFNAELTAQLSQAGANVIPLNIPLLLKEGMANPASFGLAADQNLIGTCFSGNGCTMNPTYGINGSTPDPSKLLFNDSVHPTITGQRLIADYTYSLLSAPWELTLLPEMAHGTLRAYQDELRSQWQADWENWQNVGQWRGFVGGGGQRLDFDSQDSAASGDGNGYNLTLGGSYRIDEAWRAGVAAGFYRQKLEAGAKDSDYRMNSYMASAFVQYQENRWWADAALTGGYLDYDDLKRKFALGGGERSEKGDTNGHLWAFSARLGYDIAQQADSPWHLSPFVSADYARVEVDGYSEKGASATALDYDDQKRSSKRLGAGLQGKYAFGSDTQLFAEYAHEREYEDDTQDLTMSLNSLPGNRFTLEGYTPQDHLNRVSLGFSQKLAPELSLRGGYNWRKGEDDTQQSVSLALSLDF

SEQ ID NO: 6834 - protein, 909 aa, Rickettsia bellii
MSLGYKLKSTLLKYSFVVAISINLLAINSGILLLTLNNKAEAAPPPPPPPPPPPPPPPPPPPPPPTPPPPPLPKTPPVDPKSAAKDINAELGPTFNPYDTLKKNRKNIKNKKDNSDLEAFLNLNGIAQMSKLFSIVLTQHTDNDELRARFFKDIIRNNKLSPTEKFNLANQIAANNGIYEKDDKGNIIIDNTNLNNNIIGSTSYISNFNPNYKYIISYSTPTEILEKDLTSEIIDITKGFEKDSKGNSYRKFDETKLKQIEQERVYGLIKSKVESLIELAYGANIKYVDYYNSNINDNSYEKYFTEYEKEVITKALGYKRAYEEKTGLYKSEVDKLDRSILSEEEYIKKCEEILEKIGESSWDTYQVSKPGSSSKISYEEYEKLVTNEAKKRAVIARFLMEDNNKINGKRLKIVKEDGSEEYIDNTEFNLIRAENNWDLTPANIPLSKVMKDTNNLSENEKMKKLLARIEFLENNTNNLDIINELEDAKRQLDELKSKKITGLFALNNNGENASISFDQDLIDILKILKEVPDFVSIIRAHPDLFPTVFNDPDTLAFLEKCSPEDYENIIIELSLLDSKSQDLESLIVKKQISEEVTLHNQVASITNKPIHMGIHGRLLLPTAAITGGDEEDAINRGVWISGLYGVSNQKAWRSIPKYQGRTSGVTIGMDTELSNSSDVIGIAYSRIESHFKYNKKFAKTALNGHLLSVYGLKELPKNFSLQAIASVGHNYIKNKATTANNIIGKYQNNNFNFEALLNYKYRINYNLYLIPNIGLKYDYSRSSGYKGNNFVQKLMIQKKSNRLLTTSLGSKVEFKSIKVLNDITLVPSLYGSIENHFYNKDTKVNAKAVLNNQIIEEKIIISKQPKFGYNIGGNVLLTKKNINVVFEYNHYTHKKYKSHQGLVKLKINL

SEQ ID NO: 6835 - protein, 455 aa, Rickettsia bellii
MKKLLLISAATLIVSNSTFAGGILTNTNQHAAFLRMLSRGATTEIDGALSNPAGLAFLPKDGFHVGLSIQSAYQTRNIDASFMTYNGVSATGPTVADKPFEKYYEGTAAAPVIPSLFAAYKKDKWTISGFFAITAGGGKASFDDGLPMFESAAMAGIFQNSVKAHQANPQSPIIVPGMYDITSAMDGKQYIYSLQLGLSYKATEWLSVFGGGRMNYFTGGYKGFLNAIVKGTDTNLLPLALNCDQTGWGLTPVIGADVKLGKLNIGAKYEFKTNLNIENNTKNLQYPPSAKDMVAPYEHGVNTPNDIPAMLSIAAAYEFLPVLRASVEYHFYDDKNAGMANGKQKYLTKGTNEYLAGIEFDVTKQLTLSCGGQITDYGLSDNYQSDTSFSCDSYSLGVGAKIKMNKHLNLNVGYMWTNYEDYTKKSTNYNGTGLPGTNVYSRTNKVFGLSADYSF

SEQ ID NO: 6836 - protein, 630 aa, Rickettsia bellii
MFNKLNRCTLALMLLTSSMSFSALPTKVVDPNYEYFDDDILNVIENRVGNNNPNIHIVPIYPINAPDEFVEPAAMEIANNLNNGKVSLIYNNLGGHWTASVIRKDASGAATLYYNDPNGGSYTSTSLLKAIRTLRPDIQLRDLQIHQQSDGTSCGAFTAEDLVVLAEMNDDELTLESARALLSNIKDAQMLRNKHAGIVTQENREEVTKGNREDVIQEDREYDTQENIKYVTQENREYFEDKDKDKDKEEVFNSAKDKKFVEQLRKALPGSDAEKFGNSLDELIEEQQVKEAFSKLTDRPKERNSEIIRAALRHALTDTHNSAMSAIHSRLSNGPLVVAAGDDDVAGDTWQHGVWARASISHSKDKASNKTAEYFSGYKTKGHSNTIGVDTLINDNLLLGLAYTNAYTSIKPQNQNAGNVDKARTNMFSLYSSYNIPNYNWFVDGTISYAESVIRGKNVRNGNEVASSKYKSHLYSGSVSLGYNYHTSNDIYITPSLGMTGSLIKDSGYKETGTNFQNLNVAKKHYNKLSSTLGVRTFKNINQGKLTITPELYSFVNYSLKNKTPSVNAQLQGIDETLPTINFKSNKVDYNLGVGLSLKHNMMEYGINYTATFAKKYEAHSGSLKVRVNF

SEQ ID NO: 6837 - protein, 549 aa, Rickettsia bellii
MTQGRDSEVRQCHQTDIKSKYNCCHCRYVRTTGAWQALPRRAAALLAAPDRRSRRPVSLARAGPMKKRNLATVLCALSATASGSTLAAELELYVDRKTKQIFAEPAPGRDKLGTFVQVDENGKLPASAMPAVPAQPLPPAPGAATPADAAIAQVAPMPAPVATPAPAKSGDAGKKWYDKLSLRGYTQIRYNQGIGGDAQDLRAPGDRFIGNDQSLGIRRARLVLSGDLNEHVSLYFQPDFASTPTGSTTSNFAQLRDAYADIFFDKKREYRVRVGQSKMPYGWENLQSSQNRLSLDRADALNSGLRDERDIGAVFYYSPTVAKGRFQDLVKSGLKGSGDYGVIGAGVYNGQGANRAERNDSMHAVVHATYPFKFANGQYLEVGADAYAGRFVPTAAAVNIGGRSFTPAITEPNGYTDQRVAAHIIYYPQPFGLQAEWTVGRGPELDVAQRRIRTRSLSGGYVQAMFKHDFNYGTLLPYLKWQTYRGGSKFDTNAPRMRLDEVEAGVEWQPMDALELVFAYSKMKRTDVGTAPYPVVEGDLLRLQLQVNY

SEQ ID NO: 6838 - protein, 669 aa, Rickettsia bellii
MEAKLNARNEAAKGQNVLRSAAEREAERAARNIIMNTIKTGGFVPHVAINPEITGANDNFDGIRFFKPILREAPNENIRKEIERTLNKVKENNSPLTLARKVQILETIKANDWHYNKDDIINIPVNPNKALPPVQVKPINVNPTIGYKSGFTVGNNYKIKYFHVRDNIIKEIDVTDNLIEAGRTFELQGIKAFRDKDLTLDQLHEKEILLKNLKEDIRTEVINGVDIVKAVENIQVPRHQKRNNYILYYDNVVDKSEEKNEYKKYLTQAEINAIKDGRGMVLAYQEKALMIKNDMEFLTHQFQNGNLTQQQYDDKMANLVVDKYGEESEYIRSPFKPQPGVTQVTYNVYEEELIKDAKRRAVIAYIDNIERANLINDIRLTIERADGTIENITTDKFGTGIEANPIIPDLSPNPVPVARVITRQGNVEAKEVIVLPENEAVQMLQAQIAELLREKGDLRTLILKLRGLQEQGQNQVQLQAQNQNQGENRRQDQEQTGSSESFKEAEAEELDKEEKAKEEFIILEAQHVDEARIEALEVATMQVAVKEDEKVVATIFNSTQDIYTVSKGTVSSRINSFTGVAAGDEDERVLDKGFWISGTYGISKQGTQKGFIGYRGHTSGGTIGFDIGSDNDKDLVGIAYTRLDSKFKSNGGKLNTNVDSHIVALYGQK

SEQ ID NO: 6839 - protein, 616 aa, Rickettsia bellii
MSFKLRLSVLTIAICQTFSAAATAPANPVDDIITVTGDRFDNTADQQLTVINTIEREEIARLNPKSVVDMLETLPGVSVTRNGGAGQSASISMRGTNTDHVLVLVDGVRIGSATLGAVSFNALTPENIERIEVVKGPRAAVWGSDAIGGVIQIFTRKLEGGEWYASAEYGSDDYMRASAGAGVSHGDGHTSISINREKSDGYDIKNDAEDDNDGYDRLGVSVNGLQNLNQQWQLTWAGQLESGNYEYDNMGYYGPGVNEADYDNYLVNIAAQYQTEKLTSKLALGQSRDKNENFRAEDPSLGVNLYETTRDQLNWSNRYTANDDLTFIGGVDWSKESIEGDYAVDERDLLGIYGLARYQIGKLLMEGVIRYDDVENIDSETSYNASLAYQFNDQWRVTASSGTGFKAPSFNDLYWPDSGNPELVSETSENLDLTISYTGDYLRGYLSIYQNKIDNLIQWAPTGEKDDYGYDIWKPDNIEDAEITGVELSLNYSTWDIEHQLGYSYIDAVDGESDEQLVGRSEHEFDYALSYTWSEFDLLVNYHYQGERNAGDYDYDGVTDFLDAYHQVDMSIGYKLAEAWQLRLKANNLLDEEIISDRNYFSPGRQLFLSVSYQAF

SEQ ID NO: 6840 - protein, 544 aa, Rickettsia bellii
MDQILPKLLWMNTAIAFWVMWAGTVTAQEVEVQGCGVAGEFCVLGETLESPEPVGNESSDPTENRLDPINQYGDNNSLGQVTNVSQLRDVQPSDWAYTALRSLIERYGILTGYRDRTFRGNRSMTRYEFAAGLRQALDQIQSLIARGRDVPPADLATLEQLTNEFVLELSLLRGDVDALTARTRELELTQFSTTTQLDGEVIIGAAGIVSKDDTVTTLGHRTRLNLDTSFTGQDLLRTRLQAEGLGRLERRTGTPEGELSFTGASDSDLEIDALLYRFPIGNQTQVVIAANAGAADDFTDTINPYLDGDGASGAVSRFATRAPIYYLVSGAGVGVRHAVNDHLEVSLGYLAGNGGNPEPGNGLFDGAYGALAQVKFEIRDRATIGLTYVNAYNQDWQVGSQDTNLVNQLDLPVVTNSVNLAASIQLNPRFVVGGWAGYTTANVIDEGDANLWYWALTLALPDFGKTGNLGGFIIGMEPKVTGSDGLKNLGIDDPSTSLHLEAFYQYKLTDNITITPGVIWLTAPDHNSDNDDTFIGTIRTTLQF

SEQ ID NO: 6841 - protein, 439 aa, Rickettsia bellii
MLQPGSSGPRIYRLRLRQLSAAGFPRKFNKSGGIPLRTFLTTILGASLASAALSTSALAGGFQRGTADTDILFEQGTAVMRTGVTYVNPQRGFESINGQSGNFGTYTQDYVIPSLAFGINSEMAGCAGTYVISFAAESDYTGAPGGALPRGPAAGAQTETSEFESNEFGLTCRLSYTNDIGRFSLLGGVFAEDFTFDGTSLSVTPPLLGSLPVRTTVETESGYAPGYRIGAAFEKPEIAFRAQILYRSEVTHNSFSGAGNVVTTTSVGFPAGTQLASGTSNFSDVTSPQSLYINAQTGIAPGTLLLASFRWTDWSTNGTAVSSITTASGTSSSLSPYNWRDGYTASIGLGRAFTDEISAAVSVGYDRGVSTGSETTYTDLYTLAGGVSFKANEWSELRFGGLVGYWTDGEQSINDGAYFNATVGDDFVYALNASMKFTF

SEQ ID NO: 6842 - protein, 766 aa, Shewanella pealeana
MMDDEGRRDARARTGMYGAIALVSALTADLVCSSSLHAQATLPAVTVDAPAPKRKPATSSSAPQRQARATPSRRAMQPPPMPTRAERAAAEAVVLNAAKLNYRAMPSATTLRSGASPLDTAQSVNVVPEQVIRDQLPRNIDDALANVSGVTQANTLAGTQDAVMRRGFGDNRDGSIMRNGMPLVQGRSLNAAVESVEVLKGPASLLYGIMDPGGIVNTISKRPELYQHGSVTLLGSAYANDRTGADGTIDVTGPIGDGGLAYRFIGYGVSEDYWRNFGRHREMLVAPSLAWYGDMTTVQLNYEHREFITPFDRGTAFVNGAPLAIPATRRLDEPFNNMWGQSDLVQASVEQKLNDDWKLTAAYSYNTETFSANQLRITAINATTGLETRSNDGTWGSLSRVSYGTSYVQGGFWLGGLRNEVLFGGDAQYRTIYRQDLIRQTVSTPFNIYNPVYGLIQPGTTISATDSEQTDKLGQYSLFLQDTLHLTDRLALIGGVRYMDYEQIAGRGRPFKANTNVAADKVLPLGGAILKLNDQLSLYASYTQSLKPNSTIAPLTGGVVLGSNIAPEQGTSWETGVKFDLDKRLSGTIAVYDIDKSNVLVSQLNASNVLEYTTAGKVRSRGAEVDVTGRLTQAWSMIGSYGYTDARVTDDPTYRGKRLQNVALNTASLYLVYDFGTAVPGKLRLGGGARYVGDRAGDAANSFVMPSYVVADLFATYETKHQNLPVIYQLNVKNLFDNVYYPSANSVLNVAVGDARRVSLAATVKF

SEQ ID NO: 6843 - protein, 1073 aa, Shewanella pealeana
MNKKTKLLSILGLVTAILFLFSSEVLAQSLSISGKVIDKNSQEPVIGASVLIEGTSNGTITDLDGNFMLSNVPSKGNLVVSYIGYATQTLPINGRTSFSVVLAEDTETLDEVVVIGYGVQKKVNLTGSVSSVKGDALERRPVADATQSLQGMVPGLLVSNSNTGRPGASGTLTLRGQGNLDNNANPYILVDGVEMSLSDVNPNDIESISVLKDAAACAIYGARAAYGVILVTTKKGEEGKMRVNYQGNVGWSTPTVLPDMVDSYEFAQYWNAGCINAGSPRLYSEEKMGLLQQYIKDPSSVDPWFELPKNSNMNPAFENSELGVGNTNYFDLHYKDWAFKQNHNLSLSGGGKKAQYYISGGYYSEDGILRYADMDFSRYNFAANISSQITDWMKVKVNTKFMHSDEDTPFGDGGLSEGFYHSLARFRPTVAPIDPNGHFTELTMIPYLQSGTYTNTQRDRFSLTAGLDIQPVKNWFIFFDYTYKLMDLEYEALNVSPLIYGADGVSTSKGVRDELGVSPDGKFTRYYAHTRYQSINLYSNYLFTLGDKHNFTVMAGYQEENNDYSYMKNSITGLYSTSNPNVGMGTGDKTVVDTRNGWATRGFFGRVNYDYDGRYLLELNGRYDGSSRFAKGNRWGFFPSASLGWNITREQFMMPIADVVSNLKLRASYGLLGNQAGAALYTFAATMDLNDKLGNYIFSDGRHIFTKAPAVVNPNTTWEKVESKNIGLDFGFFGNSLTGSFDVFQRDTKDMLGPTVDFPDFFGADAPKTNNARMRNRGWELVLSYRGKIGKDIDYSIGGSLSDATAEVTEYEGTRTNPKDNWYKGKKAGEIWGYRADGLIQTQAEADEYNNTYDLSFISGKPWTPGDVKYRDLNGDKKINNGLNTLDDMGDMTVIGNTTPRYQYTINGSISWKGVTVSAMFQGVAKRDWDPGTGAYFWGSGPYAQVTVFKEHLDYWSETNTGAYYPKPYIHTAGGVVPFRNKTMTLSDRYLQSGAYCRLKNLTVSYDIPAVWTKKVGLQKVQVFFSGENLLTFTTLKGMFDPEAIFTKNDYTAEGGKNYPMNKVISFGLVVNL

SEQ ID NO: 6844 - protein, 994 aa, Shewanella pealeana
MSGSNALKRFTPRKTLAAIAVGSVLMMSAPGVMAADTSIVKGHIVSSEGATVSNATITLKHKTKGLVYTVETNEKGDYFLRNVPVGDYDVSITKDGFTKTQESGVRVVIGQPVILDGQLTAVGVDNVERIAVTGSMIRRIDTSSSTSGVTFSQEELNTMPVDSGFENIALLAPGTAAAGGSNFNGASSFGGSSSAENAYFLNGLNITNIKTGLSSLSLPWEAISQTQIKTGGVSPEFGGALGGIVNAVSKSGDNEFKFGGEIRYDPSSLRATQDSIYDYNGVMQDVTAQDSYDFKQAKLWVSGAIVEDSLFYYGLYEPRKEESKWSGQTTTSVRDRESDRWFAKLDWYMTEDHSIGFMAMNNKRTWTTTTYAYDWETDEIGAQKGVDSPGEDGGQLYSLNYNGYLSDNFSVSAVVGRVVQEENTVPASTDPSVWDGRDGWVKLSQETNSTLYNEEYTRDQARIDFNWDLEEHAISFGVDYTNVAVKYLETPNGIDEGAGWWQIRTAGEGSISGAAPGEDYIQRRVRDRFTDSDVSALAFYVNDSWQATDSLVLNMGLRYTQSENTMSDGTAYVDFDNQIAPRLQAIYDLHGDGSAKVFATYGRYYQPVSANMNITQGSSASDLIDFYAFDEVDVNGYPVLLPDGSPSRGELLRDTYVQQDSSDSNAGEIASTTLKPMYSDEFTVGYQQEVFDTMSAGARVIWRDLGRGVEDSDITSPLNKKLAELGYDSVGSTWFLHNPGESLTIAKDFDGDGQVDNVTLSPEEMALPGMQRHYLALELTLDGNVTEDFRINSSYTLSDNWGNTEGLVKTDNNQADPGWTTSYDYGDIMDHSYGDLPNDHTHVFKFNGSYDITEELIFGFVTSISSGRPQNYLGRHPLGVDSCEEGNVWDACEGYYGHSSFYDENEDPAPRGSQGNLPWVTKLDLSLTYMTDLFGGDFTVKGTVYNVLNTDTATNIVETRTRDGEDGLELNPDYGRVTDRQEERFFSLVARYQF

SEQ ID NO: 6845 - protein, 709 aa, Shewanella pealeana
MKFNKSACHVLLIASSLAGTRAACAQAADAAATLPAISVNAAAEHASYDGGHSRAATKTDMSLMDVPQTVNVVPHAVIEDQNATSLQDALRNVPGVGFSVGDGQRDQITIRGFNSITDQYVDGIRDDALYYRDLSNVDRVEVLKGPAAVLYGRGSAGGIVNRVLKRPLANPVNDVGVTLGTRGERRGEFDLGWNANDAARFRMTGAAENSNSFRDQFQLNRQAIAPSAQFKLDRDTVLNVEFDYLHDRRTSDQGIPAYLGRPVDVPINTYYGSADGVNSSYNDVSAKSATVSLDHRFNDSLSFHGAIRAYDFSLERKNYVTYEPIKTAAHPVVTLDQSTRQRTDHGIDGLFELTQKTSLFGMRHELLYGLELSQQQKFDTIYSVSKVATYDLFNPQPVVLPGVPTGTRAKTNASTVVGLAGVYAQDLISLTEHWKVLAGLRFDYLNQIRHDYTSSNVNLDRTDHAWSPRVGLIYEPLDWLTLYGSFSQSFSPLADTLISSGAFTNGAALAPQKTTAYEVGSRFDLGGKATASVALFDMRQTNQQIGDPANPGYALPIGTQHVRGMELGFTGEIAPKWSVYAGYAYLNGTVDGSAQSTAAGLAVSSNTPGLMPRHSANLWLKRELPYGFYAAAGMQFQSARYTSASDLVTLPSFTVFNLGAGYRSKKVDVTLTLDNLFNRRYFIAAHGNADLYNMPGDPRTLTATVKWHM

SEQ ID NO: 6846 - protein, 215 aa, Shewanella pealeana
MMNKTIVSGLIAAALLSTGFASSVSAHQAGDIIIRAGVAVVAPNESSQDVAGNGEFGVDDNTQLGLNFGYMLTDNIGIELLAASPFTHDISLDGIGKIAETKQLPPTLVAQYYFGSADSKLRPYIGAGVNFTNFFDNEFTNDLDGALTDLSVGNSWGVAAQVGLDYQINKSWLVNASVWYAKISTDVDFKLSGDAVTIETDVDPWVYMVSVGYTF

SEQ ID NO: 6847 - protein, 385 aa, Shewanella pealeana
MNKKLLALLIPSVLMASSAQAIELYKDQTNALNMMGWLGFAAVNDGDDTAVVDNFSRVGFRFDRQEKNGWRSFAHTEWGINMVTSDDSLKYVGGQLGAQKTSDFLFNRLGYVGLSHAKWGSLSFGKQWGAYYDVAYTTDVLNVYTGYSVGAYTFGDGGLTGAGRADSAFIYRNSFGDLDIALQYAAKQNGDVALFDKNGQAVDDGSHLSFDTSYGANLTYHVTDKFKVLAGFNRGDFEGELAGVSVDDTNEIIGIGAQYGSFYQYAPGRYAKGLYVGFNAHQSKQNELVAGQLYDSTGAEFLVAYHYDNGFVPSFLISYQDLDTDETTAIKGNWTRQFAVLGLHYRYSRDTVMFAEAKFDFSDMDDKGFEAAQDNSYAVGIRYFF

SEQ ID NO: 6848 - protein, 349 aa, Shewanella pealeana
MKKTLISASVASVLTLASFGALADGPGFYGRLDLAVTNSDTGATTQNGKSGTVFENNFSFVGVKGTESLTNNIDVVYQMEFQVENTTNSGETFKARNTYLGLKSQAGTVLVGRNDHVFKQSEGGVDIFGNTNADIDRLVAGQDRVADGIWYYSPKIAGLVTLNATYLMEDNYIDADDKDAVASYDAQYALSATIGDKKLKEQNYYVAAAYNTIKGIDAYRGVAQVKLGDFKVGGLFQNTESQTTDQEGNSYFVNVAYNLNGVNLKAEYGMDEGGFGKYYQNSVPKVDGSKVIGTDINVQVITVGADYKISKSTMVYGHYAMYEGDHKVAGNKFDLKDDNVFTVGLRYNF

SEQ ID NO: 6849 - protein, 353 aa, Shewanella pealeana
MKKTVLSATIISALAATSFTALADGPNFYGRADLAITNSDMGIATQNQKSGTVIENNFSWLGVKGTEAINSELEVVYQMEFGVNNFDNSGNTFSARNTFLGLKSATAGTILVGRNDTVFKASEGGFDIFGNTNSDIDLFAAGQSRNADGFTYYSPKIAGLVTLNATYLMDDNYAQEVDGKKVDTDNMYALSATIGDKGLKAQNYYVAAAYNDSIDNVKAYRGVAQVKLGQVILGGFYQNSEHVDSKYANLEGDTYFVNAAYVMGDLKLKAMYGSDDSGLGKYVSRYVGSVDGATLENVSDVDLQQFSVGADYRLSKNTLVYGHYTKYDGDIKLAGATQDLSDDIFTVGMRFDF

SEQ ID NO: 6850 - protein, 393 aa, Shewanella pealeana
MKKALAIFPLATMVLMPSALAVEIYKDDKNSIGIGGYIDARIIDTQGQTQVVNGSSRVNIGFTREMSDDWKAYAKLEWGVNPFGDTNLSYSSESFFETTTDNFLSNRLGYVGVSNDKLGSLAIGKQWGAWYDVVYNTNYGFVWDGNASGTYTYQGDGSFNGTGRADKAVQYRNSFGMFSFALQVQLKDDSFDVIEPVDQAAAMVTTPTTVTHVEYNYTYGAGLTLDATDRLTFTAGANFGEFKARASNGSRLTETDYVYGGGVTWGSWDDQGVYAALNANQQEYHDTDNLGRMIPDATGLESLFSYLFEGDFKVFLSYNILKAGDEYEAAYNGDIFERESLVAGGHYIWNNSVIFYLEGRKDLSNFDSTNKVQEEMMGIPEDDGVAIGVRFVL

SEQ ID NO: 6851 - protein, 395 aa, Shewanella pealeana
MMMKKTLLATALVGLFASQSAVASDETKELRKIIEQQQKVLQDLERRLEATENRVEKTADVVEEVAESKSATTIGGYGELHYNNITNNDSGEDNKAIDFHRFVLFFGHEFTESTRFFSELEVEHALSGDGKPGEVELEQAYIEHDFNEMFTGKAGLFLVPVGIINETHEPPTFYGVERNPVEKNILPATWWEAGAALNVKAAPGLAFDGAVTSGLEVATEGSKAYNIRSGRQKVAKANASDLAYTARVKYTAVPGLELAATAQYQSDITQGAAGVDTASATMLTAHAIYSIKGFTVKALYAQWDIDGVEAEALGRDDQSGWYIEPSYRFNDSFGLFARYNRYDNEAGSAEDTEITQTNLGVNYWLHENVVFKADYEKVGGAKDADGFNLGVGYQF

SEQ ID NO: 6852 - protein, 629 aa, Shewanella pealeana
MSHRNFVTLFRRHFLPGKLRYALMTALALSAAPLACADARPFSSIVAFGDSYADKGNIQNIMATIPAYASELAYINTIYPTGRFSGGTNYIDTLVSLYGIAQDNYALGGAQTGTTNEFPGLPGFTSEWQGFLASGDVIEPNALVTLNIGGNDARVYYKNDGSMAGVPSAATASADNAITGINALVGAGAKTLVFTAGDVSGLPEAATHPGSAVAVGSAYSQTYNNLMQQHLSIVAASGVRVEYVDLAMIESNVVANPSLYGLQYATAAPTSNMGDPALINQYFFYLDKVHLTSAGFTIVAEYIANRLNAPETFPATCELGLSAADAFVDTMFGQLDLFNVTTAKNSATPGIGSNSWSLFVQGNGVVSNRSSSDNSQGYHSDDLGTTLGIEYRPTSETMVATAYRFANPSLNLSQNDGTTSAEVNQLGLYGTYTQKNLFLQSLLAYGWLNYSNSRSGVVSTITAKPDGETFAAALKGGYLFDVAPSLRLGPIAGLTYVQAHIDGYSENGDPALTLNLYEQTAKTVLGSVGAQARCAFDLGSTKLDSYLNVTVENNFEGSDRIIQYSATSAPLIVNSWTTTGASNHAFVRLSAGADADLTSAISVMLNLSQTIGQPGGNDFFYTAGLKYSF

SEQ ID NO: 6853 - protein, 615 aa, Shewanella pealeana
MFKLQTCAALTALACSGLALADGVPQFVGDPVIVTASRIAQPLSKTLADATVITRDEIEESGAQTLQQVLSRQAAVSITTNGGPGTSSSIFMRGANSNHTVVLVDGMRISSATTGTTAIQNIPLEQIERIEILRGPASSLYGADAIGGVIQIFTRKGEGAPRFNAGFEAGSRGTGKLTAGIDGKTGDTAYSLQLSHAQSDGFSATNPRNQTYYNPDNDGYGNDSYTASVNQTLAPGHDLTLRLYQTFAINDWDRSNKWTGQDRAKSRLTGQSIESKNQFSDVWTSRLRFSKTQDKLENFYNGNFDVRADLYQTTQEEWLWQNDLNTTVGNIILGISHGTQKIESSDVYSETKRSQDAGFATYQFDQGAHLFQASLRRDHDDQFGGKTTGKFDYGYKFAEGWMARVGYGTAYKAPTFNDLYYPYSGNPSLKPEDSKNTELSLQYRKGQQSFSVTIFQNKINQLINWAPAAPDSEIWVPKNIDRATIRGLTLEGATVVAGVDLGANLTLLDARDDGTGHWLERRPRQSANFTASKELGKWTLGAEQQIVSRRYDDPANTEAKALHGYGVTNAFANYRFARNWTATARVDNLFDREYETAYGYNTGGLGAFIGVRYSQ

SEQ ID NO: 6854 - protein, 883 aa, Shewanella pealeana
MQFHSKFSFLLLLCLMHICIEAKGTEHDEPLVTLDMKQTPIRKVLAEITRQTGVTFSYESSLTKHLLPIDITITAQPLSHCLRILFQKLPVEYIQSGKYIILKKKQKNIVISGFIRDKSSSESLIGASIYDAKSHQGTTSNADGFFSLTLEAGNDVYLNISYVGYDSFHRSFTQLEQDTLLPVLLNSHQQLAEVVVTGEYTSSPLVQTSDMGHTRLNKDLIQQTPVLFGEADIIKTLQTLPGVSAGTAGLAGMYVRGGNGDDNLYMIEGNPLYQINHVGGLFSSFNAEAVKDVEFFKSAFPARYGGRLSSVVDIHTKDGNMKEYHGSAMLGLTSGSLNLEGPLVKDRTSFNFALRRSWIDALSAPTIAIWNATRNKGETQIVARYAFTDMNFKLNHQFNDRSRGYAGLYWGNDFLKGGEKREGDNGYESRNTGRLRWGNIMAFTGWSYVFNNQLFGNVNAAFTHYSSTLKGDYYQGTEANYVSQESSTRNRIDDLSIRANFDFRPNASHQLHFGTHYIYHRFHPVDEKSHFSNGMTTQTRQNNDTALPAHELGIYMEEDWKMNKRIRLNAGVHLGLYTIDGKTYTSLEPRFSSRFLINPQLSLKASYTRMSQYVHQVNESYINLPTDTWIPVSRKLKPMQSDQLAVGAYYTTGNKIYSFSIEGYYKWMKHLMDYKDNYQFLPPSTSWEDKLTQGKGRSYGVELIARKEKGKITGWAGYTLSWNDRQFTEINKGKRFPAKFDNRHKFNIIANWKIKPKLELTGSWTYATGNRLTVSFENYQAVSPQHPFPGGSLVPPYIDSGGLDYYTERNNFQLPAYHRLDLGINIYRPKKKNRMGIWNISIYNVYSYMAPVSIRKGWWYNNDCFYTLGIVPIIPSVSYTYKF

SEQ ID NO: 6855 - protein, 1238 aa, Shewanella pealeana
MKSKLYTPRQVAAFAILFSPLALTQGQVANPSLSDDDEDIFELSPFEVTASETQGYNAATTLAGNRLKTDLRDVGSAISVVTKEFLNDVGATDNSSLLQYTTGTEVGGAKGNFGGVGDAASLNEDTVSPNQNTRVRGLAAADNTRDFFSSDIPWESYNVERVDLQRGANSILFGQGSPAGIINAGLKSAYFDNTGQAEIRFGSYGSMRTALDLNREILEGELAIRMNALYKDDKYKQDPAFSEDTRIYTALRYEPKALNKNGAFTTIKANFESGSIDSNNPRYLPPTDAITPWFTELNQATYNQFQAFDHLSGRPGHGQFRVNLASDGSANPAYEPYAGTFGFPSPRTGPSVFFDGSGQSMYVTDIVGTFVSGGIGPDGAVDGGIEAMPDNGWISLHGTSQWAINSGAPYSTAGLWKNNHLTDASVFDFYNNLIDGDSKRESQDFSVTNISLSQTFLENRLGISLDYNSESYENGQKALLPGEVRLQIDPMAVYGDGSPDPGLTGGEPYSDGTPNPNVGRPFVSSNNAWSNRSRDTDRSTVRATAFYKHDFDDGEDNMLKRFLGTHVFTGLLGKDTAETDARQWQRYGVFEDSFYELQGRPNERFNSSLTPIQTIYLGDSLLGRSLQGAYIPSVSDNITMTGGAINYFDSTWNSSVNPADPWQNGFYLPGADGYESTQSENPANYVGWTTTNLNIVDAEASAANRDRLTTGASLSKSVNKYEAMVWQGKWLDGSIVSTVGVRKDTAESAGMSMSPNDFDPNVDHGSVSFDNYVLPVGYTSLEQTSRSYSVMAHLGDMPFLKDLTSELPFAVSLYFNQSENFQPDSSRVDLYGESHPLPSGKTYEKGMLVESRDGRYSMRINHYKTSNTSANSMQINAAAIGNWMQLNQNFANVFEYNILPWGYDASSADLTGNDTDVFGDDGLPMRYNYHRFYTDALAAEPGAIVSEDGNWVVNPNFEHSVLDAVRAFQSSVDPRFYEAWGINTFGNFGPSTGEVTYSVPNGFTITEDNVSEGWEVEFSGEPVDNWRFTLNASKTDARRNNVGNANIREFMALVSEALTVENGLGRMHHYWGTEDVVTAGKNWFDGEGLVGAPGSEWRLAQLVENATVPELREWRVNAITNYDFSDGRLKGLNIGGGMRYQSSVIIGYPPMGDPNDPTTVEYDLGNPVEGPSETNFDLWVGYRKKLSDNIDWRVQLNVYNAFSGGDELIPITAQPTGDFAAYRIAPDRTWSISNTFEF

SEQ ID NO: 6856 - protein, 365 aa, Shewanella pealeana
MMNNTLKAVLLTSMLPFAASAADGMSPWYVGGGVGINNYEPNCDQKTMKSCGKDDPYAWDVFAGYLFNDYFGAELGYRDLGRAEWVDYSNKLNDVGAKGMNLGLVAFWPFAGNWSLSAEAGAFNYLISNNKNYGSEYYSDSGVAPYFGAGIGYNITDNLKIQAKYRRYENLDEDKWKTLEMESNYWGLELSYRFGNKAKPVPVVAAIIVVDSDNDGVTDDLDQCPNTPTTYKVDAYGCPIFLEVESQLDIEAKFANNSAEVEKSSYGAIRELATYMKQHPNAEVTISGFASNTGKADYNMDLSERRAASVAEILINEYDIAPGRVSSKGYGITRPLMEGSSAEANAVNRRIEAHVTDLSVTPVLK

SEQ ID NO: 6857 - protein, 967 aa, Shewanella pealeana
MRPLQFKKSMLATQVSLMMGLLTAMPVMAEEAPIAEGDIEVIQVKGIRGSQAKSMELKRQSAGVVDAISAEDIGKFPDTNLAESLQRITGVSIDRVNGEGSKVTVRGFGPDFNLVLLNNRTMPTAQVAGESTRSFEFANLASDAVSGVEIYKTGKADISSGGIGSTINIRTARPFDTRGLVATVGVKGHHDTNVEDGSSITPEISGIFSNTFLDDTLGFGLNASYQERDSNIKKATIDGWRQNIDGELNPNAVVVNENKNPYGNTFYARNIGFASQDTERERTNAQLVFQYAPSDTIEMTLDYTYSKLSDVSNADTWGLWFSGPGNATYAHINENGTFDYVTEVGGDYSGTMQQNASDNINKSLGFNIEWQATDNLLLSFDAHDSNANAEGKLGNYADNIFFILGALNVADKTYDATGTEIPLLGANYGTLNPNGEPHLLPEHYASLFAGVRAGRNETDVNQYQFDGRWLNENSDALSSIDFGVSFTSMETHAQGSYTGPISAGWYGNMGLWKDDVSYVGLGSDFLSDFSGGGNDMLIPYYYSYDQQAAMDKAQALYDVEYVSAPWQDDHRIKEDTTAAYVQVNIDSEFNNMPLNIVAGLRYEQTDVTASSMQKEAQQLVWLNPTEWQTVYADDFSYSHETHDYKEFLPNLDINLEVMENVMARFSYSRTITRPTLGSMRATTALTPIPKVGSRTGFAGNPALKPFSSNNIDLSLEYYYDDASYVSVGYFNKEVENFLMNTIETVKYDHLLDPYVGPAAEQARAELIANNETPSDEAVFQWLIDNGYGNADGRVPQSGADPVADWNISKPNNVEDLNINGVELAWQHWFWDTGFGFAANYTLVDGDTEYDVERVDEQFALPGMSDSANFSVFYEKDGLQGRLAYNWRDTFLSGMGQAEAGGPAPQFTEAFGQLDISVSYQLTDNLSIFAEGINILEQEKRVYGRYEEQMLLAQQNSARYSIGARYSF

SEQ ID NO: 6858 - protein, 760 aa, Shewanella pealeana
MSLNARHLLSRGFGITFLVPSLVPINAVMAQTVEIGAVDVNATQARSGGEMAVGRDAPPGSAAALAPSQSSLLANEPGSIVSEKIIQDVIKPGGDFNDVLKFTPGFYSSNPNGSGDAKGGWRGFSDGQYNVTYDGIPFGDANDPSHHSGAYFPSPFMGQVVLDRGPGPASQVGYAPFGGTLAMFARRFTDKPSAELQFSYGEYGTFTNAVTIQSGANDATGGTRFLAQFSHTSADGMLAYGRTMGDFGLLKIEQPIGDNVVLTGFATYGQEHYNNVGYITAQQLALYGKNYGSLNNNPATNNYWGYNTSSKQTDLEYVGIQADVAGFHLDDKVYTYSYTYPTLQNNGADLTQEGPATITSAKQYNGTKVPIIGVGKNDVTGYLKNNNYRAYGNIFNVSHDINEGLASGTVRAGVWVEHVDNQRFQQYIDYTSYKTYTALGNPDNASYKTWLSSHIDNVQPYFEYEWRPVENLTITPGYKYVSFTRDHNATINQTTLLPLNYQHTYTANLPFANIRYRFTPNLTAYGQVSQGFLAPTVSAYYVPDPSANSIAPQSTTNYQVGMVYRDETITAAFDAYLLKATNFPIAQGVVPNTVYVNGGTAVYKGLEAEMTYAFGNGLAVYVNGSLSSAQFVQGPNIGLAVPNAPRYTGAAGFIYDKDQFFGSFLFKAIGNSFGDNGQVLGSNANKIGAYNTTDLAVGYRTDALHQIGFGQNAEVRFGVNNIFDNRSIVAISGNPTTNLTGLTYGFQPNRFIYGAVTLRF

SEQ ID NO: 6859 - protein, 842 aa, Shewanella pealeana
MSSVTLTAKAIRRSLLAVAATSVATTGLFSSVAFAADEQKVERIEVTGSRIQRQDMESASPVTIISAEAIRAEGFTSVDQLLQAQTSMAGAALGSSSNNGSDGVAQVDLRGMGSQRTLVLLNGRRMVNSGSGADSSVDLNSIPVSMISRVEILKDGASAVYGSDAIAGVVNIITKKDFEGFQLDLNGSTTSESDGETGEISGLYGFNTDGGNYTIGAAYSKRESVIQSDRSWTEPGASSFLPTGSLGGKVRNDAGEWVARSTGYDYTTSSYYQTPNERYSLFANMIQELDNNLVLTGDVLYTKRKSDQQLAPQPADVMLNVCGAPGVTAGAACITLDQAMTDGEIAADDTGRVNYRRRTTDAGPRIYSQDTDTFRISAALAGELDINTGMNWDIGYTYGKNKADSSVENSINATNLKQSVYANQDAWFTGVPLTGEIVNDISFTDNADGGNEQHVVSAGLNGELFDLSAGAVAFAIGAEYRYESGFYNPDPVTVAGDSTAAQQDATDGDYNVLSVFQEVSVPFTEKLTGEFALRYDDYSTFGKASTWKVGLTYEATDDLMLRTVAATGFRAPSISELFGGDTGSYDYLDDPWGNAQDPQILVRYTSDDDLKAEESDSYTAGLVYSPNYVEGLSVTLDYWRFKVSNAITRLDVQAGLEECFANASAAACETFNIGANGDLSNLTNSLTNVGSQDTSGLDFNLAYNFEALSLDWKISNDTTYLLNFEQEDNDYTNKIDGNFGAYAEVRNNFSIQAGQDSWSVNYFNRYIGEMDDLNTGDKVDAILYHNLAGTYYVTDMITLSAGVKNITDEEPSGVSNGSDGGTVPEVYDTIGRQYYGGVTVKF

SEQ ID NO: 6860 - protein, 316 aa, Shewanella pealeana
MNTNLKKALFLTTLSCLQANEGFLAIMPNESKEESISQEKQLEQKIAPQNTIKKQQSAPLQSAELLQSQVKREVKEQKKSQKHLVAMQTKNGFFLGSEIAITGTSLTQSLSLISNVTDDLLTYSKTSKNANFNMGLLVGYQHYFGTKKRDGIKISSHLYGGTPSEISTDIKIYNSKVSTNYTPLNFGLDVKYLFDFLNVIKKNRHTLGLSVGFGWRMQYYFAKIDPIKTSHSEFITNKPKDIFNHGFYPTIGLHYYLNHHQFEINYRFGGAINYQFVVPSKIVAQNGNFKGEVLFSNFLTKATNSSYIAFNYAYLF

SEQ ID NO: 6861 - protein, 1082 aa, Shewanella pealeana
MNLNFRRTALLVGICSAVSLTYTPQLFAASVDAIDAVQQAKKITGTVTDAMGPVIGANVLEKGTTNGVITDIDGNFTLNVQPGATIVVSFIGYQPQEIVVGNQTSFKIQLKEDTELLDEVVVVGYGVQKKKLVTGATVEVKGEDIAKLNTTQALGALQSQSPGVNIQAVSGQPGDGFKINIRGAGTNGNTAPVYVIDGVAGGDINALNPADIERIDVLKDAASCAIYGSSGANGVILITTKQGKVGKVSVSYDGNIGWANIYKMPDMLNAKEYMAVMDQVAYNNGGQPYDWSKFVDADLLTAYQNGTNPGTDWVKEFRNKNAVVTNHALNVTGGSEFSKFSTGIGYQYQDGAFGGPVKTDYRRFTFRINSEHVIYRKGDVDVIKFGENIYYQHKQNQGVQLGNQYSNDLSNALRAIPLIPVYNENGDFFMYDDLKNFGTSANGILDYTAYASNPMAHMVYNQAGNNKNKNFNLNTAAYLEVQPLKNLIYKGQVSYKQWSSSWRSYLPVYQINNQGDSRDKDQTINNVSLGWNWSLTNTLSYRFDITDLHHFDVLAGTEYSKSRPTYGESVEATGYNSAFGDFTHAYLHNTERKATATVNGYPSDYGSKMSYFGRLNYDFKETYMFSAIIRADGSSKFAKGNQWGYFPSFSAGWVISNEAFMKNTASWLGFLKVRAGWGQNGNDNIPNSNWRAGYEFGDYGLYTFGSDKNGGTTGAYPNRLANPDLTWETSEQTNIGIDARFLDNRLSFTMDWYSKQTKDLLVEVGTNAASGFATQYQNAGTVKNTGLELSMGWRDQIGKEFKYGVNVNMAYNKNEVTEVNNANHFIEGGNDLLAQSTGRFVRMEEGHPIGYFYGYKTDGVIQNQNDLQAYLDQNCKGNAANSKQGASIKPGDLKFVDVDGNGVINDDDKTDLGNPHPDVTMGLTLSAEYKGFDFSVTTYGAFGAQVARSWRKFSDGQYENYTTEVYDYWHGEGTSNRYPLLAPGNSGQNFQAISDIYIDDADYVRIQNLTIGYDFKRIWKNCPFQQLRVYAAAQNLFTFTGYKGMDPENGRALNDKEPWVTGVDVGNYPQPRTYMVGVNVKF

SEQ ID NO: 6862 - protein, 1160 aa, Shewanella pealeana
MLTLIKMKWIVMLFLLLYTAGSYLHCAVLYGDILAQKYTIVLDFKDTPVEAVLDAITKQTGIKIAYNNEVLDRKKPVTVKIETSDILEALYAVLGDSYICRQIDDYIAVSKRPKPVSGKIAGKSPTMTEAFSSAIVSGLITDGDGNPLIGVNILVKGKSTGVVSDLYGRYQIEVTEGDRLEFRYVGYNSEERIVRKVPVINVRMVELPVGLGDVVVVGYGQQKKSSVVSSIQTLESRDMNVKQRNLATNIAGRIAGVISVQRSGEPGNDEAEFYIRGQSSYTGGTNPLVLVDGVPRNMEDIDVDEIETFTVLKDAAATAVYGAEGANGVVLITSKRGRPQKTLVNFSAQYAIATPFRMPRSLGACEYLSMYNEAVWNDRGNPDKDHFQPEVTDEVIEKYRSGADTDLYPSVDWTDLLKKHTQSQRYTINFRGGSEKTRFFVSGAYYTEEGIYRSNPIEDYDANIDLKRFNLRSNIDMTITKTTQLSVDLSGQYVMKNNPGYSSDQIFSYITHSPTHVIPMYYSDGTASIYSNLGYGHDKQPYSMLNHSGYTKTWDTYLQSKVCLEQKMDFLLPGLLVKGMMGFDADFGASTKRTKSPKTYFALRRKEDGTLEKKTMEEGTALSDPVKGETSGAKRIYLEASLNYQQRFADKHDLSALFLYMQKETQYQQEEGLLRLPYRKQSLVSRISYAYDDRYIVEASMGATGSENFAQNHRWGIFPAVGIAWYISHEKFMQGVENSLTKLKLRTSYGIAGNDNVFSQNGGLVRFPYRGQVTTDGPGYDLGLTPGAGGGVSNWVGGVYERSFASPNLSWETERKLNVGLDVGLWEGRIDFSVDYFSNRRKDILIQRQTISAVTGFRTGMYQNFGITTNKGVDANLIFRHQWGPVGLSARGNVTYARNEIIECDEITPKYGWMSQVGTSIGQQSLYIAEGLYTPDDFDVTERGDGSRTYQLREGLPKPSANVAPGDIKYRDLNKDGIIDSYDKTYDSGFYSTGIPEIVYGFGVNLSWNGLFVGAFFQGVSHASASLIASPSNIIPFTSGRDNGSARDIIRDHWSAEAPFNQKVFFPRLHTGAFQHNQLPSTWWMRDAAFLRLKNIEVGYEFDKSVLQRLRMENLRVYVQGNNVAVWDKIKYWDPELGNANSGAKYPFCRNFTVGLEITY

SEQ ID NO: 6863 - protein, 265 aa, Shewanella pealeana
MTLRSLLRASFLLALVAAAPAARAGGFSTTNVQLLQGWNFDKAIDTSFAGKLKDGTKTTLTLNHFSTWEYGDNFAFFDLSRGRFETDDTQWTDAYVEWHPRLFVNQLLGQKEPLFGVIRNWGFAGEVNQGAGFYAYMGGLGLDFAVPAGWVLGLNAYYRYDNFNRHGWQVSPFWTVPFAVGKVPFLFTGFIDVNGLKDEGGFYTGSDNGVEIWSQPQLLVDALAPFGGKAGKLYVGVEWWLHYYSLGSFEETSSAPQAMVQWTVF

SEQ ID NO: 6864 - protein, 406 aa, Shewanella pealeana
MMKTHPLFPVLLLSSLSALAASPPSEASKTGKPFPHVGLRSDDGRSSLDIGGALRVNYRDEHWKSTENNGRLLFDTFRLDIQATHEDFFSDLGYWFQDDGKRAIDRGFVGYRFSDLSSLQLGAPFKPFGLEPYPQFGWSYHIPFFLGYGVSAGSGAKYVYKDADWHVQAGYFPRMLPGGVRYSPEVGRYADLDDNAVAAIHSRQDNEKRDQLNLRVARNLAGDGWKSELGASLAASRLYNATTRDDGRYWAAGLHGVLNAGNWTFSGEAIRYAFDPKNPAGVSDDVVLMGTNGLTPAYLMAARASVASFNVAYDVPTPNLGMLKKLRFYNDYSRMFKDKAGWDDSQMYTAGVQFFALPIMGWLDFTWGRNANPYGGAESGTGFSSTSSSRSNEWIFRTNLNIGYYF

SEQ ID NO: 6865 - protein, 852 aa, Shewanella pealeana
MNRPQILPSACAIAIALAFAPTVAHAADKGAEKVERIEVTGSRIKRTDIEGPSPIQSISKDDIANMGFDNLQQLLERMPANGAGAFSTRGNSQDSTANGGASISLRGLGPDATLVLINGRRVAASAFAEGITNSFVDINNIPVSAIERIDILKDGASAIYGSDAIAGVVNIILKKDIEGIEVNLGYGDASGTGYNESTANMVWGMKSDKGSASIILDYFKNDTLAATDLGRFGTADQSPYGGEDSRSSRGFPGYFYVDGVPTVDPACPADRNIDGEVCVFDYGPYNLVVPAAERVGAIGQFEYHFNDDLTAFLELAAQHNTSEAGGAPTPLDEKAGLTVPGSHPNNPWGKDIKIGRFRTVDAGARRWDIESDTLRLVAGLRGVVKDWDWEASMQKGRSESTQTGDRSQGWVRTDYLQREIDAGRYNPFGGTMNSQDVIDDITTSLVRQGLSTMTSYAANISGQAFTLADRDIMMAAGVEYREEAISDEPDEQFQRGLIFGTEAVSAKGDRDQWAAYTEFSIPVTDNFELQLAGRYDHYSDFGSTTNPKVAFQWGITDELTARASWSTGFRAPSLAQIGLGPSEESSFLIDKYRCAADGQGCTLSDETTEFAGNPKLKAEESETWNIGMIWAPSQKFDIGFDIYSITQDNKIDKLLLQDIYDANCNDQNSTVCVRLAPQVGQTFGALDVIRSSFVNLGSQQVQGMDVSTHYGFELDGYGDLKFGLEWSYLHNFEKDDTHQVVDYTGEYKYPKNRWLATTNWTMDNFAANLNLSYIGEFEDFNKTRTIDAQILVDMSGTYRFNEMFKLTLGVNNVFDEEPPFAIGDGDTDLYGYVTSVHNPMGRYIYTKLTMNF

SEQ ID NO: 6866 - protein, 135 aa, Shewanella pealeana
MIIMGLFDEVVGAFLKGDAGKYQAILSWVEEQGGIQVLLEKLQSGGLGAILSTWLSNQQGNQSVSGEQLESALGTNAVSDLGQKLGVDTSTASSLLAEQLPKIIDALSPQGEVSPQANNDLLSAGMELLKGKLFR

SEQ ID NO: 6867 - protein, 935 aa, Shewanella pealeana
MYKNNFLANSVRFALIGGVTVAALNAPVAVAADDGAKKVERIEVTGSRIKRTDMEAASPVLVMNREELEATGMISIGDILQTIPAAGSALNTSFNNGGDGSTNMDLRNLGAQRLLVLVNGKRWISSLGSTVDLNTIPTSAIERIEVLKDGASAVYGSDAIAGVINIITRKNFEGVEVSVYGGQNAKYDDGRQYTADITFGSVSEKGGLLFNMSHVTQQPIWAGDRDISATGYSSTADNTRIRVKGSQMNQANQDALAAVGSPNSSGIYDFMAKEGTGVNVGVDQLRPRTGSDVYNYAPDNYLSTPQNRNSFYVQGFYDISDNLRVVSDFMMTNRKSSQELAPMPLTLGASFGAAASRVDIGANNIYNPFGETLYGDSARAAANGQAGYVPYALQRRMIEAGSRQYNQNDTTYRAMIGLEGNINDNWTWSANYIYGQNNQDVLTTGLLNLTRINQALSDNCDASNGCVALNLFGGPGTVTQDMVDYITFDSVSRSGLTMKDYAFNISGDLFDLPAGSVGMAVGLERREESGFDVPDPLTVTGESSGNQRDATAGGFRLDEAYVELSVPVLESLLITPAIRVSDHDAYGNNTTGKVGVEYRPMDDMLLRGTWAQGYRAPSISDLYAGNADSYPTWTDPCNTPSSGTIDLVQNPGCAGVPDGYKQANTQIRISQVSSPDLKPETSESYTYGAVYNPSWLEGAELTLDYYNIKVKDAIGRYGHTTIARECAKGTNPDSCNYIDRDSLGNITDLRNFLQNAGEYNVEGVDFFTAYRFPETSFGSFKASLDVAYVISNEFNGTDRVGVQTGDGGFPEFKGNLMVDWSMGDWDAHWKVRYVGPLNNDYYTGLTPDDIDYYNDLKDSGYRETMDAYMVHNVSVGYNIDGYNTKISLGINNLFAKKPQAEGPTNNEAISTNNFSVTEYDVNMDRFIYLRATTKF

SEQ ID NO: 6868 - protein, 404 aa, Shewanella pealeana
MKKTLVASALAAVIFVPTASAIEIYKDDKNAVEIGGYVDARIINTQGATEVVNGASRINFGFTRQMSDGWKAYTKLEWGVNPFGDSKIVYNSNSTFESKSGDFLNNRLGYVGLAHDTYGSITIGKQWGAWYDVVYNTNYGFVWDGNASGTYTYNKADGAINGTGRGDKTVQYRNAFGDFSFAIQAQLKQDTFEIGEVPSASNPLFPAADFMSVKAAGVNVNSSVTTVEYNYTYGGAATYNVTDMLTLTAGFNLGEFEATTSAGKRLTETDSIYGVGATWGNWNSEGVYAAFNVNKQEFHDTDNLGRMMPEAKGLESLASYKFENGIRTFVSYNILDAGSEYEAAYNGDVFKRQFVVAGVHYVWDSNTVLYLEGRKDYSDFTGVHAEAMAKSEDDGIAIGIRYTL

SEQ ID NO: 6869 - protein, 471 aa, Shewanella pealeana
MKPMLLRALAAATMTTVLGGCVSMAPHYQRPEAPVPAQFGNAAIGAAEPALAMPAWRDVFLEPRLQQVIALALQNNRDLRVAVLQVEKERAQYRIQRAALLPSVDASGSVTRSRVSDANSETGVTQVTESDAVQVGISSWELDLFGRIRSLKNEALQNWLASAENQRAVRTSLVAEVATAWLALAADEQSLAFTQQTLDSQHQTLQRTEARHAQGLASGLDLSQVQTSVEAARGALAKLQAQQAQDRDALQLLVGAPLDPALLPTAQALDGSVALAPLPANLPSSVLLQRPDVLSAEHALQAANADIGAARAAFFPTLALTANYGHSSTALSTLFSAGTRGWSFAPSITAPIFHAGALKASLDASKIGKDIGIAQYEKAIQQAFSEVADALATRDHLTAQLDAQRALVADSQRSYTLADARYRTGLDGYLQSLDAQRSLYAAQQDLIALQQQEAGNRVTLFKVLGGGADAR

SEQ ID NO: 6870 - protein, 406 aa, Shewanella pealeana
MMNMRKISTISGVALGTALLAGTAFAGPRITFGPEDQGALQIDYKGQFQMSIRDNGSGANGDDTTTNFNFRRNRLAFMGKYGDMLSLYVQTEFTEDPNVGTLGVGDNSADTEFQLLDAVMRFKFHDGFRVNVGKFKHNLTRENLEACEMPLTLDRSLFIRAPYVSTRDVGVAVWGNLFNDVFQYRLDAMEGRKAGDRDANGYSSPDSNFRYTARAHVTLLDPEKDYGYKGTYMGEKQVLTVGAGVQYEPNVAYGNAATQSDSKDYTAWTVDGYFEYPVEGFGTITASAAYADFSMDDAYTVSTNVDSGAIGLNGEKNGWYAKAGYMLPNFPLQIFGRYERWSFASLNNVVDQDINWYGVGANYYIWGQNLKLTAEISKTDFDKEGTYNGVKSEDFTTFITQLQLLF

SEQ ID NO: 6871 - protein, 932 aa, Shewanella pealeana
MYKIKHSFNKTLIAISISSFLSIAYATESIENPQPIIQLSESLSSKYSGKGVKLGVMDEGFMVKHPRHSSHLHPLIHQLTTPEGEVRIYDASYPQFEVNPVEKEDGIDLIPSLETHGAGVAGIIAAQADKTLGDGYSGGIAKGAELYVATKSYKRTLEKVIQDAKKELENAKDEEDEKTPSLDQMAKNDLLASKEKEMAIERAEWASGLNKLLDNNVFAINNSWNPFSISDDINVVDKFYQSIKQNKHNPLLQAIMRAKNSNTLLVFAAGNESKKQPGVMALLPRYFPELEKNLISAVAVDKEQKIASYSNHCGASKNWCVAAPGDLHVLIGVADEHKKPQYGLTKEQGTSFSAPAITASLAVLKERFDYLTATQIRDTLLTTATDLGEKGVDNVYGWGLINLKKAVNGPTQFLNDETITVTRDDHWSNPLASQFKITKKGDKSLHLDGENHLDTVAVEEGRLALNGKTKVKTISNHANLAVNGTEVEQNYSSSGQSQLEVLGKSGLIANAQANIHLAGSLKIDDKLTEKTEAGDVSATVVQLKDKATYQGGFTQLVENENLAKRGLIQDLYFKESEIIAKVNKPLTDEKADTNGQAGLALLNALRTTPIAYRRSWYNGWLQSALEQRKLDNLHYAVSNNIYADSLELLRSQNRKGLTQAQQHLFTAYHTPLQTTVWAEHLNQKQSASSKHTDVKHHQSQLGVNHKLADKTVLSATLSQQKNRLEKPFAQATLKQTALNIGLRYHLDNAWFSEATLQFARQKYQQSRRFASHQLGTAETRGSTLGGEMRIGYQFMPNQWIIEPSLGVQWIQTKMNGLNESGELATQTAAMRYRDVNIVPSVKLQRTFQLEQGSISPYIGLNYLHRLNGKITKITSNIAGKTLHSEATTKRNRQLNGEVGVKLHYKNWFTAMNLDYSRVKSCKPIWLESKCWL

SEQ ID NO: 6872 - protein, 762 aa, Shewanella pealeana
MNKLKVSVLAIAVSTALNAQAQEATVETQSNQQASAQMHEVIVISGSRMEQEIEQVAGSIVVIDEEAIEKSMSNDFGSLFRNESAIGIKGGAGKPTTVTIRGIGGNRVMMVKDGVRVNNQYASPLGPGAEGTGRGLTEVQSLKQVEVVKAAASTMYGSDALGGVVVMRTKDASDYLMGDDYYMSVNAGYAGINDEYAAGFTSAAAYGGFENLLTYQHREGEELPNFYDTQPDSDLVQDSVLFKSKYHFNEYTSVQLTLDYLEQTLKRWEYEFDKDNVLEENIDTNRDTQVINGALQLVSSKPTQMHDTLTVTAYFGQTEQLEHRDYFEWNKASTFYGLSEIRDYSFEDQRIGVNSTFSKYVGGDSYGHQITYGLDYEFSTMSRHRTVNDTVTGETTTPFTFATTDSQRLGIFVQDDITLLDGDLNLIAGLRYDYFSNTPDKNQAKEGLGDKYEEANFEPMNDSFWSPKLGLVYQLSDSVSVYGQYAYGYKMPTPDQKWGELEVDAGSMTDVFIQANYELESEQSHTWEIGVRGNHSDTNYELTAFYTLAKDFIDWQYVSFKPPVITPGWPPVMEPMEFKYQYYNRDEVILYGAEAQLNHWLTDSVELWGNISYTYGEDENGDYLNSVSPLKGTAGVNWYTDIADMEADFGAVVRWADDMSRTNDIELAEEDICAMGICIPKEQFNEVYGTSGYAVMDLTFGLRVNDNWKLRAGVYNLFDKEYIDYADVAGQSVFLLGASMDLEKEDFTQPGRYFNVSVNYQF

SEQ ID NO: 6873 - protein, 415 aa, Shewanella pealeana
MKHFQDKVVRSLVTGAALALSNSALAAGFQLVEHSASGMGRAYAGEAAIADDASVLAANPAAMSLIDKSTFSGALSFIDPNVEVDGTRNIGPLPNLDAGKDSAAPSALVPAVYYVHPLNDQVTVGIGAFSNFGLETDYGNDYGASDIANKTSITTVNINPSIAYKLSDQFSVGFGINYVKAEAELLSTMPDGTGPLARAKNVDLSGDGDTWGWNAGVLWNLSQDTRLGLSYRSKLSIKLEGDIKSDTVAAFNDSGSLTVDLPDITELSLFQRINDQLAVHASVTYMGWENFDNLEVKLNSGLDQVLKEENWDDSIRYAIGATYNVDDNLTLRAGLALDETPVAEENRSLSIPDADRMWYSIGATYKVNANISVDAGYTHLNGDKVYLSEESTLGRFNGSSEGDANLYSVQLNWVM

SEQ ID NO: 6874 - protein, 314 aa, Shewanella pealeana
MMNVFCKTLLASAMAVSVASSAYAADPLQVYGKLNVTAQSNDVNDETETTIQSNASRFGVTGEFELSQKLEAFYTIEYEVDTGDDTKENFKARNQFVGLKGNFGAVSVGRNDTMLKVSQGKVDQFNDLAGDMKTMFKGENRMAQTATYYTPMFGDFQAGVTYVASGDSDQVVGDNTTGEDGVSMAVMYGDAGLKSTPIYAAIAYDSKVKGYDTARATVQGKIAGLVIGGMYQQQEKLDSGIKDDGFVLSTAYGINDVTLKAQYQDMENKGNSWSVGADYKLGKPTKLFAFYTANSFDSNDQDDSYIGVGLEHKF

SEQ ID NO: 6875 - protein, 1068 aa, Shewanella pealeana
MNKLRLSKLTGAIILALGVSASAMAADTSSAMRGKITTPSGESAANVKIKVIHGPTGTVSELTTNSSGTFIANGLRVGGPYTVIIDSDTFNDTTLENIYLELGDTYRLNSQLRPLNMEKIEVSGYKIVQQSGGSSSSFGEDTIQNMPSFNRDIKDIARLNPLANINGNGELTFAGNNPRSNSLTVDGIGQNDDFGLSFGGYPTSQPPVALDAIEQISVDVSPFSAAKGNFGGGTINAVTKSGTNEFKFSGFYETSTPDMAGDVDSISQVYANGRPALDEDGHRTFVTEQVKPIQTEARYGFNFGGPILEDKLFYFVNYNAWKSELDLDYGFEGSGAANEYDVTKESFDQFLSILDNVYGMQDSLGGDPKDTNESLLVKLSWNINDDHRLDFTYQWQDDKDERNFGTGGSTVSLASNRYTYATKFNNFATKLYSDWNEDFSTEIGIAYKDVTSDSITNSKIGSVKVEEYFRGPAYQFGTDEYRHANKAATENLTLTFDGTYLLDEHQIKFGAKYESLNLYNLFAANSLGSWEFDNFAGFENREVGNYKGKHDFTYSNAYTNNSADTAYDATRSQFALYVEDTFYATDDLEVTAGVRYERLASDDKPTLNEKFLETYGFSNQENLDGVDIILPRVGFKYYATETLTINGGVGRFQGGIPNVWYNNSFQKDGLTFVDAPQSVIDGYYANNNVDFTQVPDEIKGSLVQGAGSTNYIDPNFKLPSSIRAQVGFDYEFDSELLGNGFKWQAEIAYHKKENEAVWHNTAIKPVGTTADGDRIIYEGIYEGDLKDNFDIAMTNSAEDGRSVIFSTALAKEWDNGLYISTSYAHQDITEASGGSSSQAQSNYKHTITQSRNVDLAQRGAYEVEHSFKVNVSYNTELFSGYQTKFNMYFERRSGRPFSYTMGLYEKDDLGDTRDFYSNSAYLAYIPTGADDANVNWDESGLSWSELETLLNRAGISERGQILNRNTGTQPWVTTMDISVKQEIPGFAEGHKGEVYFMIDNFANLLNSDWGVEKRLGYSDQAVYDLAGIDDEGRYIINNRHNGADVRNYSQISTSSSAWQAKIGVSYKF

SEQ ID NO: 6876 - protein, 269 aa, Shewanella pealeana
MKNVKMMAVAAATFAALSTGAAQAEQFYGFSNMSVNYLDWTAKAEERSNGGYGGAKEDFVYLEIEGGAGYSWGDVYGFVDLENPENINKSERDFSGNPVTDSFRIAAKGSIAANIGSSNWNVYSHLYSLTVAGEGFFDQNLVVGVSYDVFTDSGFWIKPFLGVHYENQTFAGSGFNGYMAGWVLGYNFELGGQKFMVTNWHETEFAREDQFRGNGTQYTLKSTGQNGAVSLWWNATQELTFGLQYRYADHKLGTAAYHDAAIFTAKYNF

SEQ ID NO: 6877 - protein, 665 aa, Shewanella pealeana
MGTQARQSNKLSKLAMLIGSALALSASSSVTFAADSSQTDSGVTNTVDEVITVIGRSENTPLNIAANVNIIDAAAIEMSGATTLTEVLRGQSGIQISDSNSGAVFAMRGFSAGQAANNTLLLVDGRRLNNIDIAAPSINAIPLNQIERVEILSGSAGVLYGDQAVGGVINIITKAPNSAGGGIQVSGGSFDTYEGKGDISGAISNTWRYYAAASYNQGDNYREHNANKTSSVLGRLQYQTESDNFFVETSYYDNDREMAGSLTKEQIKDNPRQVNPFNKDDYQHEMTTAIRTGYQHQLTDAWSLGADINYTDTQVTGISWGSPSKNKRSFLEFTPKAVANITTEKGDLNIVTGIDLSRGESEFDWGRSNVQKVASAYAQASVPLTQSLSYVVGGRYSEVTDDLVDGDVYPQGIELDQDAHAFELGLNYRPGTSHRFYLRADDNFRFAKVDEQAYTSPGVMGLKPQTGRSYEAGWDWSPASHTLRLSLYRLDLEDEIVFDPSAETPDGGKFPGANVNADASRRYGSSLDWDWQITKMVQLGLEYNYIDAEFTEGVNEGNQLSWVAEHSGRGYFSIDANQNWQVFTELLYTGERFIEGDNGNADPKLESYWLTNLAINYTRDAWLASFRVDNLFDEQYVSAGYYSSWGNGYYAGTGRALRLTASYRF

SEQ ID NO: 6878 - protein, 688 aa, Shewanella pealeana
MTKKPVVVAMALALSSGAFTAQAQQVSEQQVTEFDEVLVTATRVSEKASQTSRSVAVVTEEQLQESQPASVAQALKNEANVNVTNGPRSSSQGVEIRGLGGQRVLQTIDGARQNANSGHRGTYFMDPELLSSIEVVRGPASSLWGSGAIGGVVAQNTKSASDFLEEEDTFGGYLKQGYESNGDRVKTSGAIYGLTETSSTGSVDWLLNGSYYDSNNIKIGNDQTLENSASEGTSGLAKFGWEPTDEQRLQLSARFSNIDELVPSNPATNVGSSVPLVKRKTEDQNITLDYSISPTDSNLLDLNATLYWNGTDYHEDRITKNQVDNTAYDTIGFSINNSSRFANTVLTYGIDGYKDSIKTIRDDSGQAGQRPDDIDGNTTVWGAFTRADIELADSWSVDAAVRYDTFKNESNNLDMSSDDNALSPSVGLVWKTTDWLTLSARYDQAFRAPSIEEMYSTGTHYCIPAMPGFLPNGLCNTFEINPDLKAEQAENKEIKADLRFASLAGNDELAITLNVFRNDVDDFIEQSVSNPLMGIPGFEQTTSWNNVDKAKLTGFEFSTRYRYEQTRVSFNYGQTEGKDKSTGEYLTNIPANKLGLDLSQGIMEGDMKIGTRFTYVAEQDDLPVDNVNQYDSYKLWDLYVAWEPAMGTFEGLRVDFAVENIGDEEYRQAWQTLYEQGRNFKLSARYNF

SEQ ID NO: 6879 - protein, 345 aa, Shewanella pealeana
MNKKLLALAISGAVFGTQAVAVELYNEDGTTFSVGGHVSVAVGDVNSGDRLNEDDIGVESVSPRINFGATHDLGNGFTADAKGEWALNMLDGGDESFTTRLGYVGLSHDDYGRAAVGTQWAPYYNVAGVADMPIAFANDFIYEDHGNLGTGRGEEMVSYGNAIDFGNAGSLSAAVAWQGRKADGLNEYGNRGQIALNYAIADVTANYAYNTGDVKYVGAGSQTADSHVLSATYGSYGAEGLYLAGVYAMNNYMNSGNGQILEESVAVELLASYALSNSLNLSVNYEAVEDDKMSETVFATTALQAEYNFTSQFVGFAGYQFDLQGSGVYKEKADDQWLLGARYYL

SEQ ID NO: 6880 - protein, 431 aa, Shewanella pealeana
MNMTHRRSLALLAALLLPAAASALEGDVTLYGTLMPFFDNARVSDPTRPGLSPATGGATQVSDAAYTGVAIPQRFRLTSGTSNIGFKGGFDVLGEDLQVFFQVESAVSPDGDAPNAWASRNSAVGVKGKFGRAFFGNWDTPYKYPVLLVGAVRGLNPFDNTITANPGFGVPGTTTQSGRVNGKADAAFNRRQGNSVQYWTPELYGFSARLAYSANESRTVASATAPSISPTIYSGLVSWGHGPLLLRYAYERHQDYFGLSQLGGSPVSLTNRSSTDQGHEAIAQLSLPTGTRVSLVGERLSYQNEDRAVGAVREYARLAYYALLQQRFGPHQLFGSFGQSDAGECKVVGGGACTVNGLGATQWNAGYSYALTKAADVYVAYYETRNDRSASYGVVGGPGAVAPGGDTRGFGLGLLYTFAATANVGAPKGSP

SEQ ID NO: 6881 - protein, 832 aa, Shewanella pealeana
MTSIRVLESMPALRTLPRFTKALVMRNTLTLHPRLSTAALAMALLAPIASQAEAQKIQFDIGAQSLPSALRQFGQQSQLQVLYSADEVQGLRSNPVRGQLSVEAALAELLRGTGASYSLQGSSVTISAQRSADSVDLGDITVTSQESAWGHVNGYVAKRSGTGTKTDTPLKEIPQTINVVTQDEIKARGSQTVTEALRYTPGITGGGFADRVKIFDEPTSRGFSPAPMYLDGLHMPYGGGSTGGALQIDPYTLERIEVLKGPASVLYGQNEPGGIVNMVSKRPTATPIREVVLGGGSQDRRYGAFDVGGALDEQGTYLYRLTGVGRDINSEIDYAEQKRFMLAPSFTWNPNEQTSLTFYGQYQKDNDVPEAQGLPAYGTLFSTPNGRIKRSTFIGEPGLNSYDRDQFVFGYEFSHELNDVWTFKQNTRYAYLDDQYVAPLHGYRFVPNPNTGADDRRYATRYGVDWSQTNKAFGMDNMAQAKFKTGAIDHTALIGIDYYHFKSKFFGLYSNQEPTTIIDLYKPVYGSKFTFTNPYRWNRTTDQTGIYLQDQMKWNQWFLTFGGRYDWAKTDTKETGGKVDAKDEKFSGRAGFGYEFSNGIVPYVSYSESFQPVGGLNMDEGNKAFKPTTGKQYEAGIKYQPPGQNSFIQMSVYQIDKKNVLTTDLLHPKFSKQSGAMRSKGFELEGKASLTNNLDVIASFSRNDIKYTKDNDGRKGRHPAGTPPMTAAVWLDYTLGADTAFAGLGAGIGARYTRGSDGTETADGHFTIPSYTLYDGKLSYDFEKSPLQVKGLKVQVNLENLEDKKYVSRCSSDLDCYYGQGRTITTDLTYNW

SEQ ID NO: 6882 - protein, 261 aa, Shewanella pealeana
MIRTQTNVLLSGGLLAASQAMAGDLLLWQTNSLSYLYGKNFAINPSIQQTVTFEHADKWKYGDNFLFVDKIFYNGQEDRNKGPHAFYGEFSPRLSFGKIFDRKLEFGPIKDVLLAMTYEYGEGDSEAYLIGPGFDLKVPGFNYFTLNFYRRQTEGPRPGDGVWQITPGWSYSIPVGNSDLLIDGYLDWVVDNDQNSRGTYHANLHINPQIKYDLGKALGWGEKQVYVGTEYSYWKNKYGVESTHSFDTNQNTASLLVKVHF

SEQ ID NO: 6883 - protein, 428 aa, Shewanella pealeana
MNKRLITLAVSAALLGTVTQVQAAGFQLAEYSATGLGRAYAGEAAMADNAAAQFRNPAMLTYLEGTQVSTGAILVMPDIDVDGEVTSNGVTTPSSAKDIAGDAVVPNFYVSHQLNEQWYLGLALGSNFGMATELDDSFLGTQFGNEASIMAIEINPNVAYRINEQFSVGAGVRLVLGEGSFGAQAPVSQGPLQGKTLKYMEGDDISWGWQLGGAWQINANNRIGFNYRSEVEQNLEGEAKGLGFDVAMIMQGKAPSSQYAGSMELALPATAEIASFHQLTDKLAIHASVNWTDWSSFEKLEAMIPEISADPILVKQENWEDNYRFAVGATYQLSQKSTLRTGVAYDQAAVSDANRTTTIPEVDRLWLSVGYGYQYSDNLDFDFGATYIFADESPIHEHDEQSAMFGGTFEGQVSGNIILVGVQATYRF

SEQ ID NO: 6884 - protein, 1012 aa, Shewanella pealeana
MKTYLTVSTLPARSLLCCALAASLLAASPAMAQSSNATLRGQVAASQAGTTVTATNLATGTTRRVATGPDGTYALVGLPPGTYKVDAGPGTEKTVTLSVASSVSLNLGSGGEATTPADGTATTLDTVKVTATSLQEVKTSEVGTNVSLKQINTVPQLTRNFLEFADTVPGMQFETDPNGNSRIRGGAQASSAVNVYIDGVGQKSYLFGGVSGQEQSAGNPFPQLAIGEYKVITSNYKAEFDQVGSAAIVASTKSGGNEFHGEIFGRTTNTDFRARQADERAGAPNADGSKRQTHQDEYGMAFSGPIVKDKAHFFVSYEGKGFEVSANPVSVPDSFSALRDDLPAGVQSRLGSVTRPFKEDLYFGKIDWDVGENDRLELTAKYRDEKSRDDVGDRNTAIAGKNNLNTEERYDLRWQHFGERYVNEARVSYEDVLFNPNAFTLGNQNIYTRGVAEDDVLIRDNATSGLAIQRKGQKGPSFQNDLTFNSIDWHGSHVIKMGVKYKEVELTQSENAAVNPSFYYAVADGLGTSAIPYQVKFNLPFAGAAPSVTTKSKQLGLYIQDDWDVNDKLQLNLGVRWDGEKIPSYLDNVTPPEVVAALNGPGTDPTVSATYAEQLAKGGVNINDYISNGHNRQQDNNNFAPRLGFSYDFRGDESLVLFGGAGRSYDRNLFDILGLEQVKSALAQYTLRFAEAAPGCTPAPGTCVNWNPAYLSDPASLGSLVNSGVRNGEIDLLNNDLKTPYSDQYSLGLRTRLGEWNTSATVSYIHSKDGLILTLGNRYPNGDFFQNGGQPWNENPPGFGSLLIGNNGVETKTGQLLLSADKPYTQESGWGLTAAYTFSRARGNRGNDDRYGFDAATIADYPFLDLNAVPRHRLVLTGIYDLFWGISASAKLTLATVPPRNEAVSYDQYGGQPSDNIRIVSVDAPGGKFIAGGDIFGTRQLDLSLSKDMHVTEALTVQVRGDLINALNFRNYDQYAIDWGQNGVYNPRASINQYGALSTSPRTLFLSARIIW

SEQ ID NO: 6885 - protein, 367 aa, Shewanella pealeana
MKLSIKRTTFGASRAGLAYFAGFAGLAAFATGAHAQSSVTLYGIVDAGVEYVNHASADGGATRLVSGGKNTSRWGLRGVEDLGGGLKAVFQLESGINIANGQFDDGPGAIFDRRATIGLKNRFGQITLGRNFTTTYDYMLQFDPMGYAPNYSWATSSTATGGRKDGLFSRSANAVRYDGNFAGFKFGAMYGFGNVPGSMKSSSKYDFGLGYENGPFAAVVTFDRQNGANDSVTPADTTNYIQGIHAGLSYDFGPVKAMAGYRNYRRTFHTATPTLRSDMYWIGGQYEVTPFFSLFGAVYHQDIKNASDADPTLFSLRGQYALSKRTVLYLAGGYAMAKHGNAVSLSRDLTGAADTQAGVTAGIQHRF

SEQ ID NO: 6886 - protein, 248 aa, Shewanella pealeana
MNKKLQSGIAALALSISFSSNAAMLAVETGLMDWRSSASDYFGESKNNNPYIKMIGAHGTALGDIYGHVTLENFDNTDIYGTEINLVGQINIGETDFNLYGQVFDKSMPVWGETNTLLGFSWDKNYDNTYVQLAFAAHIVNATYKAFDSNFDEQGFNGGYAYLNISHDLSLFDQDFKFVWWQEFYFGRNEQYLELAGDMEDFGFNGQLRANWIINNNWSVGVSYRYAENNLGKKGYHDAFFYSVQYKF

SEQ ID NO: 6887 - protein, 1198 aa, Shewanella pealeana
MKKQQITLLEKRTKKKLVWMRTAFLLLVFTATALQGWAQNAENRQISLEMKNEPLGSALKQFSNVSGYKVNFPSEDVAPYRVTVSIYQMSPFAALQKMLEGKPFEYDVKQNFITVRKVKATSTTASGKFRNVGGQVVDESGDPLPGANVKVLNSPFGAITDAEGNFTCRVPVDVHTLEVSFVGMQSEKVSVKDRNNVRVIMHEDKQQLGDVIVTGYQRISRERSTAAFGFVDSEQLNRQMHSDLASSLEGQVAGLRMNINSNTGDMSPILRGVGTFSHDVGTEPLIVVDDMPTNLRLSEINPYNVESITVLKDAAAASIYGALAANGVIVVATMRAKKEGAHVSINADWFITTKPNFKSLNLASTSDIIDYQTAVFDANVAEKGSAANFLSSFEYNYYNPLFQLYLDQANGDITSGEVNATLRQWCNNDYYKEYRDNAWRTAITQRYNVTVSQKAGNSNHLLSFNYEKDSQRVISGKSNKISLYYKSNYAVTNWLNLNAGVDVRMGRSYTPNSGYTSYTLQQRYERILDADGNHYTSPYVNVDTSPSYNGSVVRKAEGVSPYRTFGFNVLDALEESITKSHDVSIRPFVSLQARFLKMFKYNFMYQYEWNKGKSELFESENTYVMRMLYNSMVDTNGKAQLPQGGRFNQTEVESKRYTVRNQIDFDKTWKDHAVTAIAGLEFRENKIPTPARQLLYGYDPQTLTSDFMNWQTYRDGVGTSALSGRTITLSGLSATLHESRHRYASFYANAGYSYLSRYNLSGSIRWDQADLFGLDIRNQRHPLWSIGASWILSEESFIKEISWLDYLKLRMTYGINGNVDQSSTTYFVVKKKTQSNPIKTTYLTYEDDDLPNPKLRWEKTATYNIGLDFRLFKNLISGSLEYYNRHSSDLLVRRYMDPTLGAGSRVVNNGEMRNRGVELSLTTNIIRKKDWNFAVDFNFDYNKNKMLKVDHSESDNARVFIASPQVYFMEGTSYNTLWAYRIHRIENGYPVAVDKDGNDLVKFNEDGTVASITSGSSLKGTDDLVNLGSLTPKFSGSVGLRFNYKNFDLNAFFVYAGGNKLRNSVLKMDDQLGTQTLKGIANRWTADDSNAQVRMYLDIPAQVKTYASTFQDWWQYGDINVKDAGYVKLRSLSVGYNLPFTVCQHLRLSSLKVKVQVNNLFTWCKAGSDIDPESYGMNDGTRGIASPKTYSIGLSTSF

SEQ ID NO: 6888 - protein, 710 aa, Shewanella pealeana
MSVGTSFKFSRLGLAIVAALASSSAFAEDTSAESTIVAEPNIERISVTGRSFNDYNVGSSSGAMRGDIDILDTPQSVTVIPDFVTDEQLATNLSEVLVNDSSVTGGSEKWNRQVFNIRGFELSSGSGFLINGQQQWSHYVQPIETLQQVEVLKGPSSMLYGQSGPGGLINMVTKKPTYETMLDIGFDTDENGSTRFQLDAGGSLNEAETIRYRTVLVKQDTTYWREYQDGSHQERDRWLGYLNLEFDITDDLLLSLKYDHTQDKTGIDRGGWLDSSGDLIGGRDIIWDQPWAFTDNTISNLGAELTYHLTDDWKVKAGYNDQQFNRQRLDSSPSLISGSEDPFTDGYYISPFDRYDDWQHKTGFVDFTGNFYTGDLEHQLLIGANMLDYYYGQLKESGEKKQVVMPGQPVPKPDLDYNRDVTKYESEYKHYGFYVQDLVTITDEWQVLAGVRYDEQKKEGAGSNSYAVSPKFGVIYSPADNGSIYVNYSKSFTPQGIVNNIDDVNDGKNLDPEYGEQYEIGTKWELFDGSLLLTGAVFDITVSNVTVTEEIEGSSQTITTQSGEQRHKGFEMGAQGQVSDSWFMTGSMMYLDAEYLRPETDSLNGKTPVDAPEWSANVWTRYEMTDDLAFNFGALYVGERFANTSNTISKDGYVRFDMGAAYTMDVMGSDVSVRVNVKNLFDTDYLAGGTNTDVTVGEGRHFSLALEAKF

SEQ ID NO: 6889 - protein, 237 aa, Azorhizobium caulinodans
MGRCILYLFCLLSALFLIPTNAAAGGIEVPHYIPIPFVYSGVYVEGLYGYASRDWESYLPYQTYVAALQGDGPPFGPFVKRGKGGSVAGVDVGYQWNRYFAAEIGWIHLPTVRYLVPSGLPVAGGRISEHSWLGYIALKLAFPICGNLYSYSKVGAAGLNIRTRINFTPVNDLTQNGDFWSPLFAVGLQYYLNWYWFFTLQYLHVNGYGRASAGAIQKLPSPHSDLFIFSVGYKLAI

SEQ ID NO: 6890 - protein, 682 aa, Helicobacter pylori
SVVALISAPAMAQGPTSDTDDTQFALPAITVTGDWLGAPTEESEKTYTGSRTVVDSEELHERGALNLEDALRANPGVQVLDETGTGILPNIGVRGLNPLRSERLQILTDGYPIAIGPYSNVGVSLFPVTLPSLEAVDVVRGGAAVHYGPNNVGGVVNFVTRPIPAETSQTLRERLTIAEETGNIFTDTYYRIGGPASDKLDLQFQANIQRGDGFRDHLDTQVDNFIVDARYYLNNQNELATQLQYYNVDAELPGGLTPEAYEQDRTQSQRPYDAYEADMTRATFTWTYNPSPDVEFQWRNFVHDADRTFFFGQNLSGTGNTFDPGLASTHRADSPRLFRVYSTEPRLAISKGRHDVTLGARYLTEDVEFDVNRVEFASNTRSTARDWHLDTKALALYVSDTMHFLDDRLTVTPGLRYEDVNMDFRDNLNGTKEENNTDEWLPGLTVGYQATDRIFLFTNSQRSLVPVQIAQTTREGDVANETAWNYELGGRIQLTPNLLSSATLFRIDYDDQIQFNRTESRFENLGETRHQGVELDNRWQVNPDLELGLGYTFLETEQLSGANAGNELPNAPEHKVSADAVYSYQAWNASLNWLYVSTSYSDADNTEEETANGSAGELPAYHLVNARLGRDIAVGNGRNLNLALAVNNLLDEDAYFRGVDVSPIGRIPQPGRSFILEAQLDF

SEQ ID NO: 6891 - protein, 230 aa, Helicobacter pylori
VNAPYVALTFDSGKFSVDGSLRYDMGDARGSYNGTAIAQNLDVNGDGVIQPVEQRVATVDTANSRPVNYDWNYLSYSLGGNYLLTDDLGAFARISRGARANADRLLFGVVRDDGSVSTNEGVNVVRQAEAGLKWRRDGLSLFATAFSARTQEQNFEITSQRFFNRSYEAHGVELEASYRYQGFTVNGGLTWTDAEISRDQITPENTGNVPRRQADVVWQLTPSYRGDHYQ

SEQ ID NO: 6892 - protein, 1129 aa, Azorhizobium caulinodans
MDLNLKNKHPRRIYYLFLVIIFFLASTEIAYSQVKNLSLHLTNVTLEEALAQIKQKGEYSLWYRNEEINLKKKVSLDIKNGSITQILDALFKGEDLGYIIEDKHIVIFKADEKSKATQQTGKRITGIIKDNTGEPVIGCNIMEKGTSNGTITSVNGDFSLNVAENAVLQISYIGYLTQEIPVKNNQNITVTLQEDSQILDEVVVVGYGVAKKSDLTGSISQVKAESMQNYTPSSVGDLLRNSIPGMSVGYSVSAKGNSDMMIRGDNTLTAGSSPLIIVDGVIYNGDISDINPNDIEKLDIMKDASSAAVYGSRATNGVVAITTKKGNSQKPVVNFNGSIGIATTANRVKPYDKDGFIKWRSDMFKSVYSATVPQTPWSPFDDPRTIDSQYLDQWMAYHSTTPDNLVDAWLSGLRLTGLEIENYKAGRSIDWEDYIFHNGPRQDYNISLSGKKEDFSYYWSLGYMSNESLVKGDEFSTIRSRVNIEGKPARFLKVGLNAQFSYRDESSVPADVDQYTKLTPYSSFYESDEETLKLYPNDDNQAKHPLLNSTYRSREQEYFTFFPKIYATLDLPFGITYTVNYTTRFVFYHNNIHDSSEHPEWKLFGGRASRENSLRREWQVDNIINWNKTFAQRHKVDVTLLANAEKFRNDTEKMSNQNFTPNDILGYHDMAIGNLPELSSNDEVRTSNALMARLNYGFMNKYLLTLSVRKDGSSLFGYSNPYATFPAAALGWVISEEKFFKVKFVDYLKLRASWGINGNRDITNYAALSKMLAEKSLNTDLNGNPITIPTLEINTMGNKKLKWEKTEAYNLALDFRLFNGRLNGTVETYYMSTTDVLVNRELPTITGYKRVYANLGEIRNKGFELSLSSTNMKQHNFEWTSNLIFSLNRNKIITITGEKYDVFDKDGNFVGQKEPDDKTNNWFIGQAKDVIWDYKILGTWKIGQEEEAAKWNQAPGDFRLEDVNDDGLLTDEDKQFLGYKTPRFSWTLSNTFTLFNDFEFSFVLYSLWGHKGSYNLAKHADHIEDRCNSRDIPYWTPENQLDDFARLRSAPAKGVDYSVWFDKSYIRLENIALAYKVPAKFLKKTPISNLKLTLNVKNAAMWAKDWKFGDPEDGMRSQRIFTFGLNMTL

SEQ ID NO: 6893 - protein, 459 aa, Azorhizobium caulinodans
MGRKMLLRGVCAAVLLAATASPAMAGSSAELLKRLHEKGILTDDEYQQLLKQDDAPSASAASGPSWVDDKSIVRVNGSGLGLQVGDIALKISGSVNGFYVHDNGDNPGPAKTVVGGVATVGSNSSAIRNGLLPGFLKIEASTTLDGWDVGAHFGIYPGINSVSYVGGGANSGGNPRALQTSGIDFRQTFLTFGRKGFGEVKIGRDIGLYGSEQILNDITLLSSGTPAGNVAPSNTTLGRIGTGYIYTDFQPQITYTTPSLAGFQASVGIFEPLSSLTGPAESNKQPGFQAKLVYDGKLGGVATRLWLAGITQKHNVVGGPDYTGSGFDTGAKVTVGPVTLVGTYYDGSGLGTTALNLFDTDGLGNKRDSHGFYLQGLATFGKVSVAGSYGESNLDYANLADAVANPALVDKNSSWVGQVRYGLNGWVTLISEYVHTRSKAHNGNKASSNAIASGAILFF

SEQ ID NO: 6894 - protein, 152 aa, Azorhizobium caulinodans
MEGELSFSNFPAETVSYTYGGGSYFSGYQESSGDLDATYLLANVWYDIPTSGLLNYYVGGGIGVAKVDADTHFFPYQANKFGYGPGETKLAGQIGVGAIYDISETLALDIAYRYKYVRGIDFVDIHLPTPYGIYENGDVGTHSIQVGLAYSF

SEQ ID NO: 6895 - protein, 788 aa, Azorhizobium caulinodans
MMGGTAKKVVPGRITALILDSVTKKPVDYATVSLIKVKDSKSVNGAVSDEKGKVNLSNVTPAAYQLSVGFMGYKTKVLPVTTTPEKPDLNLGTIYLSPTSSNLKEVEISGQKALIENKVDKLVYNAEQDITNAGGDATDVMRKVPMLSVDVEGNLQMRGSAVRVLINGKPSGTMANSVADALKMIPAEQIKSVEVITNPSAKYDAEGSGGIINIITKKKSAEGVSGSVNTSAGTRSNNGAFSLNAKTGRLSVNTSLGVNHAYPQNSNVLSFNSATINGVTRTVTQDGFSKWSRLGYNGSAGLDYDFNNYNNISTTVKYNRFSNGGPGSSNVLVDQLMSQNIRDMDMSFNNVDWNVDYRKTTKKEGEEFSVSAQLSSGRNGSDFSNRLITEGVPDVLVLGNNTGKNNEYTLQTDYVYPITKNTTLETGAKGIFRNIISDYDESLQDFDYDQNVASAYGVLGFKLTKKITAKAGVRAEYTKINWLSGSAQKFSNDYFNLFPSMIVSQALKGGGSLKLSYNRRIQRPSLSYLNPFENKSDQFNVSQGNPDLNPELSDNVEFGYSTFIKGSMINASVFYRRTNDIIESAVMPIASDATTDAQRFLTSYINVGRSESYGMNLFGTYNPKPKWTLMANIGLNTYEINNAANNIQTGTLLNYTAFMRSAYALPGGWNTEIWGVINSPKRTFQGKTDAMYFYGGAVKKEIWKKTATVGLNVLNPFNRDLVIKTENRTSNSLQTTNIHYPLRSFGINFSYKFGKLKFTAPKKGVKNDDLKKEEGQMGGGLQQENQNK

SEQ ID NO: 6896 - protein, 231 aa, Azorhizobium caulinodans
MNSFNEGVVSPLLSFWRRSLMLAGALLLTACSHNSSLPPFTASGFAEDQGAVRIWRKDSGDNVHLLAVFSPWRSGDTTTREYRWQGDNLTLININVYSKPPVNIRARFDDRGDLSFMQRESDGEKQQLSNDQIDLYRYRADQIRQISDALRQGRVVLRQGRWHAMEQTVTTCEGQTIKPDLDSQAIAHIERRQSRSSVDVSVAWLEAPEGSQLLLVANSDFCRWQPNEKTF

SEQ ID NO: 6897 - protein, 219 aa, Azorhizobium caulinodans
MPYSELYMSSTYFHSSLLAATLFSVTLTAPAFASENTQNTPQTITTKKPQPAENTFSEKNEESYWGKFKRNLTQTWDNDQYNYYLPVWTWHNRFTYDKEKTNRYNETPWGFGMGKYRYDNEGDWHGLYAMAFMDSNNRVQPIMGYGFEKMWYPGGDREGFRMGAGFTLSVTARHEYNYIPMPLPLPLVSVGYEHLSLQATYVPGTYNNGNVLFAWLRWQ

SEQ ID NO: 6898 - protein, 291 aa, Azorhizobium caulinodans
MTYDLGPGTLQLGQFKVPQGMEELTSSNRISFIERASSQVFTDSRRIGLGYDQSGDNYHFAVMGYSHAIEDDPDADMPLGAAGRVTFNPIRGAQTLHLGASLSHERFDSDGREGVVRFRDRPESRPTEGTRLIDTGGLDAKSTTKGGLEFGFLSGPFHMSAEYLQADINGDGDQRDLTFDGWHVQAGYVLTGETRGYRPTGFRTVSLASPAGAWEIAARYSSVDLNDRNVRGGEQKNVTLALNYYATDNLRFMANYIMVDVEDSAAVEGFTGGATDEDSPNIFLARMQYNF

SEQ ID NO: 6899 - protein, 731 aa, Azorhizobium caulinodans
MDMKKRLWVLHPLLLVSSLPALAAQSDEDSIIVSANRTHRTVAEMAQTTWVIEGQEIEQQVQGGKEFKDVLAQLIPGIDVSSQGRTNYGMNMRGRAIVVLIDGVRLNSSRTDSRQLDAIDPFNIEHIEVISGATSLYGGGSTGGLINIVTKKGQQDRQVDLEVGSKSGFANSNDHDERIAAAVSGGTDHASGRLSVAYQRFGGWYDGNNDALILDNTQTGLQHSDRLDVMGTGTIEIDDNRQLQLVTQYYKSQGDDDYGLWLGKNMSAVTSGGKAYTTDGLNSDRIPGTERHLISLQYSDADFFGQNLVSQVYYRDESLTFYPFPTLTKGQVSSFSSSQQDTDQYGAKLTLNSQPLAGWDLTWGLDADHETFNANQMFFDLQQSLASGGLHNESIYTTGRYPGYSISNVAPFLQSSYDLNEIFTVSGGVRYQWTENRVDDFVGYAQQQDIANGKARSADAIKGGKTDYDNFLFNAGIVAHLTERQQTWFNFSQGVELPDPGKYYGIGKYGAAVNGHLPLISSVNVDDSPLQGIKVNSYELGWRYTGDNLRTQLAAYYSTSDKTIVVNRTDMTIDVQSDKRRIYGVEGAVDYFIPDSDWSVGGNFNVLKSQVQTDGRWQKWDVTLASPSKATAWVGWAPDPWSLRVQSQQVFDLSDAAGNKLEGYNTVDFIGSYALPVGKLTFSIENLLNEDYVTIWGQRAPLLYSPTYGSSSLYEYKGRGRTFGLNYALTF

SEQ ID NO: 6900 - protein, 760 aa, Azorhizobium caulinodans
MAHPSARPARTRRTAASRTSHAGNPSSNDLRPSPLSSERALLPLGALMLAASFGSWAQTSMTPDKTLKTVTVTETAEAPEGKDSLRATETTIGKGKQKLRDIPQSITVVTEKLIDDRNLDTFKEALKNTSGISFVAAEGGESDIKLRGFSLAATGDIFADGIRDPAFYDRDTFNLDRLEVMRGSASMLFGRGSTGGAVNQVSKAPRLIDEHQVDLTLGSHDYRRVVGDFNLKTGESAALRINAMVTTADNDGLGNSLDKKGLAAAYRWGIGERDEFSVSIYSLDNKNGVNYGLPWIKPTSTSPDSATTILPVDPKTYYGLASDYNDGSANYATLSHLHRFDDGSELKTQLRKGVYTRDQRASTVRRSPTTTSLETLNPNTVFTRNSQPKIQDLNTVFVQSDFSSKFNALGVQHEILTGVDLAQEKKTVYAARTPAQGGVTNTKPPTTFGTPSDGAWFDESSRVLRLNNHYESTGWGVYAQDMIQVAPHWKVLAGLRYDSLVGDYDSYTVNPDVKTSYKMKVSEWSQRLGLLYQPNDLHSYHVSAATSFNTSGDAYSLSSANVNIDPEKSINLELGAKLDSADKRFTTRLALFRSTKLHERNTDPLVTNLVTLSGKRHAIGAEVDFSGRLTPAWEIYGSFMWIPSAKIDIGVAGSEGQGTRPSNTPKVSGTFWNTYQINQQWRVGAGLNFRGKQTPIRNPGWEVDSYVTGDLMAEYKVSENFIVKANLSNVTNKLYADQLYTGHYIPGPGRLFQVTGSIKF

SEQ ID NO: 6901 - protein, 678 aa, Azorhizobium caulinodans
MLRPALSLATRPHPLALLLAAAASLPALAHEDGATELQAVEVKGEALHGTGAAYSATRLEHDDIRDHRVARPQDLFRLVPGMNLTGYGLPGVADQVALRGFGNGGHGGDIGFVIDGIPLNEAMSHADGYADLNVIVPLELERMTVLRGPVSALYGNYNRAGTVTLQTRKGGAYRDLDLNLGSYGTVDLQAALGAGFGGNQQLNLAAQHYRSDGFRDQSAGERSTLAGRWAVQATSDLEVAVSARAHEAKADNPGYLTRAQFKDDPYGKDPRTQNDGAEKGFYTLRTDLNYQLAPELKLLSFAYATRQDFTRWFSRGGAAAPSWRQREETYERDVLGAGFNLNGHHHLGAAGQLSWVGGVETFSETTDYLKYENTRFRRRIGTAEFDRRFKLDNLAVFGEAALDAHRLFKPSIGLRWDRFTGDCDRRGAETSAQPCARMDAVEHLSPKLGVRSQVADGVELRASWTEGFALANDMAKYSLGARHVDPNVFRQTELGANVRLSSQLVLDLAAYHLRSSDEINYDSVANEYINAGSTRRTGVEVSALWAPADRFDLSLNWASAHSKVLENPNSSLEGKRVTAVPRYTATVEANWRPAPGWRGTVTWRRVGSFAVTQDNTQTYGGYSVFDLGAAYTFPGAGAYTLYAAIDNVANREYATAVSTVGYATAAPRTLRVGAQLSF

SEQ ID NO: 6902 - protein, 873 aa, Azorhizobium caulinodans
MARRKILMATASVAWLAGVCAVQAQEGPSRVDDIVVTGSRIAGGDRIAPVETLERNVIAAAGAADASQLVRLITANSGSEAQVDQLNQPQSSGTAQFNLRNLGLGSTLVLVDGQRWTTSAVVATDGSAFVDINSLVPMIALQRVEVARDGASAVYGSDAVAGVVNFITRHNVAEPEISAKYAVADGSEESVIQAVGGLALLGGDLTLAASHFHRSALSTDERDFTQADRYGRASWTAVTSYGQPGSYYRPGTGGYAPDPACDNPAFDAAYRNSAGDAFCRLDYSDFFDLTPEETRTQVFADYRRPVGDMSLSLQAAWSTSETRARQTPSLPILAQSLTVPASHPDNPFSEDVLFRGRLLGAEAGASTAVFEYETWRLAAGLDGDFAGGWTWSLAATASRQHVAYDKPDVIGSALRNALNGLGGAGCDAATGSPGVGACQYFNPFGSAYLGTGTANSAELIDSLTGSTGLRGASSLTTADASTGGQALAWAGGRVDVALGAQYRRSAFRHDWSDLVNAGELLTAGFSPDFEGDQQTLAGFAEARIHLGDRIEAQLAGRYESYDGDQGRFSPKAAVRWDVTDALALRASWGQGFRAPSVYAQSGAQASQPSVFDRGAFVFVNTLTSGDADLKPEKSESLTFGALWRPIKGLELGLDAWRFDYADQVVKESAQAIIDQAAADTAAGRTGTDAQSRITRSAGGALTFVQLYFVNASSIETQGIDLAARYGRDLWGGRASASATWTYVDRYDIRLSDGAAQVSGVGSTNLNNIGRSLPRNRGEFALSWSGGGHALTGLVHYTAGYRNDRSGINDTTIASQTTVDLLYTRTLGLDLDLALGLVNLADKAPPLAQYAFGYDPVVADPRGRVFSLGLTKRF

SEQ ID NO: 6903 - protein, 846 aa, Azorhizobium caulinodans
MRHPLTFAVTTVLIASAPALAQQAGTVQDISVVGTTDLLSEFLKTTLTVQPGAALSSVNLRQVEQEVLASGYFKTATAELRTTGGRDTLVVTVTANPVIKDVQATGLTFLPADAFKQSVAELLNIAPGAVLNTQRLEQAKEALAQNYRQEGFPFVPSISADTKTNKDGTATVTFVVDESAPLSRIEVTGATLLPQATVQNIFRPLQTSKRFTTQAFFAASDALQAAYEAAGYFQAGIDPRSVTLENGVLKLSVIESRVASVDLSPLGTLAQTPALQTKAGQPLRLAQLQADVRALANQTGQPVGFALQADPQNPSQVTVLFGAADVESGPVKSIAFVGNTKVPTAQLQAAIKTKPGDVYSPQLAQDDFMALRNVYRQAGYEISTRDAITFQNGVLTYNLREVRLAGYELAWQGQHRTKDRVILRELPAAGQTFNSKDVQAALGRVSALGYVTINDVRVKSDPQNPENVTYVIALSEGRTGIPVNLSLGYDSLQGGWSGDVAYTNSNAFGLGHSFGVRLGAVQNQAGQNWVGSLNYTIPWLDLDFADFRKNRTSLSFGVGSDVGGNIALLDANKEDTGRDYTTRTNGFSLGLGRNITPNLTASANVAFNNRTSYLEPKQEGETSNLDDAAATALLPATSLTTRLSGNLNYDNTDNVNFPGRGVRAYGALGYNVGRAGDAPLSWTDGEIGVSGYYGFGGRIKRSFGLETYRQVLAARANTGTTTGTFPDGTGYFIGGSNPLASRELRGLEDGQLFGTNYFSSSLEYRYDFGLSGGVAQGLYGVLFADYGGVWNSGEAFRSAYGVGAGVQLNLGFGGAQLPSLRFDYGYSGQNAQKPNGRFHFRIGNFW

SEQ ID NO: 6904 - protein, 573 aa, Azorhizobium caulinodans
MVVAKVRKCFSTVLSGALLAGLFCIVGSGEASAANCSAGGGLAYLGNTRGAARSVWLSGTSAGSFGLEAAQGNQMVDTWSKSKRGLHLSLSPVVSNGNGGTHKLLDLSGGKPCLLDTQNQVRDFIPPDFTWPQGRPDIGPIRFFDFDLPEGRPDTGPIRVFPDFDRPAGRPDTGPIRVFPGFDRPDGRPDTEPVRVFPGFDRPDERPDNDLPRIPPDRPDGRPDNDLPRVFPGFDPPSPSPNPTAVRGGRVVGARTAQNCIDPRSVGSDQRRDVPICPEFVAEEAATQGAGQSRGVPLTPGRDLPAPSLWNFWSDIRFTDISDERYDRDSDTFARTLDMGLDRRITDDLVVGMSFSLQDSSTHAFHDSLDIDSDGFSFGPYAAYRLSKHWAIDASLTYGRYNNDVELSVLSGKYDSERFAGEISLNGQYKFDAYYVRPKASVTLSHVKSDAYGLSGSLFNFPVSVSLPGDSYNYGVLDMSTEVSRFFRLPDGQPFLVFAELGAQYEFERPNDGKILTGDLSEVSPSPWAFSLRSGLRMLLNENLQIEATGGYLSLGQDDLDVWEGKLHVSWSF

SEQ ID NO: 6905 - protein, 490 aa, Azorhizobium caulinodans
MQLAKLTAALVAAGLALPALAAPDAATLQKLVERMEKLEARNAELEKEVQSLKGESTKLSQALESPRLSEDEPELTVRLKAVEKDALNMKKAAKIAEGLDGIKVGAALATVAQQARGLPDGIENGRSQLNYRADVSVELPLKPLGDIEHKLFAHLRMGQGLGLNAAFSNLGHFASAPNALAFRASGSSPDDSVTILGEAWYQANIPLPFLGFKPYSRETLQLTFGKMDIFGFFDQNAAAGDEAKQFLNSVFVHNPLLDAGREVGVDANGFQPGFVASYLNYFDKTQPWRLSVGMFGAGDRGSNYQHSLSSPLLMVQAEKQLKLFGGLTGNYRIYGWNRSQAADYTGELHKHTGIGASIDQRVGDGIKLFARYGKLVSGELPFNQAMTAGAEFSGSYWNRGADSIGIAGAWLQSGKGYRTSTATAYLDDAQSQIAYSFTPQGAEKLTEIYYRYRLSPQFELSPDFQYVTNGGGNSDAKSVKVFALRANIAY

SEQ ID NO: 6906 - protein, 418 aa, Azorhizobium caulinodans
MRNKTSLVSGAALGVMLACGLGVAAHAQDNTVAWKGAPQWTNDDVYFKVRGRVLLDAVFQDVKRDGPGGDFDTRNVRGRQVFLGVEGKLNNYVAYKAEGGAVNGGAWAWDDVVIEVKPTEATSILFGNIKVAGLENLTSTRFTTFMDRGPYGDFGVDSYQLGVVGKYQGPNYSFTGGVQGGSINNADVAVGANADSKERLVITGRAHWAPIATDTDKVHVALSYRYRNRGDEGAFAYTGRTNTAYSNGTTFYTTGGIGNRDNTLAVEGAWVHGPFSFQGEYSNIDVTRAGTAGSDPTIKVGYAFVSFWPTGETRNYDQVAGEFKRPKILNPVTAGGFGGVELALRYDFADLQDAYDTLKVKPATSQAGEYTGWTLGLNYYPTSYVRFQANYTDGKSDNIGLNQDYDVKQFQLRAQLDF

SEQ ID NO: 6907 - protein, 183 aa, Wolbachia endosymbiont of Trichogramma ostriniae
EILPLFTKVDGITYKKDNSDYSPLKASFLAGGGAFGYKMDDIRVDVEGVYSYLNKNNVTDAKFTPDTIADSVTAISGLVNVYYDIAIEDMPITPYVGVGVGAAYISTPLKDAVNDQKGKFGFAGQVKAGVSYDVTPEVKLYAGARYFGSYGANFDKSGGEKDKGGHTVLYSTVGAEAGVAFNF

SEQ ID NO: 6908 - protein, 192 aa, Wolbachia endosymbiont of Trichogramma ostriniae
EILPLFTKIDGIDYKKGTDIYSPLKASFIAGGGAFGYKMDDIRVDVEGVYSYLNKNDVKDVVFTPADTIANSLTAISGLVNVYYDIAIEDMPITPYVGVGVGAAYISTPLATAVNSQNGKFAFAGQARAGVSYDITPEIKLYAGARYFGSYGAHFDGEKADPKDAAKKVADKGAYKILYSTVGAEAGVAFNF

SEQ ID NO: 6909 - protein, 698 aa, Azorhizobium caulinodans
MKGARHWRRAAALPAAALTGAAIAQTAPVTGPEPVTLPTVTATAKAEGSLTVPGVARQRESLYQSAGSVGFVDAESYANTYASNLRDVLKDAPGVYVQERYGQELRLSVRGSGIARGFHTRGLEILQDGVPTNFADGSGDFYQIDPIGLNAAEVYKGGNGLAYGSTTLGGAINFTTPTAFTTEAPNQVRVDGGSFGTVRAAGQASRQIGNFDFMANLSVDHSEGYRDHERGQYEQLNANFGYRFSPTVETRFYVGAYVVDQLLPGTLSLQDALNNPTKASASALAGDQARNTRTERLANVTTVKLDSGQLDFSTWVIHKNLYHPIFQVIDQDYWTYGFAPRYTGTQTIGGMRNQLIAGARFFGGNNDARQYVNVSGDRGAQTLNSRQDAYNYEAYFEDRLYVMPTVAVMAGAKAYYNQRRYTDYGGLPANPVPKSDDTTYSGVNPKFGVLWEPAKDIQAFADITRSADVPDFSDLNQTISTTTQFVPLSAQHGWTLELGTRGRRERLGWDLTLYRSLVRDQLLQYTTNPNVPAATFNANRTTLQGVELGVSADLLQNVATTADKVTLSQLWNYSDFRFDNDPQYGNNRIAGVPEHVLRTTLAYSQASGLRIAGTIDWVPTGAYVDYANTLKVPSYVLFGVQASYDFKQGLTVFLDARNLGNKRYVSDFSTVTDARTANTAVFYPGTGRALYAGVRYKF

SEQ ID NO: 6910 - protein, 1073 aa, Azorhizobium caulinodans
MVFAVTPVYATGGAFSPLPHAVSEGDITVTGKVVDDAGEPLIGVSIQVKGTSKGATTDVNGIYTLNIASGSTLVFSYIGMKTIQRKVTKGGKLDITMENDENMLDEVVAVGYGSMKRSDLTGSVVSINAKSIEESMASTIDQALQGRAAGLQMTQNSGVPGGGTSIQIRGVNSLNSTNEPIYVVDGVIISGETGSNTSNAMAGINPADIESIEILKDASATAIYGAQAANGVILITMKAGVTGKPRINFQASVGNQEIPKTIDMMNLRDYARHYNELYALINASRVKDAFSHPETLGDGTNWQDEIFRNALLQNYNLSIRGGTKTVSYNLSGGYLGQDGICIGSDFERYTFRMGTEIQVTPKVRFGGTVNVSYTKQGTGMASWSIIPNALYQAPDVPVRDKNGNFSGPEEDDQQNLSNYSNPVALAALTQRNNEKGGARANLFMKINPWKWLTYRTDFTADGNIDNYQYFLPQYELGYSKNPYPTNEHSKNYGLYWGWKNVVTMEKTFKRKHKTSLMLGHEMTSRSSDYLQGKRTHGDNLLTDLDAGDAAYATNSGRASKTTYLSYFSRLFYSYDNRYQLTATVRRDGTSRFAKGNQWGTFPSVAVAWRLSEESFWRPLKDVVNNFKLRLSYGEVGNSNVSAFAYQRMGTYVQSIWGTSLQTANIANPDLTWESTRSWNAGIDLNFFNNRVEFILDAYIKKTRNLLLQQDYPGYMGTTGNGAATAQWANIGSMENKGFEFTLNTVNISNRDFQWRTNVTFSLNRNKVASMNTENAFIDKTYQNSGQTEVITRTAVGKPVSQFYGYKAIGRINSASDYLIDNGDGTSTVKIATPVLRVGEQVVNSGTDKGSLIKQIYIGDYIFEDLNNDGVIDEKDQTFLGSPLPKFTYGINNTFNYKNFDLTIFLYGSYGNKAMNYLSRRITNPNSSGNVHASVANHARLGYLDGNSDNTDVWNMYILPGSNGLCRMSVNDANDNDRISSRYVEDASFLRIQNIALGYTLPKNWLKKLKIENARIYANIKNVYTFTGYDGYDPEIGSTQAQYSYSGQSMLMYGVDTGRCPSPRIYTFGIDLTF

SEQ ID NO: 6911 - protein, 703 aa, Azorhizobium caulinodans
MANFVVLFKSMKDYLFFLLFISAFTLSFAQATSQNDSITQLSEVVLLDSLKAKQATGIVSSKVIGAKVFQNFSPADFVSPLNQVSGVYVLSGALNTNRITIRGVGARTPFGTDKIRLYYNEIPITNGTGVSTIEAFDLENMNSIEIIKGPKGTAFGSNLGGTIILNPKEALLHSTTVRNSFTTGSYGLLKNSIGVTHADDKLSMELRYGHMSIDGYRENNRYERDGILLNTTYKINNKNKIAFLLNYIDYTAQIASSLSQAAFDEDPTQAAFTWNAAQGYEANKYTLAGISFSHIFNENLSNTTSLFYTYLDHYEARPFNILDEFTNGYGFRTRFKGHFNLKETPANYTFGAELYKDNYNWGTYENRYEDNNGNGSLQGDELSNNKELRTQFNAFGTLTIPFASYFSAQLGMNINKTNYDFQDKFNAGNENTSGKRNFNLIFLPSLNLDYTFYPKQRIYFNLSRGYSNPSLEETLTPDGVINPDIAQETGTNYELGSQLSLDNNNLKIDVALYRMAIKNLLVAQRVGEDQYIGKNAGSTKHQGIELDVNYKLKITPKFQLTPFVSYSYSNHKFVEFIDEENDYSGNQLTGVPKHRLNTGLQMQWRNGLYWNTTHQYVGAIPLTDGNMLSSESYNLLNTRMGYKKKLSHTFTIGVDFGVNNLTNTKYAQSVLINASSFGGRAPRYFYPGNNRNFYGSLLLNCRL

SEQ ID NO: 6912 - protein, 573 aa, Azorhizobium caulinodans
MRRWILAGTAAWIVAAPNVAPAQGEDFWSGPTQMVAVDAVSGLENVEPESWARRALSTLARGKLLQGVPGRLLQGERPLNRLEFAAALAAALDALDTLIVGGEEHLTHTDLAVLERLQADFEPELALLRVRTAALEAKAGNLEANLFSPTAKLDGSVVLALNGGGGGAGSRLFTGFPDTSPAFGDALGASPVPATAANVTFLARSSLNLQASITGGDLLFLRLRGVAGYDIGALLPGIAGGLGPLFYAGGPNGTSYDQSTSAVATDGRATVSIDELYYTTDIDDNAKFRFLAAGRVNIGQLIDTNSFANNEEVDFSNGSFLNNQLITLSASSFFGPGFGLAWQINDAMRLRAIYTAGNGGAVSGDARNRLNAFGAPVGGFGAGGLFGGQTASVIELRIDPGPAASIKLQYARVVEQGAVLATVMPEAIRNSTNDAYGINAEWAITPHFALFGRYGIASTQVNAFDGYAFSGVRSNTWHVGFALPNLFAPGNNLSVAYGQPVRVFAGTATGLTAAGLTTSLVPSGTEGNIEIFYRLRLNDRVSLTPDLQFIVQPVHSRNSNGLAVGTLRAVFEF

SEQ ID NO: 6913 - protein, 726 aa, Azorhizobium caulinodans
MRSDCMPLRRTILAGTSLIALAATPIAQDQTTASPTENGAIVLDKIVIDGGSGGVIDADGYVARSSATGAKIDTPFVQTPQSISSVTQQQLEDRNPQTLLDAIAYTPSARVGGFGFDPRFDSFTVRGFDVTYTGVFRDNLRQPGASSALFKTEPYGLEGVSILRGPSSALYGASGAGGLFNLISKRPTETPLHEVQVQYGTNNRYQTQFDLSGPVKEGDPLYYRLTGLWRNADTEQPSVPDDRIYIAPAFTWKPDEDTRLTILSEFSRIKTGGTAAYYYDAVTGKVSDIFAGNTAFNDSVQTQGRVGYEFETRLNDTFVFRQNARLASTKIGADWAFAYQANEIDPLLLDSSAGTFEERLTSFTIDNQLEASFDTGNFEHTLLAGVDLTKLQWKGLNGYGYTPPLDTRHPSMGRPVAPIDFQTKDVQDQLMAGIYLQDQIRYDAWTITLGGRQDWVSTDTKNTDLATSTSSDFDQSDKAFTWRAGLTYETPWGITPYASYSTAFSPNAGVNRATGNPFEPTESEQQEVGIKYQLPNSNTLITAALFNINQDNGLYYEVVELDAGPANIQVQRGKLRSRGLELEASTSLDNGLSLIASYSYMQTSIKDGPDGTVGNEISSVPTHMASAWAHYKLPENSFLYGLGVGAGVRFVGSSYGNDENTMKNSSRAFVDAAIDFDFGAIKKDYEGVKLQVNATNLFDTSKPVCSAGFCYRDQGRTVVGSLKYSW

SEQ ID NO: 6914 - protein, 345 aa, Azorhizobium caulinodans
MQTRRFRGSVGKLAVVLGVCTCTGIAHAQSSVSLYGLADAFVGEVHPAGAAGNAWQVGSGGMTTSYWGMSGTEELGGGMKAVFTLESFYRINGGQVGSFPGQSFFGRNAFVGLSGHFGELTLGRNTAPLFVSTLLFNPFGNSFVFSPIVVHSFLGSAMGAASLQSDTAIDNSLLYQTPEVAGLSGSVLYSNAGVAGHAGQANYSANVLYFAGPFSATAAVQSLHTASLFLNGATVQTAWMAGGAYRLRGAKLFAQYERVDNNNHVTDDTVQLGASVRIGLGNVLMSWAGTRRRPSVGDHIRWSTVALGYDYPLSKRTDVYAAWRYDTITGVSTGNSVGAGMRVRF

SEQ ID NO: 6915 - protein, 280 aa, Azorhizobium caulinodans
MSNTYQKRKASKEYGLYNQCKKLNDDELFRLLDDHNSLKRISSARVLQLRGGQDAVRLAIEFCSDKNYIRRDIGAFILGQIKICKKCEDNVFNILNNMALNDKSACVRATAIESTAQRCKKNPIYSPKIVEQSQITAFDKSTNVRRATAFAISVINDKATIPLLINLLKDPNGDVRNWAAFAININKYDNSDIRDCFVEMLQDKNEEVRIEAIIGLSYRKDKRVLSVLCDELKKNTVYDDIIEAAGELGDKTLLPVLDTMLYKFDDNEIITSAIDKLKRS

SEQ ID NO: 6916 - protein, 252 aa, Azorhizobium caulinodans
MAAEPPVYPPPPPIFTWTGVYLGGQIGYAWSNGSNNFNGFDPFFNRGRGVFLDSSAGGTPNGVIGGAHVGYNYQIPSWNWFSSSGVVIGLEGTVDGTSLSNTAIAVFPDGSNVSASSTANIQGSIRGRIGIAWDRALIYGTGGVAFGGFETNVRFNGTDFATGAPFFASGSISSTRTGWTVGGGIDYAITNNWSIFGEYRYTNFGSIRENDFGQLPGGFTFEGSRRLQQNQVQVGFSYKFDIYTPPPIVAKY

SEQ ID NO: 6917 - protein, 913 aa, Azorhizobium caulinodans
MGAGSTLQTTTGTLANDDQIAVGAGGNLIAATTLTNESNGTITFANGGTLSAGGAGQGTITNEGQIVVNAGTVTATGNDNFVASGMGTGLQILGGHLDLGTGTVTDTGTGTLTAVTLTADASGGAMLTTGGVTFDEAEIELNANASGDATVTGPVTVGGTGFFDLNSAGGSTATITGDVIQQAGSTATSTLAGTLGGILDINGGTVTVDGTGGGGTSVVTGALTVDGGTLNVNANTDAAAGTTVGATGTVSNTATFATNVTNAGGFTNDGTVSGGVGNSGTLDNNGTVTGNVTNTGTLTDSGSIGGSLTQTAGSTTVDGNATVTGLFDMNGGTLAIDPGFTFAVGSADIEDAGGVTLGAGSTLQTTSGALDNDDQVAIGNGGTLLSFAALSNETNGVMDFLGATGALTAGAGSDITNTGRFNINSAVGQTVTLTTSGAGTFTNTGLIDMVDGETADRLVINGDAVLNGIIGMDVNVSGALVGTSPADTADQVNVTGTASGAPTLAFSNVNGVFSNVAVPIDLITAANTGGVSATQTGLPTNGAFIYNLQNTGTAVQLTATPNLAFGGVASGVAATQSLISTVVNRPSSALVTPLVAPGDDPCAIGSWSRITGGKASAGLSTSAASLPGSLSNQIDLRYRGIQVGLDRSCSGGYYNGWDLAYGAMLGTNGGDTSLPVNFGGTVTTLSTEFDQTFGGFYLSAAKGQWFGDLSIRADKTTYSIQESNSFANGGLGINTQDFDSRGKTVSGSLSYSHTLNEQLGLRLVPTAGFSFSHIESDSIAIENDPSTAADNATLQIGDIDQRIGYLGATLARTQVAESGTAATTYFVTGTYFNDFGDDLESTFTVDSNGSSQVLTSETLGGFGELSFGFNYTAILDAGSAVPARQVDASLRADTRFSDNLDSWGLTAQVRLQF

SEQ ID NO: 6918 - protein, 1022 aa, Azorhizobium caulinodans
MRCKSISEFIMCFMLSLFSLTAFAQIKITGTASDAETGEPLSFITIQVKGTTAGTTSDMDGNYSIEVPNRDAILVYSYIGYRSQEIKVGNQTHINVRLSEDVETLDEVVVVGYGVQNKRDVTGSIAKVGSEELMSVPTSSFDAALQGRAAGVQVTQTSGLAGSGAAIRVRGIASITAGGDPLIVVDGIPIMQNAGDRVGAAQDNPMSSINANDIESIDILKDASATAIYGSRGANGVVLITTKRGKSGKPQINFSSKVAFSTTNRKVDMLETKDYLDIYKEALENDYKFNPSGATDPSTVSSYPGGYSEEQALLNNTDWQDLITRTGISTYNDLSVSWGNKKIQTYLGVSNVEENSYLVNDHFGRTSVRLNIDYKPINILKIGGNFSFSHTDHRPTPSSWDGGWGRAISTALPYFPAYNSDGSYYVFPKSTNPVTEANEKRRRIFTQRTMASLYADLQIIKGLSLRLEGNIDYRDNESNYLRTKELSTKPNSNVTNRYETNWNAKALLNYSLSINEKHRFHFLLGTEALKSTRVSNYTNVVFEQGKEDWLFNNPAYDETNKTFTSYPNQDFSFISFFGRINYTFKDRYMFTGTFRRDGSSRFGENNKFGNFPAASIGWMITEEDFLKDNEVVSLLKLKTGFGITGNAEIPNYAQWGAVSVNTNQLYVGDNYWYINSLKNPDLKWETTSTFDVGLEYGFLKNRISGEIGFYNKNSKDLFLNVSVPASVGYTAFLANIGKVRNTGVEFNIKSVNITNRDFTWTTDFNISYNKNKVLDVGNAGPDALSGEGDTRVLVGQPIGVNYLVKVLRVDPQDGMPVYEMLDENKKPVGETKEYNADRDRQPVGHPYSDFVGGLNNTFTYKNWDFGFMFTFQIGGNIYDDGEKFQMNNVGTWNLKSNVLDRWQKPGDVTDVPRVSLGKSGIELARNTTEYLHDAGFLRLKNVNVGYTFKGIRIKKFNIRDIRLYAQATNLLTLFSEYYNKYSGEPEIMRDVDSAQKRNLSLNVTYLTPPQARTYTIGLSVNF

SEQ ID NO: 6919 - protein, 1270 aa, Azorhizobium caulinodans
MAMINLSKEATVGKALTPIAILMMLSFPVASQAAGLVIKNGTVYNANGVPVVDINKPNGSGLSHNIWDNLNVDKNGVVFNNSANESSTSLAGNIQGNSNLTSGSAKVILNEVTSKNPSTINGMMEVAGDKADLIIANPNGITVNGGGSINTGKLTLTTGTPDIQDDKLAGYSVNGGTITLGKLDNASPTEILSRNVVVNGKVSADELNVVAGNNYVNAAGQVTGSVSATGSRNGYSVDVAKLGGMYANKISLVSTEKGVGVRNLGVIAGGVNGVSIDSKGNLLNSNAQIQSASTINLTTNGTLDNTTGTVTSVGTISLNTNKNTIVNTRAGNISTMGDIYVNSGTIDNTNGKLAAAGMLAVDTNNATLINSGKGSSVGIEAGLVALKTGTLNNSNGQIRGGYVGLESAALNNNNGDIQTTGDIAIISNGNVDNNKGLIRSSTGHIVIGAAGSVNNGSTKTADTGSSDSLGIIADTGVEIGANNINNNGGQIASNGNVSLSSYSTIDDYAGKILSNSKVIIKGSSLRNDTGGISGKQGIEVAVGGSLTNNIGVISSEEGDISLLANSVDNHGGFMMGQNITMESMSGVNNNTALIVASKKLKINARGSIENRDGNNFGNAYGLYFGMPQQTGGMVGKEGIELSGQNIYNNNSRLIAEDGPLTLQAQNTFDNTRALVTSGADASIQVGGTYYNNYATTWSAGNLDIDATTLQNSSSGTMIDNNATGFIASDKNLSLEVVNSLTNYGWISGKGDVDVTVNNGNLYNRNTIAAEKGLDIAALNGIENWKDISAGGDLTMNTNRHVTNNSNSNMVGQNIVINAVNDINNRGNIVSDADLNVTTKGNLYNYLYMVGYGDIALSANSVANNNATIEATGDLIIDSKGNVGNNRGNLHALNGVLSVKGNNLNNDNGEIRGYGDVTLALTGNYDSYKGSLTSETGDVTLTANIVDNAYGLIAGENVSVDAKSTIYNNTALIAANKKLVINAGGNLENRDGNNFLRNNGALFGITDNVGGIVGKEGVTLSAQNVYNNNSSIIAENGPLNLLSRGTLDNTRALLSSGADAIIRAAGTFYNNYATTYSAGNLDVYAASLNNASDGRLEDNTATGVIASDKNLDLSVDNSVTNYGWISGKGDVHFNVLKGTLYNRNAIAADNALTINALNGVENFKDIVAGTALTIDTQKYVTNNSNSNMLGQTIAINAVNDINNRGNIVGDYSLGVKTTGNIYNYLNMLSYGVAGVSANKVTNSGKDAVLGGFYGLALEANETDNTGTIVGM

SEQ ID NO: 6920 - protein, 736 aa, Azorhizobium caulinodans
MMKSSAKNNYSLQKSLLAFAIGAAAHGVYAAEDTTGKEDTMVVEAKSANSGFKAGGDAQVPAFLEGQVAHGGRLGVLGEQKAMDVPFNVIGYTSKLVEDQQAKTIGEVLKNDAAVQPVQGYGNFSENYRIRGFELAGDDVTWGGLAGVLPRQVVDASLFERVEVFKGASSFVNGAASSGVGGMVNMEPKHADDLPLTRLGVDYTSSTQVGTTLDAGRRFGDNNQFGARVNILHREGETAVDNEKKRTTLAALGLDYRGDKLRSSLDVAAQKKTFHGGTMGINLSGVDFVPDVPNNTDNYSQKWGYSDITNQFGMARAEYDILNNWTVYGGAGAQHAHETGIYTAPKLLNRSGDAVVNVLYTNRIIDAFSSMAGIRGEFDTWSVSHKVNLGYSAVIKRDKTAWRMNWANPGSMTNIYDNHDVPMPQWDLAGGNYHDPLTTSRNRTQGYLLSDTLGFFDDQVLLTVAARNQKVVVRNYSNATGEEDTASRYTESRWMPTYGIVYKPWDTVSLYANHTEALQPGENITDQESPDYGKSIGILHSKQNEVGVKIDFGTVGGSLALFEIKKPSVIKNETTQEYSTDGEQRNRGVEVNLFGEPVYGLRLNSSATWLQPKLTKTQDGVNQGNDASGTPRFTAVLGAEYDIRQVDGLTATARLNHTGSQYDGAANEKKLDSYTTLNLGVRYRMRVNQEQNEMVWRLGVDNVTNEQYWSGVSDYDGVYVFRGEPRTLKLSVNYDF

SEQ ID NO: 6921 - protein, 207 aa, Azorhizobium caulinodans
MLKQTLLSLALMGTCTVAMAADYTYVAGGLQYGSISNNERFDKEFNQSQSSHIGNRDMDGIYFNGGYGFDNDLLIDGRISSIANNDRGLAEAVLGLGYHFAFSPNIDFYTLVGGSRHAMVFDASKDGKKTNTYNSATGEIGIKSKLSQDIGLDVAYRLANYDSRAYHEARITTDYALTQSLSAEVGYTYHNWKVSDQAMQAGLRYTF

SEQ ID NO: 6922 - protein, 229 aa, Azorhizobium caulinodans
MKTRHLMLASLVAAFAAAPAMAQQNTIKLGVANVQPHSSASDFSGPFTPGGISVEVRNKTTSFFSYTREINDQWDVELALGDSPTHDIALKINNPGLPASVQSMSGQVAATVRQVAPVLFVNYKFLEKTSPWRPFVGVGINYTNFDKTHSTAAGDTLNGGPTSVSLEDSVGLALQGGVTYRINNQWSLSAALITAQVKSKITTNTLGIERSADIKFRPRVFTLAMGYSF

SEQ ID NO: 6923 - protein, 477 aa, Azorhizobium caulinodans
MSFAQEMTTSDALRYAIENINGTARFRSMGGAFGAVGGDLSSININPAGSLFFNNNFASASITSFNNNNNSNYFGTRNKESYSTLDLNQIGAVLVFNDKSGSSDWNKISVALNYENTNNFDNRLFTSGVNPYNSISQYFVNQANFVANTEFNDYQYDMAFDTYIIDPHPSVPNQYISNVSPGGNYYQDYFATANGYNGKLTANVATSYKDKLFLGINLNAHFTDYVLTTSLYENNDNPDNPNTQPTVRNIVFDNQLSTYGSGFSFNLGAIYKATESLRLGASYESPTWYNLNDELVQDLYTYDNVNVALGDENRYYGSPIFIFPTYRLRTPSKITGSATYIFNKIGLISIDVAQKDYSNTEFKNTNQNNFRDLNSQMNTELKNAYEIRIGGEYKIKQFSIRGGYRFEESPYKVDYAMGDLTAYSAGLGYNFGENRIDLSYSNSHRNYNQSLISSGITDTSRTRIIQNNVTVTYSINF

SEQ ID NO: 6924 - protein, 792 aa, Azorhizobium caulinodans
MKRLLLLTNLLLINFAFSQDYASIQGKIVGANNQPIPFANVYIKALKQGTMANENGLFQLNTIKTGDLELQSSAVGFKTQITPIVLSTSGLKNIIITLQPDASLNQVEVFGRRSSHPDKIEALTRLPLEPYEQIQSISVISEKLIENQGALTISEATKNVPGVYTFATYGNKRESMSSRGFRGIPILKNGVRVHSDFRGVGVLTDMQGVDNIQVLKGASSITQGVATDLGSPGGVINIVTKTPKYRFGGQVAQRIGSYGQARTTVDVFGPFNEKETVAYRINGAVERADSFRDGVSSQRFYVNPSFQWKVDEKTKVTVELDHFYDSRTPDVGTVNLAENDTNAIYDLPYDQFLGFENDRSVTKNTTYAVRFDRELTDKLTLKTAFYKSELELEDKGASLGSAVTVNEEVQYNLRTRGYSNAYREDDNSVFQIDVIGDNVYTGKLKHVFQVGVDYRTNKTSLGNFTVSAVDTINVFQNNTNTLPNINFEDSNASTSQATSLGFVAQDVVSWTPWLDTFLGIRYSTTETISGDETINSNAFTPLGGVVISPVKNINVFASYTNSAYPRTGTRVDANGNALGNERFDQFEAGIKTSWYDDRLRFNATYFKINNKNINLPVYDENFVATGFFEKGGNDQRQGIEVELTGRILENLTAVAGYSYIDAQYKEHTSFVYGSSPLNTPKHTANVYLDYKFVNALKGLSIGGGAYYTGERPINDWSTGAVSHEGIVPNQKPFEVEAYTLVNLQAAYKFKKHWNARLLLNNVFNEIGYNAYRTRFINQTDPRTVAGVLSYSF

SEQ ID NO: 6925 - protein, 233 aa, Azorhizobium caulinodans
MKRLLLSSAIAAAIIAPASAADLSTRYPVKAPVVAVVPVFSWTGFYIGANAGFGGDKYNYDFGAPGFGSATANSSGFFAGGQLGYNYQFANNVVLGLETDIQWSGIEGDTTLASGGSVANLNSSLDYFGTVRARVGYAFDRFLPYITGGFAYGESKTSITTITPTTLTFGEGSGTKTGWTLGGGVEYAFTNNWTFKTEYLYVDLDDSNYGVGAGAVNVDNKFHTVKAGINYKF

SEQ ID NO: 6926 - protein, 352 aa, Azorhizobium caulinodans
MLELNFSQTLGNHCLTINETLPANGITAIFGVSGAGKTSLINAISGLTRPQKGRIVLNGRVLNDAEKGICLTPEKRRVGYVFQDARLFPHYKVRGNLRYGMSKSMVDQFDKLVALLGIEPLLDRLPGSLSGGEKQRVAIGRALLTAPELLLLDEPLASLDIPRKRELLPYLQRLTREINIPMLYVSHSLDEILHLADRVMVLENGQVKAFGALEEVWGSSVMNPWLPKEQQSSILKVTVLEHHPHYAMTALALGDQHLWVNKLDEPLQAALRIRIQASDVSLVLQPPQQTSIRNVLRAKVVNSYDDNGQVEVELEVGGKTLWARISPWARDELAIKPGLWLYAQIKSVSITA

SEQ ID NO: 6927 - protein, 987 aa, Azorhizobium caulinodans
MSQMMMNNRSLPLSPDEIDPSRDRHRSGPRTPAPSRCAGLGWLLRRALLASVGVLVGLAAQMMPAHAQLVGGNGGTGSAYSDSVPGAGGAGGLAGDGNAAGNGASGGGPDTAGSGPYGGAAGNNVAPGGGTGGAGYSGGGGGGSGSGGGGGFQGGINAGGGGGGGGRAATVSGNYAAVVNLTGGNGGAGGLGPYNGSAGGGGGGGDGLYLSGGDLQVNAGVFIRGGSGGDAGTTSADGNGGAGGGGKGVVVGTTATVTNAGSITGGSGGSGGGSAIGSGSGGGGGDGLVLAAGGIVINTGMISGGTGGPQGDPRYPTFFPPVAGGAGISGAGLVVQNAGIISGGLGNAGTGARANAITFTGGVNSLELQAGSTVTGNVMAFSYADTLRLGGAANSSFDLSTLGDSAQYRGFGSFVKAGSSNWTLTGSSSFTGAVSVDAGILSVNGSLASASLTTVNSGGTLGGNGTVGNTTINGGVLAPGNSIGLLTVNGNLVFTAPSTYVVEVSPANADRVNVTGTATLGGATVSAVFAAGSYVAKQYTIVNAGGGLTGTFGALVDTNLPATFHTSLSYDANNAYLDLALNFSIPGGLNVNQQNVGNALSTFFNLTGGIPAVYGTLSQAGLTQASGETATGSQQTTFDAMTQFIGVLTDPFLAGRGDGGSSPAGASQFADEDGFRAYASTGRGRSAAERDAYAALSRKAPAASDIVMQRWGVWAAGYGGSQTTDGNATMGSNTATSRIAGTAVGADYRFSPDTVAGFALAGGGTSFGVANGGSGRSDLFQAGAFLRHGVGAAYVSAALAYGWQDITTTRTVTIAGSDQLRARFNANAYSGRVEAGYRFVTPWMGLTPYAAGQSTIFDLPAYAEQVLAGSNAFALSYGSRSVTDTRSELGLRADRSFALSDAVLVLRGRAAWAHDFDPDRAIAATFQALPGASFVVNGAAQARDSALVTASAEVKWRGGVSFGATFEGEFSNVTSSYAGKGIIRYAW

SEQ ID NO: 6928 - protein, 177 aa, Burkholderia pseudomallei
METSLRYGGDSKALKIHAKEKLRIDTNTFFQVRGGLDTKTGQPSSGSALIRHFYPNFSATLGVGVRYDKQDSVGVRYAKNDKLRYTVLAKKTFPVTNDGLVNFKIKGGCDVDQDFKEWKSRGGAEFSWNVFNFQKDQDVRLRIGYEAFEQVPYLQIRENNWTFNADYKGRWNVRYDL

SEQ ID NO: 6929 - protein, 749 aa, Burkholderia pseudomallei
MTSTFLRHAPTARGDHARRRRRAITLTVPALAAGAFHLAPAVAQTSEAVHGHGTLGASGVASRADTDAASAKSDGAVREAASAAASRTTTGAAPDATTLPTIEIVAAPESTPLVVVTDPKTPRQPLPASDGADYLKTIPGFASIRSGGTNGDPVLRGMFGSRLNILANGMPTLGACPGRMDAPTSYIAPESYDKVTLVKGPQTVLYGPGASAGTVLFERVTPRFKTPGMRFDGSVVGGSFGRNDQNVDVTAGTPDFYGRVSANHAHSQDYEDGNGRTVPSQWDKWNADAALGWTPDDNTRLELTAGTGDGYARYAGRGMDGAHFRRETFGLKFDKKHIGDVLDRIEAQVFYNEADHVMDNYTLRMPDPTSSMPMRMASEVRRRTLGARVAATLRLTDAFKLVTGVDAQSNRLDSRSAMGMQNYGDKPWNPQANMWNAGAFGELTWYASDASRVIGGARIDYAAARDKRATTGGMKMSMRNPTFDDLRSRVLPSGFVRYERDLASLPVTWYAGIGHAQRFPDYWELFSAKRGPNGSINAFSAIKPEKTTQLDIGAQYKSDKLDAWVSAYAGYVQDFILFDYATGPMGQITQATNVNAQIMGGEVGASWRPLAPWRFEGSLAYAWGRNVQSGAPLPQMPPLEARFGVEYTRGPWSAGGLWRVVAPQHRYALNEGNVVGKDFGPSAGFGVLSLHAQYNVSKTVQISVGVDNVLDKAYAEHLNLAGNAGFGYPANLPVTEPGRTAWVRLSTKL

SEQ ID NO: 6930 - protein, 390 aa, Burkholderia pseudomallei
MKQTKHLAALAVPAGFLLSAGAHAQSSVTLYGIVDAGIAYVHNVQGADGRNEASLFKFSSGNLSGSRWGLRGTEDLGGGLAALFQLENGFNLGTGQQNGNREFGRKAIVGLASNTWGSVTLGRQYDPVVDLVQGLTEDNYFGGVFATPGDLDNYDNSLRVSNSVKYTSPVLSGFQFEALYGFGGVAGATGSGRTYSFAASYANGPLSLGAGYLYADGGANATNGVRTWTGSSDTLFNTVINQGFASAKSIQIVRAGGQYVLGSATFGLAYSNTQYRRDSLSAFSDTAKFNSGSAFFNYQFSPALRAGMGYNYTSLTGPASAHYHQVNLGAGYALSKRTDLYALFGYQKASGHTLGANGAVIDAQASVGSYGANSGTDSQELAIVGIRHKF

SEQ ID NO: 6931 - protein, 719 aa, Burkholderia pseudomallei
MLIAAHPGAAALAGTAAKSGAQKNDMQRNENVREDTRRLAAGAPPAGGELKAISVSAPKDAADDPSVATVGKMPLALREIAQSVSVTTRERIEQQNLFSLDDVMQQSAGVTVQPYVLLTTAYFVRGFKVDSFEFDGVPVVLGDMASAPQDMSAYERAEILRGANGLLHGSGNPAATVNLVRKRPQHRFAASASASVGSWGRYRAQADIGGPLNPAGTVRGRLVAAYEDRGFFYDRAKQDTRSIYGIAEIDVARDTLVTVGAQYQSVASVPDMSGVPMARDGTSLGLPRSTFLDVGWGHFDWDTTRVFGSVERELGGGWKAKVSGEYQAVRSDLKYAGAYGAIDRATGAGGTLMGSAYQFSSYSRSVDANVQGPVRAFGLTHELLFGATYASSSSGQLTAPLLAGAGTPVNVYRWNPDGVPEPGVGPYRQDMQNDISQKGVYGLGRIKLAQPVTLVLGGRLSWWNQDSLGAHYNAGRQFTPYGGLIWDVARDWSWYASYAEVFQPQTKPTWDGGILTPVKGRTYETGIKGELAGGKLNVSLAAFRIDLDNNPRIDATRPCAGRSCYYVNGGSVRSQGFEFEANGRITPWWSVWASYTFDTIRYAKDVANGGAFAAELTPRHLLRVWTNYDLPWQERRWSVGGGVQVQSDFSAASSGVTMRQGGYALASVRLGYRYDRHWRAALNINNLFDRTYYQSLSQPGWNNRYGEPRNVMLTVRGQF

SEQ ID NO: 6932 - protein, 358 aa, Burkholderia pseudomallei
MKSSFSRALQTTFACAAVAALAAGASGARAQSSVQLYGQVDEWIGAQKFPGGQRAWGVQGGGMSTSYWGLRGTEDLGGGYQAIFTLEDFFRAQNGHYGRFDGDTFFGRNAYVGLATPYGTVRAGRLTTQLFISTILFNPFIDSYVFSPMVYHVFLGLGTFPTYTTDQGVVGDSGWNNAIDYTSPSFGGLNAAAMYALGNTAGDNRSKKWSGQLNYSSGPFAATAVYQYVNFNGGPGDLGALVSGMKSQGVAQLGLSYDFKLAKIYAQYMYTKNELNTGSWHVNTAQGGVSVPLGPGSALASYAYSRDSGGHDQTRRTWALGYDYPLSKRTDVYAAYMNDRYSGMSGGDTFGAGIRAKF

SEQ ID NO: 6933 - protein, 736 aa, Burkholderia pseudomallei
MEWATSTRVRAIAAGVAFYAAAAGHAQAQAAQPGADARQPGGEAKADTAAGGTLPAISVSGAAERDASVGLVARRSMTGTKTDTPIIEIPQTINVVTAQQIEATGATDINQAFRYIPGFSSYGSDNRSDWYAALRGFTPTVFVDGLQVPNTINLSSWRVDPYMIDSIAVLRGPTSVLYGQGDPGAIVDVQSKLANGERIRELGVQVGNYARKQLMFDIGDTIGKDGTLSYRIVGVGRDGNAQTGPLADQRVSFAPSLKWQPNADTSLTLAATYLQDWGDTSSNFLPSRGTVLPNPNGTISDDLYTADANFDHYRKKQWSLGYQFEHKLNPVWTLRQNVRWMHLSLDDASVYGGGLDDADPTMATMTRYAGLFQFNYSRFDVDNQAQAKFTTGPLSHTLLFGFDYNRQTTTDSEWLAKGPSLNLYRPVYTPIPSDIFSGPNASRTDTKTTLNAFGLYVQDQIKWRRWVLTLGGRQDWTRTSQDDIANAASFRQNDHAFSGRVGLTYLGDYGLAPYLSYSTSFNPQIGLKLAGGGLATPTKGRQIEAGLRWQPPGKNLMLNAAVYQINQTNVAMSNPNDPTSSTFVQVGEVRSRGVELSAVGNLSRELSVIAAYVYQDVKNVRANDNTLNKWPVDVPRPRQIASLWADWTWRTGPLTGFGVGAGVRYMSAAAGAVDNSLTVPSYTLFDAALHYELRNWRFALNATNLFNRRYVAGCQSDAVCMYGNQRTVIATAKYNW

SEQ ID NO: 6934 - protein, 407 aa, Burkholderia pseudomallei
MSARAARQLPGNRRLARLAGAAAAACAAGFGASTAHAQSSVVLYGLIDTSITYANNQRTHGAGSPGSPGWAVTSGALNASRWGLRGREDLGDGVSAIFALENGFSGASGALSQKGVDMFGRQAWIGLKSKEGGALTLGRQYDLILDFVTPLGASGPGWGGNLAVHPYDNDDSNRNIRINNAVKYTSPTYRGWTLGAMYGFSNTAGPFGNNAAWSAGLSYANGPLKLGAGYLRINRNPNAANANGALSTTDGSATITGGSQQIWAVAGRYAFGPHSIGAAWSHSATDRVSGVLQGGSIAKLDGNSLVFDNFTLDGRYVVTPRLSLAAAYTYTMGRFDARSGETRPKWNHMVAQADYAFSIRTDAYLEAVYQRVSGGNGIPAFNATIWTLTPSANGNQVVVALGLRHRF

SEQ ID NO: 6935 - protein, 366 aa, Burkholderia pseudomallei
MKKLLIALPLAAAATTHAQSSVTLYGVLEDGVDYVSNVQGKHLVQLASGVTAGSRWGVRGTEDLGGGLSAIFRLESGFDINSGRLGSGLAFSRNAYVGVGDAKLGTLTLGRQWDSIVDYVEPFTLNGNIGGYYFAHPNDMDNTDNGFPISNAVKYRSPTIAGFTFGGLYAFGGQPGRFSDNATFSVGANYAAGPVGFGIGYLRINNPGVSTQGYQNYPGFTNAVYGNYLDAARAQKVFGVGASYQVVQWLKLLADFTNTNFQQGSAGHDATFQNYELSALVKPTPAVTIGAGYTYTTGRDHATNAEPKYHQFNLSVEYALSKRTSVYAMGAFQKAAGDAPVAQIAGFNPSGNQKQAVGRAGIRHVF

SEQ ID NO: 6936 - protein, 368 aa, Burkholderia pseudomallei
MLPGIATAQSSVTLYGVIDEGIDYVNNSGGQHLWRMRDGTYDGMYGSRWGLKGSEDLGGGLSALFKLEAGFSLENGQMRQGGREFGRQAYVGLSKTDLGTVTFGRQYDSVVDFVQPVTAVGQFGGPFVRGGDIDNTDNSFRVDNSIKYASPSFGGFTFGGMYSFTNSNAPGLGTTGMWSLGAAYSHGGFNAGAAYFYAKNPAARFTDGNFIGNTTGAAIGASGPFSYVGAPRNERIMGIGADYAFGSATAGIDYTNTKFDDANGTTSSVTFSNYEVWGQYKVTPAATLGAAYVYTDGKVNYNGARPKYHQVSLMGSYSVSKRTSFYAMAGFQQAAGDAKQADIFDFSIADASTTNRQLMFRLGMLHQF

SEQ ID NO: 6937 - protein, 405 aa, Burkholderia pseudomallei
MTGILFMKKAAAAWLVAGSMCAGAHAQGTVTLYGIVDAGLGYTSDQRVAQTKGALGSPVGYRNESSYGFASGTWSGSRWGLKGKEELGGGLAAVFQLENGFNIGTGQAGQGGRMFGRQAWMGLSSERYGTLTMGRQYDPIVDFVGTIGAGAFLTGMGAHPGDLDNIDNQARENNSIKYVSPKFGGLALGALYGFGNQAGSVKNQNTWSVGGQYVNGPFSLGAAYLYATNAYGANGGAWTGSYDGTFASSINEGFASAKSMQIVAAASTYQIGAVTLGLSYSNTRYKSGAFSTFNGTATYNSIGGTVSWQATPELRVAAGYDFTRGSSIDGQSAPKYHQVNFASYYYLSKRTALYGLVGYQKASGKTLDAYGNVVAATASVGDVGNGISSAGDTQTLVRIGVRHTF

SEQ ID NO: 6938 - protein, 767 aa, Burkholderia pseudomallei
MARRPLRAALFGAFGLYAAAARAAGPASEPAAAAPPAAASAASAASTSQVRHAAIAAARKDAPALDPITVTATRTASAASRTAASVSVITDSDLEEQQADNIKDALRYEPGVTVRRTAYRPANAALGGGRDGDSSINIRGLEGNRVLLMEDGIRLPSAFSFGPLEAGRGDYADLDTLARIEILRGPASALYGSDGLTGAVNFITKDPSDLLSIHRKKTYFSFRPSYDSVDRSIGATVTAAGGNDRVQAMLIASGRRGHELDTHGDDNSASTRRTRANPQDVYTESLLGKLTITPTARDTIKLAAETVRRRIDTNVLSAINPPTTLGLTANDRLERNRFSIDYDLRDAAARGFQTAHVQFYYQESTQDQDAFETRGGRLQSRSRSNHYSERALGGSAFAESGFATGPLAHKLLYGVDGSIDRIKSLREGTVASPGESFPNKAFPDTDYSLFGAFVQDQIGFGKLLVTPGLRFDAYRLSPSSGDPLFTGKTVSSSDHELSPRVAMLYEASPALIPYAQYAHGFRTPTPDQVNNSFSNPIYGYTSIGNPNLKPETSDTLEAGLRGTLGTGYGPLRYSVAAFAGRYRNFISQRTVGGSGRPNDPLVFQYVNFANARIHGFEGRAEWVMPNGFTLKTAMAFTKGTTQDNGAASEPLDTVNPFSAVFGVRYEPSERWFAQADLLWQAGKRGRDVSSAACQKKTCFTPPSSFVVDLRGGYRFNKHVSAYLGIHNLFDRKYWNWSDVRGIAADSNVLDAYTAPGRSVAVSMKVDF

SEQ ID NO: 6939 - protein, 609 aa, Burkholderia pseudomallei
MAGGFAALALGGASYAKPGDGNWYFFGDSSTGQGNHAALLEQRGETQFPYSSNNGFRRLSNGLVWSEMMGRDVDIVLDPDRDSNNVNFAFSGAHITASGDLAEFGLYTGVQIQTAIFAEMVEAGEASVGADDVAFIMAGANDLMDRAAAGEDFDAIIADIAEAGADNITTLGALGVKTVLMAEVRPIKFAPLVRDDAEAQAAFAEAVDAANIALFDAAVAAADAAGVNLVTVRDEAFLTYIRDNAAALGFDEVDRECYLEDADTVCAPDMAGQNRYLFLDDLHFTEAGQLLTAQWWQATLAGANGEAARPALMLPSLVAAGLEMSEQSVWAGARQGPGVFGDLAYQDVKFDFDGLTADVRLKAASFGGAYRLTDVFSAGAALRHDDAEIRFGNGDRQDYAATTLTGFLRYAEDGYGLTAAVSHSWLDFEDGVRQTGVRGLSARTSFDGEAWQASLLSDAAYEWGVFDLQVSNSLQYDAIRIDGATETGATGLALRYGAQSLNTWRFDTHLDARMDGWRVAENVTLAPVGAVGWTWRSNADHSLVSQLIDNTADPVTLFGEGLAENSFETRLGLEAQIAERFTAGLSYGRGWGDDRHSDDRIALTVRARF

SEQ ID NO: 6940 - protein, 363 aa, Burkholderia pseudomallei
MKKHRRLAGTTAISASLAACAGLASGHALAQSSVTLYGIMDAGIEYVNHAAPDGGGAFRMKSGNKNTSRWGLRGVEDLGGGLKAVFRLESGIDLANGAFDDGPDSIFARRATVGLKGQWGELTLGRNFTPTYDYMLPFDPMGYAQNYSWATSSTATGGRKDGLFTRSSNAVRYDGAYGGLRFGAMYGFGNVPGSMKTSSKYDFALGYESGPFAAVVTFDRQNGAADSVTPADPVNYVQGIHAGVSYDFGRLKTMAGYRNYRRTYHTAAATQLSDMYWLGGSYDFTPAFSLTGALYHQNIKGGTDADPTLVSLRAQYALSKRTVLYAAGGFAIAKHRQNVSVSRDSVGYADTQLGVTVGMQQRF

SEQ ID NO: 6941 - protein, 781 aa, Burkholderia pseudomallei
MTHHPRKPGLRSRLLAMSCLAGVVCSVALSGAETRAATTTTTPPKRHATSSTAATSAAHAPAAPAAHAATAAHPVTPRAAAPRTTVARAASPEDISVVSSRQALNGGGGMMRLETAPHTVQTVAKEYIDMRAPTSTALDLIKNLPSLSVSTPDTGGMQGGMIEVRGLTDLDMGLMVDGAPAAAAKYMAEDIDSENLEEVNVTPGSSGIDLPVMSAAGGVMNEQSHIASHKAGGLMDFSYGTNNLSREFLRLESGDIGNSGVRAYVSFSNTHDRAWMGAGINERRHLDFGVQKDWENGSTAKVFVSWNNENFTIDNYPTAQEFYTFKHTGQGWGRSANPSDDNYWKNNKDHWNQVFLTAPLHIVLPARFSFDLQPYFSFGQGWDASPGGVVDGVNQTSFFLQNATRQVGAVTKLGYQIDPHNAFSLGYWYENNYTDQSYPSGATNADGTPPSPWYLYKTTSPYGQNAGYELHSLFLQDTAKYLHDKLVIHAGFKFVMANTWTADPYNRYSTNTTEPLPQLSIGYTFNEHHQIYVNAEGDYRQPSAVDMGWLPTAPNAFPKNQYSIKEELGYRYHDKYVIVDLALFNYNVTNRIVNQYIGYNSFKPISIGNQTMRGFDLMVSGRSIHGFSPYASIEYLNARQDSNVMDLNEAVPTLIHSKGTQAVMAPHVMANFGLTYTYKGFFANGSVHYTGAQSVSVAGDQRMPGYVTNTLSLGYHFKPFMFAKSPTFRLNFTNLTGSIVRTGPMGVVYRATDQNANTTGTGNSFMVEPRFTMTGTVSTAF

SEQ ID NO: 6942 - protein, 98 aa, Burkholderia pseudomallei
MKRKSLAMAVAGIGIGAAVPPALAQSSVALYGIVDSGIMCSRNQKGRSAWPATSGNERARVWGRVGREDLGGGTSALFSLRTGGAGRFNHFEGSVRTA

SEQ ID NO: 6943 - protein, 400 aa, Burkholderia pseudomallei
MHIRTWIAAGVAGAAVAPACAQSGVTLYGTVDTGVIYSTNQQVTHADGSTSGDHAWQMGGGNLVPSRWGLQGTEALGGGLKAVFALEQQFLSASGQALQGGAAFSRQAWVGLRHDRYGTLGVGRQYDSYTDTLGAYVSSNSWATPYGSHLGDVDNLNAAFNFNNAIRFTSADFHGLTFGGTFGFGGQAGDFSARRGYALAVAYNRAPVSFGIGYLNLRQPLDAALGGANGYIGDFACGNAGAMYCLLQDAVSMKAFGVGGSIAFGEATVALTYTHTRLGDSAYFAAAARAQRASIAFDIAELNATYAFTPMLRGGIAYVFNRAKADSRGVTRFHQLNVGVNYSLSKRTALYAVAIGQIASGRGLGSDANGDPVNYAQIPILANSNSNRQLAMMAGVKVDF

SEQ ID NO: 6944 - protein, 374 aa, Burkholderia pseudomallei
MNKTLIVAAVAASFATVAHAQSSVTLYGVLDAGITYQSNVATPSGSGKSLWSVGAGVDQSRFGLRGSEDLGGGLKAIFTLESGFNIGNGRFNNGGGMFNRQAFVGLSSNYGTVTLGRQYDATQDYLSPLSATGTWGGTYFAHPLNNDRLNTNGDVAVNNTVKFTSANYAGLQFGGTYSFSNNSQFANNRAYSAGASYQFQGLKVGAAYSQANNAGANTTGATDPLTGFNIGGTNAASIQGRSRVYGAGASYAYGPLQGGLLWTQSRLDNLANGAPTTRADNYEANVKYNLTPALGLGVAYTYTNAKANGESTHWNQVGVQADYALSKRTDVYAQAVYQRSSKNANASIYNGDLSTPFSTSINQTAATVGLRHRF

SEQ ID NO: 6945 - protein, 617 aa, Burkholderia pseudomallei
MGTQPSKIALLVSSLISLSALSAQAADVDVNSTAIDEAITVTGSRFDTTADQQLTVINTIEREEIVRLNPKSVADVLETLPGVSVSRNGGAGQATSISVRGSNSNHVLVLVDGVKVGSATLGTVSFNTLSPENIERIEVLKGPRASVWGSDAIGGVIQIFTRQLEGGEWFAGAEYGSNDYIRGSFGAGVNHGNGSTTIAVNHEQSEGYDVYNGAEVENDDDGYKRNALSLKGSQQINSNWQAIWNGQYDKGNTQYDDIYASGSADESDYENYLWNLAGQYHNDKFTSKLALSQSRDYNENFRGDDASVATAEFETKRDQVNWSNQYLAADDLTLTGGIDWSNESVRGDYAQDQRDIFGVYALVQKQWSKLLAEVAVRYDDVENIDSEVSYNASLAYEFNEHWRLAAATGTAFKAPTFNDLYWPDSGNPDLISETAESYELTLHFNSQDLRAYISVFQNSIDNLIAWAPTGEKDDYGWDIWKPANINKAEINGVELSANYQLLGLEHQLSYTYLDAENKHTSEQLVGRSENEFNYLLSYTWQQFDLLANYHYQGKRYAGDEQFLDAYHKLDLSIGYQLDDAWSLRLKANNLFDEEIISDQNYFSPGRELFFSVSYQAF

SEQ ID NO: 6946 - protein, 1131 aa, Burkholderia pseudomallei
MLMTRHKKRKTMKRSGAKLLAPVVVAAAAAVAARPGWAQAAPYPDPGRRGDPASWRTPEFTNAWGLGAMHAEYAYAAGYTGANVAIGVLDSGYYAQHPELPDSRFVPVTAAGVSGVLNPNNNNHGTLVSGVVGGARDGVGMHGVAPDATVYEGNTNATDGFRFGVSDPKFPASDAKYFAEAYDALAAKGVRIISNSWGSQPANENYSTLNKLTDAYKLHEAVRTATGRGTWLDAAAKVSRDGVINNFSSGNTGYDNASLRGAYAYFHPELEGHWMTTTGYDQLSGQVYNQCGIAKWWCVMAPTGVPSTSYSGGAAAPTGATYANFNGTSAAAPHASAALALIMERFPYMTSEQALSVLFTTAQNMEPDPSRPDYTNNGLFSTVHPAKPGASGVPNAFGGWGLVDLRRAMNGPGQLLGTFDAALPAGTADVWSNDISDVALAARKREDDAEHRAWLDTLRTKGWEHGLPAGASNGDRIDYALGVARETAYQAREYQGSLVKSGGGTLTLAGANTYRGPTTVDGGELRIDGSIAARAVVNPAGRLTVNGRAADIAVNGGVATIAGTSANLSIDRQGRAAVTGTTADVRVASGFASLGGTSGNVAVGALGVAAITGRTADVAVDGGRASLDGASGNVAVGNGGVVSGSGTVRTLTAAANGTVAPGHSVGTLTVSGDVRFAPGSIYAVEVSPGGAGDRIVAGGRAQIDGGALALALENTPPPLTPEQSRSVLGRRFEILNAAGGVAGRFDAPSGYLFVNPVLAYGPTTVSLTIDRNATPFASVARTANERGVADALETADPGSAVYNSVLFAASAQAPQATLAQLTGEIYPAAYAALVNESRQVRETALERLWTARGAPGRAGAWARLLGAWGSARGGDVNGYTSSTGGFLAGADAALLDSVRAGGFAGYSHTGVNLRNQPSSASFDSFHLGAYAGWQPGALGVRIGAAHAWHRGGVDRAVQYGAVAENETTALHAETTQVFGEAGYRFALDGAATLEPFFGVAYVHLKNQGTTETGGAAALRVRQGNHDVTFSTLGVRGETRLGLTSRLQLTLQGSAGWQHALTDGQPSGTLAFATGSDTFTVSSVPVAKDAAVLNVGAGLELGKNGWLRVGYSGSLASRQSEHAVQGSLHWKF

SEQ ID NO: 6947 - protein, 815 aa, Burkholderia pseudomallei
MGNDEGDMTQTKTPHSLRGHTASRSIGMMTAAAIGATSPAALYAQSSDEPLLLPGIEVETSEPQAAKPKPQPAKKRAAAAPAPRATPAPAPAPVVAEAPVAAAPAAPVAGENGLSPYANPEAGYQAVQSGNSLLTQPLVDTPRTVTAVTQEVLRDKNATSVRELARTTPGITLGTGEGGNAFGDVLFIRGFRSSNDVFIDGVRDSGVAVRETFMAEQVEITKGPSGSIGGRSTTGGAVNLVTKKAQDTDFVKTTTTFGTADLARQEVDWNKVWNDRFKTRIGAVAQVSDVAGRDGSKDDRLGLSIAAEYEATDRLTLDFEAYQLQMKQMPDWGVPWDGTNGVPFTESAAGRPTLDRDTFYGNPDRDFHDATQSVATFGATFEITPGMTFTNRSRLSRTENDYIVSAPERPDTSDADPQNWTLTASPKSRYQVNEVASNTSELSFGFNTGSARHDMIAGFALSREEISQRGYVGLSSEVGGGTAEDRLEGCSVAIYNPDVSGCSTATPVRSADATLTDVTTRSLYLNDTITFNPQWQLNLGARLDDYSVSRTTTEAGADTLSRDDTMFNWNAGVVWKPRDNGSIYLSYATSTNPVGDELDAGGGSYNGIDSSNLLLEPEENTAIELGTKWQFGNLTATAALFQTTKDNARESTGGRGAPVVTTATGEYRVRGIELGFGGNITEKLSLFGGATLMDSEVLKSSNPDNVGEEFANIAHEQFNVLARYDYNDQWSFGGQATWRGSVQGGTFAATNGNELPSYWRFDLMADYHITDDASVNFRIDNVLDETYYDALYRSGTPFVYVAPGRSASISVSMKF

SEQ ID NO: 6948 - protein, 685 aa, Burkholderia pseudomallei
MRTPFVRAALAALSGLPCIALAQGDASASSASFASSVSYAPAAASPADADSALSTAPAAAAASPASGAARGAEAVSADAASAVASGASSASPARAASAAQLAPVVVTARRGPQRLADAIPQTTLFDAGDIADSGATDLPGLLALAPGAQIVRNGGPGASASLFLRGAQPTQSLVLIDGVRVDSASLGQSQIAQLPLDQIERVEVVNGNVSSLYGSGAIGGVVQVFTKNGGNHPPRFDFSAGYGSYHTQTQSAGASGRLDPDGRTTFSVSLARLKTDGFSALDPARKPQANPNANGYLNESASASLRHTFSDKWNAGVTYFQANGRNSYDDAYGSPADLNDLYSRVQQLSAFANGALADGWTTRVSVSSGEDRNQSALNGAYTDHFNTDNRQYTWQNDFAIARGHKIQAGYERLDQSFESNKYSAPERHVNSGWLGYTGRIGDSRFQANVRRDQYSDFGGANSYYLGYGFDVTEHWTVSASYSSAFRAPSFNDLYYPNSGNLSIRPERSHSVEAAVQYASDDVGVVRVTAFQTRYTNLIDYRPGASGPYYVAQNVGRAKVQGVEGSWQGHVGGTDVRIAATLQNPVDETAGRDLNRRARRFASISANRSFGGWRVGGEWLASGARDDFGDRLGGYGIVNLSARYDITKSWYVSARIDNLFDKDYELAYAYNTPRRGAYVTLGWQQR

SEQ ID NO: 6949 - protein, 678 aa, Burkholderia pseudomallei
MSRAFRLDLLLLSCLACAFAARAQTAPAAEPVVRGEPLIVRERLLTGSPATVSRIELNDTPQLQVSTAQIADRTANFFVADNGARSFTDIFSLRGLTNTPIFGDPAVSVYLDDLPLGSGFTFPSALAGFARAELHRGPSQNTVFGRAGSAGVLTFSTPAPTAVATGEVRASFGNYRSRSASAEVSSASGGAADAYVGAGWAARDGYLTNTRLNRDVDDQNALSGLARFRYRPTETAELTLLLTTFRARDGVQPLVPLGGPLDTVNRSAEGETDVDAYNASLKAAFATALGELTAVTSFSSWELGPYSNTLDFGFAELSNAVNQEQRAWSEELKLRSDERSELRWQAGAFFSDGKTQGTFLRAFGPFVYENSTYRVDTRSIAAFGEATMDVTPAFSVTAGVRVEDVRKDFARTQFVPALYSFGREHESTALLPKLAARYVVDGATSVFASIGGGYKPGGFSAFTSNAALASFGPERTKAFEAGVTHALADRTLSVTARVFWYDISGYQIERSFATNAQTDDYLVRNAPHARSLGGELELAWRPLSGLVIAADLGATDVELREFRDPFSGVRYDGRRAPAVPTHDLSLRASYEHRSGFFVGADYSAVGRTYYTEGEELMFAQRSYALVSAQLGYATGRYRVTVFGANLTDEEYYTAITPGTGHATPGAPRTWGVAIGLKW

SEQ ID NO: 6950 - protein, 301 aa, Burkholderia pseudomallei
MSGAQNRRHTAMRGPRAHRAIEVSGDLMKKLIAACVVAGASTGAFAQQAGDLVATLGWLHVMPQDSTNGLTTNVVNSPINGPLRLPGSFTSPGTSLTVNNADTVGLTFTYFFTDHIAVTSVLGIPPEFALTGHGVIRPPGPSGSLGNVDLDKPANQPAVKNARQWSPTIILNYYFNAPSAKFRPFVGIGIAYSWFSNIELNGNFAKDINDNLGSVLAAGAGKPGPTSVEGKASSSFTPVYNIGASYAIAKHWALTATLSYMPLKTYSSLVIKAADGTTLATTRTRLKADPLITFVGISYKF

SEQ ID NO: 6951 - protein, 417 aa, Dinoroseobacter shibae
MKTHKSLMVSCLSVLSITLFVQHAQAAAAFDPNGSWMLGDWNGQRTALQAQGYDFSFGYTGEYAGILDSKQTSTHGSAYTGQLALGSHLDLGKILGWQDTEAQITLTYRDGQSLSEHSPALAGHQSSVQEVWGREQTWRLTDLWIKKKFLDQKLDVKVGRFGEGEDFNSFDCDFQNLALCGSQVGNWVGDQWYNWPVSQWAMRVKYNLQPDLYTQVGVYEYNPENLERGKGFNLSTDGSHGAIIPAEVVWSPKLGVQSMPGEYRLGYYYSTADAKEIADSTKTSHKQGVWVTAKQKLFQPADQTDRGLTGFVNLTFHDSDTNKVDNMQNIGLVYKGLLNQRPQDELALGVARIHINDDWSDVQAKEYDTEYNTELYYGIHATNWLTIRPNVQYVRHVGALKNGDNTWVGGIKFSTAF

SEQ ID NO: 6952 - protein, 737 aa, Dinoroseobacter shibae
MPFSSVSGPRAWAVLLGAVPVAAMAQSPASDSSPTQLPPVEVRERAETPRLAQPAAAASRLGLTVRETPASIDVVPREMLAERGSRTVSEAAQAAVGVLAGDFPAEPAAFSMRGFANSQINTLYNGIKIGPPNMTSRVMGTANLERVEFLKGPASLMSGEGAAGGAVNFVTRAPHRGPVETEVTAAAGSFGERRLSVGTGGTTARKDVDFRLDASGSDNDGFVRDTGQRLWHLSGGLDWYLRPGLKLFVAAEVQRDRGHPYWGTPLVSAAAPGIQAQPGVVSGTYVSGFNGSVLAPVAIDRRTLRTNYNVLDNRNEARETWLRTGVDWRIDAAWTLRSQLYRYTATRSWLNNEVLAFNTGTGLVDRERFFVAQDQTTTGNKTELQWDGRLAGRENRFVAALELSDTDLDRPGAANFPGDSVSLISPDRGFYGPLVQQRQTTRLRNAAVALEDRLRITPAVALIGGLRHESIELDRTSTDAAGAARRGFPYGKTWHPTTGRLGLTWEPAAGTMLYAQAATGADVAANNIFLLGPGQPLELTRARNAEVGVKQGFWQDRGEWTLALYDAERRNVYAGQGGQSLARAGALRSRGAELSLALRPAAAWSVWTQLAFNRARYDDFVLANGTSFSGHTPPNTPKVMASVGAAYRFTAGLPMQISASLRHVGERFHSDANTVRLSAYRVIDAAWSVDVAPGTQLTLRGRNLANKVYAAWADPFYPDQILLGAPRSFELALRWTL

SEQ ID NO: 6953 - protein, 797 aa, Dinoroseobacter shibae
MKKLLIASLLFGTTTTVFAAPFVAKDIRVDGVQGDLEQQIRASLPVRAGQRVTDNDVANIVRSLFVSGRFDDVKAHQEGDVLVVSVVAKSIISDVKIKGNSVIPTEALKQNLDANGFKVGDVLIREKLNEFAKSVKEHYASVGRYNATVEPIVNTLPNNRAEILIQINEDDKAKLASLTFKGNESVSSSTLQEQMELQPDSWWKLWGNKFEGAQFEKDLQSIRDYYLNNGYAKAQITKTDVQLNDEKTKVNVTIDVNEGLQYDLRSARIIGNLGGMSAELEPLLSALHLNDTFRRSDIADVENAIKAKLGERGYGSATVNSVPDFDDANKTLAITLVVDAGRRLTVRQLRFEGNTVSADSTLRQEMRQQEGTWYNSQLVELGKIRLDRTGFFETVENRIDPINGSNDEVDVVYKVKERNTGSINFGIGYGTESGISYQASVKQDNFLGTGAAVSIAGTKNDYGTSVNLGYTEPYFTKDGVSLGGNVFFENYDNSKSDTSSNYKRTTYGSNVTLGFPVNENNSYYVGLGHTYNKISNFALEYNRNLYIQSMKFKGNGIKTNDFDFSFGWNYNSLNRGYFPTKGVKASLGGRVTIPGSDNKYYKLSADVQGFYPLDRDHLWVVSAKASAGYANGFGNKRLPFYQTYTAGGIGSLRGFAYGSIGPNAIYAEYGNGSGTGTFKKISSDVIGGNAIATASAELIVPTPFVSDKSQNTVRTSLFVDAASVWNTKWKSDKNGLESDVLKRLPDYGKSSRIRASTGVGFQWQSPIGPLVFSYAKPIKKYENDDVEQFQFSIGGSF

SEQ ID NO: 6954 - protein, 258 aa, Dinoroseobacter shibae
MRKIFLPLLLVALSPVAHSEGVQEVEIDAPLSGWHPAEGEDASFSQSINYPASSVNMADDQNISAQIRGKIKNYAAAGKVQQGRLVVNGASMPQRIESDGSFARPYIFTEGSNSVQVISPDGQSRQKMQFYSTPGTGTIRARLRLVLSWDTDNTDLDLHVVTPDGEHAWYGNTVLKNSGALDMDVTTGYGPEIFAMPAPVHGRYQVYINYYGGRSETELTTAQLTLITDEGSVNEKQETFIVPMRNAGELTLVKSFDW

SEQ ID NO: 6955 - protein, 422 aa, Dinoroseobacter shibae
MKSSKFLTIATIFLVVALDAKAQSTVTLYGIIDEAVVLQSNSRIAAGNAPTGGYGTGKSKVFLDATSGLSGSRWGLKGTENLGGGLSVIFQLENGLNLNNGALGQGGLEFGRQAYVGLNDERLGKITLGRQYDSVVDFIGPLTLATRIGSSYAAPPGDLYNTSNAQRVNNAIKYTSPRLNGLLFDALYSFGGVSGSMARNQIYSVGSDFLSGPIRLSAAFLKVNQPNVSFFSNSAIAANTLGTSTTSISTPVYSGYANANSYQVAAAGGQFSTGPVTLSAAYLNAQFRGLGSSLSNAGNGVPAGKASGNAIFNTLELNVISFITPALQIGAAYSFTRASSVAGLRDATARTSAGSGGANYNQFAISSDYALSKRTDAYAMASLQLASGTDSTGGKAVAAIDTLTPSANNRQAVLRVGLRHKF

SEQ ID NO: 6956 - protein, 622 aa, Dinoroseobacter shibae
MTSSVLRRASVAFPPLAIVLSISAAFSPLSFAQTASDQSLEPVVVTASRTVQKASDVLADNIVITAEEIQQSGQTSLIDLLQKKRGVEITRNGGAGNSSSVFLRGSNSKQVVLLIDGVRSVSSTLGDATWSAIPLSQIDRVEIVFGPMSSMYGADAVGGVIQVFTKKGSGAPRISFSAGTGTYGEQVVSAGVSGSVEGEHRIRYALNTAHEQADGFSSRVDAGQNPDKDGYRKRSMSGQFSWELAHGHELGLAFLNSRNNAEYDNGLSTYNAHNIADVDVYSLYSRNQLTENWSSFLQLSRSYNEDRSYTSALRSGLARSDSKQDQISWQNDFQLGTDIFQLLVERREENVSSTEMALNRGRAVNSVAMAYQLNHGAHIGSASVRYDNSSAYGSNVTGSIGYGYHLSKELRVSGSVGTSFRAPTYNELYRVDYGSLDNKPEKGKNAEVGLYYDDGKSDFTIAYYHNQITDLLTNKTCTKGSGTCAYNVNKALLEGISIGAGNTLGDFRLFGTLDLQDPRDKTTNKLLNRRAKYHGAVGVEYAKGPVSSGVSLAFSGYRYDDAANKNKLGGYALLNLQVGYDLNNDWQLFARWNNALDKKYEVARNYQTAGSNVFVGVRYGFK

SEQ ID NO: 6957 - protein, 1031 aa, Dinoroseobacter shibae
MLKPRRISVFMQRKRGGNRTSLLSVELRMHRYPALPTRRATVLGSALVALLGIAAAPQAHASAFHVNGDTLYYTGNVLATDPQTLEAYILAAQARGTPLRQVVFRNSPGGAASGGVGMGAIIRQHGLDTVLDGGCYSACADAFVAGVKRKVTQFGLLPAHGNYTQTVLGIHGESGPNGPTPYPGQDKYIKYYRDMFGPTDFAVIEARIVQAHYELTQQSGFLRYFDPNVAAVATRFCPTRDQSAAGNCTAYPGVTFYSDRVVTEAGYVQPGDVLSIDKDVSGDLNPNLAVRGRYTNALANLRYFQQSTPDIRLDDAFGVIRIGKGGVWSLDTASAAQYVVADGGTLRLQQNGWIHHAEAIGARNGGRIELQQGALRSLTVVERGGVLTGHGSLNATIDINEGGTLAPSGIVMRPYSLEALAPGGDDVFTSERFRIGKGRYINLNDGANLAFQVDSQRTAPALTLEEARYFLVEEDRRSGDYNLYGNINRAVLSIAPSARLTLDIKQAFFPAGQQNHLVGTQVDASALQLPVAPCGPSNGEYAGLWCRTATPDTLTRAAPVSDFIEGRFQYVERSGEAGSAVDLTAPGAVFRPRHNSLLSFTVNQTGSGLWLTANPSFDDTRLFGNAPSGDGLGIALQQAAAQRTSSMSGLLGALQFADRDDIARQAGALRGDAHASLRLADTALVGSIGNVVQQHQAASRSGGDADGLAAQAAQTASAQSATTGSRLFNQLAMHLVAPADAGSDAGDAGHNRSFWARGFGSHGRIEGGAGVAGLNHTIGGIALGADTRLADDRVTLGVSLAAADMSTRSSEGAGFSGDVRALDIGGYVDALYSRGYLSAAVRYTDLRHDTRRSIEGIEGLQAPLRAKYSNDAISARVEHAFSFTTGNGVVIQPLLPVFDYMRTSATHFNEGQDAAALIGRSGSLESIRVGAGLQLFKTFDGNNGERITPRARVVWQKELGDTQARYSNGFAAAPDLLFSASSQPVGEQVLTWNLGVTSRASKRLSVMVDYVGERRDGQTQNGIQLGLGYTF

SEQ ID NO: 6958 - protein, 910 aa, Dinoroseobacter shibae
MPSYSFAGKAVKKGECCCEGALKKTDKSVTEIAMKNLTRISAAIIAANCSAIAMHSQVATAQEQLILEEVVVTARKRAESLQEVPIAITAFTENTIDRAGIERPQDFIGLTPNVTIVDSANAGDTQVTIRGITSTRDAEGTFAYVVDGVLVTNPNGFNQELFDVQQIEVLKGPQGATYGRNAVSGAIIVTTKKPSEEFEGYVKAGMGSDSLVKGSAVVSGPLTENLSGRIALSQRESDGQFTNEYTGQDDVVDFFEDQSIRGRLIWDASDVLSFDLQGSYSKVESGAINFNAIFALPDAAANFGSPDLYKNVNDHDFRFLFNVPGENEQETSSLSLKADYEMDNSIITAVFAYDNLEEYLLSDGTSAAFGLYSYDFGAAAGPGSALTGPTVGQAQNACSQSYNENIGSLNEQAPFYAIPGAVPGMAADFGIAPFYGLNALLPPYTQTTCDGYQYQQRDQESTSFEIRIASKDTDQLSWMGGFYYAQIDREVAVSYGADLGDGFFGRKPYVEGRTDLAFWDDFSTDVIALFGSLDYDINDQHSVSLAARYDEEDREVSNKVPNVPSSNNFGGGAPINPAYDGSFTDSIPDRSEEFSQFQPKLSWTWTPVDEASIYASYGVGFRSGGFNSLGSAALVQNEFGSLGTQPQNLRDEYDKEVSTSFELGAKTEWLDNRLRVNAAVFHTEVEDSQFFNFLAGGFGILRVVTNIDEVTLQGAEVDFEYLLTQSFSFYGSVGITDSEIDKNDNRPYTEGNEMPLTPDMTGNLGFQWVGEVMQDVDMFVRLDWQYIGETWFSTVQDNVTNNGFTDVSGLYQGIGQAFGDVTQTPAGPGIPAGGILGFGQSNYDKGQRDAYDLLNVRVGIEGEAWSVTFWGDNILDEDYLEEIIPAPEFGGYFVHPAKGESYGLDVVYRF

SEQ ID NO: 6959 - protein, 559 aa, Dinoroseobacter shibae
MDVTPLLPMPSDSSISCKSRSRSMALARRRLAWPGVCGALSLAAWLAPAQAQSAMAASGPQDAPAVSIPVLDGWPVDDESGWTTIDLSGDVDDGLNDIVLPPPGLDGHPIGEDGRPVDDENGWTTIDLDGTAIDDGWTHIDIPRPELDGAPVDSEDGRLPSPPEEAPQAGPDASKQRPEGLPAPDANPQPDAKPGAEMKPRPGVEPGPEAEPGPQGQPGPQPGPQPGARPQDEPHAQPLPPAGNPGAGIYMPRSGILTAPVLAVLGTASAPQGIWQAEMNALSKRMGELRLTPAAGGVWARSFAQRQRLDNQVVDRFTQTVGGIEIGADTALPAAEGRWHVGAVAGYSRARRKLAHSARGNSDSLHVGAYATYIGDGGFYLDGIVRVNRYEHDFKADGQRGARVTGKYRANGIGLSLETGRRFTWAGDWFVEPQVEVALFRSGGADYTASNGVRVDVASTKSLLGRAGLQVGRKLDLGNGKLVQPYAKLSWLQEFDGVGKVRTNDIGHDVKLRGGRAELDLGVAAALGRHSSLFASYEYSKGSRLTIPWSFHVGYRYAW

SEQ ID NO: 6960 - protein, 84 aa, Rickettsiella grylli
MLKIIPGATGYFNKTLNSNQFDNEDAIKDKLDNRGSIKGKLNNIYGKSIDYAALRHRDIIIAKIDLFIQRITHNLWHARKKMCF

SEQ ID NO: 6961 - protein, 1090 aa, Rickettsiella grylli
MLKRMRSFLVVVMLLITATMSAQVTTASMSGKVTAQDEPIIGATIVAIHEPSGTRYGTVTNVSGQFNLQGMRTGGPYKVEITYVGYQSAIYKGIQLSLGENYVLNVSLKESSELLDEVVVTAPKTIEKIGTVTNVSERQMNTLPTINRSITDFTKLSPYAGGSSSFAGRDGRYNNITIDGASFNNSFGLSSNNLPGGDSQPISLDAIDEITVNVSPYDVKYSNFTGASINAVTKSGTNSFSGTAYTYHKPRGFAGSSIDGEDILKAKEYNSHSYGVTFGGPIIKNKLFFFLNAEIENKETPGVTWLPNQDQNGTGDSGKRISRTWVGDMRTISDFVKTKYDYDPGQYENFNNFQSDNWKLMARIDWNIHQNHKLTVRFNSVSSEDDREVSAKSTIITSTNSNRYGLDAFSFGNSNYKMKNVVTSITGELNSRFSNNVQNKLLATYTHISDTREQKGSDFPFVDIYKDGKQYITLGTEVFTPNNQVINNVFSLVDNVSISLGKHELLAGVSFERQYFKNSYLRGPYGYYRYDSMDDFMQGKVPTIYGITYGYNGNDAPGSELTFGMAGVYAQDVWSLTPNFRLTYGLRLDMPIYMNSLDSNKSIEELAFVNNTHVDISKWPKTQVLFSPRVGFNWDVKGDRSVIVSGGTGIFTGLLPFVWFTNQPSNSGLYQNMVEYNTQKNPGSLPADFGFNPNYRETLQKYPSLFPSTPSEQAPDVIAYVDPKFKMPQVWRSNLNVDIQLPYDFMLSVGAMYTRDIYNVAQINMNEAEPTGVYNEQPDRIYWASKKYEYNDYTNGKNVVVKLSNGEDKGYQYSFNAILTKKYDFGFTGSIGYTYTMAKDLTANPGSAPNSAWQNNVAVNSLNDPGVSYSLFSTPHRIIANASYEINYAKCLKTTFSLFYSGYHTGRYSYTYYNDMNGDGNYSDLIYVPNSQDEMTFVDITDKSGAITYSAVDQAKDFWDFVNNDSYLKDRKGKYVERNGSLTPWINRFDFKIAQDFYATLGGRKYGIQVSLDMLNVGNMINSKWGAYQSCGLKSYDNVQLLKTASKVGEPLTYQINANSREAFKERSSWQYTNTIGSAWSMQLGVKVTF

SEQ ID NO: 6962 - protein, 364 aa, Rickettsiella grylli
MLKKIAGAVALLGAGGFTHAQSSVQIYGIMDTAVETMDHVGASRSTLTRMPNLSGSVPSRLGFRGREDLGGGLSASFTLEMGIGPDSGALNQGGRGFGRQSFVSLNGPWGSLGLGRQYTMLFWSVLDADVIGPSLHSMASLDSYFPNARADNAISYKGVFSGLTIGATYSFGRDAVNAGPSPSGTNCAGESSTDSKTCREWSAMLKYDSATWGAALAHDELRGGPGAFAGLSSSDKTDKRSMLNGYVKWGGARIGAGYMRRKNDGYIASPRNDLWFVGVSYPMGPWTLDAQYNQLNYKDNADKGQLMVLRGTYSLSKRTAVYASLGYMKNSGNAAFGASSAQAGGAPMPGVNQTGFGAGLRHTF

SEQ ID NO: 6963 - protein, 204 aa, Rickettsiella grylli
MFKKTWLMTALLATCSVANAAPYVGASVGQASFGDVNGSINGGGTNASTKLKLEDDSSLSGKVFGGYKFNEYISLEAAIGGYDALDGKVVTVGDMKYLSIQPKATLPIGDRFNLFAKAGLSYFNAEFKISNSVIDGSAGHTTISDSTVTGMYGLGAEFAITENFALQVEWEYMMPELDIAKFGNEKVTVDADINVFSVGMSYRF

SEQ ID NO: 6964 - protein, 191 aa, Rickettsiella grylli
MLKKILMTGVLTASACAVITANAATPFYVHGQIGYADTHIKSRLESNPANFANDGLAGRLSLGYQLTPQLAVEAGYLQLSNENSNERSKKGKATFSNEQYAIDVAAKGALPITNNVNVYGKLGVAYLTTKLNPNDHEISKRKFAPEVAVGMDYDITPNVTVDTSLTHIQTFGSKRPGNIDFLAVGVGYNFG

SEQ ID NO: 6965 - protein, 231 aa, Rickettsiella grylli
MFKKIIFLCVFLIGGFVIPPLEAMPILRNKTPKKNYQEAHEKLYRSIINRQKLTRKKSGWYFLGGVGAVEAIKDYQGKEMKDWIATLNLKTGVQSFFKKYIGIRGVFAWDLGSGKVNYQSYKDPTNSFFTMLAVGLDVIMEFPLGSYKHYLGAFGGARGALVVYTDKQNFKFFKHSVVSGGLAISGGVMLTLFLRHRIELGFKILPTARLLSSSSRFETSPLFYAAYSYKF

SEQ ID NO: 6966 - protein, 187 aa, Wolbachia endosymbiont of Dryocosmus kuriphilus
SYYVRLQYNGEILPLFTKIEGIEYKKATDIHNPLKASFIAGGGAFGYKMDDIRVDVEGVYSYLNKNDVTDAKFTPDTIADSLTAISGLVNVYYDIAIEDMPITPYVGVGVGAAYISTPLKDAVNDQKSKFGFAGQVKAGVSYDVTPEVKLYAGARYFGSYGANFDKSGGEKDKGGHTVLYSTVGAEA

SEQ ID NO: 6967 - protein, 282 aa, Anaplasma marginale
MNYRELFTGGLSAATVCACSLLVSGAVVASPMSHEVASEGGVMGGSFYVGAAYSPAFPSVTSFDMRESSKETSYVRGYDKSLATIDVSVPANFSKSGYTFAFSKNLITSFDGAVGYSLGGARVELEASYRRFATLADGQYAKSGAESLAAITRDANITETNYFVVKIDEITNTSVMLNGCYDVLHTDLPVSPYVCAGIGASFVDISKQVTTKLAYRGKVGISYQFTPEISLVAGGFYHGLFDESYKDIPAHNSVKFSGEAKASVKAHIADYGFNLGARFLFS

SEQ ID NO: 6968 - protein, 753 aa, Chlamydophila felis
MIAKKRGKASDIEEVMVWGAAKDSASAGYTNPTSLLTQEDMVAINATTTEDLVKYEPSLVIRKRYIGDSNGTLGMRGSNMFATSRSMVFADGVPLHYLLQSRWSGAPRWTLVSASEIAQVEILYGPFSAEYSGNAMGGVVLIETAIPQKREVHIDLDYFSQDFSAYGFSDRLNGYKTFISYGDKLGDLSLYLSYNRLENDSQPQTFYFDQDKNHSLPEVQAQFANAIPVTGFMKNQDVYAKDAYYFGDTGVEQAVTDNVKIKLGYDFGNWSTLLNLAYEDRTTLRDSPNSYVRDEAGQTVWSGNLEQDGLWLTIPANRLGASDLERKSLSTGLRLKGQLTDQVRMETTISDFRILKDNTRTSSRSLQDPLFNGSGQTTDYDHTGWQTFDIKLVLEDMGLEGMEWITGARRETYELNLDQYNSSDWAQGDNAGYTSRSGGETAINAAFVQLNWDINAHWDLALGGRYEEWESKHGYFTRSAAPTVLIAVDDNQRNQFSPKFSLGYAPADEWLVRYSLARAYRFPIVEELFSQSQSYASTTVARPDLKPENGLHHNLLLEKQFDSGYARINLFSETIQDAIESQSNILPGGASITSFSAVDEVQTDGVELILNYYGLLVPELDMRFNLTYTKSIIEDNSSAEGVNPDNSIEGNDYPRMPRWRSNLLLTYHASDRWDVSANVQYADKSFGRLQNDDIAEQVMGAQDGYTRVGAKTTYAVSDQLKCGLGVDNLTNQRSFVAHPWPGRTLYMSLSYSL

SEQ ID NO: 6969 - protein, 182 aa, Chlamydophila felis
MKHPITTLCLAGCLLATPALAAAQQEGPYVNAQVARSLIGASGFDDTWALGATLGYNLGQRGQGFGFEGEITATLSDSENSSPGIPGVNRVRFNYTSYAVYGVYRAPLTRELGLRARLGVVYIDGEFRRRGAESRTRSDNETNVSGGLGLTYAFTRQVHGLVEWTHLDSDINHVGAGVQLRF

SEQ ID NO: 6970 - protein, 980 aa, Chlamydophila felis
MPLSLRSSSFCFLACLCSSGWVAAQTINQTNLTPPLYDIGEAFYLTSNCFIKDVYGAKFPSSFLGSSSNLTIFGKQRSLTFSQCHAPVKEGASLISAAEALTLSHLSKLVLNENISIGKHGLISGKDITITSSKAVTVTNNRTPYTPVVTESVPTSVTVNCFCGSAVHTTTSLNITKIRNQITFGSNSGNFGAALLNDTNASCNIENNSAAISFSQNFAACGGGAIYDGTVTFKNNSGPIALLGNTAAKGLQSKTPNPAKPIGSGCGGAICVPTKSVSFVDNTGGCNISSNLAQNDGGAIYATTCTFANTSPTYITKNSAKENGGAICAKALTVNAQGPMVFFNNRAQKGGAVYISPTVGNTSDPATSTLSLTAKSGDMVFIGNMLDGRPGVRNAIHMEGDSKVTALNASGLSNLIFHDPITNTGPTNNGKSLHTITVNSPGYSGSVKFTSETLTISEKLNPANTTSSLFGKVVIEDGQLIVTNNAKLKVLGLTAETGRLTLGSGSGIELLSRTNSNPTPDNFTISKLGCDIHSYLNPDYSPAQVHSGTKSVTVSGSLDIVSEDSAELYDNPLLQESLSFPFANFRANSNGPTKDNFTEGPIDVPEHYGYQGVWSSSWTTPLLAPTPNGGIPSGTSNQTLYVVWRPEPTHRAPYILDPERRGEIVSNTLWTSFLATQVFSEALEKNFLNRNEGVLVSAKAIGNYIRQPIHKSHEGFKGRYGGYQASIGINYPDEASIGLAFGQLYGQVKSKPYDTHSTEQISVFAFFGKFLLATENTATNISWEAAYGYAVNHIKTNYLNPITQRTRKSKGRWHNNTYYAAVSVEHPFLTWCTLTRKVAHDFDFSGFISAEFMGGWQNAFAEQGYLPRSFSRGRGHNIALPIGFTSEWHTPFKKAPSTLTLKLAYKPDIYRVNPHNVVTILANNESIPVTGAFISRNGFYLQVHDSVELSQHTTGFVDYVFDSKKSYASHRVITGLQGTF

SEQ ID NO: 6971 - protein, 914 aa, Chlamydophila felis
MKIRCVHLYQTCNVLPVVILAIIPSWAEGACSLSSLASAGVQVCDSGSSGPFSAPSGDHVLIFPVGGTGTVSGNILFGPGMDSVDMQSGRILGNVTQGAGIDRFTLSTGEVSGDLNQGDDPDDFVMAGGTLGSLAQGDGRDTFLMTGGTITRAFEDGDVAVMTGGSIGRVDMKLDNNVFEMSGGTIINNLVTGFGRDTITLSGGIVGGNVSVSGGDDQITLSGGEIRGEVRTSVGNDTFNWLNGGYARSNVLMADGNDTARLYNLSEYYLSANPLLDGGPGNDALTFDDTVSSQPGRYANWETVNVSNGSQLNLAGTLVLGDSLTDTGVLDIDSSSRLISTSGSVVPFSAGSLASLQNAGTLDLSDAGRSLTGTLTVTGNYTGQNGRLLLLSALGDDASASDRLVVAQGRISGSTRMLVSNSGGLGALTRGNGIEVVKAINGATSESGAFSLQSPLSAGAYQYYLFKGGATAGSENSWFLRSAVIAPPTPAPPPVEPAPEPAQPTPLPAPAPEPEPEPEPEPVPVPEPVPEPTPTPTPQPVPAPEPAPTPQPVPAPPPDPEPEPNSPPPVTPAAALPVPAIGTPPLPEPVRGAAPIALYRSEVANYSVVAPTAAVLALSSLGTFHERQGDQALLTQNGTTSAGWARVFGSDFRQRWSGDVSPGLDASFKGYQIGHDLYAWQRDGGQTQRVGLFVAHNRLDGKVKGFAEGFSDYETGRMKLQGESLGAYWTLTTPSGGYVDAVAMGTRLDGRSRSVRGVGVDTEGSVISLSVEAGYPLPLSQRWVAEPQVQIIYQRVDLQDQHDGIAHLRFDSQAYTTGRIGLRFKGQYQVSGVPLEPYLRANLWHTKDGHDTLTFDHAEQIRTAHRSTTGSIGAGMVATLSSSASLHWSADYLSDLDDDGAQGVNTSLGFRLVW

SEQ ID NO: 6972 - protein, 934 aa, Chlamydophila felis
MKQMFFWKFALLSSLTQLAYTSHLSAEVTLPLSGTHAGEDLELFTMLTTSPQGTNYTLRGEFTLKDFLGNNIHKSGGAFCNSEGNLTFTGSSPLAILNFTNLQLGGQGAGVFSKTLLTFENLKAINVENNQSSGGVFTSKQDMLFTRNTSLLFQNNISHGAGGAILLTGVQPNHMRFSEQRGAISFIKNRAQVTKNITNSGNGGAINSEVAGSSILFDGNQEILFQENYANFGGGICNAQGTVEFNGNKNTITFTQNRAVSSGGAIFTKCCNIHKQTAPVVFCKNSADILGGAIFSSQVIIKNNDAPILFSENHAKGGGAIAAVSCNITASQPIIFSDNSSRDFEGGAIYLSGQPKLHLHAQSADIIFSNNTARITTKHSSTIKNNAIIINGAPESIRLIANENQSIIFYDPVLAASQGADPIHINSVDHTLHCGSVIFSGEKLAIDRQDNNNKTSIFNQPVYLHNGTLSIISGAILAVQEFKQLGGTLHLSPGSMLTTYNSSGKDLVISNISFGLDTTHSHLPAEIRSGNSVIKLSGSPQIHDPDNIFYNNHDLASQPYHMEIVFKSEKSVNIDNFIPEEIAVQQNAYGYQGVWKFNWSKENSKRHKTLKASWIPTGTFILNPEKEGYLIPSSVWATFTGMRSSNDAILDNYLNNNTIMPIKYACIFGGPISSVMEQNGKSYNNFSTTQVGQNVGIKLPFSPNTVVCATFTQLHGSISQDNIPGKSNSHMLLGTVAAFKNWRALSFRSSISYAEESHVAKHQFSKKDITRGAWKNQGFRGSVGLSYAYPKGIRCLKITPFVDLEYTVINQNPFIETGYDPRYFASSHLSNLALPTGVSLELRLFGAKYSLFTQLSMAYIKDLLRENPTTTAALILNQHSWKVAGAFIGQEAVNLKFRSTLKYRFATAYLGISTTQREGNNLSGDAFGGLSLSF

SEQ ID NO: 6973 - protein, 677 aa, Chlamydophila felis
MKWLRMAAGAAWLIGNLGAQRVGAPTDDLTKLGVDELFSIEVTSVGRKAQGLSKAPAAVFVLTAEDIRRSGATSVPEALRWVPGLTVLSQDGRSWSISARGSTRLYSDKILVMIDGRSLYTPLFSGVIWDAVDVPLGDVEQIEIVRGPGAVMWGPNAVNGVINIITRRAQSTTGQQVSLATGNDLRASAEARTGKAWDRMAYRVWGKYDFRTPGYGSFGDFSFTNFVFRDPAIRNLDMGSGRIGFRVDGQPDEKDQWMVQGDVYKADRQDPLAFPTIRPAVERLQGHTDYEGGFIQGRWIHTASPGNESEFRWSYDHNDFDYSYVAASLQNVTADLQNRLHAGEGNEIYWGAGFQQYWDDTRSQRLVAFDPAKSLYRSGYGVLRDEWQLVPDRFLCSAGIRVDYNSYHQLEYQPSLRFLYTPNARQSAWAAVSRAIRAPNRLDRSLEYDPGYRADYDFPIRMHSTGSQAQLSEVARSAESGYRFQAGQRWSIDASLFFTYFERLRALTYSNVPEISISNGVLAISTVLATGNLGRGRSYGGEFWGMWQVRPGWRLAPSYSYVRDTFWLPPSSPVRMYNWDLIPMDLRHQALLRSQFDIGRQWQVDLMARARSRERAWGLPAAFLVDARAAWRCTRNSEVSIALTNLTDRRVIEASSESATPAIPIRRTFLLKWSQRF

SEQ ID NO: 6974 - protein, 1873 aa, Chlamydophila felis
MKWLSATAVFAAVLPSITVFCDPLSKELNSNYRGSGSSTADARLTNFTQQTQDASGITYLVSGDVSFSNFTNIPDPKPQPPSTEPETSPETKDSAAKSSESSNPASITQNIAHLQTQLYQSLFQSLGSSSFAPHFSDRDQGNLDLSNYLFSNIHSLSFPFTASAGSTTTTTTTPEDPKGGGAFYNDKDGPLSFTTYAGNPGSLSCSLIKMKGKGGAIYSKGPISFDGLENLTFKDNLSQQSGGALFTDSTLTIRNILNSIEFTTNAARVPIPLIPIQPAPTNPPAGSAVTGTLLASDSSEKKAANTSPTLPVYTTETAGNGGAAFATGAMLITTYKDMTFRRNSAEFPAIIDTIQATIDANKNKVVSAVPKSSQIISAAQPSQGSTTPEVIKGSGGALFGLDTITVSEGSGTTLFILNTATGNGGAVYGDKAVSFNNITSLKFQSNSADKQGGAIYSKGNLTIQDSSLLTMFNGNNGKTGGGAIYSLGDITLSNLSQVSFGANKAGNYDITITVKNDEGTNAIVPSVQSKISSAILASPPANLSASASAVDPAPNPPLGKGGGIYVGNNLSISNITSTLEFVKNQSTDSGGGVYVKGTLTCQDSHRLQFVSNSSKKSGGGLYSETDVTFTNLTGNTLFQGNTAEEDGGGICLANEKSLNMSNLESFCLIGNTSTKKNGGGANIPKALSLTFSAPNSSPDAILSETPAVIPVFGSAIISGNKAVEGNGGGIYTKKASFTNLELIDINQNSAKNGAGLCTQNISSSAASASGVGGLGGVGGFIKTSTGISSQKSEVAAVVSGAPAATPDDLDFKVDYVVTTNITKNAATENGGGVYGNKGQISRLDLLNITENSSGKCGGGLYFQETLTLEGIEVSNISNNTAKESGGALYAKTLTCKTFTDGLTVSNNKAETTSTVSGTNVVNASAAATNGALQAATLTEKFSTDNKAEAHASVAPAAQQASVPTAITGGALYAETLTLEGLQSTCAFSGNQAIDNNATDSTADTPADPDIQGGAIYAKTKFTLQNCSGNLTFKDNSVLTKRSQTTGQLAGGAIYAPTVEIKNCSQAINFSNNSASCTPKTAGASEKAGAGITPKESFGGAIAGTTSITFTGNQAIFFQNNSADIGSAIGCKNGNNNNGTVTFSDSGYYLFEGNTAKNRGTIYATTLSIPNGYLNFSNNSSANDGSAIYFTKQADITAGSSVLFLNNKVTLAQTPTSKNGKSAVNNLGAAIYGEPTSSSDDANLNLTALGGSITFKNNGCTAPTRQDNQVKSFCSIAGKVKLTLNAAENHSINFYDAVNITTQKTSDYNPLDINKPSNGKTSQQYTGTVLFSGELHEHKSFIPQKATLHAGTLVLGKNAELSLISFEQKPGSLLVMGPGSVLSTHKPTASGSAASGGIVINNITIDFSEIVSDNGVASPPTLKLGATPTPIAAGPGAHRSKQSALPQANKQAPDVDQEKIYLTGTLTLIDPSGVFYQNPYLGQDREIELLALPQDSSKVDISDLTLAGDTKPLKGYIGTWELQSTDQNGKLQAKWKFEEYRRWIYIPRDNYFYVNSILGSQNSLIAVKQGVVNNMLNNARFDDAAYNNLWLSGIGSFLQKSQGEESREFTYHGRGYSLAIDAKPRPELILGAAFSQVFGHAKSEKTVDNYKHKGSDHSFQGTLYAGRAFYLPYKRTKAPRPILLQGVVTYGYMKHDTTTYYPSIQERNLGNWEDLGWMFDVRMIMDLKEPSQNSTTRFSFYSEAEYTGVRQKQFTELDYDPRTFDSFAYRNLAIPLGFVMEGALMQYDILMYNKLSLAYVPVIYRNKPKCSYRVDSTGQTGEVYGVIPTRNAARAEYSTQLYLGPYWTLYGTYTVEAGMSSLVQIANCGARMIF

SEQ ID NO: 6975 - protein, 1536 aa, Chlamydophila felis
MIAKKVSRFQKSAFSHSVVIAILVSTGIVANNHRLYAYESVSEVFLDTTSLSKPPVETTVAGIFGDKKKEKSSEKKNPKKENKEAETHVDTSLLHDISSCVTKILGADVAQSQCLVDVSTLFKTPNSLSWANIHTLPANSEKDGYEVQDPQHGLAFCYKNSSEDSGGKNSPGFLGIALIGAGSKSGLSFSNLSSIASGAAVYSDEDVIFEHFKENLLFEGCASQACGGAVSGRSIALNGCHDVSLLNCKSGVDLTTSGEIADFSKGGGVLNVHKIHGEAHTSRFSNGEVLFLDNSGTFLVKGNCAESANGGSVACAQFVCSLNLGDLSYISNRALSGGAVSSLKSMDFCKNIGTLDFVENCALASSQSSAFLGGGALASGERISFLNNERISCCKNTSKSHGGAFLSRYVRIVESVGDTCFKENSAEFTGGAVSAQNQVEICKNFGSVIFEKNTSKLGGGAIYCLLPEQPYTSSEEPLPGSGDIKIIDNSGAIKFEANENLMNSPETHSHLGGGALYGANILISGNTGEIIFSKNASSQCESNSTHLGGGAIFANERVMVSDNSGAITFSYNSGKFLPLPMPSAEVSEENSSQNAPVESSKLVDLGVRGGGAIFAKSIDIEDNTAAIVFAENSMEIKNNKAQKENPLGGGALFGAEAIGLKNNADLLFSSNHVSGENSSGGAVLSNAVTISDNKKVQFVRNYSQFLGGAICALGDKLSINNNETTISFIGNRTVSAGGAIACAEGEVSISKNLGRVEFKDNLVFGDPYVENLEEGQINTVGHHSGGGAVFAKTAVVIRENNDKVLFSGNTTGCFGGAILTGSLTPAEDQERFASRVVSANTKVVITENVGDVIFSGNSTSAAQHPDHNLFGGGAIYTQDLIINKNEGSVAFYNNYSPRGGAVRISEKGSVILEAVGGDIVFQGNRGAEDASDGIYFSGKESRLVEVSAIGENTVSFSDAIVFEDLTLRKSSESHENILLDPTLIFNSKSKDDSGVTHSGKVRFAYATSKIPQVAVLESGTLVLSDKAQLWLCGLKQEKGSEILLSAGTVLRIFDPNVKSVEKIESPSAKSYYSNYEIEKNPIEKTLADISSIGVDLASFVTNDDGSSPLPPQIIVPKGTTIGSGSLDLSLVDSDGAGYENHALLNKETDLTLISFKSASTISDTPELERILEDINVKVSVPTITEETYGHMGRWSDPQVVDGKLMINWKPTSYKLNPEKDGSIVLNTLWGQYGDLRALKQQQLSHNITAQRMELDFSTNIWGSGMGTFSNCATIAKVDGFTHRAGGYALGLDTQLIEDFLIGGSFAQFFGYTDSQLYSSRSNQSGYLGSGYVGILAGSWLFKGMFIYSDIHNDLNTTYSAQSLGVSKGSWNSRGILADAHVDYRHIVNSRRFISSIVSAVVPFVEAEYTYMDLPAFTETGDEIRSFAEGHLQNVTIPFGLTLEHNYSRGQRSEVNSLSFSYALDVYRWEPKVLINLPVASYSWEGIGSDLARKSIKAQFSNDTEWNSYFSTFLGATYEWREHTVSYDVNCGMRVIF

SEQ ID NO: 6976 - protein, 251 aa, Vibrio sp. AND4
MKMKSTIVASSLLAAALPALSFADNAFTGVQAGLNLGYEDSSMDWETDSIITPATPGNSLAVGANDSESLDDSAFAYGVFTSYNMALNDRWIVGAELAYQGSNTSDSVKSIPGDPLAGNQTEAEVEINQTFLLGIKGGYLLNASTLAYSTLSATLTEVEVNSDCPSDGTVCNPGSPARSDSDDDNITGWALALGLEKSLSENLSVRAEYRYADLGTANVTAVKKENGEAFGIDADIDVTSQALLLAAVYKF

SEQ ID NO: 6977 - protein, 713 aa, Vibrio sp. AND4
MKLTPVSAAVLSVLAASQVHAESKVFSMEEVVVTANKIDQPLSKVAGSVAVITNEQIEERGETELYDVLRNEPGVSVTGGAGRPQNITIRGMTGNRIMIVRDGIRSADGFGANDINDAVGRDTFDLSNFESLQIIKGASSSVHGSGAIGGVVILESSQPGDFLKDKDFYTDVSGTYTDISNKYKGTSNLAFRSGDTESLFNVSYWQGQETRNFDEELYNRDLDGYSGAYTINHFFNEEVMLKAKAELYTQNQERLEGSPSIQPDGIWHIEDFAEDETTEEYSAYIGAEVTPINPTWFEELDTKVYWRHTEVVEDTNRLMRQVDHNGLITKRRELEHKTFIDETIGFRGDFTNTIYAANAEHQLAYGVELSTDYYERTDSDSKIDWNGVTPSTKQPFAPARAYNIGLYVRDMVELDKWTITGGLRFDAHRLTPDGAGEVGGFPLKDMDSSEVSPSLSVSREMFANNIAYVSYNHGYRAPEYDKAYGFVSHDFVPLTPFVIAPNMDLEAETSDSFEIGNKFDNGRAYVYASLFYNKFENFIDVVTTGFDSSNGNYIKQYQNLDGVETYGAELSAGYAITKRWNISTKFGYVDGKDAEGEYVRSITPFEGNAQLKYANQDFNAYVAWNWAAAMDRVPKCQTTLGLATDCAQTSAWNTFDIGATYHVSKDLRVSANIINLFDKEYIRYQDVAGIAEESKRYSTEPGRYFTLTAKYEF

SEQ ID NO: 6978 - protein, 713 aa, Vibrio sp. AND4
MSKLPFTLSVLALSIASAHAETDTQNEGVQEMETMVVTATRYTQTPDKIAGAVTVIDAEDIEEQSIISDDLTSILATLVPGITPSRQKMSNQGENLRGRQALIMIDGVPQVNPLRNGNRYGYTIDPSMVERIEVVNGASAVQGMGATGGIINYITKGAKPGDDWKQTVGTRVTSSFDNDSTGGKVFYNVSKYDDEFDLFFGGSWDQQGLYYDGNGNPIGMNDIQGETQDSTATDIFFKGGYNFDDGNQRIELTANTYTIEANGNYKGVKGDFENGIPGTVEPGSPSGEPVSNEAQLFNLQYTNYDLGNGMLTAQMFYQNYDAVFGEATWYPTETKVNDQGAISSQKTGFKVGYETYELLDLDDTWVFGLDGLHDQTEQTLDQSGLNVTPLMEYYSLAPFVQGDFLVTDALRLSTGVRYESIRVKVSDGQTIYGYGVDGHNSEIIGGTQDSSKAVFNVGAVYTFTDEFSTFASFNQGFGLPDIGRILRGNWVGDANPGQNGTPIDFNTMPAVEPVVTDNYELGLTYRGDKLFVSASTYMSIAKDGANLALNNNGTYDVERQRTDIMGYELTSTYQVLDSTKLSAMYAHVEGEVDTTGNGSVDSDMDLKNLTPDRLLLAVNHNFSDVLASRIQYNYLFDSKKSANNVGAEQNFDGYGLVDFSTHYDMRDKGRIAFGIENVMDEQYINYFSQIRNHSSYYFSGRGRTFSLSYELDF

SEQ ID NO: 6979 - protein, 724 aa, Vibrio sp. AND4
MNVKKGNYPLTLVAMAVAVATTSVAMSVQAEEYTSTTEETMVVVSSRTPKAISEIPGTVWFVDSEQIEQEYRGGKTLGEILSATIPSLDVSSGARTNYGQNLRGRAMLVMIDGVSLQSSRPISRQLDAIDPFNIERIEVLSGATSIYGAGATGGVINIITKKADSDELQFESYVSGSSGFNSGDDFDYKLAQSISGGTEKVKARVSAVYTETQGYYDANGDIVTPDISQGSLQYNETIDLQSTVDVAISDTKNINLLAQYYDSQQDSPYGLYIKNNQFIDVREGFESDRQHGTERIMLSAAYSDSEVLGHQLVVEASYRKEDQTYTPYYQSASQQTTDVISLKTALAKSFGKVNLVYGVDAYMDKFDSNQALFDPTIANNSGNLVNKTYAKVGRYPGVEVGSVAGFIQADINITDDWSIEGGYRYQYMNNKIDDFVDYKIQKKIAAGNGVSADAVPGGETDYTVGLFNLGTIYKLTPESQIWANFSQGFDLADPAKYYGQGSYSAADANGHYTLQNSINVAGSKMSGIKTNSYEVGFRTDQSALSFQTAAYFSQSDNSVKYNKKTLLIEDVDNEKRVYGAEALVSYWVMDNLQIGASGHYVISELQTDGKWDDLSAGEASTSKANSWVGWYESDLALKVQSQTMFDYKDSSDNELSGYTVFDLVGSYELPVGSLGFGIQNLFNKDYTTAWGQRAQILYSSHYDAAAYDYKGRGRTYTLNYQVTY

SEQ ID NO: 6980 - protein, 414 aa, Vibrio sp. AND4
MNKKHCSLLTISILFACNAQAAGFQVAEHSASGLGRAFSGEGAVADNASVLARNPAAMTLFKEAQFSGALSIVDPEVNVYDTVNNEHAKDVAPLQIVPAGYYISPINDQWAWGIGMFTTYGVATDYPDDITAGDMAGDTALLSVNINPNIAYRINEQFSVGGGINLVYAHAELTRHKGDLVKVYGGNKSDNLIGMEGDTFAWGWNIGALYEFNENNRFGFGYRSKVDLDFDDGEFSSYKSAIATAPKVDGRLQISLPSIIELSAFHQLNDKWAIHYGWQQTDWSTFKELKATSPQCDDGTAGQCFYKPEKYEDNNRYSFGGTYTLNSEWTLRAGIAYDEQAGEATLSIPDSDRFWYSAGVTYAMKENLTFDAGFAFVKSKSGSFTETNALKEEITFDSEGTAYISAVQVNYIFK

SEQ ID NO: 6981 - protein, 712 aa, Vibrio sp. AND4
MYKKSILSASILVALSHTAYAEEASKFEEVVVSATRTNQTINTVAASVAVVSEKDIEENMVKDLNDLFEYTPGVTVNGTQRQGVQSINIRGMEGKRVKILVDGASQPGVFSGGPYSFINSSAVTVDPDMLKSVEIVKGAASSLHGSDAIGGVVAFETKDPKDFLKDGKDFGGQAKLSYSSEDNSFSEHVALAKRFGNTEALIAFTRRDGAELQNFSKAPYDNYSVDNQDYYKNDLLVKLQSQLNDAHRLEFLGEVIYNETDSEIAHKSYKNFNAEDTTKQNRIGLKHIWFADAAISDTITSKLTWIGKEENGVSNRFIEASPGYPPYVPPSGDNQQKKDYEYTEDKFEFETQLDKEIQNHYIVYGISYKHSDISNTNREFNSDPGTPDTVYVYTPDAKEESFGLFLQDEISLLNDKLILTPGVRYDYFSTNPSNTSEESFEKFSDSALTGRLGATYSISQPGTIFAQVSQGFRAPSFDELYYTYDNPAHGYTNRPNPNLGSEKSLSYELGYRHNTAASATEVAFYYSDYSDFIEQTSSNNGGLTEFTNINISEANIKGVELSNRLDWHAIAGLPSGVTTRFVAAYTEGEDGDGNPLNSVNPWNAVAAVNYDSPNALWGTSLKVNYTAKKSNSDINSDGDKGGIKDQVALPSATVVDLTAYYKPMKDITIRAGVMNLTNEEYHLWNDVRGKTELSRDKTQAERNYNISVKYEF

SEQ ID NO: 6982 - protein, 486 aa, Vibrio sp. AND4
MTQHRSMKRVARAVVLAWGLPMLAGVSIAGAARADDAAPAAPAQAPLAATLAQQATTPNALVNADATQAVLPQPPMSSQAKSKGFIADSHFDVLLRNYADVLDAKGGPHRHAWVQGVMANFESGYTGGLIGFGVDASIYAALKLDGGAGGGNMVHVAKGGGGSNQLAWAFPGIYDVKARISNTVIKYGLQAVDNPFMEQHDNRALPPTFLGATIVSNEFKNVMLEAGSFTKTNARGHTTLTNLTTQYGGTRVDRFTYVGGTWDYSQTGSASFYAGQADDVWRQYYGSVKQSYGSPQTVKWTGFGNFYSTHDTGDARQGKIDNNAYSLSLAAQHGPHELLLGYQQVLGDQFFDYLNETNGIFLVDSMDVDYNAPHEKSLQLRYTFYGKEAGLPGFKAMVWGVTGWGADGSASAALDPTRSSIYWKDGAPVQGRHHEFGFIPSYTIQSGKLKDTKITFIAMWHVGSAHYSDSTNQEYRLVVNVPVKVF

SEQ ID NO: 6983 - protein, 763 aa, Vibrio sp. AND4
MVRLILLTGVSIIAVHASTAMAQATGTDVGADDRLSEIVVTADRNERSLQDVPISISAFSAQALEKSNVTEAKDYLQFAPNIVFTEDGATGPRSIDVAIRGVGNIKSSDLVTTSSAIGYYIDELNVGAVANGTINPQMLDVERIEVLRGPQGTYFGRNSLGGAVSINTVRPKDRFEAEVSGSYGSFDTWDFRGILNVPLAEGLYVRGAYLHSESGGVVKNVNPNGAPDSGYVDNTARFALRAEPGSGLTIDASLSYTRENAGLDDTVPSGVIDNDTKQTLGNANLMPISQGLGFYPENQRLVNHNAPEYNRNRFLIANMRVKYEGELVDLSSVTGYLYSRNSRLFDQDNISADIFNRVVKGHTKSYSQELRIASKPGSSFKWTFGGLAARDYLEQFSNVYVGSARTYTDPLTGVTTRYLPDRFPDGFPLNQRNRTSKVNSYAVFGEGVYRLGRVSFTLGARYTRDKVQATQFGVLASNVPLPDAGASSSFNDFSPRLVVNYDVNDDVHLYTSVSSGYKAGGVDINRSVVRAFKPEKLWSYEAGFKTQLLDRRLRVNGALYYLDWKNIQVVSAFLADPNDISSSTQLTLNASKATSKGAELEVQALPMRGLQLGLNAGYLDAKFGAFPDAVVFGGGQFDLTGKRVPKSPKWNLSGNAEYGFDLTSSADAYVRAEAVYRSSLEGNLDATAAPLQGLAPFPYLSPSYTVVNVRAGLNAGPISAQVFVENLFKKDYFSGTYDHFGLAGIRLKPHPRLWGLRLTWKTN

SEQ ID NO: 6984 - protein, 769 aa, Vibrio sp. AND4
MTRTKLLKSSASHLALMAGLAVSITSFAAVAQEPKPAVPQSEAEADGATVTAPINVQGNTEGDYKVDDLSSAKQTAPILDTPQTVTVVPQEVIREQAARNLTEVLKSTPGISFNGGENGFGTSANNFSLRGFDTSGSVFIDGARDSGSYTRDVFNVEQVEVFKGPAADNGRGGAGGYVNIVTKSPQLDDFIAGTVSYGFDEYDSEDRKRATVDVNQRIGQNSAIRINALMEDSGIPGREIAEQKAWGIAPSLAFGLGTEFRAIFSYEHVERNDLPEWGVPGAAYSDMNANNPDGQAAFDPALAGMSRDAFFGLSSDFDDVDSDAVIARFEYDLAPTATLSNQTRWSVTDRTARYTLPTGNAGGGVINTQTQFYDRENTSLSNLTDLSLRFTTGMLRHHVSAGIELTKEESEATRFGAVNSTTSAFNPDPNRAPGAPFVPASTADVEVKTIAAYAYDTMEIDPKWQVTGGVRAERYEVEIVSSDASIAGGNTYDDSETLLGGKIGLVHKPVSNGSVYVSFGMSEQPYGSFLSNPDISRTGANAFPGFVPGAKPITAYNYEVGTKWDLFGDRLLATAALFRTEKKDVAFSSGGALLGYGQQIVQGLELGATGKLTEEWNVFGGLLLMDSERKHDPAFDAVLRAANPGDYGTATTTNGDELAFTPNVSASLWTTYRLPVGLTFGGGMRYVGSSYLGRPDDALRVIANSRYGEVPSYTVFDAMVSYEVTESIDLRLNVENLTDRTYISSSNWNGRRVMLGNPRTFIVSTSFKF

SEQ ID NO: 6985 - protein, 707 aa, Vibrio sp. AND4
MMKKTLLLSLSLSFLLHAEDDGFYTSVGYQIGEAAQMVTNTKGIQQLSENYEKLNNFLNNYSTLNTLIKLSADPSAINDARDNLGSSGRNLLDVKTNSPAYQAVLLALNAAVGLWQVTSYAFTACGPGNNENANGGIQTFNNVPGQNTTTITCNSYYEPGHGGPISTANYAIINKAYQIIQKALTANGSNGDGVPVLSNTTTKLDFTINGDKRTGGSPNTPEKFPWSDGKYIHTQWINTTSTPTETKINTENNAQELLKQASIIITTLNEACPNFQNGGSGYWQGISGNGTMCGMFANEISAIQGMIANVQEAVAQSKIVSENAQNQNNLDTGKPFNPYTDAKFAQSMLKNAQAQAEILNQAEQVVKNFEKIPKNFVSDSLGVCYEVQGGERRGTNPGQVTSNTWGAGCAYVGQTITNLENSIAHFGTQEQQIQQAENIADTLVNFKSRYSELGNTYNSITTALSKVPNAQSLQNVVSKKNNPYSPQGIETNYYLNQNSYNQIQTINQELGRNPFRKVGIVGSQTNNGAMNGIGIQVGYKQFFGQKRKWGARYYGFFDYNHAFIKSSFFNSASDVWTYGFGADALYNFINDKATNFLGKNNKLSFGLFGGIALAGTSWLNSEYVNLATMNNVYNAKMNVANFQFLFNMGVRMNLARSKKKGSDHAAQHGIELGLKIPTINTNYYSFMGAELKYRRLYSVYLNYVFAY

SEQ ID NO: 6986 - protein, 450 aa, Vibrio sp. AND4
MKKTVLTLAISALVVGSTAPVNAAGFQLAEYSATGQGRAFAGEAAMADNASTQARNPAMLSYLEGQQVSLGGIYVMTNVDVDGDVSLRSPLFGSAEVVIPADGKDVAASALVPNFYYANPLNEDWTLGLGVNSNYGLATEVPADHAAAIFGSHTSVKTVEFNPNLAYRVNDAFTLGAGARLVYGEGEISASTPAWISAIGSHPNVPASIAARLPSAGTQLKSMQGDDIGYGWTLGSSWQINPSHRLGLAYHSGVELELAGSAAGLSYTGGQDVAIEGYLPLELPAFAELASYHELTEKLAIHTSVNWTQWSVFERLVAHFPGDVKPVGNLETDLVKEENFKDNWRFALGSSYQASNALLVRAGVALDKTAVDDAHRTTTIPDSDRLWLSTGAAYQVSKNLMIDFAVTYIRSIGDAPISESQNLLGLAEIGFNGEASGDVWLVGSQLSYTF

SEQ ID NO: 6987 - protein, 715 aa, Vibrio sp. AND4
MTTHTRFKYSSLAVALLTAFSAQALAEETVTAPDSNIETVTIMGKAYRNTATKSALEPEETPQGITVIDEEQLEQRGVQSLNQALRYAPGVVTEQKGASVTMYDTFSIRGFSNNQSYYDGLILPFLTGWNLQPQIDPIAIQQVEVFKGPTSVLYGSMPPGGMVNMIAKAPQEDGSTKVGVSTGSRNLMEASIDTSGQLGDSDFSYRLVALARKQDSQVDNAEEERYVIAPSLDWQVSDRTLINFNLYYQNDPSMGTNSAMPLEVLKASDPSVSMGDKNWSTFEREVLMLGYKINHQINDNWTFLQNARYSDASLYQENTYHRGTNFNAATGSLIRNVYSTDEDSQSFVIDNQVSGRVEVAGLEHNLLFGLDYLKLTGDSLYKEFDANSSFGDFNAYNPNNDLLDKSQLQENYRESHDITTEQLGLYFQDQVRYDALVLLAGGRYDMFKASDDKTSTYPTSDGTEKADHNQFSYRVGALYELDNGISPFVSYATSFEPAAGTDINGNSLKPQLGEQVEFGVKYLSADMAQQLTASYFYITKKDSIAADPSDPTYRSKIQLGEVRSQGVEVEGRWFVTEDWDVNASYTYVDMEVTEDANPDLEGTTPIYVPTHAANLWSNYYVYGGALSGTRFSAGARYMGEMEMDATNTQGKVPSYTVVDLSVGYDLGEASETLSGATANLLVNNLFNEEYYTCYDQSNCWFGAEQSVELSVNYEF

SEQ ID NO: 6988 - protein, 304 aa, Vibrio sp. AND4
MKNLTKFVALGSLLSCAAAQAGGLYLYETSTTDIGLASAGMAARAQDASVMTANPAGLSNVAGQSFSGHLISLYGDTMLDTVGGGDAGNIIGYVPLGSAFYSQQVNDKWTLGIGMYGNYGLGLEYDKLFNRIDIPNAITQALTVQPSASYRINDQWSVGAALGIHYGILDMDVKVDGTTIAGGVEDTDTQVNGRVGVLYELNSGTRLGLSYSNETEFEFDDKDFSTSAVAPQQLVFSAYHELNDKLAVMGNLNWQDWSAYQTLMDVETQDTYQVALGTQYKVNSKMMWNAGFVFDLSKYRFCCL

SEQ ID NO: 6989 - protein, 791 aa, Vibrio sp. AND4
MFLRVYPKLRYALCFPLLAETCYSEERTLNKVTTQAKRIFTYNNEFKVTSKELDQRQSNEVKDLFRTNPDVNVGGGSVMGQKIYVRGVEDRLLRVTVDGAAQNGNIYHHQGNTVIDPGMLKSVEVTKGAANASAGPGAIAGVIKMETKGAADFIPRGKNYAASGAVSFYTNFGDRETFRSAYQNAHFDIIAYYTHQNIFYYRSGATAMKNLFNPTQADKEPGTPSEQNNALIKMNGYLSDRDTLTFSWNMTRDNATRPLRSNAIGLAYPCEAPFSPDSSQGCPNVLDSFTRYMYHSINSANNLSLQYKREAGNSFGDPRLDFTLYTSIRNAQFDPLFDPNGVYAKFPTSLASAWEKENYPCVEGAYCTPSFSDVDKPSSQPRNLFLNNTGLNLKVAHVIDEATDSLFEYGFNYQNLSVFDARIPKSELYRPNQVYTDDKGQKQIACSLVNNNPNDPTLCQRGKANGNIYGGYVQANYSPHKIITFGAGVRWDAYTLYDKDWNHRYTQGFSPSAALVLSPIEPLSLKITYSQVTRGVMPGDGVYMRQNDLRYAKNIKPEVGSNAEFNIDYSSQYFSGRAAAFYQALDNFISQYAQNLIVTNLSQAIRIYGYEVGGTFRYKGVSLNVGVSRTWPTTRGYLMADSYELAASTGNVFIIKLDYTIPKTGINLAWLSRFVTGLDYCGFDIYLPDYGTAEKPKTPTDLAKCGSQLGLVHMHKPGYGVSNFYINWSPKTKSRWKGLLLSAVFNNVFNKFYVDQTSPYVMSPDMPGTDAVKRAIAEPGFNARFEVAYKW

SEQ ID NO: 6990 - protein, 734 aa, Vibrio sp. AND4
MKKTALLVFLLAFPALASASEISEAYPSAEEVTVTGKKGDILQQVTGRESELLNPSQMSVYKAINLMPSLSQQSVDPYGLADIVNYHESFRFRGVEATSGGVPATTVNVEGLPVTGRPGGGATIYDLENFSNINIYTGVMPASAGLGLADVGGKINMEIRRPEESFGVLFKQGFGSNDFRRTFLRVDTGALPGDVKSFISFSDAAADKWKGEGDSQRRNVMAGVTKTFGDNVKLEAFVTYSKGDIHAYRPFSYAQIGNLESAYTIDYGTNPDSYDYYGYNRNEFEDWMVMANLEVKTGEHSKLDIKPYYWSDKGYYLETITLANNQNRIRRWDIDHDLKGVLAEYTTTIGSVDLDFGYLYHTQVRPGPPTSWKNYKVVNGKPVFDQWNILSNSSSHELHSPFLEATYRFGSWKLEGGLKYINYTLPSIITYNTAGLGDLSYDEALAGNPSINAKASALDTKSFSRLFPNLTLTRFIGDNISLHAAYGENYVTHVDIYPYFISQSANFIQKGISFQQLWDAREMETSQNFELGMRVKGSNWSIAPTIYYALHNNKQAVLYDPVLDATYPMNNADAEGYGFELEAEYKPLENLSCYGSFSWNRFSFSQDINSDAPGGGIIKVKGEQVPDAPEFLAKGMVSYKAGDFLITPIVRYTSVRYGDVLHNEKIDSTTLFDLDLTWQKKMLGFKEVEISLSLLNIFDKQYVSMISTSDYKTLKTSYQAGMPFTVMATLAVHY

SEQ ID NO: 6991 - protein, 439 aa, Vibrio sp. AND4
MKTNKTFLSTAVALSLLGTSGMANAAGFQLAEYSATGLGRAYAGEAAMADNASSQWRNPAMLTYLEGTQVSVGAIYVNPNIDINGQTTLKHPVNQSVINSSSTSSDDFAHDAIIPNFYLSHQYNEQFAIGLAFGTNYGMETDLGKGFAASHFGNEASVTTMEANLNAAYKINNAVSIGGGIRYIIGEGSFGATTPKVNVLQKPQGTTLKYMEGDDTAWGWQLGTAWQINENNRIGFTYKSEVELKLEGHAEGLGFGFGTPKLPQLRDNGYMYLNLPATAELASFHQVTDQLALHASFNWTDWSSFEKLEAHLETAGTHMVKVENWEDNYRFAVGATYQLQPKVALRTGIAYDTSAVSDKNRTITIPETDRTWLSIGATYDWTKDFSLDAGFTYIIAKDAPIVESRGYKSDDSAEVVGGQFVGETTGNVWLIGVQANYRF

SEQ ID NO: 6992 - protein, 424 aa, Vibrio sp. AND4
MTQNTRLFKKTLLAVTVAMASGQAMAAGFQLNAQSATGIGRAFAGDAVIADNASVMARNPAAMALFDKMELSLGFETITTDISAKNVTYKSPFGQTLDNTSYDDIGSTSVAPNIHLIVPVNDKFAWGVNAYSNFGTKTEFSNDLVWSEYGGLTDVKSVNVGVAGSYRLNDQWSFGAGIDLIYGTGKLQRTQGWDFAGVPGLVPGVPKGTTLLDADAAGFGVGFNLGTVFELDENNRFGFSYRYSPEIEAEGDITYVYAGQKDSNGKLNLPLPDMAEFSGYHKIKDTKFAVHYSVQWIGWSAFDTLDGTVNGTDQTFNEYEWQDGWHYAIGGTYYMNSNWTLRTGYMYDTSAQDQKTSVSVPDSDRQWFSAGATYHIDSKSNVDIGFTYLVGEDVKVQEDSGLGSIEATTRADAILFGLQYSRSF

SEQ ID NO: 6993 - protein, 316 aa, Vibrio sp. AND4
MKKTLVALAVAAVAASASATTVYNQNGTKVEVGGRLDVMLGKFGKDQRADLRNNDSRLEFKVEHEIQNGLKALGFYRLGLGKKDSDRSFDDIETKKLWLGLEQDGVGRVTFGKQDTTADAVQMNDHAYIFGGNNNLVDSGDKVISFRSADWKLAEGQTLGFGLDYGFGSSKKENKDNTYGVSAFYAGQFGDFTAGLNAGYTFEKMVDGKKTKSWRVATQAGFGPASFGVEYGQSKKPDNVKEKSLLVGAKYGVLPDVSNLYAQYQHNKKGNEKAEKVYIVGADYAFNKNVVAYAEFANKRQDDKENKYAAGLRVYF

SEQ ID NO: 6994 - protein, 866 aa, Vibrio sp. AND4
MYKNTTALSVAISLALGTAAVVAPATALAEEQQVEKLQKMKVTGSRISTTDMEGPSPVTVINSKDIESKGFNSAQDVLNSLTQNTGGVMAQTNSFSFTPAAQSVNLRGLGASRTLILIDGRRLPQYPLAQDGTSNFQDIGQIPVAAIERVEVMTDSGSAIYGSDAIGGVVNFILKKDFDGVSVKVRAGDATDGGYQNGRLDVVAGKDFDDKRILFVGQFAGNEMLKQSDRDDWAGDDGSSRSQLSGYSSYGANFEGANGTLLTPADAGSSCKEVVGDAAIERADGKCGVNRSAYRTLKPENKQVDLLLRGEMDINDNVTAMAEARFGYKSTESEFEPNPYSVEVDATHFRGEGEYTRRMVEFGPRESNTEADSFGLTLGLNGLLADTYDWDLSAGYSEQSVETSNPAIYLTLDQAVQNGDVDLLGPISQDVVNKYSGTSSKEAYSKLYSVNGSLAGDLVELPAGMSGVAVYGEWNRTDYNETIDATTAAGGFSGLGGTSGGGDRDQIGLGVEALIPIIEDLEMRVAGRYDHYFDDSATGGAFTPKVALAYRPTDTLLLRGSYGLGFRAPDLKRLFGDQTRGFGSGFDPVLCANAGGSGPQDKDKYPECDTQYFDTLNGPNSELKEETSTNINLGLAWEPVDDLGVTVDWYHIKMEDVVTAPTYQDVINDPGKYPGTEVVRNTDGTIKSVSYGPVNQSYEERSGVDLAVKYAYDTNEFGSFNTRVAVTKILIAEYQENDSEPVTDERDFMPEYTATLNLGWAYEDVAINLFGKYRDRMCSSYANRYYFDDCDSAKKAGYKAEIASMTTWNLTASYQFNESGRVTLGAINMFDKVPPADPLNDTSPFYATGYDDPIGRQLYIEASYDF

SEQ ID NO: 6995 - protein, 389 aa, Vibrio sp. AND4
MKKTLLALIIPSLLLTGTSQAVELYNDQTNSVNMIGWLGFTALNDGHETSVIDNFSRVGFRFDRQEKNGWSSFAHTEWGINMVTSDDGLIYTQGQGGGQLSASKNSDFLFNRLGYVGMSHEKWGKISFGKQWGAYYDVAYTTDVLNAFTGWSVGAYTFGDGGLTGAGRADAALQYRNTFGNLHVAVQYASKQNSDVALYDGNGAPLKDGSELSFEPSYGASVTYNFTDKFKVLVGFNRGDFTGNLAGQEVDNTNQIIGIGAQYGSFYQYAPGRDADGLYVGFNAHKSEQNELVGGDLYDSTGAEFIVAYQYDSGFVPTILLTYQDLDTDENTAVQGKWARQFAVLGLHYRYSRDTIMYVEAKIDFSNMDDKAYEDLQENNYAVGIRYFF

SEQ ID NO: 6996 - protein, 195 aa, Vibrio sp. AND4
MKKVLPLLALGAVVASASVQAKGNWYVGADLVNSDLKVKSLSKDFSATGLSFAVGKELQYSENFKLAFEGEYIYFGDFEETFSYMGWPVKFSVDASAFNFNAKPKYQFAGTGFYVGAIAGLGVMSVSYEVKSSSTVTDDGRDVGFNYGVEAGYEFASGLVVSGGYRASSVSIDAENGGSEDFDFDSLYVGVDYKF

SEQ ID NO: 6997 - protein, 87 aa, Vibrio sp. AND4
MRKSLLALGVVAAVASVPASAEYLYGFGGVYLDHQSWDHGFSPVNDNVGDQRNQFVLGLEGGAGFTWGELYGFYDRESVEKSSSEQK

SEQ ID NO: 6998 - protein, 1291 aa, Vibrio sp. AND4
MDKNIINGSFIIKEGEVESVGNGETSKGTLIDEYGLQSIEYGGQTEEVKVYGGEQIILGEGSYAYSSKIQGKGETLGQQNVYDDGVALFTDVMSGGEQNLSTWLGDIGGLAVDTRVFAAGVQNVFAGGRANTVTLEEGALQRVYAGGYVETLMINSGANSLVYSGAILEGAVKINGSGKLHLYAGDGGHQTTAEEILLNGKEAQLYSIATEVNGSSSLIGKLSGNGSVIFTSTATSPDSTKLNSYYSLLYVGDLSGSLHFNLRVNVKERYGDYLIIEEGAGDHTVSVLDSGAEIANNSFQSVNLITDKSGNAHFSLKNRSGEKAATIDGGAYMYSLQQKKGNDGEKKIWYLASAEKVSTSLTTSSNMGLPINGSLGKEEDVTVSQDPIVSSYASDFSFYPDDFIMEKEEESLQSSIISEDSVHISDDGESDDPKWSINTMVEGAGTLYVEAGGFSKNTTIEHGGSEIVAEQGISESTIVYEGGKQNVEGGGVTLKAQIYGGEQLIFGDGYVNGSIAGSSAYNTTIYGQGEIPGYQSVYDDGMAVGTKIMEGGIQTLAKWFSEDDTFAQKSGGLAINTEVFAGGMQRILAGGEADTVTLYTGAVQVVHAGGYVKNLTIENRANSWVSAGAMLEGKITVKDSGQLHLDAGDNDHQTTVEDIDLSGENARLYSISDEFDDKSSYIQKLSGVGEIVFTSAGNDLYYSRLYIDNLSGSMHFNFNVSLAEEKGDYLSIKNGSGYHTISIIDSGIEIANPSSTELDLIVDQSGGAHFTLQNLSGAKVKPVDAGTYLYGLKQKNGDDGNKKIWYLSAVYIDSVQRRGRFFRHLNQNQPISVLSTSLASEEQAAEILCQRGRCRSLRQKPLSSVHPFNAVVGLRKNNIHQNLDQKPSGFDSSTVSISKNQFFEVSYRNHIHQNITKDPQFSSSTSSLEKPASDTSSPTGHYHSSDEQQQSVVSTDGQSLADQMILRPGQQGSSSPQSSQKLSVSHFLTTPSTDAVLSMSVTPALVFHNELQAVRAGRGILDRGKKNTAFWAHAIKSKEHIVADHKDFKLDQTGIVLGVSGVSELMGGEFYIGGFGSYDQARVAHARGGVSGINTYSIGAYATYFDKSGWYLDSILKYNQYQNNLKAVSTNGIAIEGNYNQWGLGTSFEAGYRFETTKSSWMQPYAQLSWLQVEGKEIKLSNEMTGDINAFTSLRSEVGLSAGYEFCLGGDVTSMAYITAAWLRENRDSNRTTINKLHQFVTDLSGNFGKLGIGLSSLVSKKFKLYAEAQYVKGDKVKQSFQGILGVRYSF

SEQ ID NO: 6999 - protein, 250 aa, Vibrio sp. AND4
MNKKWLLLALFAAPQAMADDMIHWWDASVTALYGDNYDLAPSDKQTTFTFETAGAWQYGDWFAFQDLIYFNGSNVSSDSTTYGEISTRLSAGKISGKEIGFGPVTDLSLAMTFEEGEGPVKSFLYGLGMDIAIPYFSYFQLNTYRREAISSGNISDGWQITPAFRMDFPVGNSNIVFDGFFDWVFSADNQGYEENFHFNPQLKYDLGAVIFGSHEKNKFLVGVEYDYWKNKYGVKGVDQNTYSVIAKYHF

SEQ ID NO: 7000 - protein, 326 aa, Vibrio sp. AND4
MKKIAIAVATVLAGGVISNVALADTYMGGKVGYNSLNDACYLNEPCDDDSFAASMHLGYSFNKYVAAEYGVDYLGDFTANFKKPGLNTVDGDLWALTLAPKFNLPLTDSWNLFAKVGAAYMMAGDEKDFVPTGSLGAEYQINYNWSLRAEYQRYQDMSDDVIEDMDSDFFGIGFNYKFGSEPVVQEKAVEEVVEARPATRIVDHVYPAQTTATVQFDLESAEVKDASNLSGTVDLMNTYPQAQVEITGYSDTTGSAAYNKQLTEKRAKAVADEFQAKGIAAERMTVKGMGEANPVASNETRQGRQMNRRVEVVVPAFEYQTTEKAE

SEQ ID NO: 7001 - protein, 204 aa, Vibrio sp. AND4
MTNKSILTLVIAGTISFGAQSEPYLGASLGLASFKNAVGNANTSFGSGSMDLALDDDQSVAGSIYGGYKFNSFLALEGAIGGYDALEDTYVTVGNMYFLSVQPKLSFSLTDTFELYAKAGVAYFNAEFKVSNALVNAPGYSTLSDSTLTGMYGLGAELKLSPTFHIRASWDFMRPELDVVKVGTENISIESDISVFSLGASYHF

SEQ ID NO: 7002 - protein, 697 aa, Vibrio sp. AND4
MFTKSHLALVIGAVLATPAVAEVQTDEHVVVEGREFGYKADTNSTAMRMEMTQLETPGQVAVIDETVIDEQRASTLGEVLRNDASVSAGGTSRNRERFSLRGFELSSSDGFLRDGRQHWSHYRQPIELLERVEVLKGPSGLLYGKSEPGGLVNMVSKKPTTQTQASLSQDLGSNDHSRTVLDVSGALNDAETLRARAIFAKESYGSWRRYGDGTEPKTDRTVAGLVVEYDITDNFMVSAHYDRTKDDGSVDSGAYIVDGKAVRGDKYIWDAQWSEIDNEVENYGVDINAQVTDNVNVKAGYNRQDFKRFDVESYPGFETYDQDTKIDHSGNERKDNWVFDTAYIDVTTDFSLFGTDNTFLVGANYLEYTYDRFQKYYNPISIEAGQTVPRPGYSGKVKQSTSEHDTWGIYAQNMMTINDYWQVLAGVRYDEKRDDELTENQVSPKLGVIFHPSTNGSVYVQYSESFMPQGEVSNGSRTYINEGEKLDAERGISYEIGTKWELFDQRLFVSGAVFDITLENMSLDVESGKDASNKVLHKKTQGGEQVHKGAELMAQGFVTPELSLTASAMYLDAELKKAERYEGNRPVDVPEFSASLWSSYKVQDNTNLNLGLIYEGDRYGDAANTFKKDGYARVDMGVSYKHKYDENLDIIARFNVENLFDTDYFAGGGSTNSEQKGASGVVVGEGRNYMATIQFKY

SEQ ID NO: 7003 - protein, 331 aa, Vibrio sp. AND4
MKMKTLAVAVAALACGSQAFAAEVYNSDGTSLSIGGHVSVGVGEYYEEDVKVHQVSPRINVAGKKDIGNGITIDAKGEWALNYLNGGEQSFKTRLGYIGATHEQYGRLVAGTQWSPYYDVAGVADLPIAFANDFLYDNHGNLGSARADKMLSYRKGFEFGEGFAFNLGLGWQGEQTSDATTYEQRGQVALSGSVAGFGLGYVYSGGDVKNATLGTKNAESHLFSVNYGQYGSGLYAAVVYGMNDYFYEMRKETSQIEALLAYGVNDWTFSVNYEGVEDEEDNKTVSSETALQAEYAVTPAFVTFAAYQFDLGNDYTSEENDYWTLGARYYF

SEQ ID NO: 7004 - protein, 171 aa, Vibrio sp. AND4
MINKRPWLGALSAISLGLCSFSASADFYAGALVSYSNAEFHHSSSSVTEGNPFLLQAQAGYFFNDYLAFEARYGTSVQRDSGLAVDSLASGFIKLNMPVSERIALYGLAGYSSVQIDQQNVGSNKDQGFSFGLGMHYALDKQNAVVFEFVDSTSEDQVRLNALTLGFQHRF

SEQ ID NO: 7005 - protein, 627 aa, Vibrio sp. AND4
MRKTRLLAGVAALSLMAAPAAKAGNLYVFGDSLSDDGNLYKLTGLPPAPYYQGRFSNGPVWVEYLPGLTGLGFSSANDYAYGGAFTGALTIGTTNAGTNLEAAALPGISTEIASFTAAGGSFGANDVVTLWGGANNYFAYAAAVQANPAAATALVTQGVTTTITQLTQDTTALINLGARMLIVPNLPDLGLTPNFNTTAQGVALGDAFSQAHDGALPTEMQLLHQGTGGEYHRAEYRGAAEPGGGAASLYGFTNVTNACLYTVSCVTGSIATQNSYLFWDNVHPTTHAHQIIAEYAAASLQGFESLTVPARVNANAAESFAGLLNARLDALQNGASGASYDINGVNGGTADPAHKVAMFLSVTGQFGTRKTEGLIAAIIIRSAVTALGVDMRVNEHLTAGVSLAYNNTHANVSGGGTVQDNGVDVGLYALATSGDAYAKLYAAWDHDNDKTQRNGVIGGITGKPSGTSWSAGGAVGLKFHPTTTIAVGPEFGLGYTQSGLGNYTETGDALLTQSVNSQSYKQLVASAGGTVATSVSLGGVALAPHAGAAAEFLLAGPNQRFSSAFTDVPGVTLTNSYPHQTGSWGLFNLGVSATFTQRFSASLEAATTAFKSDGNDTQVTGNVLWRF

SEQ ID NO: 7006 - protein, 373 aa, Vibrio sp. AND4
MSYLKKSLLATAITGMMFSGAALADGANSDAAKEYLTKDSFSYEVYGIIAMQAAYRDYDSGSKATDDDLGGMQLNNESRIGFRGKKQFANFGPTFIWQIEGGYVDPSFGGEGAGLGERDTFVGFESASWGQVRLGRVLTPMYELVDWPASNPGLGDVYDWGGAIGGAKYQDRQSNTIRWDSPMYADKFSLDIAAGAGDKAGLGAGDDYWGGIAAHYKLGPLQLDAAYEGNRNIESEGQTWENNTYLVGVQGWFDNGISFFAQYKYMEADASNGVNEKQDAMSAGLMYTTGDWQYKLGYAANFDLERDGKTINDTADDVLSAQVMYFVDPSAVLYVRARTLDFGDGASQLDKPAEARWKSADYDEFSVGVEYYF

SEQ ID NO: 7007 - protein, 624 aa, Vibrio sp. AND4
MTIKKYTLLTALSVTAFSGWAQGNNTTDNNNEMVVTANRFPQPKSSVLAPVDVVTRADIDRWQSTNINDVLRRLPGINIAQYGGPRQLSSLFIRGTNSSHVLVLVDGVRLNQAGISGSSDLSQIPISLVQRIEYIRGPRSAVYGSDAIGGVVNIITERETLGSTLTAGLGSNGYQNYNGSTQQKLGDDTTITLAGNYDYSKGYDVVAKGNTGMASQPDRDGYLGKMLWLGANHKFNEQFSGFVRGYGFDNRSDYDSYYYPGSPLVDTRSLSSRTYDTGINFSNGGYASQLIGSYSRTQDYNYDPSYGRYDQSATLDDISQYNLQWTNTYQLGLGNVGGGLDWQKQTTEPGTNYLSNGYEQRNTGVYGTVQQFVGPVTLEGAIRGDDNSQFGWHTTWQSSAGWEFVDGYRLIGSYGTAFKAPNLGQIYSSTYGNRDLKPEESTQWEAAITGITGPLDWRLSAYRNDIDQMIATRGVYPNSRYYNVEKATIKGVEWTGSFETGPLSHQVTLEYLDPRNADTHEILARRAKQQVKYQLDWQMADLDWSVTYQYIGQRYDSVFDPITYAASPVKLAGISLWDLAVSYPVTSHLTVRGRIANLFDKDYEMVYGYQTPGREYYFTGSYNF

SEQ ID NO: 7008 - protein, 555 aa, Alpha proteobacterium BAL199
MKGKSGNEAFQLGAESASYGFFKLFCCAARYVQIINKKLGKFMKYFVKSKIAMSIAGTLSLGLALPAMAGTLDEIIVTGKPGSGVSKFESTVSVNTLSADEVMKMAPRSAAEVLRAIPGVRSESSAGEGNTNIAVRGVPIASGGSKFVQLQEDGMPILQFGDIIVGTSDQFLRLDDTLQRVEVLKGSSAATLASNAPAGVINFISKTGEVEGGSVTVSTGLDYDLFKTSFDYGGALNEDWRFHVGGFYREGEGAREVGFNASKGGQIKANLTREFENGYFRLYAKYLNDSVPTYLPMPIKASQDSISGFDAGSGSNISNDLRDVLSVGATGGGRRSGIDNGNHSDSTSFGAEFVMNLSDDLTLTEKFRYSQNSGTFFGAFTASIGGASDVAGISSALADTGANGLGYVSGANAGVELTAAELANLNGNGLIQNIRTFDNDLESLDNFTNDLQLTKSFDDMTVTFGYYKATQEIDVNWYWQTFVQDVSNNARLMNVYADGVQLTENGQLAYSQPDWGGCCTRDTALEADLDAVYIAINRHVSDALTIDASIRYDSG

SEQ ID NO: 7009 - protein, 711 aa, Alpha proteobacterium BAL199
MVRFYENTIMKIKQLAQLCALIPMSLFAQETTEKVQDTTVTKPVALNTVIVTGQGATDPVLTTVRTDLVKKVVQPKNVADLFNDFNGFSLIKRGNYAIDPSFRASQYEQLNIQFDGGTKAMHACPNRMDPITTHVVPEDIERIEVIKGPYTVRYGATFGGIINLVTEKPIHLDNGFHGGVSSGYETNGNALVSSLKLHQITDKYDITANAGYRDFGNYEDGDGTEIPSSFRSLDYGLRLGYNIKDNQRIQAHWRQSYGRDVLHAGLPMDTDEDNSSILSIDYKFSKVNDFIEEINAKAYYSYVDHIMSNNRRPSFMMTGAISTIDATTAGGKVEFKMNPTEKWILYGGLDALLIARDGGRTRTVKRNMMGDLLPEPMVFQDKVWQDSYVNDYGLFAENKYAFSNKTMLTAGVRYDLVLSDIQDPEADFQALYTDLAQRKEHNVSATVSVKHKLSGNNTLEIACGRGVRSANMIERYINHFQVGQDPFEYVGNPNLDAEVNNQFEIGFKGKRTFEKGIDAVRYSISGYYSIYENYIVPVVDPTLDRKFNPTAQPQEVKRFINIDDAYKTGFEAEASIVIANYFNFNTAFSYVYTRNNDLDESLPLTPPFITRLGLGFEKEKFWANLDYTITSKQDEISTSFREIETAGYETLDLRLGVIPYKNVQLGVAVLNIFDATYNNHLNFSFVNQADFTRVPINDPGRNFSVFAHYKF

SEQ ID NO: 7010 - protein, 755 aa, Alpha proteobacterium BAL199
MHRSTLARQPIFAALIGAVGLSAATAHADSSPSHTAASSVTADAAAARASSALLDPVTVTATRTATAASRTAASVSVIDADDLDEQQATNIKDALRYEPGITVRRTAYRPGNAALGGGRDGDSSINIRGLEGNRVMLMEDGIRLPNAFSFGPLEAGRGDYTDLDTLKRIEIVRGPASALYGSDGLTGAVNFITKDPQDLLSIYHKPTYFSFRPSYDSTDRSIGATVSAAGGNDRIQGMIIADGRRGHEIDTRGSNNSAGKLRTTSNPQHVYSESLLGKLVLTPTVRDTIRLTAETVQRRVGTDVLSAIVAPATLGLTTSDRLERNRFSADYAFHDDASRWLQNAHVQFYYQEATQDQYAFETRGTLPSRSRDNRYRERTFGGSAFAESGFSTGPLAHKLLGGVDGSLSRITNLRDGTVPGVGETFPNKAFPDTDYTLFGAFVQDQIGYGRLLVTPGLRFDTYRLKPSGNDPLFTGRAVSTHANELSPRVAVLYEIAPALIPYLQYAHGFRAPTPDQVNSSFSNPVQGYTSIGNPNLKPETSDTFEAGLRGRAGTGYGTIRYSAAAFTGRYRNFIARTTIAGSGRPTDPFVFQYVNFADARVHGIEGRADWAMPNGITLRTALALTRGSTQNDGAASQPLNTVNPFSAVFGVRYEPTERWFVQTDLLFQAAKRDKDIDRSDCSKRACFAPPSSFVVDLRGGYRFNKHVSATVGIRNLFDRKYWNWSDVRGIAADSPVLDAYTSPGRTVAVSMKVDF

SEQ ID NO: 7011 - protein, 163 aa, Alpha proteobacterium BAL199
MKKVLLGMAIIAASASVQADSAVTLGYAQSALKEASNSNGFALGYSYVPAGQKLGVITSVLHTRGDDNSNGIKTNYTMTSLSVGPMYSVTESLDVYSTLGFMTGKADIKSDSVKGTVRDTATTLGAGIQYSFENNFVTKLGMEKTLNNDIDAINFIIGGGYRF

SEQ ID NO: 7012 - protein, 363 aa, Alpha proteobacterium BAL199
MKSCAHRSLRAAVLTGSAAVAGLAAGAAHAQSSVTMYGIMDAGIEFTNHAAPQGGNSVKLKSGNKNTSRWGLRGVEDLGGGLKAVFRLESGIDLANGASDDGPDSIFARRATVGLKGKWGELSLGRNFTVTYDYMLPFDPMGYAQNYSWATSSMATGGRKDGLFTRSSNAVRYDGEFSGFKFGALYGFGNVPGSMKTSSKYDFAVGYETGPFAAVVTFDRQNGAADSVTPADTVNYIQGIHAGLSYDFGNLKTMAGYRNYRRTFHTTAANQLSDMYWLGGSYQFTPTFSLIAAVYHQNIKGGTDADPTLVSVRANYALSKRTVLYAAGAFAIAKHDQKVGVSRDFAGYGTTQVGVTAGIQQRF

SEQ ID NO: 7013 - protein, 402 aa, Flavobacteriales bacterium ALC-1
MKLKLTSMLVAIIVSPSVFSEVNIYTDERNSMSVGGFIDVRVINTQNQTEVVNGTSRINFKIDRKLKQGWKALGLVEWGVNPVGSSDIIYNNRFESIQDEFLYNRLGYAGLSHDKYGQITIGKQWGAWYDVVYGTNNSFVWDGNAAGVYTYNKDDGAVNGTGRGDKLIQYRSSYNDLSFTLQAQLKNSEFYTCDVSDITEQECETLWNAGDTAAQQVEFNYTFGASVTYTPTDMLTLTAGVNRGEFDLTYGDGTTQNVEDLIYGAGIMWGHVDQKGLYVAANINKNKNHDTDNLGRLIKDAIGIETFSSYRFDNDFRPFIAYNVFDAGDDYVIQPNFNTDPNDVFKREFAVIGVHYLIDEDTIAYIEARKDFSDFESNDKDQQAKMEQSEDDGIAFGFRYQL

SEQ ID NO: 7014 - protein, 2175 aa, Flavobacteriales bacterium ALC-1
MSAHPCPISHKHLRGVANSLAARAATSSAAHRERATVQALIRQMLISLAIAQLFLPLPGKLHAEPDPCSLQTPSSVLCNGNQSGGIATGRTLLIDGSTLQSPPVTSIDVNTLNAAVAPGSGLPGIYLHNEAGNAVTINAGTSLAPISITANGDNTGGIVVNGFGTPTQTNNFFGLPLPSGSGGTGGNVTVNSFATISTDGDQSPGISARSRAGGYSDAVVNTYKQLLGTNQGATFGISTVQGDSAKIGQAVTGSNGGTFTLKNNLLGLAPAYTYNLSGMALNNLAPGQHIDTSVSYTVTSIIGYAPSNAVLTLRVTRLADGSLSVLPATYFDVYGRAYEAPQAIAYVDGATPLSGQISLAPNFDAYMTRLLEDSAIGGAGGNVSVTTSGSITTKNALSFGQASYGILAQSKGGTGLPGGGGVFSGDTGNAGSSGGSVMVNNTATIHTFGEGAHGIVASSAGGNGGRGGGASFAGNGGAGGTGAKGGEVTVINYGNITTESTNAFGILAQTLGGQGGQGGGGGWLGGGGGAGGAGTVNDPVIVGNAGTITTFGDDSHGILVQSIGGFGGGGGGAGGIVALGSTGGNAGTGGIATILNLGKVSTAGWNANALMAQSIGGGGGSAGGTGGLVALGGDGTAGGNGGMASVYNYGELNATGVGARGIVAQSIGGGGGHGGDSGGLVAIGGDGATTSDGGAVIVGNTGKITSASNAILAESIGGGGGTGGSSGGWFGVGGSGGGGGNGGTVTVANSGDLTTSGRNAAALFAQSVGGGGGNGGNVVAVGAFASVAIGGAGGNGGDSDKVVAKSTGGSIETWGVQSHGIYAQSVGGRGGNGGFAAAASAGKGLSLSLSVGRSGGGGGDGGEVQVESQSTITTHEQDAYGIYAQSVGGGGGNGGFSVAASAAVQGVAVSFSVGGKGGVAGDGKKVEVGKDAPITGKITTNGANAYGIVAQSVGGGGGHGGLAVAATLSAGTNGSGSLGLALGGEGGSGGAGGAVVVNSAATISTQGEKAYGIKAQSVGGGGGDGGLAVAGGVGGGLGSDSLKLNVAVGGSGGAGSMASTVDVDISGGSIETWGKNAHGVFAQSVGGGGGDGGIAIAGTLGLGGKNTNVSISAGGVGGTGSIGDTVTVSNAATIKTHGEAAFGIFAQSLGGGGGIGGAAFSGAGDLNIGQEGYNVNIDFAFGGKGGSGNKGGMVDITNTGTIETFGTASHGIFAESVGGGGGQGGSARTMSINAAVMPVSTLGKYASFSLNLGGKGGSGSDGNTVDIDNQGTIITHGADSHGIYAQSVGGGGGTGGEGAHGFFGIPALMFDKTPMYQQVSISMGGSGGAAGSGGAVNVIQHGNITAHEQGSDGIFAQSIGGGGGTGGVGAIGFTGTVGIGGSGGASGNGGKVDVIVDGNINTYGGAGYGVFAQSIGGGGGIGGNIDRGLATSWNVGLGIGVIRNSQNGGNGGEVTVSGSGLIHTRELGATGIFAQSVGGGGGVAGYQNQSWWGFAGSAGGNGSGDRVTVDWRGSIWTDGENAHGIYAQSAGGEAVDVVVYDENGNPTAKTLQGYQNLGKDVSVTVRGNVITSGVRSNAIYAESSGAEGKGNITVKILEQGTVKGGSGADAAGVHLVGGTQNLIENTGYIGTVSGISGLAIAGDTGNDVVSSSGTVTGSVSLGTGTNAFTNALGGLFNSGPLVDLGAGNQLINSGTLAPGGLGSAATTTLTGNLRQNSSGSLAVDLSLAGRASDLLNIVGAAQVDGKLSVRPVDTGFARPGTLRSVVLTASDGVSAADLTLAAPHSLLTSYVLLYPSANEIAVTRSIDFAPRSLNPNAQRIGAHLNAIQATGGTASLAPYIAALFAQPDDQSLATAYEKLGPGALGTLTKSSTASSLEFNDAMHSCRQRDGDYRFIREGECSWIRFGGSIRDQERDDQNPGYRQDMVTMAGGFQKAVRENLHLGLGVSYQQSALNSVFSDVNGERFEGGMIVKQRFDATRLSLSFSAGYGHYNTRRLVDIAAPGTYAQARPTLWSGALHGRISHDIMASENAYIRPMLGLGVSYVSRDAYDETGAGGANLRVEKASDTFVSLHPAIEFGGENSIGGEGTLLRHFVRVGMTQFIGSSEHHVTASLEGAPSGVQPFTVTTTSDKTYADLVIGVDILRKSGTTVRLEYSGQFSNNSSTNAIGVKVAMPF

SEQ ID NO: 7015 - protein, 712 aa, Flavobacteriales bacterium ALC-1
MKRLPRRIRIRKAGYISGAFCLTMGLPGVSAHAQEAGALPQLNVSGQQETALGPVKGFLARKSIAATKTDTPLMQTSQNVTVITRDRLEDLNIRSIAEAMRYTAGVTDVGGRDDPRGFGGTIRGFTPDTYLDGLKLPMASASQTFDLEPYGLERIDVLRGANAALYGSGQLGGIINAVSKQPRLDHTNEVQVQGGSFNRIQGAADLGGRLTNDGSWLWRLNGLMRKSDTFVDNVLNNRIYVAPSVKWSGEKTTVTFLSSYMQIDAGSAAQFLPAIGTVFPSRYGYIRQSLNTGDPNYDVYSKREVSVGYLAEHHVTDRWTLRQNLRFMHEDLNYRTVTTTGLAANQRSITRQAQQQLNMFNTLAVDNQSEVHFATGPVTHDLLTGVNITTQFISTRRGQGTGPSLDLYAPVYRNVTAPAYASTINTNETQIQTGVYVQDQIAWQHWRLTLTGREDFVSDSLTNNKTRSTQNSDPTHFSYRAGLLYAAENGMSPYVTYATSFQPQTGVDRVGNSYVPTTGNQVEVGIKYKPVHRDIMFTVDAFDLTQQNVLTPDPNNVNFSIQTGEIRTRGAEAEATGNLTPTLRMIAALTYQEPLITSSTEKGATGSRPVFVPSHMASLYMEKEFPISERWNFALGSGVRYNGETSGAVPNTFNVPSSVQFDLTARVEMDRWRLQVNATNLADRRIVAGCVRMTSCYYATGRAVFATLGYRW

SEQ ID NO: 7016 - protein, 1018 aa, Flavobacteriales bacterium ALC-1
MKLKFSLVVIVALCFHSFVFAQDNYKVTGTVVTANDNIPFPGVNVLVVGTSNGATTDFDGNYSITVKKGDVLQFSYVGFVTQTVIVDNQQTINVGLVEDASKLDEIVVIGYGTQSREKITGAIGKVKNEDLDQIAVGTANEALVGQVAGLNVQATESEAGSESTITIRGVGSIAGRNGPLLVVDGVVLESSFLTSIDVNDIASVEVLKDASSAAIYGSRAVGGVVIITTKEGKEGKTQFTYNTFTGFKEAIKSEDYDLSVADHHARELASTGELSLRSQYRELLGVDESWQDRVFDGGKIESHFLSARGGSKRTKFNTSLSYLHDEGVLVTDDYKKYNFKFKVDTEVNDNFKFGANLSPSVTNRRRFDGSVHDILRQQPWLPTYHDANSIQFVDFNTFPDVQIGDYAQERHFDNFDLFGDGSELVDLSSTSNTNPLAKVQERHRTEENFRIYGKFYGQYKLAEGLDFRLSLGGDYQDRRQRRYEGVLASRNGASDASLEISSRNRTHILTEALLTYDKSFGSHDINVVLGTSAETFDTTYESATGIGFTNDLLQTLSAAPIISAKESYEIEERLLSYFGRVNWSFENKYLASVSLRADGSSVFGANNKYGFFPAASVGWNIAKEDFLLDSDFLSTLKLRGSYGFTGNKDLDVNNIIIESYPSLQLYGSETAVNGTAINNGFAPINIANPDLKWERVREVNAAIDFGFYNNRISGALDVYNKKSDQLLLNVPISTITGFRDALVNRGAVENRGVELELRTINITNQDFKWTTTLLGSTNKNELVDFGGASGLISNVDDKRAAEWINLQGQPISSFYGFVVDREIPEEFIVDPYRLVGAQAQDVYVKDLNGDGVIDDDDKTIIGDPYPELIWSIANDFRYKNIDFSFTFQGSYGGQVRNMTDQYIFNHFNSSQDFNQNTTPDQGFIREKIFTDAIIQDASYVALRTVSLGYTLDTSIVEKLGVRKTRVYATAQNLFFATADGYTGWNPEAIRDEGVLNEGYQRGGSPVARTISLGLNVEF

SEQ ID NO: 7017 - protein, 181 aa, Flavobacteriales bacterium ALC-1
MQAKIAASNTGELDALQQLGFSLVEGEVDLALPVNNASDSGAVVAQETDIPALRQLASAAFAQSRFRAPWYAPDASSRFYAQWIENAVRGTFDHQCLILRAASGDIRGYVSLRELNATDARIGLLAGRGAGAELMQTALNWAYARGKTTLRVATQMGNTAALKRYIQSGANVESTAYWLYR

SEQ ID NO: 7018 - protein, 1018 aa, Flavobacteriales bacterium ALC-1
MKQNLLTKIICVMFLFLGGLLHSQSISGTVNDKVDTLPGVNISVKGTNNGVQTDMDGSYTLNDVSIDDIIVFSYLGYKTQEVIYSGQLVLDITLLEDASKLDEIVVIGYGTTTVKDATGAVSTVSAKDFNQGAISSPEQLIQGKSAGVQITQSSGEPGAGIVVRIRGTGSARANNSPLFVIDGVPVSNESVSASGADIGVGSSGSRNPLNFLNPNDIESMSILKDASSTAIYGSRGANGVVIITTKSGRSAGTEGQFNFSSNVTMSETRNRFDLLSTDEFVQRGGADLGGAIDWQDFIFRTVVSTDTNLSYSRSYGKGNVRATVNYSDQLGIIEDTQLERITARVNANHRFLKDKLKVSFQGTFSRINDQVPFISRNSGSTGDLLAAAYYSNPTLTNNPDFDTAPDRNPANLLEYYDDNTNTNRFLGNLSLDYEITNEFSAKLTLGLDNSTSERGQVLGPQILAVDNGAIGNGRAAISNLDTQSQLLEFTVNYKKEFENSRLDALVGFSYQDFNRNGQNILGQGYNSSSLSDIRAITETAYSNTRNLARNYQAYGIGTFEGGTADEFRILNLFPSLNQSTAGLPSIPIDALSVDTFDNTDELQSFFGRVNYSIQDKYLFTATLRADGSSRFGPENQYGYFPSAAFAWKLNQEDFISEDMFSTLKMRLNWGLTGNQDGLGYGSFVNRTRWNTLGITQNSQLTAPANVAVADAQPDLRWEETTQFGFGIDFGFKNDRLSGSFDFYRKETRDLLLNSPSIQPAIQPFVFDNIDAVLINEGLELAIDYDIVRSDILIWNANFNIAYNRNELTEYTGPDLQAGNLFGQGLTGATTQVLTNGRSLFTYNLREVDGTEVAADPTILDKSGLPDFNAGLSTSVQYKNWDASVFFAGQFGHYVYNNTANALFATPQIGSRNNLQSVVDDGIVLSSTNPSTFFLEKGDFVRLQSAQISYNFPLSGEGDIQSLRVSASGQNLFLITGYSGLDPEVSTTNIPANGLPSASIDYLAFPRPRTFSLGVNVTF

SEQ ID NO: 7019 - protein, 1066 aa, Flavobacteriales bacterium ALC-1
MTNFKFTLLARSIAFALNASTAYAAQPTNQPTNQPTNQPTNQPTNQPTNQPTNQDSNLSEQLEQINVSGSTETINVKEKKVGETQISAKKLAKQQASDSRDLVRYETGITVVETGRTGASGYAVRGVDENRVGIMVDGLRQAETLSSQGFKELFEGYGNFNNTRNNIEIENVKTATITKGADSLKSGSGALGGSVIFETKDARDYLIDKDYYVSYKRGYQTMNNQNLKTLTLAGRSKKFDILVVDTTRDGHEIENYDYKIYPNKQADLSAVGPTREKADPYQITRQSTLIKLGFQPNENHRLSVALDDSTLETKGMDLSYAFRPYSQADKEIYGERIINDQSKRKNIQFSYENFSQTPFWDHIKLSYSSQKITNKARSDEYCHQSTCNGVSNPQGLHLVEEKGVYKIVDKDNKDFNYQEDKNNPWSYGKELYNSKNEKISNDVDTEGGALDSVLINCEKLNCEKKKFPIYKEKDEEWKDKYEHEDRDITIKELNGKKYGEISLKKSDSSGFTKYESARFLFPKSFGYSTDFVNDRDLNTNTQQIKLDLDKEFHLWHAQHQLKYGGLYEKTLKSMVNHQYNTAANVQWWADYFFCKKPVNGNRIPAPDHSAYRCKLMNSDIGKDTYLIPVTTKNNVLYFGDNVQLTSWLGLDLNYRYDHVKYLPSYDKNIPVPNGLITGLFKKFKSTDYVYGNKYLVPKGYTNCTYTTDCYKQNFEENLALLLRKTDYKHHSYNLGLNLDPTNWLRVQLKYANGFRAPTSDEIYMTFKHPQFSIQPNTDLKAETSKTKEVAFTFYKNSSYITLNAFQNDYRNFIDLVEVGERPIEEGSVVRYPFHQNQNRDRARVRGIEIASRLEMGDLLEKLQRFPLGYKFTYQKGRIKDNGLHPKYKEFLELNKDEHPEYEAIARKPQPMNALQPTTSVYNIGYDAPSQKWGVDMYITNVAAKKAKDSFNSQWTSMVARKEKIYDTESTVPAKKANGKEVKDSRGLWRNNRYTVIDTIAYWKPIKNLTFTAGVYNLTNKKYLTWDSARSVRHLGTINRVETATGKGLNRLYAPGRNYRMSVQFEF

SEQ ID NO: 7020 - protein, 767 aa, Flavobacteriales bacterium ALC-1
MNKIIILILCLCCAFTIARAEEGPALNPSDANIVGHVVDRKTGEHLSFITIFLKGTTIGTSTDGTGHYYLKNLPEGEFTVVMKTMGYKTIETPVMLKKGRTLEINFEVEEEALSLDGVVVSANRNETTRRMAPSLVNVLDSKMFETTHATSLADGLNFQPGVRVENNCQNCGFQQVRINGLEGPYTQILVDSRPIFSALTGVYGLEQIPANMIERVEIMRGGGSALFGSSAIAGTINIITKEPLRNSAQIAHSLTMIGGSRPDNNTTLNASLVTDDHKAGIYLFGQSRHRSAYDHDGDGFSELGQLEARTVGFRSYLKTSTYSKLGFEYHNISEYRRGGDQINRPPHEAWVAEQTDHSINGGGLKFDLFSKDYKHRLNVYTSAQHTNRKSYYGTNRNPDAYGHTTDMTVVAGSQYSYSVDKCLFMPAEFTGGLEYNFDELKDEMLGYNRIVDQTVHIGSLFLQNEWKNEKWSFLIGGRFDKHNLIDHLIFSPRANVRFNPTEDINLRLSYSSGFRAPQAFDEDLHVAAVGGEVAIIQLAEDLKEEKSKSISASADFYHRFGPVQLNLLVEGFYTDLSDVFFLQEKGHDDQGNLIMERRNKDGARVMGVNLEGKMAYAWLQLQAGATIQRSRYKEAVTWSETNPDLPAQKKMFRTPDVYGYFTSTFTPVKRLAISFTGTYTGTMLVQHLAGYIPEDREEKTPDFFDLNMKVAYDFPLYKSVTLQVNAGVQNILEAYQSDFDQGKDRDSKYIYGPGMPRSYFVGCKISY

SEQ ID NO: 7021 - protein, 387 aa, Flavobacteriales bacterium ALC-1
MITRKAQKLLCVVALGGVTGAVHAQSSVTLYGLIDAGISYVNHAENASGGSSSLVKFDDGINGGNRWGLKGAEDLGGGYKAVFTLENGFGLADGSLSQGGALFGRQAFVGISRTGVGTFTMGRQYPFSHDYLNRYATGGLTAGDAYAYHIDTLDLLTSVRINNSVKFDSVRMYGFKVGAMYGFSNAAGEFGGSNGNNGKGGSSRTYSFGFDYRNGPFSMAFAYTDITYPLQEVPPLKLTLANVEPLGERDLRTLGIGAKYQFGSLLGYALWTNTRLENLDHSAATLNIYEGGVVYQISAPLEAALGYTRTQVRGSATGSWNQINSSVEYALSKRTSVYVLAIYQKASGSNDGVPVQAMIGKSTSYFGNSGSDAQNQLAFRIGMRHRF

SEQ ID NO: 7022 - protein, 216 aa, Flavobacteriales bacterium ALC-1
MKKLIFVFLLVALLATPLAALDFSAGGDFSFAHMLNIVKVEDVKGTTSVNFLGVNGFFDAEYVRAGLGVNFLVGGITAKLENAGPLSGTTKDNKTSLINLRLSVLGKYPFTIAKIVKLYPLAGMEVDFNVSAKYDGKNAKEHLSDDEKKDLNHYYLVLGVGADITVTGNLFVTPKATFGFDLRQNSTAKAAKKAGANIKGGHQMKIEFGLGVGYKF

SEQ ID NO: 7023 - protein, 1021 aa, Flavobacteriales bacterium ALC-1
MEKFNAMRTRLSQHLQTKAIRLKGFIMLTCLLLGSISAFAQTKTVTGTVTDAANEPLIGASVLVQGTSTGTITDMDGKYSISVTPEDVLVFSYVGMTTQSIKVGTQSIINVTLKEDSQVLAETVVIGYGSAKKRDLTGSITNVKGEEIANKPAMNPLSSLQGKVAGVQIVNSGRAGADPEIRIRGTNSINGYKPLYIVDGLFNDNINFLNPEDIESMEILKDPSSLAIFGVRGANGVIIITTKKAKEGQTLVNINTSFGFKKVVDKVKLVNGPQFKELYSEQLANQKDDPFDYTGWDANTDWQDEIFQTAFITNNNISITGASPKHSFYLGVGYSYEQGNIEHEKFSKVTINASNDYKITDFLKVGFQFNGARLLPADSKQVLGALRSTPIAPVYNDEYGLYSALPNFQKAQINNPMVDVDLKANTTKAENYRASGNVYGEVDFLKHFTFKATFSMDYASNNGRTYTPIIKVYDSTVKGDVSTLGTGKTEVSQFKENETKVQSDYVLTYTNSFDNGNHNLTATAGFTTYYNSLSRLDGARKQGVGLVIPDDPDKWFVSIGDAATATNGSTQWERSTVSMLARVIYNYKGKYLFNGSFRRDGSSAFSYTGNEWQNFFSLGGGWLMTEEEFMKDIKWLDMLKIKASYGTLGNQNLDKAYPAEPLLTNAYSAVFGKPSIIYPGYQLAYLPNPTLRWEKVEAWEAGFETNMLRNRLHFEGVYYMKNTKDLLAEVPGISGTMPGIGNLGRIQNKGVEMAITWRDQIGEWGYSVSANLTTIKNKVKSLVQDGYSIIAGDKQQSYTMAGYPIGYFYGYKVAGVYQSEADIKSSPENTLATVTPGDLKFADVNNDGKITPADRTMIGDPTPNVTYGFSLGVDYKNWSFGIDMMGQGGNQIFRTWDNYNFAQFNYLAQRMDRWHGEGTSNSQPLLNSKHSINTLNSEYYIEDGKFFRIRNVQLAYSFDKSLLAKIRLQALKVYVNIQNLKTWKHNTGYTPELGGTATAFGVDNGSYPVPAVYTFGINLTF

SEQ ID NO: 7024 - protein, 181 aa, Flavobacteriales bacterium ALC-1
MNKLLPIASALLISSFASSAIADDNYQGHRVGIGYSWTQLSSISNSDYRLSTDYGDGIKIEYGYDFNRIVGLNVSYAQNNEDWYFGKLDGSNFQIDSDIGYAFLLNGFDIKPYGAIGLSRINEKFTYNSGASDSSSETSLALGTGVRMGFNFGLYADLRANIVLTEHVDTEQYSFTVGYRF

SEQ ID NO: 7025 - protein, 427 aa, Flavobacteriales bacterium ALC-1
MKIMTKTLNRTTLGLALGLASSQLLAAGFALNEQSISGMGTGFAGRSSSADDASTVFGNPAGMSRIKREQISVGAAAVIAKTDIDNGRGTFGGSNDGDMVPVVGVPMGYYVKPIDDHWAFGLGVYVPFGLVTDYEKGFAGRYWGDKSHVQIVTFQPTVSYAFNDKVSIGFGPTINRIDGELTSATLNAATPGRNDGKVKIEGDDTAIGFNAGILVQATDTTRLGLTYHSKVDYKLKGKTKIEGSGFGPFGGQKYDASLDISTPESVDFSITQQLDENWTVYAGSTWTRWSRLQDITVNNDGVPALLGGSAGPIGTITEEQNWHDTWAHAIGASYKVNKEWTLRTGFSVDQSPTNNVNRSPRIPTGDRKIISFGAGWSPTDDLTIDVAYSYLREDETKIRDSSATKGSYSADYRNTAHGLGTSVTYRF

SEQ ID NO: 7026 - protein, 615 aa, Flavobacteriales bacterium ALC-1
MKTYIVAILSFSILLFLGKSACAEDSLRVFQAKDLVVTASRSPMTAESAARSISIISSEEIKAAPVHNLQDMLLYVEGVHLQRRGPLGTQADVSVRGGTFEQTLILIDGNKVSDPQTGHHNLNLPVSLDDVERIEVLRGAASRLFGPNAFGGVINIITRKASLPELRTELAGGQHGYLSGAASLALPLENYLQQLSLTRQVSDGYRHNTDFEQTSVSYKSSLSLSQNALNFFGGYVDKAFGANQYYSEFYPDQWEQTQTGYLSLDGQFLLSEQAQTVMTPKIYWRHNEDEFLLERFDPSYRNFHKTDVYGGELQLGFSTGLGKTNIGLEAGREVIASTNLGNHARARGGIFLEEQLALGNSLTLVPGVAMYFYSDWNPQILPAIDAAYQLTETARIYGSIGKSFRIPTYTDLYYSDPISLSNPDLQPEEAWTYETGVAWQSPVWGASLGTFYRDGKNMIDWARATDDDKWQSRNVADVGTFGIEFSSSLNVKSLFNQSPISAAKFSYAFLNSGKSMGEMQSRYVFNYLKHQVIVGFTHQWFAGIEQNWSVRYEERKAQDGYALVDTKLSWRTSAENWRMEIYLEATNLFDKTYYEVEPVPMPGRWIVIGLRPAIF

SEQ ID NO: 7027 - protein, 1087 aa, Flavobacteriales bacterium ALC-1
MKVKRCFLEWSLVSKRFAVALTFVLGGGMLLAANLVPLKGVVKDVSGEPLAGVTVRIKDGKSGTITDVNGHFVLDVEKGQKLLLSYIGYSETEVLVKDDQQMQIVLKEDAQQLQEVVVVGYGTAKKVNLVGAVDQIDSKQIAERSNSNISRSLQGMVPGLNITFSDGKPSRTPSINLRGTGSIGAGGSALVLINGVEGDLNSVNPADVESVSVLKDASSAAIYGARGAFGVILVTTKNATAGKTKINYNGSFSMHQRTVKTEDGIVSNGLQWTDGWYTAYLEGQEAPPGGINNVFKYSTDWYNELVRRDADPSLDKVRVNDKGEYEYFGNTNWLDIIYKDQNYSTEHNVSISGGNERARYYVSGRYYNQDGIYNAGDEKYTQYNIRSKGEIQINKSLLLENNTDVMIFRSHQPMVMYDRQNITRQAQHQGYPVTMEKNPDGTWTEAAVYIGWAGFVEGTSWQKDNKLDVRNTTTLTYTPIKQQLIFKGDFTYYSSKSTRLRAENQYNYYTGPEIMGTRNTFSSLENMDYNREYLSSNITGNYIPKFSNSDHYLNVLLGWNLEHQDYKTIQTYRRGLISATKPSFALMDGDYYTTGQGGNEWAYVGFLYRLNYNYKSRYLAEVSGRYDASSKFPENQQWGFFPSGSLGWRISEEAFMKFTRNWLDNLKVRASIGSLGNGNVSPYLYLSTIPIKKTSVILGDALQTYATTPNIVPNSLTWEKSTTYDIGLDVDMLSNRLSIVFDYYQRYTTDMYTVGPTLPAVLGAATPKGNNAEMETKGWELSIMWRDNFTLANKPFNYSVKAMLWDSRTWVTKFNNPTKLLSTYYEGQEIGTIWGYHIEGLFKDQAEIDAHADQSKLKVSATNILKPGDLKFADLDKSGTVDNGQNTLDDHGDLKVIGNTTPRYQFGFNLSANWNGIGISAFFQGVGKRNWYPHRESAFFWGQYDRPYSYMLKEHTGNNVWTEENQNTDAYWPRYRGYLANGSTKALGIQANDRYLQNVAYVRLKNLQIDYAFNKKFCDKLHLQDLKIYLAGENLLTWTPLAKHTKMYDPEGISAGDADFRSTANTDGDGYGYPILSSYTIGINVTF

SEQ ID NO: 7028 - protein, 771 aa, Flavobacteriales bacterium ALC-1
MKQIFLPLVVGGIAWPCLAQTSTDSADLPERSKTLGVVTVNGGQPSSLPTQIPTTIEGITREEIETRINATDSEDALKYLPSLLVRKRYIGDYNHAILSTRASGTGNSARSAVYADGILLSNYLGNGIANGSNYAPRWGLVTPEEIERVDVMYGPFSAAYPGNSAGAVVDYVTRMPDKLEAHVAAGYARQSADVLGSSGHYRSWNTSASIGSRSGDWSYWINLSRSDSQGQPMTFPTVLQSAGVAGGAGTPVTGAIAGLNTTNQPWYILGAGTQYRTRQDHAKIKLAYDITPTLRASYTLGWWQNSARGSSETYLRGPDGQPVYSGNIHIDGKTYKLADTAFGLSQDQQTHTMHGVSLKSHTQGEFDWELSASLYDYGKDQQRVPTVAQPAANLGGKGTLQDQDGTGWNTLAAKGTWRQNDIPGLQGTHIVDFGLGRDAYKLNISKYNVVGDWQSGPANEQSVVSQVGGRAETRYAWAQDSWQLARDWKAVLGLRWEDWTASQGHTATTSSQLSYAQRSESHFSPKAALAYQLARSTTLKASLGRSVRFPTVGELYGATSGGALSFINDPNLKPEKSWTGELTAEQDLGNGLLRATWFHERTRDALYSQLIAGTTISAVQNVDQVKTSGLELAYSAQSVWIRGLDLGGSLTWANSRITANAANPASVGKWQPRVPRWRATAWATYKPDERWALTVAARYSGRQYSNLDNSDVHADTYMGASQYFSVDLRARYQIDRQLSAAFGIDNANNARYWNFHPYPQRTFSASLRWDL

SEQ ID NO: 7029 - protein, 840 aa, Flavobacteriales bacterium ALC-1
MKIKCSLLLIMLVVSSLVAAQNAAPTFQIKGVLLDSLTQEGEPYATIKIVKKEAPANALKMLVTDMKGKFQEKVPGTGNFVMTISSIGRNTIVKDFTVKAGEKLVDFGTLYITDASNELGQVEVVAQKPLVKADIDKIEYNVQDDPDSKSNSVLEMLRKVPLVTVDGEDNIKVNGSSSFKVYVNGKPNNMMSNNPTEVLKSMPANSIKHIEVITNPGPKYDAEGVGGILNIVTVGSGLEGYTATFSGNVSNMGAGGGLFGTVKSGKLTVSARYNYNYNDRPRSYSGGNRRTVGDVTEGSSDLDYDGSSKGHGNFQSGSMEASYEIDTLRLVSMSFGLWGGGNNSTSINNTLATAPGTSNELYRYVSDGRSKSSWYSIDGGVDYQRMFHVKDRMFTLSYKINTSPQTSDSYSTYNDMHAATDWEDFLKRLYDLNNDGSQNTTEHTFQADYTTPIGKIHTLEAGAKYILRDNSSEDDRYERQIGTTGDYVLDEEHSSHYKHQNDILAAYMGYGLRVKKISGRLGVRYEHTKQEVKYLLGRGDDFNKNFDDVVPSASIGYKLTDMSNLRFGYNMRIYRPGIWYLNPYLNDSNPTNISQGNSHLDSEKSHSFNLSYSNFTQKFNINLSARYSFTNNSIEQVTEQVKDTEIEGLQNPTGKEVLYSTYQNIGKSRNASLSGYVNWNATSNTRIYANLYGNYTYMEGANGLKNDGWNLFAYGGAQQSLPHDWRISLNIYGQTPWIMLQGKGSSFFDYGLSVNKSFLNKRLTLSAFASNFFKKYTSPTSSIEGVGFTQDSWNRYTRQRFGVSVSYRIGELKASVKKAARTISNDDVKGGGGEGGGGGE

SEQ ID NO: 7030 - protein, 600 aa, Flavobacteriales bacterium ALC-1
MAIGRLGYLVRGAWAGGVMLLAAGSAWAAPNWPLAPYSYYAQQQSLSDVLREFAAGFSLALQQGKGVQGVVNGRFNARTPTEFIERLSGIYGFNWFVHAGTLYVSRTSDVVTRAVDAAGASPSALRQALLQLGILDERFGWGELPAQGVAMVSGPPAYVALVEQAVAALPKGAGNQQVAVFRLKHASVSDRVIRYRDQQVVTPGMATMLRQLILGAGPGNDAALAAVAAPLRENPPVFGDAAADGNAPLAGAAQAAGRRLSEPSVQADTRLNALIVQDIPERMPIYRALIEQLDVPSTLIEIEAMIVDVNTDLVNELGVTWGAQIGTTSLGYGDLGLRPGNGLPVDGAAADLAPGTLGISVSTRLAARLRALESDGQANILSQPSILTADNLGAMIDLSDTFYIRTLGERVATVTPVTVGTSLRVTPRYIAAKGGRQVELAIDIEDGRVLQEYPIDGLPRVRKSSISTLAVVGDEQTLLIGGYNNRRDEEQVEKVPLLGDIPGLGFLFSSKSRAVQRRERLFLIRPRVVAIEGKPVFSPVAGTSQVFMSTGWGGHGSSLSIAPGEGGHTQVRHDARAGRPVRLVPDSLHVEYGEAGEASP

SEQ ID NO: 7031 - protein, 186 aa, Flavobacteriales bacterium ALC-1
MIIRKYFLIIVLLVMPWLAIPSVSAADKGWFNTFTDNVAETWRQPEHYDLYVPAITWHARFAYDKEKTDRYNERPWGVGFGQSRWDDKGNWHGLYMMAFKDSFNKWEPIGGYGWEKTWRPLEDDNFRLGLGFTAGVTARDNWNYIPIPVLLPLVSIGYGPATFQMTYIPGSYNNGNVYFAWMRFQF

SEQ ID NO: 7032 - protein, 364 aa, Flavobacteriales bacterium ALC-1
MKIKWSAAGLVAASGLAYGQSSVTLYGIVDTGVSYYNHATAHGGSWVGMPVLTGELPSRFGFRGREDLGGGYHAFFVLESGFQPGTGALNYGGRLFGRQANVGVGSDDGALTLGRQMNMTTYALAKADVIGPSIHSLYVFDGYLPNARSDNAIGYLGRFRGITVGATYSFGRDAAGPAGPGATNCAGQVPGDILACRQYTALVAYDTASFGVAASYDVMRGGTGASAPLNRNAYTATRNIVDGYLVTGPVKVGIGWIRNNMAAATHLQSDIFFAGATYSSTPALSIDAQGVRYLQRGRDEGAHSAQSTLLVARANYALSKRTIAYTSLGYMFNSKLAENSVAAGGTVGTGMNQLGAMVGLQQKF

SEQ ID NO: 7033 - protein, 1080 aa, Flavobacteriales bacterium ALC-1
MKKFNPSVLALSISSLLLTSTLTFGQIQQQDKALFGVKEHQESLLFHQSLVKQGSDNVPIWRIPSLLRTKDGVLIAAADKRWQHRGDWGDIDTAIRISHDDGKTWGNITTILDLPSQNTEHSPVMNTSTNPWGDKDNVIRQRIRDPNYSSQYMNSAFLIDAQMVQDKRNGRVFLAVDMFPESAGFFHLNGAFNNPGKDGSGRLTIDGKQYLKLIYQDKQWTLREDGSVFDELNRKTQYKVIVKGDPNKNFKDLGDVYNENNENIGNIYLTNRKGSKNEKAPFYIPTTSYLWMTYSDDNGKTWSSPIDISAQIKKDWMRFLGTGPGVGIQTKNGNLIFPVYYTNQNNVQSTALIISKDGGKSWELGQSPNDKRIELNGMNSHNLRWDSWYANTAKQKGFELTEAQLVELENGELKLFMRNQTGKVMMSTSKDGGYTWVNTEKINELDHGYSQLSVIKYSKRINGKEYIVFSGQSRSGQGGDNLRRDGKLFLGEVQESGEIKWDTTNLVREIVSQGKAAGQPNGYVYSSMAELGDGSIGLAYENTTDYTTIMYLPIEMQEFFWKAGKIFSDVRQKEPLVFTYDGTETLEKIGDGIAIKRGEGESQSGINVSEGLLVLDQQTKDGKNKAFTQLTLNNSGVAQVNSTQNIDRFVVNNGATGYLQFTVTDTHSPRLKINQDVTAHGQIVAVQVNLQKKLKPNDKGYYHAQGEELIAFKDNGQVKWRLVNDELKDGMYVYTLASVAKPSVLRTTSQPHSLYLTNKLITADGKAVSTVSPLKAPLTVNARPQVNPVLASYLTANLALNKMSEQLQQSFMHETRLLQEKDRSIFVKYLNGKQKYGSNLSFIDYGYDFNASYSGVMLGGKVWQSERGNHALYTALNKTSYKVTPKAVDGETKAKYHSWGGSINWHSNLPHNLIVDLSAGYQKHKGDIEHAGHVKGYTFNIGADLGYRYQWMKNAFITPMVGLHYLYASLSDVNDQANKALLKYNNFNALKTNLGVDVNYRIGKFEVKGLLSYDMYQQKTRQLYVDDVAYKQGKLADTLHLNTQFVAHLTPRFAFSTEVGFQHARNKGQSSFAVGAHYQF

SEQ ID NO: 7034 - protein, 203 aa, Flavobacteriales bacterium ALC-1
MKTIKKYKYIISSTLALALASSTLVAEESSGFVGVGVGYGGSQLKAGSEKQNLSGISYEVIAGYKQFFTPSFGLRYYINFAYADASGKVKGTSEKIKGNVMDYGVNVDALYNFITGGNTDFGAFLGLGLGANSWGGRDFKDSKIDKTGLNLALNVGLRTEIAKAHGIEIAARVPFIATTLDESEPKVTASHTYNVGVRYIFSF

SEQ ID NO: 7035 - protein, 1016 aa, Flavobacteriales bacterium ALC-1
MKTFKPSTIMAALISSGVAFSAAPLYAQESPDTSIDEVERPQEDTLERIEVRGFSTSLIQSLNQKRFSDTVSEQISADDLGGLPDVSMADALTRLPGISAVRTGGQAAQINIRGLSGDFVFSTLNGREQVSTSGSRAIEFDQYPSELISEAAVYKSPKASLIEGGIAGTVELKTASPLAIEEQHKFSANMRGMYNDRASEISDATEYGHRLSFSYQGKFLDDTLGVSLGYARLFQPSVSTQFIGLAYNGQVDVDGLEGDADGPAECPNCELISEGFEMQHKGGEETRDGYVAAFEWAPIDTFTLKADAFISKFDSEAFARGFRVKLGGINAGITNPVVVNNNVVGGTFSRTDNSFTRVELVNDDNQDFDSVTNLGVNAAWEISPDLSVQFDVSRSSAESDFRNGLLWSLVGDDATAANPAFDENVQISYLLNGLNLPDIGFNQTDAFTDLDRVMVSKYGIYPFENKDELDAYRVDFQYYVDVPIISGFEFGYRYSDREYNNDRSVFEYGNDSAFSVSEPPLRLTSDMVEQVDWSGDFGYFPSYLSVDLNSALNAWFPGGRPEPVQTWGPGAAGVINGPGTGPATAWTLQESGDVFETVNSAYLMANINTEIGSIPVTGNVGVRYVKSKQSSTTLQRATQLIEDLETGTSVEVSDPTAGAQNITDDVGLINNFYRPALISHEYSDVLPSINLNFKLTDDTQLRVAAAKVMGRAPINRFAANASTTIETVTAFQDRDSGEITLSNPTARVSGNARNSPYLEPFYATQYDVSWEYYFSDTEGALVIAGFYKDIESFVEDIEIEPYDFEANGIVIPDNVSVPVYLTPEFSGQEAELARDENGDPIFVTVPTENGSYSTAVNNAEGGYIRGLEVAYTQIYSMLPGMLSGLGVSASYSYTESEIQRTLGDGVYAANLPGLSENVATLTVFWEYEGFETRLSSRYRDAFVSQQVAVNDQVVNFDDELVIDYQASYEISENWSVLFQVNNLTDEPTKSYFASEEQTGTIQYFGTQYYLGMTYQL

SEQ ID NO: 7036 - protein, 236 aa, Flavobacteriales bacterium ALC-1
MKIKLLTLAVASLVSVNALAVSIDYRHEMQDTAQAGHKDRLLISHRFANGFGLSSEVKWAQSSADKTPNKPFNEQVSNGTEVVASYVYKFNSVFSIEPGFSLESGSSNNNYRPYLRGRANVTDDLSVALRYRPYFKRNSGNIGKDNTMDKGYTLTGNIDYTFLKDYTIGYELEYKKGTSGKTILSDNDDYDITHNVKLSYKWDKNWKPYVEVGNVSGSETTDERQTRYRVGVQYSF

SEQ ID NO: 7037 - protein, 473 aa, Flavobacteriales bacterium ALC-1
MKIFKMLLVGSIFCEIATAQNLPPWFPQFLGMKATFVGQYSTNFNSPYEGPMTFGNPYKNNGGGRSEELTQSYGLYTGAQITKDIQAYLDIQLFKGNGIGGGQGIGGYPNSLYIRAGSSNLGKNPYIARAYIIYTKALSQSLEYEGRAPDQLPGYYPKEYFYVKIGKFSISDDFDNNRYANSPRTQFLNYDFNYNVAWDYGADTRGYTVGIESGVVKKHYSFKIALGAEPTMANGNTYDESGAYSLNTQLSLRPNDIGTVIRLLGMLNYGRMGSYTEAMDNFSYYYSPNSPCYYTEFGPNGALAGYDYPVICTESKDHKRYKWGFFLNLEQPIADDDKTGLFLRAGFNNGQTEDLAYTDVDRDIAGGISINGVHWKRPKDQLGIGLGINGLSNTHKRYLESGTINEPSSSFFVGSGQDGQFNYGYEEIMEAYYKYQLNKYISISPDAQYIRHPGYDKNRGPLWVYGLRVNAQF

SEQ ID NO: 7038 - protein, 1139 aa, Flavobacteriales bacterium ALC-1
MRLIVKRILLMLLLLSVGNVLTGGFQLSAQEQSKRFSVKVDNITLKEAIEVIKKQGNYSFLIRNNDIDLNRKVSVNINNGTINDVMGQLLAGTDVSYEVNGPRVIMFHAVTPQKEQEKAFVLKGRITDPTGEGVIGANVKVVDSTEGTITDMDGNFSLMVTPNARLSISYIGYATQEVVVKDQRPLNVTLKEDTRLIDEVVVVGYGVQKKANLTGAVSSVKMDDVLGDRPVVSVSDALKGAMPGLQITGNSGRPGEEMSFNIRGVNSLDKNGKPLVLVDNVEMDINMLDPNDIESVTVLKDAASSAIYGARAAFGVILITTKKGSDATKLSINYSNNFSFSRPANMPHKATPLQTVQAYKDMGTINYQSGQNVDTWLGLLKEYNANPSAYPDGYAMVDGLRYSLAETDLFDDMMETGFQQTHNISVGGGTKDISYRFSFGMVNENGVLASDKDTYKRYNVSSYLRSDVFSWITPELDIKYTNSNSSLPETSGGYGIWGAAVAFPSYFPTGTMNIDGEELPINTPRNLIDLAYPTTIQKNNLRIFGKVTISPLKNVKLIGEYTFNHLSNEKTKFEKKFYYAHGGNFVKEVSTANSKYEYSNGITDYNALNFYANYNNSWGKHDVTVMGGFNQESSDYRYAEMSRMNMINEDLPSISQSTGDYFAKDKFERYTVRGLFYRINYSFAGKYLLETNGRYDGSSKFPKNSRFGFFPSVSAGWRISEEAFMKPLNSVLSNLKLRGSWGNIGNQSITPYAYIPGMDAEQAYWTVSGIKVTTLKPAALVSNSFTWEKVTTIDVGFDLGLLDNRLNMVFDWYRRDTKGMLAPGSELPGVLGASAPLQNTADLRSKGWEISVDWNDQIGKVKYSIGFNLYDAKTKITKYNNETGLFGKDKNDNETFRVGMELGEIWGYVTDRLYTVDDFDADGKLKPGIAKVEGYNPNPGDILYKDLDGNDIINSGTSTTKDPGDRKIIGNNTRRYQYGIHGSASWNGFSLSFLLQGVGKRDLWVMNDLFYPHYDAWTTVYDSQLNYWTPENTNSYFPRIYEKAAGNTDANTRVQTRYLQDGSYLSIRNITLSYNFPSKWMSKIGVNNLAVFFSGENLYTFDHLPKGLDPERSVTDDLGQRGFTYPYMRQYSFGINLSF

SEQ ID NO: 7039 - protein, 444 aa, Flavobacteriales bacterium ALC-1
MRNLFALTPMALALCTASAAWADEGEAKEGFIEGSSLQLLTRNYYFNHDRRHASGHDSKEWAQGFIATFQSGYTPGVVGFGVDAYGMLGLKLDGGGGTGGTSILPITSPSKEGYESGKAPDEFSSGGAALKIRAFDTELKLGDQFLSNPVVAGGESRMLPQTFRGVSLTNNSFEDLTLTAGQVSFTKYYNQSGHRRLGSYYGELPGDRDSHHLSWLGGTWGGIEGFTSSLYAAELQNVWKQYYADVDYTYEIDDNWSLNPGAHYYKTVDSGDSLLGRIDNNTYSLHFAVGYRQHTVTAVLQKVNGNTPFDYINQGDSIFLDNSQQYSDFNGPNEKSWKLQYDYDFVALGLPGLSASASYSRGKLDLTRVDPDSPGYGGWYSADGKNAKHWERDLDLQYVVQGGPAKDLSLRLRWATHRGTGGYSAVDNDIDEYRVIVDYPIDVF

SEQ ID NO: 7040 - protein, 246 aa, Flavobacteriales bacterium ALC-1
MNLKTLLKMMVGTSLLVHALGAYEQSAAPSWTKNLYMGFNYQTGSINLLTNIHQVQQIIDYQNGYIRTISSVNGIKKLTNMGANGIGLVMGYKHFFHTDKVLGLRYFAFLDWQGYGMRYPKGYYGGNNMITYGVGVDAIWNFFQGSFYQDDISVDIGMFGGIAIAGNSWYIGDKGRELLGIANREVNNTSFQFLFNFGMRALFVDEHEFEIGFKFPTINNKYYTSDTINVQMRRVFAFYVGYNYHF

SEQ ID NO: 7041 - protein, 764 aa, Flavobacteriales bacterium ALC-1
MNLKHLLVAVCIFTGHLINAQNFKGQVLDHENNPIEEAHITVNNKATTYTDSNGNFDLTIPEKGASIAISYLGYKTFEDFITPQTERASFVLDEAPINISGVMVTGNSKTDPVFTVETNDYVKKIVQPRNVADLFNDVNGFSLIKRGNYANDPSFRASQYEQLNVQFDGGTKAMHACPNRMDPVTTHVIPEEIEKIEIIKGPYTVRYGATFGGIVNMVTQVPDASDYGIHGSVHVGYESNGGSLVSMARLQQATEKYDITGNVGLRDFGNYEDGDGTEVPSSFRSLDYGVKVGLNFTPNQRLQAHWRQSFGRDVLHAGLPMDTDLDDSSILSLDYKLTGLNGTLKNIDAKLYYSYVDHVMSNAKRPSFMMTDAVSAINATTAGGKIEFKLKPSENFTLFTGIDAMHIGRDGERTRLVKRNMMGPLPTPMEFTDKVWQDSYINDIGLFAESKYPLTDHTILTTGLRYDLVTSKIKDPAADFLALYPDLDKTTEHNFSGTASIKYAPSTEFMMELAYGRGVRSANMIERVINHFTVGQDSYEYIGNPNLDAEVNNQFEIGFKGKLPFTDTSSDRFIYSSSFYYSFYENYIVAVIDETQTRKFMPMAQPRNPKVFRNLDKAYKTGFEVAAGVDFLNNFNFTTELAYVYAKNKDLNESLPLVPPLTTRFKLGFEKEKFWVNANYTLTSKQDNISESFGETQTAGYEVMDIRLGVVPIKNLTLGVAALNVFDETYHNHLNFSFKNQANFKAVPINDPGRNLSAFVQYKF

SEQ ID NO: 7042 - protein, 628 aa, Flavobacteriales bacterium ALC-1
MKQLKIVLLLILVLVTITLGGTAKQDSLKTYTLPTVYVIVEKPSEAIGSLHIIEGEDVKNALSLREAMQNSVGISATIGTKDESNLRLRGFRKNEIKVMVDGKPLNNGYFGNVDISKLSLLDIEEIQILKGPASPLYGTNNMGGVVNIITKAPPNNYWLEVNTLFKRNNTNEITLSSAHSFDTWNYRIGVSQEKTDGFVLSEKFIPTPYEDGGVRNNSDKCLYNISGSLDKEFLNFHNLGVDFGYNKMDKKNIPSSIYEQRYRQYQDWMRYHIGLWTKMQVSESGTLNLQLINDGSTDRYLEYKDPAYENLTLDSKMHNAGFGFHSRFTKTFTGNKKLDIGYNYDFQGNNRKDNDSYQQWTDSVVHIHQAFSQLECTIIPKLLLTTGIGVNTRINRDNNKIQPQLEPAVGIVYEIIPDSETSFAIGRNTSHPTMRQLYSASKGNPDLKPQNSLKLEINHNQALWQNKISLSFSVYFNDTKDLIDLYNGHYENIYKVQSQGTEIGVSFSPDKFFQTSVNYAYLSYRKISDYYLTETPKNSVELCQQFTFPYKIGFRINSSYRDRCLSQDDDGRYHTLAPYWKHDLILTIPWKRLKLFLGVENVLDEDYQSEYGYPEPGRNFSLGLQAII

SEQ ID NO: 7043 - protein, 303 aa, Flavobacteriales bacterium ALC-1
MKQLIFILTPLVLISEAMAESDKKDISLGLSLGVLNGASKELVYDDTGRKLSQLDWRIDNVPIIKLETDWNINQRWTLTGDFWSILIDDGNAHMEDRDWFIENQHFPTDISISPKTTLKKAYQASLHTTYWLFIQNNYEIGALGGFQYNQFKWEDLGGTYSYNNGTDVGTFPDVVGIDYKQEFGMFYAGLTGKYRLDNSEFSFLLKLSPWVKAKDVDNHYLRNLTFYEKSNEYSDAVSLSINYNYNFGPNMNLYTEYAYTRYFEANADMTKVNNKTNDSSFSENAAGLDNLYSTLSIGLKYSF

SEQ ID NO: 7044 - protein, 826 aa, Flavobacteriales bacterium ALC-1
MVLLFAQAYSQVLTGKVNDNNSKPLPGVTIVIKGTTNGTLTNANGQFSLPSKAGAQTLVFSFVGYKTKEVTVNVSGTQAIAVPTVTLYEGNEILQEVVIQGERRNQFSRKKSAYVSKLPLRNIENAQVYSTVTNELLVSQTVTNFEDALKNAVGVDKLWASTGRDGDGAGYYALRGFSVQPQLVNGLPGITNGIINPSNIERIEVIKGPSATLFGSTITSYGGLINVVTKKPYKDFGGEVSYTTGSFGLNRLVLDVNTPLDKQEKIYFRINTAYHTENSFQDAGFRKSLFVAPSISYKVNNRLSFSLYSEISQAEQTNPTFLFLNRSVPTEWNNLAELNYDYEQSMTSNDLTLKTPTANYRMEADYKISDQWRSQTVLSGSRTQSTGHYSYLWNDAMSAVVDNVQPGASAFINPNSRTFSLNVRRENGITSTYDLQQNFIGDFKLGSIRNRMVVGVDYFSRTVISNNTAFAFVHNVDPRGNVVNYDNPNTNPIFTPTLPNNIETTPTYLTKASVERLLSNSAPVNTRVRQNVFSAYISDVVNITPALSLMAGVRFDMFDYEGDLNTTADDEQAYTQTTFSPKFGIVYQPILNQLSLFANYQNGFTNVNPELVPSDPNNPTSDLVLRNFDLEQANQIEVGAKTNLFDDRVELTVSYYDITVDNKVIGFGPAKVQNGTVRSKGFEVEVNVNPFDGFNLRGGFSNNDAQITNSPSQPELANTRFGGAGPEMLYNLWANFEFPKGALKGFGIGFGFNGASEQNVMAGEPAAGEFMLPAYTIFNQSVYYQGDKFRIGLKLNNMGNHFYYKGWTTINPQQPRTLLANFTYKF

SEQ ID NO: 7045 - protein, 1031 aa, Flavobacteriales bacterium ALC-1
MKKIISILFIICSLFSSMAYAQGGLTYSGTVIGEDGFELIGVSVAVKGTSIGVITDLDGKFRLNNIPPKSTIVFSYVGFENKEVKITESKERETIVLKQSISSLDEVVVVGRGSQRKVSVVGAITSVDPAQLQVPATSVSNMLQGRVPGIIGVTRSGEPGNNFSEFWVRGISTFGANASALILIDGVEGDLNTLDPADIESFSVLKDASATAVYGVRGANGVVIVTTKRGKAGKLTVNFKTNATYSYSPRMPEYVDAVGYANLANEARVVRGKNPIYTNSEIQLFRSGLDPDLYPNVNWRDVILNDYVIDNQHHLSLSGGGTNARYYVSMGIMNQGAVFKQDKSVSKHNTNVDYHQYNFRANVDANMTKTTLLSLNMETIITKRNSPGYGDNNNALWSAQANLPATIVPVKYSNGTLPSFGRNSDEVSPYVQLNYTGYKISETQATRMNASLNQKLDFITKGLSARGVFSFNYTGYFDQYRTKTPDLYYATGRKQNGALISKRTSSATDMTYSDYRRIARQYYFEGNINYERIFGEDHRVTGLLNAYRQENKDSYLNNDDDDTTLDERIRSIPKRYQAISARATYSYKDTYMFEFNVGYTGSEQFKKGNRYGWFPAVALGWVPTQYEWTREKLPFLDFFKLRASLGKVGNDRIKKIRFPYLSTVSTDYSSVTWPGSTVGESRVGANDLNWEETTKMDIGVDLKMFNDKVELTADIFKDKNKGIFQQRANIPEEAGFVTNPYTNIGGMESWGFDGNITFNHNFTKDFGMTVRGNWTFARNNVTYWEQSGVVYPYQSFVDVPYGVQRGLISLGLFKDQADIESSPVQTYSSDVRPGDIKYKDVNGDGVINDDDIVPLSYSNTPTLQYGFAAEFRYKQFTASIFFEGVGKVQYFYGGSGYYPFAWETRGNVLNIVADQKNRWTPREYSGDASTENPNARFPRLTYGENKNNNRPSTFWLADGRYFRLKNIELSYRFTSAWLRDKISVQNATLSLVGENLHVWDKVKLWDPEQASSNGAVYPLQRKFTLQLNVTF

SEQ ID NO: 7046 - protein, 199 aa, Flavobacteriales bacterium ALC-1
MKKIILNLTLLATISVADGNIVPVSTTTPSTEIAEENGIYVGLAFGNIFVNDDYTDEEISSNALVLQIGYQYNKYIAFEGRYNFGLNTSYKPGSTGNIIDDYNDDVSSWGTYIKPMYPIGNFTLYALLGYGGLMLKNLEKGDAYESAFQWGLGAKYNLSENLSLFADYIFLYNDTGFDYRAQLDDIDSDIWTLGVSYKF

SEQ ID NO: 7047 - protein, 201 aa, Flavobacteriales bacterium ALC-1
MKRLVTVAWIVVAVAGLSGTALADSIKGKLGVTGRLGVYLPAESDFDDRKLETDVGFIGGGGVIYGITDNIAAEIDVTHTEFGSNRVSGLDEGDFEVVNVSLGGQYRFLLPQSKFVPYAGGGLDILLIDYTRPSGTKAHVDTGVGVHVNGGVDYFVTRQLVLNAEVKGVIAPEVDMTAEGRPGNFDPSGVAGTVGVRFFFN

SEQ ID NO: 7048 - protein, 748 aa, Flavobacteriales bacterium ALC-1
MKYIQLLIVLMPLWLFSQEKVGGIILEVYDGKEVPLSGANVFWLDSQIGAVTDFKGLFEIPYSAEYDKLVVSFVGYKTDTITVTKPRNLRHVLTSTASLDEVTIRSRKKASSRSLLQAQNVINVSSAELLKAACCNLSESFETNPSIDVNFADAVTGSKQIRMLGLTTPYTLITTENIPTIRGASQAFGLSFIPGTWVESIQITKGAGSAVNGFESIAGQINAELVKPSTDDRLFVNAYGALGGRLELNTHINTKVSEKWDTGLYVHGNRRDVKNDRNDDGFLDNPLTEQINLMNRWQYTDAEKGFVAFINLNYLKDDKIIGQTAFDPDVDRGTTNNWGGEIDTERFGANVKMGYVFPDAPYQSLGLQVAYSNHEQDSYFGLRDYTIKHQSGYARASFNSIISDSRHTFKSGLTATYDDYQELVETSEYDRTEQSVGAFFEYAFDDLENFTMTAGLRLDTHNLLGTFATPRFHARYTPWEKAAFRVSAGRGKRSANIFAENQSLFSSSRTIFINDTGGDIYGLDPEIAWNYGLSFMQGFKLFDRKGDVTLDYFRTDFQNQVVVDWEDVNQVRFYNLENGSTANSFQAELSYNVFEQFDLRTAYKFYDVSTDYVGGTLEKPLTPNHRIFANVAYATPIKNNSQWKFDMTYNWLSTQRFPSTVGNDVEYQLTERAPSFATLNAQVTKVFSPRFEIYAGAENITNVRQDNPIIDAENPFGSNFDTTFVYGHVFGSNYYAGLRYKIPVKTEY

SEQ ID NO: 7049 - protein, 787 aa, Flavobacteriales bacterium ALC-1
MKHFFLFILFTVAAISVSAQEKFTISGTVIENETGETLIGVNVLVPSLQMGAVTNEYGFYSITLPKGTHEIYFSSIGFNTIVETINLTKNTSLNKSLSEDSQQLDEVVLSVDVEKINIRKPQMSANSLTANTIKKIPVALGEADVLKAITLLPGVTNTGEGASGFNVRGGAADQNLILLDEATLYNSSHLFGFFSVFNPDAIKDLTLYKGGIPARYGGRVSSVLDIYQKDGNKKQFKATGGLGLIASRLLIEGPIIKDKASFLIGGRSSYAHLFLPLFDIDSKALFYDLNTKISYNLDQNNKLFLSGYFGRDVFNISDSFSNSFGNTTVNIRWNHLFSEKLFSNLSVIYSDYYYGLELKFLEFQFDSGVQNFNVKYDLRHYISNDVKLRYGLNSIYYKFNPGDVQPTSSTSGVNPYKLTDKFAFENAAYIEAEAELSDKLSIQGGVRLSTFNRLGQEELNLYLDDNPILFNETLNIYEKADPIESLSLSKNKTMKSFANLEPRFAVAYQLDNKSSVKASYNRMTQYIHLISNTTSPTPFDIYAPSGKYIDPQLADQVAIGYFKNFEDYSLEVETYYKEIQNRIDYVDGSNLIANNAVEQIILNGEARSYGLEILFKKTTGKFQGWVAYTLSKSEQRTPGRTPEETGINNGEWYQSGWDKTHDLSITGQYELSEKWSFGANFIYQTGRPTTYPNGQYDYNGEVIPVYEDRNSSRLPAFHRMDLSATWTPKPKNDKRWQGEWVFSLYNVYGRKNAASISFAENTDNGLNEATRLSIFGRIPAITYNFKF

SEQ ID NO: 7050 - protein, 859 aa, Flavobacteriales bacterium ALC-1
MKLITSTALATIFAMAAPAHAQEQSVTEEDSGGIAEIVVTAQKRVENVQDVPIAISAFTANSLKERAVGDVSSLANISPNVSLDAGTPFSGSTSVLSAYIRGIGQNDFAANLDPGVGVYLDGVYLARTVGANLDLPDVERVEILKGPQGTLFGRNTIGGAISIVTRNPGKELSFNGDITTGRYNRLDVKGTANIPITETLGASLTFSSKDRDGFQQRVDYPGAGRFVNDVDQAFRSNYYQGANSNGGSNEWTVRSKLRWEASSRLRLTLSGDYLRQDQAATANNVLAVTANDPGPFAPTADRALVIPGLGATALYDASSGLAPNGFNFAGLYNFCIGSTGAEIAARNATALCGPRGTPLNPGQQLGGLASVNVDGDPNNDRLPIDNRWVTTDPDKTYATGNSYSKMKNWGIGGTVDFDLSDSISLKSITSYRKIDWSSGLDADNAPIRILEFAFSLRQWQFSQEFQLTGHAFDKKLNYVLGAYYFKENNDLNDFVTFNQGLLQIAGPNKLKTKNYAFFGQVDYRLNDLIGITVGGRYTHEDKGINGGQSDLNGFNYKLFNCPVFGDPCSTPLGFTNPSQPLRYYVTPTQNKSFSNFSPKFGLQLHPADDLMIYGSFAKGYKTGGWTTRLSNPLPYAPSFDEEKAESFEVGLKSTLLDRRLQINAAAFTTKFDGIQLNFQQGVSPTIQNAGTARIKGFEVELTVAPIRNFSVATSVGYTDAYYTSVLPQAIVAPNSHQAGTAIGVSLPKTPKWKFNVSPRYEVSLGAAGSLLLLADYTHTSSQWNDTERTLTLLRPATDLLNASATYKAMNGVWELTAGGTNITSERFLTSGGTQQNGAGIIFGTPNRPAEWYLRFGMKF

SEQ ID NO: 7051 - protein, 382 aa, Hydrogenivirga sp. 128-5-R1-1
MNKRWGTIAPAALLAAAAHAQSSVTLYGKIEDGINYTSNARGHGTVQLQSGYDYGSRWGIKGTEDLGAGYQAIFTLESGFDVNTGKMNQGGREFGRQAFVGIASDRYGTLTFGRQYDPSVDIFSPLTANGNWTGYLFSHPYDNDNTDYSFRVNNAVKYVSPVWHGVTAEAMYGFSNQAGGFANNRLYGAGLQYQQGGLTVGASYLKINNARNADSTGAITGDNTFDASSQQNIGIGVNYAFSNALVGFTYSHVDVYDPTSNAYFTGTTQPAGGAWKSWKFDNFEVNGLYHFTTAFYVGAAYTYTRTRVASTVGAFNPKWHQLSTKLNYDLSKRTSVFVEGVYQHAMSAHTGTDFDYAYIPGAADISSGPNQYVARIALLHHF

SEQ ID NO: 7052 - protein, 1065 aa, Hydrogenivirga sp. 128-5-R1-1
MRKALLFVVALFTMALSYEVSAQQRVITGTVISEEDGLGLPGATVLVKGTTVGTTTDLDGNYSINVPAGSDVLIYSFVGLKSQEEVIGDRSIINVTLTTDAAQLNEVVVTAIGIEREKKALGYAVTTVGDEQLENRPEQDVARVLQGKVPGVNITSTNGMSGSGTNMVIRGYSSATGSNQPLFVVDGVPFNTSTNNTNGFTTGGATTSSRFLDIDPNNIESMSVLKGLSATVLYGDQGRNGVILITTKSGASKRKAAEVTINQSFFSNKAASLPTYGYEYGNGFQQAPGFFFSNFGPRLDAGITVNHPYASSSVASVREAFPEFWVDGVVGGTPVQYDYKAYEDPSTAFFRTGLVANTSVQISGGSDRTGFNASFGYTDDKGFTPGNELVKYNFGLGVNSSINDKLSVRSSFTFAITDLESPPVNAAYGSGPSGGIPSVFAHVLYTPRSVDLAGLPFENPVDNSSVYYRGGNDIVNPRWLAKYYKNTSDVNRFFNSTSLIYDVNDNFSITYRLGLDTYTEKQEKLYNKGAGSGSAAIQSGMYTTANITNTIWNQDLVLNWKKEFSEKFGMSALLGGNSRYDSFVRDGIESQGQLAFGLFRHSNFTSASNGGLNFTSEQRRMGIYANLTFDYSNFLYFTLSGRNDWTSTVEKENRRILYPGASVSFIPSTAFNWNSTTINDLKLRLGYGTSAGFPSPYRTRNILDQDSQAFLRDGQLTQTHSVNNRLGNPNLKPELIEELEFGVEAVMFNNKLRFDLSLFEKNTNDLITSAPIDPATGFTSTEINVGKIRTRGIEFQANVTPISTASGFTWNSTVNWSLYRSVTVELGEGLEEVVVAGFTTLGNFAIPGEPFNIIKGIGFARDEQSGEPIVLSDGIYQADPDLKILGDPNPAWTGSWINTFSWKGFTLNAMLEYRHKGAVFSNTVTATLARGVTKDPVADREMSFIMPGVKEDGTPNDIQISASDYFFSGYQGRTDEPNVFDGSMIRLREVSLGYELPTSLMAKTPFKRASIAVSGSNLWFKALNFPPNMNYDVDVLGTGVGNGLGFDFVTGPSSRRFGGTVTLAF

SEQ ID NO: 7053 - protein, 953 aa, Hydrogenivirga sp. 128-5-R1-1
MVSDLCCPSMCPYCRSLFYLISFSLCSYELICLAKDKTTSSSYTLSASGYSYPLSTLLGIDGSINTSLENYGLLHDATTDIDITGQKYFYINYQYFKDNGGAVTAKDLNISKNTGPIVFGKNTSYQNGGAVSSTNCNITENKQRCCFINNATMLTPDAREATQAGGAIQCSQLAISNNQGSCEFISNVSLIQGGAISSSGDVQITENHQPVILNNNKCLTNESKGGGVYSNNCSITSNHAPITFINNQSGYGGGIFSTTNCNISYNSEIVSFLSNSGVNHIYSSQDYGGGAICSSNCNITNNSKGVIFQNNVSRRNGGAIYSKNLTIQDNGPVLFLNNVSTWGAGIQNYGGNSKFYLSADQGDIVFRNNRSVKSNNRNAIRSTVNLYLQIGARHGYSVKFYDPVEHEHPSTLGLVFNPESHHLGTVLFSGADVSPDEASDQNYFSLLRNTCKIAHGVVAVEDKAGLGIYNISQEEGILRLGNNSVIKTLKKRTSTSGSTSETYEGSSLDLTKLALNLPSILAPGANAPKIWLDPDDTSKENAITENEPKVTLSGPLLLLNSENQDPYDSLDLSSGITRVPLLYLCDNKSNKIDAQNLDIQAVNETHHYGYQGIWSPYWEQYTTETTNTNHRYLYANWTPTGYIPNPIYRGDLVANALWQAAYNIATGLHTLEHCSHKIPNREISGGGLGTYVLQKTRNSQQGFQLFSKGYSTEVAGSTETQHNFTLSFAQFYSEIRESKFKNKVSSNCYFAGAQIQIPLFDEDILTSASLGYVYSHSRVKTKNPTLKTASEGHFHGHTIGSEICCMLPEGGVSYLQFRPFIKALGIHAIQESFKETGDHIRSFETQHPLINVTLPIGISCYAQHEASLKTDWKFQLAYTPTIYRQKPKILTRRWISKGSWITSGTPVDYHAGSVTINNTISFFNKMSLSINYRGDFSKSTLCNFLNITSELQF

SEQ ID NO: 7054 - protein, 839 aa, Hydrogenivirga sp. 128-5-R1-1
MRELQGRGGPGWVGSELQQRGRSEPGREKVAAVQRHGVSFPIPLSRNSARPFVRTFVRRTIYVSAQHLMQDRVILHILSTPLNMDRQEIADDSTDEPDPAPQADDRGRDRRGAARPRRAPRRDATRRALRRLAHADPRGAAAVGRHRPRRDQAAPRYGRERARAGPSLGDVRDDGGTGSRLRPARRAPPHAGARGGVDGRRRSLRTGRRRRRSGGLLRRELRLPYGDLPRLPQRLPLRAGAGAAPPPLALPAPATAHPPPGGAIARRARGGRRRDPRQRWRRGGRSAPPPCADPGRRLFGTGGESAGAGSQRGVSTLEGRTSRASLPVLWQGRRGGRKLTLRGSPWRFFVSRRSLPGALPVALALTTLAGSPALAQPTGRPVYEGAGGDPRIAVAQPESTSQASGGYVRSIEPSLGPFGDPLGLRPLLKERGIEYSLTYIAETLGNPVGGIRQGAIVEDRLNLRLNLDLQRLAGWDGATVHANAYFIHGTGLSRYDVGNLLAASVIEALPASRLYTLWLDQQLFDGKLGIRIGQQAADTEFFVSQTATLFVNSTFGWPAITALDLPSGGPAYPLATPAIRAKYVPGNGFSLQAGLYDGDPAGANRPGDDPEGQRLDRTGTNFRTRDPALVVAEATYAFNTQEGSKELPGDITLGGWQHFGRFESLRFDQTGLPLADPNSTGIGRRLRGNAGIYAVYDQTLYWESGKDDEGLGFFLRAAWSPTRSSLVSAYLDTGLAYKGLLPGRDNDTVGVSLAQARLSDDARRSDIDTIVLTGTPMPRRRAETVIEATYQAVVVPGFTVQPDAQLILHPGGGIANPRDPEGRRVRNAAVLGLRATVQY

SEQ ID NO: 7055 - protein, 798 aa, Hydrogenivirga sp. 128-5-R1-1
MRRAFRRTRLYLALATASGILMGNSLPLHAVEQTQPGSRHFDIAPGPLGQALTRFSDQSGLRLIVASQLLAGHRSPGLQGEYDIQQGLRQLLAGSGLVGTVSGDTLLIEKAAQGDAMSLDIMRVEDNALGTITEQTKSYTPGTIATATRLVLTPRETPQTVTVVTRQHMDDFNLTNINKVMDHTPGITRHGTDNYRSYYYARGYEIRNFQYDGIPILSDGVIFSGETASDMIQYDRVEVIKGASGLTTGAGSPGATINLVRKKPTHEFSGHATAEYGRWDNYRTEWDVGGPLVESGSIRGRFATAFQDQQSYMDHFKEQRRALYGILEVDLSPKTMLTFGGNYDKTTPTGSSWGGTPFFDSHNNEVNISRSFNPGASWSRAEQFSHAFFSQLDHEFDNGWSGRVYYTFQRNASDGNLGSIKYTPDGDTGSSELLSGQYRYKTRSQALEAYARGPFELFGRTHELAVGVSGYHNHLKGSGHNVIRVPVNNIWEWNGHAERPDWGGILYRAEDRIDQRAYYASGRFSLTDDLAVILGGRVTNYRRGGDSNMRETGELVPFAGITYDLNDNFSLYASYTKIFRPQSARDESYAVLDPDEGDSYEGGLKGEWFNGRLNASLAYFEIRQDNRAELLGWNSERNYSMYEGRKAKTKGIELEISGELMPGWNIQAGFTHQVIRDDETNEKLTTQEPENQFKLYTTYRLPGRLSKITIGGGGTYQGTTWRDGTDALGNEHQFKNEAYWLVNLMGRYQITDNLSATLNINNLFDKYYYSNYGERWTGVATKTYGEPRNMMLTTRWDF

SEQ ID NO: 7056 - protein, 239 aa, Anaplasma phagocytophilum
LISGSSFAYSGNNDASDVSGVMNGSFYVSGSYSPSFPSISSFDISESDRGGSYVKGYNKNLSTLNVSDPISFTQNDPSFKFAKSLLTSFDGATGYAIGGARVEVEVGYKKFETLAESDYKHVESHNFVAVGRDATLTLDNFFVMKIDSVKDISVMLNACYDVMHTDLPVSPYMCAGLGASFINIADHVTSKLAYRGKVGVSYKLTPEISLIAGGFYHGIFDEQYAGIPASNRVNIAGGA

SEQ ID NO: 7057 - protein, 239 aa, Anaplasma phagocytophilum
LISGSSFAYSGNNDASDVSGVMNGSFYVSGSYSPSFPSISSFAISESDRGGSYVKGYNKNLSTLNVSDPASFTQHEPSFKFAKSLLTSFDGATGYAIGGARVEVEVGYKKFETLAESDYKHVESHNFVAVGRDATLTPDNFFVMKIDSVKDISVMLNACYDVMHTDLPVSPYMCAGLGASFINIADHVTSKLAYRGKVGVSYRLTPEISLIAGGFYHGIFDEQYAGIPASNRVNIAGGA

SEQ ID NO: 7058 - protein, 237 aa, Anaplasma phagocytophilum
LISGSSFAYSGNNDASDVSGVMNGSFYVSGSYSPSFPSISSFDISESDRGGSYVKGYNKNLSTLNVSDPISFTQHDPSFKFAKSLLTSFDGATGYAIGGARVEVEVGYKKFETLAESDYKHVESHNFVAVGRDATLTPDNFFVMKIDSVKDISVMLNACYDVMHTDLPVSPYMCAGLGASFINIADHVTSKLAYRGKVGVSYKLTPEISLIAGGFYHGIFDEQYAGIPASNRVNIAG

SEQ ID NO: 7059 - protein, 323 aa, Anaplasma phagocytophilum
LIALTLAALPVAATADVTLYGTIKAGVQTYRSVEHTKGKVSKVETGSEIADFGSKIGFKGQEDLGNGLKAVWQLEQGASVAGTNTGWGNKQSFVGLKGGFGTIRAGSLNSPLKNTKDNVNAWESGKFTGNVLEISGMAKREHRYLSVRYDSPEFAGFSGSVQYAPKDNSGSNGESYHVGLNYQNSGFFAQYAGLFQRYGEGTKKIEYEHQVYSIPSLFVEKLQVHRLVGGYDNNALYVSVAAQQQDAKLYRARRANSHNSQTEVAATAAYRFGNVTPRVSYAHGFKGTVDSADHDNTYDQVVVGAEYDFSKRTSALVSAGWLQ

SEQ ID NO: 7060 - protein, 236 aa, Anaplasma phagocytophilum
GSSFAYSGNNDASDVSGVMNGSFYVSGSYSPSFPSISSFDISESDRGGSYVKGYNKNLSTLNVSDPASFTQNEPSFKFAKSLLTSFDGATGYAIGGARVEVEVGYKKFETLAESDYKHVESHNFVAVGRDATLTPDNFFVMKIDSVKDISVMLNACYDVMHTDLPVSPYMCAGLGASFINIADHVTSKLAYRGKVGVSYKLTPEISLIAGGFYHGIFDEQYAGIPASNRVNIAGGA

SEQ ID NO: 7061 - protein, 291 aa, Anaplasma phagocytophilum
CAAMADVTLYGTIKAGVETSRSVAHNGAQAASVETGTGIVDLGSKIGFKGQEDLGNGLKAIWQVEQKASIAGTDSGWGNRQSFIGLKGGFGKLRVGRLNSVLKDTGDINPWDSKSDYLGVNKIAEPEARLISVRYDSPEFAGLSGSVQYALNDNAGRHNSESYHAGFNYKNGGFFVQYGGAYKRHHQVQENVNIEKYQIHRLVSGYDNDALYASVAVQQQDAKLVEENYSHNSQTEVAATLAYRFGNVTPRVSYAHGFKGSFDATNYNNDYDQVVVGAEYDFSKRTSALVS

SEQ ID NO: 7062 - protein, 235 aa, Anaplasma phagocytophilum
GSSFAYSGNNDASDVSGVMNGSFYVSGSYSPSFPSISSFAISESDRGGSYVKGYNKNLSTLNVSDPASFTQNEPSFKFAKSLLTSFDGATGYAIGGARVEVEVGYKKFETLAESDYKHVESHNFVAVGRDATLTPDNFFVMKIDSVKDISVMLNACYDVMHTDLPVSPYMCAGLGASFINIADHVTSKLAYRGKVGVSYKLTPEISLIAGGFYHGIFDEQYAGIPASNRVNIAGG

SEQ ID NO: 7063 - protein, 145 aa, Anaplasma phagocytophilum
GSRDHAVYPAFVRIGFTLNPLFGIRSERASLQLALEPFLNPVSSETDGVEAGIGIGLRYRHKLSLPLDIYIEGSIAPMYLGIDTGEQGAGGFNFLDQAGAGLQYRITKTNALFGGYRFRHISHAGTMDRSNDGINSHALVLGVSW

SEQ ID NO: 7064 - protein, 299 aa, Anaplasma phagocytophilum
SFASTETLSFTPDNINADISLGTLSGKTKERVYLAEEGGRKVSQLDWKFNNAAIIKGAINWDLMPQVSVGAAGWTTLGQKGGNMIDRDWQDPDKPGIWTDESRHPDTRLNFANEFDLNIKGWLLNESNYRLGLMAGYQESRYSFTARGGSYIYSDEGFRDDIGSIPNGERAIGYKQRFKMPYIGLTGSYRYEDFEFGGTFKYSGWVEASDNDEHYARVKRITYRSNVKDQNYYSIAVNAGYYVTPNAKVYVEGAWNRVTNKKGDTSLYDHNDNTSEYSKNGAGIENYNFITTAGLKYTF

SEQ ID NO: 7065 - protein, 261 aa, Wolbachia endosymbiont of Chouioia cunea
LVNGAVVASPMSHEVASEGSGVMGGSFYVSAAYSPAFPSVTSFDMRESSRETSYVIGYDKSVATIDVSAPANFSKSGYTFAFSKNLLTSFDGAVGYSLGGARVELEASYRRFATLADGQYAKSGAESLAAITRDAVITENNYFVVKIDEITNTSVMLNGCYDVLHTDLPVSPYVCAGIGASFVDISKQVTTKLAYRGKVGISYQFTPEISLVVGGFYHGLFDESYKDIPAHNSVKFPGEAKASVKAHIADYGFNLGARFLF

SEQ ID NO: 7066 - protein, 149 aa, Escherichia coli
LAVYTRLGGMVWRADSTQSNPTYGRISNHDTGLSPLAAVGVEYAVTKNWATRLDYQWVNNIGDAGTVGARSDNSMLSVRVSYRFGRDKAAPVVAPAPAPAPVVETKRFTLKSVVLFTFNKSTLKPVGQQALDQLYTQLSNLDPKDGSVV

SEQ ID NO: 7067 - protein, 354 aa, Escherichia coli
LDDNEAQKMKKTAIAIAVALAGFATVAQAAPKDNTWYTGAKLGWSQYHDTGFINNNGPTHENQLGAGAFGGYQVNPYVGFEMGYDWLGRMPYKGSVENGAYKAQGVQLTAKLGYPITDDLDVYTRLGGMVWRADTKSNFDGKNHDTGVSPVFAGGVEYAITPEIATRLEYQWTNNIGDAHTIGTRPDNGMLSLGVSYRFGQGEAAPVVAPAPAPAPEVQTKHFTLKSDVLFTFNKATLKPEGQAALDQLYSQLSNLDPKDGSVVVLGYTDRIGSDAYNQGLSERRAQSVVDYLISKGIPADKISARGMGESNPVTGNTCDNVKQRAALIDCLAPDRRVEIEVKGIKDVVTQPQA

SEQ ID NO: 7068 - protein, 358 aa, Escherichia coli
LDDNEAQKMKKTAIAIAVALAGFATVAQAAPKDNTWYTGAKLGWSQYHDTGFIPNNGPTHENQLGAGAFGGYQVNPYVGFEMGYDWLGRMPYKGDNINGAYKAQGVQLTAKLGYPITDDLDVYTRLGGMVWRADTKANVPGGASFKDHDTGVSPVFAGGVEYAITPEIATRLEYQWTNNIGDAHTIGTRPDNGMLSLGVSYRFGQGEAAPVVAPAPAPAPEVQTKHFTLKSDVLFNFNKATLKPEGQAALDQLYSQLSNLDPKDGSVVVLGYTDRIGSDAYNQGLSERRAQSVVDYLISKGIPADKISARGMGESNPVTGNTCDNVKQRAALIDCLAPDRRVEIEVKGIKDVVTQPQA

SEQ ID NO: 7069 - protein, 197 aa, Wolbachia endosymbiont of Diabrotica barberi
GPISDEETSYYVRLQYNGEILPLFTKVDGIEYKKGTENHTPLKASFIAGGGAFGYKMDNIRVDVEGLYSQLNKNAVTGAAFNPDTVADSLTAFSGLVNVYYDIAIEDMPITPYIGVGVGAAYISNPSKVDAVKDQRGFGFAYQAKAGVSYDVTPEIKLYAGARYFGSYGANFDKTAKDDAGIKGVLYGTVGAEAGVA

SEQ ID NO: 7070 - protein, 197 aa, Wolbachia endosymbiont of Diabrotica barberi
GPISDEETSYYVRLQYNGEILPLFTKVDGIEYKKDKDSHDPLKASFIAGGGAFGYKMDDIRVDVEGLYSRLNKDADVAGATVADNLTAISGLVNVYYDIAIEDMPITPYVGVGVGAAYISTPLATVVNSQNGKFAFAGQARAGVSYDVTPEVKLYAGARYFGSYGANFDKSVGEKDKGGHAVLYSTVGAEAGVAFNF

SEQ ID NO: 7071 - protein, 197 aa, Wolbachia endosymbiont of Diabrotica barberi
GPISDEETSYYVRLQYNGEILPLFTKVDGIEYKKGTENHTPLKASFIAGGGAFGYKMDNIRVDVEGLYSQLNKNAVTGAAFNPDTVADSLTAFSGLVNVYYDIAIEDMPITPYIGVGVGAAYISNPSKVDAVKDQKGFGFAYQAKAGVSYDVTPEIKLYAGARYFGSYGANFDKTAKDDAGIKGVLYSTVGAEAGVA

SEQ ID NO: 7072 - protein, 223 aa, Wolbachia endosymbiont of Diabrotica barberi
GPISDEETSYYVRLQYNGEILPFYTSIEGIKHKSGKDKNSPLKASFIAGGGAFGYKMDDIRVDVEGLYSQLSKDADVVSAAAAAVAAAGSSPAVAAIPEVAESLTAISGLVNVYYDIAIEDMPITPYVGVGVGAAYISTPLKTAVNGQNSKFGFAGQVKAGVSYDVTPEIKLYVGARYFGSYGANFDGQKTDPKDPTKQVTDAGAYKVLYSTVGAEAGVAFNF

SEQ ID NO: 7073 - protein, 196 aa, Wolbachia endosymbiont of Diabrotica barberi
GPISDEETSYYVRLQYNGEILPLFTKVDGITNVTGKEKDSPLKASFIAGGGAFGYKMDDIRVGVEGLYSWLNKDADVAGDTVADNLTAISGLVNVYYDVAIEDMPITPYIGVGVGAAYISTPLKTAINDQNSKFGFAGQVKAGVSYDVTPEIKLYAGARYFGSYGANFDKTSGATGKDKGGHTVFYSTVGAEAGVA

SEQ ID NO: 7074 - protein, 200 aa, Wolbachia endosymbiont of Diabrotica barberi
GPISDEETSYYVRLQYNGEFLPLFTKVDGITYKKDKSDYSPLKPSFIAGGGAFGYKMDDIRVDVEGVYSYLNKNDVKDVTFDPANTIADSLTAFSGLVNVYYDIAIEDMPITPYIDVGVGAAYISTPLKTPINDQKSKFGFAGQVKAGVSYDVTPEIKLYAGARYFGSFGAHFDKDASTGKDKGELKVLYSTVGAEAGVA

SEQ ID NO: 7075 - protein, 200 aa, Wolbachia endosymbiont of Diabrotica barberi
GPISDEETSYYVRLQYNGEILPLFTKVEGITYKKDSSDYSPLKASFIAGGGAFGYKMDDIRVDVEGVYSYLNKNDVTGATFTPDTIANSLTAISGLVNVYYDIEIEDMPITPYVGVGVGAAYISTPLATAMSSQNGKFAFAGQARAGVSYDVTPEVKLYAGARYFGSYGANFDKTDKDGKGEHKVLYSTVGAEAGVAFNF

SEQ ID NO: 7076 - protein, 193 aa, Wolbachia endosymbiont of Diabrotica barberi
GPISDEETSYYVRLQYNGEILPLFTKVDGITNVTGKEKDSPLKASFIAGGGAFGYKMDDIRVDVEGLYSWLNKDADVAGDTVADNLTAISGLVNVYYDIAIEDMPITPYIGVGVGAAYISNPSKVDAVKDQRGFGFAYQAKAGVSYDVTPEIKLYAGARYFGSYGANFDKSAKDDAGIKGVLYSTVGAEAGVA

SEQ ID NO: 7077 - protein, 195 aa, Wolbachia endosymbiont of Diabrotica barberi
GPISDEETSYYVRLQYNGEILPLFTKVDGITNVTGKEKDSPLKASFIAGGGAFGYKMDDIRVDVEGLYSWLNKDADVAGDTVADNLTAFSGLVNVYYDIAIEDMPITPYIGVGVGAAYISTPLKTPINDQKSKFGFAGQVKAGVSYDVTPEIKLYAGARYFGSFGAHFDKDASTGKDKGELKVLYSTVGAEAGVA

SEQ ID NO: 7078 - protein, 200 aa, Wolbachia endosymbiont of Diabrotica barberi
GPISDEETSYYVRLQYNGEFLPLFTKVDGITYKKDKSDYSPLKPSFIAGGGAFGYKMDDIRVDVEGVYSYLNKNDVKDVTFDPANTIADSLTAFSGLVNVYYDIAIEDMPITPYIGVGVGAAYISTPLKTPINDQKSKFGFAGQVKAGVSYDVTPEIKLYAGARYFGSFGAHFDKDASTGKDKGELKVLYSTVGAEAGVA

SEQ ID NO: 7079 - protein, 210 aa, Wolbachia endosymbiont of Diabrotica barberi
GPISDEETSYYVRLQYNGEFLPLFTKVDGITYKKDKSDYSPLKPSFIAGGGAFGYKMDDIRVDVEGVYSYLNKNDVKDVTFDPANTIADSVTAISGLVNVYYDIAIEDMPITPYIGVGVGATYISTPLEPAVNDQKSKFGFAGQVKAGVSYDVTPEVKLYAGARYFGSYGANFDGKKTDPKDSTRQVTDAGAYKVLYSTVGAEAGVAFNF

SEQ ID NO: 7080 - protein, 202 aa, Wolbachia endosymbiont of Diabrotica barberi
GPISDEETSYYIRLQYNGEILPLFTKIEGIEYKKGTDSHNPLKASFIAGGGAFGYKMDDIRVDVEGVYSQLSKNNVDGAALTPADAIADSLTAISGLVNVYYDIAIEDMHITPYIGGGVGAAYISTPLKTAVNGQNSKFGFAGQVKAGVSYDVTPEVKLYAGARYFGSYGANFDKSGGEKDKGGHTVLYSTVGAEAGVAFNF

SEQ ID NO: 7081 - protein, 196 aa, Wolbachia endosymbiont of Diabrotica barberi
GPISDEETSYYVRLQYNGEILPLFTKVDGITNVTGKEKDSPLKASFIAGGGAFGYKMDDIRVDVEGLYSWLNKDADVAGDTVADNLTAISGLVNVYYDVAIEDMPITPYIGVGVGAAYISTPLKTAINDQNSKFGFAGQVKAGVSYDVTPEIKLYAGARYFGSYGANFDKTSGATGKDKGGHTVFYTTVGAEAGVA

SEQ ID NO: 7082 - protein, 196 aa, Wolbachia endosymbiont of Diabrotica barberi
GPISDEETSYYVRLQYNGEILPLFTKVDGITNVTGKEKDSPLKASFIAGGGAFGYKMDDIRVDVEGLYSWLNKDADVAGDTAADNLTAISGLVNVYYDVAIEDMPITPYIGVGVGAAYISTPLKTAINDQNSKFGFAGQVKAGVSYDVTPEIKLYAGARYFGSYGANFDKTSGATGKDKGGHTVFYSTVGAEAGVA

SEQ ID NO: 7083 - protein, 196 aa, Wolbachia endosymbiont of Diabrotica barberi
GPISDEETSYYVRLQYNGEFLPLFTKVDGITNVTGKEKDSPLKASFIAGGGAFGYKMDDIRVDVEGLYSWLNKDADVAGDTVADNLTAISGLVNVYYDVAIEDMPITPYIGVGVGAAYISTPLKTAINDQNSKFGFAGQVKAGVSYDVTPEIKLYAGARYFGSYGANFDKTSGATGKDKGGHTVFYSTVGAEAGIA

SEQ ID NO: 7084 - protein, 205 aa, Wolbachia endosymbiont of Diabrotica barberi
GPISDEETSYYVRLQYNGEFLPLFTKVDGITNATGKEKDSPLKASFIAGGGAFGYKMGDIRVDVEGLYSWLNKDADVVGDTVADNLTAISGLVNVYYDVAIEDMPITPYVGVGVGAAYISTPLKDAVNDQKSKFGFAGQVKAGVSYDVTPEVKLYAGARYFGSYGANFDGKKTDPKDSTKQVTDAGAYKVLYSTVGAEAGVAFNF

SEQ ID NO: 7085 - protein, 198 aa, Wolbachia endosymbiont of Diabrotica barberi
GPISDEETSYYVRLQYNGEILPLFTKVDGITNVTGKEKDSPLKASFIAGGGAFGYKMDDIRVDVEGVYSYLNKNNVTDARFTPDAIADSVTAISGLVNVYYDIAIEDMPITPYVGVGVGAAYISTPLKDAVNDQKSKFGFAGQVKAGVSYDVTPEVKLYAGARYFGSYGANFDKSVGEKDKGGHTVLYSTVGAEAGVA

SEQ ID NO: 7086 - protein, 200 aa, Wolbachia endosymbiont of Diabrotica barberi
GPISDEETSYNVRLQYNGEILPLFTKIDGIDYKKGTDIYSPLKASFIAGGGAFGYKMDDIRVDVEGVYSYLNKNDVTGATFTPDTVAGSLTAISGLVNVYYDVAIEDMPITPYVGVGVGAAYISTPLATAVSSQNGKFAFAGQTRAGVSYDVTPEVKLYAGAHYFGSYGANFDKTDKDGKEELKVFYSIVGAEAGVAFNF

SEQ ID NO: 7087 - protein, 197 aa, Wolbachia endosymbiont of Diabrotica barberi
GPISDEETSYYVRLQYNGEILPLFTKVDGIEYKKGTENHTPLKASFIAGGGAFGYKMDNIRVDVEGLYSQLNKNAVTGAAFNPDTVADSLTAFSGLVNVYYDIAIEDMPITPYIGVGVGAAYISNPSKVDAVKDQRGFGFAYQAKAGVSYDVTPEIKLYAGARYFGSYGANFDKTAKDDAGIKGVLYSTVGAEAGVA

SEQ ID NO: 7088 - protein, 196 aa, Wolbachia endosymbiont of Diabrotica barberi
GPISDEETSYYVRLQYNGEILPLFTKVDGITNVTGKEKDSPLKASFIAGGGAFGYKMDDIRVDVEGLYSWLNKDADVAGDTVADNLTAISGLVNVYYDVAIEDMPITPYIGVGVGAAYISTPLKTAINDQNSKFGFAGQVKAGVSYDVTPEIKLYAGARYFGSYGANFDKTSGATGKDKGGHTVFYSTVGAEAGVA

SEQ ID NO: 7089 - protein, 193 aa, Wolbachia endosymbiont of Diabrotica barberi
GPISDEETSYYVRLQYNGEILPLFTKVDGITNVTGKEKDSPLKASFIAGGGAFGYKMDDIRVDVEGLYSWLNKDADVAGDTVADNLTAISGLVNVYYDVAIEDMPITPYIGVGVGAAYISNPSKVDAVKDQRGFGFAYQAKAGVSYDVTPEIKLYAGARYFGSYGANFDKTAKDDAGIKGVLYSTVGAEAGVA

SEQ ID NO: 7090 - protein, 733 aa, Pseudomonas fluorescens
MDRRKQPSPLPPRRPLAPLMLLMAACSSPTLAEEAARKDDPLELGSDTVTGERDSSRVVRSASAKYAVPLLDTPQTVTVVPQKVIQEQNALSLRQVLSNVSGITFNAGEGGGGSGDSINIRGFGANANMQVDGLRDSAQTSRSDLFNLEAVEVIKGPNSVFGGAGTTGGSINMVSKQPRGEAFTHLGGGLGTDRYRRLTLDANQPLEGLGESTALRLNLMAHHNDVAGRDEIDKERWGLAPSLTFGLDTPTRLTLSYFHQRDDNLPDYGVPALDGRKLDGVGRHAYFGWRNLDKERIDSDVATLKFEHDFSDALQLQNLTRYSHLRRDTVISASHVNQKGLPPGRYLPAGPQAYGRDSRNRMWTNQSNLTARFDTFGLGHTLVGGLELTRETYDRTTYSYNIGKFYPADGFDLHNPPGHWSGPTDKRDSGRNRTELETRGLYAFDTIALHPRWDLSLGLRYDWIDGKSRSRPAGKPEVRADSSDGKLSGRAGLVFKPRENGRIYLSYGTSFNPSAEYLVSTGSGVSQATGDLAPEKNSTYELGTKWEFLERRLELDAALFQVKKENARESLLDGTYVMSGEQRVRGLELSAKGKLSERWDLFASYTFLDSEVLKSVRYPEREGQALANTPPRSLSLWSTYELPEGLTLGYGARYVSQRNVTSASTAKLDAYWVHSLMLGYQATRDLKLQLNLDNLFDKAYVERVRQVTGNQTRSSAIEYGDGRSAILSAVYAF

SEQ ID NO: 7091 - protein, 1247 aa, Escherichia coli
GLIAVSELSGRVSSRATGKKKHKRILALCFLGLLPSSYSFASQMDISNFYIRDYMDFAQNKGIFQAGATNIEIVKKDGSTLKLPEVPFPDFSPVANKGSTTSIGGAYSITATHNTKNHHSVATQNWGNSTYKQTDWNTSHPDFAVSRLDKFVVETRGATEGADISLSKQQALERYGVNYKGEKKLIAFRAGSGVVSVKKNGRITPFNEVSYKPEMLNGSFVHIDDWSGWLILTNNQFDEFNNIATQGDSGSALFVYDNQKKKWVVAGTVWGIYNYANGKNHAAYSKWNQTTIDNLKNKYSYNVDMSGAQVATIENGKLTGTGSDTTDIKNKDLIFTGGGDILLKSSFDNGAGGLVFNDKKTYRVNGDDFTFKGAGVDTRNGSTVEWNIRYDNKDNLHKIGDGTLDVRKTQNTNLKTGEGLVILGAEKTFNNIYITSGDGTVRLNAENALSGGEYNGIFFAKNGGTLDLNGYNQSFNKIAATDSGAVITNTSTKKSILSLNNTADYIYHGNINGNLDVLQHHETKKENRRLILDGGVDTTNDISLRNTQLSMQGHATEHAIYRDGAFSCSLPVPMRFLCGSDYVAGMQNTEADAVKQNGNAYKTNNAVSDLSQPDWETGTFRFGTLHLENSDFSVGRNANVIGDIQASKSNITIGDTTAYIDLHAGKNITGDGFGFRQNIVRGNSQGETLFTGGITAEDSTIVIKDKAKALFSNYVYLLNTKATIEKGADVTTQSGMFSTRDISVSGNLSMTGNPDKDNKFEPSIYLNDASYLLTDDSARLVAKNKASVVGDIHSTKSASIMFGHDESDLSQLSDRTSKGLALGLLGGFDVSYRGSVNAPSASATMNNTWWQLTGDSALKTLKSTNSMVYFTDSANNKKFHTLTVDELATSNSAYAMRTDLKNSDKLVVNKKLSGKDNILLVDFLNKPSGEKLDIELVSAPGNSSKDVFKGSEQAIGFSNVTPVITPRETDDKITWSLTGYNTVANKEATRNAAALFSVDYKAFLNEVNNLNKRMGDLRDINGEAGAWARIMSGTGSASGGFSDNYTHVQVGVDKKHELDGLDLFTGFTVTHTDSSASADVFSGKTKSVGAGLYASAMFDSGAYIDLIGKYVHHDNEYTATFAGLGTRDYSTHSWYAGAEAGYRYHVTEDTWIEPQAELVYGSVSGKQFAWKDQGMHLSMKDKDYNPLIGRTGVDVGKSFSGKDWKVTARAGLGYQFDLLANGETVLRDASGEKRIKGEKDSRMLMSV

SEQ ID NO: 7092 - protein, 1248 aa, Escherichia coli
GLIAVSELSGRVSSRATGKKKHKRILALCFLGLLQSSYSFASQMDISNFYIRDYMDFAQNKGIFQAGATNIEIVKKDGSTLKLPEVPFPDFSPVANKGSTTSIGGAYSITATHNTKNHHSVATQNWGNSTYKQTDWNTSHPDFAVSRLDKFVVETRGATEGADISLSKQQALERYGVNYKGEKKLIAFRAGSGVVSVKKNGRITPFNEVSYKPEMLNGSFVHIDDWSGWLILTNNQFDEFNNIASQGDSGSALFVYDNQKKKWVVAGTVWGIYNYANGKNHAAYSKWNQTTIDNLKNKYSYNVDMSGAQVATIENGKLTGTGSDTTDIKNKDLIFTGGGDILLKSSFDNGAGGLVFNDKKTYRVNGDDFTFKGAGVDTRNGSTVEWNIRYDNKDNLHKIGDGTLDVRKTQNTNLKTGEGLVILGAEKTFNNIYITSGDGTVRLNAENALSGGEYNGIFFAKNGGTLDLNGYNQSFNKIAATDSGAIITNTSTKKSILSLNNTADYIYHGNINGNLDVLQHHETKKENRRLILDGGVDTTNDISLRNTQLSMQGHATEHAIYRDGAFSCSLPAPMRFLCGSDYVAGMQNTEADAVKQNGNAYKTNNAVSDLSQPDWETGTFRFGTLHLENSDFSVGRNANVIGDIQASKSNITIGDTTAYIDLHAGKNITGDGFGFRQNIVRGSSQGETLFTGGITAEDSTIVIKDKAKALFSNYVYLLNTKATIENGADVTTQSGMFSTSDISISGNLSMTGNPDKDNKFEPSIYLNDASYLLTDDSARLVAKNKASVVGDIHSTKSASIMFGHDESDLSQLSDRTSKGLALGLLGGFDVSYRGSVNAPSASATMNNTWWQLTGDSALKTLKSTNSMVYFTDSANNKKFHTLTVDELATSNSAYAMRTNLSESDKLEVKKHLSGENNILLVDFLQKPTPEKQLNIELVSAPKDTNENVFKASKQTIGFSDVTPVITTRETDDKITWSLTGYNTVANKEATRNAAALFSVDYKAFLNEVNNLNKRMGDLRDINGEAGAWARIMSGTGSASGGFSDNYTHVQVGVDKKHELDGLDLFTGFTVTHTDSSASADVFSGKTKSVGAGLYASAMFDSGAYIDLIGKYVHHDNEYTATFAGLGTRDYSTHSWYAGAEAGYRYHVTEDAWIEPQAELVYGSVSGKQFAWKDQGMHLSMKDKDYNPLIGRTGVDVGKSFSGKDWKVTARAGLGYQFDLLANGETVLRDASGEKRIKGEKDSRMLMSV

SEQ ID NO: 7093 - protein, 1248 aa, Escherichia coli
GLIAVSELSGRVSSRTTGKKKHKRILALCFLGLLPSSYSFASQMDISNFYIRDYMDFAQNKGIFQAGATNIEIVKKDGSTLKLPEVPFPDFSPVANKGSTTSIGGAYSITATHNTKNHHSVATQNWGNSTYKQTDWNTSHPDFAVSRLDKFVVETRGATEGADISLSKQQALERYGVNYKGEKKLIAFRAGSGVVSVKKNGRITPFNEVSYKPEMLNGSFVHIDDWSGWLILTNNQFDEFNNIASQGDSGSALFVYDNQKKKWVVAGTVWGIYNYANGKNHAAYSKWNQTTIDNLKNKFSYKVDMSGAQVATIENGKLTGTGSDTTDIKNKDLIFTGGGDILLKSSFDNGAGGLVFNDKKTYRVNGDDFTFKGAGVDTRNGSTVEWNIRYDNKDNLHKIGDGTLDVRKTQNTNLKTGEGLVILGAEKTFNNIYITSGDGTVRLNAENALSGGEYNGIFFAKNGGTLDLNGYNQSFNKIAATDSGAVITNTSTKKSILSLNNTADYIYHGNINGNLDVLQHHETKKENHRLILDGGVDTTNDISLRNTQLSMQGHATEHAIYRDGAFSCSLPAPMRFLCGSDYVAGMQNTEADAVKQNGNAYKTNNAVSDLSQPDWETGTFRFGTLHLENSDFSIGRNANVIGDIQASKSNITIGDTTAYIDLHAGKNITGDGFGFRQNIVRGNSQGETLFTGGITAEDSTIVIKDKAKALFSNYVYLLNTKATIEKGADVTTQSGMFSTSDISVSGNLSMTGNPDKDNKFEPSIYLNDASYLLTDDSARLVAKNKASVVGDIHSTKSASIMFGHDESDLSQLSDRTSKGLALGFLGGFDVSYRGSVNAPSASATMNNTWWQLTGDSALKTLKSTNSMVYFTDSANNKKFHTLTVDELATSNSAYAMRTNLSESDKLEVKKHLSGENNILLVDFLQKPTPEKQLNIELVSAPKDTNKNVFKASKQTIGFSNVTPVITTQETDDKITWSLTGYNTVANKEATQNAAALFSVDYKAFLNEVNNLNKRMGDLRDINGEAGAWARIMSGTGSASGGFSDNYTHVQVGVDKKHELDGLDLFTGFTVTHTDSSASADVFSGKTKSVGAGLYASAMFDSGAYIDLIGKYVHHDNEYTATFAGLGTRDYSTHSWYAGAEVGYRYHVTEDAWIEPQAELVYGSVSGKQFAWKDQGMHLSMKDKDYNPLIGRTGVDVGKSFSGKDWKVTARAGLGYQFDLLANGETVLRDASGEKRIKGEKDSRMLMSV

SEQ ID NO: 7094 - protein, 1247 aa, Escherichia coli
GLIAVSELSGRVSSRTTGKKKHKRILALCFLGLLPSSYSFASQMDISNFYIRDYMDFAQNKGIFQAGATNIEIVKKDGSTLKLPEVPFPDFSPVANKGSTTSIGGAYSITATHNTKNHHSVATQNWGNSTYKQTDWNTSHPDFAVSRLDKFVVETRGATEGADISLSKQQALERYGVNYKGEKKLIAFRAGSGVVSVKKNGRITPFNEVSYKPEMLNGSFVHIDDWSGWLILTNNQFDEFNNIASQGDSGSALFVYDNQKKKWVVAGTVWGIYNYANGKNHAAYSKWNQTTIDNLKNKFSYKVDMSGAQVATIENGKLTGTGADTTDIKNKDLIFTGGGDILLKSSFDNGAGGLVFNDKKTYRVNGDDFTFKGAGVDTRNGSIVEWNIRYDNKDNLHKIGDGTLDVRKTQNTNLKTGEGLVILGAEKTFNNIYITSGDGTVRLNAENALSGGEYNGIFFAKNGGTLDLNGYNQSFNKIAATDSGAVITNTSTKKSVLSLNNTADYIYHGNINGNLDVLQHHETKKENRRLILDGGVDTTNDISLRNTQLSMQGHATEHAIYRDGAFSCSLPAPMRFLCGSDYVAGMQNTEADAVKQNGNAYKTNNAVSDLSQPDWETGTFRFGTLHLENSDFSIGRNANVIGDIQASKSNITIGDTTAYIDLHAGKNITGDGFGFRQNIVRGNSQGETLFTGGITAEDSTIVIKDKAKALFSNYVYLLNTKATIEKGADVTTQSGMFSTSDISVSGNLSMTGNPDKDNKFEPSIYLNDASYLLTDDSARLVAKNKASVVGDIHSTKSASIMFGHDESDLSQLSDRTSKGLALGLLGGFDVSYRGSVNAPSASATMNNTWWQLTGDSALKTLKSTNSMVYFTDSANNKKFHTLTVDELATSNSAYAMRTDLKNSDKLVVNKKLSGKDNILLVDFLNKPSGEKLDIELVSAPGNSSKDVFKGSEQAIGFSNVTPVITTRETDDKITWSLTGYNTVANKEATRNAAALFSVDYKAFLNEVNNLNKRMGDLRDINGEAGAWARIMSGTGSASGGFSDNYTHVQVGVDKKHELDGLDLFTGFTVTHTDSSASADVFSGKTKSVGAGLYASAMFDSGAYIDLIGKYVHHDNEYTATFAGLGTRDYSTHSWYAGAEAGYRYHVTEDTWIEPQAELVYGSVSGKQFAWKDQGMHLSMKDKDYNPLIGRTGVDVGKSFSGKDWKVTARAGLGYQFDLLVNGETVLRDASGEKRIKGEKDSRMLMSV

SEQ ID NO: 7095 - protein, 1248 aa, Escherichia coli
GLIAVSELSGRVSSRTTGKKKHKRILALCFLGLLPSSYSFASQMDISNFYIRDYMDFAQNKGIFQAGATNIEIVKKDGSTLKLPEVPFPDFSPVANKGSTTSIGGAYSITATHNTKNHHSVATQNWGNSTYKQTDWNTSHPDFAVSRLDKFVVETRGATEGADISLSKQQALERYGVNYKGEKKLIAFRAGSGVVSVKKNGRITPFNEVSYKPEMLNGSFVHIDDWSGWLILTNNQFDEFNNIASQGDSGSALFVYDNQKKKWVVAGTVWGIYNYANGKNHAAYSKWNQTTIDNLKNKFSYKVDMSGAQVATIENGKLTGTGSDTTDIKNKDLIFTGGGDILLKSSFDNGAGGLVFNDKKTYRVNGDDFTFKGAGVDTRNGSTVEWNIRYDNKDNLHKIGDGTLDVRKTQNTNLKTGEGLVILGAEKTFNNIYITSGDGTVRLNAENALSGGEYNGIFFAKNGGTLDLNGYNQSFNKIAATDSGAVITNTSTKKSILSLNNTADYIYHGNINGNLDVLQHHETKKENHRLILDGGVDTTNDISLRNTQLSMQGHATEHAIYRDGAFSCSLPAPMRFLCGSDYVAGMQNTEADAVKQNGNAYKTNNAVSDLSQPDWETGTFRFGTLHLENSDFSIGRNANVIGDIQASKSNITIGDTTAYIDLHAGKNITGDGFGFRQNIVRGNSQGETLFTGGITAEDSTIVIKDKAKALFSNYVYLLNTKATIEKGADVTTQSGMFSTSDISVSGNLSMTGNPDKDNKFEPSIYLNDASYLLTDDSARLVAKNKASVVGDIHSTKSASIMFGHDESDLSQLSDRTSKGLALGFLGGFDVSYRGSVNAPSASATMNNTWWQLTGDSALKTLKSTNSMVYFTDSANNKKFHTLTVDELATSNSAYAMRTNLSESDKLEVKKHLSGENNILLVDFLQKTTPEKQLNIELVSAPKDTNKNVFKASKQTIGFSNVTPVITTQETDDKITWSLTGYNTVANKEATRNAAALFSVDYKAFLNEVNNLNKRMGDLRDINGEAGAWARIMSGTGSASGGFSDNYTHVQVGVDKKHELDGLDLFTGFTVTHTDSSASADVFSGKTKSVGAGLYASAMFDSGAYIDLIGKYVHHDNEYTATFAGLGTRDYSTHSWYAGAEVGYRYHVTEDAWIEPQAELVYGSVSGKQFAWKDQGMHLSMKDKDYNPLIGRTGVDVGKSFSGKDWKVTARAGLGYQFDLLANGETVLRDASGEKRIKGEKDSRMLMSV

SEQ ID NO: 7096 - protein, 1247 aa, Escherichia coli
GLIAVSELSGRVSSRATGKKKHKRILALCFLGLLPSSYSFASQMDISNFYIRDYMDFAQNKGIFQAGATNIEIVKKDGSTLKLPEVPFPDFSPVANKGSTTSIGGAYSITATHNTKNHHSVATQNWGNSTYKQTDWNTSHPDFAVSRLDKFVVETRGATEGADISLSKQQALERYGVNYKGEKKLIAFRAGSGVVSVKKNGRITPFNEVSYKPEMLNGSFVHIDDWSGWLILTNNQFDEFNNIASQGDSGSALFVYDNQKKKWVVAGTVWGIYNYANGKNHAAYSKWNQTTIDNLKNKYSYNVDMSGAQVATIENGKLTGTGSDTTDIKNKDLIFTGGGDILLKSSFDNGAGGLVFNDKKTYRVNGDDFTFKGAGVDTRNGSTVEWNIRYDNKDNLHKIGDGTLDVRKTQNTNLKTGEGLVILGAEKTFNNIYITSGDGTVRLNAENALSGGEYNGIFFAKNGGTLDLNGYNQSFNKIAATDSGAVITNTSTKKSILSLNNTADYIYHGNINGNLDVLQHHETKKENRRLILDGGVDTTNDISLRNTQLSMQGHATEHAIYRDGAFSCSLPAPMRFLCGSDYVAGMQNTEADAVKQNGNAYKTNNAVSDLSQPDWETGTFRFGTLHLENSDFSVGRNANVIGDIQASKSNITIGDTTAYIDLHAGKNITGDGFGFRQNIVRGNSQGETLFTGGITAEDSTIVIKDKAKALFSNYVYLLNTKATIEKGADVTTQSGMFSTSDISVSGNLSMTGNPDKDNKFEPSIYLNDASYLLTDDSARLVAKNKASVVGDIHSTKSASIMFGHDESDLSQLSDRTSKGLALGLLGGFDVSYRGSVNAPSASATMNNTWWQLTGDSALKTLKSTNSMVYFTDSANNKKFHTLTVDELATSNSAYAMRTDLKNSDKLVVNKKLSGKDNILLVDFLNKPSGEKLDIELVSAPGNSSKDVFKGSEQAIGFSNVTPVITTRETDDKITWSLTGYNTVANKEATRNAAALFSVDYKAFLNEVNNLNKRMGDLRDINGEAGAWARIMSGTGSASGGFSDNYTHVQVGVDKKHELDGLDLFTGFTVTHTDSSASADVFSGKTKSVGAGLYASAMFDSGAYIDLIGKYVHHDNEYTATFAGLGTRDYSTHSWYAGAEAGYRYHVTEDTWIEPQAELVYGSVSGKQFAWKDQGMHLSMKDKDYNPLIGRTGVDVGKSFSGKDWKVTARAGLGYQFDLLANGETVLRDASGEKRIKGEKDSRMLMSV

SEQ ID NO: 7097 - protein, 294 aa, Escherichia coli
GLHMPYGGGSTGGALQIDPYTLERIEVLKGPASVLYGQNEPGGIVNMVSKRPTATPIREVVLGGGSQDRRYGAFDVGGTLDEQGTYLYRLTGVGRDINSEIDYAEQKRFMLAPSFTWNPNEQTSLTFYGQYQKDNDVPEAQGLPAYGTVFSTPNGRIKRSTFIGEPGLNSYDRDQFVLGYEFSHEFNDVWTFKQNTRYAYLDDQYVAPLHGYRFVPNPNTGADDRRYATRYGVDWSQTNKAFGMDNMAQAKFKTGAIDHTALIGIDYYHFKSKFFGLYSNQEPTTIIDLYKPVY

SEQ ID NO: 7098 - protein, 1248 aa, Escherichia coli
GLIAVSELSGRVSSRATGKKKHKRILALCFLGLLQSSYSFASQMDISNFYIRDYMDFAQNKGIFQAGATNIEIVKKDGSTLKLPEVPFPDFSPVANKGSTTSIGGAYSITATHNTKNHHSVATQNWGNSTYKQTDWNTSHPDFAVSRLDKFVVETRGATEGADISLSKQQALERYGVNYKGEKKLIAFRAGSGVVSVKKNGRITPFNEVSYKPEMLNGSFVHIDDWSGWLILTNNQFDEFNNIASQGDSGSALFVYDNQKKKWVVAGTVWGIYNYANGKNHAAYSKWNQTTIDNLKNKYSYNVDMSGAQVATIENGKLTGTGSDTTDIKNKDLIFTGGGDILLKSSFDNGAGGLVFNDKKTYRVNGDDFTFKGAGVDTRNGSTVEWNIRYDNKDNLHKIGDGTLDVRKTQNTNLKTGEGLVILGAEKTFNNIYITSGDGTVRLNAENALSGGEYNGIFFAKNGGTLDLNGYNQSFNKIAATDSGAVITNTSTKKSILSLNNTADYIYHGNINGNLDVLQHHETKKENRRLILDGGVDTTNDISLRNTQLSMQGHATEHAIYRDGAFSCSLPAPMRFLCGSDYVAGMQNTEADAVKQNGNAYKTNNAVSDLSQPDWETGTFRFGTLHLENSDFSVGRNANVIGDIQASKSNITIGDTTAYIDLHAGKNITGDGFGFRQNIVRGNSQGETLFTGGITAEDSTIVIKDKAKALFSNYVYLLNTKATIENGADVTTQSGMFSTSDISISGNLSMTGNPDKDNKFEPSIYLNDASYLLTDDSARLVAKNKASVVGDIHSTKSASIMFGHDESDLSQLSDRTSKGLALGLLGGFDVSYRGSVNAPSASATMNNTWWQLTGDSALKTLKSTNSMVYFTDSANNKKFHTLTVDELATSNSAYAMRTNLSESDKLEVKKHLSGENNILLVDFLQKPTPEKQLNIELVSAPKDTNENVFKASKQTIGFSDVTPVITTRETDDKITWSLTGYNTVANKEATRNAAALFSVDYKAFLNEVNNLNKRMGDLRDINGEAGAWARIMSGTGSASGGFSDNYTHVQVGVDKKHELDGLDLFTGFTVTHTDSSASADVFSGKTKSVGAGLYASAMFDSGAYIDLIGKYVHHDNEYTATFAGLGTRDYSTHSWYAGAEAGYRYHVTEDAWIEPQAELVYGSVSGKQFAWKDQGMHLSMKDKDYNPLIGRTGVDVGKSFSGKDWKVTARAGLGYQFDLLANGETVLRDASGEKRIKGEKDSRMLMSV

SEQ ID NO: 7099 - protein, 916 aa, Microcystis aeruginosa PCC 7806
MENNMKAHNLKYTVAFFLLLSPFGMFAQQQMAMDSISIFELMDAVEKGTSCRIYTTITVPFKVKRAEVKNPTAEYLREALAATIYKVTVYGDRIFVLPEVFLATSLPPVLMGEKLETDEELLPSYIPIVKSSSENKVYEIGNKYKPAPGDMITLTGRVSDFKTGQNLDGINIIHREPWVATTTNRQGEFTIDLPAGYNILEISGMNIKVTHRQFMLYGEGIVHIELEEEDHMLDEVLIVSGRIQNVKSVQLGMEKLQPALLKNIPTAMGEVDVLKMIQTLPGIKTVGEASSGYNVRGSAADQNLLLFNNGTIYNPNHLFGFFTAFNSDMIKDAELYKSSIPSQYGGRIASVLNITSKEANKEKFTGSAGIGLVTSKLNLEIPIIKEKTSLLLSGRTTYSDWIMKTLPNKSGYRDGKAGFYDLGTVFSHTVNERNKLNVYGYYSHDRFAFNDNEKYAYNNMNFSANWRTVFAEKLTGNFSFGYDHYDYRNDETVEEASAARLSFAINQWFGKADFLYQAGNSHAVNFGLMSQLYNVNSGTYEPVGPNSLVRYDELQKDKALESAVYIGDEWDITSRLSINAGIRYSMLNALGPRTYYTYQEGILPSMSSVADSITAGNGKVIKTYHGPEFRVSARYAFTDDFSVKAGFNTMRQYIHKVSNTAVMSPTDTWKLSDPNIKPQRGWQVAAGAYYNTPGQLLELSVEGYYKKLIDYLDYRSSAQILMNHHLETDVINTEGYAYGVEFQVKKPAGKLNGWMSYTYSRTFLRQNDPRIARPINGGEWYPTEYDKPHDFKLVGNYKFTRRYSMSFNMDYSTGRPTTIPAGQYYDQGLKKMQVYYTDRNSYRVPDYFRMDLSFNIEPSHHLTLLTHSSLSFGIYNLTGRKNVYSVYFVSEEGRIQGYKMSIFGAPIPFVTYNIKF

SEQ ID NO: 7100 - protein, 1042 aa, Microcystis aeruginosa PCC 7806
MKIKQILYLMSFCLLLSATTFAQQVQEFTVSGTVVDKDKLSMPGVSVYIKDKPSKGTTTDNDGNFKLKVVYGDKMIFSFIGFKPSEHVAIKPQTDLTVTLLEDNNSLDEVVVVALGNVQRKISSVGAITTVSTKDIQSPSPSISNLLGGRAAGVISLQSSGEPGQNIADFWVRGIGTFGANSSALVLIDGLEGDLNTIDPADVESFSILKDASATAVYGVRGANGVVLVNTKKGLSGKIQITGRFNTTLSVLNRLPKYLGAYEYAQLANEARAVRNETPLYDDTEMGIIRDGLDPDLYPNVNWQDEILNKTFWRHTYYVSGRGGSDVARYFLSLGGKNESAAYKVDKNSIYSSNVSYNTYNYRINLDVNLTKSTKVYLGSDGFLSQLNQPGVANTEYIWGAQSRLTPLSIPTQYSNGMLPGRGAGELSSPYVMINHTGKAANEVYKGKSTLAINQDFSELINGLKLRVQGAYDIHSYFNERRSVQPALYNALGRASDGSLIMQETVQEKKASYSKSTRQYRKYHFEATLNYDRLFGTDHRTSALVYYYISDSKDTDDATSNLSAIPLRYQGVSSRFTYGYKDTYLLDVNFGYTGSENFQPGRQYGFFPSVALGWVPTGYKFIQEALPWLDYLKIRASHGSVGNDRITDVRFPYLTKVNEGTGSAWGVPDIEIIGETRIGADNLAWEKAIKSNVGIEGKLFNNKIDFVVDIFHDQRNGIFQQRVQVPEFVGVVSNPYANVGKMKSYGADGNISFTQDFTPDFGFTLRGNFTYSKNKVQNWEQAYLEYPYLEYNNFPYNSIRGYQAVGLFKDEDDIKYSPKQTFGEVMPGDIKYKDINGDGMVDKLDMVPLTHSTYPLLMYGLGAEIRYKNLTLGVLFKGTGKTSFFYVGQKTTVNDETRLNGMGYMPFFEGNTGNVLTLAANPVNRWIPRDYAIAHGIDPSLAENPNARFPRLQYGNNSNNSQLSTFWQGDSRYIRLQEITLNYHLATAFLRRIGVSSLDIQFVGNNLYVWDKVKLFDPEQARWNGRVYPIPSTYSLQLYVNL

SEQ ID NO: 7101 - protein, 1059 aa, Campylobacter concisus
MNRSIQKRGLALALALAMGSVHAQSTTGSIVGSVGQGSGTSVLVENNSGLSREVPVDARGRYTAGNLPLGTYKVTVKRDGAVVETRENVAITVGANTDVSFAANAAGSGVQTLDSVTVNAASLTTIDVSSVDTRTVVTAEQLQQLPLGRTAEAIALLAPGVVVNSGGFDNGPLGGSLPSFGGSAASENAYYLNGFNTTTISNNLGGLTLPYGAIDQQEIFTGGYGAQYGRANGGVINQIGKRGTNGWTFGATVIWEPNGLKANQRDIYWRPDSQGSTINNAAYRYARAANGLYQPASEAEASQTTYSAYVGGPIIQDKLFFFLAAEQVNSDGVRVGTNRDTDNGRTGGLTDDDYKQKRWYAKVDWNITDNHLIEVTGASDVAETNGSIYRYDYLARRRGAYFTDESTWKTGPTLFTGKYTGYLGDNLTVTALYGKMRTPDELTPFNYDAAGGPVINSAALQNPAYTGGTPRIGNQLVASVSSPDREYKKDNQRLNLEWRIGHHTLNVGIDNQTSEGIDVGSILSGPGYAWTYGQTNDPYGLATGGLVSQSANEAGGVGAPSPGLVDPVNGASGYYVVRNINTRLYSYEAKQRAYYIEDKWQVTDNVLLSLGLRKDEFTNYTPFGDPYIEIDNAWAPRLGFSWDVNGDSSLKVFGNLGRYYLDLPLSAVGLFTPAATTDTYFTYSGINADGTPILAQQLGSAVSVNSRFGRIADVRTAVAKDIEGENQDELILGFTRQLDSGWVLGVRGTHRRLNAGIDDQNYDVSNTALIDAAAAQGVTIDFSKVAGAALINPGQTNTWGVIGTDGQFHEVSVSREAAGFPKFKRNYSAVEFNLERPFDGKWYAKVNYVWSHSYGTTEGQVRSDLWRTGGALGSYQGQASVSTTQSWDHAALMEHFNGDQSNDHRHQLKLFGFYQFTPQWGASANVSLISGAPHNCLGNYYGTEYSGRDPAGYGGSAITGGPYHYCYNPETGTGVASPPGSQGRLGWIAQLDMGVTYKPAFADGKLALRFDVFNITNEQTATNIYPFSQLPDNTTNPLWNQVVAYQAPRSGRVTLSYDF

SEQ ID NO: 7102 - protein, 750 aa, Campylobacter concisus
MRSLLIGTGAAALLWTGTAVAQTEVEPQEDATARLESIVVTAQKRSENVQDVPIAITALSSTMLEKQRVTDITSLDNLAPGLRIAAADAAANPKIFIRGAGLNDFNPTSSSGVGLYADGVYIGSPLAQFSTFYDLDRIEVLRGPQGTLYGRNTTGGAINVISKRPTFTPEGTASIEVGNFGSVETNAAFGGPIIGDKLAFRVAGQYAEDDGYSTNAVTGNKVNNAERYALRGSLLFTPDDLTDILFTVNTFANRGGAVQPKSRQLFPVDPAAAGPDGVCAPDFFRSGLCTDAIGFADTDADPYTITSDVEGKDKVDLWSAALTIDREIGDLTLTSITAYQDVERAAHENTDSSPLQMLEAFYNNTQEQFSQELRLASDVGKLKWVVGGYYMQDTTTSDSAYDILRILRPMFTSPENPTGVSPENSVIYLGYPYTQETDTYAIFGQADYELAPGLILTTGLRWSSDEKSMDYTTIAEGVLPLFTFQDSKTFSDWSGKVGLKYDLTDTTNIYASYSRGYKSGGFFGGNADNAEQIEPYENETVNAYEIGSKSDLLGNRLRMNLSGFYYDYQDIQAYSTVERNGLTVQVLDNAAGAEMYGAEAEFTAMPIENLDLSLGLAWLHAEYGEYNSLGGDYTGNQMPQSPEYSLTSRAAYTFVADTGVTVTPSVDVSYRSKVYFDSTMRERLSDPELWLVGAELAVASPDGSIEAGLWGRNLTDEAYLTSANPIDSLGVDLLTYSRPRSAGLFLRYNY

SEQ ID NO: 7103 - protein, 1136 aa, Acaryochloris marina
MVRLPAVAASPWGTEVRWRLQLPSRVASAATRPCRASSRSRAAPCHRKSNRMYASPTRYRRAPGRARLAPAPLLPSLLATALWAALPVHAADLTGPLKVINGQTLQLDASDTLLHSMGGFALDVNGAGSTATLDGTRVDVTGGGSAIQASAGGSVLVQGGHIQLGNGSSGVGYALNATGIGSVIHASNLVINAYRNSSGYGTVNATNGGKIWLDGGSVSSDGHALYSSGRGSELHVSGTTISNGAGRAIYADGGALLSLESLAMTFAQATNGSSGRLSASGSGSVLSLRDVDVINGYFDIDNGGILRITGGTATANGSSIRLMGNRTSRTFATAEITNARFESTGGYGVNVNSWGKLTAEGAHFTVRDGSSGIWLSGADSLADLSNTVISTFGDNGYGHGVDVWGGTATITGGSIDTHGDGVYGLRASGSNPPTPYSRIRARNLDIATYGAVSGGVFLGGSTADIQLDGGSITTHGAASFGIVQMNTAKLTADALHIQALGTNSGAYRSYITVFGPYWDRLVFNDSQIETLDGPALWLQGSNHELTLNNTAVVARQAGDLVGGRLLRVSDTVFTDGSSVATSEIRFTANNSRLSGDVVVDSATAEVHMVLRNGTQFSGALRNDSGYQVAQLALDGSSQWNVRDSSSVGALEHAGTIAFDAPAAGGFKTVTVSGDYVGNGGHWIFNRALGDDTSLGDQLVISGNSSGTASVSVRNAGGAGALTQEGIRLITVGGQSDAQFGLQGRAVAGAYDYFLFKGGVSTPDDGNWYLRSEYVDPVDPVDPVDPVDPVDPVDPVDPVDPVDPVDPVDPVDPVDPVDPTRPKVERPEPAAYLANRSAALGMFRHSLHDRAGDPAAEAGVSGDAVAWMHLRSAQPDSHDRNRQVQVDGQISSVLVGVGRRFEVGGKGELQAGAMLGHGRARNDSRSQVTGYAARGVVTGTSVGAYATWLQDARMQGGAYVDGWLQYGRFRNSVQGEGLQKERYDARNWSASAEAGYVLPLRRTAQRGIYLEPQLQVVHSRYDSDRVVEANGTVVEDRGGSETSSRLGLRLYSRGLSPAQGQVHPYVAVNWWSGGNGAGLAMDGERLQRQLPRDIYEAKAGVQVNLSGGWRGWGELSRQSGGMGFRDISAQMGVSYTW

SEQ ID NO: 7104 - protein, 657 aa, Acaryochloris marina
MGTTALSLILAAAPALAQEADDGFLGTISLGKSKREVATDTATAVTEIDSREIADRQAGTMAELIDSVPGVTLVNGATAQGSGINIRGYGANSTYGTDQKVLIQVDGVTRGSEELYRIGNQLFTDPALYKEVEVIRGTVGSFEYGSGVVGGVVRLETKDASDFTGSTPGFAYRQTFEFQSNGAGLTASSILAWQPTEKLEFLLSHTRRTLGTQSDGDGNLINPAANDVDDPSWLAKARLTFGDNDEHSLTASYTSTESTEYDVPYDSFGTTTFGNVDREVNSETFMLRYGYNPLGNDLIDLTAQLSYANEEIIQTAVIPGNPLLDADHQYETTTLTLKNRARFDTGALGHSLVTGVELINRKRLNASSAPGGEDDRWAVFAVDEIQIGEAWTVTPALRYESSTIQGSTAPNDGRYSNDALMGGLSLRYAFGNGWSVFGSAAYTEVLPPIDDLDNIARVTQSEKSRTYEIGAAYERRDAFRAGDSLSFKINAYDTKLWDVTSFVSTTIVGGIPVFTDLDEINTQGIEIEASYALENGLYMDANLNIADGSETTAAQIEQDWRNLAANSARLTLGKKIGETYDFSWEAVAADDITVNGVRSSGYVTNNLRATIAPQSGVWAGTEFRIGVENLFDKQYQPHLSTRAATGRNVKLTLAKTF

SEQ ID NO: 7105 - protein, 114 aa, Acaryochloris marina
MILDRHITSRGYVCMRPATIAPLTPYDKWDGEKWVTDTEAQHSVAVDAAEAQRQSLIDTAMASISLIQLKLQAGRKLMQAETSRLNTVLDYIDAVTATDTSTAPDVIWPELPEE

SEQ ID NO: 7106 - protein, 431 aa, Acaryochloris marina
MVTRIRGALLAGIALGMTVGTIGGAMAGAFGLREQSAEAQGLAFAGAAAGSGGLSSMFWNPAVVTMKPGWNSDFNATVVVPHAEFTTLPGTFAPLRTLGESGDIGQAAVMPATATNYQLGDRLFIGLSGAAPFGLVTKPNQVWAGQTYSRSSRILSLNFNPVIGYRVTDWLSVAAGPTIEFFKLKLRQATGITPTAPSVLLKGEDWGVGFTAGVLIQPNAATTIGVGYRSSIHHELDGLLSVVPGRVRANLNTPEKVSVGLTQAITPDFRLNFGFEWDNWSRLGTPAIVSTALNLPVAALPLNYKDGFYYSVGGEYDVNPQWTVRAGFAYEISPIDNSNRSTRLPDGDRYWGSIGASYRYSEKIQFDVAYSHLFAAGRNRIALVPGEPLFTPPLTYLATTDVSADIVSVGLKYRWDNPPAPLAPAPIIRKY

SEQ ID NO: 7107 - protein, 733 aa, Acaryochloris marina
MSKAVQGAGRFQLKCLAVVIAATCHGMVQAQEDQVTLPSQTVTGELDRPQGPDYGYKAEKSLTASKTSTPLSETPRSVSVVTRKRIEDQKSQSLTDVLGYVPGIFAPPFAAGDGLAGDLFFIRGFNATDYGYGLLRDGLRVQGNRYDTTSEPYGLERVEVFRGPTSILYGENAPGGLVNLVSKRPTAAPQGEVQLSYGSNDRRQLNLDVSGPLNDSGNVLGRVVMVGREADTQVDHVQDNRIYIAPSLTLNFDDYNSLTLLANYQKDRTKLQLGLPAAGTLLPNPNGKLDKDTLVGHPDWDDFDREVWTLGYEYTHHFNDDWQFRQNSRYMQSRIQRNEVWPSSSLSSANYSSTVGLNLARDRYNKSMTYSLDNQLEGKFATGALQHTLLLGLAFDRTSFNQNQDVGIISQIDYYNPAWGVVGKPTTPIAQGNTLLEQQMTGVYSQLQSKYENWIFLLGGRFDSVDNQYRNKLAPATDLDYSDHKGTWQGGVMYQFENGLSPYFSYSTAFVPVQETSTTSGPLDPITAEQYEVGLKYEPKGWNTMFTAAVFDLRKENDVYFEAAINDYRQVGESRSKGVELEVSSDISANLNITAAYTYTDARVTKDAPGSLLEGNQMTGVPRNQASVWANYRFLDGALRGLRLGGGVRHFDSTFAYTNPPGTNPAVVSYGRLDTGDVTLVDAAIGYDIDENWSVDLNAKNLFDQEYVAGCNNAGRCYWGDERTFLGTVSLRW

SEQ ID NO: 7108 - protein, 1171 aa, Acaryochloris marina
MKGTTLKSVQTILAAALLAAAGFAQTQTARLVGTVHDSTGAVVPNAKVAAMNLGTKQTSEAITNANGDYVMPALQPGTYSLTVEAGGFRKARIDGIDLAAASNVSQAITLEVGQLTEVVEVTANTVNVQTTDSQVANSVTIKDIETLPQLARTPITLAIFQPGVQVNPQANGSSSGADYSFAHVNGLRQGSNNNSLDGIDVNDSVAPRIGLSLTANNTDSVEEARVITDGGKAEYGRSAGAQVQLVTRSGTNQFHGNAFDYLRNRDLNANDFFNNAAGVPIPVLIQNTYGGSFGGPIKHNKLFFFGNYQGIRTHAQGVQNTLVPTATAQQGIFQWNTAAGVQQYNILNADPLHKGIDPTVAALLKLYPAPNNNNCSNADGLNSSCYSFNFPNGSLSDQFTIKMDYNLNDRMHIFERTSWQRNSSIDSLNGAQNVIPGQDPGTQGGKRWGVAGGWDWTISSTMVNEFRYGHQSASTNFNRPEREAGPMVSFNTWTTPLLTAFPQGRNSPVDEYTDNLTKIHGSHTFKFGGQLRFTKQYGFNDAGIYPNVSLSTANGNILNSSLIPAGLSSTQLTSFQGMYNDLLGRISSVTETYYSNLTTFQAAGTPRVRNFVFHEYGFFAQDDWKVRHNLTLNIGLRWEFYPVPYEANGQQGILSPANVFNTAGTADNITVQPSTKWWNNNWKDFAPRFGFAWDPFSDGKTSIRGGYGIFNDRVVGAATSSVDGATPGFSQAVTLFPNSTTGSDVRIGTAPPLPVQPGSPALTPAATRQTALDLMSPNLKTGYVQQWNFNIQRQIAKNTILDVGYVANRGVKLFFQTNLDQSHIYDNGFLTAFNQIAGNLTNLSAVPVNNPIASVFGSASAAVSAIGSSVFSTGQVGTAANTIDVNNFSRYAAAGIPQNYLRRFPQFSTVLLGNNDGRSEYNSLQVRLQRQFGALRVGANYTWSKSIDNDLSTATGGEGNGFAAPLDSFNEALDRGRSNFDIPHAFTMTSQYTLPIGKGHAFGGNMPGWANALVGGWDLGSLWIWESGSPFTVSSGRATGPSTANTWADYTGSRNIGSVMTNNNGIGPGVYYFTPAQIASFSEPAAGSIGNSGRNTFRGPQFFNLDASLVKRFQVMEHKSITFRAEAYNLLNRVDFANPGVNLGGNASAFGKISAVVNNPRIVQMALRFDF

SEQ ID NO: 7109 - protein, 266 aa, Desulfococcus oleovorans
MKLAHLGRQALMGVMAVALVAGMSVKSFADEGLLNKVKERGTLLVGLEGTYPPFSFQGDDGKLTGFEVEFAQQLAKHLGVEASLKPTKWDGMLASLDSKRIDVVINQVTISDERKKKYDFSTPYTISGIQALVKKGNEGTIKTADDLKGKKVGVGLGTNYEEWLRQNVQGVDVRTYDDDPTKYQDLRVGRIDAILVDRLAALDLVKKTNDTLAVTGEAFSRQESGVALRKGNEDLLKAVNDAIAEMQKDGTLQALSEKWFGADVTK

SEQ ID NO: 7110 - protein, 212 aa, Desulfococcus oleovorans
MKKTLCTLAVIASIAAAPQALAHKKGDFLVRAGIASVVPNESSDDVLGLGEFKIDSNTQLGLTFGYMITDNISFEVLAATPFKHKVSLGPLGEIAEVEQLPPTFMLQYYFMDSGSKLRPYVGAGINYTTFFNEEFNAAGKNAGLSDLKLEDSWGLAANAGLDYMINDDWFVGASVWYADISTDVKFKAGTDDVTIKTDIDPWVFMISGGYKF

SEQ ID NO: 7111 - protein, 710 aa, Desulfococcus oleovorans
MRLFNYILILEYSIILLFSIFVSGIVAQDNSDSMIVQKAETVRVIGKVSDSGSQNFRSNPSGFQSAIKLDETSERYTSLPEVLEREAGLRVRSFGGLGSYSTLSIRGTNPNQSRIYLDGIPLNNSQGGEVNLADLPFDSLESVEVYRSGNPIGFSGSAIGGSVNLVTRKDTGKPRTRVNLGGGSFNTGKASVSHTGTYNGIGASFLALGEKSDQNFSFKNDHGTVVLNTLDDTIDRRRNAAFERAALFGTLKYQMGKTELKLLNDFNHRIHGLPGPGSNQTNRVHRKYDRYTGSFATDTKGLFVDFFRLETRSFYTAAKDDLFDPGSEFSKGTPNSRAEIRQAGIQIMPTLYLTDYYQILRVFVSLERESFDRNRLTPSNVIGRVEPLKERTYSSFRLEDEVRLWNAKVLLVPSVTWDHYRDRFPSEEPWYRRQDLFASDSKKITFTNPKLGFVWKLFEREAWDVQFQANVSRQYRIPSFLEMFGEQGSIIANPNLRPERSGNGDAGFVFKTNHSYLKTKTSVSYFSKDIKDMILFLPNSQFTLRPENVDSARIRGIEFSHRVDWKYGIKFLFNYTYQDAINTSSSVYLRGKILPLRSRHEFASILSWKRKRLETGIELLYIGAVFRDRTNEYINYIPERQIWNYFFTWILDSEPGESVKNSLGDLKESAPSREVLLTFETKNFTDRRVSDLIGYPLPGRSWYVTLSMRF

SEQ ID NO: 7112 - protein, 796 aa, Desulfococcus oleovorans
MADGARYSRALILGASVVSIAAMMPESGFAQTADQAAQAKPVKPRQAKRKPAKPQADQQQANSSVWNARAQAIVGVQALDTITAAASKTEERAVDALAPVSVVTSSQIQSRQASTVGDLIYNVPGVWVQNRGDEPSTSINIRGLQDFGRVAVVVDGARQNYQRTGHFANGSFFLNPELISGIDIVRGPTANIYGSGAIGGVASFRTKDIEDVVRAGERWGVDVKTILGSNYGRALGSAFGGVHVNPNVDVFAGGTYSTQESYKDGTGFEVANTGNRLTSGIAKLTVRPADGHEIKLGTIFQEDIYSVGQPPRRAGDPNSTNANGANNLSGTSIYKSDVKNYTTTLGWKYSQPDDQWFDWDAKVYWNRTENDQVKTAHTSTTPSVFCGGVPGNAVSGCIGSNRGYLLDTVGVDVYNTTRFDTGSWRHAVTYGLDAFQDKVSTQDRTGTSEVTTPGGQRTVSGGFVQWKANYTFMLEVIGALRYDNYQLSSGSTSSSGDRLSPKITVGLVPTAVVTPYVSYAEGYRAPSITETLVSGPHSGATVNDSFFRCPSGTPGPGADSTFCFVPNPNLRPEVGKNKEIGFNIKKNDLFTAGDTLRGKINVFRNDISDFIDQVRLWKSAGGPHRPAAGALHHRASVPAISERRVPPASRVSRLSDVRREHLVLRLSGSYQTGKNLQTGFGLYSVPPQKVTTTAGVRLLDRTLILSVMWTSVIANTDIPPTYTPATSYDLVNLYAQYQPRPDLTLNFSVENLLNQYYRPYAIPVGSTGDTQNDVKWASAGPGLVVKGGLKYHFGGI

SEQ ID NO: 7113 - protein, 373 aa, Burkholderia multivorans
MKQTTRLAAIAGGAALAVASQFAEAQSSVTLWGVADASIRYLTNANAKNDGLLSMTNGAITNSRFGIYGSEDLGGGLKAVFNLESGVNLQNGAFADSGRLFNRAAYVGLQSPYGTVTLGRQKTPLFDLLADTYDPLTVGNYLENAWLPVALGGGLYADNQIKYTGTFSGLTAKAMYSTGTNYESTGAGGFSGQIPGSLGKGNAWGVSLSYVMGPLSIAAGAQQNSDNSARKQTIYHANVVYAFSKAKVYAGYLRSKDDTGFVDSLLAQQSIPVAKGTGRIDDGPFAGVSWQVSTPLTLTGAFYYDHMRKAMTANGTLASGNRYAIVGIAEYALSKRTEVYGTVDFNKTNGAANVELPGRSNQTGIAIGLRNIF

SEQ ID NO: 7114 - protein, 718 aa, Burkholderia multivorans
MTASKGKFPLSTTALAILAASTALTAQAQETSTNDKMVVVSSRTPKAISDIPGTVWYIESDKIEQEYRGGKTLGDILASAIPSLDVSSGARTNLGQNLRGRKMLVMIDGVSLQSSRSISRHLDSIDPFNVDRIEVLSGSTSIYGAGASGGVINIITKKAHSEELEFESYVGGTSGFNSSEDFDYKVAQSISGGNEKVQARTSVVYTETQGFFDANGTIVTPDISQGSLQFNQTVDFLTTVGVNVSETQKLNFLAQYYDSQQDSPYGLYIVGRDFVDVRKGFESDREHGTKRIMLSASYADAQFLGQQLIAEASYRKEDQTYTPYYQSSGQQITDVISLKAALAKSFDKLNIVYGIDAYQDKLDSNQALYDPTIANNSGNLVNKTYAQVGRYPGVEVSSVAAFAQVDYAITDDWSVEGGVRYQYMLNKIDDFVGYNQQKKIAAGSGTSADAVPGGETDYSVALFNLGTIYHLNRDSQVWANFSQGFDLADPAKYYGQGNYTLVGDHWQLNDSINVNQSKMSGIKTNSVELGYRLESGDVNLQTAAYYSQSDKNIKYNKTTLLIEEIEDKKRVYGLEAMISYWVHDNIQLGASGHYVVSEVKGDKGWEDYDAGYASTSKANAWAGWSDAELNVKLQSQTMFDYEDASNNKLNGYTLFDLVGSYQLPVGSLGFGIQNLLDKDYTTAWGQRAQLIYSAHYESAAYDYKGRGRTYTLNYQVKF

SEQ ID NO: 7115 - protein, 901 aa, Burkholderia multivorans
MGNEGCIPPIVNESSIMDSICNRRPRRAHAGVCADTAHAPAGLPEAAQPAARLGAGRPRDAAAPRCARQATSHTSHASHTLHAPCMPQFAPQFAPRRVVARVAAAALFSACAAPGVSGAAEPAAATRGYDIPAGPLDAALTRFGREAGILLSFPGELTTGLRSPGLHGRADPAAALDRLLTGTGLVALRQPSGGYTLARLPGPAAAGADAALAADTTLPTVAVRASGPHADSYRPPREAAGLRSDAPLAEVPQAVAIVAQQVLRDQRPRNLDDALANVSGITQGNTLGSTQDTVMKRGFGDNRDGSVMRNGMPIVQGRSLNATTDSVEVLKGPASLLYGIMDPGGVINVVTKQPQLAGRHAISALGSTYGGGRNGGELTFDSTGAIGESRVAYRLIVDQTNEQYWRNYGEHRETLVAPSLAWYGRDTQMVLSYEYRRFLMPFDRGTALDPRTNAPLAIPARRRLDEPFNDMRGESNLAQLAIDHQLAPDWKVHVGYSYNRETYDANQIRITAVDPLKGTLTRSNDATHGSRSTDSYGIAYVDGRVTLAGMRHDVQFGVDGEYRQVYRADMLRQPIKTPFSYLNPTYGLVPPSTSVSASDSDQSDTLHTASLFFQDSIHLSERWMLVGGARWVRYSQLAGRGRPFQVNTNLSGTKWLPRAGIVYKWNDALSLYGSYTQSLKPTSKIAPMAGGYVIDGSTAPEEGASWELGAKLDMPGGLAGTLAFFDIDKKHVLVSQYDDATNQTAWRTSGRARSRGIELDVSGRIGARWNVIASYAYIDAKTTEDPLYAGNRLWNVARHTASLAAVYDVGTVLGGDDLRIGAAGRYVGARPGDSANSFTLPAYATADAFATYDTRLGKQKLQFQLNVKNLFNRTYYPSSVNRFFVSVGDARQVSLLTTLQF

SEQ ID NO: 7116 - protein, 378 aa, Burkholderia multivorans
MKRTALLLATTAVAIAAPAQAREGQAYVGLEAGINDGNQIDIDLADTDPQTNAAFADPNLGFDADVIFGYDFGWFRLEAEGSYKNNGIDDVTLLNPTFTAGGQTTPVSFVSSSADINIISGMVNALIEFGDDDGIQVYAGGGAGIARVDLSIEPANFGSLIDDSSSDFAYQAIAGFRVPVNDRMDVGLKYRYFVVDEFEIDAANGNPIEVDCQSHSVMASLIWNLGGQAAPPPPPPPPPPPPPPPPPPLPPPAPPPPPPAPACNTGPYIVFFDFDESAITADAATILDNAITAYANCGMARVMLAGHTDRSGSVSYNMALAERRNMSVMEYMTGRGIPAARIMGEAFGESQPRVPTADGVRELQNRRVEVTYGPASGM

SEQ ID NO: 7117 - protein, 1083 aa, Burkholderia multivorans
MRTTPTFPTKTFKPTAMALAVATTLSACLGGGGGGTSAPDFNAGGTGIGSNSRATTAKSAAVSYAGIKNEMCKDRSMLCAGRDDVAVTDRDAKINAPPPPNLHTGDFPNPNDAYKNLINLKPAIEAGYTGRGVEVGIVDTGESVGSISFPELYGRKEHGYNENYKNYTAYMRKEAPEDGGGKDIEASFDDEAVIETEAKPTDIRHVKEIGHIDLVSHIIGGRSVDGRPAGGIAPDATLHIMNTNDGTKNEMMVAAIRNAWVKLGERGVRIVNNSFGTTSRAGTADLFQIANSEEQYRQALLDYSGGDKTDEGIRLMQQSDYGNLSYHIRNKNMLFIFSTGNDAQAQPNTYALLPFYEKDAQKGIITVAGVDRSGEKFKREMYGEPGTEPLEYGSNHCGITAMWCLSAPYEASVRFTRTNPIQIAGTSFSAPIVTGTAALLLQKYPWMSNDNLRTTLLTTAQDIGAVGVDSKFGWGLLDAGKAMNGPASFPFGDFTADTKGTSDIAYSFRNDISGTGGLIKKGGSQLQLHGNNTYTGKTIIEGGSLVLYGNNKSDMRVETKGALIYNGAASGGSLNSDGIVYLADTDQSGANETVHIKGSLQLDGKGTLYTRLGKLLKVDGTAIIGGKLYMSARGKGAGYLNSTGRRVPFLSAAKIGQDYSFFTNIETDGGLLASLDSVEKTAGSEGDTLSYYVRRGNAARTASAAAHSAPAGLKHAVEQGGSNLENLMVELDASESSATPETVETAAADRTDMPGIRPYGATFRAAAAVQHANAADGVRIFNSLAATVYADSTAAHADMQGRRLKAVSDGLDHNGTGLRVIAQTQQDGGTWEQGGVEGKMRGSTQTVGIAAKTGENTTAAATLGMGRSTWSENSANAKTDSISLFAGIRHDAGDIGYLKGLFSYGRYKNSISRSTGADEHAEGSVNGTLMQLGALGGVNVPFAATGDLTVEGGLRYDLLKQDAFAEKGSALGWSGNSLTEGTLVGLAGLKLSQPLSDKAVLFATAGVERDLNGRDYTVTGGFTGATAATGKTGARNMPHTRLVAGLGADVEFGNGWNGLARYSYAGSKQYGNHSGRVGVGYRF

SEQ ID NO: 7118 - protein, 362 aa, Burkholderia multivorans
MKTFRTAATAVSFAAAAASPGAQAQGSVTLYGIVDTGVQYYNHAAGGGAVAGMPSLTGEVPSRFGLRGVEALGGGYRTFFVLENGFALNSGALNYGGRLFGRQANVGIDSPYGTLTLGRQMNMSMLVLLNADVIGPSIHSMASFDSYLPNARSDSAIGYLGHFGGVTLGGTYSTGRDAAGPAGPSATNCAGNVPGDPVACRQYTMMVAYDAPQFGVAASYDVMHGGTGASAPLSSPGYTDTRTIVDAYVKLGIAKLGAGWIRRNTAAAAHSQSDLFFAGGTVYATPALSFDAQAVRYLLRGRYDSNLFVGRANYSLSKRTLVYTSVGYMTNSAFGTSAVAAGGTVGTGRNQVGAMAGIQQRF

SEQ ID NO: 7119 - protein, 619 aa, Burkholderia multivorans
MKKTFLALAITSVYFPSFSIIAAEDNTQTDDVMVVTANRFEQPVTSVLAPFNIVTRQDIDNIQAKTLTDVISLLPGVQITQNGGRGQLASIRVRGTNSDQVLVLVDGIRMAKAATGNVDFNQIPLTQVERIEFTRGARAALYGSEAIGGVINIITLADVDSPSKTKLNVGIGSNNYQEASASGAYKVGENGLLQLAAAYEDDEGYNVHPVIGVNDSDKHGFDSRNGMIAYHHSFNDILKGFLSTRWYKNHYQYDSSFFRSHGYATAESELFDYSAGLDLDLNNYKSAIKLDYQHQKNQAYDVLNPLNLYAQVHEKFSQKNIQWSNAYKLNEILNIVGGVDWRNEAWTELQSNTTNSRNNTGLYGVGLFNYNHVSLETSVRLDDNQQYGSNTTYNIAGGWYLNDNIQLRGSYGTAFKAPNLFHLYSNASIFEGNPNLRPESSKNSELSLHADYELVSLSATAYHMRIDDLITYQNGINDSKGTWKNVKGESKIKGIEFEADFDTGLVSHELNFDFKDPRSQNGKLLPSRDKFSFKWVGSASIGMLDTAVTYQYHGKSYSDSNNTQILPSYNTWDLAMTYWLQPKLALKGRVSNMFNEKYETAKGYPMPERTFYTSINYQF

SEQ ID NO: 7120 - protein, 243 aa, Burkholderia multivorans
MKRKLAITGAAALAFAFAGGTAHAQSAGDFYVSTGWLHLSPQDSSDPLFVYRVGGTPINQSIPNTGAGINDADTLGLAAGYFVTDHISTELVMGIPPKFDITGKGRFENFGVLGRAYQWSPALLLRYHFNDANAKFRPYLGVGATYVWFTGAKITNSSFENGVLGGPTSATTSNQWAPVLNAGFTYNFTKHWFGGLSISYIPVSVTATFTTARRTPVGTLTETSKAKISLNPIVTYLNVGYRF

SEQ ID NO: 7121 - protein, 735 aa, Burkholderia multivorans
MLLTGLLLGSLTVQAQVSGTVKDQTGEPIIGANVFWKNIPGGVATREDGTFSISKPDKSNHLIVSFIGYENDTIQVNDKKAILDVVLREGMELSEVQIVSRKLSTLKLRSSVMNEEIITSDELCRAACCNLGESFVTNPSVDVSYSDAATGAKQIKLLGLSGTYVQMLTENIPNYRGAASPYGLGYVPGPWMHSIQVSKGISSVKNGYEALTGQINVEFKKPQLPEADWVSANLFASTTNRYEANADATVKLSKRWSTSLLAHYENETKAHDGNDDGFADIPRIEQYNFWNRWAYMGDHYVFQAGIKALDESRKGGQVSHSGVPAADRYEIDIDTRRYEAFTKNAYIFNKEKNTNLALILSGTLHNQDALYGRKIYNVDQSNAYASLMFETEFTKEHNLSAGFSYNYDGYDQHYRLTNNAETPLTKVFARESVGGAYAQYTFNLDNKFVLMAGLRGDHSSEYGFFVTPRAHIKYNPNDFVHFRLSAGKGYRTNHVLAENNYLMASSRKVSIADHLDQEEAWNYGASISGYIPLFGKTLNLNLEYYYTDFLKQVVVDMDTNPHEVAFYNLDGRSYSQVFQVEATYPFFQGFSLTAAYRWTDAKTTYNHQLMEKPLTGKYKGLVTASYQTPLGLWQFDATWQMNGGGRMPNPYTLADGTSSWDARYKGFSQLSAQVTRYFRRWSIYIGGENLTNFKQKNPIIDAADPWGDRFDSTMIWGPVHGAKGYIGVRFNLARD

SEQ ID NO: 7122 - protein, 402 aa, Burkholderia multivorans
MKKTLIATALAAVIFVPSAAAIEIYKDDKNAVEIGGFIDARVINTQGATEVVNGASRINLGFTRVMSDGWKAFTKLEWGVNPFGNSEIVYSSESNFESQSGDFLNNRLGYVGIGHDTYGTLSIGKQWGAWYDVVYNTNYGFVWDGNAAGVYTYNKADGAINGTGRGDKVVQYRNSFGDVSFALQAQLKHDIFYTCESAQDLGTDCEVRWKANEESQEVNYDYTYGGAITYLATDKLTLTAGVNRGEFEVAFHTGEMITATDLIYGVGATWGGFDSEGFYAAANFNKNENHDTDNLGRLIKDSYGIESLFSYKFDNGLRPFISYNILDAGSDYVIQPNSADPNDVFKRQFVVAGLHYVWDVNTVLYVEARKDFSDFNSADKDQQAKMSIAEDDGVAVGIRYTL

SEQ ID NO: 7123 - protein, 689 aa, Burkholderia multivorans
MSKKTRFRFFVLCFLSVSFTTSFGFAQTPADTSLTKLLDSVIVTASRMAGLEQQVPYALTVSDAFYMQTGQRQLSINEALQNIPGLVALNPDNFAQDLRVSIRGFGARAAFGIRGIKIMVDGLPESTPDGQAQVDNLDLGAFQQMEVIRGASSSLYGNAAGGVISFSSEALPSKPYVELGLTTGSFGLQRSQLKTGWQQGKLGGFLHVAHTQTNGYRSQSAMQSTLLYNRLEWKLNTHTHLKLIYNYVFSPKADDPGALTRPEADNQRRAARDRNVMFATGEAVEQGKVGAILTHQFSPRQRLQLKGFFLDRSFSNRLPFENGGIVQLRRAYAGGGATYYYQNQPNNYRIKAGIDIENQRDNRQRYQNLQGTRGAQTLYQIEGFATTGLFVLQDIELSPVFKVNLGTRYDVIKVSAIDRFLSNGDASGNQSFRVFNPSLGVVYSFAPFAHIYANLSTSFETPALSELSANPQATGGFNPELTPQKAISYELGVKGLAHKKLNYTAALFYIQVQNELLPFELAAFPQRIFYNNAGASTRQGIETSLKYQFVPGVLLEGSYTFSRFVFDSFVADGQNYAGKVLPGIPQHMGHLGARYIYPNGSYIAVSARFNGRIFANNDNSVVDPGYQLVNLRAGWKKSWKNWAIEPFAGVNNLLNMRYTSNLRINAFGKRFYEPGATINFYGGVRVRFF

SEQ ID NO: 7124 - protein, 918 aa, Burkholderia multivorans
MSTPRQQPLRPLGRLALAGSLAFASCTLPMGIGMAQAAPQQSTAKRNLIQFDIPAQALDSAVLAYAEQSGVQVFFDSRKLAGLRSDGLQGSHEAEEGLRQLLRGNPVRYHFSAVGQVGLERIPQADEALELGATHVESNRDGDWVYQAPRSVSVITREQIEQRAPRHAADLLEQTAGVYTAVNQRDPGLSVNIRGVQDYGRVNMNIDGMRQNFNVNGHQQRNGVMFIDPEFIQGVEIDKGTSAGMGGAGVIGGIASFNTVQASDLLAPGKDIGGRLRAGHGIGELGNGTYFNGSALFAIGNERGDILLGHSERHFGNYRSGTQNADNLGTQIRGKLENREAWKSWLDGEVGAMDSVTRSQLFKLGLNLTDDQRVQLSYFETDTDSKDAWTYNDSTRNRYYYQVTGSNDINAKNAALDYSYSPDNDLVDFKAKLYYVTTRQDRWNADNMASASTGNRVEAYSDRFQTDTWGLQLQNTSRWHLGQADTLSFNYGTELFQDSFRPSTERVAAANEVESLPYVQGANPKGKRVMASLFGNLTYEHDDWLTLDAGLRYDRYRLTGKTGVTTWMYPEGVTDVGLSRRQTHMIFDEDTEEGRFSPTFGIAVKPGPEWLQVYTRWGRGWRPPAVTEVFMSGRPHAGGSAEMVYPNPFLKAEESHNWELGVNIFKESLLRDGDRFGAKVAYFDTRIDNFSFLDTNVSLPGSSVAGIALGRSAYQNNLETTRFRGVEYSLDYDAGDYYGQLSYTHMIGSNDFCSNQFYMGGAQRLVSAGTIMRPVRVGNRVIMLPVRVSRAESAADTNAVVSCGDIMGNASYMPADRGALTLGMRLLDRSLDVGMRLRYSEGNGENLKSHTYNKIDQAQWPKYQVYDLYASYWMTPSVNLSLSLENATDEAYFVAMGDGNNLSLARGRTLSGMFEYRF

SEQ ID NO: 7125 - protein, 863 aa, Burkholderia multivorans
MHQSGSVSLCRSAISVLVATALYSPIALASTVEYGETVDGVVLEKDIQLVYGTANNTKINPGGEQHIKEFGVSNNTEINGGYQYIEMNGAAEYSVLNDGYQIVQMGGAANQTTLNNGVLQVYGAANDTTIKGGRLIVEKDGGAVFVAIEKGGLLEVKEGGFAFAVDQKAGGAIKTTTRAMEVFGTNRLGQFDIKNGIANNMLLENGGSLRVEENDFAYNTTVDSGGLLEVMDGGTVTGVDKKAGGKLIVSTNALEVSGPNSKGQFSIKDGVSKNYELDDGSGLIVMEDTQAIDTILDKHATMQSLGKDTGTKVQANAVYDLGRSYQNGSITYSSKAISENMVINNGRANVWAGTMVNVSVRGNDGILEVMKPQINYAPAMLVGKVVVSEGASFRTHGAVDTSKADVSLENSVWTIIADITTTNQNTLLNLANLAMSDANVIMMDEPVTRSSVTASAENFITLTTNTLSGNGNFYMRTDMANHQSDQLNVTGQATGDFKIFVTDTGASPAAGDSLTLVTTGGGDAAFTLGNAGGVVDIGTYEYTLLDNGNHSWSLAENRAQITPSTTDVLNMAAAQPLVFDAELDTVRERLGSVKGVSYDTAMWSSAINTRNNVTTDAGAGFEQTLTGLTLGIDSRFSREESSTIRGLIFGYSHSDIGFDRGGKGNIDSYTLGAYAGWEHQNGAYVDGVVKVDRFANTIHGKMSNGATAFGDYNSNGAGAHVESGFRWVDGLWSVRPYLAFTGFTTDGQDYTLSNGMRADVGNTRILRAEAGTAVSYHMDLQNGTTLEPWLKAAVRQEYADSNQVKVNDDGKFNNDVAGTSGVYQAGIRSSFTPTLSGHLSVSYGNGAGVESPWNTQAGVVWTF

SEQ ID NO: 7126 - protein, 893 aa, Burkholderia multivorans
MNHSFRKTVLATAIVSAFGYSNTVLAQEQAVDEEAMEVIEVTSFRSSLIKAKDFKREAIISRDSILAEDIADFPDLNLADSLQRVPGISITREGGEGRQISLRGLGPDFTRVQVNGMEAMGTSASAMDAKGGASRTRSFDFNVFASELFNRIDVNKTYSADQEEGGIGGTVGLYTAKPFDYDGAKSAISLKGGYNDNSEETDPRFAGLISNTWGNFGALASVAYSERSTTEYGTNTTRWRREGGKTAADPTDTELQAELDSGELWFPRGHRYSLWNNQQKRLGITTALQFKPSKELSFSFDLMHSELENEYDEHHSAVKDNDIVKDLEWIENDGHKEVLYASYEDATWRNENTRRRNESEFNQYTLTMDWSLTPDLSMSAMVGTSSSDFEQPQVLKSNIHAKNKVDIMTDFRGDRFYGISTSPNFDVTSMEGFEVKDIYMQENYITNDFDIAKVDFSYFIGDTGELTFGANYKKFENTGYQLTRSNAQNEAPQNAGELTLTDDLVNIFNQHPDQNWIQADLNNLLAYYGLQGTRLDDSDLSENDKSPVTEETSAVYAQYGFESSVAGRPLRISTGLRYFETEITSAGVSGGVDIETARTYSDVLPTLNMVYELNPDLLWRFAATKNVTRPSLGSLSYNASVSQTSGEAITSVSMGNPNLDPFESTNLDTAIEWYFEDVGYASAAIFHKDIDNFIVGTTTEVVYSTLGLPEELLPADKNMDSIFYLERPENVDSSTIKGAELAFSRDLDFLPAPFNNLGVIANYTYADGESLYRNIYGIEGNDQVKPFSGLSKNSYNFTLYYEVENWGARVSAAYRSRYGSGATSSADQDESGYHGTTYVDFSSFYQLTDNVKLSLEGINLTNVREESYSDSHDRAYNTITSGRTVMLGITAQF

SEQ ID NO: 7127 - protein, 704 aa, Burkholderia multivorans
MDVTRFLLCTTAPLCLAVSAAAQQAAPPPEEDIFAGLVPVVTQSGGTALDPIVVGSGTDNVASDTPQSVSVISAEQIAREQPTTINDLFTSIPGVTAVGSERVLGQRVNIRGIGSSAEGDQNRLITRIDGVVKFYEQYRMGAIFTDPDLYRRIEVLRGPASSTLTGAGAVGGVIELQTREAADFLSGPEDDFGGRQKLSFGTNGNEALSSTVLAFRPAEGLEFLTAFTYRERDNYEDGDGEEVVGTNFDATAVLLKGRYSFGEGMAHSVFATYQNWASDAKQAEYAQTETFEAFGRVDRDVDDSLFVLGYDYNPPENDLIDLEVRLGYSDTEVIQENATNPLGIPSSLFEDAEYGYESWQLNVMNTSFLALGGTEVTLAYGFDASRQERVGEATSRKFPTTPPNGFIAFQPGGEDENIAVFAQAEIVTPFGLTIIPGLRYEWETLTPADNNTSFGAGDKVENEAFAPKIALLYEVTDAINVFGTYARTERLPVLDEVYDGSSGNLDLVPEKAETWEVGLSYSALDVFQSGDQLVGKLTYFDTDVENLIARATTSDPFVNIDDATYKGWELEVAYDSDLWFGSLAYARVRADGTDDGGPREPLEGIPADEVSVTLGTRLDRYDLELGVTGTYTWEQDRVPTGDETTDSYQVVDLFATWVPPVDLAQGVEVRLAANNIFDEAYKPALYLTDNARGRNISVSLALAF

SEQ ID NO: 7128 - protein, 248 aa, Burkholderia multivorans
MLKRIVLLGALGVLANAEESAAFVGVNYQVSMIQNQTKMVNDNGLQKPLIKFPPYAGPGFEVGYKQFFGKKKWFGMRYYGFFDYAHNRFGVMKKGIPVGESGFIYNSFSFGGNTLTERDSYQGQYYINLFTYGVGLDTLWNFVNKENMVFGFVVGIQLAGDSWATSISKEIGSYVKHHSNSSYSPANFQFLWKFGVRTHIAIHNSLELGIKVPTITHRLFFITNEKGYTLQADVRRVYAFQISYLRDF

SEQ ID NO: 7129 - protein, 360 aa, Burkholderia multivorans
MKKALVAAALMAAGVVTAHAQSSVTLYGRLDAGLEYLNGLQNGHQVRAESGDWGTSLWGLKGSEDIGGGNKVLFHLEGAFNTMNGGLGTSGSIWDRFATVGISNDRYGTLLLGRELAIANGVWDFDPLGQSSWSSASLVRGRNWNKTSNNVSYQSPQFYGLDFYGQFAFSNSTSFNGNTTAGQPGRAAGAQVTYTNSLFQLRGIYDETRDSNGRFSDVFNYSREYFAGLNVFLGQFKLQAAYQSSHADGSGGPAVNNGITGTQQVWGGVTWQATPAAALIAAVYHVNANHGGGNANIYTVGGSYNISKRTLFDVQVATVRNSSTANFGLNANGAGTAVSTGNPHPGGSQTGVYAGIQHLF

SEQ ID NO: 7130 - protein, 385 aa, Burkholderia multivorans
MKKSLLALVALGAFAGAAHAQSSVTLYGIIDEGFIFNNNAKGGHLYGLSSGVMQGSRFGLRGTEDLGSGLKAIFVLENGFDVNSGRLGQGGLMFGRQAYVGLSSQFGTVTLGRQYDSVVDFVGPLEAGDQWGGYIAAHPGDLDNFNNAYRVNNAVKYTSPTYGGFSFGGMYSFGGQAGQFSKNQVWSLGAGYNNGPLVLGVGYLNARTPANFGGMFNTGASAATTAVSSPVYGAYANSANTYQVIGAGGAYSFGAATIGATYSNTKFKGFSVGPFVNQTATFNNGEINFKYQLTPALIVGAAYDYTQGSKIDGNSAAKYHQGSLGVDYFLSKRTDVYVIGVYQHASGNALDAAGNVVQAHASINGLDPSTTSNQVAARVGIRHKF

SEQ ID NO: 7131 - protein, 417 aa, Burkholderia multivorans
MRPGVLLLGATTIALVANGAANAADLEPEVKLPAAVWNWSGGYIGGHVGGGYGRTSFSNPYGPSIYGGIVDTPTFLAGGQIGYNWQKNGWVFGVELDVSGAVSDGTNTCLASSGFVVSANCKAGPNIFATATGRVGYTFGASGGTLAYLKGGAAWQNNQGDVINNHEGGLVPQEKTHFDYGRIGGIIGLGVEQALTPAWSVAAEYDYLNFGGPSVATPPTVQGPPFAIVPANTTSPSSNYHIGKIGLNYHFGADPWTAQWSYVPQYAKAPVGAPPIAYSDGWSFEGGSRLWLSRGRFQWDHSVAPYLPLDPSVLVSRLTYHGLDGLSGELFGRVDSPSGVFLKGNIGLGRFDKGNINNEDWLADRELSYINNASRQRNGRFTYFTADLGYDFLRGANYKVGGFIGWTYYEQSSDSIG

SEQ ID NO: 7132 - protein, 461 aa, Burkholderia multivorans
MKLAKLSLAAMIVAGLASSSFAADTLADAFKNGKVSGEIKAWYFDKTVENTDAAKDKENNANIANFGLTLGFVTDSLYGFYAGATFQGSATPFIDNDAEGKNTAKDGKADTANFGTTNAASGAVLSEAYLGYKLGKTDVKVGRQFISTPLVNGSGSRFFKESFEGAVLVNTDLPQTTVFAGYAGKFQGRTSAVSGDGLGDAPSFHKKAVYAGLKNALTGKSATDYTSRDGGYTAGAINKSISNLTLTGQYLFVDNAHDTDGVDVYYTEANYVLPMSGFKLGFDATFRGSHTRDDLDALNASGHMFSGRVSLSGLAGFGASFAAATTSSDHVLLGAGNGPTTYTATMIAGAATPTAAANTDSYLFQVTYDFSKVGVAGLTAVAQYGWTEQGTQPKLDLETGNSSKVKGTDRTTYAAGVTYAVPALKGLTTSLQYEVQEADSKTAGTKTVDTDEMWFKASYKF

SEQ ID NO: 7133 - protein, 194 aa, Burkholderia multivorans
MTSPIHTGSILGNTEGTFFQGVMLMKRLTKVLAGAAILSVAPLANAGFYVGAGIYNSGTDEKIDNVEFDDDDTSGGLFLGWRPIELVGAEVGYYDFGELEADNGTKIEGGAVTFAGLLSFELGPVGLYGKGGVANTDFDVKHPSFKDDESSTDAFGGVGATIDLMDKLYVYGEFMHFDNDAGIDMFGAGLRFQF

SEQ ID NO: 7134 - protein, 358 aa, Burkholderia multivorans
MKAFARRASRTSVKLIAAAACVAAAAPVHAQSSVSLYGQVDEWIGATKFPGGDRAWNVSGGGMSTSYWGLHGAEDLGDGYKAIFTLESFFRAQNGQFGRFQGDTFFARNAYVGVSSPYGTVTAGRLTTHLFLSTILFNPFYDSYTFSPMVYHVFLGLGTFPTYPSDQGAVGDSGWNNALSYTSPSFGGLNFGAMYALGNTAGDNRSKKWSAQFNYANGPFAATAVYQYVNFNNGPQDLSSLVTGMKSQGIGLVGATYDLKYVKLFGQYMYTKNDQVAGSWHVNTAQGGVSVPLGVGNAMASYGYSRDAGGLDQTRQTWAVGYDYPLSKRTDVYAAYMNDHISGLSSGNTFGAGIRAKF

SEQ ID NO: 7135 - protein, 380 aa, Burkholderia multivorans
MKKTLIAGASAAALFTPLAHAQSSATLYGLIDAGIAYTNNANGAAQWRMTTGTINGSRFGLRGSEDLGGGLKALFVLENGFNANNGGLGQDGKLFGRHAYVGLSQAGYGTLTLGRQYDTMVDFVAPLSATSGDFGDTGFAHPFDNDNLNHSVRINNAVKYTSDTVAGFKIGALYAFSNSANFSANRAYSVAASYTNGPLKLAGAYLQMNGTKGSTSASPGATDSAEAKSLNQGGWSIGSDRMRTYGGGVSYVFGPATVGFVYTRSQYDNTGAFGSSGQIAFDNYDVNVRYAVTPAVSVGAAYVYTDASVSNPDSKHGTDPKWHQANLQAVYKLSRRTDLYAEAMFQHASGRGYQAFINTSGGASSTANQVVGTIGMRTRF

SEQ ID NO: 7136 - protein, 422 aa, Burkholderia multivorans
MKKRVLPGLIAVTLMLFTPLTGWATNGMNMIGTGAVSAGMGGADVAVPAGCTAIAGNPAQLATTCNRVISVGGALMFPDMEDAPAGGSNVDNEFQVFPVPFIGYAQRLGTSRWSAGVGIFAQGGMGVDFKDVEVNTAYYPGMKDDLMSEVGFVRFSPTVAYNVSDRLTMGASLFAGYATIKYDFFPNTIGHKVKDLSSFTFSGRFGLSYQINDQWSVGATYTSESSIDFDDGELTQNFGPMGKVKYDDVKMDGFTWPRQVEIGAAYRATPKLLLALDLSWINWSSAIKTVTVTASDPNGPVPPGYEKLKVPFEMDWDDQFVVAIGAEYELTESFTVRAGYNYGNTPVTNVNLSPIFPALVEHHATVGCTYTWKQWDFDFAYEHAFTNTETNDGDANPMTNPFYGSEVSHTMDTFSFMVSYRF

SEQ ID NO: 7137 - protein, 698 aa, Burkholderia multivorans
MHLPAPSMRRAPFAHVAYTPLARRAPHAGTTTFNSFPMNSHFSPLIHKRLALLLMLPAATFADAPATQLEPLVITATPAGDRPLEVRIDPQTPAQPIPAQDGADILKTVPGISVSRKGGTGGEVILRGSAGSRLDILVDHESILGGCPNRMDPPTAYIFPGAYDSVTVLKGPQTVLYGPGNSAGVVLFEAGPVHLDQPTASLDASLVFGSFDRNDQLASVLAGTPDFYVRVEAVRSESHDYEDGNGDKVHSHYERSTERVALGWTPDKNTVIELHGALSQGEAAYAHSMMDAARLDRQNVGLRFEKRELTPLVESLEASFYYNHIDHVMDNYSLRTFTPTMMMPMPMSSNPEYTLWGGRALATLAPAENTRLDVGGDFRLGGHSKESVDDAQIDNYGFFAEATQTLATRHRLIAGLRLDTWRAEDKRTATASPTGGDDRNETLPAGFLRYEQDLSAIPVTVYVGIGYTQRAPDYWEMFSYQSAGSTSAFDTDPEKTTQLDIGATWKKGPLTAFVSGFANDVSDYILIEKTGSGMMAKTIARNIDARSLGGEAGFGYTFGGGWQLDASIAYVRGENRTDDLPLAQQPPLEGRIGISYTTPVWSLGALARLVDRQDRYAVNQGSVAGQDIGATGGFAVFSINGGWRINSHALLTAGIDNLFDKTYAEHVNRAGDGDPAYATNVRVNEPGRTLWMKLQVTF

SEQ ID NO: 7138 - protein, 701 aa, Burkholderia multivorans
MSRKNWAAAPMAIVVGTAGLSAAEAQELSLPAIEVSGQRTTAPFRAPESTSATRTETDVMEIPFAVSSVDKKLIQTVAATRGEDLYDWVAGVARQNNFGGLWDNYAVRGFAGDGNTSGTDYLVNGFSWNRGISVPRDTATLERMEVLKGPASALYGRGDPGGLISYTTKQPQFARANTIGVSAGSYGALRETLDSTGPVTKSLAYRFIAMNEDNGSFRDTVSSKRYLFAPSFTWDIGADTTLHYEFETARQRAPLDRGVVAVNGQLGAVPASRFMGEPRDGDYDVRNSGHQFTLEHRFNADWSVNAGFAQRDTDLSGRSSEAFALQPDGRTLWRRYRQVAFHSNDVQGRVEVAGKARTAGIGHTFVMGVDAYRFNYDQFVSRSTPTAAAPYAIDIFDPVYGQPAPVPRTATNLLERDDGQGLYAQDTLAFGPHWKVLAGLRWDRFHQSVENRLKGVTTTQLQTALSPRLGIVYEASPALSLYANTAYSFRPNNGADVNGRAFDPEKGHGYEAGVKWAGTRWLATVAAFYVNKRNVLTADPANAGFSRAAGEVRSRGVEFEWNGELGHGLRGIVNLAYVDAQVTHDNVLTPGARLVDIPRLSGSALLMYETALALVDKAGAGAGVIYVGRRAGNTANTQDGFDLPAYATVQLNGYVQVNKHLRASVVLNNLFNRTYYVSSYNSLWVTPGAPRSLFASLAYSF

SEQ ID NO: 7139 - protein, 335 aa, Burkholderia multivorans
MLAAAGSVNAAEILKSDAGTVDFYGQLRTELKFLEDKDPTIGSGSSRAGVDANYTVNDSLALQGKVEFALKDSGDMYVRNHILGVKTNFGKFSFGKQWTTSDDVYGADYSYFFGGTGLRYGTLSDALHDSQVKYVYEADSFWVKAGYGFPEDNAKQELAELYVGATFGDLAVHAGGGQNRDKAFKVGSNTVGTTTTDIKADVTNSYFEVTGEYTIGDALIGVTYYNAELDVENNPLVIDEDAISVAGTYKVADKTKLYAGYEYVMQEANTGADEDGTLVYLGVEYKFASWARVYAEYGYGDGTTLGYTNKGSDAEVKATKVDSANNFGIGARIYW

SEQ ID NO: 7140 - protein, 478 aa, Burkholderia multivorans
MLLAWGLPALAGVSLTGVAHADDAASAPLTVAQAAPAAGSGASVAQATTPNAIVNAEASQAVTPPDEPSAQSKSNGFIADSHLDFLFRNYADVLDNKGGPHRHAWVQGAMANFESGYTTGLIGIGFDASLYAALKLDGGQGAGSMVHIAKGGGGGNQLAWAYPGIYDVKARISNTVVKYGLQAVDNPFMEQHDNRALPPTFLGATLVSNEFKNVMLEAGSFTKTDARGHTTLTNLTTQYGGTRINRLTYVGGTWDYSPNGEVALYANQADDVWHQYYASVKHSIGSPQTIKWTGFGNVYSTHDTGDALQGKINNNAYSLSLAAQHGPHELLLGFQQVLGDQFFDYLNETNGIFLANSMDVDYNAPHEKSLQLRYTFYGKDAGLPGFKAMVWGVTGWGADGSAGAANDPSKSSIYWSNGAPVQGRHHEFGFIPSYTFQSGKLKNTKVTFIAMWHAGSAHYSDATNTEYRLVVNLPLHAF

SEQ ID NO: 7141 - protein, 329 aa, Burkholderia multivorans
MHRSRILYAIPLSLVMSGEVFAADQNVPPEQPPRSGTKKTSTAGTQAKTVEKLEVHARRASTLASSATKSDTPLIETAQSVTVITRNEMDIRNVLNLNQAVRYTAGITADLRGGGVGTRYDQFALRGFTVPTFLDGLKLQDSPTGYAVAQTDTSRLDRIEILKGPASALYGQSSPGGLVALSSKLATDQRSYGSVNATGGMFDLYRVDADVGGYVTDNGFVRYRVNGTINGQHSQLARTGSRRFSISPSFTFGGDGPTTLTILGNYQYDPENGTYGGVPLVGSLRALLEIRYDRFSRGFERDSKAGCGRQHNEAAWPELHARRNAIRLI

SEQ ID NO: 7142 - protein, 383 aa, Burkholderia multivorans
MNKKLLTIAVLAATTGAAHAQSSVTLYGVIDAGISYVNHSKTATGSGKMFKYDDGVAQGSRWGLRGTEDLGGGLKAIFVLENGFNSGNGTIGQGGAIFGRQAYVGLSQQQYGTVTFGRQYSFSTDVLGSNYSTGGNTVAGNYAYHVNDIDQLTSSRINNAVKFQSANYSGFTFGALYGFSNSTDFAGANGSGASNTGGSSRAYSFGLNYANGPFSLGAAYTDIRFPSQSTPAFSTSIANLALTNIRDLRTYGVGGRYVFGPATAWALWTRTQFTPIAAGASGTFYNAYEAGLKYAITPALSAAAGYTYTNATQSGSSAHWNQGNLALDYALSKRTDVYGLVVYQKASGNNVQAQIGSSTSYFNTSGTGASNQLAARVGIRHKF

SEQ ID NO: 7143 - protein, 358 aa, Burkholderia multivorans
MKKLALATAVAALSVSAAQATPTVYGKAFLTVDANNTDTTYNSGLVQLSEDTNESGLNSNTSRIGFKGSEALNANTDVVYQLEYKIDIDADRGDNFKSRDTYLGLAHKQYGTLLAGRLTTIDDSVDFASMLEDNNVADIGPTFNAPRANNAFAYVSPEYNGTQFLAMYAFDSDTDKGGLAKDDQFGVGATYSTGPINAGATYIHYGDDSHIRLSGNYAVSPALTVGALYQISEFGVAAKNQKASPLSEGKVGDKKENTLIVSGEMKTATPWTAYGQATLIKNVAGNDGDESVGVGIGGKYAFNKATTGHVYTGYVNSERKNVKYEGSNETHKNAHKDTKFDGYKNSGFGIGAGLEYKF

SEQ ID NO: 7144 - protein, 710 aa, Burkholderia multivorans
MTIFQLRAPRASRNACARRLPRVLKLTVPALAVGALAASAAAAETARAPGAPTDDTAAPLPAIEVVASPLSTPLVVVTDPKTPRQPLPASDGADYLKTIPGFTSIRSGGTNGDLVLRGMFGSRLNILANGMSTLGACPGRMDAPTSYIAPESYDKVTVVKGPQTVLYGPGASAGTVMFERVTPRFDKPGMRFDGSLVGGSFGRNDQNIDVTAGTPDVYGRVTANHAHSQDYKDGNGNTVPSQWDKWNADAALGWTPDDHTRVELTAGTGDGYARYAGRGMDGAHFRRETFGLSFDKKHLGDVLDRIEARVYYNEADHVMDNYTLRQPDPTSSMPMRMASEVRRRTVGARAAATFRFTDDFKLVTGVDAQSNRLDSRSAMGRQNYGDKPWDAQATMWNAGVFGELTWYASDVSRVIGGARVDYASARDKRATTSGMMMSKPNPTFDDDRTRVLPSGFIRYERDLASLPVTWYAGVGHTERYPDYWELFSAKRGPAGSINAFSAVQPEKTTQLDIGAQYKSDRLDAWVSAYAGYVQDFILFNYAAGMMGPTTQATNVNAQIMGGEAGVSWKPVSPLRVETSLAYAWGRNVASGDPLPQMPPLEARIGLEYTRGAWSAGGLWRIVAPQHRYALNEGNVVGKDFGPSAGFGVLSLHTQYNVSKTVQISVGVDNVLNKAYTEHLNLAGNAGFGYPANSPVMEPGRTAWVRVSAKL

SEQ ID NO: 7145 - protein, 587 aa, Burkholderia multivorans
MRHQILKSTIIVAIFFIANLATAQDKDKDKEKDKEKTIGTEVVNVVKPYTPSVSDAFKIKQTPSLNDKETGKKKEIKYSIFSFPVASTFTPAKGRAAGLKKAKKEKLYNTYVSLGLGNYNTAALDFYTSRAISRDETFDISLRHHSSQGGIDNVELDDKFFDTKLDLAYINRSRDLSWKGKFGYQHQIYNWYGLPGDVTLTPAQIDGISEQQTYHNLYLGGDVTMDDSFFKGGKVLYRRMFDAFSSGENRLILQPEFEVEIAGELINTMVDIDYVGGTFENNFAETGGIDYSILKAGISPSLVILRDDLTVNFGAGIYVGLDTENSETDIFIYPRITAQYRLSGDDIIAYGGIEGDLNQNSYYDFVQTNYFVSPTLGIAPTDQQYNGYLGIKGKLTSNVSYNARASYMSEKGKPLFKVNPFNPSPDSANGYTYGNSFGVAYDDVTTIGVFGEINVDITSNFKFGAKAEYFNYSTDQQEEAWNLPEIEASIFADYQITENWFAGANIFFIGERSDQIINPGGIVVSTPQTVTLDSFIDVNAHLGYRFNDRLSAFVKANNIANQDYQRWVNFPVQQFQILAGATYKFDF

SEQ ID NO: 7146 - protein, 383 aa, Burkholderia multivorans
MLSNQASQHSRPKPRFMLGAVTVASAASWCVAAHAQSSVTLYGIADVGVEHVNNTNTGGAQTREASGNLSGSRWGLKGVEDLGGGMKAIFQLENGFNINDGTTAQSTKGLGSNAATTSRIFGRQAWVGLAYRGQQLTFGRQNALFYEQAVAFDPMGASSRYSVLSVDYAAAARIDNSVKYTGVFGPLTAQAMYSTRYDTGYGAEVPGAQLTGRFFSAALTFSQGPLAASVSYEQRNSNTVATNTGTERRATAAASYAIGPVKGFAGYRYLRASNAFLPANPIRVANGAEASTANLYWAGAQYAVSPAFVVTATAYYQDVHSTSADPWLAVLCADYLLSKRTDIYATAGFARNKGGSALGVNGYGTVAPDHNQTGVVIGMRQKF

SEQ ID NO: 7147 - protein, 379 aa, Burkholderia multivorans
MKQSKVAVAAALACAACIPAVGHAQSSVTLYGIIDGGITYVNNTGGSHVFKFDDGVAYGNRFGLKGTEDLGGGLKAVFALESGFRLGTGQLNFGGAEFGRQAYVGLQNNWGTLSFGNQLDITNELVSIYNISAWGSGYAIHQGDFDRFNGDRLPNSVKFLSNDLNGFKFGAMYSFGNVAGNFHRNSAWSAGASFTKGDFSIGAAYTRLNNPNGIYAFDPYAMIGTHTFLGQQTVTVDPATGQRTDLFANTPMDVDSQGTFGVGASYTIGKLTLDANYSYTTIKGFGQSSHMQVYEGGGLYQFTPALSFIAGYQHTRFEGHHWNQGTAGLHYLLSKRTDVYISGDYLRASNGVDAVIGYSFTPSTTQTQADVRIGMRHSF

SEQ ID NO: 7148 - protein, 832 aa, Burkholderia multivorans
MPNRLMYFRKAFLRASASAMVGYIGLVPISAHAQDAAASEPQAEEQQTGGLEEITVTARKRAENLQETPVAITAMTGGMLEERQVTNVAEVAKFAPNVNISPVANISGSSASITAFIRGVGQTDFNITVDPGVGVYVDGVYVARSVGALLDMADVSSVQVLRGPQGTLFGKNTIGGAIVVNSVEPQNDFDMKLEAATGRFNRADFKGMINVPLSDTLAMRAVASYETRDGYQKRLFDGGRQGNKDSFGGRIAFKWEPTDKLTVNLSGDINIRREEMAASTLVNLFESPNLLQVVDLNGRTVVFPSSTYAWNKLQGGAGFCGADGQLAPVNDPRCATTQWITGDIDSTWSGAKNQSDFDLWGTNLTLDYDFGDINLKSISSYRDQKATIQFDFDGTPHPYLNLTNNIDLWQASQEFQLTGSVLNDRVKFVLGGYYLKEKGQDKNNLLFGFADFFSGGKIDNDSYAAYLQATIKVTDRLSITPGIRYTDETKRFDPSFQTINVDYTAPLGQAGIIPYPQGVFIAFSQCVTGQPVPLLVTDPASPLFGFPLPGGCAPAATNPGGNHTMPAVQVAAKAKEWTPAISADYKITDDILVYASYSKGFKNGGFTQRIFPAEQVAPSFRPEFVESYELGLKTELLDRRLRLNLAAFMSNYDDIQVVVSEGIAPRARNAGSGRIKGFEVEGEAAPTDWLRLTFGVGYLDAYYRSIDPLAFPVNLNSKFAFVPEWTGSASFNADVYEGDMGKLTLRGDWSYQSETFKDAVNSPQLRQPGYSVFGASASFTEKSEHFTVTAGVTNLTDERYIQGGYVYPFVAGTALATYSRPREWFLKLAYKY

SEQ ID NO: 7149 - protein, 892 aa, Burkholderia multivorans
MNSLTLTAKAVRVGLFAAATSSIAFSGIAIAEEQSDKVERIEVTGSRIKQVDMETSSPVTVLSAADIALTGEKTVADVLNNSSINAFGSWRGTSGYGSGASATSTVNMRGLGSQATLVLLDGRRMPGTSSSSGAEADTSQIPLAIVERIEILRDGASAVYGSDAVAGVINIITKKEFDGFQVDFSTEQPSVEGGDANRFSIAAGFNSEKGNVTFTYEYYDTKAVMDRDIWNMDDPSYGDYSSFSSVPNGYYNTGEKDADGDDIYAFYSNSEMCADTDNVADTTDGQNNGRCLYSYGAVTKLFGDMTRNSFMTNFNYDITDNIRFRGRGTASLSETNTRYAGTPVSTNYPVMSADNQYNPTGKDMTLYMRSVQIGERDTLTETNSFDILGGFVGYADVGNGIDWELNAQHSASTTNAFNYNLINDNIIQSEIDTGNYDVFNTSGMSYAEWEQQMTALYSAANHTGVYQGKFDSTQIDGLASTMLYEQGDFSLAIVGGLEYEMINFKQTSDPESASGIISGGSGGDDVDAERTRQSAYTEIQMALPANFELSAALRYERYEQEGTLTGAEGQVTNSSTFDAVVPKFGLSWRPVDSLLLRASYGDSFRAPNMGEMFSSQSLSFEKAYDSVWCEANNNSDANYCATGNQHKTWFGGNPNLEAEEGNSLTLGGVWNVTDAWSVELSYYSITYDNKIEAVSASDVIRDEKINGGSDFVTRGPDGKIEYLESGYVNKASLETSGFDFASSYNFETGFGDFNLKLDVTHILDFKEQADAESEKIDYSGTQDYPDWRGNFAAAWYYNDFSAAWTTVYIGSQSGAMWRDLGYDYIIDTPSYFKHNFQVGYTHDWNGTITVGVNNLFDEKAPTWYDYAGYRDVNTNLYDVLGRTFYLRINQKF

SEQ ID NO: 7150 - protein, 419 aa, Burkholderia multivorans
MTTSPAPYALPGLIALALAGIALPAAAEEAGFIDGAKVNLNLRNFYINRNFTNPTKAQGKAEEWTQNFILDAKSGFTQGTVGFGMDVLGLYSVKLDGGKGTGGTQLLPLDHDGRPADNFGRTNVAFKAKLSQTEVKVGEWMPVLPILRSDDGRSLPQTFRGGQITSKEIDGLTLYGGQFRANSPRDDSSMSDMSMTGKAAFTSDRFNFQGGEYVFNDKRTQIGLWNAELKDIYSQQYVNLIHSQPLGDWTLGANLGFFYGKDDGSARAGDLDNKTWSGMFSAKYGGHTFYVGLQKLTGDSAWMRVNGTSGGTLANDSYNASYDNAQERSWQVRHDYNFAALGVPGLTLMNRYISGDNVHTGTTTDGKEWGRESELGYTVQSGALKDLNVRWRNSTMRRDFSNNEFDENRLIVSYPISLL

SEQ ID NO: 7151 - protein, 151 aa, Burkholderia multivorans
MGTRVAVENTSGRGFFQEYTPFVKVQAVYARQDSFVELGAISRDFSDSHLYNLAIPLGIKLEKRFAEQYYHVVAMYSPDVCRSNPKCTTTLLSSQGSWKTKGSNLARQAGIVQASGFRSLGAAAELFGNFGFEWRGSSRSYNVDAGSKIKF

SEQ ID NO: 7152 - protein, 748 aa, Burkholderia multivorans
MKSRSDELKLGKFTTLCSVLAASPAFAQDAAPPAASADHDKELAPIQIKGAAEHSYKADFSSSVKFTAPLVDTPKSVTVIPQELIHNSGAATLTEALRTVPGITFGAGEGGNPLGDRPFIRGYDTQGSMFVDGMRDTGATTREIFNTERIEITKGSDGAYGGRGGAGGSINLVTKAPHLGTTAEASAGLGTDRYRRFTADGNWQFADHAAFRLNLMSHNNDVAGRDAVNNERWGVAPSIAFGLGTPTRVSASYYHLSTDDLPDGGIPYFYTTANKPANVDTIYPANVDRHNFYGLVNRDFRKTTTDIGTLRIEHDITPSLTVRNTTRYTESTQDYIWTQPDDSQGNVVNGRVWRRNNNRNSAINSIANQTELFGEFRTGPFKHSFTTGIELSREWGKRDSYSVATGTGKICQQGIGAASGYNCTSLGSPNPNDPWAGSITRNNDYAHARTVTKSLYGFDTVELSKHWQVNAGVRVDDYSTRFTDTRANGGKTYTRDDTLVNWQLGLVFKPARNGSVYASYATSSTPAGALLGEGSETQSLTPGRGGVGANADQLAPEKNRSIELGTKWNVLDDKLSLTAALFQIDTTNARVTLPNNQYAMVGNKRVQGLELGFAGQLTRAWQVFGGYTYMKSELRDNGRNTADNGHQFPNTPKHSFTLWTNYDVTPKFTVGGGAFYMSKVFGDTANLRAVPSYWRFDAMAQYRINKKLDLQLNVSNLFNRTYFDQAYPAHYASIAPGRSAFVTLNARY

SEQ ID NO: 7153 - protein, 199 aa, Burkholderia multivorans
MKIGMVALSLFTAFGMSSYALANENDTAAKELGHFYAGVDIGFYNETELEYRGSKIEDSSDLADLSYNLVGGYEFNTHDVVKLGLEAEYRKIGKVNFAQMMDIEGQAFFVNVKPKFIVKGDVLDLYVSLLAGVGSIDTEIKAFGLSASESEAAYQIGGEFGAIITDNIDVHIGYRSAHIEIESIDVSSKTAYIGARYHF

SEQ ID NO: 7154 - protein, 432 aa, Burkholderia multivorans
MASAISGQVHASMGNLATTFGILPSDMATAQAYSLFNDQVSAAYYNPAALALSPRGELTIGAMQASPELIVESKGGANPPTRSGKVLESTNTENVLVGMKTNLTSLTKFETPVYLGLIAGVEKYGMEMLAFDSSTELQGQFFQYGQKPLFLSIAGAAKVMDGINVGAGLRVTLHASATMELESDLAGNTNSEKLSVSAEPVLIPVAGITADMGELLCSEDEACFWQGLDFAFSYRGESDTQTKVNANATIPGTIPDPGLPLIVTTLDAYQPMILSFGTKYDLTSDWDVSGTIEFQQWSTLTDELKKDTIKDQANLEFKDSYIPRIGTRYKWSDLLTLNAGISYEESPLESTQSADVNVFDNDRLIGALGLTAYYRETKFLAYPLRIDAAYQYHQLQDREFTLSSDEVPVSPYEEVNTKGSAHVISLSFSMTF

SEQ ID NO: 7155 - protein, 699 aa, Burkholderia multivorans
MTDSAPRGDEDVGLFQKDPSMFSHSVARGLPLCALVLMLSSHPVLAEDSADQSAIIVTASPIVEEAAARVQRTPGGVDVVSAQEFDDKLAVSLRDALSFSPGVYTQPRFGQEVRISIRGSGLSRGYHMRGLTLLQDGIPINAADDNGDFQELDPQVFQHLEVYRGGNALRLGGSTLGGAINAVTPTGRSAPGVELRIDGGSFDTLRGKMAFGYADDHGDAFMAITADRSDSDRIHGDRKALRFNGNVGLKISERVETRFYASAQTIRQKLAGALNETDAIANPSKGNVFGDQARDIDSIRLQNRTTIALDDATVAFGVYFNAKQLFHPIYQVIDQKSEDRGVFGSVDLTGDIGGMPVALTLGSQARFGRTVARQFVNLNGKSGAPTADAVQKAQTINSYAEARIAPLPSLWLVAGGIYSHGERKIDNRMAPARSGQADFDSFAPKIGLLYEPSDRMQVYANYSRSVEMPGFGELSQAPAGGAPGFTPVGLQKAWTAEIGTRGRVGIATWDVSVYRADIKGEMLQYSVVPGLIPAATFNADRTRHQGVEAGLDLTLSPWARLRQVYQYSDFRFRDDIQFGDNRLPVIPRHFYRAELTLGTDRLSVSPAVEWLPQGAWVDYANSKRVESYAMLNLTAQAQVRDGVTLFVDARNLTKERAIGDISALVRYVADDPATPANEGSAAFYPIERRAFYAGVRARF

SEQ ID NO: 7156 - protein, 394 aa, Burkholderia multivorans
MNWRSLFVAIPALCAAPAFAQGSVTLYGLVDAGIDYTNNVGGHSAWQMASGFAQGSRWGVKGTEDLGGGYSALFQLENGFNVNTGTLAQGGRMFGRQAYVGLGSARFGTLTLGRQYDAVVDYLAPTTANGSWGVYPFSHPLDNDNTGNTFRVNNTVKYASPDFAGFSFGGTYSFSNDTGFANNRQWSVGAQYEQGGLLVGAAFLNADNPGATSGGAIAGSGSVGADANFASARLRIFGAGINYTAGPATVGFAYTNSNVTRPTANVGYLFGDETIEPVTGPLAGGTVSAIKYQNFEVNGKYQFTPALFVGAQYVYTTVRYDATTGSAKPKIHSLGLMADYNLSKRTDVYLMGAYQRIAGDATGSSLDQAYIPGAADLSSTSKQLMVHAGIRHKF

SEQ ID NO: 7157 - protein, 364 aa, Burkholderia multivorans
MNKTLIVAAAAASFATVAHAQSSVTLYGVLDAGITYQSNVQPALGQAGKSLWRMGAGIDQSRFGLRGSEDLGGGLKAIFTLESGFDIGNGRFQNNGGMFNRQAFVGLSSQYGTVTLGKQYDSVQDYLAPLTATGSWGGTYFAHVGNFDNLSTNGGYSPNNSIKFTSANYAGLQFGGTYSFSNNTNFGNNRAYSGGVSYQFQGLKLAGAYSQLNNPGQTTGGAIDSAIGTQGRVRTYGAAAAYAFGPAQVGAAWTQARVDNSTALGTSVRVDNYEVNGKYNLTPALGLGVAYTYTNGRLGQDSAHWHQVGVQADYALSKRTDVYAQAVYQRASGANASIYNGDITTLPSSSINQTAATVGLRHRF

SEQ ID NO: 7158 - protein, 359 aa, Burkholderia multivorans
MVKHAVAAAVIGMGAVSGAWAQSSVMLYGSMDAGIAYVNNVGGHAKWAMIQGNTQPDRWGLKGKEDLGNGLSAIFQLENGFYTNNGQFATANTIWNRAAFVGLSSERYGTLTLGRQTPLSFDYLDPLSTAYLAMSWYAFHPGNIDGLAATGNVPYNNAVKYRSPTFAGFSAAATMALGNTTNFSTGKSVGVALNYANGPFKASAVYSNEHDRSILISTTGITSFQGQNTANGYTASKVENIGAGASYQFGDFLVHGLYTRTKMQSNGFSDTFQSYDAGVNYRSSAFNTIAGGAATTTLAGRRWTQVELGDIYSLSKRTQLYANVLVEHGSGGAQAAFFTAGVSSTANQVIVLTGIHHSF

SEQ ID NO: 7159 - protein, 959 aa, Burkholderia multivorans
MSRTILVLVILVLAQIFAGFAFAQKGTIRGTIFEEGSGEPLFGVSVLVKETSTGAVTDFDGKFEIQVEPGTYSISISYISYSTVELTGVEVKSGAVNVLNEISMAEEASELETVTIAAAAIRTTESALMSVKRNAANLMDGISASAFRQIGDGDAASAVKRVTGVSIEGGKYIYVRGLGDRYTKTVLNGVDIPGLDPDRNSIQMDIFPTNVIDNIIVSKSFTADLPADFTGGVVDIETKDFPEEESMKLSLSGGINPSMHFNSNYLKYDGGSTDFLGFDDGTRAIPTDGRTDIPQYGDAIGNPNGPKGLEYQQILGDFNKTLGGYRSNSLMDMGLSFSLGNQIARSKATWGYNFAFTYKNETEFYQDAEFNLFAKPREASATELEALERQKGDYGVNNVLLGGLAGIALKTDNSKYKLNLMHLQNGESKAGEFDFVNTNLGANFTAKQYNLEYSQRALSSIMLGGTHYFNGRNWEVNWKLAPTRSTIQDPDIRFTRFRVPENTVSTEVGLPARIWRNLEEYSMVGKLDLTRNLSLFQRDSKLKFGGNYVFKYRDFDIQSFQFATGDTELNGDPNEILLDENLFSADNRNGVRYNADFIPINPNKYESIATNMGGYASLEANPASNLKAIVGLRVEKFNQYYTGTNQTGTIDYDLVTMLDDLDFFPTVNLIYNLAEKQNLRFSASRTIARPSFKELSYAEILDPITGRTFIGGLYPETTNGGSEVLWDGNLVSTRINNFDLRWEAFQDRGQMFSVSAFYKSFDKPIEMVQFLSDPGTFQPRNVGNGSVAGLEFEFRKSLKFIAPKLENFNWNTNVTVTKSQIKMSESEYRSRVLTAREGQEIKDTRDMAGQAPYIINTGLSYQSFVNGLEAGLFYNVQGSTLNYVGFGNRTDTYTVPFHSLNLNLNKTFGADERIQAGIGVQNLLNDKKEMVFKSYEAQDQIFTRLSPGTKITMRVGFSF

SEQ ID NO: 7160 - protein, 732 aa, Burkholderia multivorans
MSSVPVRFPLPFPRRLPLSHALAQGLLLLALSGGTAAAQSSQDEDKAKPAPASQTLQTVQVTANQLGTITEGSGAYTPGTIATATRLVLTPRQTPQTISVITRAQMDDFGLDGIDDVMRVTPGISIVTYDSERTEYYARGFAVQNFQYDGIPMSRDSAYSAGNTLSDTAIYDRIEVLKGATGLLTGMGDPGATINLVRKKPGKDFAGSATLGVGRWDDYRAEIDVGGPLTADGRVRGRAVGAWQDKHSNLDFYQRTSKVGYAVLEADVGERTLLTVGGDAMDSDPKGSTWGGIPLLDSAGNFNDMPRSFNNGTRWSGWRQYVRTGFATLEHTFANDWVAKLQLNHQVNGYDAALAGAAAGNPDPLTGEGVSLWLGKYVGKTVSNAADFYLSGHFGLFGREHELVVGGSASRKRWTNTGYGPQAGFPDTVPDYRTWNGDIPEPEWQRSYSNNEVTRENGLYVVGRFDVADPLKVIVGSRLASYRSPQTRETGVFVPYAGVVYDLGEHYSVYASYSTIFKPHSERDEQGKALDPLEGRSYEMGLKAEFLDGRFNASAALFQLDQDNFAQPTGGKTPDGQDAYRALMGVRTKGYELEMSGQLAEGWQVQGGFSHKIARQAGAKVTTLEPENQFSLHTSYRLRGDWKGLTLGGGARWQDSTFGEITNPATQAKVVHRTQPYWLLDAMARYEFNDRLSATLNVNNLLDKRYYTIFSWYSTYTWGEPRNVRLAMTYKF

SEQ ID NO: 7161 - protein, 224 aa, Burkholderia multivorans
MRKHTLSALCLTLAALSPLASAHQQGDWIVRGGLTTVAPDESTSNIVAGGNDLGVALNIDNDTQLGLNVAYFITDKINIELLAATPFKHDVNFSVADPLGTGNQLGEVTHLPPTLTANYYFNDASSAFQPYIGAGINYTFIFDEEFTGANEDAGLSDLSLDNSFGLSAQVGMDYQIDTKWHVNASVRFIDIDTEATFKVGDAAGKVSDIEIDPWVYTISVGYTF

SEQ ID NO: 7162 - protein, 1105 aa, Burkholderia multivorans
MRLTTVILIASFLQVSASTFGQRINISRKNVPLESVLKEIRKQSGYDFYYDGKTISADQKINVSITNLDVDHAVKAVLNGLNLRYNIEGTTVSITRSEPSLLKRVLDRFSAIDVRGRVVDKSGKALPGANIIAYPGRNRTTPDANGVFFMAGIVETATLEISHVGYVTKRLKAKPDMEDIVLELNDSKLDEVQIIGYGTESRRLSVGSTFSVQADAIEKQPISNPLAALEGLVPGLNITPTSGAPGAGIKVQVRGQNSLSQIGFGQKPYDQPLFVIDGVPTAAQNVNINSLSSFGGGDGTLSFGGMSPFNNLNPSDIESITILKDISATAIYGTQGANGVILITTKKGKAGKTKLQATFNTAVNSASRKYELLNLDQYLAYRREALANDGVNLSTASPLAYPDLLLFDQDKSTDWVDYYLSRTARNTDAHVSLSGGSDRITFLISPGYNKSEYNFNGNFYDQRFTLHSNLNYASPDNRFTVDFGFDYSYERNNSAASPSLVSSILTPPNFPDLYTAEGKPNWNYKGYNTSQFVQYSAALKQPSLLNAYNLKNSLALGYRIVEGLKFNINLGYNRLLSNEDQQIPASTINPRNNPVSSASFTTNTFETINIEPQLNYQRNFGKGIFTALLGGTYKKNNVSRIQLNGTRFSDEALLGSIASAATIQATDSYNPYKYIGAFARLGYTYDSKYIVQVSGRRDGSSNFGVGRKYADFGAVGLGWIFSEERFFKFANEVISYGKLSGSYGTVGTDATSPYQYQQLFTTNTSMPDFQGVRPLYVQNLYNPDYGWDTKKSLNLGLDLGFFKERVLLNLTYYRDRTGNQLVNYSLPSQTGFSSVLSNFPAVVQNKGLEFNLTSKNITTQNFSWNTSFNISANRNKLIAFPGLAESAYAALYTIGESVNIEKGYRLKGVNSETGFFEFYKSDGSVTSDPVYGIPSEGGDLQTIANTAPKFIGGLGNTISYKRFSLYFHFQFQRKQQANYLRSLYANTRPGAMYNQPVEILDRWTKQGDVASIQKFTRGFNMPAYYFTMSSGAYSDGSYVRLRTAALSYTLPTGFSKKLGISDGKLYVNGQNLFLLTNYKVGDPELTDIFSFPIQRTINFGLTINL

SEQ ID NO: 7163 - protein, 4238 aa, Burkholderia multivorans
MRMRMGSNKKRAEARPKLLVPTGMLVALVGAGIVPVDALAACTGTTTVSCTGATTSYSNGTNNLNLTVAPLATVSVVPLLGGTALSLTGSGVTLTNNGRIDPALSGLSLVSNGTVVGNVGSASTVNVTNASSGVMMGSTSSLLNGPALTVYNGTGGTTNITNAGTIGTTGLLGFSAGPTAQVVTTSGGAQVNFTNASGGAINGSVVLAPSGTPGAGNTFTNAGTVTGNVSLGSALGTSNTFNAQTGSSVGLGVDAGLGGNNTLNLQLNTAVGSPANGTIAVDTYGNFNNLGVQGGTWDLTGASTATNASLTGGTAIVHGAGALGTGTIVAGGGTLEAGAAGVNLLNNVALGTSLTVDGANGLALSGTIGGGGALNASGTGTLTLNGANSFTGGTNLTGGGGLVVGTGTALGTGALNVSSAGGTLGTSIGGTLLGNAVNIDTGVTLGLNGSANLGLGGTIAGNGGLAQTGAGTTTLLGANTFSGGTALSGGGLIAGTGAALGTGALHVTGAGGSLATNVGGTLLGNAVNLDAGATLGLNGAAGLSLGGTIAGNGGLAQSGTGTTTLLGVNTFSGGTALSGGGLIAGNGAALGTGALNVSGAGGTLATSVGGTVLGNAVNLGAGATLGLNGAADLSLGGAIGGSGHLAQSGAGTTTLLGANTFTGGTALSGGGLIAGNGAALGTGALNVSGTGGTLATNVAGTVLGNAVNLGAGATLGLNGAADLGLNGAISGAGGLALGGTGATTLSGANTFTGGASLTGGGSLIVGGSTALGVGGALNVSGLGGSLSADLAAGAALANGINLNGASLTLNGANDLGLSGAIGGTGGLVLSGTGTTTLSGANTFGGGTTLSAGTLLAGSNTALGSGALDVAGAGGALGASVNGIALGNAMNLGAGATLSLTGTHDLGLNGVIAGNGGLAQIGSGITTLTGANTFSGGTTLAGGGILAGNGAALGTGALNVTGAGGSLGTTVGGTVLGNAIQLGAGAALTVGGANDLGLGGIISGSGGLSVNGPGRTTLTAAETFTGGTTIGSGTLAIGAGGSLAASSPVNLTGAGAQFNISGATTPQSIGTLSGVAGSTIDLGANHLTLAGNGSGVFAGNIGGSGGLTLAGTGSQALTGNNTYAGGTALTGGSLVVGSGAALGLGALDVDGSASLGASVPGVTLGNAVNLGAGVTLGLNGANDLGLSGTIAGNGGLAQTGSGTTTLLGANTFSGGTTLSGGGLIAGNGAALGTGALNVTGAGGTLATNVAGTLLGNAVNLGAGATLGLNGAADLSLGGVIAGNGGLAQTGSGTTTLLGANTFSGGTTLSGGGLIAGNGSALGTGALNVTGAGGSLGTNVGGTVLGNAVNLGAGATLTVGGANNLGLGGAISGGGNLSVSGPSITTLTGAGSYTGNTTIGNGSTLAVGAGGSLSGGSLFDLTGAGATLDLSAATSPQTTGGLVGTAGAAVNLGGNTLTLGGSGNGTFGGTIGGAGGLTLAGTGTETLTGTNTYTGGTLINSGTLAIGAGGSLAAGGAVNLGGAGATFDLSGAALPQAIGTLSGVAGSTVNLGGNGLTLGGAGSGTFGGTIAGAGGSLTLSGTGTETLNGANTYTGGTNLAGGGTLVAGNGAALGTGALNVAGAGGTLAASIAGTTLNNAVNLGTGSSLTLGGANDLGLGGIIAGGGSLAQTGSGTTALTGANTYTGGTTLSAGGLSVGSNTALGTGTLSVTGSGGALNASTANLLLANAVDLGIGSALHLGGAFDFGLNGTISGAGGVVQSGSGTTTLGGANTYGGGTTLNSGGLSVGSNTALGSGALNVTGNGTLNASVSGTTLGNAVTLGAGATLGLNGANDLGLSGTISGSGGLAQTGAGTTTLTGTNTYDGGTTLSGGGLIAGNGSALGSGALNVTGAGGTLGTSVAGTTLGNAVNLGAGSTLTVGGANDLGLGGGISGSGGLSVSGPSTTTLTGVNTYTGNTTIGGGSTLAVGAGGGLSAGSALDLAGAGATLDISAATTPQTSGMLSGVAGTNVNLGGNTLTLAGAGNGSYAGTIGGTGGLTMAGTGTETLTGTNTYTGATTINSGTLAIGAGGSLSASSPVNLAGAGATFDVSGATTPQTTGTLSGVAGSTVNLGGNNLTLGGTGSGTYGGTIAGAGGSLTLSGTGTETLTGNNTYTGGTNLTGGGTLIAGSGSALGTGALNTSGAGGTLGTSVAGTTLTNAINLGAGSTLTVGGANNLGLGGAISGSGNLAVNGPSTTTLTGAGTYTGNTTIGNGSTLAVGAGGSLSSGSAIDLAGAGATLDVSAATSPQTTGTLSGAAGSAVNLGGNTLTLGGSGNGTFGGTVGGTGGLTLSGTGTETLTGTNTYTGATTINSGTLAIGAGGSLSGSSPVNLAGAGATFDVSGATTPQTTGTLSGVVGSTVNLGGNNLTLGGTGNGTYGGTIAGAGGSLTLSGTGTETLTGNNTYTGGTTLSGGGTLVAGNGSALGTGALNTSGAGGTLAASTPGTTLGNAVNLGAGSTLTVGGANNLGLGGAIGGSGNLAVNGPSTTTLSGANTYTGSTTIGSGSTLAVGAGGSLSSGSAIDLSGTGAMLDLSAATSAQTTGALSGGAGTNVNLGGNTLTLGGAGSGTYGGVIGGTGGLTLSGTGTETLTGTNTYTGATTINSGTLAIGGNGSLSSSSPVSLTAAGATLDLSGAASPQSTGAISGVAGSTVNLGNNNLTLGGSASGTYAGNIAGTGGVTMSGTGTETLTGSNTYTGATTINSGTLAIGAGGSLSGTTPVSLTGAGATFDLSGATTPQTTGTLSGVAGSTVNLGGNNLTLGGSGSGTYDGTIAGAGGSLTLGGTGTETLTGVNTYTGGTSLTGGGTLIAGNGSALGTGALNTSGSGGTLGTSVAGTTLGNAVNLGAGSTLTVGGANNLGLGGAISGNGNLAVNGPSTTTLTGVGTYTGNTTIGNGSTLAVGAGGSLSGGSALDLAGAGATLDLSAATSPQSTGALSGVSGSTVNLGGNALTLGGSGSGTYGGTIAGTGGSLTLAGTGTETLNGTNTYTGGTTLSGGGTLLAGNGSALGTGALNTSGAGGALGTSVAGTTLTNAINLGAGSTLTVGGANNLGLGGAIGGSGNLAVNGPSTTTLTGAGTYTGNTTIGNGSTLAVGAGGSLSAGSAVDLSGTGATLDLSAATTPQTTGAVSGVLGSTVNLGSNTLTLAGAGNGTYGGTVAGTGGLTLSGSGTQTLTGNNTYTGATTINSGTLAIGAGGSLSGTTPVSLTGAGATFDVSGATTPQTTTALSGVAGSTVNLGGNNLTLGGSGSGTFGGTIAGTGGSLTLGGTGTETLTGPNTYSGGTNLTGGGTLVAGSNTALGTGVLNASGAGGTLAAGTPGTTLANAVNLGTGATLTVSGPNNLGLTGAISGSGTLAVNGPATTTLSGANTYTGGTSVTGGGTLVAGTPTALGSGTLSVGGTGGTLGASVAGTTLGNAVNLGTGSTLTVGGANNLGLSGPISGGGNLVVSGPSTTTLGGANVYTGNTTIGNGSTLAIGGNGSLSAGSALTLAGGGATLDVGAATTPQTASALSGAAGSTVNLGGNTLTVAGPTGGSFGGTIAGTGGFAVQGGGTQTLTGANTYTGGTTIGSGSMLALAGAGSLAPTSPVILAGSGATLNLAASAAPQSIGTLSGTTGSTVNLGATPLTVNTAGTSSFAGTLSGTGPLTLAGTGAQVLSGTNTLSGPTNVTGGTLAVTGSLASSPVTVGSGATVTGTGTVGGLVVSGGGTASVLQLGQPLKVAGNATFQPGSTLQVGATPQQSGGLDVTGSATLNGGSVQVVAATGQYQPGKLYTIVNAGAGVQGQFSAVNSTYAFLTPTLTYNPAQVLMSLAPNGTPFSSVATTPDGQAVAGAVGTLGAGNPLFDTVLTSDATTANRAFTQLAGDLYPSTRSVLLSDSRYVRDAVLDRARLGSQPGGALCGCEAPVSADDHAAALDRRMAAENGCTPAKSYKPAVWGRLYGSHSRFNGDGVASIDRNLYGFIVGTDAEVSSHWRVGIAGGASRSQLNTDQNESAKVNGGTIALYASGRYDAWNVRGGVSQSWYRVHSERNPSFGSFADHDTASYDANATQVFTEIGYSTAIRNVSLEPFVGLAFASLHTGGFKENGGAAALQGDSDTTGLGFSTLGVRASTDVAVTTKGKVTAFGTVGWRHAFGNTQPASTLSFASGGSPFSVTGVPVARDAAVLEVGVDAAVTKNLSLGLSYSGQLGGHISDHALYGNLLWKF

SEQ ID NO: 7164 - protein, 642 aa, Burkholderia multivorans
MNLRHLLATSAATALLSPLAHAAGDTAPAQPAGPAEGADLPTISVTDTRHLPESFDRRYASTQVLTRDDLDRLSPADPSITQALATLPGVTVTQNGGPGSSASVSIRGSSASQVAVFIDGIRIGSPTTGIAPWADLPTDAFERVEVISGPAAASFGNNAMGGVVQLFTRRAAQQPNQTTVSFGGGTNKTFDTRFRTSGTVPSTGPLAALGGLTYSLGLHDYNTAGIDATRPFFYGHEDGRNPYHAQDLDARLGYARDNWSISTFALYHRSDLSYDNSGYANRELDHQLTTGVAFHLDITPDTQFDQSFGYANDRQFIYADNPALATDQINSQRISTSTSLTHQAHGFHLFGLPLSGESKLAYDFTREQAFLPVDIPGGVPTRNDSAFSLHQSATLGSVTMFVAGRHEIVAGQAVNTGNAALSWAITPVYTARVSYGNAFRLPTFNDLYYPGYGNPSLSPERSTSVEAALDANTAYGTFTAAIYDTRVNNLIAYNPATFSPMNIGRSHIRGIDLSYKGTIGRSTPVSIAVGILNPQDETNQTWLSRRPRQTVSLNVDHTWDELKLHALSTGASLLYGGSTFDDPANRQYLASYLTVSLRASYRINSHLTVSASLSNLFDRQYMTAYGYNTLGRTAFGKVSYTF

SEQ ID NO: 7165 - protein, 393 aa, Burkholderia multivorans
MKPIKTLSISFITTLILAGCHSMPTSGPAQNHIIGLKKPQNESLPSVDVIEMNDKVAHTLFKQKQSQSFTQFKQQNSNYADIINVGDTLDVLIWEAAPAILFGSVLSQTGSGGANLTTLPEQIVARNGKITIPFLGPILVKGKTPEQIQRDIAHALSSLANKPQVIVRLNKNNSKNVTILRQGNSVRMPLTSQGERVLDAIAAVGGATENLQDISVQLTRGKEVKMLSLEKLATHPEENILLRSNDVVTLLNKPLSFTGLGALGTNKQVKFSANGLTLAEGIGEMGGLLDNRADPKGVFVFRYIPFNKLSLAEQTKWKARGYDNDMEIPTVYSVNLLNPNALFWLQRFPIQDKDLVYVSNAPMAEFQKFLKLVFSITSPVTGTLHNINVIKNL

SEQ ID NO: 7166 - protein, 336 aa, Burkholderia multivorans
MRAAFSDTPLDQSLLNALVEVKLEVINVQQQVKKEPQDQEEKEKIQRKQKELISRYSNSALSELSATVNSMLSVQDELDRLFVDQAQSALWTNIAQDKRRYDSDAFRAYQQKTNLRQIGVQKALDNGRIGAVFSHSRSDNTFDEQVKNHATLTMMSGFAQYQWGDLQFGVNVGAGISASKMAEEQSRKIHRKAINYGVNASYQFRLGQLGIQPYLGVNRYFIERENYQSEDVKVQTPSLAFNRYNAGIRVDYTFTPTDNISVKPYFFVNYVDVSNANVQTTVNRTMLQQSFGRYWQKEVGLKAEILHFQLSAFISKSQGSQLGKQQNVGVKLGYRW

SEQ ID NO: 7167 - protein, 1895 aa, Burkholderia multivorans
MIEFLCECVVRDKRCAMTPPVSGYKTGRGPIVKRLSGVFFFIMVSLFVAPQAAQASFTSCPANTSGGDPLTMNLTVDECTLQSGAAVSALSDDLIQIQIAGGSSTNFFIFDPSANDLRDLIFSVNNGSPQGTLDADGGSLSGIDCAAGCTVSGTHGGSPFTFTYTASGGGGSLSSPAEIDDLVSSTGNTVADGGTDTIAAAIDSGTPTTITYDVSNSGSGTLSLSGLTQGTPTNASFGATSIDAASVASGGTETDAISITFTPSSTTDGASFSVPFSFTTNDADDGTDETTFNVTISGTINAEAEISDLTSSTTNTVADGGSDAQGTVASGSAQALIYTITNSGTADLSVATASSSSASNVTVNSIGAPGSTTVSAGGGTTQFTVQYTPSAAGAFSFDLSFVNSDADEDPFNFTVSGTATAAPGFSQAIAPGTILADGTATVTFTIDNSANATAATSLDFSNSLPAGVEVAATPNASTTCTGGTLTAVAGSGTLSYTGGTVGAGASCTVQADVTAGTDGSYSNTSGDLTSSLGNSGSASASLTVASPEIDLQRPAATSLADGDTDAQGNVAVGVQQVLTYTVENTGNATLTLSGTPSSSAASNVSVDSISAPGSSSLAASASTTFTVAYTPTAAGAFSFELDVSSDDADEGTYDLTVSGTATAAPGFSQAIAPGTILADGTATVTFTIDNSANATAATSLDFSNSLPAGVEVAATPNAATSCTGGTLTAVAGSGTLSYTGGTVGAGASCTVQADVTAGTDGSYSNTSGDLTSSLGNSGSASASLTVASPEIDLQRPAATSLADGDTDAQGNVAVGVQQVLTYTVENTGNATLTLSGTPSSAAASNVSVDSISAPGSSSLAASASTTFTVAYTPTAAGAFSFELDVSSDDADEGTYDLTVSGTATAAPGFSQAIAPGTILADGTATVTFTIDNSANATAATSLDFSNSLPAGVEVAATPNAATSCTGGTLTAVAGSGTLSYTGGTVGAGASCTVQADVTAGTDGSYSNTSGDLTSSLGNSGSASASLTVASPEIDLQRPAATSLADGDTDAQGNVAVGVQQVLTYTVENTGTATLTLSGTPSSAAASNVSVDSISAPGSSSLAASASTTFTVAYTPTAAGAFSFELDVSSDDADEGTYDLTVSGTADGSAEIGVGSATGGSLEDGDTDTIPGTPSAGSPTVIIYTFTNSGSGTLNITTPTVAGNISNETNVVVNSLTLASNTVAGGGGTTTLEISYTPQVSGAYRFDLQVANDDADESLFNITVAGSASGLPEIEVSSSASGALSDGDTDSIATVATPGVTASVTYTITNSGTDVLTLDAPSVASNIRNQSNVTVDRLSLASTTVASGGGTTTLRVDYTATAGGAYGFDLSLGSDDADEDPFDIVVSGTAQSVASALAAQSGSGQVSEVGAQFPAPLVVLVTDSTGTGVAGVDVTFAAPASGASVVFASTGTHTETVTTGSDGTASTSAMTANGTPSSYAGGSTLQSYDVTASATGLASVTFALTNDRDSEADIQKTQEVIAAFVSNRANAIVSNQPDLVSRLRQGALAGQQGRNGFDLRATSGGRSANFSFSLRALLEEARRRNDGARWRETLRHADASAGPGADSAADRAMASQAYALRFRGTDPAQAAPVVTPVISSGWDFWAEGTYAITESGNFESRSGLFFAGADYRWSDQVLLGVMGQLDIADEDNVAAGTSASGTGWMVGPYVVVRLDQNLYLDVAATYGRSSNTVNALGLFEDDFDTERFLLQGGLTGDFKLNARTTISPFARLTYYYEKQESYTDTLGRVIPSQDFELGRFEFGPKISWEMYLQEGTQFSPYVSFSGIYDFNKLQGATPTDATLASSQSDLRGRLEAGATFLVPDRGIKVAVEGFYDGIGTSDFESYGASLSVLIPF

SEQ ID NO: 7168 - protein, 725 aa, Burkholderia multivorans
MWMETGTGRRARAIAAGGAWCVAAAGAAHAQASAPGAAVAVLPAIDVRGPADAASSVGLVGRRTATGTKTDTPVDEIPQTLNLLTTQQIDMTGAADLNQALRYVPGFATFGADSRTDWYAALRGFTPTLYVDGLPAPNTAVIANWRVDPYTIDSIAVLRGPTSVLYGAGEPGAIVDAHTKLADGERVREAGVQIGNDARKQAMLDVGDRLDPDGKYAYRFVGVARDGNAVTGPNGDRRVALAPSFRWRPNADTSLTLSATFLQDSGDISSNFLPASGTVLPNPNGRLSQDLYMGDPSFNDYRKKQWSLGYALEHRVNAIWSLHQDVRWSHLSLDDATVFGNGLAPRSTTNMMRFAGLFQLNYSRFDIDNHAQARFGTGSLEHTLLFGVQFDRQTTTNSVWLALAPSLDLYHPVYRPVTAAIFAGPTSLGHVDQYTAMNGVGVYAQDQIRWQRWTLTLGGREDVVNARFDDRAAGTHAQQDVSAFSGRVGLTYRGDAGLSPYVSYSTSFDPVIGVRMFGGGLPKPTRGTQTEAGLRWQPPGRNLMLNAAVYQIDQTNVVTPTPVNLDPTATTSVQTGKVRSRGIELSAVGKVTHGLSIIASYAYQDVKNVQANDVSLNHWPVSVPLPRQMASMWADWTWHTGALAGLGVGGGVRYQSASAGAPDNSLTVPSATLYDLAIHYDLPRWRFAVNVANLFDRRYVSGCQSYAVCVFGNERTVLASAKYNW

SEQ ID NO: 7169 - protein, 836 aa, Burkholderia multivorans
MLLAVLLIPVWATAQNAANSSFQIKGILLDSLTKEGEPYATIKIVKKEAPEHALKMLVTDMKGHFQEKVPGNKGNFIMTISSVGRNSIVKNFSVKPGEKSVDFGTMYITDASNELGQVEIVAQKPLVKADIDKIEYNVQDDPDSKSNSVLEMLRKVPLVTVDGEDNIKVNGSSSFKVYVNGKPNNMMSNNPTEVLKSMPANSIKHIEVITNPSAKYDAEGVGGILNIVTVGGGLEGYTATFSGNVSNRGAGGGVFGTIKSGKLTFSARYNYNYNNQPRSYSGGNRRTVGETDSSSSDLDYSGTSKGDGSFQSGSMEASYEIDTLRLVTMSFGLWGGKNKSDGATNTLATFPGTANELYNYVSNSHSKSSWYSIDGGIDYQRLFPVKERMLTFSYKINTRPQTSDSYSGYEYDMDNVAPDWQDFMKRMLDQHNDGSQSTTEHTLQADYTTPIGKMHTVETGVKYILRNNTAEDDRFQRAAGQQTDYEFDEDHSSHYKHLNDILAAYAGYSLKVKKLSGRLGVRYEHTIQNVKYLLGKGDNFKKDFDDVVPSASIGWKLTDMSNLRLGYNMRIYRPGIWYLNPYLNDSNPTNITQGNPNLDSEKSHAFNLSYSNFTQKFNVNLSLRYSFTNNSIEQISEIVPDTEIEGLKETTGKEVLYSTYQNIGKTKNASLSGYINWNATSNTRIYANIYGNYSYMEGANGLKNDGWNLFAYGGAQQTLPHDWRISLNVFGQTPWVMLQGKGSSYFDYGLSVNKSFFDKRLTLSAFASNFFKKYMDNTNTLEGVGFTQESWSKYSRQRFGISVSYRIGELKASVKKAARSISNDDVKGGGGGNSVQ

SEQ ID NO: 7170 - protein, 950 aa, Burkholderia multivorans
MKHSTGTDCTTSSAKLTQRRIKALAHGLSQYLCSTVSYSAIALAGVTTIVAANPVRADDYHYIGTHSLLDRWGRPASWAEGKLPGGGDRAIIAGSATGIIPAASAIGSIWITQTSALKTFNQSSVSAAITINGIDGAGVRTDAAQMINFFRGTNVGGNISIQATNEAGGGFNFSAPPAGGSTTGFLETNGYTVTFDPVNTANLMNVTGGYEIIGSGNLVKTGAGLLTIEGYTNNSAFTDSPAQYSGSTWIQQGTLALIGTASLRRSSVVRVDGVFDISATADGQYDPSGIPGGTSVAVLTGNGSIVLGARNLTLNEGGNDFAGQISGTGKLILQQGTTVLSGESTYSGGTDINSAHLYVGNAKALGSGAVNMQGTAALGFLVDDLVIKNDIILASGNTSAIDTGTFNETLGGDISGDGSLTKQGDGTLIVAGANTYTGSTNVLAGTLRAGAANTFSAASAVDLAAGATLDLGGYNQSIASFSNAGTLKFGTKPGTTLMIAGNYTGNDGLLILNTDLGGDDSATDRLVVTGDTSGNSTVNVNNLKGEGAPTVEGIKIIEIGGVSDGEFSLKGDYEIQGEQAVVAGAYAYQLYKNGKTNPTDGDWYLRSALKPKTVDPVTPTSPSKPLYQAGAPLYEAYPQVLQALNGLSTLQQRVGDRYWATDENGGTSNTTRSSVWGRIEGAHNRLTPNSTTTLTSYDVDTYKMQAGLDGQFFDGDSGRLIGGLTAQYGKASADVWSVFGDGTIDTDGYGLGATLTWYGDNGIYVDGQVQANWFDSDLSSVTAERGMTDSNKGFGYALGMETGKRFAVAPGWTLTPQAQLIYSSIDFDSFNDGFGARVSLKDGDSLNGRLGLSADYRKSWQAANGLISSTNVYGIANLYYEFLDGARVNLAGTALSTENDRFWGGVGLGGTYSWSGGKYSLYGEGMLKTSLAHPSDSFGVNGTVGLKVSF

SEQ ID NO: 7171 - protein, 726 aa, Burkholderia multivorans
MRPVAAAWRASLGLSIMTNFLLRAPRAPRNAGARPLPRVLKLTVPALAVGALAASAAAAETTPAAGAPSGDAAMLLPPVEVVASPLSTPLVVVTDPKAPRQPLPASDGADYLKTIPGFTSIRSGGTNGDPVLRGMFGSRLNILANGMPTLGACPNRMDAPTSYIAPESYDKVTVVKGPQTVLYGSGASAGTVLFERVTPRFERPGMRFDGSLVGGSFGRNDQNIDLTAGTPDAYGRVTANHAHSQDYKDGNGNTVPSQWDKWNADAALGWTPDDHTRLELTAGTGDGYARYAGRGMDGAHFRRETFGLSFDKRHLGDVLDRIEARVYYNEADHVMDNTTLRQPDPTSSMPMRMAADVRRRTVGARAAATFRFGDDFKLVTGVDAQSNRLDSRASMGQQNYRDQPWDAQAAMWNAGVFSELTWYASDVSRVIGGARIDYASARDKRAMKSGMMTSKPNPTFDDDRTKVLPSGFVRYERDLASLPVTWYAGIGHAERYPDYWELFSATRGPAGSVNAFSAVQPEKTTQLDIGAQYKSDRFDAWVSAYAGYVQDFILFNYAAGMMGPTTQATNVNAQIMGGEAGVSWRPVAPLRVEMSLAYAWGRNVASGDPLPQMPPLEARIGLEYTRGAWSAGGLWRIVAPQHRYALNEGNVVGKDFGPSAGFGVLSLHTQYNVSKTVQISVGVDNVLNKAYTEHLNLAGNAGFGYPANAPVMEPGRTAWVRVSAKL

SEQ ID NO: 7172 - protein, 102 aa, Burkholderia multivorans
MTTYGDGYISNKAQSFEVVAQYQFDFGLRPSLAYLKSKGRDLGRYGDQDMIEYIDVGATYFFNKNMSTYVDYKINLIDESDFTRAVDIRTDNIVATGITYQF

SEQ ID NO: 7173 - protein, 347 aa, Burkholderia multivorans
MKKQALTIIFLLVSLVTGIQAKENDHWYLGTKMGWSDFNILEYRSKDITPFDTKIDTKNPLGAPVFGLFLGYEFNPYFSFEIENDTTGFSPHLIFQKNEQNIQINSLQLATKLSYPITDDFHIYTQLGGMMFWDNLSFKKDLQNIFTEKSRLIPNVSLGAEYIFNKKFITRLDYTWKSNIAKIMNLSMKPVLGDVALSFGWKFGKSNINEIFSSYIPQSSDKQYVALNENINFPFNSTELKPISHDKLQKLQKEIKNIKSKNIFIMLSGHADRIGNKEYNQKLSENRAYSIKNYFTSHGISQDKISIQGMGNEFSLTNQICKDVSDRPLLISCLAPDRRVEIEVLSD

SEQ ID NO: 7174 - protein, 362 aa, Burkholderia multivorans
MKLRFGVLAVLAVAQGAWAQSSVTMFGLIDSGITYVSNEGGGKNVKFDDGIFAPNLFGLRGIEDLGGGYRATFALVNQFSMANGSIIGTGIFGRNAYVGIESDRFGSITLGNQYDFMVDALFSKGNAISRDISGLYGFRNGPFQRLALPGNPTGAFDWDRTAGSKPIANSVKYSSPTVAGFSGGVMYAFGGVAGSIGADNAVSAGVNYELGAFGVGAAYTNEKYGPAPGVPSTSVRNWGVGMHYDFGVVTAKALMTTVRNSFNDAGVWMAEAGGLWRIRPDVVLGAKYMYMKGNEALNDDHAHQVSVALQYLLSKRTMVYVSADYQRANGGANAQVNGVLDPNGASSSASQAVARVGVHTVF

SEQ ID NO: 7175 - protein, 390 aa, Burkholderia multivorans
MKRIRSFALLALPASLHAAGAHAQSSVTLYGIADAGIAYVHNVRNANGSNASNLVRFSSGNLSGSRWGLRGIEDLGGGLSALFQLENGFNLGTGALGQGGREFGRKAVVGLANSTYGTVTLGRQYDPVVDLVQGLTEDNYFGGVFATPGDLDNYDNSLRVSNSVKYTSPLISGFQFAALYGFGGVAGATGSGRTYSFGLSYANGPLSLGAGYFFANGGSTVASGVRTWSSSSDTLFNTVINQGFSSAKSIQIVRVAGQYVAGPATFGLAYSNTQYGADTLSAFTQNAKFNNGSAFFNWQFSPALRAGVGYNYTSLTGPASAHYNQVNLGADYALSKRTDLYALFGYQKASGNTLNASGAIVKAAASVGSYGVNSGTDTQELAIVGIRHKF

SEQ ID NO: 7176 - protein, 897 aa, Burkholderia multivorans
MNNPLAFGRILLLSTALMSPAALLAQAAAPAPADQPADRSSADKGEEQVEISTLGAPSARDIVVTGRRQQNVVRATPQVVSVLSSADIARTGDGDIAGALQRVTGLSVVGNGFVYVRGLGDRYSLALLNGSPLPSPEPLKRVVPLDLFPTSILASSLVQKSYSANYPGEFGGGVINLTTKAIPTETFLSIGGSIAGDSETTGNLGYTYYGSDYDWFGFDDGTRDIPKGLKSAIRNSGTTPIVQGATYSAQDLQGFAASLNNADTALLQRNRNIPANFSADLTGGTSFDTDSGRVGVLAAFGYSNSWRTRDVLQQSSIDPDLAGIPQTQFQTVITDNHVTVNGLLGLGAEVNDHKFRWTNLFIRDTVKQGRLSAGYNRSVEDQDATLPPSLLKQNTYWFERQLIDTQGVAELRFDKLSIDLRGTYANSQRESPYERSFSYNYSPVVGDYVNNLTSAGQSADIAFSDLNEDVYAGSADIGYTLDGALKGTLTAGYAYNKTKRSSERYQFQFFRPTGALNQGVAQERPDFLLSDYNIYTYNIQLRDVSGAEGSRAYDADLVIHAGYGQAEIELGDGLRIQGGVRYEDAKQTVTPDAGSGTNISKSYFLPALTLTYNFNDDMQVRIAGSKTVARPQFRELARQIYQDFESDRQFTGNPFLTDSKLTNAEARWEWYFDRNQRLSLAGFYKKIDNPIEASAFFAGGGVLRTGFANAPEAQLYGAEIEAEKHFPLDGLGGEFFASKRLVMIANYTWTKSKLKVDDSIVIGPDLSPVAANTLFRDGAPLTGQSDHIANLQLSFEDTERLSQITMLLNYASDRVTNRGPIQGTLRQPDIVEKPGFRLDLVGRQGFKLLGTDMELKLEARNLTGTPYKEFQKTGSNTIYLNRYKVGRSFSLGLTANF

SEQ ID NO: 7177 - protein, 952 aa, Prochlorococcus marinus
MSLKTNPLRNAIVIALAASCTTPAFAQSAGDTPTNLDRIEITGSRIRQASVETAQPVVALSRAEIEKKGYINVADILQDVTAAGAPSLSRSSSLSSSRDFGGTYVSLRNLGPERSLVLIDGRRMGVSAGGYSDLASIPSAIVERVEVLTDGASALYGSDAIAGVVNIITRKNFDGGEASVYVGQYGEGDGQKRSYSATFGKTFDRGWFSVGAERTKEDEILGSEREFSRYPGGPRHPDDVKALNQTTQWGSVTVDGKSLTVGPGGDPSQKGNFHTPNPADGANTKTNMSLLSGLERTSVFANGGFSITDDLRIVADALYSKRESTKHLAGYPYSVSTAQARNGSRAALSKDSAFNHWGQDVLFSHRTEEMPRATENNLDTKRASIGLEGSFETGSRYWDWNVSYMYNRNEGERIGTGSMYQPHVDLAVGPSFMDGTVARCGRPGAVIAGCVPWNPAAPMGYAGPGSLSNQDVQDYLFTRFVDKMKSTTKVASANISGSVFTLPAGDVMAAMGFEHRNEEASYTPDLMVQKGQIAGTTGQPTRGDYSLNEVYLELQVPLLADMPFARELSLDLAGRYTDYNTFGSTTNSKFGLKWKPIDSLLVRATYGTGFRAPTVDDLYGGAVKSRDSFTDPCDTSFGIAASSATVAARCQALKVPADFRQQTASEGNVANRPGQQGIADFDSGSNANLKPETAKTWTVGLVYSPEFVPGLDVSLDWWKIRIDNAIVGESATDILNQCYVQGVDSACGRFTRSTSAKTLGQVTSLDRSLVNAGYRETAGYDFSLRYRLPETAFGRFAATWNTTYTDYLEQRNDSAATTPVEQKTGWQGNFRVRSTFNLDWQYGDLGIGWTARYYSGMKEACSYDLAGGPDCNMAGFVSPYTDAQPSRKVGSNTFHDLQVRYSLPWDGTVSLGVNNVFDHQGPIMYSQPNSSFTYYGGFDIGRFMYMKYQQRF

SEQ ID NO: 7178 - protein, 515 aa, Prochlorococcus marinus
MKLFQQLLVFPAALGLVAPLAANAAEVNMTDVSKYAAKTAKSIKAPSSAQFSDIVPGDWAYTSLKNLSASYGCVDNAYTQNLNSGLALTRYEAAALVNACLDNGLVASGEGLSSDASLLADEFGVEMAILKGRVDGLEYKLNELSAGQFSSTTKLDGTVAFVVGAVDYENSADTAVDHGDKLTGTYSYKLDLNTSFNGNDRLHASIMTGNMDGNNPWGDKDGGTYLAVANDNEQVLEIDKLWYEWTKDDLKFWAGPKIESNQMLASSPSIYKPVQKQFAFGGNTAAYASSTTTGFGVAWTQPTEADRKWTVSANYASIGGDDATKGILTDEQTKFLTQVTYGGQRWQIAAAVARHGCAGQDANSSCHAWSDLYATAAGDNATGEGEMAYSLRYYWKPVETGAMPSIQLGMDYRELDDAADTEVQSTAAWMAGLTWDDAWIDGNRAGIAFGSREHATDYAGSGDDEADDNLVWEAYYDYQLTDGITITPALFGGSHVYDGSDDDIFGALVQTVFKF

SEQ ID NO: 7179 - protein, 555 aa, Prochlorococcus marinus
MKLFQQLLVAPAALGLMAPMASNAADLAIKGVSDYSASSEQVTSISQFQDVYPTDWAYQALSNLIERYGCVAGYPSGSYLGNRAMTRFEAAALLNACLDRITEVTDELRRLLNEFEQELAILKGRVDGLEARVGELEATQFSTTTKLKGKSIFVLGAVNAGGDESLSDPYNEEVGAFTFTYDLRLGLNTSFTGKDLLYTRLRSGNMGSTAWEGEGLKGSLTALDTASATGDIVTIDRLYYRFPVGDEFTFIAGPLARNTEMLGIKPTAYGKSKVLDYFGGTMGTPGVYNKETGGAFAAIWKQKTSKGDPAFSASVSYVSDAGEANDGNPSTGGFMTDNAEGNITGQLAYSSKRWGVALGYRYGQCGVKFRRGTDLVADNKWHQNCQQVVGFDSDGDEVFDQRSGAYSNNFAVNAYWQPEDSGWIPSVSAGWGLSSLSGDFYDLADNDLEDDLEDQVPDQFQSWMVGLQWSDVFMEGNYLGLAGGQPQFVTSLTGDETTYDGNYAFELWYKFQVTDNISITPAVFYLSRPMGQDTGDQYDNKFNIFGGVVQTTFKF

SEQ ID NO: 7180 - protein, 462 aa, Delftia acidovorans
MKRTLKISSLLCVALPLTVQADCLSGDEVAQNSDVTLYEQVSYVNKQASAWQIAGKNPYTRHNGYQEAGIGINSGCSIIDNTLDLKLNLYGINEYALKPAGKFETDDSRTRALINRLSLVYSASDSVQFEAGKFAAPSGMFFLRSPSDLQTHYYTGFQSTRLHDPKMTSAYQASSWGAKMSVDTRDYAFSASVIPKLATIDKRYVTSGNWSANQQGNSDEAYLLSFSDHRFGEHTPTVNVRLGPSPSLALSDSYHYTPQLTLNVDAAYHRSQQWRHLSHRETAQVEEYQFPDSLYETKDESGVELALGGQYTSDNFSVFGVEYYFQSEGYSRAEQRQQRELIDFLNTTTGYAPLDQAFDSYKYLMASEISNTANQGMLQGKHYLNAWASLPLAGESTLQPSLVVNLVDGSTLLGLHYSTPLSAISNQLEAYAGGYSALGSRYSEFALFGDTLGLYLGFKYYL

SEQ ID NO: 7181 - protein, 468 aa, Delftia acidovorans
MRSLPGLLATTAAALVLAAAPAAAQGQPSQAQIDALNRQIQALQSQLETLRESVEKQIQTVDKRTADMPTVTVNAGRPRIVSADKAFDVALRTRFHIDYGNWFPDSGISADLPDGFNVRRAFFGIAGTVYRDWAFEFTLDASSSRGTSTRLQAANIAYTGVPGWRFEIGLMQPPFTLDDATGSNDIPFIERSAITNTITNIVASESRAAVGVRKTGSNYMVAAYLTGDQAAISPVGGDDQLAAIGRGAFLVHSAQNQEVAIGASVGTVITPRQGTGPGAARPYLFADRPENRIGGGTLLVSGGTLDLEDYTVWGGDIGASFNNFWAAAEYYAQDVETRDSPATVADEGADLSFEGYYVSLGYILTGEHRKYNIGTGGWAGVVPSAPFNSQGGIGAWELAVRYSVNDLQDPDYVTPLEGKQTVWTFGVNWYVNAAIRFMLNYQMIDIERPAPLVDADADAIIGRLQFQF

SEQ ID NO: 7182 - protein, 516 aa, Delftia acidovorans
MTDGTSGNPQRADAAALTTARPAAALSRHWGRGIARSLAFAAASIGLVASAAAADLPAFVKAPPVMPDLTWHGITIFGAYDIAGQYESNGAPYNGSAYSSAGIISPFNRGPQWVLAPNQSIQSFIGVKVDEKITDQLHVIARLEMGFNPTTGEISDTLKSMQKANGIPLNQQYVNGDGPRAGQVLNGEAWAGFEEKTWGTLHVGRNNAVSADMLFAYDPLSSYGFSLFGYVGILGGGGSSETVRVDQSIKYLNKWGPIRVEAMYGNPNTNTKEFYQGSIGLVDLNYSVDVVAGHASDLVSSSALAGPANLGSQFLGARVSDADTVGVFGKYVFDLGRNGLRDPNESRFTLSGGVSRIEFSNPSDGGWAPGHTTIGGYQIGPAFATNGSSAAGIVNYAYTGGNRVLIASFIAGKYQYDAQWSAALAYYRYDQKSYGLGVNGLPGIVAPSFSTQACSSSSYINCAGGEQVVSFRVDYDWTKNLKLYGGLAYSKVDGGFAFSYLKTSEFAPTVGMRLTF

SEQ ID NO: 7183 - protein, 738 aa, Delftia acidovorans
MKRTLLATAVATTMFTSVAQETQNNNAIDTVTIYGNQLKVQEATGAAQYIGEQDLEKFAYTDIQRIIRQAPGVSLQVEDGYGLRPNISIRGVATERSGRITLLEDNVLIAPAPYSAPSAYYFPTAGRMSAFEVVKGPAAITQGPYTIGGAINMISTPIPSTQSGQVTLEAGQDATYRAHATIGGQNDSGFGYLLEAHQWQSDGFQDIDRSSNDTGLDVTDVTMKLAYSPRDSRHSVELKLQYTDQDSEQSYLGLTDADFANNAQRRYGLSALDNISTEHTQVMLNYAFEINKHLHFTAVAYNNTHERDWFKTEGIDLDGSENAQDFSRTSWSDVVNAINNNESIGDTSVAMLQGILDGSIDTEVGSIQLRSNSREYFSRGIQFGLNWNKQFGEAKHHIEMGLRLHEDEEDRLQRNSTYQQVDGQLLLSDLGELGNAGNRVQDADALALHVYDRIELGDWIFTPGLRFEDISQSRTRYTNGAERVFRDDRENDTTVLLPGLGVLYKVDGNLNLIAGAHKGFTAPSNSPGAKEEEAVNYELGFRYNNNALNAELVYFLSDYDNIVGVCTASSGSNCEIGDAFNGDAATVQGIEFLLKTELGQFNGVRIPFNITYSYIDSEFDTDISGTDFFGDVSAGDSIPYIPENQGQITIGLEGDKWTTYLNAVYVDGVCTRASCGGFEVTDSSFILDLSGSYNVSNDLRVFARIENLTDQEDIVSRQPYGARPNKSRTASVGVTYSF

SEQ ID NO: 7184 - protein, 743 aa, Delftia acidovorans
MKYIVIALFSSLVVSQSTRSQEIKPNDSIVKLNTVIIAPVQQSPERMPETKGNVIFSGKKNEVIKISQITANLTTNNAREVFSRIPGVTVWENEGSGIQINVGVRGLSPNRSWELNTRQNGYDISSDVFGYPEAYYNPPLEAVESLELIRGGASLQFGPQFGGMLNYVLKRETKKEFSFETQNTTGSYNLMSSYNAIGGKVGKFSYYAYNHSRSADGWRENSQYKVRNSHVFLEYAFTEKTKISTEYTNMDYQMQQAGGLTDEQFNNNPRQSFRERNWFGTPWNVFALNFDTKINDKFSSNTKLFGLIAERNSVGFTATPNNPDAINPATNDYDNRRVDRDSYQNFGLENRNLYRYKLGNIENNLAFGIRIYKANTNRKQNGLGTTGSDFNLDIDGKYQRDLDFNTKNVALFFENQFKLTENFSATPGMRYEYINSTGSGRFGIISGNDVPFEEKEISRSKPLFGLGLEYKLGTTNIYANITQAYRPVLFSDITPPAVTDQIDPNLKDASGFNADLGYRGTFKNYLNFDFSLFYLSYNNRIGGVRQFVNNDPTEGTFLYRTNLGETINKGIEGFANLNVTRFFEVENRLGNIDLFATISFIDSRYTDFKIYSASGTAPNVVITENNLKGNRVENAPRYIHNFGIGWNKNNFSTTLQYKMSGKIYTDANNTVTPSANGVTGLLDKYNVLDLSAEYKFLKNYNLRGGINNLTDEMYATRRAGGYPGPGILPGEGRTFFLSIGAKF

SEQ ID NO: 7185 - protein, 872 aa, Delftia acidovorans
MALSIALLLSPGVHAQEAAPDGTAAAQPATAQPTSTLDAVQVRGVRSSVESAISTKQAHKEISDSIVAEDIGKLPDNSVAAALQRVTGVQVARAGGEVGQVLVRGLPNVVTTLDGRNVFTTVGRDMELADVPAELLRSVDVYKTTGAQFQEGGIAGVVDVHLRRPFDFDDDSTIAGSVSALRGDQAEKTVPNGSLTMSQRWETGVGRMGVMGSVAYQRRPYQESNTLYGTYDLKPNPLEPAQQLYVPYSAGGLMARGDRKRKSANLSFQWAPSDNSEIYIDTLYIGYDNRPQVNYWLPFPGLANAENTESVSVRPGSNVLDGLVARDLQTLSSTQAHKNASDTYQAALGGRWSGERVKLSTELAYTYSDAKNRAFTLDMDTRAPLLHMRSGGGAADTWITQRDGSPYDITAPGNWVLRQYYDSWNRQRGEEWAWRGDATFELDAGPLTSLEVGARASRRTATNHSGDTGARDNITGAPILLSDVPGLASVTPGNMLDGARAFTSDRWASANQDVLLQQSARLRTLMGQSPEAPLENPALFFDDREDNYAVYAQLNYGFSLGPVPVDGRIGARATRLDSSLEGSQSLDGVLSPVSIDRRIDKVLPNYSANFTLYENLILRLAGSTTITRPEFADLNPQLALYQSTESLPARGNGGNPQLRPVESRNADLSLEWYFRPGSLLSLAGFHRDIDGYIQNYAADELIDGITYSISRPRNTGQGSLKGVEVGYTQFYDFLPGWLSGFGTQLNYTYISAEADSPEGVSQPLTNVSKNAYNAILMYEYARFSARVAYNWRGDYAVSFNSSGDQPEQINQGREKWLDVAFNYELSERLTVFAEATNLLGTTTDNYFAQRGAFPREVASPERTYSLGLRFRL

SEQ ID NO: 7186 - protein, 643 aa, Delftia acidovorans
MSYQVLARKWRPQTFADVVGQEHVLTALANGLSLGRIHHAYLFSGTRGVGKTSIARLLAKGLNCETGITATPCGVCDNCREIEQGRFVDLIEIDAASRTKVEDTRDLLDNVQYAPARGRFKVYLIDEVHMLSRHSFNALLKTLEEPPEHVKFLLATTDPQKLPVTILSRCLQFHLKALDVEQIRHQLEHILNEEHIAHEPRALQLLARAAEGSLRDALSLTDQAIASGDGQVSTQAVSAMLGTLDDDQALSLVEAMVEANGERVMALINEAAARGIEWEALLVEMLGLLHRIAMVQLSPAALGNDMAAIELRMRELARTIPPTDIQLYYQTLLIGRKELPYAPDRRMGVEMTLLRALAFHPRMPLPEPEVPRQSFAPVAPTAVMTPTQVPPQPQSAPQQAPTVPLPETTSQVLAARQQLQRVQGATKAKKSEPAAATRARPVNNAALERLASVTDRVQARPVPSALEKAPAKKEAYRWKATTPVMQQKEVVATPKALKKALEHEKTPELAAKLAAEAIERDPWAAQVSQLSLPKLVEQVALNAWKEESDNAVCLHLRSSQRHLNNRGAQQKLAEALSMLKGSTVELTIVEDDNPAVRTPLEWRQAIYEEKLAQARESIIADNNIQTLRRFFDAELDEESIRPI

SEQ ID NO: 7187 - protein, 825 aa, Delftia acidovorans
MAWRRGLLVTTILVPAAALGGAGRAAAQGDTIALEQIDVVPVTPVAGAGGLRRAEGGAPVAAGGALPLAKVPFTVETVSARQIAQDRATLDPTFTLARTTPGVSLSDGQGNGFRQTVTYRGFDASPVQGAPQGLAVYQNGTRINEAFGDVVNWDLIPSVAINRIDIVTGNPIFGLNALGGAVNVEMKNGFTWQGREVSVAGGSDGRILGTLQYGEVVGPWSFYFAGEGLKDDGWRYRSPSEIGRVYADLGHRSLDSEFHLIASGAKTRYGAASATPVDLSHADERAIFTNPQITDTEVGQIQVTGRVSLTPGWDLAGNAYLRRFSQRYVDGNDGNFENCSTRSNFRGFLCYQDDGFTAAPGQTQAQFRNQFLLLGAGNAPIPFRAGIPYATLDTVKTEATGWGGSLQATNRDRLLDHGNTFILGGSIDVADYSFKSASLLGLINPDLSVTTNPLNPTYGLVPGLGTGPLRTAAALGIAPSSVIGSNLYMGLYALDTFDLTEQLSLTAGARLNFARIATRDLTGFSPDVTGTHYYTRVNPVAGLTYRVAPWLSLYGGYSESNRAPTPLELACANPNRPCLLPNSLVADPPLKQVEAQTYEAGLRGAVPDFYEGGLLSYKLGLFRTDLTHDILQVAVPGNAARGYYVNVPATRRQGVEVAAEYAAERVSLYANYALIDATFQFQGELSSPNNPLASGDGLIRVRPGNKVPLVPEHQIKAGFEVAVTPEWRLGMNVAAFSSSFFRGDESNLNRKLAPYALVNLTTSYQVSREVQLFGLVTNLTNTRVANFGTFIEPSAAFANRYALTDPRSTTLLQPLSVYGGMRVTW

SEQ ID NO: 7188 - protein, 480 aa, Delftia acidovorans
MRCTIDPGAMRTIIAIQTHLQKLRWRQPLAATVSLAAALFVAGPAVGEDRDKNPDGIPSPSIATSLPANGDPTGTHRWFATRGITHGLSYTSEVLGNPSGGVRRGGLYEGKLEGFVAADLEKLIGWNGLSFFSNAFQTHRTSGARDQHLESLITISNIEATPSTRLSEFWLEQKLFNDRFSVRAGQITADAEFFISEYSKMFISSDWPTITGANLPSGGPAYPLATPGVRLKFDPTENWTALAALFNGDPGDQATVNRHGTNFRMSDPPLLMGEIQYRYNQDKDAKGLAGILRLGAWHHFGEFEDQRFDDTGVSMANPLSSGTARLFHGTSGIYGIVDQQIYRPEGGEPDSGVSVFSRIAATPSDRNLVDFYLDGGTVFSGMLPSRPDDKFGASFIYVHISDQARALDRDTIAFSGVNQPLRDYEMTFELSYQAQIVPGLAVQPLFQYIVHPGGHVPHTLAPASPVKSGALFGVRSTIVF

SEQ ID NO: 7189 - protein, 404 aa, Delftia acidovorans
MKKNLVALAVAAAFVVPGVAFAADTSNADTGPVVFGYAQITGAQQFGTGPGSSNGLIFGANRIRLGFKGEAVPGVTYYIQGAYDEAGLGNANALFPKTAGLLNNGLGGNIGGGAQAQLMDAWINFAPVPFAQLQVGKFKTPEGLEYTGTAGNELMFIYRNMNQSLLPGRSAGAMLHADDVMGTGIGYAVGMFDNTSLDPATVYSNINTFGGGQSGLLNGNGKYIVSGMLKYSMGPLLTAEVSGSMGTENNRGTDNLTSWNVGVQGGMMGIHYGAGYTKASGVSAWPYLNINPLYTPVTYSATDWHAELAANLYEMTLTPDWLDVEAAARYDQYAVHGQGTLSNTTVGLNYYVNPNNPHAAEVQLNYILATRGGSIDNTYPGPNGLAPINGVAYNTLMLQFQAGF

SEQ ID NO: 7190 - protein, 1432 aa, Delftia acidovorans
MAVSQIATTDTPAVTPIKSTLTGPFERNSAGTSFGSNVDVDVIDNTSTATRVIAETTPEAESTIGEATGQEGGNATAVIPPTTTPSEQEITEPEQPGLLDKIKDLLGLGEITQEQADALEKNVKTKVEKVDAQTAAKLALESAQAEAQKAAEDALYLKTENVSYQAFAQTEEKIKKEADEAKKKQDKTKEDAIKAVKVNNTPLVPGDKDIAEKVTKAVTDTTKVQGEKAVTLATKITDAKVAQEKKDANTEALAEIDGRLISVSNALIQATGTDKGPLDQKLKEAQQAKTEQDGKELASGGYKELFEEDKKTSGYFGIAENDNGSGQQEKLAEAKKNRDAYNKAAKKELDAIAKAQKAVEAIDAQIVKLKKDKGDIEQEQSTEKGKTGGLDIALSGANDAKDAAQGEFDTAKNAAELAETAAKAIEAAKITDKAVEDATAAYKEAADKAEQTKTALEAAEKAKEDADKLVVTNTGLLNDADQALEQLVTAQNNAQPTLDLPAIDVTIAPAKTQDVIEGTSAIATQVAGGTQNVAKGGKAIDSVITKDGIVNLAAGANAKGTEVTKGTLNNNGGVDTDTVVSTEGKLVLTGGSETAIATSTGAKVAEGGVVTAGDHSVIEKMISSGNVTASGNNTIVRDTTINDGKLSLAGTATANNTTFNGGIFSVEGDTAATKTNMTGGKFAVTGNAKIEETVVSAGDVSLADKATANNTTLTGGTFAAAGDTAVSATNMTGGTFTVAGDTAATKTKMTGGEFAVTGNAKIEDTVLNASDFSLADKATANNTTLTDGTFTVAGDAAVTATNMSGGKFAVKGKAKIKDTQLSAGNFTLAENATANDTTLNGGKFDVSNEATATNTTINNGLFTLKDGAHADSTTVNSGTFVMADQSTANGIQLVDSAFTLASGAKASGITKLTGGQAQVAGSLESLSLTGGRADFANSAKASGLLDISADSQIIMNRGADTAQANLNLAGRLELLASDVAQAVAQPVARAAMELSNARAVMPAPAMPVPAAAPVAHFALNDVVMTGGTVDMSNAKNAQLTMASLNGTGNFNLGSVMQSDSVAPLNVSGDANGDFIIAMNSSGQAPTNLNVVNTNGGDARFALANGPVALGNYMTNLAKDANGNFVLTADKSAMTPGTAGILAVANTTPVIFNAELSSIQQRLDKQSTETNQSGMWGSYLNNNFAVKGRAANFDQKLNGMTLGGDKATALADGVLSVGGFASYSSSDIKTDYQSKGKVDSHSFGAYAQYLANSGYYMNAVVKNNQFSQDVNITSINGSASGVSNFSGMGIALKAGKHFNFNEAYVSPYVAMSAFSSGKSNISLSNGMEAQSSSTRSAMGTLGVNAGYRFVMNNGAELKPYAIFAVDHEFAKNNQVTVNQEVFDNNLSGTRVNTGAGMNVNITPNLSVGSEVKLSSGKDIKTPVTINLNVGYSF

SEQ ID NO: 7191 - protein, 2199 aa, Delftia acidovorans
MKFNNAGSILNITSNGNVTATMNGDLDPGAAASGIIQLSSTGGLLTITGGNNLGINGGNTLNSMILAGNGDITITPAINIATPLSTGIAGNLTLTTVNGPVNFTNTTTLAVTNITGKTDFVNNAGIIKLNNNGTVNVLGAATLGPVTGITALNLNGAGVVTINGASSATNLTINNAGVVAKAAGGFTGNAAVGAGQLTTNTIGNVTIGTGTYTGDISGTVTFSGTGILNTTQVGGKADFVNNAGTINLASNGQLGAVTSTGGVSGTVNVLGAGTLGPVTGITALNLNGAGAVTINGASSATNLTINNAGVVATAAGGFTGNAAVGAGQLTTDTTGNVTVGTGTYTGDITGTATFTDAGVITTDQIGGQTDFAGKAGTVNVNDSGNLGVVTSSNAVNGNLVFLGGGNVNGAISNINTISIKGVAGNIVNFTQNVSAASLTFTNGATANLSGSLGTANNAVAVDFGAGGGVLEFSGTNSAGYLLNSPITNGNTGTLNVYTTGTTLTATDSSIGTVQTINIGQGNAAAAFTVDVSNKALTLESAINLNNTNSIFGLTTSKNQQVTFTNNVDGFVNVGNAGGIVNLSSTSNAPPNKNVLTLQGNVGNETLGTKANPLAVINVSGNVGVVGTNAKLGTNGLDVSNTAVLNIAAGGVFVDASLTSASINAINIGDAKAGPAVYALDAINVDFDLDAPGVAFKNDSSVLKLMTTSTDVNTPSTIYLTGNIDPGAANFGIVELNAENANTTLVINGVKNKGVNPILSLGTANHPLQQIKFSGLGTIEVTAINTKSIDVSVPQLAIGVVNADAFFSGATKLGVVQISGNMDFQNNAGTAIFASDTKNNIPALITGNITSTGGQPNGTVVFMDNGTIGTVGGNNTITNLAMLQAGADNSTVTINSGGNMSITEVQGTGTGNILFTQPTTLTGTITGNGVNLMFTGPSSVSGDIGSSTSKVGDITVSTDLLNCAGGVNAAYVILINGGDIKFNGAINILDISEGSSFFPFALAINPEDSLVIFDDSNAITYSGSIGTKGMVDVVQIDGGDVTIQGTVKTGSVSFTTTQSATLTLANTSVVGGATTTGNKIHTLAITGDLTTGTSPFGSDSNHLKTIQLNSDGKFTIDSQDVYSSVTTKTNNEGTAIFNADNGFTDDLGGENLNLKLVQFSSNKGTVKGDTYAKDITIDAGKSAVFTGYNSRSLDIAAATVGGVKVPRATTKFNYKTKIVSENFKGSSSDSSAEYTNAALVQAPINGGSHKFDDDVWLQKAVTGANVITFAPKKTAFIASNLGANTIVADQATMMFTGDNTKVNVGGNISGSNITFDLGNNQVTYTGSATPTGELIINVFYDTINAGQTGNANSGNIVLASGSTFDLSNVSSIKVFLTAQNNPSAIGEGSAYPVISAAGGSIIVGNAANLPFNVTANEGGFVRWQITGNSFVLLPIEPTGDVTVDNIIGKIIKAPPGSDAAKVANVLVNTPIDQRAAVIKHLLPLIERPSNEIHRVTTPLTPMGPLVGPSVGGGFNPIQPPPTSGSVVNNIYVPPTTPGGYDVTPSNPAGYNTPTTPVTGTGGFGPNGPGTGGNAPSGSVTGGVFTPNGPSVVAPSGPATGGSVGGFGPNGPGTGGTTGGNIGTGGGSPSVGTGGFGPNGPGTGGTTGGNIGTGGGSPSVGTGGASGSNVGTGGTSYNGPASGGSPAGYVPSTSATSGGSVGTGGTSYNGPASTGGVGNSGTTPSGTGSNVGTGSNSPAGGNSVYSPSTGSTRNNVGGYTPSVGQGGTSSNGSVTGGSVGTGGTSYGGAGSNGGVTNGGSSPYGNSGNPTTTSISPANNSNNIGGSSESGMPAIGSSRDNSSGTGSGGNSGSGISRSNANDGFNAAHDNTSTGTQEVGKRLKTLKDAAEDGANPAAEDATSRKRGAAAVGGGDCELDEGNANNSVYGVWVSPYYGKAVQKAFNGLSGYKAKSTGGSIGVDTVINDNIVLGAAYTRVDTKLRYQNAKSGNTTKVGTNMGSIYGLYYFVNNWFVEGVTTYSRSDIKTNELRNIIGGYETAHGKYHSTSYSGQVVGGYNYLWKETSFAPMAGLRFTKIKDSGYQEYGTSFQNLTIQKRQYNKVEGILGGEIKTTFYKDEFIIRPQVHAFINYDFKGKTPAIIADLNGLNEPLPVPTPKPTKMLYDLGAGVVVKKGRTEYGVHYGLNLAKKYHAQSGTLRLKVNF

SEQ ID NO: 7192 - protein, 1040 aa, Delftia acidovorans
MKTIHGAIFAATLSSTSPLWGADFTVNTAVTSGQTLNDGNTGVVTSEGSVTTSGSTAGVMITPTTTTNSIITLTNNGTISQTGTGRAVRNNTSNKTSRIVINNNGTLSSVGDDTVKIADSTATIIINNQGTIIKQGSMADSGQALDFRNSNATMGNTIINGSVSNTSALIKSEGDDAIRPSHNMSIVNYGTIISTGPVNTKCVGTCSGDPKAHDGIDVGDKTGVQIDNYGIISGSRHAITADEEIYVVNQAGATIIGNNGSGVGSDGTGTVINYGTITGAYAGEGNVYDHSASNGGTSTANNGDGDGVDIDGVAIIRNYGTIQGLGAGGVDSGGLPNGAEGIAAGGGSLFNYEGATIYGQSIGILIDDGSNGTAVASGRGTTTAAGGAQIIGNRGTIIGVTKAAIGLVGNYDDTITNYASGTITGGSGSVKVDEVGSTTAAAAIQMGAGEDTLVNHGTITGQNGMAIDMGSGDDTVQLLGGTVNGTIDGGSGTDSIVLGYANNFSLSQIINFENFTIQDGASLNGGGTVNTLIVNDGGILYPMASTLRVEGNLNFASGGTYRLNAYANGTSGRVDVNGNASLGGAKLVVVADSAGSWNTSTLYTILSATSLSGTFGDVATNLAFLTPSVTYDSTHAYLTLAKNAVTYGDIATGGGVLVASVLDGVGSNSAMQPLLSRIDSMGASQAQSAFLSLRGDDLASLSSSSRSSYLPFGTLIATRLGNLSQARAGIGLGGLYFADAGDGMLLAQILKEEGIWTEKGIVDPYAYDYTMWAKALGGRITSSSDSAQNIASSHTHVYGTQIGIDKSDNDSVYGASFASLQSRFKTNDGQLSSTVKSQVVGVYGSRCAGDFRIDSAIDYAFIEADSERETLLGGADSQYDAKAMGIWISGAYTYKLDQGSAIEPYVELRYDRYKQDSYSEGGAGGAGLAVDGFRSKLYGAGMGAKFIQSFYENRGSWDIGVGFFKEWGDLETPLVMRFSSAPEAGSWRSTTLDRGSLICKANLGVNYKVLRLTELFATAEGQVRERERAINGTLGVKVRF

SEQ ID NO: 7193 - protein, 181 aa, Delftia acidovorans
MKTFLQSSLLMLACAIPATSFAGSDSGFYIGGSVGQSSLEAEFDTNAKLNEDDTAYKIVAGYNFGVLPLLDLGVEVDYRDFGKFKGSEAIGSADIVAVDLFGVAGLNFGPFGVFGKIGYSDADVDAVVENIKASSSESNMAYGIGAKFQLGSLALRAEYEKFDMDDVDDLSMFSVGATITF

SEQ ID NO: 7194 - protein, 609 aa, Delftia acidovorans
MPYNSKRKKTIFLMVKVLTIILVWLFLPESTAVVKFNTNIIDAKDRSNIDLSRFEVDDYTPPGNYLLDILIDDRLLPERYLVTYLAVDEGKSTKLCLTPDLVNLFGLSTEVRESMTLWNNDKCVAIDEKKEIKIQYDKEKQSLIISIPQAWLAYNDPNWVPPSQWGNGVAGTLLDYNLFGYHYSPNMGGSTTNFSSYGTTGANMGPWRIRADYQYINTETAGEHYRNFDWSQVYAFRAIPSIGAKFVGGQTYLNSSIFDSFRFLGTSLSSDERMLPPTLRGYAPQVMGIAHTNARVVLSQNGRVLYQTNVAPGPFVIQDISEAVQGNIDVRVEEEDGRVTVFQVNAASVPFLTRKGAVRYKAALGRPMLGNSASNPTFFSGEFSWGAFNHVSLYGGLMTTSQDYTSAALGIGQNLYDFGALSIDITHSRAQLPNEEQQNGESYRVNYSKRFEQTDSQISFAGYRFSKKNFMSMSQYLDWLNGNTALQYDKQAYTVAANQYLAWPDITMYLSVTRRTYWNAASSNNYSLSMSKIFDIGTFKGISATISANKVNNQYANENQMFFSLSVPIGIGQQASYDAQRGRNTGYTQNISFQQPESEKYLAYQRGWR

SEQ ID NO: 7195 - protein, 726 aa, Delftia acidovorans
MKHKHLWVLNPCLLVMLTPAAWAEDQLVVSANRSHRSVAEMAQTTWVIEGQELEQQVQGGLEIKDILAQLIPGIDVSSQGRTNYGMNMRGRSIMVMIDGVRLNSSRSDSRQLDSIDPFNIAHIEVISGATSLYGGGSTGGLINIVTKKGQEGKQVELQTGGKTGFNSHNDHDENISAAMSGGTERAFGRFSVSYQRYGGWYDGKGNEVLIDNTQTGLQYSNRLDVMGTGTLNIDENQQLQLTTQYFNSESDGKHGLYLGQNFSAVTGTGQASNSAALNSDRIPGTERHLINLQYSNTDFWGQDLVAQVYYRDESLTFYPFPTLKDGKVSTIGASQQKTDFYGSKLTLNSEPIDSLTLTYGIDLEHESFNANQQFFNLAKAQQSGGMTLENAYNVGRYPSYTTTNLAPFLQTRYDINPIFTLSGGVRYQYTENKVDDFVGYAQQQAIASGSATSADPVPGGKTDYNNFLFNAGLLAHLTESQQTWFNFSQGFEIPDLAKYYGSGSYTLVNGHYQLQNSVNVNDSKLEGIKVDSYELGWRYTGDNLRTQMAGYYSLSDQTISINKTDMTINVLPDKRRIYGVEGAVDYFFDNSEWSAGATFNLIKSETKVSGKWQKLTIDAASPSKATAYIGWAPGDWNLRVQSQQTFDVSDSKGDKIDGYNTIDFLSSYALPVGKLSFSIENLLDKEYTTVWGQRAPILYSPTYGSPNLYSYKGRGRTFGVNYSVLF

SEQ ID NO: 7196 - protein, 690 aa, Delftia acidovorans
MSSFDVRGDSRQRLRVSPLSMAVALVCVSFSHTALAETLAPVTVQSDWLGPPTEESVKTYTGARTVLEKEDLEERGALNLEDALRRVPGVQVLDETGTGILPNIGVRGLNPLRSERLQILVDGYPIAIGPYTNVGLSLFPVTLPSLEAVDLVRGGAAVHYGPNNVGGVLNLVTKPIPAKTSQTFRERLQISEETGNMLTDTYYRIGGFVREDLGLQFQANIVDGKGQRDRSDTEVRNFIVDGEYYLNPNNDFKAQLQYYEVKAELPGALSPAAYDQNPNQSQKPFDAYDADMWRGTFTWNHSFSDDFKLTWRNFAHQANRTFFFSQSATFSDDPAQTPAFVLDSPRVFSVHGTEPRFTKQIANHTVIAGARFVEEDVRFDVSRTTLATGAVNPFRRWDFTTKAMAYYLSDTIALMDDRLKVTPGIRYEDVETRYRDLNTGTEFQNNPDEWLPGLTVGYQATKDVFVFTNAQRSLVPVQTAQVTRGGDVGNETAENYEIGSRWQINPQANIAATLFRVDYKDQIVFDTGAFRNLGETRQEGVELEGRWNLNSQTELGMSYTYLDTEQLSGADQGKELRNAPTHHLGLDAVYKFGNWTANANALYVSESFSDSANTQVETANGSAGELPAYTLVNMRVGRDFPIGQGKNMNLGFGINNLFDEQYFFRGVDVSTTGRVPAPGRMLLVEMQLDF

SEQ ID NO: 7197 - protein, 348 aa, Delftia acidovorans
MNLKHIATLSLAGVAVGASAQSSVELFGIVDVNTRYVNNSNLPSNLTMNNSGLSSGRWGLRGVEDLGGGLKAGFWLESDINADTGTYSSTGKFFQRRSTVSLMGNFGEVRLGRDFSPASQNATKYDPFNVIGLAGSNVTSRLPSAIASYYRHDNAIQYFSPKWNGIQAEAMYAMDEDPLTSVGRHMAGRLAYDNGPLSVSVSYGATDVNASGAKLKQYGAAASYNFGIATLMGYFQRDDLPYGTYGSRVAGSEDRWQIGVTIPVGKDYIRANYVRTDSRGGPAAYNGSDANKFAIGYVHNMSRRTALYGTIARVTNKGGANFSLVGGAAGLAAGGNSTGAEVGIRHSF

SEQ ID NO: 7198 - protein, 167 aa, Delftia acidovorans
MATLSNADARVKGVEVELTAVPVPGLTLNAGLSLLDAKYTDFPACQPDGSACDGNRLSDSPKSTLNLLAKYDFDLGGRTASIQGGANWTAKRFFDFRNVSYIADDGYWLFDARASYEIMDGLTAALWVQNIANTRYYTNGFDVSAFGYSLLLPGTPRSYGGSINYRF

SEQ ID NO: 7199 - protein, 504 aa, Delftia acidovorans
MARRSARRSRGLAALLASLLLGAEPLTAEPDPAVSQLADVRSGEWAERTLTSLERQLGLPDPARPHAQLISRAEFAVRLGRVLAAVEKSAQQANALDAEQFDALRRLQLEFLPEREGLTARLENLEKRLDRARYAPFDSKTTMSGQVIFGLSTLSNTLDDDEGDSTAVRFSGRARLTFDTTFGRNDRLRVRLQAGDFPNYGSLAGTDMARLGVGGNTNRVFNVARLEYRFDLAKNLRVYIGALGGRLDDFTDALHPLVGSTGSGAISRFGQRNAIYRLISGTGVGVRWEATKTLTLSAGFVADFGSLAEDDDLDDVRQTDRFLPTGILAQLNFQPSKTTGIGLSYIRTFNATDTGTGSDLANDPFDGDSKRTFADSYGLQGFWKISPGFQIGGWFGLTEARAEDLPGRPGSSIVNYALSFAFADLAGKGNLGGLVIGQPPRVTRSDLGNKFQDPDGAVHLEIFYRIRLTDRISITPGLLTIFNPENNRNNPTVQVGTLRATFDF

SEQ ID NO: 7200 - protein, 712 aa, Delftia acidovorans
MTHPIHARRLLPALLAIACNSHAGMTDEPAQLEELTVKVPGTRGKASGYYQKDAGGATRTDTPLQETSQSVKIISRQVLDDMRATRLDDTFDLVSGVSRQNSFGGLWDNFAIRGFAGHENTGPAMLRNGFAGNRGFNPPRDTANTERVEFLKGPTAALYGNSEPGGTLNVVTKKPQFKSSNTAEVYAGSYDTYRTSFDATGPVADNLAYRMIVAAEDKGSFRDHMDSERLLVSPSFTWLIGPSTTINYELEYLKHRTPFDRGIALRDRDGNRLHNVKHSRFLGEPRTGDTTMEAYTHQLSLEHEFSQYCRGRIGLAYKENKTDGDAVEPLSPLSAVAPNGNINRRLRGRAFDSDDLMLQTDLNGKFNTGSLSHDLLLGMEAYRFNQQQTQFGSSATAINIYSPAYGAVLAPMTRLSDFKEEQTDMAVFAQDQVSLTEKWKLMAGVRFDSFRQQIDTLTNNTQVRQDHFVTSPRVGLTYVLNPEVSLYTSFSRSFRPNAGTDAAGNGFDPERSRAFEVGMKYQSANQLLGGNIALFDITKQNVLTADPASNYLFSIAAGEVKSRGLELDLNGQLAEHLRVIASYAYTDAYLGKDIALGAASSIPSGARLSNIPRHSANALIMHERTLANGGKLGLGGGFSYVGKRADSPEDMFELPSYVTVRLMTYWQFNEKLRLSFDVTNLFDREYYASSYNSNWTMPGAPRMMTLGLQARF

SEQ ID NO: 7201 - protein, 1052 aa, Delftia acidovorans
MMASALLAGSPWTAFADTDNILEVLQNSTVRGKVVDASGEPVIGASVVVKGTTTGVITDLDGNFILNNVSEKSILVISYVGYKSQEIAVSGKSAINVTMQEDSEMLDEVVVVGYGAMKKSSLTGSVTVVDSKIFENKGSMSNPLQALQGQAPGVRITRSSSAPGEEGWGVSLRGAVSKNTTEPLLIIDGVPSDAVSDLQYLNPSDIETMNFLKDASAAIYGAKAAGGVIIVTTKRPQAGKLKIEYNGSYTRKMPGLQAELMSLDEWAGSFLQAMENDGLDDTYTWYRYVKLMQANKGGFINVHDGSNPNPIPGMGVNDYVFHDVNWTDVMWGPANSTQHDLSFSGGNEKVTYRLSAGYLFDDSNLRWGENNNQQYTFRSSNVIKATDRLTIESVISAVRKEQVTPTQIGRALNVTTPLPGRPVSTIDGKPYLWGTDYTANWLLELGGENKLVVTTFNLNETLKYQFTKELTASATFGYSTNSAIRDEKMKSIQWYHYDGTVNTSTANPYPTQAESKYTKRASRTDNYSVSGYLNYAKTIGKNHNINVMAGMQYDRRDYEITGTSATDIQSELGIINGNGVISIAEAKKNSYALLSYFGRLNYNYNQKYLIEFNARYDGSSKFQPENRWKGFYGVSAGWRITEEAFMVNIKKYIEELKIRASYGEVGNQSGIGLYDGVQLYNFNTASGAYIGDGKVSYIAAAKELVTTNRTWERIKNYNVGFDFTVLNSRLTGSVDLYMKKNDNMLIGLLYPGTLGGNAPASNNGKFESKGYEGMLRWSDKIGEVSYHIGGTYTYMENKLLSGGNDVISAGFNSTINGYPLNSVFGYRYAGKIQNEEDLQAYKNLYYGNNTLSMPSNLRVGDHMYEDVNKDGKLTQDDLVFLGTDDPKVTFAFDLGLEWRGFDVSAIFQGAAQRTVCRDADSWKVPFKAVWMNTSNHTIGKVWSPENPNGRYPAYSTKSEINNWNYMPSSWFIEDGTYLRLKNLTVGYTIPKAILTKITKGVLENFRVYVTGTDIWENSKINDGWDPEATRKVSDRQRYPFTRTYTVGLNATF

SEQ ID NO: 7202 - protein, 221 aa, Delftia acidovorans
MQPIKTLLLAAAGAAVFASVPAQAKQGDILVRLRGIVVAPNEKSGSGLPAFPGEKVSIDNAVAPEIDVTWMASDHIGFELIAATTKHSASGRTGTTGSIGKLASTWVLPPTLTAQYHFLPDAPVRPYVGAGVNYTLFYSEDASGALESAAGQTKVHMSDSFGWAAQAGVDIDLNDRLFLNIDVKYIDIDTTARLSTTAAGVQKVHVDLDPLVFGVGVGMRF

SEQ ID NO: 7203 - protein, 413 aa, Delftia acidovorans
MSKIKKTTLATALLLVTAQSSAAGFQVSEHSASGLGRAFAGEAAVADNASVLARNPAAMSRFDKAEISVVGSYIAPTADIKGVNDPTPYNDASRLDSNDVINDAFVPAFYYVQPINSKVAIGLAMFSGYGMVSEHEDDYAVGAGAGTTDLLTFNINPSVSFKATDELSLGLGLSAVYAKATLERNLGDLSSTLGGSADSQLFLLEGDAWGYGWNVGALYEFSENNRIGLAYRSQVDIEFEGDFTGVTSGGNKIQTTLEIPLPATVEISGYHKVTPKIALTYSALWTQWSKFTELEANSSECTVTATPTECFKKEEHYDDNIRYAVGAEYYVGNTTLRAGFAFDEQAGETTLSIPDTDRYWYTMGATYELDQTLSFDFALAYIFTKELEFTEYGYTFAGQGDAIIASAQVNYRF

SEQ ID NO: 7204 - protein, 405 aa, Delftia acidovorans
MVSSLAEYPIDVPEEDLILRHAPVCSLNAVREALTTSVCAWGAARPCRAAISAGVRAGWVGGALLLYAHGAAAVTDIDTSTDVATGVNTGFVSLYGVIDTSLEITDPGSGWTPRLDSGAYRGSRVGLHGAEPLGGGTAIVFTLENGFSSTDGTQQVPGSIFNRQAWIGASGMWGELRFGRQYSPIYIPFKGDLDAFGAGTIASGLNNLSKITPYASNAVAYLSPRVAGFSTTLMMATRDPSEHDGSGIDGYYATASYRLNELHLSYAHQQTHGAGALRANLGGANYAFGKLRVWLSFFNGDGGTPVYHGAGGSLSAQYSLSTNARASLGYAHVRDYTTPGGSADQFSAAFEYNMSRTLLLYFSAAYLANHDDSSFTLRGVNVTGLPVAYPGAPVAGVQFGVVERF

SEQ ID NO: 7205 - protein, 2535 aa, Delftia acidovorans
MALRLTSASGGTVQINNAGVIDSRPLAGLSILSSDTPVIAVTGGGTVNAVNTGTINGRVGFQSSATGNTFVNAGAINGSVSMGAGSTNSFTAVTTGTVNSAGGLALELLGPGGLLSFAQTGVVDGGLGGNNTLILQNSAVGTGSGSTGAGTLSTAQYINFGNLRVNSGTWSVGGANNFGNSALNGGVLQFANPAQLGNTITANGGTLEATAAGLTLAPTNGIALGAGGLSLQGTNNLIIGSAITGTGALTKTGTGELTLNGAGTFTGGVNLIDGALTVGTNSALGTGTVTASGGSVLAGASVNLANAFSLSNTVGIGGENPLRIAGTISGTGLLNKVGTGTLTLGGNNTYSGGTTLGAGSVLLETSGALGTGTGGSLDTTAPLSLTNNFALTNTLGLGASGNALTLSGTLAGVGGVNKTGAGTLTLGGLNTYSGGTNLASGTLQLGTASALGTGALNVTGASNLSTTAPLTVANDISLAAALNLPSTQALTLTGAISGAGSLIKNGTTTLSLTATNSYSGGTSLTAGTIAVGADNALGTGTLAVLGNSVLSNAVAVALANDIALGAALTVDNAADMLASGAISGSGDLIKTGLGTLTLSGNNSYTGPLAIQAGTVVASTAASLGNASNVDVAAGALLNLTNGGLINTLTGAGDVDTDTGATLQLGGGDFAGSVGGGGNLDKVGTGTVRLLGTSAIGGSTQVSGGTLDVVGSLGTSALNVALGGTLTGTGTAGNVGAAVNISDGGRLALTSGSSLSVGALTLAPGAFVDVALGAPSTTRLLEVNGNLTLDGTLNITDIGGFGTGVYRLIDYTGALTNNGMLIGLFPRSVDISQLALQTAIGQQLNLVVTAPGSIVQFWDGVQTTANGTIDGGNGTWGAATNWTGQDGSANSAWQGDFAVFSGAAGTVGVQGTQNIGGLQFVTDGYQLTDVGAGALAVTNPLTAIRVDPGATASIGVAITGIGGVEKLDTGTLVLSGPNTYTGGTALSGGSLVLGNAQALGTGTLTAAAGTTLDTNQAWAVGNAVVLNGALTVPGSNDLALTGAISGPGSLIKNGTSTLALDGSNSYLGGSVLNAGTLAVGSNTALGAGALSVLGTSTLSNAIALALGNNVNLGANLTIASADNLALTGVLSGAGALTKTGLGTLTLSGSNLFSGPVSVQSGVLATSSTGTLGTTASVDVAAGAGLSLGSNTALNSLAGLGNVAIVGSNTLQLGVNNASSTFAGSLSDAGNLEKVGTGTLQLTGTSAIGGTTQITAGTLDVDGTLGSTGGLTVGTGGTLSGSGVVDAAVTVNDGGRLVVTSGSLLTTGSLSFAPNATLDAFLGIPSQTGVLAVNGDLTLDGTLNITDIGGFGTGVYRLIDYTGALTNNGMGFGTLPGTVDSTQLTLQTSLAQQVNVVLLESGNTAQFWDGAQTVANGIADGGTGVWTAGTTNWTSGDGLTNSDWQNSFAVFGGTAGNVGVQGTQGIVGMQFITDGYVLSDAGAGALSANAANTIIRVDPGVTGTIDVAIGGTGALQKLDTGTLVLSGSNTYTGGTALGGGSLVLGNAQALGTGTLTTAAGTTLDTNQALTVGNTVVLDGALTLPGSNDLALTGAISGAGSLIKNGTSTLTLSGNNSYAGGTVLNDGTLAVAGDTALGSGTLSVNGDSVLSNPVAAALGNAVTLGAALTVDNPADLTLAGNISGSGALIKTNTGTLTLGGSNTYSGGTTLTAGTLVGDSASLQGAIVDNATLAFNQVADGVFNGSITGTGTVVKDGVGALLLNGANGYMGGTSIVAGTLIGDTASLQGDIANDAALVFNQTTDGVYAGTVSGTGSLEKAGAGALQLLGPNTYTGGTVISAGSLVGNTASLQGDVVDNATLIFDQASDDTFAGTVSGTGSVIKQGTGALTLVAPNTYSGGTTVASGSLIGTTASLQGDIVNNAVLVFDQAGDGTYAGNVSGSGALIKQGAGALTLQGGNSYLGGTTINAGTLIGNTASLQGDITNNSTLTFLQNSAGTYSGRLFGFGRFIKLGNGTLVLTANSGSFTGPTEVNAGTLSLGNQANPGAALGGPVTVGPGGTLTGSGSIGSLVSSGTVVIGGTSGTISVGGNATFAPGSTLQVAPGAGGVVTPVTVGGAATVATGTTLELLRATDLPLFTEIPVISASGGLTGQFTNIISDYAFIDPNVSLTATALSVTFGRNTVGMVGMVTTPNQQSTAAAVDGLPNTSPIYQAVLRLPDDPEAVRTAFASLSGESHASTATALLDSRFLNSGIGNHLRGDSQDTLVGDTMVWITGRSLPNRVDGNADAVSVRREDNGVMAGAERRFGESSVVGIAVGNQDIKSWSREWGDRADVDGTHAGVYGRTDWSAFSLQGVVDYASYNIDSTRRLMLPGVLAERLSSSYDATAVTVSLEAAWNLRTKGAVYSPFVAADYTRLKTDGFTERGGISALSVDRASDTFSTATLGVRGHWDLGQKAGLYASAGWRHAFGDRSVQRSAGFVGTASEFSVQSVTLAKNAVVGELGVSLITSPGSRLALSLQGLDGDGQTAYGGQVTWAVSF

SEQ ID NO: 7206 - protein, 801 aa, Delftia acidovorans
MPAVKTCRLRPLARAAHPLFAMSLLLCAPAWADEPARRTFQVAPASLGAALTHFADQAGVSLSLDPALVEGRQSNGLSGRYSVDEGFNQLLRSSGLQALPVGEGAFTLMPAPQASGALEIAPTRIVGGLAAGNEAQPYAGGQVARQGAQGLLGSRDFMETPFSITSYTSDLVKNQQARTLGELIASDPSVRATNPAGGRFEQFTIRGFSLFNSDVAYNGLYGILPTYSIDMEMADRVDIIKGPSQLINGISPRGSVGGGINVQPKRAADKPITEFTGSYASAGQAGGAVDIGRRFGEGQQFGVRFNGVKQAGDTEWDHQRVDREMAVLGLDFRGERLRLSADLGHTERDTDAPQERVLVGANAKVPNANDVRHNYAQAWSKARTNDTFGALNAEYDISESLLAYGAVGARKSNHDFLRHNVSITNDAGDFTVQPRDFTRDESVRTAMAGLRHWFHTGPVSHALNLAASYYYMDFTNGGARYAAAPSNLYNPVAAPTPGTPTRLDPEVYTENRFSGVALADTLGFFDDRLLLTLGARWQRVQVDDWSDGVKGDTGYDEEKVSPSGGVLLKVTDQLSLYANYMEGLSQGKIAPSTSINEDQIFPPFTSRQIEVGAKYDLGQVAFTASAFRIRQPAYETNPASRVFGPNGKRDNRGIELSVFGEPVQGVRVLGGVMYIDSELTDTVGGAYDGNRAPATPEYNVNLGAEWDVPGVNGLTFTARGTHSSSQYLDQNNSKRIDGWERYDLGARYAFKVNATEVTLRASVENVLDDRYWSSAGASDDSEPGLSLSTPRTYLLSATVGF

SEQ ID NO: 7207 - protein, 296 aa, Delftia acidovorans
MRPPYTTHLQRVPLMRKSLLALSLLAATSAPVLAADYSDGDTHKNDFSWMQFNLMHAINEKPGNSDHTYLEMEFGGRSGIFDLYGYLDVFNLTDSDSSDKAGKDQLFVKFAPRMSIDGLTGKDLSFGPVQEIYLANYTTLDGGADYNLYDKDGKEKSNTPGFLTKWGIGSDVMVPWFGKMQFNLYKTYDVKAKEWNGYQFSTVWFKPFYFFENGSFISYQGYIDYEFGIDKVHIPGVGQLKSSHGGAMFNGIYWHSDQFAVGYGLKLYDDVYGLTDEGVAGRTSGVGHYLAVTYKW

SEQ ID NO: 7208 - protein, 904 aa, Delftia acidovorans
MMSHYKLLAAVSGLALMAAAGAHAQTAAPANDAAQVDEVVVTGVRKSLRDALQVKQGSDKVVEAISAKDIGVLPDVTIAESIARLPGVNATRDRGNDSQAVVRGLGARLVLGTINGREVASSEPDRNVRWEIYPSEVVQGVQVYKSQSADLIAGGVAATINIDTIAPLDYRGPSVVLRAGPVYYDGGKDIPNYGQTGYRASGSFVHKFNDDLAIVLGLTSQKQKNGYTSFQGWGYNDSVMRQPAGASDYSGDLNGDGKVDPTPWGMQLEIKKIDQKRNGVSTGLQWKPTDHFELKADVLYSDIKITENQDQQIYAQNYGNWNNGNAFDWQGNPIGYNAPGASYTLVNGDVVAATLPGAAVTSVIARYTEDKKLYAGGLNGKWTNDAWTVAGDVSYSKAERTNNWRAVRAEVYPAWMTYDTRAGVKPSVTTSEDPTTLAQVAPSWRGGQNDGLEHLNDELKAGALDFTRDFGGGAFKSFQFGARYSDRVKDHDQASWSTCPNPTNTANLAGLKDQWGNCLYSVTLPASLFSTYKIGSFNVPSILTGDLDAIAKAAYGDHGFDAANAVDNLAQRWRVHEKVAEAYGKLNFAADGVAGAWMTGNVGVRVVSTKTDSEGYRQDPGLATFSAVSVKADYTDVLPSANVKLDFDQGRVLRFGLAQVVARPPLDELRASRTLTTWSPYTGSAGNPNLKPFKAIQFDASAEWYFRPESLVAASYYYKDVDTYIGWKQTPETYNGITYAVSSPVNGGGGYIQGLELTFQTPFFFLPGPLSKFGIYSNYAYVDSDLKEFQPVTKPLSLTGLAKDTVTLDLWYANGPIEGRIGYKYHSPMTVIYGWSGADLQTLESASTVDFSSSYQVTDKIGLRFQVNNLTNERLRMYRDNKPDRLGRYDLYGRRFLFDVTVKF

SEQ ID NO: 7209 - protein, 697 aa, Delftia acidovorans
MRVTTKAGLLCATILGWVATPVAAQVAEPSQIFVLGTITLTADSDESRGGTTTSVTSDEVLRSNRTSLDDALRVAPGVQVGNTGGSRNERLIHVRGFDRFQVPLSVDGIRVYLPADNRLDYGRFLTPDLAEIQLQKGYVSVLNGPGGMGGAINLVTRQPTQPFEGEARLGIEAGNRGDVTARSGFLSLGTRQQDYWLQGSHMRRDSDGFYLSRDYEPRPQQGAGLRDNSDTDDSRLNLKAGWTPNASDEYVLSYTRQTGSKKAPYNIDQPIRGITDAPGPGQGWQRDWTWPEWDLDSLAFYSYTELGGGYLKTRAYYNRFDNLLSAWDDASHSAQTERRAFDSRYKDRAWGLSLEAGADLGAANTLRGALHYRRDKHRSIQFSQPGLGGGADPTEVSEEKTWSLALENTWQARDDLSVIAGISYDRAEVLKADRTADDAGLPTGSSDAVNWQLAAIWQPDSRGEFHASLSSRTRFPTLFDRYSTRFGSAVPNPDLKSERALNVELGYGGDLGPARIETALFYSKVRDMIQSVPTGELNDEGEALSQSRNVGDGTYKGFEVAASWELDDRFGLVANYTYLHRDISDPIRADYRPTDTPRHSAYLRLDWRAMDNLTISPSVEFSSSRLSESAIQPDDPAQIAYTRMGGFGLANLDAEWQATEQASVVFGIRNLFDRNYQLVEGYPEPGRSFFLTTRVTF

SEQ ID NO: 7210 - protein, 633 aa, Delftia acidovorans
MVTAEEIQLDPINVSGEVEDQHGTVSLSGETLEDLAPREMSDLFAGEASVMSSVIPTGNKTFVNGLSSSMMNVTVDGTLQGDGVFHHATTGMYDPALFKAATIKPGVVAADDGPRANAGSISYETKDAADLLQEGDNFGGVASLSFDSNSSTFRRDLTLFGRQGAFEYILYGSKATGDDYEDGAGTTYRGSAADLASFLGKIAYQWDNGYRLEFAGSGTQDTGWRQARPNFGDLTGVVFPLFDTEVEQSNYSLTLKNENATGGFSPEFHLGFSSSFLDQGDPVDPSYTRPLWGGEVETWNGKIQNEFLFGNHSLTAGIDFFEQTGTGGAVQGTFTDPATIGGSFGPYTEKTSNIGIFAQMRSDLSDAFSLSYGLRADHQDFTGWDGTKLSDDGFSYNISGSYALSDAVTLEAAYSQVWGGYELGETAIINYSYPWVNYAGMQAQETENIRIGLQVNTGNWDASFALFRTDAENIRTRNSADQATSSNIVTEGIDASLGYNFASGYLRGTYTYADVTEDGQISNTTNYYAAQPMGHILAIQGAFDVATDWRVGGTAEAALSLDLANATLPGYEVVNLFAEYKPARVQGLTVRAEINNLFDSYYISRATQGSDNGRVLAYGEPGRSLAVTARLAF

SEQ ID NO: 7211 - protein, 800 aa, Delftia acidovorans
MTPFFNISSLRPSVLAVCLALGSPALMQTAFAQNNKSAAQSFDIPAGPLDATLTRIARQSGQIISIQPEQVQARKAPAIRGEMSADQAYRQALQGTDLELFMSASGALNLRPVPAKTVSTLPAITATASQETATGPFIGYAARRSATGTKTDTPIIETPQSITVIGAQEIETLKSQSLQDALGYVAGVSRAEGMDRTTDSLFLRGFRTSLGNYYRDGTLYTVNIYNGRQEPYGLERIEYLKGASSVLYGATPPGGVISTISKRPVTEPLRELNVELGSFDRKQLSGDFGGALDEDGQWSYRLTALRRDSNTFVDHVPDDRTYVAPAIKWQPNAGTSLTLLGEYQRDHTAYAYGLPAQGTVLPNPNGRIPRDRFGGEPGFDRFDLKRTSIGYVFEHAFNDRLILRNNLRYIRAESGYDSTSIWQLAPDLRHTASRTASPRWDLSTAFNVDTSLQYKVETGAIQHTVLAGFDYSLPKHETKRYLRRASSIDLYDPVYGGPMGPATPNYGSSTKSDTRRMGVYIQDQMKIEDKWVVLLGGRQDWVRASESNVFTGEQYADNEKSQAFTGRAGLVYLADNGLAPFVSYSQSFEPTSGQDREGSRFKPTEGEQYELGLRYQPAGSDTMLSASVYTLTRKNVTVADPMDTSYQIQTGKARSRGVELEARTRIGRNTNLIAAYAYTDARTLKASPLQPDAEGRRLDSVPLNQFSIWSDYGFGSFGLPGLRVGAGMRYVGSTYGMAHGTRVEVPSFTLMDAMLSFSRDRWKFALNATNLADKTYIGSCTYGCFYGEPRKLISTVTYRW

SEQ ID NO: 7212 - protein, 737 aa, Delftia acidovorans
MQVAPGTTILRCATQAFSGFRLYFSATLLGVTTAVAPALADGNDIPDKVEPLRGFYGFSDDIPEVLTTTRLRQPKTRVPGSTTVIEGNLIRQLGINSLVEIFRLVPGMVVGEVGSGTPVTTYHGTVHYEQRRMQVLIDGRTAHRATLSDMDWQSMPVALELIERIEVSRGPNSAAYGINAFLGTINFITRDPGDTVGTELRIMSGSRDYRRTFASIGDATKDIDWRLAFEKREFGGFDYQKEDGEFIPFHDGQNLNFLMFDSRLKLKPDFNIELRAGITDGVNEEDQYKTGYFPAQANPDIDVQDFYLDSRFNVIPSADHFFHVQVSFENFKRRQRWPIKVPIEDVLPLFNGICLNPADSSVNCSNLNTAPESLSANLNADSEDSRLELELQDTLVLSDTTKLVSGLGYRHDTYRSETFFNGRGTSEQYRVFGNLEYSPTNWLTFNGGGNWEHTDTTGKGYFSPRLAANLIFNNQHALRFVYSEAVRTPDSFEQNPNYGFVLRNVNAAYAGELEGYRLTTGDIAREKFSDTLGVELHEEKIRSHEISYFGQFPLTPALLTLEVRGFKDEMRDMISGVIQFEEWNIDNSVNIDQKGFEVEGTLVFPLTTFRASYGYLDQDTRYSGPLSYNGQNLREEEVPIKLRLLERLSVRHSGSIAVIQTLPWNVTAASVFYWADEFRNSQFERFDIRLAKQIIQPRYTAELAFVMQHYLNREFELSSDNNIADQNQFFVEAGLRF

SEQ ID NO: 7213 - protein, 747 aa, Delftia acidovorans
MSPFYRHVCGRSLLSVAAALPLAMPGPAQAQEPSAQLEEIAVQGGPGTGLPPNAPAEAIGAEAAAALRTPSLSQASPVGLNLRTPSRSASRLGLTPLQTPASLDIISGETIRLRGQTSVLEAVSQDGTGITAFGSPGSGVGFFTARGFAGQNSIQTLFDGTRLYVGANTVTFPFDTWNVERIEVLRGPASVLYGDGAIGGIVNIVSKKPLFTPLNVARFGLGEDGIARAAVDSTGPIGESLAYRLNVSGNRADGWITPEGDFRNLAVSGALTLQATPDLAFTLSHDLGYQEPTRYWGTPLVNGRIPDSIRFNNYNVRDSKIAWTDNWTQLRTEWHPSADVSVRNTAYRLQSRRHWRDVEQYRFNPATGLVDRSDYLEIYHSQEQIGNRFDATFRHSLFGFANTVSAGFDVNHVSFRHTNNFTFSETPTSVPLNGYDPGFFPPEGRASPAYATRTNQASVFAEDRLFLTDRLSFLTGVRFDAPNLTRQDLRSGATFERSFRALGYRFALLYEPTPDTSLYVQYATATDPVNSLITLSQSLAGFELSTGRQVEVGAKGLAFGGAVEWTLAGYRIVKDNLISAVPGQPTVSTQVGQQSSLGAEAALSWLPAPGWRIDANLALLHAQYDDFTQNVGGVAVSYAGNQPINVPEQVANLWVNWAFARDWEGRVGLQHVGEVFSDFGNTARRPGYTLVNLGLDHQVTAGSRLSLRVFNLFDKVYAVDGSAVNGLGTAWLLGRPRSLEVAYTIAW

SEQ ID NO: 7214 - protein, 592 aa, Delftia acidovorans
MNSSFHTSYKLIVAVIALLAVQVSYAQEEESTIGTEVVNVVKAYTPTIRDAFKVKATPQLNDSITTAKKKVTYSIFSVPVASTFTPAKGKAAVVKKAKKEKLYDNYATLGFGSFTSVLAEFYSNFQISRTEDFGVFLNHNSSQGGIDGTVVDDFFYDSRLNLNYGARERDLTWRADLDAKHQVYNWYGIPEELKELQGPADGPLFTEDFDVTHSYLTAGLNGSISLKDSFFKEATGMVRYFGDDLESTELRAVVAPTVEFPIAGELITTKLSVDYLSGSFANSFGTTGTEINYSFLNAGINPSLVILRDDLEVKLGVEGVVSLDTENSETDFFIYPKIAASYRVAGDYFIAYGGLEGGLIQNNYHDFAQENPFISPTLIVAPTNKQYDGFLGMKGKLSEALSYNLRASYASESGKALYQHNPYSQSGNNFGQNGYENGNSFGIVYDDVNTLGVFAELNFDVNANFKMKLNGQFNSYTTDTEAEAWNLPDLQASLFADYQITEQWFAGVNLFFTGERQDLVFSQDPVDILTPSSIETLESYFDANAHVGYRFNNRLSAFARVNNILDSNYQKWLNYEVQGLQGMVGATYKFDF

SEQ ID NO: 7215 - protein, 362 aa, Delftia acidovorans
MKKSLIALAVLAASGAAMAQSSVTLFGIVDTAFGYVDNANAAGDSVYGLSTSGNATSRLGFHGVEDLGGGLKAGFWLEGEIFGDDGNASGFNFKRRSTVSLAGGFGEVRLGRDYTPGYSKFISYDLFGQTGIGQFMGWRDWGTNSDFQTRVSTADANNMRASNIVSYYTPNFSGFTGGLGYGFDEQVSGKNGRYVGGFVAYDNGPLSIAVSYDQRELLGSVGPVATAVPFTGSRDTLTVGASYDLNVVKLSTILQQSKYKIDGAGSDKFNAYALGASAPLGAGEVKLQYALYDQKAIDSKAHQISLGYVHNLSKRTALYGTVAYLKNKDASNLALPTKGLTVDGPGAGENQTGVQLGIRHSF

SEQ ID NO: 7216 - protein, 809 aa, Delftia acidovorans
MTAMPSPRHATFALKALNLSLALAFSALLPSAAQAADSVSESASRSVNIGPGLLSHVLAQFAVSVGVPLSFDPAQLGNRQSPGLQGSYTAQSGFARLLEGSGFELISTGHNGYTVAPKVAADSALELGATNVSALRDDSGDTYGGEQVARRAQIGMLGNQEVNDLPFSVTSYTAKTMADQQAQTVGDVLLNDASVRQSNGFGNFSQMFMIRGLPLASDDISYNGLYGVLPRQIIAVEALDRVELFKGPNAFVNGVTPSGSGIGGGINLQPKRAMDTPTRSVTLDYSADGRVGGHLDLGQRFGEDNRFGARVNLMQREGDTAVDDEDQRSSLFSLGLDYRGDRLRVSTDFGYQKQVINQGRSVVYVDSSLAKAPKVPHANASYAQSWSYSQLEDTFGMARAEYDLNDNWTAYLSGGAKHTRENGVYSSLTVTDLNGNARGGMLYSPHDEDNQSAMAGLNGRFDTGPVTHQLNLGWAGIWGEQRSAFETIGTAGRYSTNLYNVTDKPRPAPTSFASDISDPRITGKNTLRSEAISDTLGFVDDRILLTLGVRRQALKVDGWSTASGARTSSYEESITTPVYGLVIKPWEHVSFYANRIEGLAKGPTPPTTAINRDETFAPVRSKQIEAGVRLDMGSYGANLGVYRIEQPSSYTQDGIFRVDGQQTNKGVELNVYGEPLDGLRLLSGATVMKTELEGSSNGANDGNRAVGVPRFQFNLGADWDIPGLEGAALSARMLRTGGQYLNAANTQSIPAWNRFDLGSRYAFKLDEKQITLRANLENVANEAYWASANGGYLTQGTPRTLKVSATVDF

SEQ ID NO: 7217 - protein, 787 aa, Delftia acidovorans
MPRPLHLALLVSAIWAGSAFAQSKSFDLPAQGLGSALTALAKQGGIQILFDADALKGKQASMLRGSYSADEALGKLLSGSGFQAVSTGKATYAIQKRPPAEGAPNVLGEVTVTATPERSYKADKVSVAGKMPLTLREIPNSVSVLTREQMDDQNMVTVWDAMSQMPGVQAIANDISQGQYHSRGAALDVQFDGAPSTLPLSGYQQFDLAMYERIEVLRGPSGFVQGSGAISGTVNFVRKRAEKEFASRFLASTGSWNNNRLEADVTGGLAQDGRLRGRAVFSYVDRDYVFNRVHTEKWLAFGTLDYDITPSTTANIYVAHQQDNSSAFSGLPAYTNGRFLNVDRSFNPYPDWGRMEWNTTDLGADLTHKFDSGWTVTGRVLRRKQTQFFKDAYPADGVNPANSVISSYIRREFDYEYDMDNVDVYAAGPFQLFGRRHNLMLGANYSNFFSHGVGANASSPGSSYLRVNNILLSDPPVVVEPNVIYTTGSENETTQSGFYGQLRLSVVDPLTVVLGGRLSDYNYKSRTISPNPTPTNWAQGGRETGQFTPYAGLLYDVNKYLTLYASYSDIFAPQTSKQVDNTVLEPRVGRQYEVGAKTELVDGKLAVNLGVFNIRDKNRAFADANNPGYYIAAGELESKGWEVEVVGRPAQGWDISGSYTRLDTEFLKDSTRQGQPVSLWYPKTQFKLWNKYRFGQGELEGLSLGFGLRGASQSASGTATSTVAAREQNFYAVYDAQIGYNLSRDVAVTLSANNIFDKTYYTRLGGTNTYNYYGDPRNFALTLRVRY

SEQ ID NO: 7218 - protein, 589 aa, Delftia acidovorans
MILMLKLLLTQTVSPVIIGLFFATQPAIASTDRNENLDIVAPTEALEIIRNRPQLQTPLNRDTSKQFKDAGSQPSMSQVTNVGELRDISPTDWAYEALRSLVERYGCIVGYPDRTFRGNRALSRWEFAAGLNACLNTIERLIQENVAVLREDIEKLKRLAQEFEQELIALGARVSNLEERVAFLEDHQFSTTTKLNGEVIITISDAWGERALDFREQDLFNQGLLERRRIDDNGVIGHRSRYNFDTSFTGEDLLKTRFESGTIVNWSDPTGTEMARLGHDSDSGSDTFIDDVYYRFPIGNLTTWVGANSLDIDDIFDVGNPLLFAEESGALSRFIRYNPITFRGPEGKGIGINYAFNDVFILRGLYLSDTANDPSLGNGLFNGNYSTGAQLGVYPTDALSFTFTYLHSYFAAGNSDVSSSTGSYVEPDNQTPQTGQGIAKDPFLGAPTIRDSYGITGNWRINETFNFSAWGGYALARAQGLDAEGNSRKGFGSDVWAWSASLSMVDIGKEGAVLSIAGGSITNSRRIDAITGDLTVPDQDTPYIIETQYRYPLNDNILLTPGVFVILQPDGNNENNSIWVGALRTTFTF

SEQ ID NO: 7219 - protein, 766 aa, Delftia acidovorans
MPLPRSTRFALLSLLSSGMASVTLPAWAGTPDAPAPAGTGPADARHTAPGQTQARPAATTVTTRAAPGQPSASAPESITVTARLDRARAALQPSTGATVYSFSRNAIETVPGGDNAPLNSVLLQAPGVAQDSYGQIHVRGDHNEVQFRLDGVQLPEGLTVFGQTLMTRFADSMTMTTGALPSEYGFLQAAVIDITTKNGTTDPGGEASIYGGARDYFFPSLQYGGHSGKWDYFATGDFVHDRVGIENTTSSFNALHDLTNQYHFLGHLRYTADDDTRISLIAGVSNAEYQLPNNPGQQTQFQQPSFAGSALAQQLAGSVDSASLDERQREITDFAILSLQKEIGRFSLQSSAFLRYSSLDYSPDMLGDLVYNGIAQQASRSVFSSGTQSDVTWRVAPRHTVRFGYQVFVERNVSQTDSLVFPQTGTDAAGNAVFGTTPESIHQGSGLTGTIWGLYIQDEWKPLRNLTVNYGLRMDGVDEYTHQQQLSPRLNLVWTPWRGTTLHAGYSRYFTPPPFEVVSGASVAAFNGTSAQAASPQSSTVKAESDHYFDAGITQRLLPGWQVSFDAYYKLAHNLIDEGQFGAPIILSGFNYRRGQVNGYELATSYDRGPLSLYGNMAWSRAIGKDITSAQFNFSPDDLAYIQHRWIYLDHDQRWTASAGASYSFFHRTGHPTRLSATMVYGSGLRADGDVPNGVKLPQYVTFNLSLVQSFQDLFHVPFLKRTQLRLDVINLFDRTYELRDGTGIGVGAPQYGLRRTILTGISQRF

SEQ ID NO: 7220 - protein, 729 aa, Delftia acidovorans
MSVSKLSILKKISPVALAVSSTLASGYAVASELNQTPDTRDEMEVIVVTSDFRGTELEKMPSSITVIDQQQIEDEGAQHFEDILNSIANFNWSGGSSRPKYFQIRGVGEQEEYQGAPNSSVGYIIDDIDMSGLGMISSMYDLQQVEVLRGPQGTRYGANALAGLIYLKSNDPTDVFEHGAEVSVGDDALTTFSGFSSGPLTDSGKLLYRVSLQQHKQNGYQDNLYLGRDDTNARDEFTGRAKLRWYATDDLEIDLTLLHADFDNGYDAWTLDNNGFDTLTDAPGVDKQRTSGSSLKFTYTGADAFDLVSLTSYASSQTHHNYDGDWANPDYWAGLDCGGEPCQYDYTWDKRGERNTVSQEFRLSSTEAGRIFAGSTDWLLGVYGMNLDENNEVTSFYNGWADEHVISDFNARNYAVFGQIDSDLGNGYSFSTGLRVEEREAQYDEDRLVDGEMKSSSFNPDETMWGGHIALSKTLSNTQETYIRIARGYKAGGFNMALPEQLADKTEYDSETLYNYEIGLKSIWLDGDINTNFSVFYMDRQDQQVAASQQAVEDSQRFYLYTENAGSSSNYGAELDGTWYATDNLKLYASLGWLETEYGDYSYQDKYGGTVDLSGRELAHSPKFTYSAGATYRTDSGWFANLTTSGKSEFYYSDSNESTSEAYTIFNARMGYETELWSAYLWGRNLFDEKYGTRGFYFGNEPDQDWADKQYIRYGDPRQLGLTFSIKFI

SEQ ID NO: 7221 - protein, 1024 aa, Delftia acidovorans
MAFACPARGRPYRVFGERMTVRETRTLPRTRRLTSALLFAMSTPLAAQTAPAPQSASTVPGSSQADPATLDTVQVSGIRGSLTSSMNVKRDAQGIVDGIVAEDIGKFPDTNLAESLQRISGVSIDRSLGEGSRVTVRGVGPDFNLVLLNGRQMPGASIEESNASNSRAFDFANLASESISGIEVFKTSRASTPTGGIGATINIKTARPLDNPGMHANVGLKGVHDASNENLPGRLQGDWLTPEISGIFSNTSADGRFGVSLSGSYQERDFGYSQVGVPNGWRAFRGDSTAYGTIPQPGAPGSENIVNRPGPNDIYSVPQNLNDRVVGVERQRTNGQLTLQYKPLDNITATLDYTYSENKIQQQRNEMSVWFNYGPSASSWTQGPVSGPITYSEIVNPPTSDLATAGSNAATRNQNKSLGFNVDWAVSDQFKLNVDIHRSTAEAGADSPYGSSNSLGVSGFYRGTSVVDFSKDFPVLQQQLGFGLNGLDPSRTLVTGSAFRNSYMKSEIDQAQVNGDFTFENYSQLTFGIGSTEVKNRSAFSNVQRNTWGGNGTAADYPDDLWIPSSFAQYFDAIDGSGNPQQFNQLYLFDFERVRQAAAHAAGDESLYRISPVFTTDRRVIEKSKNAYLQWNNSWDDLRVPISLAAGVRYEETKVQAQALVPVAVGIDWVANNELPIRLSDSAFAGGSGKYKYWLPSLDLSFKLREDLVLRGSYGETIGRPGWGDIQGGQTLNQIGRIEGGSGQEGNPGLKPLLSHNIDLSLEWYYGEESYASVGFFRKNIDNYVGVTTRNDTSLGLHTPVGGAYWNQALANGCATAELTCIRNYIFRNFSGQPGVVRGTDDTNGNATGTISGQPGDPVANFSITAPANQRSASLDGWEFNVQHMFGQSGFGVSANYTKVNSGLTYDNYVIGEQFALEGLSDSANLVGFYDKDKWQVRAAYNWRDEFLAARFDGSGLPNPVYTEAYGQLDLSIGYQWTETLSLSLEAINLTNEIQRQHGRQKNEIIYATQTGPRYMLGLRYTFW

SEQ ID NO: 7222 - protein, 200 aa, Delftia acidovorans
MKRSASFLALATACTVLAAPALAQSQGDWTFGVGIINVNPKSDNGTLAGSPATLSDDTQISLTAEYFIRDNLGIELLAATPFEHDINIGGAFAGTSKQLPPTLSINYHFPTKGKIKPFIGAGINYTTFFEEASGLGVLKLEDSWGFALQAGADWQVSDKGALRLNVRYMDIESDAYLNGASIGKAEIDPVTIGVSYVHRF

SEQ ID NO: 7223 - protein, 723 aa, Delftia acidovorans
MTSAGQCLAQLPGISTSGLCTPAKATALVLGERKMLNFVGRARSSSAAGKSLEHREQVGWMPVSAGCRGIVAASIAAAGVVCGAAGASAQTYTPIAITPSPDVYAYIQQNPFVQGWLGPRVAGQFTRLTVFGDSYADWGNEMRAGSSVPASGRFSAGLAMADVVQYHYGLPTSAVANYATGGAMSGGTNVGNLFGSTGPVLPGTGTEIGVFLAAGGRFGPRDLVDITTAGGNDSVPILFNPTITQDQMNTAARQTTANILSDVQQVVQAGARNIAILSVGDLSYLPAGAGNANVHYFQSTLTQMEQASLAPLARSGVRIFFFDLATLTQRVVANPSFYGFTNVTTACTDVPSCVGGSVAAQNQFLSYDGLHFTTAGFALIGRYQTNQIDAPLTVAPQGDVATSIASGFAGSIFGHLDAYRNVRGAADAMNAMAADMPTKAALAAPAAVQSPWSVYGDVAYSGGSRDSQQFLSSYNYNSVGGWIGLDYRLSPDLMVGGLFSYAQPNVNLALQNAHEKIDAYQIGGYAAYNRANWFADALLAYGRHAISTDRQGVIDVIRGSTHADTFTVAARGGYLWDLGAVRMGPIGGLSYSNVQIAGYTETGDMLLTNMVNRQRLESLTGSAGVQLRAPFAAAGAFYNPYLNLTVEHEFISSARSLITTQVTTPLLPVLTPIDGRAATYGKVAAGLAAAITDKVSVNLGVVSTFARSDRNDYGVNGGLKVAF

SEQ ID NO: 7224 - protein, 250 aa, Delftia acidovorans
MNPSLNVIWDITSNLALKTKLNYASRSPALATANTITDNRANLAQVRGRRDVDSNLKPEQSRLAEVGFEWKHSGARLVASLFDEKVTNYYSGVTAPTITNLGNLRTRGYDAEASYEIAGLKIGVGASYSRATPEGFKLSGDVLDIVPKGRQWKTTLSYTFENPNLEIGYRGRYAEAKTFVITTRSGDERIRKAGYGVHDIYANLRLLKDDLSLDFAINNIGNKRYQSHSQRLHSHINPGRQYIIGANYRF

SEQ ID NO: 7225 - protein, 885 aa, Delftia acidovorans
MRTSAVARLSWTGLSLSISTLLMSGAAMAQSTTSDADAGSSTSSAASTSVPKQLDQVVVRGDYIPEPMLQTSEVASFVTREDMERTGDSSAAVALTRVTGLSLSRGKYVYVRGLGERYSSALFNGSPLPSPEPTQRVVPLDLFPSDVLASVTVQKTYSADYPGEFGGGVIDLQSMEIPDTPFLSLTVGGGANSVSTGEKGLTYYGSDDDEWGVDDGTRKQPAALRDAIRTGRRVDLGSFSREDIRRIGRSLNDANLYVLQEKDSIAPDVNVGGSAGYSMDVGEARLGIIAVASYDNEWRTRTGKQQDGIFVGDSVEFNSNYDFATTRNNVRSNGMLGLGWEYGRHTIGWTTLYVHDTLKVARSRAGRDELAGFDVRDDNTEWYARQLINNQLRGTHAFGEYDDLKIEWRAAVANASRDVPYETGIRYERLDGYWAHDASRVQNYTRFSKVDDKVASGGVDVTWRLPMEHDLTVKGGLAYLDNDRSAWSREFRFLALDGPLPFLNQYQRVDYLFSDYNLSNDLLRLRETTGSFGAAAYDATLKVKAAYLQAEGEIVPTLRATAGVRYEDATQAVHPYDIFSGTRQDGVAPLHNSYALPSATVTWNFAENQQLRFGASKTIARPQFREMAPQQYLDPDIDRQFFGNPFLVDSELVNLDARYEWFFEPGQYVTVGAFYKNIDKPIEAIVNDAPGGGIVQSFINAPKATLYGVELEAKKYLELPIAADWWGDKRMFVSGNYTRTTSEVSASDGDTVQPFGFSAPVQATLFIRDGSALQGQSDDIANLQIGVESERTHSQATLIANYVGERVSARGRPGQPDYIDKPGTSLDLVIKQGLTWSGETVSVNFAARNLLKTKYQEYQRVGSNRVDLYTYQPGISYDISVTARF

SEQ ID NO: 7226 - protein, 431 aa, Delftia acidovorans
MSAPFSPRSPRTLRGLGALALCGGFVAPAPAAFLEDGSARLEARTVYFNRDFRDGSSANPQGASKREEAAQGFILDLRSGYTEGALGFGVDTLAMLGIKLDSSPADSNSGLLPSSGHDPRRSVDQYAKAGVAGKMRFSQTQFRYGAMLPDMPLLKYNDGRLLPTLFHGAQLTSEEIAGLRLSATRLERYTARDSSDAQDIRLHCKNKRYACDTTGNRFDAYQLDYQVNDGLLLQYAQGGLRNVYRQRYLGAVGKRQLGAGKLSADLRWFDSEDAGAARAGKIDNRALSLLLAYAQGGHTLSAGWQRMNGASSMPYLDGSNPYLANYLQVNDFANPEERSWQLRYDFDLRSVGVPGLSFMTRYVNGDHIRLANGDEGKEWERDIELKYVVQSGRFKDLSLRLRNATYRTDFERSARDVDEVRLIASYNLSLF

SEQ ID NO: 7227 - protein, 773 aa, Delftia acidovorans
MTRSFVSTSSTIALTVAALLAGAPAAAQEATSAPAAAEADNGGLAEIVVTAQKREQNLQKVGISVTAVSGDQILERGISNSIDLITRTPSVDNYSPYGPGSSANIVIRGIGLNDFGEGHEAPVTVYVDEFYVVNVPAVDFALFDLDRAEILRGPQGTLFGRNSTGGLVHYVTKKPSQEAGGFVKGSYARFNELKLEGGVTAPLTDTLSARLSFLSHHSDGYIKNLNPQFAKDKGGQAGTDAVRLQLRYDDGDWDVLLKGEYGRTDKVHTYYEQTPSLRDPVTGLGSADPTGVDDAGYNEANFGAGKRNVAYTSNPQRLKSKGSTALLRAERDFGDVSFTSLTGYMHFTRNLEEDCDASPNTICVATFPYKSDTATQEFRAFGKGDGFNWTAGVYGLYSKARNNPNATFNVPVSGDTAVDPVTGLYNGAFFPINLAANWKMRTTSVAAFAQGEVELADRLTFTLGGRITRDSKKFDERDNASLRSCPGFPIPTNCFLPPNGPGIANPYRDTYKKTLISGKAALDFQVNADLLLFASVSRGTKAGGFNNGFYPGGVSTAQIPYRDENVIAYEIGEKATLFDRKLRFNTSFFYYDYNRYQTFNFEGIGGLLTNQSANAYGAEVEIQAAPVDHLELRFGGSWLETKIKDVRNGVPGGGVYVADREMSNAPKWTANGAIAYTVPLANDRSLVFNWDWNYRSSRYSNNFNDPSVKMPGYFKHNADISFNVNENWQLQAFVRNIGNKLAITKAFQFNDLGYVQYIYSEPRVFGASALYRF

SEQ ID NO: 7228 - protein, 785 aa, Delftia acidovorans
MAAPSSVLADHEAGHVLPELTVEAPRAARAKPKKPRVRAATAPRASRSAADASTTPPRVIVTGGSVTPAGALAGLTQSPSGQTATTIDHRQFDNRPSFSVSDVLRDSPGISVKQGNGPRDFGISIRGSNARNGFAIRNMVIFDDGFPVTQPDGLSRSDLIDPHAYGAIDVIRGPSSALYGNYATGGAINFRTRPGREIDGVEYGVDGGSFGYLNNYLAVGKKVGNFEASLFASDARGDGFIGNSWFNTQTVNFLGTYQATPDDRFTLKIINNNLDARLPIRLSLNQFGVNPFQRGCSAAVGGVAPQGCATVSLFDNGFNGSRTNQTAEQAGLGRTDRRTIIGARWEHDFDNQTTWRNQLVFDDRNINQPTGATSAIGDYPSYNFISDITRRGELFGFETTSYFGGFYNTLNWSGNTFNVMPGGDATLGLLSSNVTGTHSNFGLRAREEVKLTDALTAIGGLGWEVTHLKGVNTALRYPVAGDPTAVPALTSVDRQFTNLAPELALLYKFNNEWQGRARVGTGYGTPQVGNLFVLADGSNGNNTGLMPQRNVGYDLGLDWTPNKTFKVSLTGFYEFFRNELVSQATPVGAANASYMFNAPRSEHRGIELAADWRFHPGWRATLAYTYLDQIYTEYTEVIRGGVTAYSFDRAGNKIPGISPNELTARLGYDETAGIYAGLGAFVEVQWKDAFYMDNANILKAPGYELVNLNVHYKTDVKSDVFKTLNVYFEVRNLFDKTYIASANNIGNSVTSAGVQDPANILANRTGSIYAGSPRTFVAGMKVAFR

SEQ ID NO: 7229 - protein, 417 aa, Delftia acidovorans
MGTFEYDLPYGMMLSGGLGHMESRYSGAFGQITSPKQNGEFEVSGIRGIDFRSRTTSGNLKLQGDFEAGAISYNWNLAFDSEIRQRDHDQSSKTNGKIKGGTIYAPNFAQLKNFDLTANTQGVDSKLSANSLAFADTLGFVENTVRLTLGGRFQWIKQQDKKAGTEVKADRFSPMVTLAYVPNPDLVLYGNYLEDLEPGNIDVETGEMNSSRVSKQIEVGVRKNWDNWLTTTLSAYEIRRPGIIRGNKAALKAQAGKEHGKERNRGIEFNTYASLLNNTLRPSLGLTYNQAKVFDFPTYADVITDGVQVTSPRWMAKANVEWDTPFVANLTLNAALQYYGKSYQDSTANYRLPSYTTVDFGTKYVVKVADKQTLTLRGGVENAFNKHYWQVQRGQYDRSFAVLGMPRTYWANMEYSF

SEQ ID NO: 7230 - protein, 910 aa, Delftia acidovorans
MQQQHLFRLNILCLSLMTALPVYAENVQAGQAQEKQLDTIQVKAKKQKTRRDNEVTGLGKLVKTADTLSKEQVLDIRDLTRYDPGIAVVEQGRGASSGYSIRGMDKNRVSLTVDGLAQIQSYTAQAALGGTRTAGSSGAINEIEYENVKAVEISKGSNSVEQGSGALAGSVAFQTKTADDVIGEGRQWGIQSKTAYSGKNRGLTQSIALAGRIGGAEALLIHTGRHAGEIRAHEDAGRGVQSFNRLVPVEDTHPYANFIVEEECESGNYETCKSKPKKDVVGKDERQTVSTRDYTGPNRFLADPLSYESRSWLFRPGFRFENKRHYIGGILEHTQQTFDTRDMTVPAFLTKAVFDENRKYGPIRGNGKYAGDHKYGGLFTNGENGALVGAEYGTGVFYDETHTKSRYGLEYVYTNADKDTWVDYARLSYDRQGIGLDNHFQQTHCSADGSDKYCRPSADKPFSYYKSDRVIYGESHRLLQAAFKKSFDTAKIRHNLSVNLGFDRFDSNLRHQDYYYQHANRAYSSKTPPKTANPNGGKDQPYWVSIGRGNVVTGQICRLGNNTYTDCTPRSINGKSYYAAVRDNVRLGRWADVGAGLRYDYRSTHSDDGSVSTGTHRTLSWNAGIVLKPTDWLDLTYRTSTGFRLPSFAEMYGWRAGVQSKAVKIDPEKSFNKEAGIVFKGDFGNLEASWFNNAYRDLIVRGYEAQIQNGKETAKGDPAYLNAQSARITGINVLGKIDWNGVWDKLPEGWYSTFAYNRVHVRDIKKRADRTDIQSHLFDAIQPSRYVVGLGYDQPEGKWGVNGMLTYSKAKEITELLGSRALLNGNSRNTKATARRTRPWYIVDVSGYYTIKKHFTLRAGVYNLLNYRYVTWENVRQTAGGAVNQHKNVGVYNRYAAPGRNYTFSLEMKF

SEQ ID NO: 7231 - protein, 153 aa, Delftia acidovorans
MSVETGKRIALNGNWVLTPQAQLIWSSINADDFEDVWQANISVARGNSFAARFGLAASYDSSWQGSDGRVVNTSVYGITNLYQEFLGGTRVNISGVDFSTDNDRTWAGIGAGGTYAWAGGKYLIFGQGTINTSLDHFADSYAIKGDVGFKVKW

SEQ ID NO: 7232 - protein, 128 aa, Delftia acidovorans
MRFAIVVTGPAYGTQQASSAFQFAQALIADGHELSSVFFYREGVYNANQLTSPASDEFDLVRAWQQLNAQHGVALNICVAAALRRGVVDETEAGRLGLASSNLQQGFTLSGLGALAEASLTCDRVVQF

SEQ ID NO: 7233 - protein, 203 aa, Delftia acidovorans
MKALLPVALVSALCSSVALAHEAGDIFVRGGFAKVMPNESSDNVLNKGELELDNDTQVGVTLTYMLTDQFGVELLAATPFTHKVSTKGLGEVAEVSHLPPSLMAQYYFGQANSKIRPYIGAGLNYTIFFDEKGKGVLADTDVNLDNSFGLAAQIGVDVNFAENWFANASLWYMDINTDVHTTVGTFDADIDPITFMASVGYTF

SEQ ID NO: 7234 - protein, 185 aa, Delftia acidovorans
MHSPSALADTPSVGVSKGQESLQPAAEGNLWQRLIRNVSLAWNSPHQELYIPVNTWHNRWTYDDEKIASYNERPWGVGYGKYRYDEDNNWHSVYAMAFMDSHNRVEPILGYGYQKMWIPGEREGWRFGAGFTASITARYEYHYIPLPLPLPLISIEYNRLSLQTTYIPGTYNNGNVLFTWIRWQF

SEQ ID NO: 7235 - protein, 872 aa, Delftia acidovorans
MQTNSILAKAVRFALIGGAATAALSASVATAADDQAKVERIEVTGSRIKRTDMEGSSPVTTIDASAIEKTGELSMADVLRRSNLNTFGSTSENSGSAQQSQATINLRGAGSDRTLVLLNGKRMPGSPTLGGTAVNLNTIPTAAIERIEVLTDGASAVYGSDAVAGVVNIITKKNFDGVEVSTTATDPVQGGGEEWKTHIVGGLTGDKGSMTFSFEHLNREIIYQRDRWFTSSSNVLAPKFDDATGVSKYARNFLDGKTGQFSPMAACNNPKMVGAGHVYDAGGGDRVCGYDYTSEAADHASRTYTAGYVNSEYELSDEVVFQGQGLFSRNETFGRYAPAAGWFNVAANQLDIQNFDAAGNLTGVSKNPNAGKAYYRFTDVGTRDGNTTDYSTDIQLALVGSHDDFGWDVTYHYNLAENTNSGTGYVHRPTVEQYVKDGIFNFGPEGNSQSVIADIAHNTLKQDIMKFQSINAGLNFEYLELPAGAVSWYLGTEASQYKYDAKVDAQTAAGDVIGSSGNGSQGDRDVYAVFAESIVPVSEDVELNFAYRYDKYSDFGSATTPKVAIRYQALEDVVVRASWGQGFRAPSLSDLLAADALSADMATDYSYCDVLGTAVADCKAKQYDVTRQANSELEPETSDFYNLGVIWDITDNLSTKVEYYNLSIDNVITFVSLDSLLKEEQKVGYGNLSRGEIKRVNNNPNGKLLSATTPKANGTGFDTTGIDFNITYSGFETAIGEFGTSYDLTYVLSYDDEEYFDGPVNDKIGRNGKPEIRFTWVLDWSYGDHSASLLTQYIDGQSEKTNPTDFSQVGNLSSQTTFDVSYGYHTSWDGKFGLGIRNLTNQDPVLDSDLEYDSSLYNLYGRTFTATYTQKF

SEQ ID NO: 7236 - protein, 208 aa, Delftia acidovorans
MPSSAIDTPGRAIDPRALPARPATGEPSRASAAGRARQSSRSLTTEPCQASNTNRHVIGAACAAVLGITATAAAHAQSSVALHGLLDASIAYTNNQSGKHAWGKHTWRQGRGLPSNTVFGLSGSDGPGARLRVAPRAGRIVDAYASRGDDRHPASVPTARRERHRASGARTRRAAAAGESALEGPTGGRMRSALAGVMKLVNIADLND

SEQ ID NO: 7237 - protein, 1065 aa, Delftia acidovorans
MIKMKQIMLALMMAFTAQVSLAQVKTIKGLVSDQNGLPLPGVSIIIQGTKTVSQSDYDGMYTIQASAGDVLAFSYIGIKTKTVTVGTSPTINVVLTQDTQNLNEVVVTALGIKRQKKELGYAVQDVKGEQLSKVITTNVATALSGRVAGVDVSIPATGVGGSTRVIIRGISSIGENNQPLYIVDGVPIDNTGLSNDSAAASKWFDGRDNGDGISSINPNNIESLTVLKGAAASALYGSRALNGVILITTKKGSKGKLQVELTSGVSFDKVYAKYDDFQTEYGSGSHGILPDPSKAPNEIYQYTTSSWGPKFSETVGQEIKIFDGSMKPYARVDNNIKGFFRTGFTTTNGIALSGGSENAYVRFGFNNLKNDDVVPGSGLERNDASLNATLKSDKFTLDANVNYMVENTENRPGLGDSPNNVGYSLTGLAPNIDQAWLKNYKNEETGEIYKWNNNIYQLNPYMTTEANHNTSKKNRFMGNVAGTYKLKDWIALTFRTGLDTYVFGAKDFMAAGSTWPGRETGYIGLNDITVSEMNTDIIATISDIKLANDLTFSGILGTSRRDFRRQENSSSGINIIEPGTEYISNFTTHTINAPTETKTRTNSVYGSAKLDYKGYLYAEFTGRNDWFSVINKDAFYPAVSLGFVFSDAFNIKSDAFSYGKFRASWANVSNAPGAYKNSLNYTTYSSYDGQSVVNIKNTSAPNLNLTYQSKTGTEFGLETAFFKNRLRADITVYREDTSDQTLDLASSATSGYEFLSVNAGKLRNEGIEIFLSGTPIKTNSFEWGIDLNFSKNKNSILSLHPDINTYTISEARWAGAAIVAQVGGQYGTIIGKDFQRTESGEMIVGANGLPLYTDTKVVLGKGVPDWAAGLTNRFSYKGITLQFLLDMKFGMDVYSMTNSVAATKGLLDVTTEGRDAYNAARAQAAASDPNFNIQSWVPTAGYVANGVVNTGTAQNPNYVRNEKPVDPQAYWTNVFDNTPAPFIYDASYVKLREVSLGYTIPKSVFEGAKINSIYISAFARNLLTFSKDLPNIDPESMYTSGNGQGFEYGSLPFRRSYGFNIKVTF

SEQ ID NO: 7238 - protein, 488 aa, Delftia acidovorans
MPIQCKYKLQHLVLAVALAVGCVEFSLAEQTEPDTSVVKEVKPKNPRKPKDKPAPLKLAEETTREEKIAPPLEKIPVSTELPVVPAHTADDISSKKIATTESGSALKESLEKPAPLPEPVLAETPATQQASLADQPPSTDSPSPAGNSAIAALLAADETTAALALNQLSGGSNANLAKATLSSVTPVSASLLSAMLQLDDQHDNQPSAPRHAAGNAESGRIWLQALGHSGKLDRDVEPMQHSTKGLLLGADWRLDEEWRLGLMGGTSDTRIDSEELDGDLDSWHLGAYAMRQTGSLALRLGAAWSNHEGSTRREVAFGRFHDRLKGNYQASTQQVFIESGYNLGRANVSIEPFVGIGYQRYQRDGYTEKGGAAALRVDDQSQGNFNTTVGLRMANVSTLDNGMRLTPRFSAGWKHVYGETYTSTRQRLVAGGHGYTVYGAELDRNSLTLDTGLDLAVSSSHTFGVGLSGEIGTDSRNHGVSGQWRMAF

SEQ ID NO: 7239 - protein, 627 aa, Delftia acidovorans
MHTKYRGTALRRMKIDSKQTRAVAAIALGIALALPAAACAQAFYALGDSLTDNGRVVRLTGILPNATSTIFRNGRSSNGPVWAEYLPSLIGARFAPDDDYAINGALSGHGGYLNIIPTRPTWRSLPGFVDQVDQLIAAHPRLRGDDLVGIWIGTNDQDLTKASLNGIEPFLGVPRPANIAEMSAYTLTNLNAQVRRLIGIGARQFVILNLNDANGTRPGYVDYNGKLPADLVQFSRQGVNVHLFDVSGLLNQMRRNPSAYGLNDAPDVQCRHVPSCNGGVVGLQNTYLTADGTHMMTSVHEYIALYLANQLNAPAAISTAPALGLDVARASALSALNMTDSGPLGAPRVALSDKLSLFADVGYTRNFHGAANGIDAFDSDVEMFSIGADYKLSAESSAGALFSSGNASGSIAGGQGRIGMHAYRLGFYHAFDRAGLFVRSYVGAGWSQYRLDRGAVLPGAISAHTTGFDFGGLVKAGFLFPLGGARLGPVADIGYAQLVTRGYAEEGDPILAQDVGVQRLKGVSAGAGVRFAAPLAAIGLRAGELSAEAHLRHDAFGDRTLVTAQRYAPGLPISTAVDGASATYERLSVALTVNPAKRWRGKLAVQADLGNAQRRSYTLLALLGGTF

SEQ ID NO: 7240 - protein, 715 aa, Delftia acidovorans
MAGYSTPAQAGISRFPAPLLNTPQTVNVVSQQLMQDQRTTSVQEALRNVPGITFTAGEGGVQGDNVTIRGYTARNDFYRDGIRDPGWYARDAFSFDRVEVYKGPSSFLFGRGSTGGVINIIGKTPQNRDFYVVEGTANSAPGGRIMTDFNKTFGDVSARLAMVGYNSDTADRDFVNTKRYGFAPSVAWQMTDQTKNTLSYVYQNDDNIADRGIPLLPGSYFGTSYRQPAPVPRNTYYGVATPGQEDVERTEAHNIINKFEHEFLPGLKFTNTTGFSKVDRFNRTRPVQITGINASNSNLWNAAVGGTRLATPGNPLLATTALSNIWIANTNHFENQTNNQLISNVSDLNAKFATGFLQHNVLFGVEVSREDREQFRTVFGDTTYRINVANPNPYVSGVLDPHTTATLSKADAVGVYLQDQMKVTEWLELLGGVRYDNFQANTQAYTYNRASGAVVSTGNFLNGSAIGAPTNLSSSNDFLSYRAGVVLHPTANSSLYYMRGTSANPPAEFLTITNGQQSLDPVVSEIDEIGAKADLLNNRLNVNAAIFRIKKKNDYENQGTNAAPVYVGIGTSQVEGFEIGATGKLTEQWSVSGGYAYLKSELLDTLTAANKGHELAFTPKNSFSLWSTYDITPQLTVGGGAFYVDSRWTGVANDARIPDYWRFDAMAAYKVTRNLTMQLNVYNLTDEYYYESAAGAGYAVPGAGRYVSVSARASF

SEQ ID NO: 7241 - protein, 1011 aa, Delftia acidovorans
MFELRGERRLSRSRLTRALMLSCAVTAFSAPAFAQNDEVEDVVVIQGIRQTIQDSIETKRNSDTVVEALSSDDIGDLPALSIGEALETLTSAASHIEQGGATEISIRGLGPYLGSTVINGREAANGSGDRSVNFSQFPSELFNSLAVYKTQEASFIEGGVSGQISLSTLRPIDYGRSRIQLELKGNYNPDNSDLNISERGIGHRATLSFVDSWETGAGEFGLSFGYQNNRSTNPEQEARTTSSFRDCRNVVSGDPNSDNFGVDSLGDPDQNCDSGGGDLVLEVDPATGVAPDANTPFVFVPSQRHFRQNITDDARDSIFFAAQWQPNARWDINVDYQQSDREFTELRSDLTIDGNSVLNVGESGEIVPLSVSPTGAFLGGTTYDGAEVSSHYMERIEEYTGYGLQAEYQLTDDLTISADYSYSETMRRENIIQSRLRSDTDGDSGSEDVFVGIIVEDDAQRFVFGDFDVTDPANFDVGPRTREDLNQFRNNSIEAFRADFDYLWDNGFITNVRGGVRHSTLEYDSVPRVRRESDGSPLSVGDGAAASAACMNTVFPEDDFLADVVDGPLITNVDSAGNVIANGTGNSYVTFDPLCLAEAILGRAPSIPDASDVFLTSAEMGTGQNPLQIVDVAEETIAAYLQADFTGEMGELPVRGNFGVRVVDTEVTSNGYRGSLTIDRDGANVITGIGVDNSNLVEITANHSYTEVLPSANLVVELRDDVLLRGGIYRALSRPDPSDLGVGRSFSSSIDNDGGSTDVADVIAQVTGFGNPELDPLMSWNYDAALEWYPNEDTILAFGVYYKSFNGGFTNVGQVETFTVDGQDLQAVVTTQSVDSEESTISGFEISAAHAFSYLPGAWSGLGFRVGYNYADSDFEFEDAVFGASTIIAADGTEIERVGIVAPANVPGLSEHVASAQLYYSIGDLDLQGVYKYRSGYFQQFISTPGNLRYIDERGIYEARASYQVNDAVRVSVEAINIFDEPRVQYNPTLDNFAEVNVYGPRIYFGVRGRF

SEQ ID NO: 7242 - protein, 109 aa, Delftia acidovorans
MNTLPATISQAAKPCLSPVAVWQMLLTRLLEQHYGLTLNDTPFSDETVIKEHIDAGITLADAVNFLVEKYELVRIDHRGFSWQQQSPYISVVDILRARRSTGLLKTNVK

SEQ ID NO: 7243 - protein, 1019 aa, Delftia acidovorans
MQKTNPNKFLNISTFLGCMLFAMFSYAQTTVTGKVVDEQTEPLLGVTVLIKGSSSATTTDIDGNYTINVADAAAATIVYSYVGYATIEMPVNNQSVINVTLKEDLALLDQIVVVGYGGVKKSDITGSVSSVSSKELSAFPVLDAAQALQGRAAGVVVQSNNGGEPGAPISIQIRGNTSINASSSPLIVVDGFMGATMPQAADIESMEILKDASATAIYGSRGSNGVVLVTTKKGRNGKLVVEYNTNYSIQNTTNELDLLNADQFAAYQTQIRANNGNTTPYPQGTANTDWQDLIYTTGSTKTHQFSFSGGSDKINFYASANYFDQEGIVINSDFERITFLSNIDAQVSDKLKLGLNLFGSLGTKNGVSTQSTGSGGIGGGGDDVISLAMRYAPDQPVFNDDGTYNSGNTVGDLVDNPFAIATERVDETKEDNFRANFYGNYEIVKGLEFKTTVGLSSETNKRGTFSPSILEVTAGAVGGRAAITNARQRSFLNENYLTYKREIGKGNLTLLGGISYQKTTTEAFSASGNGFLSDSFSFYNLGNALTILPSSSSLSEVEIQSQFGRANFDWDDKYLLTATVRRDGASNFAKNEKYAIFPSAAIGWKISNEDFLKNVDAISNMKLRASYGVTGNPSISPYQSLSSYADLYAASNGQTVSAATPDQPANPDLKWESSYQTNIGLDVGLLKNRFILSLDYYNIDTKDIILANNGIPEYFGYLNDGILTNLGEVNNKGFELALTSRNISNENFSWTTNFNISFNKNKVVALINDADVFADGTPSYFSHDQSTILRVGEEVGLFWGYDYAGVYQGGALPAGTATLAGGVAGDPLFRDIDNSGDITEEDRTTIGNPNPDYTFGFTNNFSYKDFDLSIFFQGSQGGDIFNLTNVQLVNGDANTTVDNFNNAWTPSNTETNVPRVGNNSNREISSRFVEDGSYIRLKNVALGYNVPADFLTKLRLERLRLSVSAQNLLTITDYSGLDPEASYFGGGGVNNAKRNTIRGFDFGNYPTSRTVTFSLSATF

SEQ ID NO: 7244 - protein, 354 aa, Delftia acidovorans
MTRQIIARAGGALLALAGTAAHAQSSVTLYGIVDTGVEYVNRVAQGASKGSVVREQSGNLAGSRWGLKGSEDLGGGYKAMMTLEGGFNSDTGTLGQSGRLFGRKAFVGLATPSGTLTLGRHQNLLYELMFKYDPLTFNPSYSAQSMDSQFVNRADNSVRYGLNLGGVTFAALYSAGFDAAIQNGGEVPGASKVGREMSAAILYDQGPFSVGVTYDQLQGTSIATQSNTQQRTLLGLSYQIGPVKALAGLRWLNTRNTDAPPSSWLYWGGMTWQVNAPLSISASVYHTHFRESNGGPTMGALLVDYALSKRTDVYAEGAYVANRSTTNVGIRGTGVDVVAGMNQAGVTVGIRHLF

SEQ ID NO: 7245 - protein, 735 aa, Agrobacterium tumefaciens
MTKMHSTALRNAVAFAVFTLGSGAAFAADESLGTVTGTAGAANNFFGSAPAGNVGQTPSEDLKKIQRFKKGATNAETLITKGQFDLITPTDSYTQALRNMPNTLVVSGGDSMDGDDIYINGFGKNLINFTLDGIPLNDNDSYTFYSNEFIPSRLISGTRYYPGAESAAIPGLSSFGGSVETYSLQPSPYPFVRPLAGVGSFGKYNAGGLINTGLFLRNIAPTSAWVYFNKNQRDGYFQNNPAVQNQFLFKSVSQIGPGQLTLFFSQNNQRFNYYNGATAAQIAQYGRDYNSNTDQPFLANGKPNTAYTGYNYNQYLNWLSYAKYKAQFSSVKFSNQFYYYYGNGFSAGASTFSQTVLAPNGSIIHAAPPSNGVLQRHSVNQTDRWGNILRMRFPLGPVATELGFWFNHNDTTHDSQYYNGNTYVGSSYLEPVVTDTYEPYVALTYQPMDSLKFSAGVKYLYATRDFRDDTALAQGKPGQFNATFRSLLPSLGVNYRILDNWHIYANFTQNSNPPGYNQFYTGTYNASLNPQKANTYDIGTVWDTGVWSGALDLFRVDFQNYILSTTVVLPGSAINQTVLANAGTAINQGISWQNNFVINDIFSAYANFGFLDARLKSAGKPFPYAPHHTEAAGLIVRYRGFRGSIGVNEIGNAYYALGGGFLPLGSRFYTDASLRYTFRNAPLGRSLGFKSVSAGLYLNNLFDRSYIQSYTGSSGNPNRKLNLPTNVYASLEATF

SEQ ID NO: 7246 - protein, 789 aa, Agrobacterium tumefaciens
MRGLASAFQPCLPPGVRSTMPAFSSTTSARSSAPRRTRLLTLLIALSTAQQAHALANETPRPFHIGRAPLEHVLLEIARVSGQHVSFASNLVQERWAGPIDGTMSAREAAGRALQGSGLTLASLPDGTLTVVAADVSAPPLNVGTLAATEVHGSTDDGFAVFSTGGITRVETAMSNMPHAIDTVSSGLLASRQPPSLADAVNQVGVVPVVVDQAAPPQYAIRGFMTDTISVDGLPDRIASMRPLEALDEIAVIKGPNADVAGVTMAGGTISASLKTPGIVPERSIAVEAGSHAERKVIADLGGAIGTNGLTYRVIGVQDSSANSDAGYIGHRVSYGHAALGWSDSATEVTVGVESLASRQPVQPATFALNGAPVRLASESPLGNTDDDVRGHAERFYYKLSHNLTDDWAVHSRWSYENVRLQSAQWHLVPTADGSVPMPTVGMGYRSDNRVWALSNDLAGTVRQGPLTHSLVLGWDEIQDRLDFHYPGAVDLGLQNPYAPVPLPATAFVPGLSLSQTVRQSVFRLRDRIAIGERWEISGSIRANDYTAKLPHAKLQGLAWTPALGVVYKLDARTSWFADYSHGFQINTGYFYNGATMQPERSQQLETGLRWEDRQRKLTAQAALYRITANHVGVADTSHPGYYTEIPEQSSDGIELSLQGSLARGWETSLWVTAAHIKRGLPGNPSFTAPGMGGSMWTTYTVQGGTLAGAGAGVGVTAQRWIPCFDGTAFRVPGFVQVDGSLFWHRKQWRIDLLARNLFNVRAYGNTVSSSFIPILPGRTLTLRVTRHF

SEQ ID NO: 7247 - protein, 436 aa, Agrobacterium tumefaciens
MSISRKCLAAGVALAALVAASQASAAAFYLQEQSVRGAGRAYSGEVADRGAASLWWNPASIAGLEQNEIYGGLHVIQVDSQVDDHGSTLTRPIPPAGLTTPVGGEPRAGGPINNGIVPNFAGAFRVNDKLALGLTVAAPYNFTTDYNSRSWTRYDALKSNLTTIDVNGSVAYRINDMFDVGVGVSAQYTDAELTSALPNLSPLLPDGSSSLKGEGNWDYGWNVGAQFHPSSNLTIGASYRSQIKHELDGKVVVSGLLGPLAGANVNTTGVAKITTPWMANLGARWKMDDKVTLNASVSRIGWSEFDKIVVTYAGGGSVSQQNYKDTTTVAFGIDYDVNDKLTLRGGVQLDPTPTPDVGRTARVPDGDRTLYAIGATGQITPTLKLDAALSYISFKDTQINRQETIYAGTPAATALNLQGDVSGSAVVISTGLRWSF

SEQ ID NO: 7248 - protein, 383 aa, Shewanella benthica KT99
MTKKLVLGATVAASLIAPLAHAQNSVTLYGLIDAGLMYTNNVRKGSSQGALIQATSGNINGSQFGLRGNEDLGGGLHAVFVLENGFNLQNGKLGQNNRLFGRQAYVGIDSTQYGTLTLGRQYDSGVDFVAPLSEVASSFGKTGFSHPFDNDNLDYSVRINNAVKFNSHSIAGLKFGGLYAFSNSTDFSSNRVYSVGASYGQGPLNLAASYLQINGSNSANTSGAIDTAESTANGTAGFQLGADVQRVAAAGVNYAFGPAVLGFVYSHSQYQGTKSFGSAGGTVRFDNFEVNGRYALTPALKAGVAYVYTDGHVSRTTTYGTDPKWNQVNAQLIYSLSKRTDVYAEGMYQHVSGKQYVAFVNTSGGASSSANQVVGTVGLRTRF

SEQ ID NO: 7249 - protein, 771 aa, Shewanella benthica KT99
MRKVSLLTAMLLGTSSLAHAQTATPAGAAEPVAEIQEIIVTAQKRAQRISDVPMSISAYDSELLSQIGATELNRVAQITPGLVIQLQDRLLPGISLRGITSDDTSPASEPRVALFQDGIPITQIASAYAEMFDVDRVEVEKGPQSTLHGRSALNGGVSVFQKLPTPELGAEFKTGIGTYGYRQVQGVVNVPLSDYFGVRAGALVHKQNGYVKDAESDNSYNKIDARAYRLTASYNPEGDFSFDFAGTYDKDDTDSGGAFKSGLFLPLNQQTGAVEGDLNFWSPTHIGTFGQMPAAYTDREVLGLSGTARLEINDNLSLTSVSGYRWYSACQAGDIDGTPTNIIAYEQCNGGRQYSEEVRLNISDVGPFEGFIGAGYFKAENDLSVDLGSDERAMALLLTGNLQRYAPKGLTNNQIISALGSKAANYKAFHLDRKVQTADIQTYDVFADGTWHITEQLETFVGGRVTWDEKDVSLLANTPLGVSKLTGKGLLITSTPGGVAVTGDHSSTLVTGRVGVRYALTPSVNLYAVHGVGKRPDVVELTSSGRTDLVPEEKLSSSEAGVKYRLFNGRLQGDASVYHYTYSNFQTKQRVDGVLTSVNAGDASATGFETQVSWQIIPDLSVLGTYAYNHARFDNGAYEGNQFRNSPDHKFAIGLNATADVPFGTVAFAPFYSWQSRVFFSDDNDRTDLQVRTPAAYSDTKVDEVQKAYGLLNAKLSFAPESGPWSIDLVGENLLDRKFIVDAGNTGDSFGMPTFVSGTRRTVRVDLNVKF

SEQ ID NO: 7250 - protein, 284 aa, Shewanella benthica KT99
MGTFIEKCFGFYQVRKELEARISGLEDENAELFAENEKLALGTSELKDANNQLRQKNDKLFTTKENLTQEKTELTEKNKVLTTEKGNLDNQLNASQKQVQALEQSQQVLENEKVELTNKITDLSKEKENLTKANTELKTENDKLNHQVIALTKEQDSLKQERAQLQDAHGFLEELCANLEKDNQHLTDKLKKLESAQKNLENSNDQLLQAIENIAEEKTELEREIARLKSLEATDKSELDLQNCRFKSAIEDLKRQNRKLEEENIALKERAYGLKEQPSKQPKP

SEQ ID NO: 7251 - protein, 484 aa, Shewanella benthica KT99
MMRYQRVTGATLGLALMASAAPGWAADEQETPPTPDNPSYAAQVQSIPSVEKPIKGQAGASGLFEGQSLTLTTRNFYSRENMKDSFTFRIPKAGGGSQRIHQRNAWVQGTVLKYSSGYTQGSIGFGFDVAAFNEIALERGKGRIGGGGNRTLANSDGEAIGEWSKLGVANIRLRASNTEFKAGRFLVNTPVFSYIDNRALPSSFTGFAVTSEELDNLSLQAGSFRKVSPRTGSGDEDMTTEYGTRQVKGDRLNYLGGNYKPLDGLEISLYGSHFQDVWNQYYLGVTHDIGDLENGIALRTAFNGYHTGDTGAREAGYIDNDTWSLAFTLGHRAHALTLAYQQVDGNEYFDYVHETSAIFLANSMLADYNSPNEKSAQIRYETDWSYYGVPGLSTGVWYVKGWDIDGTHYDGDRNGAYGNYAEVRAQDGEKHHELGLMAAYKVQNGPIKDSTFKLTYMMHKASQNQVDGSVNELRLVSTFPFNLL

SEQ ID NO: 7252 - protein, 454 aa, Shewanella benthica KT99
MRFNKKNPACAASLTLALGISTAAVAADDDEGFLEGSRFKVLNRNIYFSQDFRNGDSALNPQTGEKKTRRSEWAHGVIATFESGFTPGPIGFGLDVRGQFGIKLDGGDGLVGNGMAGNGIVPRRGYNFDGSPKDEFGRLDVALKMRLFDDTELRYGDVRPLTPVVNTSDIRLLPQSFRGGTVMNTSIEGLTLQAGKLESNADRTATAHNGDLGTAYGGRFKESDDFVYFGADYQVNDRLLLRLHHGRLDDVWNQAFLGVEWNQPLREGLKLRAGGKYYRTRDTGKSLMGDINNDSWSAHVGLDVGAHSFTVARTHIDGDTPFDYVWNTWDFYLDTFSQSSDFNNPNERVWMARYDYDFAGIGIPGLSFTTRYMRGTDIDGTKAGPHYAAYQNIRDGRHWENDVWLGYVVQSGPAKDMTFRIWHATHRVYGDHTAEANLDELRLIFEYPLDFRLF

SEQ ID NO: 7253 - protein, 854 aa, Shewanella benthica KT99
MGDAQAGPTLKRGRDVDSAFFRLAALAGGLLAGGLLAGGGLGAAAQAQQLRTPNLATADGPVSVEVGGIPFVNQGLQGAARLPAATRDFLGDTLGSFSSLAIDLETWRRRGDTYAGTLYTLPDRGYNNPDGGLFSDYAGRLNRFSLTFAPYAGPALPQSPGSQRQITLAQDGGIVLTDAKGQRFSGLDPGAGTTTQLGAVLPSAASGPSAGRISLDAEGLVRKLDGSFYVSDEYGPNIYYFDRDGRLQGVLGIPAALKPVTGGALNFNSVTAPDTGRRNNQGLEAVALTPDGRGLVTILQSATMQDSGPSQQQRTNTRILVYDVSANPTPAAPARAYVLQLPTYQQSGNGGAPNRTAAQSEMLALNDTQFLVLSRDSNGLGTGATTPIVYKSVLLVDVAGATNVAGTAYDGTAPLAPGGTLAPGITPVHTTELVNMLNPTQLGRFGMNLSTNPATPTTLSEKWEAMGLVPVLSEKAPNDYFLLVGNDNDFLTRRGQINGQPYDAGLDNDSVILAYRLTLPTYVDPLSLAVMRRTAPVVLQGLGAGALSVAAAAVRGPADHLAALRRGSRSPEAGAGPWGAGSGVWIGGDVVFADSPRNGGLASDRTLAQGSAGFDLPLTGPWRAGLAVGGGGGRLDRPGGFRQDQAGFTASAYAGYFGPGFYAQGILGGAPFLDFTGLRRPAAYGLTAEGRTGGSGFALDGEAGLPLDVGALRATPFAGITYLSATVDGFTETGAAGNNVAYAALTARQTTARFGAELAYHGFGGGFVPSLRVAYSLAAGPQQASASVRLASVQHALAAATLPVAFARRDVVGAGIGLQGNLTERLGWRLDYQASLGTRAGIAHGVTAGLRYQF

SEQ ID NO: 7254 - protein, 743 aa, Shewanella benthica KT99
MKNKHSQPALTGFKYSAFTLAISAALPISMANAEEITELATAKASAQTEESYKVDESTSVKYTQPLLDTAKSISVIPQSVMKDRNVDSLRDALRNVPGISMAAGEGGTPTGDSMSIRGFSTQNDIMIDSVRDIAGYTRDTYNVEAIEVAKGPGSAVYGRGATGGSINLQTKTAKLDEFADVSLRLGSESDHRAQLDVNKTLGATSALRVNVLSDAGDVAGRDEVNNATKAVALSFATGIGTDSRLSVNADFQTQDNLPDYGIPWVSNSATSDPVAELADSEGGAPPVEFSNFYGNVYRDFEDIKAQSLTVKYEKDLNASTTLRVLGRTGSVSRESVVTAPRFISLTTSTDVRLNDEKTRDTRDSLNVVQVDLLGQYQLGGVTHDIVAGFEMGKEKFERGVYDDNGTDNLDTTPELNDLYNPNPRVNYEGTYTSLGKDDKATGDTTSIYAFDTLTLNPNWEVSVGLRYDIFETEYFYDLSGDDPSVKVGTEDSQLSWNLGVVYKPAENGSVYFGAGNSFNPMAEDLTANTRTDSNMHNLDPEKTTSYEVGTKWELLDSKLFVSGALFRTDKTNTLTDDPFFTADSEQSRYDTLNGHQRVDGLELSAVGQVSDQLSITAGYTFQKSEVLNAEGDDEVDQEGNALPRTPEHSFSLWGRYDVNEKLAFGLGSQYLGERYNSTSTTGREKANDYQIFDLMVSYQISDAWAVQLNAENLTDESYIDQLGGGHFIPGDGRYVSVKTSFSF

SEQ ID NO: 7255 - protein, 1034 aa, Shewanella benthica KT99
MKKQLQCTCLLLYAAASTFATPVMAKTFNTNHPVLVSAAAFPVQQDVIKGTVKDASGETLIGVSVLVKGTKTGTQTDGTGQFSLNAKPGSVLVFTYIGYKTQEVTVGTSATVNVTLAADDQQLSEVVVTALGIKRSEKSLTYATQQVGGDELTRVKSDNMMNSLNGKIAGITISPSASGVGGSAKVILRGNRSFSGNNQPLYVIDGVPISNSPNKAEQPNSPYGGSTNVDGGDGISNLNPDDIESMSVLKGASASALYGSQAANGVILITTKRGKAGKMQVNFNSSLTTDQIVSKPEFQNTYGRTTSSSIQSWGDKITTGSKDNLDEFYQTGTNLTNAINLSGGTENAQTYFSYANTNARGVQPGNKLDRHNFNLRETAKFFDNKLTVDGSVNYTAQNIDNSPGLGYYFNPLTGLYLFPRGLDITPYKENYELADQVGYARQNWIANQDLQQNPWWITNRNLNNSKRNRMLVNGSVKYDFNKYLNIQVRGTLDRITDSYDQKLYSGTQATLSRPNGQYILNNQTMEQKYADALLNFNIPLSADFKLDGVLGTSITDNKTVGTNIGSGLGLNIPNLFTAQNTLIAGTVSNVTTLAPRHSQLQSIFANANLSYKDWAFLTVTGRSDWSSNLAFTPTQSYFYPSVGLSFLLKQMVELPDVISYAKIRGTYAQVGNTVPPYVTNVVNYLDPNNGSIVLNPVAPFPSLKPEKTNTFEGGLDLRMFDNKLNFAFTYYKSNTTNQFIEIVPVASTGYTKGYINGGEVQNTGFEVTLGYDVIKNDKFQWTTGLNAARNKNKVIDVSSANGIDRATLTANSNTNYESRLVNGGSFGDIYGVVTKKDAQGRIIVNADGSPQIDNEGFRYLGNANPKFSMGWSNNFNYGNFSLSFLIDGKFGGQVLSATQALMDEYGVSKVTGDARNAGGVTINGVDVNGNAVTSVDPQVWYSSVGGKAGVSEQYIYSATVVRLREAALGYGFPVKNSVVKNLRLSLTGRNIFYFYKKAPYDPEVTMSTGNGLSGVDIFNQPATRNIGFSLNVTL

SEQ ID NO: 7256 - protein, 633 aa, Hoeflea phototrophica DFL-43
MAGRSVSGVAAIRMARLLASISFAALLLPSQAAFAQTAPSSAPSAGALQQSITFAIPPQSLSSGIVAFSRAAGIDLVFDGAVPRGARTSGVSGTFTVRDGVNRLLAGTGLSARFTNARTVQIVNPSAAGGVSGAAPSGAISLDTIDVQGETAWGPANGFVASRSATATKTDTPIIEVPQSISVVTRDQIEIRRNQTLNETLQYTPGVFAESSGMQHSGPTFQIRGFSAVPADGPIFLNGLRTINNGDIEPFGLERIEVMRGPASVLYGQNQPSGVIALVTKRPTEGPVHEVQLRGGSFGQKSGAFDFGGPVTEDRTLLYRFTGLLREGGNGIDFSNDQRAFVSGAVTWRPTDATELTAFSLFQKDKGRWNYGLPAQGTALPNPNGRIPVTRFIGEPDLDYNVTERAVVGYNLQHRATESLTFRQNLQYARENWDYRNATPIGLQADLRTLDRSYETLRASWDTFAIDNQAELKTTTGVLHHTVLFGVDYRWRRYNSLGLWGGVASPIDVFAPVYGQPVLISADNYGSRQTQNFPGIYLQDQIKLDRWILTFGGRHDWAESKTVNAFSAAVTNQNDRAFTRRAGLGYEFDSGVVPYVSYSESFMPVSGTTFDQVPFRPKPERSTRQASNTSRMI

SEQ ID NO: 7257 - protein, 1023 aa, Hoeflea phototrophica DFL-43
MAASPLMAQQGRTVRGTILEETSGEPLPGVSILEKGTTNGTVTDLDGNFALTLASVDATLRVSFIGYKTQEILVDNRTEINLQMVSDLGNLDEVIVIGYGEQQKETITGAVANVTSRDIDKVPSATVSGALAGKMAGLSFRQPDGRPGAGAWLQIRNMGTPLFVIDGIQKDEGQFNNLAPGDIESITILKDASAAVYGSRAANGVVLVKTKQGKRGETPTININGYYGWQNWSRFPEGVDAYEWMLGKADADINQFGSTNITAEELEKWNQGTEYGYKSFDWQDFIIKGNAPQSNFNASVSGGSERTNYYLSVTRFDQKAVFSDEFEFNRTNIQSNITTDITNKLKVGMQINGRIENRNNPGVPGGDDYWQPRFALFRNRPTERPYANDNPDYPANINNIETNWALLNYDRTGFYENKWQVLQTNFTAEYEIIPGLTAKGLYSYYLADNMFNTFEYTYDVFGYNPESDEYFRSGGNDNPYRDRGQTKIMENVWQLSLSYNKTFGEKHNFSAFALNERIDRTRLYNFLHSVPTNNYLDIIKFADTDTYNDERQVEARIGYVGRINYDYAGKYLLELAGRADASWKFSPDNRWGFFPSVSAGWRISEEEFMSEFSSKLDMDELKIRASYGQLGDDNIGIGPFDYLTGYRYGVSTVIVDGENIQGSANTGQPIDNLSWYVASIADIGLDFSFGSGKITGAVDYFHRKRTGLRGVRNDIFLPLELGYGLTDENLNSDSNSGAEIALNWNGKAGDLVFRVGVNASYARSKFLQSYNPTFSSSWDRYRNSREDRYNGIFWGYEIEGQFESFEAINDHPVNIDGQGNKTLLPGDLIYKDVNQDGKIDGYDERPIGYQSGGQPSLNFGLNFNFQYKGFDLTADFSGGGMYSYNQNWEMRWPYQNGGNLLASMYDDRYHREDILDINSPWVAGKNPSLRFNTGGHSNYNRNSTWWLTNVKYLRMRTLEVGYTLPERMLNKWNMSRARLFVSSYNLFALDNVHQFGIDPEVADENGLQYPQNKVVNVGFNVSF

SEQ ID NO: 7258 - protein, 83 aa, Hoeflea phototrophica DFL-43
MESTKMKTSVRIGAFEIDDGELHGESPGDRTLTIPCKSDPDLCMQLDAWDAETSIPALLNGEHSVLYRTRYDQQSDAWIMRLA

SEQ ID NO: 7259 - protein, 704 aa, Shewanella benthica KT99
MSFKLKTTVLAMGLAGLSSAWAQNNALPEVKVSAETESSSGTVPYAGGQVSRQGTLGVLGTNDVMDIPFSTVNFTSTLLENQQARTLKDVLENDASVRVLTGTGGFGEDFQIRGFNVPSGDVGLNGLYGLVSSSRLPIEILERVELLKGPGALVNGIAPNGSVGGGINVVTKRADDIPLTRLETSIQSEGQVGAHLDIGRRFGENNEWGVRFNGVLRDGEGSIKNGDAALGLAAIGLDYRGRQLRWSLDAFEQREDIEELRPQIGIPATLSAVPAPPPGDLNFYPGNPLELQDTTVASKFEYDINEHVTTYGGLGYRQGDATQVFPVTGGDLDEQGNFTVRGTFFDSYSKTSSMDAGVRLKFNTASVKHTVNVGVSLLEQENGNVFVSGGANVPSNIYNPTPLPPVGQPRRGPAKASESTLFSYVLSDTMAFMDDRLLLTLGARDQTVEQDGFNTTTGAVTSSYNASSISPLVGVVFKATPSTSIYSNYTEGLTRGTIVGPAFANAGEVLAPFKSPQFEIGVKKDWGRITTTAAVFEISRPNLQTNAATNTSNYDGEQRNRGLELGAYGEVFPGLRGMASALFNDAELSSTAGGVNQGNEAPSVPRQTFSLGLDYDLPWLPKASVNGRIINTSEMAVNAANNLSVAGWTRYDIGAQYRTSLGNKPLILRANIENLTDENYWLVSGTFASVAAPRTFIVSASVDF

SEQ ID NO: 7260 - protein, 250 aa, Shewanella benthica KT99
MNNKWIFATLLLTPQAFAGDIIHWWDVSLSALYGENYDLAPSEKQTTLTFETAGGWKYGDWFAFQDFTYFNGSNVGKEQTTYGEITTRFSAGKIFDTKVGFGPVTDLSLALSLEEGEGPVKSFLYGIGSDIDIPYFSFFSLNLYRRSAISDDNISDGWQASPSFKIEFPVGNSSIVFDGYVDWVFAVDDANYSTGVHVNPQLKYDLGAAIMGEGNKGHLYVGIEYDYWKNKYGVEGIDQNTYSFIVKYHL

SEQ ID NO: 7261 - protein, 434 aa, Shewanella benthica KT99
MDAPYGRIPTDLFTSEPDLDHFKRDQFLAGYEFEHRFSDAWTVRQNLRYGHLEIDFQNYYGVGYAGDPADAQLARGNFVTVPEADLFTLDNQVQARFETGPLVHRVLLGIDYKHYRIADEQGYEAGTPLDLRNPVYGSYAPPESRYTLNETAQDQLGVYLQDQIQLATRWNLVLSGRHDWVSTDLENQLLPDASYDGSVKSFSGRAGLIYTFDSGFAPYVSYARSFNPVAGTNAAGELFEPETGQQVEAGLKIQPDGMESTLGLSVFELRRQNFVTTDGAFNQLQIGEVRSRGAELEVITQLLPGLSVIGSASLYGLEITDGADFETGKTPVGVPELMASLWVDYTFQQGALVGFGAGAGVRSVGRSFADRANALEVPGFTLVDLGLHYQRSHWRAAINVANLLDDEYVSSCSSESACFYGDQRRAALNVGYTW

SEQ ID NO: 7262 - protein, 404 aa, Shewanella benthica KT99
MADTFVKRSALALAAFGLSMGAHAQSSVTLYGTVDAGLIYTSNQQTTLANGSTNGHANYQLGGGNLVPSRWGLMGTEDIGGGTTVNFALENSFLIGSGAMLQSNTLFNRNAWVGVNNATYGALTFGRQYDPFSDYMGAYASSNNWATLYGSHFGDVDNLNEAFNFNNSIKYISPSFGGFTVGGLFSLGGVAGNFSQNKGWALAANYAQGPLSLSAGYLELNQPLQAALGGTSSYIGDFSCANADASYCLLQDASKVRIFGAGGSYSFGKANVAVTYTHTRLSQSQYFASAARPGGADVSFDIAELNTTYALAPDLQLGLAYIFNDVKPSGSGSTRVHQINLGAVYSLSKRTAVYAVAIGQKSSGAGLGVDAVTGASENLAQIPNVVNSDTDRQVSVVVGLRHNF

SEQ ID NO: 7263 - protein, 341 aa, Hoeflea phototrophica DFL-43
MRIRGYTCAAALMLSISGLSVAEEASVDQARDALAKKNDDADSAKALEEVFQAAEKSYTLLKKGERTLTYGFDYALVRDQRLTLVPLTKTSGGTQIYGLAGRQSQSQHTFTNSFTFDYGIWDNLTFSFRLPLVAKYDTEMDTHAYSLGDVSATLRWQPWAAVRGRPVTTLYTTIGLPTGDSPYKTNLDKDISTGNGYYSLGFGANMSYVIDPVVLYGSLGYTWNLPVDDVHQTLADNSQLEKVSPGNTINFNMGMAYALSYDVSLATSYQMAYTLKNRYHTTAGTFESSEQTSSIMNFSLGLRTSPDYIVNVNAGFGLTEDSPDVLLGLSVPLDIKGLKAQ

SEQ ID NO: 7264 - protein, 822 aa, Shewanella benthica KT99
MKLNSGRSVLLAFVSTSALMSAPLAFAQEATPAEDAADIGEIVVTGTRAIGRTRLDTIAPVDVITGETLTRSGTGTETAAALAAAAPSINFPRPAISDGSDHVRPATLRGLAPDQTLVLINGQRGHVGALVNVNGALGRGSTAFDLNTIPSVALGSVEVLRDGASAQYGSDAIAGVINLRLRQARDGGGLTLNHGRYDTEYDTARGSHEATDGEQTSLAGWIGLPLGEDGFVTVSGELQKRDPTNRSDYAAPSAVVGNTSTNTVLGRFGDPAVESQSLWFNAGKPINADWETYAFGGIQHKESESGATARAYNNANNVLAIYPNGFLPLINTQIVDYNLYGGVKGEAAGIDWDVSVGYGRNVLDYRVTNSLNASYGAASQQEFEAGGLKYDQLTLGVDGVRPLEFGLIEPVNLAFGVEYRTERFEVYAGEPASYNRGPSAGGGGAQGFPGFSPANAADEDRNNWSAYVDLEGKLTQGLTVGVAGRYEDYSDFGDQFTGKVSARYDFSPAFALRGAVSTGFHAPALQQQYFSYTATNLVTQLIGGLPVTSLIQAGTFRVDDPVALALGSKPLEPETSVNYSVGAVFRSGGFELTIDAYQIELEDRIIYSESLGTTRPSQSAATTTAVQTLLAPFGVSAARFFLNGVDTTTKGIDVVGRYRLPTDTLGRFDFTLAGNYNETTVDKTPETPSIGIPTSDFFLFDRSNILAFEEGTPKTKVVGGIDWSLGGFGVSAKATYYASVLVANNAASLDYETGDKTLIDLEGRYQFPYGVGLAVGVNNLFDEYPEYTPAALNGATGSVGFPSYSPFGFNGRFLYARLSYSF

SEQ ID NO: 7265 - protein, 608 aa, Shewanella benthica KT99
MSKTVRTFLSGASVALGATVAFSGTAQANTELLDQINSYSQDDIAQVNSVFQLSDVSPSDWAFDALRNLVENYNCIVGYPDGTFRGSRPLSRYEFAAGLNACLQQIERMIQSGTSEVTPEDLAALRRLVNEFEAELATLGARVDDLEGRVEFLEDNQFSTTTKLGGEVIFNLGGAFGEEKASPLALDSIEFPGGDFDPETVTFEELFDVVDYQDISSEERELLKEFFVGLGIDEDALGFSFGLGDDGDLQDFFTGLADNDDIDDEITFSNRVRLNLDTSFTGKDRLRTRLEAGNITAFDDATGVDSARLGFDTDNGNDVEIGKLFYRFPVGDNVTAYVGAVGMGIDDIFDATSPYFESSGSGALSRFGRFNPIYRGPDGAGAGFNFDLGERFTFSAAYLADDGDVNNPEEKNGLFNGNYTAGAQLDFKPADDIMFSAFYANRYQKAGDVNLSGSTGSVIANDPTFNSLAVSSNNFGLQGSWLIGDKFNLGGWVGYTTADIEDPNVTGNFDVWNWAVNAALLDVGGEGNVLGLIFGQTPKLTSGNIDFGQIEVNYNDDSDSSYLAELQYRYKLNDNITITPGAYVVFNPNQNDDNDTVVVGSVRTTFSF

SEQ ID NO: 7266 - protein, 1341 aa, Hoeflea phototrophica DFL-43
MIRGIARRPRCAVEGDWMSAGFCHVSEGKACPTAEMRGVALGRFLICGATGLSFLTLSLAAVSDAVAETLLWTGPDGAEWFTDAAWGPSHRVPNAGDDAMINTYGPVITIGTNAEVHQLSIGNAPGDGTLVVQGGLQTNSVILGATGGSSGTASFIGANWANDGDVSVGGNGTGSLLLLHGTTASSENIYVGESGTGSGSLKLDNSSTLTVADTVFAGYNSWSSSAAGGSGNVEVLGASSLYSANGVLANDPDTVGTALVSGGGSSWNMSSDLVVGEAGVGTLTITGGGMVISQTTTVIADLNSADGSSVTVSRLGSSLQSDSLVVGNGGAAKLVVEAAATVTSGEAIIGRHSASEATVTGDGSKWTTGDLQVGGDTSDPGGLAGNGTLNVTAGGSVDSTVAHLGVVAGATGSAIVDGKGSVWTVDRNSLEVGVSGAGSLAVTGGGLVDAANIIIGTNTGGNGSVRVSGADSTVKSRSDLNVGLYGNGSMTVEAGGAVKSRDGYVATYGGSTSAVTVTGDGSSWAMTGTFFVGYASGATGNVTVSNGGAIRATGVTLGDLAGASGTMTITGAGSKVTAYVDNGTVNSGSVDVGFQGSGSLSVVNGGSLDAYNLYVGNALGSSGAVLVSGVGSHVSVDGLMVVGNAGNGSVEITGGASLAAPTILIATEAGSTGVLSIGAGSGQTARSAGAVEARAIAFGAGNGSIVFNHSETGYTLSADISGAGRVVAEAGVTTLSGNNSYSGGTTISAGMLKGTAKSFGSGGIVNNAELVVDGGGTLSNAISGTGSFEKTGDGNLLLTGNSTYSGATAVSAGKLSVNGSLASAVSVGSGATVGGTGTIGGLTVNSGGTLAPGNSIGTLTSTGNATFASGSTYAVEIDADGSSDRLAVTGTITIANDVSLIVTPLGAHSAYSLGTRYTILTATGGVTGTFSSVDESFAYLTAKVAQSGDDATTYLSFLRTSPDSGLLAAATSTANARAAANAVEALGQTSPLYEAALFLQQGETQGAFSQLAGEIHPSLAMALINRSGQSRDVILNRLRSAFEGVDARPILPVAYAEGGQNPFAVDDGALSFWSSGFRSRGRIDSDGNGSSVDMNGGGILFGLDGELSDSWRAGVAAGYGHDGIKQTALAASADVDSYYLAAYAGTQIGPASLRLGAIHAFQDAETRRSISFSTLQESLSASYGGSTSQVFAEAAWRFDFDLTHIEPYANIAYVNTRTDGFQEKGAIAAVSSGSTRYDQLYTTFGARISRDIALEGMLGRAMFDLAWRHNYGDTAMGSSLFYEGGGVFSVASTSSPRDAAILNLGLSYDLTPSATLTFRYGAVFGAGVLDQSAAAELGVRF

SEQ ID NO: 7267 - protein, 1157 aa, Shewanella benthica KT99
MKTQRNQPPLAVGQNRRRLTVFALLFVLAAFPVWAQIDRGTIQGLVKDPSGAVVPGAKVQVVRIDTNSAIELVTNGEGLFTAPNLPAAAYRVVVEKPGFGTFRREPVEVLPRAQASVDVVLQPGGVNESVTVSTEAPILDTAAVNNSAGFNDKMIEDLPLIVVGTKRDITGFLDNLPGANNTNTFIPTVNGSTTGATEAFIDGARASERIQKGSLSENGPFLEQVGEVNVVSGAFNAEYGGFGSWFTNVIIKSGTNALHGSVFDHLGNDKLNARSFFAKDRTPYRQNEGGFTLGGPVVIPHLYNGRNKTFFFGSLGLFYSRQGAAGLLATVPTPAMLSGDFSGLTAANGSQIPIFDPTTTQPDGKGGFVRQQFPGNIIPANRITQMAKIVSSYIPAPSLPGQLNNFYDHRATTWPYYNTTTPLIKIDHSISDKQKLMFSYTHQTRPRLLWGNPAPGLGPQPAWGEVQTNPLDQIYDQQDTSWKVRLSHDYIISPTLVNHITIGIDREFNIGPNGTDGQAWDTKLGITGIPQDNGAFPALTFSGGTAAPAAMGRGYDVKFYALDYTFIENLSWIRGKHSFKTGVEIDRDRINQLQLNSIQGSFNFSNAMTSQPNSSSFGSWGSSVASFLLGAVNTAGAFIPAETGLRDFRVGAFVQDEWRATPKLTISYGLRWDYNPTFSEVQNKMSSFEPYIANPGAGGRLGALAFAGQSGLPGKFFSTDWKKGFGPRFGIAYQINSKTVIRTSAGIYYQNAPEQLITTPFHAGFNSSPTFSSADGYTPLYFINAGSFPQNFQRPPSTDPSFLNGQSISYLSPNATRLPQDVNWTFSIQRELARNLSLEAVYLGRRSTHLAFAANYDYLPIDNLKYGSLLLQPINSAAASTGGFTSPYPQFVNQLGANTVYQSLRPYPQYTSVLASPGEGSGQQKFNSLQLKATKRLSGGLTMFGYFTWAKSFSLATAQYPGSRFMQLDPNPAASFSFSWTYDLPLGKGKHFLNGVARPVNAVVSGWKINGFVKYNSGIPLTITAAAGNLGAIGYTQWGNAVQGVSPYITTSPGDFTPSSKYLNAAAFTTSTGFNFGNLNPNLSWVRGFWFKEENLTLGRVFALKEKVKLDFSMDFVNPFNFHRWGAPNTSLTSAAFGTVSSVSAGRTVQANAAIRF

SEQ ID NO: 7268 - protein, 148 aa, Shewanella benthica KT99
WDVYTRLGGMVWRADSTRNNNGIRISDHDTGVSPLAAVGVEYALTKNWATRLDYQWVNNIGDANTVGTRPDNGMLSLGVSYRFGQDYWLFAPGPAPAPAQVVETKRFTLRSDVLFNFNKATLKPEGQQALDQLYTQLSSLDPKDGSVI

SEQ ID NO: 7269 - protein, 418 aa, Shewanella benthica KT99
MKQVISSFLCRPRFVGSAIWLLPVALSHAAEAPPFPNLLQQSLALAPAMVAQAANVRAAGADAAQAQAWLNPRIDTVLENLGAPSSDGLSQRQNTYSITQPFELGGKRGARIEVGERNFAAAQARERQAQVAYAAELAVAYATAEAALGRKILATENLARANEELAAARALVDSGKEASLRSAQAKASVAAAQAAEAAATNDATQALARLSAMSGASEPYTAVTSSLLTTQAVVPNAPAALAESPSVRAAEAERNALDAQVDVERKRWIPDVGVSAGVRRYGWTNSSGYVVGVTASIPLFDQNRNGINAAVERVAAAQARLDSVRLEANVARQSAISQVATADKQLAAASEGEQAAAEAYRMGRIGYESGKTPLMELLAVRRALVDARQLTIDARLARVRALAALAQADGRLAFEESR

SEQ ID NO: 7270 - protein, 420 aa, Shewanella benthica KT99
MLTAVRRSPAPARLALAVAAASLAPLAQAAFIEDSSATLQTHNIYLNRDFREGTAQSKREEWTQGFILDVQSGFTEGTVGVGLDALGMLGVKLDSGGGRAGTDLLPVQDDGGTPDEFSRLGLTAKAKIAETELRYGSHIPEMPVVKASDSRTLPQVFEGATVTSTDIDGLTLTGGRLDKVIDRSSTNSQDLQLNNKNGRFASAAEADHLTFAGAEYAFNENLTGRYYYGELDDVYRQHFFGLLANKPLSNNSALSADLRVMLSDDTGAANAGKIDNQAWNGMLGYSLGGHKFSLGYQQMRGDTGYAYIDGGDPFLVNFVQINDFANADERSWQARYDYNFAAVGIPGLTFLTRYISGDNAEYSGGNNGSEWERDFEFKYVVQSGPLKNVALRWRNAMYRSDFARDADENRLIVSYSLPIW

SEQ ID NO: 7271 - protein, 641 aa, Shewanella benthica KT99
MLAVDDDGETMVVTASSVEQNLKDAPASISVITQEDLQRKPVQNLKDVLKEVPGVQLTNEGDNRKGVSIRGLDSSYTLILVDGKRVNSRNAVFRHNDFDLNWIPVDSIERIEVVRGPMSSLYGSDALGGVVNIITKKIGQKWSGTVTVDTTVQEHRDRGDTYNGQFFTSGPLIDGVLGMKAYGSLAKREKDDPQNSTTTDTGETPRIEGFSSRDGNVEFAWTPNQNHDFTAGYGFDRQERDSDSLDKNRLERQNYSVSHNGRWDYGTSELKYYGEKVENKNPGNSSPITSESNTVDGKYTLPLTAINQFLTVGGEWRHDKLSDAVNLTGGTSSKTSASQYALFVEDEWRIFEPLALTTGVRMDDHETYGEHWSPRAYLVYNATDTVTVKGGWATAFKAPSLLQLSPDWTSNSCRGACKIVGSPELKPETSESWELGLYYMGEEGWLEGVESSVTVFRNDVKDRISISRTSDVNAAPGYQNFVGFETGANGRRIPVFSYYNVNKARIQGVETELKIPFNDEWKLSINYTYNDGRDVSNGENKPLSDLPFHTANGTLDWKPLALEDWSFYVSGHYTGQKRADSATAKTPGGYTIWNTGAAWQVTKDVKLRAGVLNLGDKDLSRDDYSYNEDGRRYFMAVDYRF

SEQ ID NO: 7272 - protein, 910 aa, Shewanella benthica KT99
MPALDPALAAKFRVHLDGTNTEPAHTLGFTGKGYMIGVVDSGVNRNHVTLHDKVVHNNVYVDYQDPASPDDVSGHGTNVAQLIAGQPVEYWPGGIAPGATIFSARVFSSAAENAKQGPIGGNFFEGEAAQLKRVNADMIAAGVRIQNNSWGYENQNTGDKQVWIDPAVTDAFVNVYRDFVLNNNGLVIFASGNYSQQQPGRLSRLPSLPTVEGGASPADLERGWLVVAALDSFDHPDQLTSYSNHCGIAMHYCLAAPGDLIEIDPNVTTSPVDGDKGYLNGYLIQNGTSFAAPLVSGAAALVWEAFPYFSNDLVRQTLLGTATDLGAPGVDEVFGYGALNVGKAVLGPAKFDWGDVQVSFDDRRSTWGNDITGSGGLIKRGTGTLVLGGSNNQYTGATQVLGGTLQASSLGASAVSVSNAATLIGSGRFGGAVSNAGTLELGKDGLKVQGDYTQLETGRLALHVGDQLSVAGNATLKGGELQVLGKRDYVTFNTSYSVLQADGSLTGTFSQLTWGPAVLLGEGRLTYGANNAYVTLQRLNVSAAAQALGIVDRVAQASAQRVEQAFRAIDAQQAQGRGALPTSFIGAAAALQQSSSAAVAAGSLQSLSGQSHVAAALVSLDAIDLGRRSLATRLDAPRSGERIVTWHQALGGPGQNGAASGTFSLSGWLVGHDAQLASGDIVGVAFGQTDTSPSGSAFGSRGIDRQVQGRVYLQRTQGPLYVLGQLGFGSFQRRLDRQLQLGDWNDWTSSRYSGQFWSGSVEAGYHWHQGTLALTPYLGLDQTQLRTDGFREQSGSGFGLQVQSAQATRSQLLAGVRTEWRWAGVQWRGYGEWQQTLRQSGLNPQASFTATSSWTPLVASSWPGRSGGVLGLSMVLPVGVTAGLWTMGLEHYFGTRSRGESLGLRYQLGF

SEQ ID NO: 7273 - protein, 315 aa, Shewanella benthica KT99
MKKTLIASAVAAATISSTTFAMDPASELAARLDSMPTVYGNIQLVQSYVNVDTGAGESSNTDFADNGSTIGFKHKHEIMPGVEGFFKAEFHFDADDQATNTGLGEKFDEAYIGVKGDFGTVLAGSEDTVYEWVDQIDLFESVGVAGDVAGMAESDTLHYYSPSFSGFTVGVTKSLEGGSEYTASVAAKYEMEALQVVLGYAINDLDGGEDVIGLSGSYKFGDFKVIGQFETQDENVDFWALGGVYTMGATQFAAAYGFADFESDEEASEITLQALHNLSDNMYVYVEYDLKTLEPAGGGDDTDVETFNVGATYAF

SEQ ID NO: 7274 - protein, 1074 aa, Shewanella benthica KT99
MTQARQKLPQNHNNNSVRTNMPVANNPNNSLIMLPFKPKALTVALCMVSFGASHTVIAQPVLPHQQAEVITQNTSPLSAIDFSIPAQSADEAIIAFANQAELTVVFPFNKVRHVFANEVSGNYTPQEAIKKLLAGTGLSAHIVDNTRIKIVPASDGDENNHLLGRLFNAITAQDDSLVTVPDEQGSYDIEYIEVRGLRARVAQSVGIKRNANVIIDTIQSVDMGKFPDQNLAEALQRVSGVSIDRAEGEGQLVTVRGFGPEFNRVLLNGRPMATDKLGREFSFDTLASEIVSSVTVHKQSQATMQSGGIGATIDVQTAKPLSFKGMRAAGSVKMQYDTNSQQYAPSTSAMFSNTYLNNSFGILASFTQHKRQARLEEAQIDGWLVNTNVPESELSEDVPTLYVPRNYDQRVRFDDRTRTGSALVLQYRPNNKLELTADYLGSTFDVETSATSMGHWFTSSNLEDVTVDKNGTAVAFSQNSGHATDFHARTFNRSSTLKSFGFAANYIASDSVIVDADLSYSMANVDDNNGEGNSLSLIGYLNRSSFDHTQSNILPAISGFEQANPRQVNALGEPVGVSHYLDPANGRSHVMLRRGWSVDDDIGQAKINVSVLGDDNWFSKIDVGGALTQREKANERRDNEADARHCSFCGYFDAPDIPDSFQTIFDAGDDFLGSISGHENIPHQWLRHDGDTLFRYLENAGDVSLAAETRGSSFAVKETVYAGYVQAAIEKDFAPWFIDVHAGLRAEYTDVKVSGVDEQLSALVILDQTELGQEFGASVSIDESSNYTNVLPSVSFKASWLDSWVFRAAYNHSITRPTLEQMAPGVTYTTTRQGGDLRARIGNAQLLPFEAKNIDVAVEHYYQENSYISAGYFRKTVDNFIVNESSTQTFNNVTDPSTGTNPNAADDADALAQFSVISPSNGESATVEGVEIAVQHLFGDSGWGIQANASFVDSNAELDTANIRSTFALTGLSGAKNMVLFYEKDALQWRVAWNQREGFLQSLNQTQSTEPTFVSPYEQWDMSLSYQFSPKVAVFFEGINITNETVHKRGRFSNHLLLVQDAGARYALGVNITY

SEQ ID NO: 7275 - protein, 316 aa, Hoeflea phototrophica DFL-43
MIIVNSFMITRISITLFLIFISCVYFFITYISNDTHIEQVQPLKLETDNNESVIRSEEVTEKEILINDLKYQELESSPIKQPSILQVANQKNMWSRIADQAEPTKEKSKKLDFYVSANGGKVYHDNSETFVKGIQEIGKRVLTLVESHYGFIIKNIVANEIKSIQQFDGKIDFQWLNSISLGYYAGENGRVDFETMYSRANIENSNSPLVFDKSASIFAFLLNFYYNPSVQDIQFAPYIGLGIGPTVFRLKRISGSPQNSMPLNVPWFAYQIKLGVDYSIIPEVKTFLGYRYFSVPIPVADDISTHNIEIGLIFNF

SEQ ID NO: 7276 - protein, 291 aa, Shewanella benthica KT99
MFTGEKKATSMWMRHIGGHNRWKDSSSQLNTQSNRYVVQLGGSIAQWTDGQDRLQQGIMAGYGNEKSSTTSSLSGYKSKGAINGYSTGLYGTWQQNDGNDNGAYVDTWIQYGWFNNTVNGEKLAAESWKSRGFTGSVEAGYTFKAGEFTGSQGSHYDWYIQPQSQITWMNVRASEHTEKNGTKVQLSGDGNIQSRLGVRTYLKGKSASDDNKAHQFEPFVEVNWIHNTRSWGVKMDNTALSQDGATNIAEVKTGVQGKLSDNLNVWGNVGVQAGDKGYSDAQAMLGIKYIF

SEQ ID NO: 7277 - protein, 321 aa, Shewanella benthica KT99
MNVFCKTLLASALASATLASAYAAEPLTVYGKLNVTAQSNDENGDATTTIQSNASRFGVKGDFELSSSLSAFYTVEYQVDTGAASSDNFTARNQFVGLKGDFGSFSVGRNDTLLKISQGDVDQFNDLSGDLGKLFKGEVRAAQTATYLTPSFGDFVFGVTYVAEGNDVKSQFAQDGFSVAAMYGDAKLKKTAVYAALAYDSDVSGYEVLRASLQAKLAGIKLGGMYQQQEQTYKLDKTTSLPVEVTAESATGYLLSAAYDINAVTLKAQFQDMEDLGDSWSVGADYNLGKPTKVFAFYTNRSLEANTDDDKYIAIGLEHKF

SEQ ID NO: 7278 - protein, 910 aa, Shewanella benthica KT99
MQQERNKDDEEAIEKITVVGSNIRGAQAAGRLPVTILDSDDIINTGAVTGDELLRSIPQVGDISFNNERSIGGVNDARGDVASINLRGIGTGNTLTLLNGRRLVLHPGTQTENFVPVTTVNSNTLPVTGLRRLEVLRDGASALYGTDAVAGVVNYVLKKEVTQTQLNLSAGNAEGTSMQQYLASGSTGVFFNDNKSHLSLSFAYYTRDEIGANERSYSASEDRRFNDRIPEAFVGDTQLDNRSLSSPWAIYDGENIGRFHIRPESMGDCFQTLSDGVCAAEGSIPRDMRYDSAQDQSMTSAIDRVNLFAYYTHSLAPNLELFGEALYYEALSKRRREQNANLTAQRFTISEDAAYNPFGETVTLRNIRPMDVDPRRIEVEDSSYRLLGGIKGYSEQWEWESALLYSRADTLDTGYNRIHVSALQEAINSTNIEEAYNPFIGGNPDNLNNGTSVYNSAEVIAGLTEDITRDSTSELAQWDFKLSNPVLTSWYAGDIGIAAGVEYRYEAYADDRHYLLDGSSPFYDQVTGELMTNSDVLGSSFTPDSEGSRNVFSAYTELLVPLHETIDMQLALRYERFNDVGSVTKPKVALSWLPMDWLQLRASYSGGFRAPNLPQVVEESVSRTNSRTDPVIDDRYSITEIRGGNSKLTPEDDEIYNVGFAITPFDNFLITVDRWTIEQENVVGILNSQTHLLYDSLLRSQGSSNPAVIRNDDLEVVYVNNQYDNLEVREISGTDISINYEVNSEAFGLFNFSLNAAHLRKFMQTPDPISAIVLEAQENGNPAVPIDIPVVGAGDLRQMDGNPKWRSFARLDWDLGNWGAGIRVNYVDDFYETSVTTSDGDMMPIDSWITTDIYLDYYFNQESLDGLSLRIGARNLADKNPPIADESFGYFSDVHSNRGRYTYATLSWAF

SEQ ID NO: 7279 - protein, 1039 aa, Shewanella benthica KT99
MMKNFLFICMLLLGLSTSALAQESIVVTGVVTDTNKEPMIGVNVSISNIPGLGAITDLNGKYSIKMPPYHKLVFTYIGFEKVEVLVKEQRTVNVTMKEASAREIDEVVITGTGAQKKLTVTGAITNVDVDVLKANPSGSMANALAGNVPGILAMQTSGKPGSVSEFWIRGISTFGASNSALVLVDGFERSLDEINVEDVESFSVLKDASATAIYGSKGANGVVLITTKHGKAGKINISAKAETFYNMLTQVPDFVDGYTYASMANEAKITRNLEPLYKADELEIFRLGLDPDLYPNVNWIDELLRKGSWSTRATLSMNGGGNTARYYVSGSYLDQQGMYKVDKALKDYNTNANFRRWNYRMNVDIDITKSTLLKVGVSGSLQKANDSGVGSDAIWTALMGYNAIMVPKLYSNGYVPAYGNDNGDRFNPWVQATMTGYRENWKNNIQTNVTLEQKLDFITKGLRFVGRFGYDTENNNWINRRKWPEQWKAKRFRATDGTLDYDRVAEERKMFQESGSDGLRNEFFEAELHYSRGFKHHHLGGTLKYNQSSKIKTVGLGDDLKQGIARRNQGLAGRFTYNWNYRYFIDFNFGYTGSENFAAGHRFGFFPAISGAWNIAEESLIKKHLKWMNMFKIRYSYGKVGNDNLGNTRFPYLYDIETMTKKDGDKTVDTGGYNFGDYTFDRYYGGMRYSSLSSPNVTWEIATKHDLGIDFSFFNDKLSGSVDYFNEKREGIYMLREYLPGIVGLESNPSANVGKVTSEGFDGHFTFRQKLGAVGLTIRSNITYSKNEIVDRDEENNYYWYKMQKGHRVNQARGLISLGLFKDYDDIRNSPVQDFDGYKVMPGDIKYKDVNGDGKIDGNDQVAIGATTKPNLIYGFGIAANWKGLDVNLHFQGAGKSTYFIDGSTVHMFKLGDGWGNVLSEMANSNRWISADISGDPATENPNAEYPRLSYGPNSNNYQQSTYWLRNGSYLRLKTVEVGYTLPTQLVNKVHFNTVRIFFVGTNLLTWSAFKLWDPEMGSTDGKRYPLSKNLSLGISVNL

SEQ ID NO: 7280 - protein, 713 aa, Shewanella benthica KT99
MLPFFSARAGGAPHVRPYLAAIILTLSAFSGASAQEILSQPDSVEAGKTEHLTVNGVRQPRTTSADTAHLLDHALGYSTYSAGGVSALPVLNGMADDRVATLVDGMRIDAACPNHMNPAMSYVDPDSVSRAVAIAGITPVSLGGDSIGGTVEIERKDPLFAKTGNILVTGHVRGDYRSNGGGSGASGSLKVANDMFSLRYTASYSHASDYQAGGNGQRVRSTDYLSFNHAVTLGVKKANHLLALTFGQQDIPYEGFPNQYMDMTNNRSTFVNGKYKGDFNWGTLDVRGSWQRVTHVMDMLSDKGGHSATTGMPMNTDARTAAYAIKATIPLGLKHTLKLGSSFDHNGLNDWWPPLQGSTMMGPGTYHNINNGHRDRLGHFVEWDAQWLPRFSTQLGFRNDVVMMNTRKVAPYSWSSMMSMADAAAAETFNKASRGRTDVNFDVTATGRWKPLDSLSIEGGYARKTRSPNLYERYAWGMGSMATRMIGWFGDGNGYVGNLNLSPEVANTASVTVDWHDPNPTQRWDLKIQPFYTYTHNYINVRRLGSFSNGLSMLGFVNHNVQSYGINASGSVRLWDRHAYGRGELVGNINWVRGVDLVTHSGLYHQMPANGVIGLHETYENWTGRVEVTLVKSKDTVDWLRNEPRTPGYALLGLGGSYRWRYFTLNAELANVLNQRYYLPLGGLSLGDYDATGILGPLPGMGRSFNMSLTAAF

SEQ ID NO: 7281 - protein, 352 aa, Shewanella benthica KT99
MNTMNTLKSLVAIAVGLCSYNAHADDAQTLEQRIANLENNAAPSQFKNSQVSLYGSIRPTLSYLDDDQDKTWDVRDALSRVGIKASTEFADGWSAIAQGEWSVDIANSGNFGKARQAYAAIASPYGQVGIGKQRPAQYTLVAEYVDIFNHGNSPYAYDHESPFFVDNFVTYKLVTGGFTLMAGAQVDGNSGDTGADMVNLGVGYDLDQLHLGLGYVSQNTQTDAGIEGDDQTIGGVVAYTFSNDLYVAVSYQDKQYNFDALSQDRSGSTLDSALAYPIAKNYKVKLGYFQFKDGINDNTSADYDGFNTTLEWNPTSNVRVHLEYLAKNSDNRADDQALTLGFRYDFNLNWKG

SEQ ID NO: 7282 - protein, 913 aa, Kordia algicida OT-1
MTKKPYFRLSIISCLLISCYVKAETQSIKDTKEAISSEVDTQSTEDSELETISVTAEKVRDRKDNEVTGLGKIIKTSESISREQVLNIRDLTRYDPGISVVEQGRGASSGYSIRGMDRNRVALLVDGLPQTQSYVVQSPLVARSGYSGTGAINEIEYENVKAVEISKGGSSSEYGNGALAGSVTFQSKSAADILEGDKSWGIQTKNAYSSKNKGFTHSLAVAGKQGGFEGVAIYTHRNSIETQVHKDALKGVQSYDRFIATTEDQSAYFVMQDECLDGYDKCKTSPKRPATLSTQRETVSVSDYTGANRIKPNPMKYESQSWFLRGGYHFSEQHYIGGIFEFTQQKFDIRDMTFPAYLRPTEDKDLQSRPFYPKQDYGAYQHIGDGRGVKYASGLYFDEHHRKQRVGIEYIYENKNKAGIIDKAVLSANQQNIILDSYMRHTHCSLYPNPSKNCRPTLDKPYSYYHSDRNVYKEKHNRLQLNLEKKIQQNWLTHQIAFNLGFDDFTSALQHKDYLTRRVIATASSISEKRGEARRNGLQSSPYLYPTPKAELVGGDLCNYQGKSSNYSDCKVRLIKGKNYYFAARNNMALGKYVDLGLGMRYDVSRTKANESTISVGKFKNFSWNTGIVIKPTEWLDLSYRLSTGFRNPSFAEMYGWRYGGKDTDVYIGKFKPETSRNQEFGLALKGDFGNIEISHFSNAYRNLIAFAEELSKNGTTGKGNYGYHNAQNAKLVGVNITAQLDFNGLWKRIPYGWYATFAYNRVKVKDQKINAGLASVSSYLFDAIQPSRYIIGLGYDHPSNTWGIKTMFTQSKAKSQNELLGKRALGNNSRNVKSTRKLTRAWHILDVSGYYMVNRSILFRLGVYNLLNYRYVTWEAVRQTAQGAVNQHQNVGNYTRYAASGRNYTLTLEMKF

SEQ ID NO: 7283 - protein, 1076 aa, Kordia algicida OT-1
MRTKFNGILTLLLAFVVHISFAQEKTISGTVTDQDGLPLPGVNIVVEGTTNGTQTDFDGNYSISAAEGQSLLFTYIGQKDIRQIVGAGNSMNVQMQEDAQALEEVVVTALGVKKEAQSLGYSIAKVDGDEVAQKPSSDVGRLLQGKAAGVNITASNGLSGSSTNIVIRGYTSITGSNQPLFVVDGVPFGSDTNNNEAFFDNATESSRFLDLDPNNIADINVLKGLSATALYGNRGRNGVILITTKNAQGGDFEGKTTVTVSSSTFFSNPHLPEYQQEYGGGFDQEFGWYFSNWGPRFGDTNPGIWTGYLNEIRDGRVFLNHPFATNTVPAYITGYEDLAAGQYEYKAYQSVPEFFRTGVYTSQSVGINGGNGTTGYNVTYSRTEDKSFVPGNRLMKNNFGVGGSTKLGKLSVNASLNYSVTDLNSPPIAASRGSGVEGDGASLFGDLMYTPRSVDLSNIPYTRADGGSLYYRETNSIQNPNWTVENSKTGQKVDRFFGNVSLSYELSENLSASYRYGLDIYNEGSFYGQQKGGIDGNALGLYRTQKIRNMITDHNMSINYDKDLNENFNLKLVGGFNANSILFERDGLESTNQIAYGVLKHWNFTNAASSNSFNGINFQRKTQNNTYGVYADVSLGYKDFLYLNGSVRNDWTSTLESDNNSLLYPSASVSFVPTNAFEGLRSDGNGLNYLKLRFGYGSSAGFPSVYSTRNTLSLSGRAFVDESGNVVSSNTTSNFLGNPTLEPETVSEIEIGVDTRFLNNRVGLNASIFKKETKDLITDKDLDPSTGYTLTTINGGDMEVKGVEVDLDLHLVKSVDNGFNWKTNVNFYADESLVTRLPDGIDQIIIGNFFTADAKNAAIVGQPFGVLIGDKIVRDDAGNKVITASTGAYVNDTNDVPIGDPNPDWTASLDNTFTYKGFSIGATLGYRHGGDIFSKTAVTLLSRGVIDFPFDRLGTYVLPGVNPDGNVNTTQIGATDIAFSNWLGQDELEVWDGTTIRLRDVRLGYSLSSKMLEKTPFASLSFTLSGSNLWYKAVNFPEGVNFDTNTLSNGVGNNIGLEYFSGPSSKRYGFSIKATF

SEQ ID NO: 7284 - protein, 1025 aa, Kordia algicida OT-1
MRTKFSGILTLFLAFMVQMTFAQSKTITGTVTDGSGLPLPGVNVIIQGTSNGTQTDFDGNYSISASTGDILVFSYIGFTTQNQTVGASNTVNVKLEAGEELDEVVVTALGIKRKQDEITTANQVVKSEELTQAQNPNVAQGLAGKVSGLQINTTNSGVNQNVRINLRGNRSLTGDNQALIVIDGVISSSQVLTALDPNIIEDINIIKGANGAALYGSRGSNGVFIVTTKKGSGGDKLTVAVNSATSFEEIAYIPQRQTRYGQGWNGEHVNYENGGWGPEFDGSLQPVGLPQEDGSYRFFPYVSLGDNISEFFQTGRTFQNTVSLSAGNLEDGYVFLSANKTDTEFVIADDVSERNTFNFKGGKKIGNWTLEGNATYLTSKTTQSTGTLYLELLQTATNIPVQEFSEPNNATHWTSYYRSPYWIRDNERTTDRYDIFSGIANVSYQFNDHISIGYNANIRTRQRSGLSYVNGDVDTANIGGGDYTTISSFDTYADTQRNYYGDLIINFNDYNITDDITFSANIGQNLQDNLFTQSTNGGDNLTIPGFYNVDNITGTPRVSNTILRSRRMGLFANLDFGYKDFLFLNVTGRNDYVSTLDKENNSFFYPSAGISFIPTKAFPSLKGDVLNFAKIAVSAVKVGNDGSIGAYETVPVFEQAANYPYGTLNSFRQDRTITDPLLEPEFVTSYEGNLNLGFFKDRLTFDGSYYFSKNTNQIANTSTSSASGISSSRINIGETETRGFEIDLGFTPIKTENFRWDARISYSTNETKVIKISDDTDEIALQSFPNNANPVGVFAVVGETFPTIKGTSYLRDPQGRVLIDPTTGTPRVSSDLTNLGTSNPDYIIGLNTSFEYKGFRLAGVFDYRTGHQFWSGAKSWLSWSGHLIESAENGRGGFIYPNSAIETSPGVFEENTNVITGGTTYSNYLNYFSNDYYTVTENFVLDATAFKVRELSLTYTLPQDYLAKTPLTAVTVGVNARNPFTVLPKENRGYNDPETSNTTGNGQGLAAINQYPVTRSYGLNLNIKF

SEQ ID NO: 7285 - protein, 465 aa, Shewanella benthica KT99
MEKNKHRLFAIGGYNQELTNNGDWDQWAMSSFFAKANYTFDNRYLLEGTVRRDGSSRFGPGNKFGVSPSIGAGWNIHEEAFMKSTKNFLNEFKLRMSYGSLGNENIGLYKYQTLINAGNGNETVFGNPDITWETVHMLDVGADIRLFKNLTVTFDYYNKLTTDMIITPPISYIGGISAAPLNSGKVRNKGWEFDVSYNKQVTKDFGLNIHAGLTHNENKIEDLFGAPYDNGNRIHQIGYALNSYFIYPTDGLLQEDDFTKDAAGNWIPKEGVVIFDGQKPGDIHYLDTDEDGKITTDDRVISGDDQPDLNYFANISLNYKKFDFEILFQGVTGVDGYYSGPYAYGLNTSGDGQTPLAVQTDYWTPENPTARYPRLAPNSSYGNNDHTSDYWRFDASYCRVKYIQFGYTFDQIGLKKIGMSNIRLYLNVQNPFTIAKEDLVDPESRGQRGSYPLVKTYSAGVSLNF

SEQ ID NO: 7286 - protein, 147 aa, Kordia algicida OT-1
MKNATFYLLDNDTTVDGLSAVEQLVCEIAAERWRSGKRVLIACEDEKQAYRLDEALWARPAESFVPHNLAGEGPRGGAPVEIAWPQKRSSSRRDILISLRTSFADFATAFTEVVDFVPYEDSLKQLARERYKAYRVAGFNLNTATWK

SEQ ID NO: 7287 - protein, 157 aa, Kordia algicida OT-1
MKKLLLVASVLLATSAFAEKVGVVDSQKAFFQFSETKKAQQSLESQAKKVENEARQKEVALQKEYVALQAKGDKLTDAEKKAFEKKSQDFQAFLNSSQDKLNKEQMAKLKKIEDVYVKAIKKVAADGKYDYIFEAEALKVGGEDITARVLKEMEALK

SEQ ID NO: 7288 - protein, 584 aa, Shewanella benthica KT99
KVTKNGKPTLGFLGGVGSGIVMQDGTLVFPIQTAHQNGIATTIMYSKDNGKTWEMPEIDNPVAPNQSSLENMVFELEPGKLVMTGRGNSRWAYSSTDMGKTWELFTPTNGLLPTSSQPTQGSSIYVTLPNGRKVLLISKPDGKNDGWKRGDITLWMLDAKDPSHKHKVHIIRPGSGNAAGAGYSSLAYKEGNLFVAFENDGDISVKNLTEHIAEMEAKAIEWGLPDELTPALDKINALPYLNKAQKETLVEKMRRANDTAIAQSFVINKEMYNLKNNSDELDKLAKNITKALPSQQNIYQRALAYVNKVTNTADTTYLNYNGIMDTYANLYESYLALNTKLDFTRYIQKARKFNEYNTDILYRSFDNFFAHYDTGVKHNNLSLGLNTKLSENLRGGLFFEYSNKNRNSVQIGARAKYEMDNHQLSGFLRYRGVKHKDMLARNNSVDGYLNYAYRIQLDDKLSISPSVGAYVSRSSRSLIDEDLAINSRTVYASDVGLNIHYKLNDIDAYIRPSIGFVNGDITLSQSNDMTNTYKIKDKSNVYSVTTGLKKRFANGVALGADFKLHRYGSQTTESNFGLNVSYNW

SEQ ID NO: 7289 - protein, 196 aa, Kordia algicida OT-1
MRQISLFILNTLFLLFAPLSAAEWMVTPSVGYTLGGKVLDQAGRQYDLENSSSYALAIETTYDNGRIGLFYSTQATEVQTLVNQDASIHYLHFQSSIYYPVAEKLSSFIGLGIGGAYTDVAWADKKFGFSAGAFGGVEYRVASNVALNAQLRWLGTMVDNDSSAICTLPSSESCVVKFKSDWLNQASAYVGFTIRF

SEQ ID NO: 7290 - protein, 995 aa, Kordia algicida OT-1
MQAQEVGIKPTVKVIMKSDAEMLDEVMVVAYGTAKKSAFTGSASTIKADKLAERQVSNITNALSGQVAGVQTTSGNGQPGTGSTVRIRGIGSISASNNPLYVVDGVPYDGDISAINSQDIESMTVLKDAASNALYGARGANGVILVTTKKGASGKAVVNVDAKWGTNRRGVPSYDVMTNANQYVETYYKAMLNGWAGGDPNKIVDYAGDGSVMISGNNLVNALIFGSDYLGYPIYTTPNGENVIGMDGKINPNAKIGSVYGDYYVTPDDWEKELFDNSNLRQEYNVSISGSSDKMTYYMSAGYLDDSGIIPGSGYSRLSTRLKADYKVQEWLKVGANFSYANVKSRYPDEQTKTGSSMNLFYITNNIAPIYPLYIRNADGSIKQDSRGYTMYDYGNGMYNRQVNGKTEALNRPFLSNSNPASSLQLDKREFLMDILSAKGFVEIEFMPGLKATGNWGMDLDNTRYSELVNPYYGQYASESVGGLVSMEHSRTFSVNQQYLLTYKNNFGIHNIDLLAGFESYNYKSQYLSGSKQKLYNPTIIEINNAIKTPAVYSATTNYATQGFLARAQYDYDSKYFASASYRRDASSRFHPDHRWGNFWSVGASWLLNKEAFMSDLTWIDMLKFKASYGVQGNDNIGNYYAYQDQYSVSNSNDDFSVSLAYKGNKNITWETSHSFNTGFDFEFFDQRLNGTIEYFSRKTTDMLYNKPVNPSVGYSAIPMNVGSMINRGVELDLNGDIIRTNDITWSVNFNLTHFKNKIQKLHPDLNGELIDGSRIYQEGESMYQFYLRKYAGVDEETGVALYYKDITDANGNVTGQEKTQNWSDATRHATGDILPKVYGGFGTRLNVYGFDFAISLAYQLGGRVYDNGYVSLMHAGDDPGQNWHKDILNAWTPENKTSNIPQINVFAQYANSLSDRFLTSSDYLSINNITVGYTLPKNWTRKMLISSMRIYMAADNVALFSARKGLDPRQSYTASSADVYSPIRTISGGITLSF

SEQ ID NO: 7291 - protein, 215 aa, Kordia algicida OT-1
MRAYIRVLCVCLISLAAVLNLSTASAGQWWAKVGPSYIDFDEDVSLKQGGVKVQGANAAFSNNASLAAEVGYSFNNSWSLGFTFGVPPTTKIYGRGSVEQIGKVGEITYAPAALSVEYHFDTGTRLRPYVGVGAVFVYILKSKDSTVDNLDADNAFGSLIKAGLEYPLTDRLGLFLDVQKMFIETTAKGSLMGAPVKADITLNPFITHAGVMFKF

SEQ ID NO: 7292 - protein, 245 aa, Kordia algicida OT-1
MNLKISCQTALFLSSLGAESSGFFLNGAYEIGQAYYNNELATNKKTEFKSHNEQSTQGFGVGLGYNQLFGKKGWAGLRYYGFYDWAEVKFGTQYFAPGSYLQAKGGLNSNMNINTYGAGVDLLLNFVNLERFSMGFYGGMAVGGTTWSPQARNRTITWNTTLNGQQAERLLAGDYGVSIVFKSTVFQWSFNFGVRSVIAKHTGLELGFRIPMVATPYLTMINGDSNYKETFKRLYSFNVSYYLIF

SEQ ID NO: 7293 - protein, 375 aa, Kordia algicida OT-1
MKKAVVGTLSLAFVSAVAHAQSSVTLYGMLDAGIAYTNNQSGKSAWQQGSGLLSNTVFGLSGNEDLGGGLHALFRLESGFNLNNGTQSYRNTLFGRRAYVGLQSDQYGTLTLGRQYDAVVDYLGPLAMANNGDGNNLASHPFDNDNLDDSFYIDNAVKYTSPTLAGWQFGGLYGFGNAAGGFANNRAYSAGVSYANGPVSVGAAYLQLNRGGLTTGGALSANDAPNFPAVRQRVMGAGGSYAFDRLTIGAVWTHAMFDETAASSLPGALNALRFDNYEVNARYALTPAVSFTGAYTFTDGRYDDATGSHRPKWHQATLMADYALSKRTDVYAETVYQHAFGVPSGATLGFANVTGLAASSTRTQVVATVGIRHRF

SEQ ID NO: 7294 - protein, 698 aa, Kordia algicida OT-1
MNYSKIGLAVLAGMYASVSFSETSLDAITVTATKEERKALDVSQSVDVADRQAIEDKNARNINDVIKTMPGVIAVSKNGGYDSRLIIRGAGLKARYGVREIMVMRDGVPMTDPDSFTRFDFIDIDDMESVEVFKGPGSIEAANASGGVISVRSISVFDDSKDYFKVGAGSETSRNAAIHKTWQAGDDDNFSVQLSRRQTDNNWREHNQFDTTQFSVKQGHFFADDSTLETEISYQKSNLELPSSLNEDGFVYYKDTGKTLNDKANTGSVWSQSARDSETLFFNTRYKTELGNGIKFNPQFYVNKWEHFHPVTGFINDSKNNYVLGTDLMFSRQHFAFGKPANQVFGVTMRADIREDGKKYKYRDITTIPSGRITQVSSDEKGDLAQVEDANSQLSGAYFQQTISLTPDWTVDAGLRYDHLNMDISGQQYYAFDYAAGGYKVGEGAYSYKASYDLFAPKVSANYALNQQSRLYGTVSGAQQAPTDSEVSANYAYGQAEKLKASTALQYELGYKLNATRLATTVAIYQIDLTDEIVGVKDGWTTYYVNAGKTQKRGAEVSASYRVTPSVTMGGSAAWQNYEYLEYADSGYDYSGNKVRFIPEQQYNVFVGYKSNGWQARMEALGFGSYYIDDANTEKYDGYQMVSNMMLGYEMKQHKLQLNVNNVFDMRYAEEVSKDTRGTYAYTPGAPRNIQLNYRYQL

SEQ ID NO: 7295 - protein, 1108 aa, Kordia algicida OT-1
MKKMQIRMQLVCLFSMLLLFFPVELFAQQGTITGKVVDERGESVIGATVMVKGSTDGTITDLDGNFKINGKVGTTITVSYVGYAPLEVKITKLTGNRFVMKEDSKTLDEVVVVGMGTQKRNTITAAVATVNADAIATRPVTDVTSALQGNVAGLNFASDASESGTGGEVGGEIKFNIRGIGSINGGEPYVLVDGVEQSLQNVNPADIESISVLKDASAAAVYGARAAYGVVLVTTKSGKQDKARVTYRGSVGMSAPINMPEMMNSVEFANYKNAYRSAIGESPYFSQETIDLMNQFLQNPYGEGLLGITANQENTGWRGGESQYANTDWFDYFYKNKSLRHSHNLSISGGSDKVTYYVGLGYTYQGGLLDRVEDSLDKYNVNTKFQIKPNDWLKFNFNNNITLNLISRPLPDMSILYHQIARSQPNMVTEVPISGLYNLPSWNEALYLDNVGYSQNRISDAMTFAATVTPLKGWDIIGEMKVRFDVQNDEFLQKQPRTTRPDGTIENVTAPRQGYSYPGIEYSNSLWGSMTRGNQFNYYLSPSVSSSYTNQWGDHFFKAMAGFQMEVQQNSSMYAYKDGVMSDDTFSFDNANGKAYNSEARDHWATMGFYTRLNWNYQNVYFLEFSGRYDGSSRFASGNRWGFFPSFSAGYDIARTDYFKQWSLPVSQLKVRLSYGRLGNQNGAGLYDYLNFMTLRPDYSNAWLLSGVTSATPVRGTVALTPSMVSPYITWEKVDNANLGFDLTLLNNRLTITADIYQRTTKDMIGPAEAIPDIGGIAVDQRAKVNNATLRNRGWELSVNWSDQLKNGFSYGIGFNIFDYKAVVTKYNNPEGLIYNNHTGLVRNKGYYQGMDLGEIWGYEANDLFLTNQEVDEYLRGVDMSFFKPNKDWQRGDLKYIDSNGDGKIDPGSGTLKDHGDLKIIGNTTPRYSFGLNLHAGYKGFEVSALFQGVMKRDFPMAASTYLFSGDSNFFKEHLDYYNVYNPGAYLPRLTKPDSPEYNANVGYNTSRYLLNAAYMRLKNLMISYNFQPKLVKKMGLENLKVYFTCDNLFTIDNLPDVFDPETLNQVNTWAGGSNETAPGLTSPMKQNGNGKVYPLNKNYVFGIEFTF

SEQ ID NO: 7296 - protein, 1160 aa, Kordia algicida OT-1
MKKFHNNSLKALAFSASAIAFAVAGPVYAQDTNEDEQEEPDGVTTGQGQDVEVSTGSQGQTNDNRITVTGSRIVRDTYSSISPLQVLSTENQQSVGAFDPAQILQRSEAAAGTQIDATFQGFVLDNGPGSQTINLRGIGAGRTLVLVNGRRLAPAGVEGAPTVPSINLIPATLVDRYDLLTDGASSVYGSDAVAGVVNVILRKDFDGLEIQANGDINPQGAGEDYSVSAAWGFSTDRAVFGIGAEYQFRDEVQAIDRDFLRGCTNNLEEDANGNIFTLGVADNAVVQDRTPGVSVSESECIVSGISGRIFQPFARFGSVYFPANGNIANFPLDPRTGRPFNFGESTDAFGTDLDVNGDGIRDVDFQNVNVNASEAELFRTFISQQELVNVFTYGEYTFPGEANITPFFEAQYTRAEITNTGAGNPQIFPSVPDLNGFNPCNFISNPDGVDCRAVDNELLGINGTGAALSTGFTLPTVPIAAIRGDRNNFDVTQEQYRGVLGVRGDLPFIGSSWTFELAGVYSRSEGVSSRLGIREDRMALALGLDPTADYDGDGVVDNDGDGIADDYDQGVDVFGIFGDPLFIGECNAGGLANPDLAAPDLNAAGCVPVNLFAPSVLTGAIGDFATQAERDYLFDSRDFDTTYEQVLVSGYVTGDLFDLPAGPVGVVLGAEWREDSIESNPDLVASNGLLFGFFADGGASGSKWIRELFGEVDIPLMAGETLVEELTLNVSGRLTDEEFYGTNGTYAIKGGWRPVPSLLFKMSYGTSFRAPNLRENFLRGQSGFVGIFDPCAVPDDAFVNGAYDASLDQRQDFVLQNCLREGRDPTSVGIDAEGLNTIQVVSGEVTQGGSLDINPETSRSITTGFAFEENWASGFDFALNVNYYDIKIKDAIIEPSAAFIVGDCYFREEVNERSEFCDRIEIDPTDRALISGVQAGFLNRDEETVRGLDINATMGYPLTIGDEVFDLTLNLVANHLIERRNLQTTETGDILEQDFKGEFGFPDWTGRLTGAIDWNDWRFTYQVRYIDSVNEDFREITVGGTTFERPFGDAFSQNAPGTDPSIPGAFSPTCLGAGGPNGNVAGDGNFCRPIGTADEYFEHTASIRWDNNDFRVILGVRNLFDTAPPQVSSRSGVLEISNTPLGNGYDLNGREFFAQVLARF

SEQ ID NO: 7297 - protein, 842 aa, Kordia algicida OT-1
MKTILLTGAAALALATPALAVAAEAPADIVAPPADDAAADGGTIIVTGTRSRSVRTVADSPVPIDVIEPAELKATGRTGLKEVLGQIVPSLTMPALGGGGTSASVRPISIRGLSGDYLLVLVNGKRRHTTSLINNLSRISGGSTPVDIDLIPTNAVGRIEVLRDGAAAQYGSDAISGVINIILDDSPEGGEFSSTAGQLYEKGGALLQQQIGYGTRIGDGGFVRFAVEGKYHDRADSSAEPVPYIYPFINGAPDPREANADHLIAGGYGRSNRDKIINGSLNAELPVGDALKLYGFSTLSYRDIDDKRGSAFAAPTGYGGLANVQGQTVLPQVYPSGFQARRRIREWDGQGTLGLKGTIGAWDFDVSSSYGRDHVRLGAVGTLNPSLGPSSKTSFFMGKQVQALWVNNVDLSRDYDIGLAEPLSVAVGVEHRWEKFQNIAGEPDSYRDGGYVIPADGTPFGQLYGGRSPSPGLVSFTGTSPADQSSISRNNLAAYVDLSTSITRGWFVGVAGRFEHYDDSAGDTVSGKFSTRYEIAPGFALRGGVNTGFRAPSLAQTAFSTTQNTVTVIGNNRVSTISKFLPVNSIAALALGAKALKPEKSLNFTGGFTFERGPARLTVDAYQIRVDDRIVKTEFLGTASNGGTAIRDILIANGVANVDSAQFFTNAIDTRTRGVDVVAEYTVRTAGLGSFRLNAAYSYNKTKILKVIDNPAQLAPLNVTLFGRQAQRDLVAALPRTKLVLSNDWSLDRFHALLRVTRYGSYVESSNVASGDRRFGAKWVTDLDVSYELSERVTLSAGANNLFDVYPDRNGLIAYDGSGAYGNFAPFGLSGGFYYGRVSVKF

SEQ ID NO: 7298 - protein, 423 aa, Kordia algicida OT-1
MKYSNKAVLAAAIAAASTQLMANGLALNEQSASSAGSAYAGRASTAANASTLYGNPAGMSRLDRAEVSGGLAFIDASTDISNAQGTAPGTNDGDMVPFSTVPFGYYVSPINDRLHAGIGIYAPFGVESDYEDGWQGRYEGLNSVVQVVTIQPTISYAFNDRVSVGFGPTINHIEGKLTNNVSSVPFGGSGDAEVDIEGDDIAYGFNLGALVAITDTLDWGLTYHSKVDYTLEGDTTVSGGTGALGPIPGMTPGLNGEYDAKLDITMPESVDTSFSYQATDELALYAGATWTRWSRLEGIEVENSGVFPLYSAQFDTVSEELNWEDTWSFAVGGAYQLNPKWVIRAGYAYDESPTSDEHRTVRIPVSDRDIYTLGAGWNVSDDLTLDAAYAYIDEEKGRVSQDSYSADFENSAHGLALQATYRF

SEQ ID NO: 7299 - protein, 757 aa, Kordia algicida OT-1
MNLKISLLFAFLCSASFSQTTEIKGVISHKSSPQAFVNVYIKNGDKGTITEHDGTYSLKVAQGKYTLVVQAIGFKTIEKEITVGKTTLLLNFNLKEDLLGLDQVVVSATKTELNRREAPVLVTVTNAESLKNVQAATLFEGLNFQPGLRTEVNCQNCGFSQIRINGLDGAYSQILVNSRPVFGSLNGIYGLEQIPTNMIKQIEVTRGGGSAIFGSNAIAGTINIITKDPIENQFQVASKVGLIDGKSVDAVTTFNSTLVAGDLNKGITFFGMYREREGYDNNDDGFTEMTKLRNLNFGFKSFYKFDFRRKLTLEFNTTHEYRRGGDFIDKSPIFANIAEEITSNVIGGGITFDYFSEDYLQKFSAYGNIQNTSSDNYYGTNQDPNGFGVTKDFVTVSGIQHTAKFENFFNGSMDLTSGVEHRFNRITERRENPLVNQITQNTNTLGIYTQLDWKILENLKLLTGARGELFTSNLNDESLFIVNPRASLLYNITETISFRTGYSQGFRAPQFFSEDVHSEIISGEVRRVRLAADLKKELSHSFIGSLEYSHQHEDHQLVLTFEGFYTTINDPFVYEARGEVDGLEIKEKINGDNAIVNGFNLEARFSPNPKFLFQLGGTFQNSYFENSYEPEEGIVTNKITRTPNVYGNMMVNFTPNERWDFNLNGVYTGRMFVPHVAGFIPETVLEETPNLLEIGLNASRTFTLSGKYQFEINGGVKNLFNAYQDDFDQTIDRDPNYIYGPAQPRTVFLGLKFGTDL

SEQ ID NO: 7300 - protein, 1050 aa, Kordia algicida OT-1
MKNSTRFKLFGLTFLMYLGLMSSVLAQTREVSGVVISGEDNLPLPGVSVLVKGTTVGTVTDVDGKFAVNVDGSDATLVLSFIGFTTLEVPVGDRSTFDLTLLPDTKSLEEVVVVGYGEQKKETITGSVATVKGKDLVKSPAMNLSNSLAGRMAGVVAVNRSGEPGYDGSGIRIRGSNTLGNNDALVVIDGIPARAGGLQRLNPNDIENISVLKDASAAIYGSRAANGVILVTTKRGSTGAPELTFQVNQGWAQPTVVPDLANAAQYAGMLNDLSVYELPTEEWAAANEAYKQNGEYTRPNGQVRSAPYTPDELELYRNGSDPWYYPNTDWYGETLKTWSPQSRYNLQLVGGSENVKYLTSLGYQNQDAYYKDAATGYKQYDFRINLDANVNKYVKVGLGILAREEFRFFPTRGAGAIFRMQMRGKPNQPAYWPNGLPGPDIENGENPVVITTNKTGYDRDKRDYIQTTGTLEIKIPGVEGLKFTGTAAIDKYIQYQKRWEIPWTLYELGNGFEADGVTPQLVGTQRGPAEPRLREANAQQLNILLGGVINYDKTFNEDHTVNIVAGVNRETVEGNNFNAYRRFFISTAIDQMFAGGDLQKDNGGGAFNRARLNYFGRVAYNYKEKYLAEFLWRYDGSYIFPEDTRFGFFPGVMLGWVVSDEGFWKNSLGSTFDFFKIRGSWGQLGNDQIGEYQFLSTYGFSSYIIGGAQTKTLYETRIPNRDITWEIANNSNLGFEGQFLQGKIFFEFDLFYNKRTNILWQRNASVPQTTGLSLPAENIGEVENKGFDLNLGVRGGKGEFQYSISANGGYAKNQILFWDESPGAPEWQQSTGSPMNTFLVYQYDGVFPDQQSIDAETLDYTAITNNLRPGDMKYKDYDGDGAITPDDRVRMDENNIPTFQGGVNISANWKGFDLAILFQGATGARQYVSAGESGNIGNYFLDIYENRWTIDNPSSTHPRIANRNDQYYSGGNTYWFRETDYIRLKNLEIGYNLPATITEKVGIRNARIYVNGLNLLTWDKLGVMDPESSNSTGQYYPQARVINTGLSVSF

SEQ ID NO: 7301 - protein, 1026 aa, Kordia algicida OT-1
MSLSAQEKKIEVTGVVTDMNNEPLIGVNVTVKDQAGLGAITDINGRYKINIEEFSRLVFSYIGFDRQEVLVKRQRVINVTMKESEASELDEVVITGTGAQKKLIVTGAVTTVNVDDLKSNPSANLSNALAGNVAGVLAMQTSGQPGVNTSEFWIRGISTFGANSAALVLVDGFERDLNDINIEDIETFTVLKDASTTAIYGPRGANGVILITTKRGKEGKININAKVESSYNTRTITPEFADGYSYAMLMNEARITRNQERIYRDDEMEILRLGLDPDLYPNVDWMDTLLKDGAMTYRANLNMNGGGSTARYFVSLSYINEEGMYKTDEAMRKDYNTNPSSQRWNYRLNTDIDVTKTTLVKVGVSGSLKKRNAPGQGDNVWYSLLGQNPISIPIMYSDGSIPAFGEGENRKNPWTLATQTGYKEIWNNKIQTNISLEQKLDFVTKGLRFEGRFGFDTDNQSSITRKRMPETWRAQRERDDNGDIILKQQSIEKPMEQTSSSTGDRREFFEAILQYNRAFKAHHLGGTLKYSQDAYRTTVDIGTDVKNGIAKRHMGVAGRFSYNWNYRYFADFNFGYNGSENFADGHRFGFFPAFSVAWNVAEEKYIKKHLKWMNMFKLRYSYGKVGNDKLGERFPYLYTLANEYTEKVDGKDVVKYYPGWTWSDYDSEDNKYNGMLYTQLASESVTWEIATKHDAGVDMSLFNDKFTASVDYFHEQRDGIYMERKYLPSIVGVRSNPKANVGSVLSQGFDGNFAYKQKIGKVNLTVRGNMTYSKNEILEKDEENAVYPYQTEAGYRVNQAKGLIALGLFKDYDDIRNSPKQAWNKVQPGDIKYKDVNGDGIVNDADMVAIGATTKPNLIYGFGVSAQWNGFDFNVHFQGSGKSSFFINGTSVHAFSDSQWGNVFTNLVKDRWVDPETAKILGIPVNENPNASYPRLTYGGNENNYKKSTFWLRDGSYLRLKTLEVGYTLPKSIVNKMRFNKIRIFFIGTNLLTFAKFKEWDPEMGSSNGEQYPLAKVFTLGLTVNI

SEQ ID NO: 7302 - protein, 1819 aa, Kordia algicida OT-1
  misc_feature (1364)..(1364): Xaa can be any naturally occurring amino acid
  misc_feature (1367)..(1368): Xaa can be any naturally occurring amino acid
MATSKEALRIDLSNKLESRAQLNGHKERQYPQQIGTVIVSEPEINTYTPSEIREMKISNEPKAYNPLKDIPIEDHYKVVARSKSDVGKARKVRPITRCKTFAGIEKTEQSQNTYTPESTEQMPQKPEIIITASSPTVSPASNSFITAPNTPNTTLTSPEHYNTAPGTSSSTPATSYQSTSDSKPNDSLGANSPPNINTNSKATRRLSFSSSNPQQQAVQSSSQVKSEVPPKPTFVPLPIKKSSTEIVAGMVSNISRVHEMIGIKLAEVTQAIKDTTDKKDKKRLQKLYTQLTSTQKTTETLKSRAEEIETKIKIGENKDKIKKLKKELTSKNNKADRLFRKIEKIDIPANKVSIKSQETVPVTTASTEVSAFQAQQARINEARQGVFNKNKSSGDNARKSSAGTKREKKKQEAQKQLLEIKKQEKAIKTASDKAKEVAASAKKEISRTALRAMQDKMNGDSEQLNKIEENLKLLTPVVYNSSTGPTYKQSPKAKPTIPLNYGVQRILGEQPEDEEGYLVPIKVQQQPYQEIEDPIPSHSKDIYEAKVSQYINYLTSIQPNQSNQAQIDSVIDSLATEMRKFSADQFSQKLGEIAHLASIKAYAGLFEKLYEIQQARILETQKVYEQAEISQSYAEYEENSRKSSTPVLSRSSSAKSVNFEEKSALLQTTTTDESLRSDNNWKNSAPYSSSPKLDKRGLEYLDLAGDAFVQNLKQPDTLTIETLGLITPTQNTTVAKSDSSRKNNVSGSISGIQQLQSEKMSTETLGVQDDLGLDLHYAPQETLTEESTYLVSSKKKQGNIIKRALSKVGSILQTNYAENRRRKRDGETSKQRTVDQEREFGHVWGNENHKESSLSVVSGCIKKATQLISLLDAKRTAILQTTSPSQRRSVSLVLQEIKNDYQEAVKISQKLQQVLIRKPEDIKAYNAKAEKKLDAIKSRADKHFNNIETDVDVGFNPNGGNSHSMPTANMDSLPKNLAVTPPINVGSLYNSLQAQQFREDHKNIIINDRSQGRLNLVDSTIKKGTQPLSNLSTIYESVSYEDLASETIYKTEQPKPSISYTNTSKRKLPFRSAELDKKLEYLDLEDKLLEVEEARIVKEKQDIAKLNQYQDPENLEFKRLAMEALDLSSKESQLKQKRKAIEAEFSLNEKSSSTDVSILRSYSIDDISGVLSDAESNLSRSPSVSGLEDLNNSNVMQLGELKSKHEKIANDYNKELELDTLNKEKILLEGKIKDLDTESKPKVTESKPVFSCSSSVGSIHSFSNDDDLSSRDVVTPVDTLNIEINKDYVDTYIRVLSNKIQKIEEIQKIEELSGSSSRSEELNHIKEAMAYISNRIQDVEELDEKMLLAINAQLQEHDEKISSXLRXXATDILAQLLLQEMLVSDGKSESTLPAGDEEQEDTEVSRQLSSLPALASSNESALALSDDREKECLALGDSSEDEESYDSEFEEEEETIGQLSDSDGGNLKITEVDTVIPLEQEAKKEMQTQISENAPTLNQAKVVNTIVNNMIRNRLDASMNMSNNMVTVGAGDEEESNIKRGLWMRGMYGTNNHGRVENMTGYRGTNKGATIGFDAEIDNNIVGIAYSNVHSVFKFKNSKNNDKELINSHVVSIYGQKELPKNFALQALVSASKNFIKDKTTYSYGDTKIKSNVKHRNHSYNVEALLHYNYLLQSKFIITPNIGLRYGKSRDGVYNETGVNVQEIALTMKENNILSGIVGTKVTVPLKDALKFNNLGLTFQGAVEHNFKEKTQRINRVVKIFDNTFKHHYLIPKQPKTSYNLGTGIIGSIKNTTISLDYNYYLNKHYRSHQGSVKLKVNL

SEQ ID NO: 7303 - protein, 905 aa, Kordia algicida OT-1
MALVATAAPAVAQENQEETVAEGEDNQIVVTGIRSAIQNSLETKREATSIVEVISAEDLGQLPDLSIADSLARLPGVTAQRVRGRSQQISIRGLGPDFSLALLNGREVVSAGNNRGIEFDQFPSELIGQGVVYKTGDARLAAIGIAGAVDLRTVRPLDFNDTQLSVSATYVLNDSGSRNPDFPDDGYRFFGSYIDQNADGTLGWSLGVTVQSNPTHFISRELKTNQFQVATDENGIIYPADNPRQGAVSREFERTSIAGSLQFEPSSDFALMFDAFYTDTQDNGIFRGTETPIASWSGAQFDGATGSGPFADSAQYSAVVPILRTDTEGNDSEIFALGANADIGVTDNLSLILDYGFSTLDRTDIDYESYAGTGPARSGAQDTLNFTFPSNGEYSIDGLIDYTDPSNVLLTDPGGWGQVGFLREPVINDELHQLRAELAYEFDGGFLDSIIVGWLHTDREKDFDNNGTFLRAGAPFVDNAAPIPADLIRGATDTGDLGQNIIAYDPSSLLTDGTYVLERATDDTEWVVNEEVHNFYIQANIDGMLGNVPVRGNLGLRYADTDQSSTGTIGGGFTNTVAESYDDWLPSLNLSFEVATDTFIRIAAAKTVTRARLDQLAANQNINFNPLSCVDTDEDQFPDTVIGFAPPQLVCFNLSGGNPFLQPYESLAFDVSFEKYFSPGSAIIVAAFHKDLSDWIIDFNELIDLTQPIENAGFGGILDTAPELATGVFSGPVNFADGTITGIEGTVRVDFGDVTPALEGFGGFFSYTYADAEIEDQAMNLLPIPGYSEQTWSGDIFYENNGWRAKLAARYRSGFLSEVQNFDGSLSGADAQSETILDAQIGYTFQEEAGPLKDLGILIEVFNLTNEPFVTQNDLFGAGGNQVGTFPSRHEIYGRTFNFTIRKNF

SEQ ID NO: 7304 - protein, 1041 aa, Kordia algicida OT-1
MKKILLLGLTFCLATAIAFAQSRQVTGVVTSGEDGSPIPGATVLVKGTTNGTATDLDGKFTLTVPGPDAVLVFSFIGTSTQEINVGQKSIINVVLREDAQSLEEVVVTGAAGIESRRIEMGYNATSIETRDVAQGRAVNVAAGLTGKVAGMQINTTGSGVNPNVRVVLRGSRSLTGNNEALVVVDNVIVPNSILGNLNPQDIQEITVLNGSNAAALYGSAASNGALIIVTKKGKAGSTRVTVGHTMNLENVSFYPEIQDQFGSGYAGGYPHQYVPYENQQYGPRFDGSMVNIGKPLEDGSIQTIPYSPTGAKNNFWETGITNQTDVTVSGGGENSTTFFSAQYLNNDGTTPGDNYTRASIRFNGTREFSKKFALNYSSNYVQNRYDITTVTGGMFDNILQTPAHIPLTSYQDWENDPFANPNGYYNEYYDNPYFAIDNNRQNSGNDYIVGNIELKYKPIQWMDVTYRVGISNRYFYSKSTTGQFTFSDYTKDISAAKTDIAGGVSDNSGFNTQINSDLLIMLKKAAGEDFFFNLLLGNSLRQNRYKSVSTGANGIVIPGLYNVSNRVGEASASEANYQAAQVGVFAQLKTAYKDFLFLELTGRNDWVSILAKDNRSFFYPAASVSFDATNAIPALMESSTFDLFKLRGGISQVGQVNLGNNSNFGAYQLAPTFSPSAGFPYGGLSGYSLDNRLVAANLKPEITTAYEAGFDFQLFENKVNGAFTYYKSETKNQTIPTGVATSTGFSSYLQNTGVVANEGIETNLNVVALSRNNFQLTVGANYTFNDNWVVSLSDDSDQLALSSGGQAQVYAIKGQPFPILQGTVYNKDEQGRIIVDPRTGYPSAAEQQAVLGNTVPKHRLGLNAEVLYKGFRLYALAEYRGGYKILYNGGGSFDFSGSGITTTYFNRERFVIPNSVYEDPENPGTYIENTNITVTDGGAGFWTDGSFRRNVAENYLVSGDYWKLREVAISYDVPTSFMNKIGFVQGATITAQGRNLLIFTPKSNVYTDPDYNFSAGNAIGIVTLAATPPTRFFGGSITLTF

SEQ ID NO: 7305 - protein, 822 aa, Kordia algicida OT-1
MTLIIKKLPLAIASILMTQPLITLAQEAPAVPVNDDALEIIEVTSRKKVESLNRIPVAVSAFSDTMIEQQGFQSIDDIARFSSGLSFSKAFGRATERPVIRGMGNVLAGIQFGVESGAAYFIDGNYYSGDVQSLDMSDVARVEVVKGPQSALYGRNSYSGAINFITKGPDHGDFTGNVKLNLAQDAQRTASAYISGPLNDWLAASLSLRDYQVDGDDNWRNIVTDDIVGGEDTRSVSVVLDAAPSDKLGVRFRFQSQEDRDETRPFFLTPTSENNCAPGYRSLASWAASGSDNNFQYFCGEIKNQPIALNDKADTDGIPNEVPGVPVSSFLPSGSTFFGTPYDTADGTAFDGVGRDLIISSLAMEYETDAGYSMSLALGYRDDDVSTGSDGDNSSVNYTFAPGQEAFFANTSRQETKDKTLEFTFQSPEGKLQWMAGAFYYEQDRDSFDLTFEDTKVGIFQDNSTVTNKAVYASVDYQFNNKLDGTLEARWAEEEKTVTEFAPDGLMTFDADGNWNNFTPRATLNYRYDSDTIFYGIVAQGVKPGGINGSAGADTGKPTYEQEEITTYELGIKSSALNKIYATVSMFYNDVSDVQLTTPLNVPSGNITSVATNQGEGKVFGIELDINAQFTDNLSGRFTYALADTKFTKGCDDFQWSLTSGGGVLTPGTTTGTDFRDDFGITTSASCSIDGNAFPLSSKHQASAFLEYITPITGELEAFFNIDASYESKKYVQVHNLAYVPSAIIMGARMGVNGENWRVSLYARNLTDEDAPILTSRWLGIPYFTFSSLNTAPDGADNGSPRAFFSAARRGRQMGIDMTYRF

SEQ ID NO: 7306 - protein, 724 aa, Kordia algicida OT-1
MKPIRGAPGSPPIRFRQTSTDSSTMRDLPRLPRLPRLPLRPLSPVSLMALAALAHAQTDTPATATSPSSSGAPLAPIFVTANPLGDAELIAPTAQLSGDALLRRQADSLGETLNGLPGVSTTTYGPMVGRPIVRGMDGDRIRLLQNGVAAYDASSLSYDHAVPEDPLSIERVEIVRGPAALLYGGNAIGGVVNTIDNRIPREAIDGPTGTLDVRYGGANATRAGAAQVEGGNGRFAFHVDAFDRETGKLRIPGYARSDTQRALDGPDTPQPVGSVPNSDGRVHGGAVGASYTWADGFAGLSYSGYESNYGSVAEDDVRLRMRQERLAFASEARNLPGPFSTLKFDFAYTDYRHKEVDNGETATTFRNRGYEARIEARHRKLGPLEGAIGVQFGGNTFSALGDETLVPSTRTNSVALFGLEEWQVDPALKLSLGGRIEHVNVDPDPAGVEKFAGAQSRTFNAGSVSAGALFSLTPVWSIAANVAYTERAPTFYELYSNGPHDATGQYLIGNPNASKEKAVSTDLSLRYASGPNRGSVGMFYNRFSNYLAEYATGRIVDSDGEPVPRGTDDALAEAVYRGVRAEFYGIELDGKYRVYAHSGHTVDLELTADYTHARNVDTGEPLPRIAPLRATLAADYGYGPFGARAQLTHAWSQHRVPADDEPTAGYTSLGVVLTYKFRVGATHWLAYLRGDNLTNQDIRYATSVVRGFAPQGGRSVMAGLRTTF

SEQ ID NO: 7307 - protein, 750 aa, Kordia algicida OT-1
MKYLFLTILIITSKCIYSQNISGKIITNSPVVQGINISLLNTNFKTKTDSLGIYQFLNIPKGTYKIQVTSTGFKPIVQRISLLENQDLNLDFELEEDQNELNEVVVSGTLKPVKRLESAVPVEVYSPVFFKKNPTPSIYDALQNINGVRPQLNCGVCNTGDIHINGLEGPYTLVMIDGMPIVSSLSTVYGLSGIPNSLVERIEIVKGPASSLYGSEAVGGLINIITKNPTNAPAFSADYFTTSYFESNLDLGMKFNAGKKAVSLIGINYFNYDQVIDKDKDNFTDVTLSERISVFNKWSFKRNHNRLFTIAARGMYEDRWGGDIRWEKKYRGGDEIYGESIYTKRAELIGSYQLPFEEKLMFSFSGNVHYQDSRYGTTSYIANQKIGFVQLTWDKKIGRNDLLAGIASRYTYYDDNTPATKEAENTWLPGIFVQDEITFSPKSQVLLGARYDYNSIHGSIFTPRFAYRFKADENTIFRLNAGTGFRVVNLFTEDHAALTGSRDVVIKNDLKPEKSVNVNLNYIQKINFGNGTFMGIETTAFYTRFSNKIISDYETNPNEIIYNNIDGYALSQGISTNIDLNFPSGLKFIVGATVLDNKNVENGISERPYLTENFTGTWSISYKIQPWDLSIDYTGNVYSPMKLPLLSETDPRSPKSPWYSIQNIQFTYSGWKDFEVYGGVKNLLNFTPKQNNPFLISRTNDPFDKNVQYDSAGKVLVTPDNPYGLTFDTTYVYGQNQTIRGFLGLRYTLR

SEQ ID NO: 7308 - protein, 815 aa, Kordia algicida OT-1
MQYKWKLSYWVLMVSSCLVQPTSASDWCDVVPPESDVRYRQYDCKVKKTGELIHVQETEEGMIIIKPYDKLTYFGGYYGVDNALIIIDDGKILKDSILAGGNVANISHEESDIPNNEKNSPGKSVNVIVKDEGKLYVNKGGMSKNTVIDRGGSELVEATGGLQGVSKNATVKKDGWQIIDQGGKSEGAQIYGGKQVILGEGLVGDKDTSSSAYDTVIYSDGETLGEQKVYDGGIAQNTKIMNGGVQEVAKVGPKEIKGGFVQNTEVFGGGKQYVSAGGSAESVTLNETAMQAIYSGGFVKDLTINNEASSWVYGGATLAGRVEINHNGSIYLYAGNDEHHTKVENVILNGRNATLFSVGTKEDNDFTQIENLSGTGIVQFILSGDNDKHYSQLHVKNLLGNLNFMFNTTIATSRGDYLVVENGQGKHTVSVFDSGVEITQPQSQTHDLITDKSGGADFTLVNLSGAKINAVDGGTYVYGLQKREHENAKIWYLAAKFKPEPEPSPQPSPDPLTTPSTDALLSIGVTPQLIFHTELQTLRADRGILDRTKKNTALWSYVLRGKERLATGHTHFDLDQTGVVLGTDVLRELTSGDLFIGGFGSYDHAHIAHARKGVSNVDVYGAGIYATYFDQEGWYVDSILKYNYYQNNLRAFSTNSEKIEGDYQQSAFGTSFEAGYRFQIEHNSWVQPYGQLTWLQVENKNIRLSNGMIGDIGSATSLQSALGLFIGRDFTIKENTQVTTYIAASWLREYIDNNYVTINKQNKFITDLSGNTGKFGLGLKGSVSDNLTLYAEANYLKGSKRKQSVSGLLGVRYNF

SEQ ID NO: 7309 - protein, 329 aa, Oceanibulbus indolifex HEL-45
MKKVLFATTALIATASVAAADVRMSGYGRFGLDYNSANERVAGVSETNITSRLRLQFDMSTEADGGIGFNARFRLQSESRDGLVSGGAFGGTAANGARFGVTYGGLAVNVGNIIGAVENAPGLYTTGTRSAGTGIDGMGFHSLAIKSRTGTAFNWDAYSSGGNGVNGIEALYSVGGFTGHVSYTQRNGGVVLGTAGGEDRTGVMVTYSFSDYYVTAAAQSSSVAANDITFVAAGGDFGAFGAKIAYGTTDAADSVTLEGNMDIGAASNILVWVNSTDVSGVVTAADTADGTSFGINYQYDLGGGATFVAGYVDEADNDNQFQAGVYFSF

SEQ ID NO: 7310 - protein, 309 aa, Kordia algicida OT-1
MVALYGENEYFITDDLIFTTGLRYIYSNLFDSEFTPRIYLVYHLNDNIAFKGGVSKGYKTPSAKQLTNGYYNYANGNALFGNPDLKPEESINYELGADFRVFDFAHYSITGFITDFTNQISSEYLTGMQNGINCSNGTVCKRPINLGKTQTKGIEFAFNTKTYNGFSLNSSYTFMDNRYKDSQKNWFGGDRIENLPRHIAMLKLNYERGKFNSYIKTRARLDTIAKARVGGNGSLPWQKYKPFYIVDLGINYKINKQSSLSFAVQNLFDKNFFDPQVTRWDGANPAGYANRYQDYTEGRSFWLSYKYDF

SEQ ID NO: 7311 - protein, 354 aa, Kordia algicida OT-1
MKKTVLSATIISALAATSFTALADGPSFYGRADLAITNSDMGIATQNQKSGTIIENNFSWLGVKGTEAINSDLEVVYQMEFGVSNFDNSNNTFAARNTFLGLKSATAGTILVGRNDTVFKASEGGFDIFGNTNSDIDLLAAGQSRSADGFSYYSPKIADLVTLNATYLMDDNYDQVNASGEEVYTDNMYALSATVGDKGLKAQNYYVSAAYNDGIDNVKAYRGVAQVKLGQVILGGFYQNSEHVDSKYSNLEGDTYFVNAAYVMGDLKLKAMYGSDDSGLGKYVSRYVGDTNGATLETVSDVDLQQFSVGADYRLSKNTLVYGHYTKYDGDMKLSGFTHDLSDDIFTVGMRFDF

SEQ ID NO: 7312 - protein, 191 aa, Kordia algicida OT-1
MKNTILTLAGLISLASFSTYSHADDFKKDVAENGVYVGANYGYLKVDGEDDFDDDNDVLQGLVGYRFNKYLALEGSYIDFGSYGNNLSSAETDGYTAGLKVTLPIAERIELYAKGGQLWYSTDYDVVGFSGNKDDEGVFAGAGVAFKVTDRFLINAEYTWYDAEINLDNVSNGSDTETDFKQASIGVEYRF

SEQ ID NO: 7313 - protein, 783 aa, Kordia algicida OT-1
MTTITSSIFTVSKLALLVAGVIGTNAYGQTSRNQHQIEEITVTAQKRDQSIQDVPVSISAYDGALLESLGVAELDTLSEITPGLVIQEQSPNNPGFVIRGITSDSGSSQAAPRVSIYYNGADVSRSRGSYFELFDIERIEVVKGPQATLFGTAASVGALSVITRKPQEEFGAEIKASVGNYSAETLSGFVTGGNSQVQGRLAFSYRQRDGFIRNIAGEAGSQNPDGFDQEDMHGIERTAFRPSLRFTPSDELTIDLVYTHEKNDDTGTSFKNGLFAPTGGDTSAFSFVEMSGSPLSQEVFGRKDLGVERTVDDLNLTVNWDINQDLTFTSISASRRFDSLEVFDADGTQAWFLEFAEDATGDQFSQEFRMIHQGDKLTTIAGVSYFTEDGSQAVPFSSEESVFLNCLGAFAALAQPCVANDGSVPVLTPILTEGAAQLLPYRLEFENYGETDAYSAFADVTYAVNEALELTAGLRYVREDKKSGYRSDAPASVLTGSELFTVDTEGQIFRAEEDYDDWLPRFNMLYVLNEDINMYATISKGRRSDVLNVTSVRGEDGSGEKSVTEIPAEIIWNYEAGIKGQAFDKSVNYNASVFYQDYSNFQVTLLDDEGVAYAADAGSATNVGAEAEVRALLGADFELFANLAYLDATIDDDSTNGDLAGNRFRLQPEWTASVGMFYATALSQGYNLTSSLVYSYRSDVFFEPANAPISGLDISEDSVSLVSARIGIAGADEDWAVNLFASNLLDKEYLVDAGNTGGGFGNPTFVAGAPRFYGIEFKMRFGE

SEQ ID NO: 7314 - protein, 1269 aa, Kordia algicida OT-1
MHIQFREPISTSPAQPDAGRQHLFSRVPAAVMNPTTLAIIVAFSTLVLPQTAWAACNSSGVGTYVCEGENNTAISLFGTDIAVETRPGFGITEHEITDSALSLTGSGTISYLDTNSSALDTDSRYSLYIKNDTLITEQSASINVQSNGSISSGVYIDNQSSDDSTIRVDLSGILSSSLSGAPALSIFSSAGNDSTIILNTHAISGVTGIQSDNNSQNGATITHVDVTGDINVENSGVSIRNAANGGTSIINFNSKSINTEYDSFYIQNTNYVGGVITDINIDGDISSANSQAARIYNYTNGGLASLRFRANNVTGSTGLYIDNSSQNGAVTDIILTGDLTATSGSALQANAYSDEGNIETAIKLNNVYSLYDALNISDYTRSGNILHDLDISGTITAENGTGIKVMGAAGEGSSTMLINVNNITSSSQSLDINNYNFLGSAFSAITATGHLTAEWGQGAMLQTHSSLGDATTLIHFNDITAMSSGISLINEANQGTSTTDITVTGQINVSHGEGITLNALTTDGRTLVNVDVNNIASEYDAIRLYNYNYNDNYATGVDDGTGADNGTSTIDLITRGALVSQQGYGINIETNTADTYVTVGGLVHGGNGTAIGIHRLDNIQTSATLELQSGYALEGVTQALVFNGSYAEINDAALDLANSHLVLGGAGDAAFDLTRIDNREEAILDGDPNRITGFGTLTKTNNSIWTLTGANMADGDANAFLSANIAGGILVLDNATLGLTPDAGALTGATVNRLSAADIAADPTRVATETGALTLAEGGALSSLGDSVLSGNLISAGGILLSNHYTGGNGAATDDRLTVTGTYFGENNGSGEGAWLALDTVLGDDDSATDRLVINGDATGTTSVRVNNAGGLGDKTLNGINLITVDGLAQDDTFLLAGDYVTTDGYQAVVAGAYAYTLQADGEAATAGRNWYLSSELMLTEGVRYQVGVPLYEQYPQVLAALNTLPTLQQRVGNRYGAPGALADLNFDDNQWAWGRIEGSHQVTDPARSTSGSQREIDVWKLQTGIDVPLYQSQGGSLLTGGVNFTYGKAKADIHSFFGDGRINSAGYGLGTSLTWYGNNGVYVDGQLQTMWFDSDLSSRTAGHAVASGNNGRGYTSAIEAGKGYTLGHGLSLTPQMQVTYSRVDFDTFRDPFDSEVSLQEGDSLRGRLGVSLDKETTWSAKDGTTRRSHIYSHLDLHNEFLNGSKVQVSGGEFATRDERQSVGLGAGGTYEWQNGRYAVYGNVNLLGATRNVSDNYAVGGTIGARVSW

SEQ ID NO: 7315 - protein, 354 aa, Kordia algicida OT-1
MAMKRTAMACAVMGLAAAGSASAQSNVTLYGLVDAGIEYVSHAGPDGSAVKLTSGGKNTSRWGIRGSEDLGGGLKAIFNLESGIAIDTGRLDTDNTLFDRRATVGLSSRYGQVVLGRTFTTTYDFMLPFDPMGYAPAYSWATSSTATGGRKDGLFSRASNAIRYDGSFGGLKLGATVALGEVAGDFKSASKYALGAGYNAGKFAAAATWDRQNGAGTSTTPADSTDYIQGIHAGASYDFGDLKLFAGYRNYKRAFTTGAASQRSDMYWGGASYAFTPAFTLYGAVYKQNIKGGNDADPILFSLRGQYALSKRTLAYLSVGYAKARNGQDVSVSRDLVGFANNQTGVMAGLQHRF

SEQ ID NO: 7316 - protein, 550 aa, Kordia algicida OT-1
MNRWLLSKNQVNSQALLLLLSTGITLTLTPLSTAQKLDNSHPMSQITSVSQLRDVEPTAWAYTALQSLVERYGCIVGYPDRTYRGLRAMTRYEFASGLNACLNKITDLIGEGTNILQEDLATLQRLQAEFEQELAGLSLKIENLEARTAFLEDHQFSTTTTLSGSISFAGTAYASAGEGTREAVLQHQSYLQFSTSFTGRDLLSLGAVASTSVIPQLASFNDGRNVGFTNEGFTVWAYGGSTGSDQFLVGSIEYIFPIINDEINRWYMTISLENGFNTSRFLLPILSPLTWEGYELNRGPISAFGQRNPLYRLGGTTGFITNYDRGPWRFSAGYFGTQAEDPSPGNGFFNGDYLALAQLNYTPSGRFALAMIYYNNYFGPGRFAFNNSYKFDQNTPGYVGTALANRFDNAGVFFDEDVPVISNTYGVQTFYKINPRFVLGGFVAKIDARLMGRGDADIWTYALSASFPDLFKEGSVGGLIVGVEPMLTGITGEDIPDFKRDTSVHIEAFYEYLVNDNLSITPGVIWITSPNQDSNNDDIVLGVIRTTFSF

SEQ ID NO: 7317 - protein, 202 aa, Oceanibulbus indolifex HEL-45
MKRTMKLASAAVLASTAFAGATYAGSLAEPVVEPVMTAPVPAPDLGGDWTGFYTGLQLGYSDAEVDNGLEGDNGSYGFHAGYNYDFGRFVLGGELDYDKTDIDLDDAAGVTQGSIDSVARAKIKGGYDLGSTLIYATGGYARADTSLGDEDGAFYGIGMDYKITEQYSVGAELLEHKFDDVNGVSGDDADVTTFNIRGSYRF

SEQ ID NO: 7318 - protein, 799 aa, Kordia algicida OT-1
MKKLLLIFFLLISHLGFSQTEIKREVIGRDIGQLKGIKIVGRIIDEITGEALVGATVTIPELDQNKITDNNGGFELTLERAEYNLQFRYVGYETIDYPITAVGDGRLSIKMIQEDFQLDDVVIYGSDPEKNIRSTDMGAVTISMNTMRELPPFLGEVDIIRSMATLPGVSQVGEASAGLNVRGGGADQNLIQFAGAPIYNPTHLFGLFTSFNPEAVNGVTLYKSVIPPKFGGRGSSILDIQPKAGSIAKWGGEAMVSNFSGKVGFNGPLVKDKVSIRGGFRGSYINWFLGALKNPDLKNSQANFYDGNLVISAPVSEKNEFTYSYYTSYDDFAFASDTTVSWKNNSHSLQWKSIVNDKMGFEVLGYYTQYDYSIFNRSGINDFDLNSGIKDIGAKAFFYYQFNETNKLTFGGDFKTIALQPGELIPSQGQESGILPQKVQDESGRESGVHFQHEFEIGERFGMSYGLRYDMYGYYGPRVVREYEENQPISDGTAISETTYGDGEEIQTYNGLGPRGSLRYSFSKSSSVKIGYNKMYQFIHLISNTATIAPTDVWKLSDQYLKPQIVDQISLGFYNNFKGNIFETSVEVYYKDIQNVIEYKDGANLILQNHLETELVPANGRAYGIELYVKKNLGRLTGWVSYTYSRSLRQVITPFEEEIINDGEWYASNYDKPHDFTFIGNYKVSTNTSVSATFGYSTGRPVTFPEAKFDYGGNSLAYFNRRNEERLPDFHRLDLSVNFKIPGDGKFWDGDWTFSILNVYARKNPFSLFFVDELGAPPQAMRLAVLGVPLPSLSYSIKF

SEQ ID NO: 7319 - protein, 373 aa, Kordia algicida OT-1
MSLIGLTSVHTFAHDSIAAQMVVADPELVWKAWDAEEDGPLETADAQFKSGWYVGGGTGLTEVSPEGSSGGFYVEDDRDWGYKVFAGWRFMSHWGAEISYVYTGEAGLGNVNPAIADDIADATIRYQIPTMAASYYLRGAEHPLDVFGRVGLSAITNSVSDDRIPYEKQTPVQLNLGIGVEWRINETWFARAAYDGFDNDASMLAISLGRYFTRHPDHRALPEPTPIPEPAAPEPITPPEPVCAEFNGAIDAIQFAVDSAQLNDTSRVRLQEAANTLRQFPDINIQIEAHTDSTASEAYNLSLSDQRAQAIRDYLIELGIDEQRLTATGYGESQPRASNESEEGRSLNRRVEFRMEDTSPCSMETVNTEESNS

SEQ ID NO: 7320 - protein, 690 aa, Oceanibulbus indolifex HEL-45
MMIFYRKFFTVTVLISLPCLVWSQSHNNSKDELDTITVVAQKINQQQQKTPISISVLTGFDLERENIENIYESIMRIPNVYMVKAGNPSDAGFFTMRGTTPGMEGIQSVGFFIDGVYANTFDTELLDVDRIEVLRGPQATLYGRNTESGVINVITKNPEFSPEYKIGLSYGNYNRTQVTTVLGGSINDSEQFSYRAALKYLYGNGYFKRDYDGKNNVDNLNDFSGRFKLRWQPMDDGWDVITTFDIQNRRNGNTSFTALDKIKSGQKYVDSNYIGKSDVDAYKGQINAVYTFDDIDFTSVSAYVDERKVDNQDLDFTRLSISELLMNRKTKQFSQEFRLNSKYSGPFNWLIGSYYFYQDDENEIDFRYLPYNLAQLRKSNIKTNNYAVFGNVNYYLLNDVELVAGARYDYEKKKLNFLMDNGFNPYQPYSHDNNSNSFGAFLPKVGLNYYITGDAMLYTSIARGYKSGGFNTLGPQSSRAYNAEYMTTYEAGVKTEWFDRTVRWNTSLFWNDMKDQQVEVAYYPISYSVNSGKSLSRGLESEFEWRITRGLTVFANVGYTDAYFKNFPTEIKVDNNYIPVNYKGNRPANSPRYTYSIGADYNFLNGYFVNATYNVKGSTYLDNANSKKQPAYGLLDLTAGYENKDYGVNVWIKNILDETYVTRAFKMDDGIWYGRAGEPINFGVNFNVKF

SEQ ID NO: 7321 - protein, 1185 aa, Oceanibulbus indolifex HEL-45
MKSHCSSLKGLFLASTAAVLAAGLATTPAAAQAASGASAQGRAITIPAQPLGAAVQALSEQTDAVVIAAGVRLNGRRSAAVSGAGTVEQALTTLLRGTGLGWRRDVNGAYVIAPAADEPVRRRQTTAPAALSAPQQARPDVAALEDIVVTARRMEERIIDVPVAVSAFSAEQLDERKIEGGAELLRVVPNVNFSKDNFTGYNFSIRGIGAKVLATTADPGVAVSFNNTALLRNRLFEQEYFDVQRLEVLRGPQGTLYGRNATAGVVNLLPNLPELEQFSMDAQWEVGNHDSRRARGMINIPVGDTLAVRGAFAVTQRDGFDYNTVTDQNVNGRDLWSTRVGVLWEPTENFRANFLWERFREDDDRARTGKMLCTRGETPESLAWTAPDGTAQTTPIFSYWSSTTLTAGCTPSSLYDDKAFGVPDGRGFPLTAAIINFTGVFVNPVWTGGGRPPRGYTSSASNGWDGTYLLPLYVDPFGVEGNRQSPDLRTISTGYDPKFQAENDIFQLNLEWDLTPGLTLHSQTLYMEDSYSGFQDFFRTYATGQMYRYETPGLVHGLPRTVAPTWAPWIGESSAEVGTVYSMAWTGQGICGPLPDCGIPSGGVFLDPQLGATDRFMALDLSQAESTQWSQEFRLQSDWDGPFNFNLGANWLRYKTEENYWVFSNVFSMMAVQQNGGSPVTSGNFDRYCNLTPQGQAGVDAGTLDPHTCAYIDNTPLNDIINGQGGDGHNYIRSTSISQTESWAVFGEGYWSVRDDLRLTLGLRFTDDTKTITPVPTQLLASTPHVYKPDATGLVGRGYPRYPDEEMHWGEWTGRAAIDWKPDLSFTNDTLIYASFSRGYKGGGGNPRDRDYNPNLVNVPSLPSRYDPEFVNAYEIGTKNSLAGGRLVFNATGFFYDYRDYQVAQLIERAIHNENFDAHIWGAEFETAWAPTRNFRLDATVGLLRTRIGDGEESVDVMNRTQGNPDWVVIKPWPGSPSTCIVPADVVGRLINRNDEVGTTFPNLLGSLSLRTLCPDRQLINSWVPGSGSQFNYADGWTDAWQALEPLSYNPFDAPNGGRGFSADLSGNELPNAPRWTFNIGAQYRIELPAGWDLMLRGDYYRQADSWMRVYNLRPYDRLEGWGNANLSMTLTNRTSDLVVQAYVKNVLDDTPITDGFTGPDDLGNATNVFTLDPRIIGVSVKKSF

SEQ ID NO: 7322 - protein, 617 aa, Kordia algicida OT-1
MVYSENTATVTHSGTINANGTNSDGILISDGLAPASSFQINLTNSTIDAQSFGINIQTVGDTTFTLSGTNVVSGVVGDIKGGTGDDTINNSGTLTSTNGIDLDAGTNAFNNLSGARFNSGAEVILGAGNLLTNAGILSPGGDANIQETDITGDFQNEASSTYMVTFNADMTTSDTLDISGTATLNGGVVQTSGATFAPVGAFTIVDAAGGVTGTFDSVVDTLFIDWELNYGATAVTLTATALANNFCGLAGNENQRSVACVGLDSLPLSDPLPQAVLGLSNGAQAQAAYDDLSGEIYASIQGALVENNYRRMALINNRIRNADASLGAISASLAPEQDPLDPEKERRNGLWGIGYGAWSNTFSTSDTASLDNSLGGLLFGYDREFDDNFLAGVLGGYGRTNVKQDARSSSGSATTWSIGIYGETDVKDVGFVLAGIYNWHFLEGARTVDFSTIDEREHSSYNGRGWQFYAEANYEFPLIDAFVFEPFFGVSYIDVRTDGFTEDGGIAALTKQGGSFDSTFTNLGVRGAYNVLDWVNVNASLSWRHAYGDVDPSALLAFGGSTAFGVDGAPISQDAFELEAGIDARATENLFLNAEYNGQFGDNATIHVIELDFTIRF

SEQ ID NO: 7323 - protein, 252 aa, Kordia algicida OT-1
MPIIQSVERALQILDLFNEQATELKITDISKLMGLSKSTLHSLLKTLQLHGYIDQNPENGKYRLGMKLVERGHFVVGSIDIRQKAKGWLTELSRRTGQTTHLGILDGREGVYIEKIEGKLAAIAYSRIGRRLPVHATAIGKVLIAWLGEAELNALLEGYQYTTFTPATLASREALMSALAQTREQGYALDSEENEQGVRCVAVPVWNHESRVIAALSLSTLTSRVDDAELANFREQLQQAGLALSRALGYPA

SEQ ID NO: 7324 - protein, 716 aa, Kordia algicida OT-1
MRHPMSLRYLLMLGVAFSALLAGPARAQQAGETSSILLDTITVETQGQKESPTGPVQGYVARQTLTGTKTATPLLEVPQSISVITRDQMDDRQVQNLGQALDYSVGVVSQPYGTDPRFDSPIIRGFSSATSQYLNGLKLMRDAGATSIDPYALERVDVLRGPASVLYGQGNPGGLIDMISKRPTWTNFGEFNLEAGTFDNYSASFDFGGPTSPDSKVAYRLTGLARTTGTQTDFVDMDRYLLAPSFTFQPDAATSFTLLAMVQYDTPNSTVGLPAQYTLQSLNGLKLSRNTYLGDPDFNSSSRTLSSVGYEFSHTFDNNVTFRQNARYLKLDWDYAALYYNGLSTTNPAIANRGSSTNDENLGTFTIDNQLEAKLTTGPLSHDILIGADYRNFNTDTFSTFGTAPTINVFAPLYNQYIGNSIWYASKVNGTVDQLGLYAQDQIKLDRWLLTLGARQDWASTNSSTLTNYGLTTQDQDDSAATWRAGLTYLFDNGIAPYVSYSTSFEPVIGNMPAALGGAAFQPSEGKQYEAGIKYQPVGWNAFFTAAVYDLTQSNVQSTDLINGVSYAVQNGEVHVKGVELSATASLTQGLKLIANYTYMDAAITQGQYAGNQPGNVPKNSANAWLDYTWQTGPLKGFGLGGGVRYVGERYDLDSNANLLPANTLVDAAIHYEKGPFKAQLNVSNIADVTYVASCGFFGCFYGDGRTVTGKVTYKW

SEQ ID NO: 7325 - protein, 678 aa, Shewanella benthica KT99
MIRTRNTKIAVIISSLLSCPAAMANEANDVFSLGEIVVSDQTGVKDIAINNTMTAEQIELIGAKTAADALDYVPGVHVAQSSKGEKFLTIQGFEQDKVLILLDGVPYYETNYGQLDLNQIPASIIAKIEVVKGASSVLYGPNGMGGVVNIITKKGQDGVSGDVQASFGQMGQNHESASLSLGKNGFSLFATVDHRGRDAMRMSNDFEPVLSDIRDKYGDLPKQMVVEDGGKRENSAYESTNIWVRGGYANESTELFASVFSLDSDRELPYNTRNNKVFSDFSSFADISEYKDTGMDLSGLHRVNDWLTVRALGYYHMHNDSYDSYSNPEKEVKLATSSFSDYTAGGALFTDMALADWNSLSLSVNFKNDVHKKKNVAYVDPDRSHAYERSQLDTISLAAEDTMTFGALNVVAGVAWHKQTVVEDRGNDAAPGEDGSDTLDPMLGMSYTFDNAGLVYGSIAQKTRFATFTEMYDDTGARHDIKPERNTSYTLGWKNDFSHKLLNSIDIGLFYHDVSDKIVSTYMPDPTDPGWDLEIYQNIGKSEFYGIEITTLSQLTENISLSLDYTYTHARNKSVDRDSDYFRDIPKDSVTAIVNWYQPWLDIDSNLRVRYRTDIMIDERSDEWESDTLTIDMGIKKSITPQLSAYVNLNNLLDESHYEGYGQPNEGRSYEVGVKYRF

SEQ ID NO: 7326 - protein, 1096 aa, Shewanella benthica KT99
MMNKQLAFVKSGLGLALCFLMVGAGVTPPIHASNANVSISQQAKKVTGTVTDAKGEPLLGVNVVVKGTTNGTITDLDGKYSLEVEPNSILVVSYIGYVSQQIPASGEVVNVTLKEDTQNLDEVVVVGYGTQQKKDITGSVAVVDTKDLLASSGSSATQQLQGKAAGVYIGQTGSPGSPSMVRIRGINTVNDNGPLYVIDGVSTRNQDLSTLNPNDIESMQVLKDASSAAIYGAQAANGVILITTKKGTKSGQPRLTYDGYIGVQKTGKKYDVLNSMDRLNLDWEAQKNNIAMRDIGGYPSNPQFGTGDRPSIPNYLTQSGAQGSTTIDPSDYDYPTTTYAPFSDTDWWDELDRAAMIQNHQIGLSGGTEKGQYNLSANYFKQDGTVIDSYYQRYQVRANTSFNVRDWLRVGENLTYAFTKDNGLSANGAESNPYSWTYRASPWVPVYDIAGNFAGSKFSGTGNFQNPVANQVRNKDNYYTRNRIFGNLWAEADIFKDLTFRTNFGIDYTNRYYYRMEKKNPEFSESMGQNNFEEQSEFNYRWVWTNTLTYNKTFNDIHKLTVLLGTEAIRDGLGRKLTGRRYNYLFEDNTNSWVLNMGENNNQRLANSEYKGEFALFGLFGRVDYSFNDKYLFTGIIRRDGVSRFSKSNRYGVFPSASLGWRISQEDFMESTRDWLDDLKLRVGYGQTGNSEVPRITNYAMELATYPKRSDYDLNGQNNSTTTGFILDKYGNEDTKWESTEMWNVGVDATFLNGKFNIGAEWYWKKTTDMLIEAQYSAFANPEIKKPYINFGDIKNTGVDLNLNYRDSKGDWSWDVSLNLSHYKNEVLRISESDDASLWGAGTRLDGNVTRTTKGHAISEFYGYKVNGFYENVDEVLALPPLGQSGLNAESAKAWVGKFKFDDVDKDGKLTERDRTFIGSPHPDLIAGLNATVTWKNWDFTMFWYSTIGNDLFNNTKYFTDFWMFNGNKSERMRDQSWTPGADNSNAILPILDSNDGYSGKFSNSYYVENASFLRLKNVVLGYTLPKSVLSKVGIQNLRLYVQAENLLTITGYSGLDPEYTNADMGKESGGDLQRGVDMGGWPSTMRFLFGVNFAF

SEQ ID NO: 7327 - protein, 893 aa, Shewanella benthica KT99
MLPNSKLAKAVRFALITGAATAALSAPAVYAASDDESVERIQVTGSRIKRTDMETATPVTVMSADDMAKQGFTNIQDALESLTSTTSAMTTQSVHGFTPAASSISLRGAGANRTLTLIDGKRLNQYPKPAGGTDNFVDTANLPMEAVQRIEILQSGGSAIYGADAVGGVINIILKKDFEGVALKYRHGDTFEGGGGSDRVALSLGSSSDRGNVSTFIEFTTNEQLKATDRENFGLHTDKVPYSEYSQYSSYGARIAGGSGAKALTPEECTAGGWFWDAARSICGFDRSQWRDLEPESTRFISSTNFNYELADDVTFVGRLDFAEAKSTTRIEPMAINDYDINVAGDNVTVSAGDLSKTFNNKATALGGDFANAEDGDYYYVRRLHEFGNRMGETKTRNYFFTAGLQGVVFDEYDWDASVNYGRTNVDVFRGGYATIAGMFDYITDGENGNSLLKNMNAEDVEAASYTPFERAQSTQKNVQANITGTAFEMPEGDALFSFGAEYTEQDYETESDSESAKGNILTTGGSSGAGDRSYWASYAELSIPVLDVLTIDAAVRYDNYSDFGGNLSPQIAIEYRPMDELLVRGSISSVFRAPDMHRVYGDSTNGFTTVIDFKQCLAMGGTPAQTHPDPRINEICNELHIDTTTGANKELEAETGYTANIGAVWGGDSLNASFDLWEWKLDDMVSDISASKAAREYEQYEDMITRDDDGTITHVDAVAQNLAFQKVRGIDMTAGYAWDLNEFGELKLNFNGTYILLSEGQLAPTDPVEDDIDNGGLPQYRANLVLGYFIEDFETTLGAYHTARMHGMQYKSFKESAGDDFDESAHEVASQTKWNLTAGYSITDDIKVKAGVVNLFDAGPNFDPTATSWPHYQRSVYNARGREWFLEGEVKF

SEQ ID NO: 7328 - protein, 424 aa, Shewanella benthica KT99
MKKTLVALMVATFSISASAAVVYEADGTKIEFDGSLRLLAEKDKITTESKETEIKKNTSKYYINARGSHAETYRETLTTSYHDKKNKEMKKNYRNSGSRLGITATQDLDDGFYAFGRLEVRADKTNNENQFGRLYIKRAFAGLGQKDVGQLTFGRQLTIVDDSYQTDSYEFGIVPSYIASDGNSVIRYDYTGVDGLVFSANYNLSEKQNAKGEALDYKLKNAYGVGFTYQANLKNNKAFYLNTAYGRSNYDNTDKTQAQTKSTKAKHYRDGYQMALGYKIGNFKLVSDFGYAKKSRNEERIVKTTSLYAAPGLQYQFTNSARLYGNYLWENSHMDGIWSAKSKSKGFLLGIDYKPHKNILLFVEGKMLQTKINYNNNITKIHIKEVFDSKRIPRKLESIDDIQLEAHSSAKTEKSIGIGVRVSW

SEQ ID NO: 7329 - protein, 949 aa, Shewanella benthica KT99
MYKNNLLTNSVRLALVSGAMTAAFTAPAVFAAEEDKVERIEVTGSRIKRVDMEGANPVQIITRKDLVESGISNLGDILQEIPAVAGAATNTAVNNGGSGAVRVSLRGLGSARTLVLINGRRMVNSGTGADSSADLSTIPVAIIKRVEVLKDGASAVYGSDAIAGVVNIITRNDFEGFEVNASYDGSTAEWDGETKTIDVTMGVTNENSNAVISAYYTQQTEQMSGDRDWSAFEYDLNPETGELDKGGSSAPPWGRYNGIDGNIAGQECSSFTHGAGSGPGQSDPSDFSNPTGYDCWDWDKDTYNYAPANYHLTPQERYGVFAGGEYQFTDSLRFFTELSFNRRTSKTKLAPLPLAPLAFFGWTDAPYSADNYYNQELGPKDKDGNSVDITDWRRRMVETGGRDTSFQVDTVRAVFGMAGEFGETWGYEVSYVYGNNSSSSARAGGVNFEKVSQAVGPSFKDAEGNIVCGTVDNPISDCVSLNTFGVPGTDTQVSQEMLDFITFEAHDLGENEQTVLSASVFGDAFELPAGSVGMVFGAEHREESGSDLPDALIALGITSGTTRQKTQGSYEVDELYTEMNFPLLSGVVGAESLEIDGALRYSDYNTFGDTTNYKLGLRWIPLDGLMFRSTVSTAFRAPSTSELFAGASDNSPSVTDKCATNPTPFCIADGVPAGGFEPIGDQLSSTRGGNEDLTPEEADTLTVGIVYSPSFIEGLSLTVDYWDIKLDNAISTIGEQLILDKCADEGLYCDQITRYGADAGALYGNSSDIDDRNVNVGSITSKGYDFNAVYAIETGIGDLRFNLDSTYYDTYDITQADGSVVVNAGWFRRSSGDGNFPEWKTNFNINLSQDDWAANWKIRYIGESLEPFDANNDGETDLDDLSDSRTIDSQTIHDAGFTYFFENVTATVGVNNIFDQDPPYAATGFNDNTDPRTYSTTGRHLYLGVGVKF

SEQ ID NO: 7330 - protein, 225 aa, Phaeobacter gallaeciensis 2.10
MKRYFLSAAFLAGALSPVVAADLAPVESPPAISAPAAFDWNGFYLGGNVGGGRADVDWTYQPFGETAHHDGKGFLGGVQAGYNWQIDGFVIGAEADFLGSSIDGDTPCPNPAYSCTSDTKWLSTVRARAGYSFDNLLVYATGGLGIGRFEIKTDDGAGTSGSTIRNDTGWVAGAGVEYGFSPNWSIKAEYMHHDFGERTYTVDGGNPVDADFRFDTGKIGVNYRF

SEQ ID NO: 7331 - protein, 775 aa, Phaeobacter gallaeciensis 2.10
MTRMSTRAVLAASAALFALPAVPAIAQEAPADETTASNEITVIARRREERLLDVPIAISALSTEALDKAGAKDLSGVQGAIPNVNIVQGRGSASSANFYIRGIGQPDALQTFDPAVGVYVDGVYLSRIQGALLNLFDVQRVEVLRGPQGTLYGKNTIGGAVNVVSKKPDLNDLRGEASITYGRFDEVTAKGYVSAPLVADKLALSVAGVYDDRDGIVTDPATGRKYNDRNNLSGRAILRAQPTDTVEVLISGDYTRQRNSLTMGQATAPLIGFDYNADFSAVTPFVIAPAATGEWDYKASSSFAGDKGQKLDHWGVSGTINVDLSDTLQLVSISAYRKLKTDFFVDIDATTAEVGDVFVGTRQHQFSQELQLKLDADKLKGVLGVYYLNEHVTSHQEAYADSYLRYVGTPLNFLRTIDDEQDTKSYAAFGQLTYDFTDAVSLTGGLRYTRETKEYFRTTTATTSSPIFPALVIKGTFTFPTNLPAPYNTLDSVTYEAWTPSATLSYKPSRNTMLYGSVSRGFKSGGFNGRVNGLGDVTQVVDGTTVVVPTFKPETVWTYEVGAKGSFLDGRVNISGAAFYSDYANFQARVGGGNTGINGGSFPVLNAGKLRIQGFEFDVNVRPADPVTLFASVGYLDADYKEFNDGRRAPAFSCNPTGAKVTCKPAFAPPLTLRAGGEYRVPLGDATLSLGGDVRFVDKHYLSVDNRPGLTEDGYLIGNLYAQVDFDKFYLRGAVRNVGNTLYKTDGQEFSSVGNIQTVYYGDPRTWNVTLGVRF

SEQ ID NO: 7332 - protein, 611 aa, Sorangium cellulosum
MRKSALAITLASLLSPVSYLQAQETSTDETIVVTANRFEQAESRTLADVEVVTRQDIDRIQAKTLPDVLRRLTGIQVSQNGGRGQLASLFVRGTSSDQVLVLVDGVRFARAAKGAVDFNQIPLTYVQRIEYVRGARASLYGSEAIGGVINIITIARADEEGTKLSAGLGSLDYQELSVASGIKVTESGQLNIALGSESDDGYNVRPVPGVNDGDRHGFDTKNGLLGYVHNFNDQWSAFGNLRAYENVYQYDSSYGSRGYYEAEKDDLSVTLGGKYQSDNVMSELQVTAQKQKSWNYEQAKGKHSGTEDELEQQNVQWTNSYLLNNNTTLAGGIDWRNESYKDKSANKTFDRTNGALFGMATTSIDKAMLEGSARLDDNEEYGSEFTYSLAAGYQFVPEFGVKASFGTAFKAPNLYQQYDPTYGEKDLKPEESDAWELAFSGDVQGVFWSVTGYDYKITNLIDYHPTTYKYLNVDGETHIQGVELVAEFDTGIVQHQLSADYKDAEDDKGHQLQRRAKEMYKWNALVSFDKVDWSVSYQYVGKRPDVDYSTWPSQDITLSSYSLVDTAVTYYPNESTSISARIDNLLDEEYEMAKGYPAAERAYYINVGYEF

SEQ ID NO: 7333 - protein, 797 aa, Sorangium cellulosum
MACWGRGEGRHFHRLHSSILLFGVTVLGTELGASPGWAQSESVLLEAVTVTSPPPRATTVVRTAPTARAKQSRRRAYSEVAAQTVTAVRVGIASVPNPASFDAQQQRLWRRPGAESAVSVVRQDPGKKSNLRDVLQLTPGIYMSDRGENSQGTISIRGSDISQTGPRSGRGVRGYIDGIPLGRIESGISLPILDLSVADYLEIYRGAASLRYGALATGGALNLVSKTGLTAPGARLSGYVGSYGVRQSQMEYGGAKGNVDYYAQVNGFRNDGYEYHSANDTLRFSGNVGWRPTDNIENRTSVAVGSTRQELATQVPLDQIVTYRRSGYDPTNASFPYDTRANLDYQRVVNKTIFRNDTTSFEITPYFLATSFDHLPSPRAGIVDVKWQDVGISTRLEHRADLWGLPTELVAGYRPTYETANYRSWQWAAGSGGTVKNRLVQDDQFKSWLHEAYGEAAVEVLPQVRAFVGLQAFQTSRVYKDDYAGPVIPSAGLMGPGSSSGRRNYDRSFEALNLKFGMNWEYASRHFLFGNISRSTEVPNSGDIFALLSVETATNLKVIQDLQMQQAWTYEGGVRGSWDRFQYDLTLYHMNLRNEILSQCALGLIPKAQQTPAIRGQFACNLVGSLVPFNADRTVHRGIETVFRTKPFIDLFTPGDNIFLNAAWTYNDFYFDGDRLYGNSHLPVIPRHNLYGEVGYRHASGFYASANLRYVGERATTFDGSGGENFKIPSYNLFGAKIGWRAPDDSASLWFEARNITDVAYAGDFTALRTAADASGGVTVMPGTGRAFYAGFSKRFD

SEQ ID NO: 7334 - protein, 681 aa, Sorangium cellulosum
MIRLLVGVAALALPVAAMAQDAAHDLEKIVIADLRLPPGVIVVTGSGSLAPSDGDAAQGFAVLRDLDRGLGTRVENRLRDEAGIVQFRRSDGRSAHPTSQGVTLRGLGGNASSRALVTLDGVPQADPFGGWVAWSAYDAVRLGGIVVTRGGGSGADGPGALAGTIGLHSEMTDGAEANLAHGSRDGWDASASVGGAVGSGQVALDGRYSRGDGFIPVAKDQRGSADRAAPYEQGGIGMRLRFDAGDSSRIEASLRGFVDRRDRGVDFTQSKVDGIDASLRFVRDPAGGAQWLALAYVQLRDFETGFASVAADRSSAAPVLFQRVPATGLGARVEYRPAVGGANPLRLGADWRRTTGRTEEDFFFAAGVPQRHRSAGGSSDTVGAFAEWTSGRRDDDFLWTLSGRVDRWWLGGGYRREGNIGGAPISDARFADRQGWEASGRAGVRWNGDGVALRAAAYRGWRLPTLNELYRPFRVGAEVTLANEALKPEHLWGGEVGIDWAWADTSLSATLFANRLTDAIANVTLAPNLNQRQNLDAIDSKGIEVSAEQGIGPLTLRATWAYTDADVDASGAAAMLDGRRPAQIAKHGGSVSLRSNGDGPLGGFATLRYIGTQNEDDLGLLRLDDALTLAAGLSWRFANGISVEARGENLFDELVPAAISAAGIVERAMPRTLWIGARFGF

SEQ ID NO: 7335 - protein, 928 aa, Phaeobacter gallaeciensis 2.10
MAGPGALRWGLLRPLLCLALLVAAPPAALAGDPAATHDYRINAGPLPSALQQWARQSGIALVFDARELAGLHANGTHGQADPASALKQLVAGMPVTILRTPSGGFVVRRIRVAPAVAPPVPATVAPRPRMPPQSPPQVDLAPIHVTGSRLPRTSVQTTLPVTTIDRADILRSGYGSLFDLLRHLPGMNGLPAMSSARSGDSQYLPVGAAATTSLDGMGPRATLFLVNGRRLPRYPMVSLEQGGLTDLGGIPLSFVERIELVRGGASAIYGADAMSGVVNIILRDQADGPEATLQTGLSSRGDAGQYRVQAATGGLRGSGDRWFAGIDLHRVDHLAGDQRDWHAETSQYLIGAFRDGDYWPATRCDGPLKRRNGACWFDSSRPRSLQPASDTASAYLRYRHERGQGRYVYAEARASHNRQRFDLGPTAVALGLYGYTFNSVLREAGNVRPQVRATDADLTLGIGRDQGSHSWDAGISAQRSDVTLATPGTVRAEPFIEAAQSLRFLPGFDALPADEATSLFPSIRNRGLTEQWQGWWGIQRALMPMRGGNAQLATGIDLRHERWTSHPDTLLSQGDLALGLPQQQRRLSRQSGGAYAELGLPLTSELRMDLAARWDYDGDYTAFSPRAGLRWTPTPHWSFLLASGRGYRAPSLFEQRRPPGQFGTLTLPVSSALPPCAQSEPGGRCVVTADVEENNALKAESSRSHSLAATWSPSDAFSLSLTHNIVELRNEILALQPADAVWNRDTWQLDEDGNLSSLRLSFDNIGRTTSRNWVLRGEYRVDTGSTGQWLFSLDALKQQELRRRRDHEPAIDLRGHVTPEMAAVLNVQWQNSNWDIALRGNQVGRTRAWLPGAECPQRQIEQNHCMNPRQLRWNLHLARRLGTRVIAALDVHNVLDAQPVNYLVGNGGQMPGLDDPLGRYYLLTLQFR

SEQ ID NO: 7336 - protein, 350 aa, Sorangium cellulosum
MLRECDYSQALLEQVNQAISDKTPLVIQGSNSKAFLGRPVTGQTLDVRCHRGIVNYDPTELVITARVGTPLVTIEAALESAGQMLPCEPPHYGEEATWGGMVACGLAGPRRPWSGSVRDFVLGTRIITGAGKHLRFGGEVMKNVAGYDLSRLMVGSYGCLGVLTEISMKVLPRPRASLSLRREISLQEAMSEIAEWQLQPLPISGLCYFDNALWIRLEGGEGSVKAARELLGGEEVAGQFWQQLREQQLPFFSLPGTLWRISLPSDAPMMDLPGEQLIDWGGALRWLKSTAEDNQIHRIARNAGGHATRFSAGDGGFAPLSAPLFRYHQQLKQQLDPCGVFNPGRMYAEL

SEQ ID NO: 7337 - protein, 708 aa, Sorangium cellulosum
MRTRSVPLVRTAALVLTAPLLAPVAARAADLFAPRPTAQAPAYTDWSGGYVGLEGSAGGSYGAYSFGPTTIGGRPVPPFKSGDSTGRSDQGKNATTATGGLFGGWNWQAGPWVYGIEASLDAANLKRPVPSTIAGFGYADTTPAFNIVRAKTDLYGALRARLGYSFDRYLIYGTFGLAGANARILANYPDLDAGGQTAARRDLDYVGFTLGAGVQYAITDSLALGIDYRYIDLGGSRRFPLGAVPGDAGGPVTTRASFNSNQLFARLMWFPDGLKVPPDPDETAPHDPDNGDTGRFSLHGQTTLIAQGVPGFRSPYEGAQSLIPHQARQTTTATIFLGLKLTDSTEVYYNPEFSQGFGLSRTLGVAGFVNGEAQKAGAPFPKLRSNRYYVKQTFGLGGETVEVPDGPNQVATRYDAERITLIAGKFALGDFFDGNIYAHDPRVDFFNWSLWGSSAWDFPANLPGFTQGVYAEYNRPEFAIRAAYTQVPKEPSSDVLDPRVFRRAGLNVEFEERHVLPWLEQPGKIRIGLFSNVGVSANNRDVVTLTQLGLFDDINDAVAATRRPRRKTGGYINLEQALTPELGLFARASLNDGRTENISFTDIDQSFSGGLSLKGKAWDRPDDTVGIGAAMNGLSPSHRAAFAAGYLGLLVGDGRLNYGTERALETYYALNLTKFVTLTFDYQFIDNPGYNRDRGPAHFFASRLHADF

SEQ ID NO: 7338 - protein, 887 aa, Sorangium cellulosum
MKFKYLLATSVVGLSAVAASPAFAQSTGSIDFEDEGEEVIVVTGARFNGVGGVEIPDTTKAKQVLNEEIIRRQRPGQTVNDIVNLVPGVSFQNNDPWGSSGGGFTIRGFGADRVSQTLDGLPLNDSGNYALYTNQMVDPEVLEEVSVSLGSTDVDSPTASATGGTINIRTREPGDVLGMTATMTYGDVLAEGVEDSAYVRGFLMVDTGDITGMGTKAFGSVSYTTYGVPYNPYGRINKTQFNGRIWQDLGTNGDFVSISGHWNVNRNNFAGSEGLETLLSYYEPASGFNDKEQRFSVYEGAGEYPCAVDPRVLAEETGYAVGSPGDSVDYSDRNGCGAAFYRRFNPSDTGNIRGASRFSLTDALTLTVDPSYQYVKANGGGPDDLRESFFVTGYEDENDNFIETGRYTGAFNGGYYFGRDLNGDGDLDDEIAGNDPSQTTTDRYGVITNLIYEINPDHRVRATYTLDHARHRQTGQITYMLGNGEISDVFAIDNPLLDVNGNPVNKRDRLSYAILHQISGEYRGRFGDLTAKLALRAPFFTRELNQNCYTTSDNGFVDCPNPGFDTAGYELAKIENGQDFAPPQSRTYKYDKLLPNIGFTYDVTGDVSVFANYAKGLSVPGTDPLYDSLFLDANDPASQPVPETTDSFDVGLRFQSGSIQAQIGGYYTQYQDRLASAFDPDARDGEGARVFRNLGTVDKYGIDGSIAWRPTRNTLLYVFGSYNDSEIKDDVLSGTCNQFEVDNNFYSCNAVGDLQYLATGGKTESGTPQYSFGARGQIAFGPVELGAQAKRTGTRFVNDQNVPLEGELANGDEFFFPAKVPAYTVVDLDARILLGEFPTGGDVAVQLNLTNLFDEYYIGYFGGSLDDFGFAQIGAPRAGSVSLVIGF

SEQ ID NO: 7339 - protein, 900 aa, Sorangium cellulosum
MHEKHKIFMKLCLFFSLISWSTGVYAQGFVVTGKVTSSGESVIGATVQVKGKITGTITDIDGNYRLTLENSKETLVFSFIGYQSKEVTVNGKNVINVELEEDVAQLEEVVVVGYGTMRKKDLTGAITRISTENTTQSVTSVAEMLRGTVAGFSAGFGTSAKGGGSMLIRGEKSINASNSPLIVLDGVIFNGDLVDINPSDIETIDILKDGSSAAVYGSRAASGVVVISTKQGNEGKSVINFDMKIGMQNLTRNQRPFNGQEYMVMRRDEKIRSNPSRPLGYFHNPDNLPQGIDLNTWLSYTGASADSNLAEIWLNRLAFSTTEIDNYLAGRETDWYDASFQNALRQDYNVSISGKNDRVSYYWSLGSINNQGIVVGDQYKTIRSRLNLKVNVTDWLQVGLQAHYATRNESVDEVDWEEAIQASPWGSKYEENGSLKFYPNDDNMSTNPFANYEQRDRFNVTQTFNATLNAKITLPWGFVYEMSYSDYNNWQKNHYFDPSTSMAGEKYKGHAVRRNNSAHSWMLDNILRWNHTFNKIHKLDLTLLFNLEKNETWSDKAENSNLTPSEVLGWHAVANGTNPVVGSDDTVDTGNAMMARLNYNLMDRYLFTASFRRDGYSAFGSNNPYANFPAFAFGWRMNEENFMKAISWIDNLKLRLSWGINGNRSIGRYAALANLDSEKYLHNGSTVIGIYATRLPNENLKWEKTEAYNIGFDFAILGNRLNGTVEAYYMSTKDLLLTRSLPDIIGFSGVTTNLGEVRNKGFELSLNSVNIDHKNFRWSSSFIASLNRNEIAHLYGEMVDVLDKDGNVIGQREDDDIQNGWYIGHALDEIYDYKILGVWQENEREDAAKYGKEPGDFKIWDVNNDGEYLPEDDKVFQGYKRPRFSFGIGNTMEFFKCVDF

SEQ ID NO: 7340 - protein, 414 aa, Sorangium cellulosum
MSINPLGVTALLLASASPLLQASEQSESAGFIEGSKLSIKARNMYMQRDNRASGARQNYGEEWAQGFIGTFQSGFTQGTLGFGIDLIGQYAFKLDTGDGRTGGGTGLLEQDSHGAKQDIGKAGAALKVRASNTVLKYGTQVMAVPVLATSDSRLLPETVDGFSLTSKEIRNLQLDAGHFTGLTNRNQSSRDSGRMTAVDYIGGVYSFNERLSSSLYYAKTAEHFRKYYVNTRYLLPLGASQSLKLDFNAYDTQSIGQARSGDLDNRIWSLGGTWTLGAHAFTLAYQKVSGTGDYVYGPDGNAVYNFANSVQYSDFDYENEKSWQARYDLNLAAYGAPGLSFMTRYVKGTDFKNGSGGDLDGKAWERDVELRYVVQAGVAKDLSFRVRQASYRSSDRGGQIDEVRVITEYPLNLF

SEQ ID NO: 7341 - protein, 700 aa, Sorangium cellulosum
MKRGLLIGVAAAGFAGVMATAPAAAQVVASDQDELIVTARKQSENIRDVPDTIQAFSATTLERAGIESVNDLTQMVSGFRIVEAQQPGVVLINIRGIGQVRNGESPVAVVVDGVQQNSPNQITQDLFDVERIEILKGPQGALYGRNAIGGAINIVTKEPGDSFGGSAELGYAEGDEFRAKASITAPLGEKAGFRLAGSYLNRDGQITNSTLNKKVDFDETWAVRGALLLKPTETLKIDLRGSYYDQDAGASWYVGGPANSPRVPVVGNILGKAGRKLGDVSAKIDFDLGSVALTSVTAWSSVKSDLFEELDWEPQDLAAATQTLDVKAWSEELRLSSNTPGSALRWMTGLYYLHTDRTLNTAIFLGPDLTGLPSRVLGSRLIAKDDNDAYAAFGQVNYDIVEHLELTAALRYDIDRRRQDDVSPPVPAVVPRYKGTYKSLQPKLSLAYSFPGGSLAYATVAKGFRSGGFNSNAVVTREFKKEELWNYELGFKTALADRKLYLNGAIFYSDITDRQVFGLDLSTGPAQFIANPIPKSSVWGAELEMTARPVKGLELSMGASLMDTKINTYDVTVFSGTAARGDFKGNKLNQVPRYTLNAAAQYTADLGGSSLISRVDVSGWGGDYYWEIDNAQKQKPVWLVNARLTWAVGKVELTGFVKNLFDRRYDVEFVPVNFGGTITGKDLGSASPPRQIGGSAKVRF

SEQ ID NO: 7342 - protein, 456 aa, Sorangium cellulosum
MVGGCTAVNAACGAFIVFRLFLWGMDMKKLYVVLAVCLLWACQVTTAGAEGFALTEWSSRGLSLAGGMVGRADDPSAIAYNAAGITQLPGTHVMGGFAAIAPMGTIDLDLADGSHTSTTTKPHIWAAPHAYITHQLNDRFWLGLGLFSRFGLGNEFADNWTGRYNLTNINFQTFSLVPTVALKVNDVLSLSAGVEIMHASFAMGQQIPSMQYIGYFPSKGEDSKMTLNGTGWGVGAQLGAHFRMTDELSLGFSYKSPVTLNIAGTADFSRHHSNMLADQGQVPHTIDTDVHSTVHLPDSFAVGLAYRPLENLSFEVGTVFTRWSTYDSMNIYFDSDFQSINHKKWRDGWNFNASVEYEPLDWLALRAGFWYETPVTNESHADFMVPSHGRTGVSVGAGFQWGNWTLDLAYAHLWVHSLDYSETDAAGIRSSVGNVSSGNSRNTVANIYSATIGYTF

SEQ ID NO: 7343 - protein, 797 aa, Sorangium cellulosum
MSSTPVPQRHPLSRAVHGAFLGLVVSSCALPALAQSATAEHSNQAQQWNIPGGPLAPALDRFARQAGISLSFDAQRIADRNTAGVQGTLGMSAALSQLLQGTELQAQQQGPSAYLVVPQPKPAGPLELGATEDYRLAPVIINAKVKASADEDSNSVVAKELWVGGKVATSILNTPASVSVVTNKEMQQRSVSTTEEALQYTPGVVSDYYGSDDRNDYFLIRGFQATTYRDGLTLSSMRGVREDPYAYERIEILRGANSTLFGPADPGGSVNFVTKQPRFEKFGQGYVTYGSYNHAETGIDVGDALNDEQTLAGRFTAKMQNSDREYDHSQDDNRFVMGGLTWAPTDFTSATMVLDYLKTDSSPNSGGYPLDKEYDRSDFYGEPSYNFHNVERTSLSGNITHDFDNGFVLRSNLRYSELSDDFGYAYLSDSTSRVGTTIPRYIFGTDSDADQLNGNLMLQYDAQFEHIDSSTLVGVEYLDSTTKQSSVYGLAPSIDIANPVFTGVPGGITPYTRKKNDATTKAVFLQQNLSFFDRVIATAGVRNDSMDLSSKEYIGGEQTEKDNFSETSYRAALTYIVNDEVSTYVSMVESVSPPQVGVTPQTGRQYEVGVKYSPLGMDALFSAAVYDLTQENVTIAVVLPSGIIEQQTVGESRVRGLDLEAKAQVTQDISVIGAYSYMESEVLRGSLWNGDSLKGNEFATAPKHTASLWSYYDVPGTDVSVGLGARYVGAYYMDAANTKKSDGTTLFDAALNYKIAKGTDLALNVSNLFDEQHVVGSGTANYYNPGREVTAKLSYSW

SEQ ID NO: 7344 - protein, 206 aa, Phaeobacter gallaeciensis 2.10
MTRITIAALAAMASTALIGAAHAADFSYRAPYTVNQPLDAFSWAGPYLGGNLGYAWGSVQNSLTRPDGVFGGVQAGFNWQSGPVVFGLEGDIQANAANDTFAAWKFSNPWFGTVRGRIGYAFNNVLVYGTGGLAFGKLRAETFGLSESHTSAGWTVGVGAEVGIYQNWTAKVEYLYVDLSSSSFTITGAPHSYQSGMVRAGINYHF

SEQ ID NO: 7345 - protein, 339 aa, Phaeobacter gallaeciensis 2.10
MKKILFASTALVAFAGAAAAEVTVTGAAEMGIVGGNRYATASNTDGVTQFWTDVDVTFTMSGEADNGLTFGTKVKFEEAAGGIATQTEDDFAVWIAYGNARLDMGDTDGAFDWAMQEMNLAAGSIDDSETEHPGFNGNAGFDGHEDGQIARFTYTFGDFAAALSAEIDDDPNAQAIAPSVNPDSDDDVVWGLGFKYSGDLGGTKMNVGLGYQDQNDFGSLIGLSVDATLASGFKVGASYSEMDPDSNIASDNVTHTAIGFGYEMNALSIGLNYGKYENFDKMSGTYGSAAESDGYGLAVAYDLGGGLAVQFGYGVGDSTTAAGVDSDWDSYSLGLAMSF

SEQ ID NO: 7346 - protein, 901 aa, Phaeobacter gallaeciensis 2.10
MAHTKMHANKNAQHAKKFVPYFARTGLFAAISMASAMAVAQDTHSENSNPMEEVTVTGMRAALDKALDVKQNSNFVMDALSLEDINSTPAITIAEALVRMPGVSGVRDRGNESQAAIRGMGPRMVFSTLNGRELATSEPGRAVRYEQFPSEMISAVEVYKSQSADLTEGGIAGTINLKTLSPLNHSGPTYTVRAGLQYNDAGADLPNYDALGNRFSLSTVHSITDEFAIAVGYSAQTQKNAYASFQGWGMNNDATWQPAFADGPAELDGNGTRGYAPWGAALELKGLTTEREGLIFTAEWAPSDDLSVKYDTLYTDVGLFEETPSNWYQGLGNWDGGQNGSYRDIELEGDYAAAATAVGIAEVRHVIAKYRQESSSISHGINVKYDGYENLQISADINYSHAERDGYWNAIWFDQYGQTIRYDFREGSEGVSAPDGGNVLTPTADGALTFPSWGPEEWNQANANEGNHLEDTMLGGNVDFKLAVDAGHLVGVDFGIRHAGREKENSPTSFVMTDPEQATAMDRLPEGFFTTYEVTEFPSTPLVYAESYDALAEAFYGGVDYSQAELRNGDYWLVEEVNNAAYVKLNFEGELAGFAYNANVGVRHAKASIDSTGYPGGGDTLQSVSNDYSHTLPSATINVDIHDDMVVRLSAARAISRPPVDEMRAGEFINLTTGAANGSAGNPYLEPYISDQIDISYEWYFASESLFAATLFYKDISNYVGIETIGTFQDENDPERSFTISGPVNGDGGYVKGVEFTFQMPFNFLPVEGFGVYSNLALADSNVMEFTPVNNPYTMAGLADYTATADLWYSNNRFDARLGYKATSDYTTGFTWNGAELNTIAPEASLGLSMSYTFTDNISARVQAWNLTNEPARLTRDNTNASLMRYDEYGRGYMADVTFTF

SEQ ID NO: 7347 - protein, 699 aa, Phaeobacter gallaeciensis 2.10
MILRRTAVSTFALLASVPAMADVVELEPIIVTQETGDAFFGKSVSLDTGTVAKTGDAIAETPRSVTVVTAQELAERGAQNVEQALQYSAGVVGGQWGLDSRANWYLVRGFDASTLHDGLPARYGFYNDTKPEPFLLNSVEVLKGPSSGIYGSGAVGGVVNTTSKTAAQEAENLFQVQVGSHDRKQVAVDVSGDLNASGTLRYRFVGLLRDAETQVDHSQDDTVVLAPSITWRPSDDTELTILANYQKSDGSPLIQFASMAGTLLPATGLGNGDYLPNSLFVGEPGFDTFNTEQRAITAMFKHRFNAVWSLNANARYLESDGEYQHAWWAFDNFGSGRYNPDGTINRTFYRAENTLKTWGFDAYGTAEYRLGGFDMRTIIGASYTRGHYDSDTGYGAQVGPIDPFNPVYVGYPTVSVTDTPGTSITETGAYVQQRASYDDRLFVDFGLRYGKIESGPSNGSFGATSIAASDSEWTGNAAVMYRFDNGIASYISYAESFRQDAIGSDVNGKAFEPTRGEQYELGVKFQPAGSDTLLTAAVFDLTKSNMTVADPGNPGFQVQTGAASAKGLELELFHRFGDLTVDAAYTYLDSEDAEGDYIAQVPKNAASLWLNYAPEAGALQGWSFGGGVRYNGEAWGGTGTYLTPSYTLYDAAVSYSQDNWLVSLNVQNLTDERYVTTCQGGACYFGDGRNIALTLTSKF

SEQ ID NO: 7348 - protein, 418 aa, Sorangium cellulosum
MRSNVSCKIACGLSAAIASTLAPALSHAAGFVEDAKVNLNLRNFYINRNFVDPANAQNYAEEWTQNFILDARSGFTQGTVGFGVDALGLYSLKLDGGKGTGGTQLLPIHSDGRPADDFGRLAVAGKARFSKTELKVGEWMPVLPILRSDDGRSLPQTFQGGQITSKEIDGLTLYGGQFRANSPRNDASMQDMSMTGRAAFTFDRFNFGGGEYVFNEKRTQVGVWYAQLEDIYHQQYFNLLHSQPLGSWTLGANLGYFQGKDDGQSLAGDLDNKTWSALLSARHGGNTFYVGLQKVSGDSAWMRVNGTSGGTLANDSYNSSFDNAREKSWQLRHDYDFAALGAPGLTLMNRYISGDNVHTGAITDGEEWARETELAYVFQSGAFKSLSLKWRNSTMRRDYSTNQFDENRVIVSYPLSLL

SEQ ID NO: 7349 - protein, 646 aa, Sorangium cellulosum
MRLATPRVNLSETLTSVPGLQVQNRQNYAQDLQISIRGFGSRSAFGVRGIRLYVDGIPATMPDGQGQISNIDINSIQNVEVLRGPFSALYGNASGGVINVTTETGRQPPTLEASSYYGSYGSWRYGLKATGAMGDGTQPGDVDYTVSTTRFTTHGYRDHSGARKNLANAKLGVRLDDVSELSLIFNSVDIKADDPGGLTESEWKADPQQAPRAEQYNTRKTIKQTQAGLRYERQLSAQDDISVMAYAGERETTQYQSIPLVAQLKPAQAGGVITLQRHYQGIDSRWTHRGELGVPVTFTGGVNYENMSENRKGYNNFRLNNGTPEFGHKGDLRRDERNLMWNVDPYLQTQWQLTQKLSLDAGVRYSSVWFDSNDHYIAPGNGDDSGDASYHHWLPAGSLKYALTDAWNLYLAAGRGFETPTINELSYRADGQSGFNFDLKPSTNDTVEVGSKTRIGNGLLTAALFQTDTDDEIVVASSMGGRTTYKNAGKTRRQGAELALDQRFAGDWRVKASWTWLDATYRSNVCQGQNCDGNRMPGIARNMGFASLGFIPDEGWYAGTDVRYMGDIMANDENTAKAPSYTVVGLNTGYKFNYSQLTVDIFGRVDNLFDKEYIGSVIVNESNGRYYEPAPGRNYGVGINLAWQFE

SEQ ID NO: 7350 - protein, 940 aa, Sorangium cellulosum
MSRRRFAFSHHPLTHAVACGLLLAGSSATVLAQDSSKAATNLDRVTVTGSLIPQTQIENQTPVLTISAEAIQARGFSSVAEVLQQSSLTTGGLQGGQTSASFTQGAEAAGMFGLNPGYTKYLINGRPMLSYPALYNGSDAFNNISGIPIDIVDRIEVLPGGQSSLYGSDAIAGVVNIILKERMDGGTLNVRGGAYSDGGGASFRVSGANGFNSKDDRFRALVNVQYEKTNPIWGYQRDITKQNNPHGYTRQLPSNDFLVFDADTNDFLMMDPNNCAGVSGQFGGTTILGTRRAGQSCGSAFGAGYKTIKNGKESSQLYSSLTYDVNDNLQLFGDVLYSYETVKYNTGAGYNYWGTDISMGPFFDQSSGRYLGLQRVFAPEDIGGIGYRDIMNTDRSKSYQVTLGARGAIGSNWDYEASITHGEYKLNERGYARWNDPINNWFADNVLGPVLGQTDDGYNIYNPNWGAFYSQLPQGAFQSFTGFTTSRSRTWQTQTRAQITNSSLFKLPGGDAGFAAVVEGGSEGWNYTPDVRLTDGTVFGTTSVAGNGHRSNYAVTSELRLPLHDMLTVTASGRYDNFKIAGHTVDKPTYSIGLEFRPFESLLVRGKYGTAFRAPSLPDAFQGKSGYYANGSKDYYRCGQLGFDPSNTVDCRYGSVSVFGTQSGNPELKPITADVWNAGLVWAPINNLSVSLDYYNWKIKNEVNTLSSDQLLLAEYYCRNGLTNTAGATCEEVANWVTRDATGALEEIYTPKLNVARQNLEAVTASFKYVQDIGRFGSLQFSSNYTNMLKRELQPQLNDPFLDLLGNPYAMWVYDSYAKVRADGSIGWAIDKFTTTLYFNYIGRTPNYLSYLGRGYDYVDPTSGYKAGKWGSYTTYNLSVNYRAMDNLTFSLMVNNLFNKVPDNQQHSYAGNIDVPYNNSLYNAYGRAIYVQAQYDFGRK

SEQ ID NO: 7351 - protein, 366 aa, Sorangium cellulosum
MPELCHRQIIRQQQIMKKSALTVLIALLPLAATAQTPSINGNGKKIEKEKMESKDYLPKIHGTIRAKYEYQTTMGAGRFEVRNARVSVTGNVLPSVAYKAEIDLSDEGQIKMLDAYARLFPTKGLTVTTGQMRVPFTIDAHRSPHQQYFPNRSFIAKQVGNVRDVGFIVGYTLPTNIPITVEGGLFNGSGLTNQKEWHKEVNYSAKAQFLFTKGLNLTLSIQSIQPEEIRVQSYDIGAYYESDRFHIEAEYLYKQYSDNAFKDVQAVNTFINYDLPLRKIFNKMSFLLRYDMMTDQSDAKTTDEETGALVTTDYKRQRLTGGITFSLSKAFRTDLRLNYEKYFYANSSIAKESEQDKIVLELMVRF

SEQ ID NO: 7352 - protein, 1091 aa, Sorangium cellulosum
MTPSVQHSLKRRTPAPRTVVRLFLMAGISYSVLPSVSAHAQTSTTAPAKHVSAHKSAAKKKAPAKAATTARTAPVAAPAATAATPVATATATAPVTQSNSKVLQQGTEASGSAEVVTVTGTRLSQTRLTNVMAGTSLSADQIRKRGYTDIGIALMRENPAFGAGDNSPIGTQGSFGAGQSYTSLLNLGSQRTLTLIDGMRMVGGETASLYGAGSGSQVDISAIPTSLLKGVDTKLGGAGAAYGADAVAGVVNYQLDDHFTGVDFNAQGNWSQKLDAPGEKITFKVGHDFDHGKGGMVFDVEYRNSGGMLDNDRINLTGRNATTYVREPIGSTSPYTYDFARGARNVIASVTGVPQLTGGNPPIYGGKVVDGISNAAGQPLMFSSNGQSLVPMTWNYATKSPTTVVGGNGTALQDYGQLYAPTQKLNLTLLGHYDITDHIHATWQGWYARGTASSEVAQGTWSTPVFKEPLTLENYHNDGAVIGAYQLSTNNPFLTAAERATITNALAAKGLPTDTFYMSRLNQDLDGGMYQTTMQMYRFQGGLNGDFDAVGRHFNWKVTGEYSRYLNDTWQPSIVAQNLINALNVTTDAGGNIICSPGYTSAPVKTRSSTCAPFNPFGSGQSTPAAVNYITADAHQKNANAQRDIQAEISSTVMRLPAGDVRWDIGYEHRREGYRFNPGAFSRGWEQDDGSYLQYGSSASLPPTGGAYHTHEVFGELDVPLVSPNMHVPGVYSLSATANGRYINNSMTGGYWTYMFGGAWWPTQDIGLSGNYARSVRNPSVTELFAPQSTDYEDGIDPCSSAGLNSGPNPAVRAANCAKAGIKQPFESNFNNFTVQGTAGGNSKLKNEVSTSYTGTLELRPHFIRGFDFRGSFVDVKINNAITSLGAQDIMDGCYDSTSYGPSNAYCAAFTRGADGQLENFTAGYYNIANYETQALQANIEYNTPLSRFGLPSSAGEIGLTGNYVHYLKSQQSYLGNTYLLTGTTGSPNDNFTLNANYIRGPFTLQWQTLWYGPSHYAVQVPATQYFANKRPSFAMFNLTVGYEITRNFSANFMVNNITNALPKYPGAVSLTRYYDAIIGRSFQMNLGVHF

SEQ ID NO: 7353 - protein, 194 aa, Phaeobacter gallaeciensis BS107
MTRIVSMAAIAAALSTPAFAGNLEEPVVAPAPAAPPVVVANDGGDWTGAYIGGQIGQLDADTSNGLSGDDVSYGVHAGYNYDFGRFVLGGEIDYDATDVDLGGGAATVDSVMRGKVKAGYDFGPVLAYVTGGVAQVDTSVGDETGEFYGIGVAYRVTDQWTVGGEVLEHDFDNLGSSGISADATTVSLRASYQF

SEQ ID NO: 7354 - protein, 1026 aa, Sorangium cellulosum
MMHTTFRTPARRLLSTALVSCLMLAAAPNVMAQSANASLRGQVSGAQAGSEVTATNVATGTVRRGTVRADGSYSLMGLDPGTYNVVANGQTQKVTVTVASTATLNFADAASSTPGTTAATNLDTVNVVAPTLLQEVRTSEVGKTVSLQQIQTTPQVSRNFLEFADAVPGMIFTRDAKGNTSLRGGATNSDGTNVYIDGVGQKSYVKGGGISGQSGSAGNPFPQLAIGEYKVITGNYKAEYGQVSSAAITAATKSGTNEFKGETFYRYTNDSMRAMTPAERQPGKSKEESAEKEYGFALGGPIIKDKAHFFVTYEAKRFDLPVTIAPDGAVSSAAANLPADGLAGLGPASQPFQQDLIFAKIDFEPTDNDRIELTFQDRDETQQQFSDQTAKVHGKVVDNTDRRYALRWNHSGERFYNELMVTHEEAFNNPLPLTYGNGIVYTAPDFGDKNRNTPQEKTLVQIGAADAFASQVKGQKGWAIEDNLTLDGLQWAGDHTIKMGAKYKQIDLYASDAAQINPQFFYTIDNPAFSSGTPYKAQFTKASTGVTGVQSEVRAKVKQIGLFIQDDWQVNDHLQLNIGLRWDYEKNPVYTDFVTPPEVVNALFSQDRHAPAGQTYAQTLALSGLNVNDYISTGHNRKNFKNAWQPRLGFSYDVNADEQHVFHGGAGRSYDRDLFDNLALETTKLALPQPTVFFRNPATGSCMYGQTPCFDWNPNLMNGIENVQALLGSTSNEGMEVDLLNNNMKVPYSDQFSLGMSNQIGEWLTDATISRTLTYDGFAYTLGNRFNNGNFFDNQMLCGADEPTYGQPWGCSIPGFGSLIIGQQGIKTRSTQILLSAQKPYSKESGWGTSIAYTWTNARHNRNINEHYSFDRGTIGEYPTIKSNGAPRHRLVVTGSYDGFWGITFGGKLTLATPTPGNDWSCIAQAGNSNCMPTPAAGTPSGNGHFLLGGKIFGYRSLDLQATKTFKLAGDTELYARIDIINVLNFDNFSKLNYVKSDGKLLVSYNETGDIIGTPRQVKAEVGFRF

SEQ ID NO: 7355 - protein, 699 aa, Phaeobacter gallaeciensis BS107
MILRRTAASACALLAAMPALAEVVELEQINVNQHSGEGFFGESVSLETGTIAKTGDPIAQTPRSVTVVTAQEIAARGAQNVEQALQYSAGIVGGQWGLDNRSDWYLVRGFRASTLHDGLPARYGFYNDTKPEPFLLNSVEVLKGPASGLYGSGSVGGVVNTTSKTAAQDAENLLQLQLGSHDRKQVAADVSGDLNASGTLRYRFAGVLRDAETQVDHSQDDVLALAPSITWRPNADTELTVLANYQENNGSPLIQFASIYGTLLPATGFGNGDFLPNSVFVGEPGFDRFDSEQRAITAMFKHRFNPVWSLNANARYLEAEALYQHAWWAFDNTGTGRYNPDGTINRTFYRAENKLKTWAIDAYATAEYAAGGFDMRTFAGVSYSRGHYDSDSGYGAQVGPIDPFNPVYAGYPSITVADTPGTSITEAGAYVQHRAVYDDRLFIDLGLRYGDIETGPSTGSFGATSIAAKDSEWTGNAAVMYRFGNGLAPYISYAESFRQDAIGTDVNGTPFEPTRGEQVEIGVKYQPPGTDTLLTAAVFDLTKSNLTVADPGNPGFQVQTGEASARGLELEAYHRFGDLTVDAAYTYLDTEDAEGDYIAQVPKNAASLWLNYAPLEGRLQGWTLGAGVRYNGEAWGGSSTYLTPSYTLYDAAVSYGQDNWLVSLNLRNLSDERYVSTCAGGACYFGDGRNVALTLTTKF

SEQ ID NO: 7356 - protein, 99 aa, Sorangium cellulosum
MTSGLERLSNLLSKKDSVFVSDLLREAKVNELDETLSTTRLNHLIDKGYERITLQLDLGGESPGYLEKDKHYREADAALLNVIYPTNLSKINTRRKEQV

SEQ ID NO: 7357 - protein, 1196 aa, Sorangium cellulosum
MRRANWFAASLLSTLLLMTSMLWASITGSISGVITDSSGAVVAGANVTATDTQTGTHTTVVTDSKGFYNFPSLAVGNYTVEISRPGFKQYRTTDLVVNANSALRLDAALVVGAASEKVEVTSEAVHVETQSTQMGEVITGKTMTAVPLNGRAFTDLLALQPGVSPYNSSDTGMAGVNDRPVDGGLNSGNQSVNGQREASNGFMVNGSNVEEGKTNGAAIIPNLDSISEFRIITNNYDAEYGNYSGGQINVVTKSGTNALHGTVFDFLRNTSLDAKNYFAAHSDPTPVFRQNQFGGTIGGAIKKNSTFFFVDYQGTRQTLAPTVTAQVPTVDNLGGNFSDSADSFSGVVNGPYFANLLSQRLGYNVNDQEPYYTAGCTNATQCVFPNADVPKAAWSPVATAMVGMGLIPQPNVSTQNFNYETSQYAQTLRDDKGGVRIDQNWRFGQLFGYYFADDYLLDSPFPSGGASVPAQGFPYSATTSGRAQLVNIGDTKSFGATAVNEFRFSYVRNTLSLTTPTSGIGSNFSLANLGFVTPWGAASGGISPIAPGLEGVPYITFNSFGIGVPQVSTRQYNNSFQWLDNFSKVIGTHSLKFGGQFHYDQINERNLAAENGQYGFSGSETGIDFADFLIGAPDSLTQASPQILDSRSKYYALFAQDSWRVTPNLVFNYGLRWEASMPWYDTQNKTETIIPGKQSVKFPGAPPGYVVAGDPGVPRTLAPTQWANFSPRLGLAYSPSATSGFWAKVFGGPGRTSIRIGGGLYYTSVEDLSQFLEVGDPPYGLYYGSANPPLLEAPYLARYSGDSVGQRFPFPYPPTNVSPSNPDSTFPWAQVEPLSYDWSFNSHNKLPYSEHYELSLQRQIGADTVVTASYVGNQAHRLVAAVESNPTNQAACLFLSDSANLGPNSAGPCGPFSETPPFTVTVVGGESIGTTTPWVTSTGKVVNSVRPLGPLFDTNPWVSTIANSNYNSLQMSANYESSSLSFLAAYTFSKCMDNASGLQDSVYPYDPRVSRALCNFDVTHNFVISYNWLLPFDKYASKRWERALIGGWALSGITSFATGLPVSLSENDDNSLIGANAAPVDVPNCSYSGAVLGDTDPRSGKPYFNTALFSPEQLGQFGNCRRRYFHGPGINNFNMALLKTVVFTESKQLQLRFEAFNVFNHAQFTNPSGEINSDTFGLVTNARDPRIMQVGAKFIF

SEQ ID NO: 7358 - protein, 753 aa, Sorangium cellulosum
MRHLAGANTSFRACLLAGIGLSIAVPAAAQSPAAETGDIIVTALKRDTTLQDTPIAISAVTGETLTKSGVRDIGALNAPSLNFVDGGPSSRRVVIRGIQAAGEPTVGVYYDETPVTGALGAGNDAGSNTPELRLFDVERVEVLRGPQGTLYGSGSMGGTLRIIYNKPVFETRMAADVSLSGTEDGGFNYLGNAMVNVPLMQDVMALRVTGFYGRDAGYIDNVALGIDNINKTKVYGGRAQLRIVPTSALKLDLAAFVNRSRTDTPSWALEAGRYKTDSLTRQPRRDDFELYSGTANWDLGGVVATGVLSYAHLRSVAANDVSRYLAGNRSPGACAALVNANTPCGADKLADFYALVDDQVPSALDPDQTVKTLTTELRLSSDGKGPLNWTVGGFYSRRHSLLANRHLHADPVTGELQPGRPLLVLRNVDDLLKQVAAFGELSWDLTDRLNLTAGIRYFKYDKVVSGETPIGNVLVRSAVLPLTTVTSSEDGTTLKFNASYKITRDVMVYAGAAQGFRPGGLNQVIGLDPSLAPYRSDNVWNYELGIKSTLFDRRLTLNADVFQIDWSDIQITGTTPNGAFRFITNAGSARVKGIEAEASLRPVDGLLLEANGSYIDAKLTTDQKTATVSAPGKAGDRIPYVPKLTGSVAAEYRWAVGGDLGAMVRIDLRHVGSSFSDFRPTGTFTRRLGAYELVNARIGLQAEDGRWGAYLFATNLFDKVAVTRSTASALTGGRTFVNTVAPRTIGINLRTDF

SEQ ID NO: 7359 - protein, 894 aa, Sorangium cellulosum
MTPPTRYPRRTVLLLSAGATILTQTLSSAFAAPASSVHIAPQPMGQALVTLGQQTGRNIIFTSDAVANLRAPAVDGTLSPDEAVKRLLRGSGLKAEAMPDGGVIIRKGTPPRPKPQRLRETQAHEIEQIVATGHRTRSVMSVSGDEMQTLMPGQSPMQALDLLPGVTFTNVDPWGNNEQNSSIYVHGFNQNQLGYTMDGVPLGAGAYGNYNGLSPQRAAISEDIGSTSLSSGAGALGTASTSNLGGTIEFTTRDPKQKAGATINQTFGSYSTFRTFARVDTGNFGNGNSAYMAFARQDARPWNLGNANRQGGYQVNGKFVHKGENTTITAYFDWQNKAEPNTQGLTAPTDLYARGAFYPDLNAAMAGYPAESSTKAGPATPNNKYYFSAAQRTDYLTYLKISHRFSPNLTWDNQLYFHYDDGAGVVATSIRTNAILTILGTYLDPTGTKYIKNGQFTYSVAGIDPKVWNATGGTGFAVRTTEYNDYRGGLTSTLHYHLGHHNIELGGWYERNNNMQARRWYPLTATNTLTPYERPTNPLFTQWQNNFYTNTFVTHLQDSWKVTPRLTLTAGFKSELVYTNGTLPIAALPQSLASSVKGAKTIVDTSTQTIAGGTIPSYNPFLPAFGALWNFTQHEQLFANIQENMDSFASTGYGSTSPWAVSSQADFEKFKRSGKPESSWTYETGIRTSHPINTRILTGISGQLEYYHVDFYNRLGTISPPGQGISGVGNTVANLGSVSTNGMDLSFTLRFGPHFSIYDAVSYVSSIYGNDFMDGATLYATQGKMVPAIPAWSDKFAVNYNQGGFNAQFSGSYMGVRPGTITNSVMVPPRVLLAFSSSYTFHQIPHMNSLKLQFNASNLTNSRSWSSISAGDGSTYTGYPTAPRMFFGTVSAAF

SEQ ID NO: 7360 - protein, 238 aa, Sorangium cellulosum
MTTPRTLWKLTTLSLMLSAPAFAADEVEQAQEDRGFALGLRAGYGVPLGHAAGSDLGETPKMSEVFKSAIPLQVEAGYFFNSNVYLGAYFQYAPVLIAEDCDSDVSCSANQMRFGINASYHFRAGEKLMPWMGLGIGYEMLKLNVSSSEDGVEATIGTGVRGIEFAALQAGADYRINDTFSIGPYLSLAAGVYQSSTSSIEMKNVPIIGDVSESESESIDNKTVHAWLSGGVRMQFRF

SEQ ID NO: 7361 - protein, 1177 aa, Sorangium cellulosum
MSSSAYLKVWKYAALGSALLPIAAKAGDIPTTPPVNFTNSSTATVGSTMVNVVDAYTNLMLNDPKLTNGTGVMEQNLATVIRMTNARTAAQTLEAIHDDRTSQQYSVLNGLGVLTGYFMTGTGASASTTPTSLTPTTYAPYTLQNFQSNINYLNSASWGATSFGNGTATPLASAVNFVNNVVRANSSTEPSKRTFERYMGSTAPVTTPSALGASVNQTTVSPLAAAFSNYNATTKTGLSTADTANIVVPSYYGNLTVPAVYGNVTNWVRGFTVTQAMIDAQNVANGTSLGYLTVPNVGTIVNGVLQPTQFNVGDYVPGVGASARPYRLSTDVNVPTPLLQIINSTNPYADGGFISGHTNSGYTQALGLAFLVPQEYQSLLARAADLGNNRILAGMHSPLDVIGGRMFATAVAATNIYNSLYDANGNRLDWTNPANASAYAVYQAYTQTQSYLSQSCGTVSVQACILQSQGGAAAIAASSKDVNLSNADPSSYTYRMTYGMQLAGASTTLPETVPVQAQVLLLTRFPYLSDAQRTEILRTTALPSGYALLDGNTWDGWGRINLYKAAYGYGAFDSAVTVSMDAAQGGYNAFDIWSNDISGAGSLTKSGSGTLVLAGANSYSGGTTVNGGTLVVAAGATVTSPVTVNAGGTLSGLGTVGDVSVAGTLAPGYQAVTGLTGQAGKLNVLGSLAFTSGATYALQLTPGSFSTTSVSGTATLAGQVTATFAGGIYAAGSRLAIVSSGRGVSGRFAGLSTTMTGPTNVAPSLSYDGQNAYLTLNQAALPSLPATGVNGNGQQIYAALNNAVSKGGTLPVSLQSIYFQNAAGVGAVFNQLASQSAPAATQSLGQSMTGFMTTVLDFGSGGRAGGFASTGSSPMMAYADATGGPSTKAAKMFAKAMPAEPGWAVWGSAFGGGGHIGGDTAAGSQDVSSRIYGLATGADYRLAPDMTVGFALSGGQTSFNVAQGGGYGSSDFIQAAAYATKRFGQAYLSGSLAAGAHWMSTTRNLATGAAETLRASYTAPTLAARAEAGYRFDLGWSSLTPYAALQLQQVWSPSYTETSSLSANGSALSFAARDTTLPRTELGVWADRRISETFLLRGRAAWSHDYNHDATVTATFQTLPGASFVTTGARIAADSALLSGVAEVALTSRLSLSGQIDGQFAPSATTWAGTGRLRYQW

SEQ ID NO: 7362 - protein, 748 aa, Sorangium cellulosum
MSCTTSHTIFFEGKRRTRVKHLLIIVTGILALAFYQYPGVSAAGESIPVLKEEQETNDRILTKWAERPDNQAAQEKLIIRIPGKEEIPEVIEEAYPADEFKSIETIQKQPDNVKNIPEEPEVYPLPFEEKIPLSHTTIPSPETPKDPPPKDGKDRQCEDANDTEDTVITPTRTKQLSKNVGSSLSIITQKDIENSKAPLLLDVLRQAPGIEVTRTQGIGGTTSLFIRGASAAHTLVFVDGVQMNSPTSGAFNFANLSTDNIERVEILRGPQSTLYGSEAIGGVVNIITKKGAGDNKVNLGTEYGMRDTYRETVNVSGGKENFDYSVGGSYLKTLGISAASSGSEKDGYKNLTGSARLGWNFLDNGRVDTTIRGSHSDFEYDAFVYGVGAVDDPDRRQTTDEVLFSAKASKTFFDIWTPSFLISVNDTELKGFDPTDESGRFRIPTRVWRAEHQSDFLLFDVNTITLGYEYEVLEGKNEGKYDGQTYRNNAVFLQNQIELFESLHWTIGLRHDDFSTFGSHLTYRTTASYNMEEIGARLHGSWGKGFRAPSLNELIYPYYGNPHLRPEESKGWDFGVEKEILKDTLTIDVTYFENNFKNLITATVQPDGSYLAENAARAESQGIETILTYKPFTILSFTGTYTYTDTRDREKDQQLPRRPENRATLGINTNPIEKLNINVTGIMVRDRIDSNGTKMDNYWTVNQATRYDVTKFMAAYVRFENLFDYDYEEVTGFGSLGFTAYGGVEFKF

SEQ ID NO: 7363 - protein, 680 aa, Sorangium cellulosum
MEVRIVTVSKKEEPIFEAPLSSTVLTADEIKNAGATSIMEALRLVPGVIVREETPGNYDIHIRGFDGLDPYALGIQKINTTTLVMVNNRIVYNDAFGGTLWDVLSVGINDVEKIEVVRGPAAALYGPNAVTGVINIITKSPNQKAGWSGSTYSQVGTYSTYLANGAVNYATEDKKFSFRLSSSMEKRDRQEVDYFVLGSESYSATPEYFSDGRTNTLVDEQFPDYELATDNYSMYAHGKYEDEDLELNILGGVSRSKLQRLYFMSSDYTLSTEKNESEFTQLAGEWNGFTFNTDYTNTRNNTLKTFDFTVRTFNVNVDYNIPITESFSIKPGLSFHYVKTISNDSTLLFSDEIITDREELSTRNGMNSSVTNTTTSGFVRGEYFINKLRLIGALRLDKFNTPDKWLLSPQILATYQVDRDLLLRASYGRAARTPFSANLFAKFIPDYKTTFVYLLSGETIPDELLVIDIFEIGGRMKVSDKLSFDVELFYAVGDDFETIEISGGDPSVIINPSSPILFSYATSTMTAKNYGMTLSMMYTPFEKMSCKAYVTLQESKIDDYNVSQNVVWRDIEDASDSSFTSENTPTVFGGFSINYLPAKKWTLNLNSYFYSAQVRTLAGVTAASEDIKANILLNTVASYEIADGIKLFANARNLLGGNRRQYGMSDRIKMTISGGLNATF

SEQ ID NO: 7364 - protein, 892 aa, Sorangium cellulosum
MCLAADFIFSLSVGADMFFGDGGQLLSDKSLTGSAGGGNNRMKFNILPLAFFIGIIVSPARAELYFNPRFLSDDPDAVADLSAFTQGQELPPGVYRVDIYLNDTYISTRDVQFQMSQDGKQLAPCLSPEHMSAMGVNRYAVPGMERLPADTCTSLNSMIQGATFRFDVGQQRLYLTVPQLYMSNQARGYIAPEYWDNGITAALLNYDFSGNRVRDSYGGTSDYAYLNLKTGLNIGSWRLRDNTSWSYSAGKGYSQNNWQHINTWLERDIVSLRSRLTMGDSYTRGDIFDGVNFRGIQLASDDNMVPDSQRGYAPTIHGISRGTSRISIRQNGYEIYQSTLPPGPFEINDIYPAGSGGDLQVTLQEADGSVQRFNVPWSSVPVLQREGHLKYALSAGEFRSGGHQQDNPRFAEGTLKYGLPAGWTVYGGAWIAERYRAFNLGVGKNMGWLGAVSLDATRANARLPDESRHDGQSYRFLYNKSLTETGTNIQLIGYRYSTRGYFSFADTAWKKMSGYSVLTQDGVIQIQPKYTDYYNLAYNKRGRVQVSISQQTGESSTLYLSGSHQSYWGTDRTDRQLNAGFNSSVNDISWSLNYSLSRNAWQHETDRILSFDVSIPFSHWMRSDSTSAWRNASARYSQTLEAHGQAASTAGLYGTLLGDNNLGYSIQSGYTRGGYEGSSKTGYASLNYRGGYGNASAGYSHSGGYRQLYYGLSGGILAHANGLTLSQPLGDTLILVRAPGASDTRIENQTGVSTDWRGYAVLPYATDYRENRVALDTNTLADNVDIENTVVSVVPTHGAVVRADYKTRVGVKVLMTLMRNGKAVPFGSVVTARNGGSSIAGENGQVYLSGMPLSGQVSVKWGSQTTDQCTADYKLPKESAGQILSHVTASCR

SEQ ID NO: 7365 - protein, 664 aa, Sorangium cellulosum
MTPAWAQDAATPPPDSAAAEHPAEQAEAALEDNIFQMAPVVVTATRTEQDVTSAPASVTVVTQEDLKRAPVGDLTDAIRLAPGISLTAGSQGRRGISIRGMDSSYTLILVDGKRVNSLEAVFRHNDFDIGLIPTEGIERIEVVRGAMSSLYGSEALGGVINIITKPIAPKWTGGIDLKAQTPTVGANGEELRSSVFLSGPLIEDTLSMKLTGGFNHRQAWNGARNPGSPVLNADGAPVTREDGSVVNHGDLATLEGRNDHNGRLSLNWTPTAQQTITAEYGRAYQNRIGEYYIGGSYGDADAVVHRNDAVLGHKGKWDWGNSEVRGYWEGLESGVDGLTQDNIVAEANATAYLGINTLTVGGEARWIDLKSDEFTSGGASVHQQALYAQDELALMDKLTLLLGARLDNHENFGLHFTPRAYAVYSPINHLTLKAGVGTGFKAPTLRQMSTESLVTSCRGRCGIIGNPDLDPEKSTNFEVSANWTMTSWALSATVFQNNIRNLIDTPRGTGVEPVGTDPGTGLPLYVPRNVNRARLRGVEATASKAFGNVVRLSANYTFLESRDLENDVQLAYRPKHTLNGQIDLTPVDKLKAFVRGQYIGTQLSGTEEVEAYALFDAGASYDISKNFGVNAGVLNLANTRTEDEEGYVFQERGRTLYAGVNARF

SEQ ID NO: 7366 - protein, 731 aa, Sorangium cellulosum
MSFRRPLRRARALRPWRAGLPALITLCVAGGAHAQAQRAAPASAASAADAASPAAPPAAERELPAISVSASAVADPTVGYQPRTSSIAGGDDRALKDIPQSIAVVSSAVMEDQHANSLDDVLGNVSGITQTNTLGGTRDAFIKRGFGSNNDGSVLVDGVRTPVLHSYLATIDRVEVLKGPASLLYGMQDPGGVINLVTRKPEAEFGGSISASRTSHGGSSAQFDLTGPLGKPGQVAGGTLAFRLTGEYDTSRYWRSFGRERDALIAPALSWHDANTSIDVAYQYVDYTTPFDRGTVLVNGRPDDALRYRRYEEAWSQSGGIQETLRARIEHRFSDAWRVRATYGWGRDRYDQYLTRAAAFNSKTGALTRSSDANLGRNDADQIATLGLLGNLTLAGMHHALYIGGEYELQRSFRGDTIRGTATKGFDLYDPVYGLLAPGGTVSAKQSDSLSKVHAYSMIVQDTVKLTERLTASAGLRWEDWQQESGMGRPFVFADRSHGNVWLPQFGLAYALTPSLTAYANVSRSFKPNVASNVAAPLAPEFGRVLEAGLKFSMTPAISGTLAAYQIDKRNVAVTVGDLTSTIGTARSRGIELDVAGQLTRHLSLIGSYAYTNANDRDSNTPLANVARHTGSLFAVYDTAIANLPGRWRFGGGARLVGARPGDTANSFTLPGYVTVDAFAAYETMVGKFPTRIQLNVKNLLDKTYYPSSNSNLIVAVGEPRLVTLTTTVSF

SEQ ID NO: 7367 - protein, 200 aa, Phaeobacter gallaeciensis BS107
MTRMVSALALSAALAALAGPALAQSQGDWTLGVGIANVNPKSDNGTVAGAAATIDDDTALTFTAEYFIRDNIGIELLAASPFEHDISLNGAYTATTKHLPPTLSVNYHFPTQTKFKPFVGVGINYTTFFEESSPAGVISLDDSVGLALNLGADWQISDRGALRVNVRYMDIETDVTLNGTKIGTAEIDPVTVGFGYVHRF

SEQ ID NO: 7368 - protein, 931 aa, Sorangium cellulosum
MPPPAVPPQLPEVPAADLPRVRAPLSTYRRPQRTDFVTPAGGPFIAKQDKALNTIDLKMAHDQKLRGYRVKVAVVDEGVRSDHPLLNVEKKYGGDYMADGTRTYPDPKRQGRHGTSVALVLAGQNTDTYRGGVAPNADLYSANIGTRAGHVSYEAAFHAWSDLLGHGIKIFNNSFATEGPEGEQRVKEDRNEYQRAANKQNTYIGRLDRLVRDGALLIFAAGNGRPSGRAYSEVGSVGRTPRVEPHLQRGLIVVTAVDENGRLETWANRCGQAQQWCLAAPSTAYLPGLDKNNPDSIHVEQGTSLSAPLVTGAAVLVQDRFRWMDNDNLRTTLLTTAQDKGPYGVDPQYGWGVLDVGRAVQGPAQFAFGDFVARVTDTSTFGNDISGAGGLVVDGPGALVLAGANTYAGRTTIKRGTLDVFGSVTSAVTVEPGGTLTGIGTVGTVTNQGTVVNKEAGLHVKGDYSQTAQGLLVTDIGSLLDVSGRASLAGRLHVDDIRPGYVGGDGKSVPVIKAGAVSGVFATLTRSPGLLLNARLDYQPQAVYLTMRRAERVHAVAQRAADDGRRASVLAVAERLDAAMRELDALPESQRDAAAPAAAIGRIQRVQSRKVLQDNLYSLAGATYANAAAVNTLEQNRWMDRLENHLAQTGGERVAAIAEYRHGQLRWRPDGLQGRQRGNGIMLGLAREVSAGLSLAAALTHSRTHWDESSGAPARDNAAMTTPGVLLGARRAWDDGWFVQGALGYSRYRNQATRHISLGDAGHTVGATARGHVWQADAGLGRQWTLAPGHTLAPRAGLQLTHLHQQGFSESGAQGLGLRARALTRTVPTLWAQLQSRHAFMLGATPMTAQLQLGVWHDLRARRYAASGGFAGLAQDQGASGYWPVPRTRVQGALGLRAEFAPGLALGLGYTGQLATHWVDHQLSASLTYRY

SEQ ID NO: 7369 - protein, 611 aa, Sorangium cellulosum
MCEMAICPALRIGMIRVILHGDARRIRLRRICISGNHATGRSVAGQSSILPRLSVRDLGKFVKRWRRNVSRTRIAATAIGLAGVLAASQAQAQSASNSEQEIALLKQQLKMLEQKLDKLQSQTAANTAATAKAKAEAKAEAKAEARSEAKAVVANANAAIPLKGPAPASGVVVTMPNNRPTICTADGANCVAITSRVHWDVGGYDYRPNTAGTVPQKLDSGENVRRARIGVVGKFLEDWNFALIYDFGGSADGFGGTGAAGATPVGFLPGGGTSGIENAYVSYTGLKPFGGKMAIEAGIMDLAWTLDESSSSNDIPFMERASVGVIAQNIAAGDFRSAVGARWYNDVFWAGAYVTGPTTGAIHSASSVSPPGTSEQYGATARVAGQLVSGKDYSLHLGGDAQWLIQPPRNLVANTQTLTLSDRPELRIDPTTLISTGAIANVAGAQVYGVEAAATYGSLFLQGEYYWFNIDRNANTSVPLIGAPSLKFQGGYAEAAYVLTGESRKYNPANASYGGVKPDHPFSLDGGGWGAWEIAGRYSTMDLNNQLATAAGIAGGRQTVYTLALNWYVNGNVRFMLDYLHGTVSKQASPVSTADVGSKFDAVAMRTQFAF

SEQ ID NO: 7370 - protein, 664 aa, Phaeobacter gallaeciensis BS107
MAHTTAHKSSILLTGLLCSTALTVFSATKGHAEDDGVLSLDPIIVKQRDADGDAADRATAVYVADAEIERAAMGDLKDLFAGIASVSVGGAIPVAQKIYVNGIDMLKLAVQVDGVSQNNRVFHHASANAFDPGLMKSVRVDPGVAPADAGPGALAGRVVMETIDAEDILTEGQAIGGKTRLSYGENGDTFGTSLTLAGQSNGFEILLYGKRMTGDDYTDGAGNTVGGTRSDLTAGLLKLAYETDAGHRFEFSGQQMQDTALRNRRANFGTASFNPLDTVYDTKRTVYSLRYEDVNGGGNWDPSATIGFSENEIGSIGTTETSVGVTRTYSATFQNRFHLSESDTITAGIDFQDQKSSASGDYWGTNRPSETSQTIGVFAQARLQPSDRLKVSAGLRYDWNAFTGQDFGQSGRPYEQDSSGLSGNLSIVYDVNDALSLRAGYSNVFGGIGIEDNFLFFRDWDYSALKPRRASNVVVGADWQSGNWTLGAQAFQTKIDDTRDVAGPTVTSYDFESRGYNLGATYGWDSGFARLTFTDSETRVNGAATSSYYVLDSGAPIGQVLALEVQQELPQWDLVVGGHIDAAFDYDQQLNEADATTQLEGYEVLNLFAEYRPAAYDNVTIRAEINNVFDRQYADRATYGGDYPGFATLKEPGRSVSLVANVSF

SEQ ID NO: 7371 - protein, 640 aa, Roseobacter litoralis Och 149
MRTYFNKAALSAAVLSCLSTPAYSQTLNQDIETLTVTGTRLPISLTKLPGSVSVLTESDIQASGALQLTDLIRGLPGVSLAQSGSPGGLAEVRVRGSETNHLLILIDGVVSNDIGQGSLVDLAHLTSANVVRIELLRGPQSARWGSGAIGGVLSITTKSGQFAANTSHVDFSAAAGTQGTLQGSMNARSQSDNVGVSAYASYIRTDGDNVSRVGNEDDGYDNMTAGLNLNYAVSNEHTLIANLRTVHYENDYDGTDFAVTGLPTDTDNVTDGAQLSAKLRWEFAPNNTQYRSALSAHYRKDENDNTESGVDAGGTTGERIELNWTSFYAIKNWDFAGGVEYLQRLFDQRGPINFGDPNQKQHDNTYSVFAESNGQLTESLTATLSARYDNNSEFDNALSYRGGLSWQLNNHYTLFTSYGSAVKTPTFTERFGFFPASFVGNPNLEPETSEEWEVGVKANWKKVTGQISVYTADLEDEINGFVFVPDAGAFSADNIDGESAREGVDVELNWNSGYGDITAAYSYLDAEQTDNGITNTELRRARHQGSLTYTTDFGTDTFSLYTKLAYTGSHYDTFFPPFPEPSQTLALSAYTLATVNLSYQIDAKWQVSLKVDNAFDTDYEDIVGYAGQERRALLSVNYSM

SEQ ID NO: 7372 - protein, 806 aa, Sorangium cellulosum
MRWICFSLSLSAAWGLTAAPTLAHTAQDLRETASLSAMDLAAPLPEAALAQAGEPQSAPPEADLLDEVTVSATRRPTRERDTTATTYTVKREDFQALGARTVPDALALIPAFETQPALGGVRNARGLFLRGFDDARFQVLKDGLSLTRPSNGRNDLSRLPLADIERIEVLTGGATLRYGAGAVGGVINLITETPAGAPKLTLAYEAGSYGNSTATAKYGGGDSTFNYLFTYTGLVAFNNYPFRFTLPNTALFYGPEAITPDGTSLFGFLRPEVGPPLTLTGVADSAFNASDTYTGKLVWRPSAEHRLTLRASHQNSKNAGNGPGLYAAGACFGGPGSGNATLESQTRFLPLDAAGRELSCDTQRYLVSTPSAAVAIPYAFKRSADGTVTFAPGQSYPAAESAIGTIDFYITTFQSQTETAFFWDYDLSPTASINSYAAYYRFTSPRTRPARFAVNTDVLGGETAFALGQLGSPFTEDSKLELQSALNTQISPGQTLSFGVNFIEDRSFQQQQRGSTFVDRAIARTSLFLIDDIRFGDQLAANLGVRYTDSTQFGAVLTPAAGIRFSPSRAFSLRANWSQVFNAPNISDLYTAGGVFVPNPDLRPETGITYDLGFDFTPASNLGLRFTYFNTTLDGAIATVFFRNPDSGDPNLFLQQQRNLDTRYASGLEVVGDWQVADQWRLRLTWTNTDARFVGAVDSNDTRLFFAQYQDPNIPFNRVALAATYAHRGWSATLLGRYAGGRRRGEDPFGVPAYASVDLNFELPVAPRFTLTGNLFNLTDTQYEYAAGIPAPGFTFRLGGRVELGG

SEQ ID NO: 7373 - protein, 980 aa, Gluconacetobacter diazotrophicus
MTVQSLFHGVSRTRALGLVAIGLGAGSLAQTVLADPLPSSSTTYETLNYGTTGTFLTGIRGDNIVGNYTIPGTTETGGLYYNMTSHTWSPMPEATDNGANYPGAIGSSPYGPSFGTPGGILRVVGSYQTEASAPYDLSYLYDAAAAPGQTLTPLAYPGTDTLYTIAHSNFGNQVVGDYDTRLATGNAFIYNIDTKTYITNNIPGAVSTTAYGIYGDKIAGGYGEVEVGGGLHAEHGYIYDQTTGTYETYDHPGAVATHFEGITGAGRSGEYNLVTNWVSADGVVHPAVMHIDALGVVTWYEIDIPGAVVSSNSAYGDNVVGIYVSTEGGTTTINGFIATIPGMYNPIRNIGTLNFADDNAAALSGLKGDDIINSGTIHVTGNGGIGMRGETYGVLTNKGTITASGIAGAAVELHGTYGTFLNYGILQTTVEADALRTGPDSHGTVIVNTGIIDGRLAATAGTDKRFENSGWLGVSGTGPTITHLFSGIFVQTAAGTYAARVTDEGSDFLEVTGTIRLSGTLQAAFLNTSFAPTTTLMVATDGITGTFDQVVTPGLPALFDASVAYAPTAVTMTVAADLAGKAGNTRNQRAVGGAIDRVINTTTDGLLTTLPTALSPLYGLTAAELPGALTALSGEAYASAQTVLLGDSAYSRDALLGRMRQGSYAGQGGPTAALGFGGPALAYAAPTTPGVPFPTKAQPSAEPAFNGTIWAQAFGGWSAYGGGRDTADVDASIGGLISGADVKVENWMLGAAVGYTHSSAQMDALASQSDADSMLVGLYAGASSGPWKLRLAASYAFNQIDASRTIAYPGYFQRAGADYSGGTGQVFAEVGYGFAVQHLALEPFAGLAYVLLNTDGFTETGATAGLTGASSTMGVGYSSLGLRLATTVELSRGMALEPNASVAWQYAFGDLTPDAQLAFLSVPSANFTVAGVPLAQNTALVKAGADLRIGQQVRLGMAYVGQFADSVTVNAVQANLAWRF

SEQ ID NO: 7374 - protein, 610 aa, Roseobacter litoralis Och 149
MTHTKKDSIQAGRNYMIDEVVVTGTRNETDVRHLPMTISVVGRQQIEKRYEPSLLPLLTEQVPGLFTTSRGIMGYGVSTGAAGGMSLRGIGGSPTAGLLVLIDGHPQYMGLMGHPIADAYQSMMAEKVEVLRGPASVLYGSNAMGGVINIVTRRQQEEGVKTNMQVGYGSYNTLQTEFSNRVKKGRFSSVVTGSYNRTDGHRPDMGFEQYGGYAKLGYDISSFWKVWGDVNVTHFNASNPGTIQVPLIDNDSRITRGMTSFALENHYEKTSGGLSFFYNWGRHKINDGYQIGKEPQKSHFNSKDKMLGVSWYQSATFFTGNRLTVGFDYQHFGGESWNKVLATGEHTPGVDKQMDEFAGYVDFRQDISSWFSLDAGIRVDHHSHVGTEWIPQGGLAFHLPKNAELKAMVSKGYRNPTIREMYMFPPANPELKPEKLINYELSYSQRLLEGVLSYGISLYYINGDNLIMSNGLFPPLNINSGEIENWGVETNIGYHINSHWNVNANYSWLHMENPVLAAPEHKLYAGADYTSGRWSISTGVQYVKGLYTSVVKGSEQQDHFVLWNLRGNYRVCRFANLFIKGENLLAQRYEINAGYPMPKATFMGGINLNF

SEQ ID NO: 7375 - protein, 612 aa, Gluconacetobacter diazotrophicus
MSENHASSVLTLWLGASLSALSWAEEISYLEKPVVVTASRTNEAAEDTLASVTVITRTDIERQQARSMQDLLHGIAGINIANTGGPGKLTTLLLRGTESDHVLVLVDGIRMGSATSGFSEIQNYPVELIDRIEIVRGPRSSLYGPEAVGGVIQIFTRKGGKKGLKPTLSFGGGSYGTINGSATLSGSSERAWFNLGISGSDTNGFNACKGSFSAGCFTIEPDKDGYRNISGSARAGYRFDNGLDVEASFLHTDGHYEYDGSFQNRTQLAQQVFGGTARYSLFEPWRITLTAGRSNEDSDNFKEKLFTTRYHARRDTISWQNDITITPNQLLTIGTDYLYDRINSSEKFTTTSRYNWGVFAQHQISLAAHKLQLSVRHDDNQQFGSQVTGGASWGYSLTERVRLTAGFGSAFKAPTFNELYFPGFGNPDLKPEDARTVELGAAGRFDWGNWSLNLYETWIDDLISYNAATFTPDNIDKARIQGLEAILNTEIKGWLIQTNLTFLDPQNRSKGANKGNILPRRSKQAFRIDASRQLGDFVVGAMFLAETNRYDDLANNQKLDDYVKVDLRAEYLINPQWRIQGRIENLFDKDYETAAFFNQPGRNFFVTLRYQP

SEQ ID NO: 7376 - protein, 379 aa, Gluconacetobacter diazotrophicus
MTMMRSFNSQFLFLLALFFLLFSSCSFAAKEADKQGGWKSINADYYSYITTATNTQSGTDNSAAAGIFRLFGNYVLGDSQNDYGKVVFKVEHRDSYTTTSPKYFVLNNVGAIGLIEPQFNDQGFRLTNLYWQKQWNNNNIEVLAGFLDTTDYVDTYMLGNPWSGFANFIFSTGAGSLAIPDEATLGIALRNMFTSNLYGLGSLTDANASSSEPFDGLFQGSELFSSLELGWVESLDSFYTRNLHLTYWRLDGGTRHSIEDSSGYNFSFIYKVDDWIPFIRAGYAEGDASLLSSSITMGLGYLGVGDGSDSINFAMGWGQPNKALFGAQFDDQYTTELFYKTSIGKHVTLSPNIQYLKTLPLSSDYDDSWVFGLRMHLKI

SEQ ID NO: 7377 - protein, 450 aa, Gluconacetobacter diazotrophicus
MAVVTKVKRILAALACGTLAQQGYAVGFLDDSKASISSRTLYYDGDQRSTGGADQRQTLTGLRLDFQSGYTEGVVGLGLDLQALAGFTLSGGTSPHNASTVNTVSPVTTDGSPVDNWSRIGGNARFKYSKTELKAGNALTFNLPVLISNDGRLLPASFQGAALTSNEFENLTLNGGFLNRAIGRASSNWAGISGGGAKGSDGFAFAGGDWNVRKNLKLQYYYANLEDYYSQNFLGLIHSFDMGVGQSLTTDLRYFKSDSDGKNGTDSRYALRNGYNENGKIDNTTWSLAFTYKAGGHALTLGHQQVSDKSGFATVNSSNVVDGRGRPEGEGGVQSLYLYTDVMVNSFTRAGENSTFGLYSYDFAALGVPGLKAGWTYVSGKDIRGTGNTTTGRYNEWESDYRLDYVLQSGTFKGLGFTLRKGVFRTGLPDSTLKDQDQVRFFVNYTYALW

SEQ ID NO: 7378 - protein, 134 aa, Gluconacetobacter diazotrophicus
MHVIDLSYFVKIYRSKNKHISVNFLRHLHRAGDLHLSGTTRCIYEDVIMKKCLTLLIATVLSGISLTAYAAQPMSNLDSGQLRPAGTVSATGASNLSDLEDKLAEKAREQGAKGYVINSAGGNDQMFGTATIYK

SEQ ID NO: 7379 - protein, 919 aa, Gluconacetobacter diazotrophicus
MTNQFMPRRARLMSGAATGLALLLTTAGLAHAQDKAAPANDTVEEITVTGIRAGIENAIALKKSSSSIVEAVSAEDIGKLPDTSIAESLARLPGLTAQRLDGRAQSISIRGLGPDYNTVLLNGREQVSTGDNRGVEFDQYPSEILSGVLVYKTPDAALIGQGLAGTADLQTIRPLKYGKKVLSANARYEFNSEDKLNPDAKDKGHRFSATYVDQFMNDTLGVAIAVSDISTPTQSRRFNAWGYPTTGTGDLVIGGAKPYVQSNNLKRTGVIGVLEYSPTDKFHTSLDLYYSKFREKQILRGIELPLFWSSATLQPGSTANGGLITNGVYSGVKGVMRNDLNTRHTTLKSAGWNIAYDTDNGWTLAADLSHSEAKRTDVIFESYAGTGPSGVGATDTMTFHTTPGAGTTFGSTLDYTNSTLFMLTDPQGWGAGAAGGALTQAGFYNTPSIKDELNAVRLSAKRDLAWGPINKVEFGYNASRREKSKQVHESFLTFGGRIADGAPQSRAIPKEALLGTVSLELIGIKAMLAYDPTYLLDNGYYTLIADQNPAVQTRNWAVKEDVQIAYAKFNIDSTVGSIPVTGNTGLQVVHTDQSSTGTRINPADTAHPANNDGGAKYTYVLPSLNLTFDLSNETFLRFGAARTLARARMDELRASQSFNMNAGNLTSTDPNNAYFSTDGGNPQLRPYIADGVDVSLEKYFGRSAYISAAGYYKKMSNFVNSSSSHLEDFSAFKPLLSPAQQAALGTTQGVAKGPENGKGGYIRGIELSASIQGDIFYEPLRNFGLIISGSYTDSSVKLDDNLPAIDMPGLSKKVINTTFYYENNGFNARISNRYRSKFLGEVAGLSAARIYRTVDTESVLDAQIGYEFRQGPLEGLSILLQANNITDEPFKTYENGDPRRTIDYQKYGSTYMVGASYRF

SEQ ID NO: 7380 - protein, 728 aa, Gluconacetobacter diazotrophicus
MVRLCVFSTGIHSFLQQWNDMSRMFKLHPLAACLAVALPALADDHDPQPLALPSTAITDTQDNRTIDLATPTQAGSRLGLSALETPASISSISERQIQQRNNITVQDAVTRSPGITFVGSPGDGGTGLSARGFAGHSSVMTLFDGARLYTGAGTQTFPVDPWMVERIEVIRGPASVLHGEGATGAVINVIPKKPFGGEVRNHLRLGYGSWDRQQLGLDSGGSLSERLSYRLTLNQQAGNGWVDRTASRSLALSAALRFDASDNLSFTLAHDRGDAQPANYYGTPLIDGHYRSSLRKKNYNVQNDVQQYVDEWTRLTTDWALNDQLSASNQLYYIKSRRHWRNAEDYSWDTGREQLLRGSYLEIKHNQEQFGDRQTFTFDHSLLGLASKTVLGTEYNKVRFNVDSNSPYNDVGGDYIDPWQPQSGWFHSASPLRPQTLSTTHTFALFAENRLQLSDRLSLVTGVRRDQNHIDRNNLTNDSRSDRSLQGGNWRVGLVYALNDDLSLYGQYSTSEDGVNNLISLSPAQMNYDLTEAKQTEAGLKQRFWEGRGEWTLAAYHIVKKKLLVDDPITHEKQQAGQQTSDGLEATLELALAHQWQVSANASLVRAKYDDFDEMVGGMPQDRAGNRPANVPRRTANLWLSKGFGQQVEAGIGARYVDERYADTANTQSAPGYTVVDANIAWQVLPDVKLGLQLNNLFDREYVQSAFSGQQWLMGIPRSYFATVDYSF

SEQ ID NO: 7381 - protein, 309 aa, Gluconacetobacter diazotrophicus
MKFVKSSLCVALLSGLSFNVLADVDVYGKANVTVQSTDDGEGSFTEIKSNASRFGLKGSEKITDGLEAVYKFEFQVDVTDADSKGDDDNISARNQYVGVKGSFGQVVVGRNDTAFKQAQGKLDLFNDLEGDIKNVFKGENRLGDSITYTSNSYEGFKVLATFIAEDDVDADNGYSMAVTYGDSALKKSAIYASIAADSEVNGYDVVRASIQGKVEDFKLGAMYQTQEKVDGSAEGDGYLLNAAYSMGKNTFKVQYQAMDFDDSDDKTAISVGVDHKLNKNIKVFGFYSSFDMDNNVDQDYLGLGMEYKF

SEQ ID NO: 7382 - protein, 393 aa, Gluconacetobacter diazotrophicus
MRRTSTVAAVAGLFAWGGAASAAQAGEVSLYGQVHAGLHQFAYEDSSDVTKFTDQGRTRWGVSGQQPLDDEWTAIGQLEWSASPHLGDDDFSRRISYVGVDSPYGELVVGTVHAAYKTLGGVRWDPLVATELQQRRTGGMSGGSFGHNDFVNRAVQYVSPEMAGLQLHAQIGVEDDNQDRTLSSPDPGDADQDLQQGDVILGASYLGLPDWHFIAAVMHLDERFTDVDDVDDGDTNWKVGARWAPDAFSLAYQYESVEIIRGPGGAGRIDNLVGDPSNRVDGESTTDDDPAFYDGRFTDAVDHHALIGTYQQGRNQWVLALGHADADGDDEDVSSITGAVVHQPHEDFRVYAGVQYQSFDDAIGSAGEDPDEAADDHLTTYAIGARYDFGATF

SEQ ID NO: 7383 - protein, 720 aa, Gluconacetobacter diazotrophicus
MPNLVPASDSPPVQSKTGTNTAAEASPLESSGRSLPVLNPVVITGTRTEQSSFSLPMSIDVVETKVIQEVQPRVNLSEALSRVPGLVIQNRQNYAQDLQISSRGFGARSTFGIRGIRIFVDDIPATMPDGQGQAANINLGSTKRIEVLRGPFSAIYGNASGGVIQAFTEDGPNETTLSGTLLGGSYGTSRGEIKLGGTLGGTDVISGPFNYVVDISRFQTSGYRDHSAATRYQASAKATYRFDHDANLTLVVNELHQGNTQDPLGLTQAQVIENPRQADISAHTFNTRKSIDNTQGGAVYEHRFSASNKIKLIGYAGTRQLEQFLAVPRGAQIPATSSGGVVDLDRQFGGAGLRWTYRSMGERPFTLTAGIEYEIFKERRKGFENFSGAILGVRGGLRRNENNTVSSLSQYGQAEWHFTQSWALSAAVRYTNVKFKSEDFFVRPGNADDSGSLTFRNVNPVLGLLYKATSTLNLYASGGWGFETPTFTELAYRPDGASGLNFSLRPSESRNIEVGFKWLATDNTRLNLALFESVVTDEILPATNIGGRATFQNATDTRRRGIELAAVHRFGADLSAYFSYTFLDARFRDSYTYQPRAGTPFVIVAEGNLVPGIPRNTAYGELAWRRGLPGFSAVIEAIYRDRVYANDINTEAAKQYAIANIRLAYSHQLGRLKLSEFIRIDNVSNAKYVGAVIVNEGNERFYEPSAGRNVIVGLNASYVF

SEQ ID NO: 7384 - protein, 502 aa, Gluconacetobacter diazotrophicus
MSQRPAPLLPTASRRARVPWPARAIVAAGCLALGAFSVTRAHAVPPTINLGNAAEAEDDASSGVFGFLSNWRRSANFLGNMWGLRPELGKYGAVLAVQETSEVFGNATGGNRRGVDYDGLTQAVLQINTQRAFGWYGGTFNVSMEQIHGRSLSQDNLQALQTISGIEADRSTRLWELWFDQKFLDQQQLDIKIGQQSLDQEYMISSNALIFANTMFGWPMVPSADLPGGGPAYPLSALGVRGKYWLATPLYVLGGVYSGSPTRALSGDPQQTNASGTSFPLDRGVMAIAEIQYVYPALGAMVSPDDEQPLSHVYRLGGWYDSEPFADQYYDNTGTPLASPASNGTPVNHRGAFSFYAVMDQMLWRSHVDPNRTINMFGRAMGTPQADRVPVDFSLNYGVTMKDPFPYRTDDTFGLAMGYTHVSSALARYDRAVHQYTGVYSPPQGGETYVEATYQYQFTGWMQWQPDFQYIFNPGGGIPNPSHPDHHIHNELVLGFRTNIAL

SEQ ID NO: 7385 - protein, 836 aa, Gluconacetobacter diazotrophicus
MKDRIPFAVNNITCVILLSLFCNAASAVEFNTDVLDAADKKNIDFTRFSEAGYVLPGQYLLDVIVNGQSISPASLQISFVEPQSSGDKAEKKLPQACLTSDMVRLMGLTAESLDKVVYWHDGQCADFHGLPGVDIRPDTGAGVLRINMPQAWLEYSDATWLPPSRWDDGIPGLMLDYNLNGTVSRNYQGGDSHQFSYNGTVGGNLGPWRLRADYQGSQEQSRYNGEKTTNRNFTWSRFYLFRAIPRWRANLTLGENNINSDIFRSWSYTGASLESDDRMLPPRLRGYAPQITGIAETNARVVVSQQGRVLYDSMVPAGPFSIQDLDSSVRGRLDVEVIEQNGRKKTFQVDTASVPYLTRPGQVRYKLVSGRSRGYGHETEGPVFATGEASWGLSNQWSLYGGAVLAGDYNALAAGAGWDLGVPGTLSADITQSVARIEGERTFQGKSWRLSYSKRFDNADADITFAGYRFSERNYMTMEQYLNARYRNDYSSREKEMYTVTLNKNVADWNTSFNLQYSRQTYWDIRKTDYYTVSVNRYFNVFGLQGVAVGLSASRSKYLGRDNDSAYLRISVPLGTGTASYSGSMSNDRYVNMAGYTDTFNDGLDSYSLNAGLNSGGGLTSQRQINAYYSHRSPLANLSANIASLQKGYTSFGVSASGGATITGKGAALHAGGMSGGTRLLVDTDGVGGVPVDGGQVVTNRWGTGVVTDISSYYRNTTSVDLKRLPDDVEATRSVVESALTEGAIGYRKFSVLKGKRLFAILRLADGSQPPFGASVTSEKGRELGMVADEGLAWLSGVTPGETLSVNWDGKIQCQVNVPETAISDQQLLLPCTPQK

SEQ ID NO: 7386 - protein, 885 aa, Gluconacetobacter diazotrophicus
MTLRRSLIAATILAMQFDLSAALAQTAPSQTATPQKPATSGHRHVAKAGKKAGAPKAHAATASAATPGVVPAAAVSTAAVAPVVPVAPVYHAPPPDAGEAVIVTGTHAYNRHARDSTAPITVISAATLQRTGAVNLADALTRMDPSITEQTMGADAGALTSSIRMRGLNPNEVLVLVDGKRRHTTANIYADQGPQQGSTPVDLNMLPANAIDHIEILRDGAAAMYGSDAIAGVVNIITKKTAHGLNLTGQTGANAYNGDGWQYQTGIDGGFSFLGDGYVHISGQVEHADHMVPKGASDLRTDPNNADYGGVNFPSNSNMIMSTPEETRENLLINFGKTVTEGIDFYGQITYAHRHSEAYENYRTPTKAPQIYPAGFSPLETIDENDFAATLGLKGDNFLGFDWDVSTTYGQDDDTIGNKNTANPNMLSTDPTVCGTNPANAATYSTDGCGWSPTTVLAERYSLAQWTNNADFRRRLKIANVVPVTVAFGAEHRLEQYQIWPGNPPSYQIGGTQGYAGLMPENAGKWGRDIWAGYLDGDFHLLPHWDLDFAGRFEHYTDFGNTENGKVSTRYDFTKRIAIRGTVSNGFRAPTLPEEHFSALNVSPTGATGLLSTTSAAGQSVGALPLKPERSFSAEAGLVLEPIDGWHVSADVYQINIRDRIFGSSTFSDSDALNAIAMTGASLPAGITNSDVFVNYFANVGSTKTQGLDIMSDYLLRLNQYGNVDLSLGVNLNRTKVTRTNTLANSLPALNAQTASYLTNGAPKNKIVLQAHWTIGQWDVNVRQTRYGATTILQTYEDQAPEALQYSNTQWLSFKNTAAWMTDLEVGYRLNHIWHFAVGANNIFNVRPRRLPLIVNYLGANQFDQNSSGIPFTGGYYYGRINASF

SEQ ID NO: 7387 - protein, 946 aa, Gluconacetobacter diazotrophicus
MTLFHGNNKTDNLSAQQILYLYQRFFNRNKPIMKYSFLLLITCVSTLMINSLSILLPSGAAGAATITGIVVDDADGLPLPAATISVKGSEEGAITGQNGRFRLENVATSNPVIVASYLGYMTEEYPVLLSSEGLAKLSIRLKPGIVVSQEITIVGEMLKGQAKALNQQKNNLNVTNVVAADQIGKFPDSNVGDALKRIPGISVFTDQGEARFGHIRGTEPRFNSVTVNGERIPSAEAENRTIQLDLIPADMVQTIEVTKALTPDMDADAIGGSINLVTKLPTEERFSLTAGGGWNMIDETGGARYQLGGTYGNRFLDGKLGVLFSVSYDDNDFGSDDIEAEWDAEEDGIEALKEFQVRQYDVRRIRKSFSTGLDYRFNENHVLKFNGIYNWRKDYENRYRGSYKDLDEDLAELVWETKGGTNNNARLEDQRMMSFTLGGEHDFGKLDLDWQAAYSKASEERPNERYVSFVAEDQPFITDISNPEHPLVTVNSNVADGISGNGSWTLDELTEEYQYTEDIDKNFALNLAYDLSDSFKLKFGGKIRDKHKMRENDFYAYEPAAEEAFYTAVYDNLSDKTKEGFLPGEQYESGSFVSNDFLGSLDLNSQDFDKERVLEELAGNFDAKEQIKAVYLMGSWDLSRKATILGGVRLEHTRNEYDAYEYNADEDILTKVTGTPSDYTNVLPSMHLRYKINDMTSLKLAYTHTLSRPNYFDLAPYTLIDDEEKYIGNPDLEPTMSKNVDLMIEHYLSDVGILSAGVFYKSVSDFIITRKTDDPEYEDGLFQPLNAGDGTLTGLETAAQFQLPFIPGLGLFLNYTYTHSTIDNFNIEGRQSDGLPLPGSPEHTANASVAYEKGPFNIRLSANYHSDFIDSEEGSIGENKWEDRYCDDAFHLDLNGGYRLNDIVRLYFEVSNLTNEPLRFYQGGESYIAQEEWYERRILLGLKANW

SEQ ID NO: 7388 - protein, 713 aa, Gluconacetobacter diazotrophicus
MPLPMPLQRTLCLALTLHVATLAHAAESSAAAPKDLDKVEVRGRAQTLYRVDDAAVGTRTDTPLELVPQSIQVIPRELIDDQAARQVTDLYRSISGISYFSYAGVTLRGFRQENVLYDGLRGDPYAGFSVPQLFNIERVEVLKGPAGALYGGGDAGGVINYVTRKPKASDERRIEVQLGDKDFRAGSIEGTGPLNAAGSVRYRAGLYADSEQGVRWNTDSESVIGDASLAFDVGQTGELVLQFTDITQNLGGNRLRGVPVNDAGTFLTDRRWNHNEASDFLDMRAKVALAQYRFAPLDSLDLDFAARWFSNSEHQMYHEPMGLIDRDRDGVAEWMTRQLRNQIRDNEAFTANGNAVWRVTTGAVEHKVLFGADVYQLDADFTAQTANSADLARGAGPVRGIDLFNPVYGASTWHDYNLAALPWRSTSTRSKRHGGYLQDELALGPRWHVLAGVRWDGFKDEDRITGNSVDGNDLSWRLGSTFTVREGLNVYANVASGFVPQSAANQNPAAGGPFDAERSKQWEVGMKSLLADRVALNMAVYRIDRSNIVQATGEVIGGVNQLAALGLVRSTGMELDLLADLSERWVLNLTYAYNDARVKDAGPNGITNASGDRFANAPRNKLGLWTRYDLPAINSAIGFGADHVGERVSLDGQTVKAYTVFDVSWKTTWRQWQFQANVKNLFDKVYAASGFIERNGHFPGDPRRVYVQAAYSF

SEQ ID NO: 7389 - protein, 1069 aa, Gluconacetobacter diazotrophicus
MRQKLFNVFLVCLFCLTAPAVAFAQQAIKVTGKVIDSTNEGVPGVNVSVKGGSLGTITDIDGNYKIDAPNSKSVLVFSFIGYEKQEVAVGNRTVINVTMKDDTQLLDEVVVVGYGTSRKGDLTGALTNMRPDANDAAKAMSIDGLLEGKVAGLVVSTASSTAGAAASVTIRGASSLRGDNQPLYVIDNVPQASTGEFGRSAISGDFQIAQDPLSSLNPADIEDITVLKDASSTAIYGSRGANGVILITTKKGKQGKTTVNLSATFTVANVTRLLDMVDLDEYAAYQNSRIGDGLYAYYKVGDEMRYVYNDALAKYDPNNPGTYKLIYYRDWQKEIYHSAFSQNYSVSVNGGSGKTTYYISANFKDINGTTKQTGWKQGDLRANLSAELSKTVKIDLSLSGALKQNDMMAGGNTLGGPTSAISRTALDYSPFEKPDDDPSLTNENKTNVFSWLNDYVDIADDKTFRGSLNLNWKISKFLSYSLRTGGNININNRKRWYGLQLYQGMNNDGYLAQSDMSRSNYSVENILNYNTKLGSIGTLDATAGVTYDEYHSLNKNVIGNHFTMFEFRENGLHMAGNTVYSSPSQNDYQLLSYLGRVNVNLYDKYLITASIRADGSSKFAKSNRWGYFPSGSVAWRMEQEEFLKDVSWLSQLKVRVSYGVTGNQSISPYSTFSMYGQSSGAPISYADGSGNQLTSMIVTNMANNSLKWEQTASWNFGVDFGFFKSRLSGTFDYYIKKTKDLLISRPLPGSSGFGSTYYNQGGLDNKGVEFSLNAQIIDTKDWKWSVGGNIGANKSKITDLGLLPSDWGCLGERIGYEGTALADQFGVANAFLQGEAPGLFWGYKTQGIVQAEDITSDGKVKYIKKDGTEGTYTKAVSAGDVKLVDMNEDGEINGKDRTIIGNPNPDFTYGFQTEVSYKSLSLKATFNGVQGRDIMNTGVRYNETPSKQANNITKKAFYGMWTAENPGNLYPSSLYVIENMVMDRYIEDGSYLRCSDITLSYILPKIWMKAIGIQNASISASVRNAFIITDYTGYDPEVNSFAFEGLRPGVDMSSYPNSRSFVFGLNVTF

SEQ ID NO: 7390 - protein, 795 aa, Gluconacetobacter diazotrophicus
MSAYDLKTKKTLLAVSVCLAFSAQAETSKNKVERANQLPEVVVYAEQNAGLSSSQKVTAKDIKSSPNSNGNISDFLKTNSHVRFERSDENSFQRGEIKPADISINGAEANQTSYFVDNVNINNDLGFDSAIFDGAMQTLPMASHAQAYFFDANLLSSVTVYDSDISASLGGFAGGAVVAKTKQYDGTDGVQLRYRTSHSNWAKFHLEEKDREKFKQASPNGSSADFQPKYSKDFFSLSAQHSLGKNIGMVAGFSRRTSDIQQRRLVLGKDDKLSSDNRRHKRRSDNALLNFNWLANEDNRFELSLRYSNYVETKFFDTNVDSNVQDYHQAYGATLAWIRSLKSGVLTNTLAYDQFADKRKSASNYLKQILAFDENYDPINYERGGMGDSALTQRNVHFSSEFAMDPLTWGRTEHSISLGGIWQFTHYRFQRDQNAKSEIFMQDSMESPLSSNSVSKGTVKTDYHNIALYVEDLIKLGGKWEVRPGLRLERDTFLKNTNIAPRFVARYQPFEQTKLSLGANRYYGRSFASMKLSEGIFKLDDIDGTKGTTRYQSVASMKTPFSDELSFSINQELGNVILDARYIHRQNKNRIILKEDGQNGKKVRHFARGKDYSNNVYTLQIQNKDSWKFWQTEWRASLGFDWLNTKGIDIGVGYDPNSIVILDGKQMTELEMRSKVNNNREEWMARIGVDMSMPNYNLEWTNRIYVKAPIKGFKQLDTGSRSSQLPIYRSYNYGTHTQWDTSLRWQPKIFGKHSAIVKFDILNVLNQTRKGLSSNEDNGFYAAGREFWLELGYEF

SEQ ID NO: 7391 - protein, 681 aa, Gluconacetobacter diazotrophicus
MGTCISRLVTGIFLLTTLGAPLAFAQQEGEGAAAPALGEMDLEQLTNLKVEQVYGVSKFEQAVTEAPASVSVITADEIKHYGWRTLADVIRSSRGFFTSYDRNYSYIGTRGFSRPGDYNTRVLLLIDGHRINDAIYETAAIGTEFILDLALIDRIEIIRGPSSSLYGAGAFFGVINVITRSAKQIEGGEAAASGGSQRTGAGRLTYGKSFDGGEFVASGSAYKSRGNDSLFYPEFNDPATNNGIASNMDRDRNYSLFASGRLHDFTLTGALISRDKRIPTASFNTIFNDPRTHSVDRRSYLDLKYDKALEGGTGVTARLFYDEYRYQGNFAYEKGLDDPGFYPPTYLNRDDHLARWWGGEAQASRQVLPRLQLTAGASFRDSFLKLPNYDAVPQGRRVENDHSDLFLALFGQGELRLFEHLIVNVGVRHDHYQTFGGATSPRLAVIYTPVEGTVFKYIEGKAFRAPNAYELYYNDVFDTNVANPRLAPETVRTRELIYEQYLGEVLRTSLSLFQNKIENLISYQNLPSGEVSFGNAGRVKAVGGEFEVEGQWASGFAARTSYSFVSARDEGQDQRLDYSPRQLAKLNLTAPLYRKKLFAGVELQGTARRDFSHNGVQTAAPGYLIANATLFSTGILPSLDLSLSVYNFLDRRYQDPATTDHRQSLIAQDGRTFRVQATYGF

SEQ ID NO: 7392 - protein, 814 aa, Gluconacetobacter diazotrophicus
MSFRTPSRLQAAAIRTGLLRTSLAAFCSALALSTAHADPAAQPANGTAATTGTPARKAPAAAPRRTAAPAVEQIISTARRTRSEQSVGQVQMQRILPGINPVKALEILPGVVFEDADPWGNNEQNSSLFIHGFNQNQLGFTMDGVPLGDQSYGNFNGLSPQRAAISETIGMASVATGAGALGTASTSNLGGTLEFQTQDPLHRAGGQLDQTFGSWSTFRTFARIDTGDFGNGNSAYVAWARQDARAWDFDGHQGGNQVNAKFVHQGDNDRITGFFDWSDKVEPNEDGIVEPQGGDLYKRPFLYPNLQQAINYYNNSAAYKAAGLNYRNYYSDAQREDFLSYIKWSHDFSSHLHWDNQIYYHHDLGEGVVAGPITAAGLPALFGAYFPDNSAPQLSQVFGGSGMATRTTEYWDNRGGLMSTLRYQLGHHHIELGGWYERNNNTQARRWYAFDAADPTSPYDRQQNPLIHQYTNYFYTNTWVTHLQDTWQVSRNFSLNAGFKSELVYTNGTLPVAGLPGSLSPKTAVTVPGGTIAAVKPFLPSFGALWNITGHEQWFANIQENMRSFQDTGYGNASPWGVTSQQAFQDFKDHGHPETDWTYETGLRTNRPLSFGPLTNISGQLEYYHVHFSNRLLAVSSSPNLASIVGSATILTNVGSVTTDGMDFSFTTQFGPHFSFYNALSYNKSVYNDNYANGTTIVPTAGKNVAGVPNWTEKFVASTNWGDFNAQFIGDVIGKRYTTYTNDLSASSYALFSVNAGYTIHGIPHVRGLKVQGNITNLTDTRGWSTLNISNASGQYTAFPIAPRMFFLTLSATF

SEQ ID NO: 7393 - protein, 1298 aa, Gluconacetobacter diazotrophicus
MKTLGLTWLLLAGFALSAFSQVTTGRIEGAITDPQGSAVPGAQVKVTNNLTGQILDSVSDEKGLWSMPSLSTSTYTIAVSHPGFKSITIENVKVDAGVPATVNAKLEVGSVSETVEVMGGAEVLQTQTATVTSTLVGRQLHDLPFTSRNLTELIVTQPGSATPGVPRSTSVYGLPQSAMNVTLDGINIQDNSNKSSDGFFNAIFPRADAIEEMTVSSAAAGADSNAEGAMQVKMVTRSGSNSYHGGLFEQHRNQDLNANAYFNNLNGTAPRDHLVFNQFGGLIGGPIKRNKLFFFGHFEAFQLPQTYTEPTGTVLTPEALAGNFRYRDSGGVVRSVNLLQLAGANGFTSTVDPSIGKSLAQIASLTGDAPGLKSRIATNADYNRNNLDFQSKGGNYRRFPTTRLDYNVTEKHHIEFVYNYQTNIRRPDGVNIGTASPIFPGTGNVLGGTEFGNQGGIAFSAVAALRSTLTSKLVSEVRFGIVGGTVIFNNGINPGDFAQWSGYAPIFSSTNCNAGTAYVTCPYRTTGQTRRNTPLKQGNANLTYSMNAHLLNFGGSFTQVNAWTTSVNGTQIIPTVNFGVATGDPIITGATNIFTAANFPGANATDLQTNAPALYAMLTGRVSAVNRSVILDDQTKTYGAFPPVVKNQQREFGLYFQDSWRLHPRLTFNYGVRWDRQNPPVNLNGVYTRPGYAGVWGVSGVGNLFKPGTLTGQVPVFNATAAGEAGYATHNKQFSPSVGLAWQVPSATGPLGWIFGKGSVIRAGYAINTIREDASTLALWGGNQGRTITLNVDPTNFPAQFGAPGSVLFRNPLPSRVAPTTPSFPLAVAAGNSVSDFSPNLKTGYVQSWDIGIQRELTRDTVIEIRYVGNHGTDLWRQINLNEINTIENGFTNEFKLAQQNLALARGCSASDPVCMSVNRSKSNQYFGLPGQAPLPMIFTALAANNDATSALQIEQGQAGALANAIATNTTRMARLTAAGLPVNLFQVNPTLVSGAANLEVNGGNTNYNGLQVEVRRRMSKGLLFQGSYVWSHSISNEQSQGIAGSFVTMHDVGYDKGPSPYDIRQAVKMNWVYELPFGPGKRYFGHSGSPIVRKALEGWQLASVTRLQSGSPIRLTSGRLTMNQNDSGVILHNLTVSQLQSMMQIRKVTLAATANSGPIGAVFYLPQALLDNTNAAFEVNGKTLANLDKNAPYIGPADQPGQMGERVFLYGPMQQKWDFSLGKKTNIGEHANIEFRMQALNAFNLTNFLLFVPGSGITTTLGANGTGFGQTSGAYRDLSNTNDPGGRIIEFSLRLNF

SEQ ID NO: 7394 - protein, 219 aa, Roseobacter litoralis Och 149
MKRILIAAAAIAIWGMPAMSQATPARPGGYFSGFLGVSIPRDADVAGTDSGTSFNDRVEFDPGIVVGGTAGYDYGFLRLEGELSYRHSEIKSVTASDGYRFHGVDGDLGALAVMANAFVDMHNQSPITPYVGGGVGFAVLNLGNTTSTELDPLYEKGDDTVFAYQAGAGVEIALNPIMSLDLGYRYFGTSKATFDEGVVTATKFRFESHNALMGLRVKF

SEQ ID NO: 7395 - protein, 425 aa, Gluconacetobacter diazotrophicus
MPCTTAPVLTGRSLIAPLILVLLAGNASPAFATNGYFSNGYGAPSKAMAGAGVAMGEGPLASAQNPALGTAVGNVAGLCFTSFMPHRDITNEGTGGLKNGSYDSKNEFFEIVCGGANYMVDDRTSVGLLMFGNGGMNTEYDTNVFAPGFGSGTTPLGVDLAQAFFSFNLAHKFDNNVSLGIAPVLAVQRFKAYGLEMFGPMSTDAAHLTGNGYDWSYGGGFKLGATWDPLPWLSLGAAYQSRMWMSKFDKYSGLFAEQGDFDIPSFINEGIAIKPHRDWAVMIEHQRIFYEDVAALSNSHVRSSSALNLGSNDGGGFGWNNMDIYRIGVQWQADPALVLRTGISHANEFTNGQETMFNILAPATPTTHVGFGGTWHIDEQWSLTGSYAHAFSHSISGANPAMNANQTTKLRMDQDELAIGFSFKF

SEQ ID NO: 7396 - protein, 919 aa, Gluconacetobacter diazotrophicus
MVSAQNTGSIAGVLTDQEMNGEPLPFANILIKGTTTGTTSDFDGLYEIDGLDPGDYTVVFSFLGYETVEIPATVEAGKVTQINVPMSANEGMALDEVVVTTVSRKDSEVALLLDQKSAILIRESIGSQQLGRIGVSDAATATTKISGVTASEASGDIFIRGLGDRYLSTTLNGLPVPSDDVDRKNIDLGLFPTRVIQNVSIGKTYSVQSSADQASGTVNITSRELVGSNELTIGLRGGANTNVIQDGVFDNFKLSPASAKAPLGYYSFNRSVQQLITQQGWNTRTEEAPMDYVLNLVAGKKFGDRLSVLLTGSQSRSYDYGQGLFRQFRSNFIDDTLTDATRWRKREVTSGLLDMVYFINENHKLKSSSIFLNTFTEEIFEGGRNGEGFIFEETDPAEGLGQFVRDQNIKQTQILISQLLGTHRLGQKNSLQWALGFNNVNADEPNRIRNEVNFDPDGSFVQLGRTGGFQQRKSSQEIQDREYNGYLKDVMDIIQEEDKSFRIEVGVNYRNKERDFESVFVGVEEQSVNTVNPPSIDNIGAIFQPDNFTSGRLQYNLLQPDLYNGKLESMAGFADFNVGLNKWNFNAGLRFQRDEINVGFDVGNFPGRVGETNKEYSNLYPSLNVRYSIDDRNALRLAMSRTITLPEFKEIAPFEYVSQVGQVTRGNPDLEASRDLNYDLKWEYFPSAGELISLAAFYKEISDPINRVQDRGSAGVFSYFNSGEKAEVIGIEAEAKVDLITAPENEEGLREGSGLGLVFNATRMWHEQDLKEVRDEEGNFIRTFRYKGLTETGLQGASDWIFNASLNYSLEGANPFNATLTANYASDKIFSLGAPEIQSQSDTFYNDAIVEKGFVVLDAVLIQELGEHWRIRLMGRNLLTPTIERTQLVRPSTTNIETEEVVRSYTSGAQISLGLNYTF

SEQ ID NO: 7397 - protein, 720 aa, Gluconacetobacter diazotrophicus
MVSSNHCATLTRCAAAVAAALLSLQASAQAPSPTTTAPEAGLSAITVTGNWLDNPTEEKVLDHAGARTIVERARIEETGSSSLRDVLRLVPGVQVQDSNGTGGSDVSLNIGVRGLTARLSPRSYVLMDGVPVSYAPYGQPQLSLAPVSLGNLESVDVIRGAGSVRYGPQNVGGIINFVTRAIPKTFAAEASVGTEIYSHGGNAKTTPSLFVGGTNESGLGLALLYSGTHGDGWRAGNDKTDIDDILLKGAYRISAQDDIAVSLHHFEGSGRMPGGLTTAQYAADPFQSTRSYDSFDGRRTDASFKYNHKDGRNNFEVLGYYVDSFRGSYIEQDNANQRRLTAAPRSYHYFGIEPRYSRLFETGSVVQEVSVGYRYLKESSSEVALRTAYYNPATMANAMALPITPYQTSQGGTTAHAFYIDDRIDIGNWTITPGVRYERINSFNNVSNLGADGSTVTSQLFPKADASEFLPTLSVLYRMNAQWSLFANAGKSFGPQQYAQLAQTERGLHPESAKTYEVGTHYNSPALNAELTLFNIDFDKELLLTRVGVDGIWTDLGATRHRGIESSLRYDLGQWNAALKGLTAGVSYTYTEAVSRAGDFAGRDLPLYSRHTGQLWARYALGQWTLNADLAAQSKQRSPGSGTQYVTQEDAAGRLGDIPGFATVGLRAGYDFGKSLSNLRVAVGVKNLFDRRYYTRSTDNNGGKYVGMPRTLYVQGTLPF

SEQ ID NO: 7398 - protein, 734 aa, Gluconacetobacter diazotrophicus
MAACRHAPPHGVARTISCADRDCLLHHSNSANASLTGTCFPWPWPWGAALPGRCAFFSELIMQIHAAAAAGFATACASSSSRPLITVRRSLRPMLGMALAAAGLLTHGLTAAQEKSLETVVVTASGFEQEIKDAPASISVITREELEKGSYNNLHDALRDVPGVNLVPSDNNSNDISLRGMGVNYTLILVDGKRTNTRETQANGSTGTDQSWVPPLEAIERIEVVRGPMSSLYGSDAMGGVINIITRKVAKEWMGSIRTEATLQERSSSGNIYQSNFYLSGPVQTDLLGLSIYGNYNKRGEDNILNGYNDYDNRALNVKLALTPNKDHDIIAELGTGKQHYTSTPGKTLAATAALSDRQFERDNFSLQHKGRWGWASSDTYLQQEKTRNLSRDMTIKNTVFNSSWVAPLGASHLMTTGVSYNEQDLTDTTTNTLPNASRTHINRSQWALFAEDEWRLLKDFALTGGLRYDHDSQAGGQVSPRLYGVWNLAPQWTVKGGVSTGFRAPSLRQTVGDWGQSSRGGNIYGNPDLKPETSLTKEIGVLYDSGAGTTAGLTVFDNEFEDKITRVACPSCGPLNSSGRVPTTNINVDNAITRGLEASLGTQLSRALRLKTNYTFTKSEQKSGEFAGMPLNQLPRHLFNVSLDWSPSAQLNGWLKASYRGEESAPTGGASSGSFTQKSYTMLDLGGSYKLNKTVTLYAGIYNLLDKQVIYDGVNYDTVLDGRRYWLGMNVKF

SEQ ID NO: 7399 - protein, 778 aa, Gluconacetobacter diazotrophicus
MPPSLDSSPTPLMPKTHQLSAAVLAALVLAPAAYAADLEVSADTGATVQQLDAVSVIGQGETRQVQRITQQDIAVLPPGTSIQKLLNRMPGVNVQSNDAFGANEESQTISLRGFNGTRLGYTLDGLPLGDNAYGNYNGLNISRALIAENFGGVELASGIGALGTASTSNLGGTIQYYSADPSSVFGGQVSQTVGSDANRRTFLRVDTGDYNGFSAYVSGINAEADMWTRPESPTTTRQFNAKGVYQFDGGKLTAFADTSRTSQADYAYLSKSGMARGLGWDWNLYAPDWNRALAAAYCAPATRNAARCGFSGGVDNIDDAYYQSRALRDDDLFYVAGDFQPNDAISLHTQVYHHENKGQGHWWSPGQASNPGTPEALPISIRSTNYWINRTGGIASLGWELGPHHLEAGLWYERNHHDVERNFYWITGPVSDDKFLQNPNRRLFSQNYVITTRQFYVQGNFKFLDQRLSLDLGIKSPSTEMTARETPGVAVEAPVATGSLKASESVLPQIGLGYRLADGQEVFASYAENIAAFQGGGAGGPLLVTQASFDASVGALEPEKSRTLEAGYRVVRDRFEASLVGYDVTFDNRLLSLNPCASIQQGTTPACTTRFFNVGSVSSRGGELTVIWKPTSYLQWYNSASINRSTYDDNYVQNGVVIPTAGKYTVDTPKRMFASELAFNSGPWNLNLRGKYTGQRYYTYTNDQGFGGYTSFDAGGGYDFGQVGVLQGLKLSLNVTNLTDKRYASNLTAFANTDPNGRQLAFHASAPRQVFLTLDAKF

SEQ ID NO: 7400 - protein, 720 aa, Gluconacetobacter diazotrophicus
MVDLAGGNDMHIGGDGKDGVYVVIDAGDGQVSLANDNQYLGTTQIASGTLMVSDNSQLGDTHYNRQVIFTDKPQESVMEITANVDTRSTTTEHGRDIEMRADGEVAVDAGVDTQWGALMADSSGQHQDEGSTLTKTGAGTLELTASSTTQSAVRVEEGTLQGDVADIFPYASSLWVGDGATFVTGADQDIQSIDATSSGTIDISDGTVLRLTGQDTSVDLDASLFNGDGALVNATDGVTLTGELNTNLETDSLTYLADVTVNGDLTNTSGVVSLQNGVVGDTLTVNGDYTGGGTLLLDSELNGDDSASDQLVLNGNTAGNTTVVINPITGIGEPTSTGIKVVDFAADPTQFQNNAQFSLAGSGYVNMGAYDYTLVEDNNDWYLRSQEVTPPSPPDPDPTPDPDPTPDPDPTPDPEPTPAYQPVLNAKVGGYLNNLRAANQAFMMERRDHAGGDGQTLNLRVIGGDYHYTAAGQLAQHEDTSTVQLSGALFSGRWGTDGEWMLGIVGGYSDNQGDSRSSMTGTRADNQNHGYAVGLTSSWFQHGKQKQGAWLDNWLQYAWFSNDVSEHEDGVDHYHSSGIIASLEAGYQWLPGRGVVIEPQAQVIYQGVQQDDFTAANRARVSQSQGDDIQTRLGLHSEWRTAVHVIPTLDLNYYHDPHSTEIEEDGSTISDDAVKQRGEIKVGVTGNISQRVSLRGSVAWQKGSDDFAQTAGFLSMTVKW

SEQ ID NO: 7401 - protein, 436 aa, Gluconacetobacter diazotrophicus
MKLTRINAGILVTFSPLCLLTNLSFAQGVEVQKTVTEEQEIAQLKRQLIMLNKQLKQQQQAINHIARQVLTKEANLKSGDANQKPVGSRDASIQRQPVAKAQVSTGAETVSSQSSTKKKAPDRGRSTEDVLQEAHNVFDRPLTVETSFTYSYYSRKDLVLRGFLALDAIFLGNLNLDRIRSNTIQMDLVTRYSATDRWQFEMNIPVMYRWNQYDSVGEGNSSQRYETAETDGGEIGDMSVAAYYRLVKEGSGWPDLVWNVRVKAPTGKHPFGIPLASSPTANLTYPTEIATGSGVWGISTGFSIAKTYDPAIVFFNLNYGWSLPGEFGDLSGLEGNSPGEIDLGDYIDYSVGLAFAVSEKMSLGMSFNQRFYSKTKQRTQGFAWEDIPRSDTNTATLGIGATLALSDSLSMVTNIGAGLTEDSPDYQVSLRFPYRF

SEQ ID NO: 7402 - protein, 741 aa, Gluconacetobacter diazotrophicus
MSTFVKKGYLATAIAAVLASTFSPVMAQETAESSVTKNEAAQNDVAKNKELEKIVVTAQRRAQSIQEVPVAVTAIGAADLELKQVTNVLDLQYEIPNISLATNTGTASGARIFLRGVGEDESRVSADPAVGVYVDGVYVGRQVGALFDLVDLERVEVLRGPQGTLYGRNSNGGAIKLISKAPELDENYGLVKATVGSDGRLDGRFTGNVGLSDTTAVRATVLSKSRDGFHTVNPNGDFADQAGTEAGEKDTKAFRIALYNEFSEDWNMNLAFDYTKDDSDPVPDTVALANDADNNLFTIEPVPGVTCSAATPAAFLSLGCFNDYRSEVETSGLSLNVQGQIGEYDLSFLTGYRQMEDDLSSRIGFPYSQQTDQNQFSQEITLTSNYEGAFNFVTGVYYFTEDVQMDSIFVFPSELGVETEAYAAFLQTTYEFNETLTLTTGIRYTDETKEIDALMPVSGGNRNEELDFSNTTYNIALNNQFTDDVMGYVSYSTGFKSGGWSPDCFGVETACFLPVDEEELDAFEVGVRSDLLDNRLRLNATYFYNNYDNLQIASTVPGLGFTRFNVDETKISGIELEALFEMTDSLTVNVTFGTIDGEYTEMTLAQAGGLTNSGSSPGCNGEVSIECAKALELKNAPDYKGTIGFTHRMPIAEGLLTSRIDFSFEDDSYSLVANAPAHSLTSVGTIINARIAYEPNSEKWAVALWGKNLSDEVYSRAAAAGDFTQYVADPLTWGADFEYRF

SEQ ID NO: 7403 - protein, 795 aa, Gluconacetobacter diazotrophicus
MTHFPKALLPQAIGSIAALAFAAGTYAETNEAEDKKQLQKVVVSAAGYEQKVTDAPASISVVSAEELSERPYATLLDAVRDLEGVDVGETRDKTGQGTISMRGMGSDYTLILVDGKRQNNHGDIYPNNFGGNQFGHIPPLDAIERVEVIRGPASTLYGADAMGGVINIITKKVTDKWQGSVSHSRTIESNDAFGDDITTDFNVMGPLIPGKLGLSVRGSAYNRLASNPTYESVTDPAGVERIRSLGFGGGGKTVDNENQVLGIRLSWTPTDNQSLWFDADTSTQEYDNTPRLNDAGEYEYPVGTVDNIASVWRTANVNGTTRVAPQVGYSPTQEFTRDTWSLTHEGNWSFGNSFVSLSYVDTDNLGRTLPFTVAERAQLQEMWDGTGAYVGLTTAQRRALAEETFLPRPKRTLKSSQYTLDAKLDMPYELAGQQHVTVVGAQVIQGELEDGVFGMESGVPGGVQEHNMYSLFAEDTWYVIEPLAITAGLRHDDHEVFGDHLSPRLYGVYTLSEEWTFKGGVSTGFKTPKTTQLYDGVVGFGGQGVSPMFGNPDLKPETSRTTEVAAYWQHPNGHNFNITFFRNEFDDKLSSEPCGAGTNIACSSTGDYADLGYTTSSKTVNIDEVVIDGAELAGRWHIVDNVSLRANYTYTDSEQKSGANKGRPLGNSAKHMANTTLDWKVSSVFNVFLTAEARSKRYRGVHVITGEELSFKDYEVLHLGASYKASESVTFNVRINNLLDRDFTTYRAEFRDLNNDGDYIDTNVGGSGRNETLFYDDYNNKDKARNIWLGVNVRF

SEQ ID NO: 7404 - protein, 234 aa, Gluconacetobacter diazotrophicus
MQTSSNQTERRRRMKKIMIGAAACALTALFAGPAMAEANDGYYVSGNIGVAMPRDSTATYPDTPGLSQKYDFDSGLALGLALGYKLGPARVEGEIAYQKSDIDDITVSQAGTSTSLSAAGVQFSGDAKATSFLLNGYYDFHNNSAFTPYLTAGLGLAKVKVSQTVVGQPWSDSDTVFAYQVGVGTEYALNQTVSLDARYRYLATADPSFSADDGSPIDAEFASHNLLFGVRVSF

SEQ ID NO: 7405 - protein, 897 aa, Gluconacetobacter diazotrophicus
MPVHHTGHPASRRLRRTPVRAILCTTIACVLATAFGAHAQDTAPAAPPANDTSSAASNGQAPVTLDNITVIGQRASLNQAVQAKQMSDHVVEVISADNMGQMPNVTVAEALVRLPGVNGTRDRGNESLATVRGLGPRMTMGTVNGREIASSEPNRAVRWEVFPTEIVSTVKVYKTQSADLVAGGLAATVDISTISPLDYTGPGFVGTAGPVFYDHTKDVHGYSPWGSRFGASWVHKLNDNLAVAFGATYQKQKNASSSIGSWGYTDATTSRDVDGDGTVDPTPWGAADQLKLIDQTRTGAMGTVQWRSGNFELKFDGLYSRIEIDEDQLQNWFNGLAFSTFSGSTNPYTTPGSSYTIVDGDVVAGTLANSNLQVDHVVSHYNEVKTLTAGGLNAKWSGDVWTLGSDLSFSQAKRDNTWQAVRFGSNPDTISFDFRRSVTPTISTSSDTPEYGIAGQTEPQALRDKIAALALNASRAVDAGPFTSLELGARAARREKQNRRFLSNQSGYDQPISAYQDLIYPVTMPDLNVPTLTGGNMAEIARIGFGGFDPNTLDEQLLDHWNVKEDVREAFAKAVFSSQLFGTDVTGNVGVRLVNTRTTSEGFDSVGSTIQPSTGSKEYTDVLPSATLNFLIDDQRILRFAVAKVIARPPLDELRTGRRLDDPSVTVGQLTGSGGNPQLDPFKATQVDVSYEWYFHTEALAALAVYRKEVDSSIGYRTDRETINGLDYLVSAPFNGGGGYINGVELTFQTPFYFIPHMENFGVYSNYSLVDSNLKEFSPEDNPLPLSGLARKTGTFDLWYSNGTFEARVGYKYHSPYTVVYGWNAARLARLQSEGTVDLSLNWQYSKQLGFRFQASNLTHEPLRAYTDNKPNRLANQDDGGYQVFGRRYQLEATYKF

SEQ ID NO: 7406 - protein, 453 aa, Gluconacetobacter diazotrophicus
MSGGMKRFYWLAVLAVSVCNNAWAMGPFEFYEQALRNDPVYLGAIKERDAGLENRAIGRAGLLPHLGYSYNKGRNQSKVTYLNDRGASQHDDRNYSSYGSSLTLQQPLLDYEAYAAYRKGVAQALFADESFRGKSQELLVRVLSYYTQALFAQDQIDIALAKKKAFEQQFHQNEHLFRQGEGTRTDILEAQARYELAIAEEIEARDEQDAALRELGSLIGVPALDIGDLAPLHDTFQTFALQPASFDTWHELAVSNNPNLASQRQAVDVARFEVERNRAGHLPKVSAYATMRQNESESGNTYNQRYDTNTIGLEVSVPLYAGGGVSASTRQASRNMEQAEYELDAKTRETLIELRRQFSACVSGANKLRAYQKALSSAEALVVSTRQSILGGERVNLDALNAEQQLYTTRRDLAQARYDYLMAWTKLHYYAGTLGPQDLAKVDEAFVSRAPIQ

SEQ ID NO: 7407 - protein, 320 aa, Roseobacter litoralis Och 149
MKKILMASTMLVATAGMAAADITFDGFGRFGIVYNDGADDAGDRSDTQLDQRFRLNVVGTTETDGGVEFRARLRLESNDNGDGQGSGGGNVVEAPEFGVRAGGFNVFLGNTSDLIDSGDVVDYYGNGIGLTDFAETSSNFVTGSIISGINGGDEIDPTIKTSYTVGDFTFGASYSDNALDSATEEYQIGAGYKFGNFGVGAAFGNVDGGDFDDTDFWALSFNGDLGSFAFSLLAADSDDQDSVALGASVAVPVGAATDVRFVVSDNGLDSDDSFAATKGDDTAYAVGFRHSLGGGVRLQGGIGENSLGDTVGDLGVIFNF

SEQ ID NO: 7408 - protein, 743 aa, Gluconacetobacter diazotrophicus
MSRIVSAARRLRAGIVAAVFLHAIDLPTAFAQQAAAEQLPPVEVTRPDDQNRTRARAIGDGDTARLRAPSGAPAGNGAGSSGSGGEAVAGNGGIVGAAATVITAADIAHAPSQTLAEIIATQVPGAQITTLYGGQIGAKTSVDLRGFGAFATANSLVLINGRRLNDIDIAQVDLSTVPLNSIERIEITRGNAGAVLYGDNAVGGVINIITRNGVGGPPVAARIEAGFGSFDTRLGNVSTSLNSGPWSTSFYGNAVKTDGYRDNNRLVQENGVGNLNYTTSDLTAFVTVTGDNQELRLPGGRTVDPSIGVDELATNRRGTSTPFNYANQQGFSATAGFTKTLANGIDLIVDGGVRDKKQQSAFFSGPAPVPALFTSTYVDADLTTWSITPRLSVKGLLLGMPSQLLTGLDYYDASFQQNRGAGQGLAPWHNYDLRQQTVAGYFQHTLGVAPTTDVSYGVRVQSVSLSARDHFDVAAPFNTDIGALPLRSDETQYALHLGGEHRLNDIVSLFGRAARAFRTPDVDERVSSGPSFDPFFNPLPQTFRLKTQTSQDVEGGLRIKGGGLQLQSSLYLMDLANEIHFSPILFYNTNLDPTRRYGSETSLSYRVNDSLLLRSGMAYTRAVFREGVWAGNDVPLVSRYTASAGVTWNIWQNYVVLDATARFWSERRMDNDQAGTQRPIPANGTIDLKLSGQYERYFWSLSVNNVLNALYYDYAIASTFTDGRFSAYPLPGRTYLLKAGAKF

SEQ ID NO: 7409 - protein, 708 aa, Gluconacetobacter diazotrophicus
MRVSVSLVLGVGLGCSSPALWAETESPAELEVLTVTAEAERAEGPVQGYRANRTASATRTDTRIEDIPQAISVVPRQVLDDLDSARIERALDFAGGVSRQNNFGGLTMFEYNVRGFTTSEFYRDGFSANRGYMNAPDSATIERVEILKGPASSLYGRGDPGGTVNLVTKKPQAERFARLHASAGSWDRYRSTLDLNTPLDEEGDLLYRMNLAVEDSKGFRDYADGQRLLVAPSISWQLDPDTSLLVEAEVVRNRQVFDRGTVAPHNHLGSLPRSRFFGEPDDGKIDNNNETLQATLRHHFNEQWSLRLASHYKHGHLDGYASENSSLAADGYSLRREYRYRDFEWHDSITQLDLLGDLHTGSIRHQLLMGLEYERYHNDELILRSIPSRNPYAIDIRRPVYGQPKPPFGRDDRNHEEVDAMALNLQDQIEFSEKWRGLLGVRFDRYRQDMNATRLNNGRFRETSSQQTQRAATPRIGVLYQATPEVGLFANASKSFKPNGGTDMAGKAFDPEEGRGYEAGVKLDLLDGRLGMTLAAFHLKKKNVLTADPSNPGYQQTAGEARSQGFDLQFSGQLTEQLRLIGAYAYIDAEVTKDENIARGSRLLNVPKHSGSLMGVYEFREGWLHGADAGAAVNYVGERAGDSSDSGFELPAYTTVDLLARYPLASNATLGVNVNNLFDRRYYERSYNNVWVAPGEPRNLTMSLTLNY

SEQ ID NO: 7410 - protein, 206 aa, Gluconacetobacter diazotrophicus
MGQTTIAALAAVASMALIGTAQAADFSYRSPYTVNQPLNAYSWAGPYLGGNLGYAWGSVQNSATKPNGVFGGVQAGYNWQSGPLVFGLEGDIQANAADDIFARWKFSNPWFGTVRGRLGYAFNNVLIYGTGGLAFGALRAETFGLSESHTNAGWTVGVGAEFGIYQNWTAKVEYLYVDLSSSNFTITDAPNSYQFGLVRAGVNYHF

SEQ ID NO: 7411 - protein, 647 aa, Gluconacetobacter diazotrophicus
MSRFNPSPVSLSVTLGLMFSASAFAQDATKTDETMVVTAAGYAQVIQNAPASISVISREDLESRYYRDVTDALKSVPGVTVTGGGDTTDISIRGMGSNYTLILVDGKRQTSRQTRPNSDGPGIEQGWLPPLQAIERIEVIRGPMSTLYGSDAIGGVINIITRKDQQQWSGNVQLSTVVQENRASGDEQSANFFVTGPLSEALSLQVYGQTTQRDEDEIEHGYGDKSLRSLTSKLNYQLNPDHQLQLEAGVSAQDRENNVGKSAQSSGSKTDNEYRRNHIAVSHQGDWQDVGQSDTYLQYEENTNKSREMNIDNTVFKSTLVAPIGEHMLSFGVEGKHESLEDKTSNKISSRTHISNTQWAGFIEDEWALAEQFRLTFGGRLDHDKNYGSHFSPRVYGVWNLDPLWTVKGGVSTGFRAPQLREVTPDWGQVSKGGNIYGNPDLKPETSVNKELSLMYSTGSGLAASLTAFHNDFKDKITRVACPTNICTDGANQWGAAPTYRVNIDEAETYGAEATLSLPITESVELSSSYTYTHSEQKSGNFAGRPLLQLPKHLFNANLSWQTTDRLNSWANLNYRGKEMQPEGGASNDDFIAPSYTFIDIGVTYALTDTATMKAAVYNLFDQEVNYAEYGYVEDGRRYWLGLDIAF

SEQ ID NO: 7412 - protein, 756 aa, Gluconacetobacter diazotrophicus
MCAALLLTLGATPAGAQESASLSGYVRDAETGETLIQASALVKGTSRGAATNSEGYYTIQDLSAGTYTIVFSYIGYQNRVEKITLSAGEARRLDVELQPAGVAGEEVVVTGEAADEEGSVSMDQVETALIKELPTAFQPDVFRTLKLLPGIKTASDYSSNLYIRGGGPGQNLILLDGTTVYNPTHFFGFFSTFNPDAIKDVELYKGAYPVEYGGRLGGVVDIRNKDGNRRETSGGLSVGLLASRAYIEGPYGGNGDSADGSYMVAVRRSTLEPVLAGLRRTDTDGIPDAFAFYDVNAKVNYDAGPDDKLSLSLYGGQDRLDLQFQTAGRFDIDYGNQTISADWTHLFGSQAFSTLQVTGSRYRSTPVANIANTEFEQTNGVDDLSVNADIEYTPGSNHTLKGGAQWSLLSFQLQESFDGSVTFDQDLRSQQAALYVQDTYKPTGDWTLKAGLRGSYFQKGSFWRLSPRLSAEYSLSPSVQLQAAYGRYHQYITLETSQLFTGFDTWLMSDEGVPPSSGDQLALGLTTQFGDGWQAEVEGYGRTMPGLFREDPFSSGTAGVPYAERFQIGDGRAYGLEALLRRETGDFTGFLSYTLGRTERRFPNINETQAGGAQYYTPKYDRTHDLTLVANYRLTRGWRLTSTFSYSTGQPYTRPERQFSTVDSPFQSATDERTVLISPFNNARLPPYHRLDVGATRSGRFFGIADYEFKIQLINAYARRNVWFYQYERQDDGSLERTEIPQIPVPIPNLSFTLTF

SEQ ID NO: 7413 - protein, 556 aa, Gluconacetobacter diazotrophicus
MPHAAASSLRANQAAYSWPADMDPNYAMRDCLLATTSPRTYSATAALSFNLRPRGKQSGLAIALSLAACLVGNPVLAQTASGLDPSNHPVDQASKRGKTSDRAAKLPIDLICQAIRPPAPARAAGPGVPLEKRGNADRAAQTRPQKTIDPFQRYDNLREKGLWFPIPGPADTIDQDKGGVRSALADVGIGYIGWTHNSFASNQLPHAARSTIANQLYMGQNPTFASANFMIVTYDLSRFGIADGQIVVGAEQQYWTWDRPGPDRVGLNTLAYYQTFFNRTLELKLGYLRNQNEFTGTLFGGITGSNMSALFQAGMSTNAAPTPAANLKYNFDARLYNKVSVQRSISPDGAYAHITENPTGLKWSTANAGILLVEEAGYKSKAAPGVPDTWLRAGVGLNRSRYTNLADPKQQRESGNNFHYIAADRQLWQSDALGSPSRGIYGGFSVMGAPPERNRISRYYELRLYAKGPFDSRPSDLIALVATNTAWSKLAVDAALAKGQLAHRDSTAVTGTYIAHLAPGIYASVGLSYIHYPTIITHTPQTEHALNLLISTLIFF

SEQ ID NO: 7414 - protein, 342 aa, Gluconacetobacter diazotrophicus
MGWRAGVASAALLFCLQSVAASDGGAGAVTLYGVLDTSLEITDPGSGWTPRLDSGAYRGSRVGLRGSEPLGNGTDIIFTLENGFSSVDGTLQAPGVLFNRQAWIGARNGWGELRFGRQYSPIYIPFKGDLDAFGAGTIASGLNNLSKITPYASNAIAYFSPVVGGFSATLMTATRDPSEKDGNGIDGYYVTAAYQLDNFRLLYARQQTHGAGALRANLGGATYAIDKVRVWLAFFNGDGGTPLYHGAGGSLSAQYSFSPSARASLGYAHVRDYTGAGASADQFSVAFEYNFSRSLLFYFSGAYLANHDNASFTLRGVNVTGLPVSYPGAPVKGVQLGVLERF

SEQ ID NO: 7415 - protein, 490 aa, Gluconacetobacter diazotrophicus
MTFQQQVVKTFAPMLFVSVLGAQGAQAADRELLEILLQNNVITQEQFDRLVDKESLTTADILAPAPESVVVVREEELEVDVSLDENIQMAIDEAVASAVSDESPIKASYGSKGFQLATRDGNFATNLQWRAQFRYSNPFGSDPRQVKNFNADSTSSFEQRRLRMKIGGHGFQPWIKYYFEVDLQPARDVDADAISSGARVIDWRVDLAKWDWGGIRMGQWKVDFNRERVDSSGRQQFVERSIVNRIFTVDRQVGVQLRGRLFEGSGADLNYYAGVFNGEGRSVKNSSDEHLYVGRLQWNFLGRQLKTRQTDVEFTELPTGSFAVAGLTNEGPCTRWSSSGCGNLDGFAKPVAAQDDQFKIEQGLQEFAFKYRGFSVQQEWHRKFITDRVEGTESDLTGAYFQAGYFFHNWIDAIPAPLEFAARYAYVKEPNKADRMLYNEREEFTLGANWFFNGHRNKLTFDFSHLTLDDTLLMQKESENRVRLQWDVSF

SEQ ID NO: 7416 - protein, 817 aa, Bordetella petrii
MSLRTARKNIVNRAVMIALAATSVTSVQAVAEEGAEEVERIAVTGSRINRTDIESASPVTVISSDFITKSGFTSVQEILSMQPAAAGMSLGSTSNNGSGGSATVNLRGMGVQRTLVLLNGRRMVASGTGADSSVDLNTIPVSMIQTIEILKDGASAVYGSDAIAGVVNIITKKDFQGTEITADGSITDKGDGESGGFSLLHGRDFAGGNLVVGAQYSNRGEIIQSDRDFVPAGESSFVPGGSLGGMVPDGEGGFVPREESYDYTDDSYAQTPNELLSLFTNFNSEIADDTELSVEFMYTRRESNQQMAPQPASIDLDTSLLDDNYTDQFKDENGVLPEELEYRRRMTDAGPRIYGQETDTYRASVGLTGYLSNDSQWDMSATYGRNDSKDSVGNSIHAGNMEKSIYNHQDDWFSGDPMSNDFLASEGVMYTEQNEGGNEQFILAAGYSGVNEHDIGYAVGVESRFESGYYTPDLITQAGESTAAQQDPTEGNYSVQSIYGEISVPVTDSFTVEAATRYDNYSTFGGAATWKLGATYSITDGLMFRAVAATGFRAPSVSELYGGNSGSFDYLTDPWDNEQDSQILVNYTSDADLKPEESESFTAGVVWEITEGLSTTMDYWQFDITNAISRVNVQNEMNKCFGDDLVACDTIGITPGGDLSEMTSTLTNIGQQNTSGIDWNVSYTAGMFKVMFDTTYLLEFEEDGISYEGTIGGNMGGYSQLKSNLTVSADLTEDVNLLYTANYIQGMDGDGYTTDDVIYHNVSAAYHINDAWQVTGGIKNLFDTEPEEVPDGNDMNTVPNIYDVVGRTFFVNTSYKF

SEQ ID NO: 7417 - protein, 710 aa, Bordetella petrii
MKRNSNIGYSIASCYPNSQSTQGKLTFLFKLRSACVLTTMLAASQVVLATDLLELPTAPGFNGRNSLPLGINGNGNVIVGSISDVRDHAFRWNALSGKLDDLGFLPGGTSSKANAVNADGNVVVGQSNRSPGRDNPDNGPLTHAFRWTQAEGMKDLGTLGGLYSEAFDVNAVGDVVVGTSSIRAADGGYRRAFRWTEAGGMQDLGTLGGGNSDGQGVNADGTVVVGASTYAGGPLTKSYAFRWTEAEGMKSLGTIAGDNSKATAVNAAGDVVVGNSTHQIGNDSQHAFRWTEAEGMKSLGTLDGDSTNGFSSAAAVNKAGDVVVGMSTDEGARTIRAFRWAQATGMQSIEAWLASHGLIVKNTQTQSATGVNDDGNAVIGFLANGNGFLARVTPGGAGMIDVSEFNTGLYRVANSALLAINDADLVMHGAHGNPMRTLLPVGRSSFWAAGDAGKQEHGVYDNKQGVAEIGYGYRPSQTMQFNVALGRTYSSSDTGFDGDTTARSTYVLPELILSVPDSSTKATLSAYYGQGDLRIDRAYLNAGNLTHAYAKPDTETFGARVRLDWVDAITAGKTNLTPYTSLTYMETGLDAYTEQGNGFPAQWNKRTEHATTARIGVDAVHPVSGTVTVVGRLEATHRFENQGTTASGRLLGVGGYAFSFRGQDLNKTWFRAGLGLEAKVGNGIASAMLNATTQGEMPTYWLAASYRWLF

SEQ ID NO: 7418 - protein, 786 aa, Bordetella petrii
MSFTFAARSSRGRFALACAAAFAWPAAYAASTDDVRAEAARGGGVDRPAAAPAAADVAAASAQAGDTLTAVSVTAQRQPVDPDTPAVVTSITREQIDAHTNVTTEDALKYAPNLMVRKRYIGDRNSIFAGRDFNELQSARGLVYADGVLLSNLLGSSYAYPPRWSLIPPDDIARVDVLYGPFSALYPGNAIGSTVLLTTRRPEQLEASLSTQFFTQRYHDGYGFADSFGGNHQTARIANRVGRFWFALSLDRLENNGQPMQYASPNSAYNPKLGAAVPVTGAATDIGPNGKPRTIVGAQTIERTEQLNETVRMGYAFTDHVDATLTLGHWENHYRQHGETFLRDAAGHPVYGGNVSIGGQNMTVAPNAFAPQRGDQENWLYALGLNGRLDSGWRVSGVVSAYDVSRDVLRAASTVQGGAGTLFQGDGTGWRTLDLKAEAPAVKGHTFTFGYHYDNYFLRNVTYNTADWLAGPTTSLASVYRGDTRTQALFGQDAWRIAPRWLATLGLRYERWDAYGGALGNARGTLGYADRGANALSPKVALQWDATEVWRFRLSFATGTRFPTVGELFQGTISNNAIVNNNPNLRPEKAIDWDFTAERDVGVGVVRASVFQSDLRDSIYSQTTVSGATTVTNISNVDRVRVRGVELAFSGENVGVRGLDLDANVSASNAQILADAANPAYVGSRFPRIPRMRANLLASYRFDEHWLTSVGVRYSGRQFNTLDNSDVNPDVYGGTSSFTVVDLKARYRFDRHWTASAGIDNVTDRRYYTFHPYPGRTFYGELKWSL

SEQ ID NO: 7419 - protein, 757 aa, Bordetella petrii
MKFRTRKATKQTLLLCTVSLLALAADFPHGARAQSNLPAVTVDAPQPQQRARSAPTTSSRSTARATRRANRAATTPPQAAPMPSVHERIYAGTNSYVAGQSSAASKTDTPLIDTPRSVSVIDRKELDDRGVTSIPEAVRYSAGVTTGGYGYDPRFDQIYIRGFSTTTLGDFRDGLKQFPAGFSTFRTEPYQLDRVEIIKGPAAVLYGQSVPGGLVDRRSKFPVENQVNEIAIQAGTFDRFQTAFDIGGAASPDKSLLYRLVGVARSGDTNFDVADQRLMLAPSLTWRPTADTTLTTYALVQKDETDSSVAALNRNGKLLTVNGEYLRASDPKYDYLKLQQVQTGYKLEHRFDDVFTFRQHTRFSNLKTDSRYLSGSFANTTTSIYNRAAYAVGDEQTSWQTDNNLQADFATGPVAHRVLAGVNYDHNVWDFQFGGSGVQSAYALDISNPTYGIAGATPAYTSGSRSTQEQVGVYLQDQMRLGGWHLSLAGRHDWADQTRINTYTNAVTGQRNDSAFSYSAGLLYHFDNGVAPYVSYATSFQPTTSMAIDGSVLAPSEGEQFEAGVKYQPRADVLLTASVYDLTEKNAAKLAGYVNGVAYYASVGEIHVQGVELEARARLTPELETVTAYTFSDAEITKTTVASELNKVPAVTPKHTASSWLNYSFLNGPLDGLGLGVGVRYIDATWTSNANTDRNNGYTLVDLAMRYDLGKLARQFAGFQASVNANNIADEQIAVCNAGYCYLSQGRTVIGTLRYRW

SEQ ID NO: 7420 - protein, 614 aa, Bordetella petrii
MKHAIFTATALSLACAQVAAQDKPANPLVPSLETVVVVSSRQETPLREVATSVAVLEEAQIEKLGYTALVDALRTLPSVSVSNSGGMGKTTTLRVRGEAGYRTLVQIDGVDVSDPTGTQSGAQIQHILSSDVGRVELLRGPQGLMYGADAGGVLNISTRQAEQGNKTVLSGEAGRYNSQRGSLNTSGASDKLDYFVSVARAETEGFNTSKQDTLLKDNDGYDNTTLHARLGANLTENLRVEAVARNTDASAQYDRCGWPAIDDCTSTFEQDAGRLSLSHRLGRLDNSLAYSKSDISRQSFAAGVNDYDTEGSIEKLEWLGRAYLSEAHTLAYGLERRSDSVREMERDQDAVYLEYQGRYADRVFFTAGGRSDDNDDFGRYDTYRTSAAYVQALDAGELKFKATYGTGFRAPSLFEIDYNQQQTASYGYVLAPLTPEESEGVDVGVEYFGSNGLHLEAVLFKQTIEREIAYDSVGWTGYIQGDGENRSEGIELIANMPLADQWIINLNYTYTDTKTATGSARPRVPRQLANLGFTYAASDALQLAVNLRHSADAKETTGADLDNYQVLDASVNYQVTPMLAFYLRGENLTDKDYVEIVNYNTAGAAAYAGVKITF

SEQ ID NO: 7421 - protein, 373 aa, Bordetella petrii
MLAAGACVLAATGAHAQSSVALYGIVDTGVEFVTHANAAGDHVVRMPAVTGEMPSRWGIRGNEDLGGGYQAVFVLESGFNVRGGDLGQGGRLFGRQAFVGLKGGFGTLAFGRQYTMTYLALQGADIIGPDIYGLGSLDAYVPNGRADNAVTYIGTYRGVTLGAAYSFGRDGAGTGNSPGQGTCAGQVPGHAVECRNWSAMLKYDSAYFGAAASYEEQRGGTGAAANFFDGVAPVAFTSSAGKDARVHLSAYAQAGGARVGAGWIGRRVSTGSPAAAGAHSDLFFVGASYTVKPYLIVDGEGYRIVNSAHDTRATMATLRTTYLLTKRTSVYAQTSYLWNSAHARYAVSGGGPGTTPGEGMGQLGAMVGVKHLF

SEQ ID NO: 7422 - protein, 415 aa, Bordetella petrii
MQMNKLAINILGATLALAGGNAMAAGFALQNQNGAGTGNAFAGAAAAAEDASTVYFNPAGMLLLPKGHNITGAVTFLDRSVEFSDRGTARLVPFALGSDGGDGGSLAIVPAAYWSYAVSPDLAVGLGVGPTFGNKTEFDRDFIGRFSGYFAEIKQININPSIAYRVNDMVALGFGLNFAKNETEFKQMAPLAAGIPIGVPVTIKGDDTAFGWNAGLMIQATPATRVGVTYRSELSFDLKGTQEISGVRTFDVKAKLKTPDQFSFGMHHAVDSKLELLADLTWTGWSSIESIKVRGGTNPELPYHFKDTWRVGLGVGYQMNNQWKLRAGVAFDEAPVRSAADRTMTLPDTDRTWLALGARYTLNKNASIDVGYAHIFFKEGPTERIVYNGSTPIQQIKGKFDVSADLLSVQYNHNF

SEQ ID NO: 7423 - protein, 359 aa, Bordetella petrii
MKKTLLAVAIPTLLLANSAMAVEIIKTEDGTVDFYGQLRTEVKKLEDKDVTLNAGSSRTGVDARYKLTDTTDVFGKVEFGLNYKADGSDYSMNNRLHYIGIDSEFGKISFGRQWVVSDDVYGADYSYFFGGTALRYSTLSGARHDSLIKYNFDGEDFWVAANYGLSEDDSNQELAELYVGTSVGRFNLHAGGGQNRDKSHKIGTETVTPEASLPEFTQENTITADIENIYFEGTVEYTVGAALIGFTYYNAELSDKNSNLSIDENGYSLAGTYSWADNATAYAGYEYTEQSADSVEDQDGTLVYVGSDYNVNSWFRVYAEYGYGDGTTLGYSNKGSDSFIGLTEVDSESSFALGARVYW

SEQ ID NO: 7424 - protein, 460 aa, Bordetella petrii
MKSRKINKSRLALAITAGTLGALAQQAVAAGFIEDSKASLTLRNFYINTDNRNGTASPSKQEEWGQGFILNYQSGFTQGTVGFGVDALGLLGVRLDGGGRAGKSGLDRQPGTVFPLESNGEPVHDFASLGLTAKAKVSNTEFRYGTLQPKLPVVTYNDGRLLPVTFEGGQVTSTDLKDFTLVAGQLEHSKGRNSTDNRSLSIAGANGSSASSRDSNKFYYAGGDYKVNKDLTLQYYYGNLDDFYKQHFLGLIHNWQIGPGVLKTDLRAFDSSSDGKNGSRSGRADGYVSSGYYGSGVTKGEVDNRAFSGLFTYTVSGHSIGAGYQILNGDSDFPFLNRGDGEGSTAYLITDVQIGKFQRAGERTWQVRYGYDFATVGVPGLTFNTIYLSGDKIKTARGDQSEWERDISLAYVIPDGTFKGLGFTWKNASFRSGLPAAGSSNNQRDQDENRLIVSYTLPLL

SEQ ID NO: 7425 - protein, 452 aa, Bordetella petrii
MERTAIRTTEQQQDECLAMKTLRTLPALFCAGLLGLSAQAAESPRGGPLAGLGAQLERHGVKTHAQFWSLSLKNLDTGPRPHSFGNSGDLFLGADLDLATLAGIDGASLHVEETVFILDRGTGQPTGPSWQGAVGSYFGGAPLHNDIGANQLSLLTWQQKWLDGRLASHLGRTNARRYFLVYNCETVVTCNDPVIDASTGILPPPYGAWGGYLKYQATPALYLHAGAFESNPVDYLKKRHGLDFSTDDASGTSLLLGIGDKREESLDPYRSHYELNAYLNTASQVDPLTGARDHGSAGGFFKFQQLFWRADGGRLDSPRALGMFGSLSVSADAKQPFRHFAELGLTYYAPFDRPLDKLNLKASYLRLNDHQLEFQRQARVAAGGDPRLGQRDVYALETNAHIALTPHIALEPSVQYIFNPDNYYNPGARELSGDGFVVGLQLMVDMGSLLGL

SEQ ID NO: 7426 - protein, 1156 aa, Bordetella petrii
MRAAPGSRLYPRLSPGSGRDDTVRFRQKKVPSALAETRHACVDPSKAVLHGDGGRSRGVHKKMTINTRRRAVRGFLMASAAVMVLAGPALAQDARRTFNIPAGDAVTALQAFAKQSGKQVLFPFEAASGKQTPAVTGDLADADALGRLAKAAGLVVQSDDGKTITLRQAPAERPQSSGAGAGATSEEAQIVEAVIVVGSQIEGARTTGALPVTVVGEQDIIATGAVSGDELFRSIPQAGDVQFQEARTTGNLNDARGDVASLNLRSLGTGNTLALLNGRRAVLAPGTQTENLVPVQTVNTNAFPVAGIRRVEVLLDGAAAIYGTDAVAGVVNTVLDTKFRGLRVEGQVGGSEGTSYREGTFNVKAGTRLEDGTRLTFFGSYTARSRLMASERDYSASEDHRAAMAGTAWANDTAFDNRSTSSPWGAFTLIPATTAPRQNGVALTTTGVFHIEPVSNTAAGCSSATLTGDICIRAGVITGANSRVLRYDENPQRSLKGGLERTNLFSTVEHDFGEITAYGEVGYYHALFTGNREQSAPLSTAPISIAANAYWNPFGPTTLASGAVNPNRLSGLTGVATTGVAMNITNYRPVDAGGRTYTVTDDSYRLLGGLKGDWNGWKWDSALLYSQARTKDMTHNAISNTRFQAALNRTDASAYNPFNGGSLTNYSGADATPNSQDTINSFLINVYRISETSLALADFKVSKKDLFQLPGGDVGFAAGVEVRRETYDDNRDSRLDGTIKYTNTVTGLTYATDVMGASGSPDVSADRTIASAFFELAVPVISPEMNIPFVEEISLQIAARDEHYSDFGNVLKPKGAILWTVGQGLSLRGSVSQSFRAPNLPQFYSEGASVSNTRTDWAACRINTPTAATCPSASTIEIRSGNDNLKPEEVDNASVGFVYQPRFIPVEYGKLTLTTDFWSIRQKGVIGILGGANQIALDWLLRQQGSSNPNVVRDAPVGTNTVGAISAINDTYMNLQPRMVQGVDFSLSYDLDDTAWGDFALNLNVAKLLKFDQSPSATEALLQQAVAAGKLPGVTVTSAGNQIGLGGAPEFRGSASMTWRKDGWGAGAFVNYISEVYDTGSTLTGGEYYQMPPWITVSLYGQYAFKEGRLDGSTVRVGVRNIADKDPPVSSNNFGYYGSLYNATGRYWYMNFSKRF

SEQ ID NO: 7427 - protein, 556 aa, Bordetella petrii
MDNAELAIGIDLGTTNSLIAVWKDGAAQLIPNKFGEYLTPSIISMDENNHILVGKPAVSRRTSHPDKTAALFKRAMGSNTNWRLGSDTFNAPELSSLVLRSLKEDAEEFLQRPIKDVVISVPAYFSDEQRKHTRLAAELAGLNAVRLINEPTAAAMAYGLHTQQNTRSLVFDLGGGTFDVTVLEYATPVIEVHASAGDNFLGGEDFTHMLVDEVLKRADVARTTLNESELAALYACVEAAKCSNQSPLHIRWQYQEETRECEFYENELEDLWLPLLNRLRVPIEQALRDARLKPSQIDSLVLVGGASQMPLVQRIAVRLFGKLPYQSYDPSTIVALGAAIQAACRLRSEDIEEVILTDICPYSLGVEVNRQGVSGIFSPIIERNTTVPVSRVETYSTMHPEQDSITVNVYQGENHKVKNNILVESFDVPLKKTGAYQSIDIRFSYDINGLLEVDVLLEDGSVKSRVINHSPVTLSAQQIEESRTRLSALKIYPRDMLINRTFKAKLEELWARALGDEREEIGRVITDFDAALQSNDMARVDEVRRRASDYLAIEIP

SEQ ID NO: 7428 - protein, 821 aa, Bordetella petrii
MHAPCMPQFAPQFAPRRVVARVAAAALFSACAAPGVSGAAEPAAATRAYDIPAGPLDAALTRFGREAGILLSFPGELTTGLRSPGLHGRADPAAALDRLLTGTGLVALRQPSGGYTLARLPGPAAAGADAALAADTTLPTVAVRASGPHADSYRPPREAAGLRSDAPLAEVPQAVAIVAQQVLRDQRPRNLDDALANVSGITQGNTLGSTQDTVMKRGFGDNRDGSVMRNGMPIVQGRSLNATTDSVEVLKGPASLLYGIMDPGGVINVVTKQPQLARRHAISALGSTYGGGRNGGELTFDSTGAIGESRVAYRLIVDQTNEQYWRNYGEHRETLVAPSLAWYGRDTQVVLSYEYRRFLMPFDRGTALDPRTNAPLAIPARRRLDEPFNDMRGESNLAQLAIDHQLAPDWKVHVGYSYNRETYDANQIRITAVDPLKGTLTRSNDATHGSRSTDSYGIAYVDGRVTLAGMRHDVQFGVDGEYRQVYRADMLRQPIKTPFSYLNPTYGLVPPSTSVSASDSDQSDTLHTASLFFQDSIHLSERWMLVGGARWVRYSQLAGRGRPFQVNTNLSGTKWLPRAGIVYKWNDALSLYGSYTQSLKPTSKIAPMAGGYVIDGSTAPEEGASWELGAKLDMPGGLAGTLAFFDIDKKHVLVSQYDDATNQTAWRTSGRARSRGIELDVSGRIGARWNVIASYAYIDAKTTEDPLYAGNRLWNVARHTASLAAVYDVGTVLGGDDLRIGAAGRYVGARPGDSANSFTLPAYATADAFATYDTRLGKQKLQFQLNVKNLFNRTYYPSSVNRFFVSVGDARQVSLLTTLQF

SEQ ID NO: 7429 - protein, 730 aa, Bordetella petrii
MRLYHLFAAAAVAAIATGSAQAQTAPAADADNIGLEEIVVTAQKRSEKLQDIPVTVTALGAEALERRQVLSVSDLQSIAPGVSVGQHAGYNRLFIRGIGLTSISSGQDPSVSFQVDGVVIGRPSAQLASFFDLERVEVLRGPQGTLYGRNATGGSVNLITRKPTRDLSGYLDLTYGNYDRIQLDGAISGPLDGKGDVRARIAFQKVKHDGYGRNVTLNEDVSDQDSWAVRGILQVDPAANVDITLSADYAREDDHNYPFNGFGPYRSDVPMPGLLLGGTLLPNSRDVTTEVPTRNDRTFWGLSGTIGVDLGGGLRFQSITGYRKSRRANINDPETTSYAVFSPTLTAENARQFSQELQLLYTSDRLNGVAGLFYYDESLKAELDLGFPVIGAALGFPAADYHEDGTIDIKAYAAFTQWTYEVVDHLRLTAGVRYSDEKRRSNGTFTIFSFMPPPNAANVVVPVHVDKSWHALTPKFSIDYKPVENVMLYASATRGFKSGVLLSGNPNPPVNPEYIWSYEAGIKSSFLDNRVQLNAAAFYYDFKDLQVNRIINVSIVTENAAAARVKGAEVELRARPVEGVTLNADATYLDATFRKYSTKHPARPELGLLDLSGNRLANAPKWSLNAGAEFDLPIGVPGRLSARGDVAWTGKVYFTEFNENLLSQDAVATVDASLQYESEDGHWRASLFGKNLTNRKIVANKFIAAQTTGFALNGGFKPPRTYGLRVGYRL

SEQ ID NO: 7430 - protein, 302 aa, Bordetella petrii
MKKTILATAILLAGAANAAEVYSDDTTTISLGGSFRGHVVIDNSDDVNFEDAGSRFDIKAAKTLDNGLKAFGQMEIKYKDVSGLDTLYINNAFLGFEHDVYGKLVLGKKLGLNDDLVMNDFSYENGIYNHQNAAAGSDTQDQLEYTKSFGSASVVVGLINQDTYSIGGTYEVAGLTLGVAYNIANDKVGTATPLVDNSAIIVGAQYSLDALTIGVQYQALDVDNVDTSAYGIGAHYALGQAGVYAMYDILDGDAKADEGSEIVIGADYEIAKDVKTYVEFNSSDNDVTGSDDTLWLGARVYF

SEQ ID NO: 7431 - protein, 659 aa, Bordetella petrii
MNGPISIGGTNNLASHAENVYSSGNIVNINGGVVDLGICGGYYNGTVDSDVASSGNAVTIGSAFSGSNSIDVYGGFARNVNAFSMTASDNTVTVNGGTARSVYGGFAYVASMTGPCVATASGNTVNINEGTIYGVYGGYAGANFGAGPHTVSGNTINISGGTIDDVFGGYVDTHYGTGQVTNNVVTISGAPNLATARLYGGYLGMKTDGDAFSGNTLNVKTAGLDVASLSNFQYVNFYLPSSLSAGDTVLNVTGTADLTGSAGRSSTVNVGIDGGSSPLQVGDTITLIDAGTLVTNGGLNSTARGTGMQGVTLVYKFDLATEDNRLLATVSTDAVPAVNEQTKTLSEGFVSGMGMVTQAADVAAGQGMDSAVSAAKGGSAAGGGAPAGFGALSGGSVRYNTGSHVDMHSASLMAGLAWGADVPLGRLTFGPFLEYGTGSYNTYNSFSDAASVEGDGSTRYFGGGVLGRMDLADTGPGHVYVEASARVGELHNEYESSDLRDASGRSAEYDSSSMYYGLHMGTGYVWSMTENASLDIHGKYFWTRQEGDSVKLSTGDPIDFKDVDSNRLRLGSRFSYMVTEHIVPYIGAAYEHEFDGTARASTNGYAMEAPSMGGDTGIGELGLMYTPLASLPVSFDLGVQNAVGRREGVTGSLQIKYEF

SEQ ID NO: 7432 - protein, 1049 aa, Bordetella petrii
MKLTKLLIFCVSSLLFSVIAMAQDVTVTGTINDESGMPVPGATVLIKGTNKATASDFDGKFQINVPSNGTLTISFVGYVTVQEAVNGRNKISVKLQPESQNLNEVVVVGYGVQKKSVVTGAISSVKGKDLENLPITRIEQSLQGRVSGVSIAANAGQPGSASTIRIRGFTTLNNNDPLWVVDGVVVDNGGIGYLNQSDIESIEVLKDGASGAIYGSRAAAGVIIVTTKKGKAGKISVNYTGFAGTSQAAKKIDLLDASQYVTIMNEAYTNGGKAPLFPTVNGSGQPINYGKGTNWQDAIFNNHAQRYSHELSFSGGNDVSTFYMSFGITDQEGIVTTDISNYTRKNIRLNSNHKIGKFIKVGQTLGYSNEKTIGIGNTNDEFGGPLASAINLDPLTPVIETDPSKTGPGSIYANPNTLKDANGHYYGISTIVTQENTNPLAYTQTRLGNNDFAENFVGNVFIEAELLPGLKFKSSAGAKLAYYGSDNFTPVFYLNGATKRDKNELFRSYKKSFSWNWENTLNYTKKFGDHNFSILIGKGTYVDGITSGNDATYQGIPATTHDEASFNVDIPLADKFVNAYNSTAVEHRVESLFSRLNYDYKEKYIFTGIIRRDGSTRFGPNHKYGTFPSVSLGWVPSKEGFWKENNVVTSLKIRGGYGVTGNDSSPDFLYLSTIGNKRNYTIGGTPVPGQSPNAIPNPDLKWEETKQANIGFESTLFHDFNLSVDLFNKKTSGILMKVPIPGYVGASGDTYANLADMENRGVDIELGYRKKIGALNLSVNGNFSYIKNEITYIDKGVNFIAGDETVQSTSYEINRTQVGQAYNSFYGFKTNGIFQTQADIDNYKNAAGVVIQPNAKPGDFRWQDLNGDGKIDGNDRDFLGTSLPKFTYGLTLNLDYKGFDLLVFGQGAGGNMIYQGLRRLDITNANYQTEVLGRWTGPGSTNSYPRVTVDDTNKNFSNPSDFNLQKGDFFRFKTIQFGYSFPQEWINSISLTKVRLYLTGENLFTITKYTGFDPEIGGPTTAGMNNVQGVDRGYYPQAKSYMLGVNLQF

SEQ ID NO: 7433 - protein, 629 aa, Bordetella petrii
MQIKIDVASNIPKTVNKQPSTVTLITRDMIERSNAVYLMDLLQNVPGFWAGADTIGTFSLSFRGIWGMEAKILLIVDGIEQNELSFGSLPLGNRFPVSTIEQIEIIRGPGSVKYGGQAALAVIKVSSISQKTETALSSHAEVIKQGLVENSISLYHGGTLSDETSSSAKYDMTLSAGYGDYSVARWQGLDGYEQDLKNYSNSQPLHAWLKLQEGQQYIQVQYDRFEQEDRLLFGDAGLFYSPNERYQEANTLSFEHLALQAYSRSPISSVWDSESKLTLVNQKPWNSDNQYGQTVSRDATRYRLDQTFYWHGKRDQDIAFGLFYYQEYEKVTRSFLFDSTTRFDNDNSIEQINVGGYFQHSLYLPFANVTYGARYEDHDAIGKEWVPRLAINSNWDSTYLKFVYNQAFKTPQFDTLASAKNSGSAITKTEKTLSTELELGYRISSAGRLSYNVFWLEIQDFIGFNPSSASNVTLGDISNFGHELMFHWKTDVITMNASYSLFLVDQNSIEAIGIANEKNALLGIPNHMLKFDASLPIQTNASIYSKLNIISSRYACTTDINLICGEPEKLSEEYDWEISYQKRYDKWRYGMGIKNILDEKILYVQPYRGSQSPIQGLPRRLSLDVHYRF

SEQ ID NO: 7434 - protein, 369 aa, Bordetella petrii
MKKTLLAAALLAGFAGAAQAETSVTLYGVIDTGIGYNKIKGDGYDGSRIGMINGIQAGSRWGLRGSEDLGDGLRAVFQLESGFDSGNGNRAQGGRLFGRQATIGLANDSWGILEFGRQTNMASKYLADIDPFYTSYTQANLGLGASSANTSRWDNMVMYRTPSVNGFELGVGYSFNVDDGNADQTGFRTADNTRGITAGLRYLNGPLNITLTYDQLNGSNSSSQIDHDATPRQYAAGVSYDFEVVKLAAAYARTTDGWFTGQDLPSGTPYSNEFGSNRFVDGFKANAYMVGGTVPIGGASSVFASWQRVDPSNDRLTGGDSTMNVWSLGYTYDLSKRTNLYAYGSYGKDYAFIDGLKSTAAGVGIRHQF

SEQ ID NO: 7435 - protein, 80 aa, Bordetella petrii
MNSLAGIDMGRILLDLSNEVIKQLDDLEVQRNLPRADLLREAVDQYLINQSQTARTSVPGIWQGCEEDGVEYQRKLREEW

SEQ ID NO: 7436 - protein, 362 aa, Bordetella petrii
MKKTAIALAVAVAAFATAAQAAPKDNTWYTGGKLGWSQYQSTGNNWDGVNIGNGSTHKDQIGAGAFAGYQYNQYLGFELGYDWLGRMAYKGSYNNGAFKAQGIQLTTKLSYPVMDDLDVYTRLGGMVWRADSTATINATSAGTQKRFSENDTGVSPVFALGTEYAITPNIATRLEYQWINNIGDKGTLNARPDNGMLSVGVAYRFNQETPAPVVEPAPVVAPAPVVENKTFTLRSDVLFNYNKSSLKAEGQEALNGLYNELANIDPTQGRVVVIGYTDRIGSQNYNLPLSEKRAQSVVDYLVSKGIPANSISAEGRGKENPVTGNTCDNIKARAALIDCLAPDRRVEIEIQGTTEVVVQPGQ

SEQ ID NO: 7437 - protein, 277 aa, Bartonella tribocorum
MNMKWLITASAFAFVSASTVQAADVVVPPRSTPIAPVIVAPTFSWTGFYIGGQIGGFSSKTKMNILANGKTFPVKDDLLPKLSGFMGGIYVGSNVDLGNGLILGVDTDIIWSDKKYTKTGKVYEITEQHIPYIKKMLTEAGIAISNNDLKPGAKRVHSFTFKEKWAGATRVRIGFAAERIMPYVAGGIAYTQLQDIGSISIKNKDSSKVIASGNLSDETKTFVGYTLGAGVDLAMTNNVVVRAEYRYSDFGKKKFTKGQLETSYKTNDFRVGVAYKF

SEQ ID NO: 7438 - protein, 279 aa, Bartonella tribocorum
MNIKSLMTTSVIALISASAAQAADVIVPHEVAPTVISAPAFSWTGFYIGGQVGNFSSKVEITDPNKKDKLFSKDDTPKPSGFMGGIYAGSNMDLGNNMILGVETDAVWADREDAKTSSAEAIGQDELETFRDSLKKANAAFAQGKTSDNVAAVDKHTDSLALKEKWSGATRVRIGFTAADRIMPYVAGGVSYAQVQAVSSTKVTQAADDAEIATAQLFDKTKTLVGFTLGGGVDFAMTDNVLLRAEYRYSDFGKKKFEKEGSEFSYKTNDFRVGVAYKF

SEQ ID NO: 7439 - protein, 761 aa, Bartonella tribocorum
MNTKLTKIISGLFVATAAFQTASAGNITDIKVSSLPNKQKIVKVSFDKEIVNPTGFVTSSPARIALDFEQTGISMDQQVLEYADPLLSKISAAQNSSRARLVLNLNKPGQYNTEVRGNKVWIFINESDDTVSAPARPAVKAAPAAPAKQQAAAPSTKSAVSVSKPFTPAKQQAAAPFTESVVSVSAPFSPAKQQAAASAKQQTAAPAKQQAATPAKQTNIDFRKDGKNAGIIELAALGFAGQPDISQQHDHIIVTLKNHTLPTTLQRSLDVADFKTPVQKVTLKRLNNDTQLIITTAGNWELVNKSAAPGYFTFQVLPKKQNLESGGVNNAPKTFTGRKISLDFQDVEIRTILQILAKESGMNIVASDSVNGKMTLSLKDVPWDQALDLVMQARNLDMRQQGNIVNIAPRDELLAKDKAFLQAEKDIADLGALYSQNFQLKYKNVEEFRSILRLDNADTTGNRNTLVSGRGSVLIDPATNTLIVTDTRSVIEKFRKLIDELDVPAQQVMIEARIVEAADGFSRDLGVKFGATGKKKLKNDTSAFGWGVNSGFGGDDKWGAETKINLPITAAANSISLVRAISSGALNLELSASESLSKTKTLANPRVLTQNRKEAKIESGYEIPFTVTSIANGGSSTNTELKKAVLGLTVTPNITPDGQIIMTVKINKDSPAQCASGNQTILCISTKNLNTQAMVENGGTLIVGGIYEEDNGNTLTKVPLLGDIPVIGNLFKTRGKKTDRRELLIFITPRIMGTAGNSLRY

SEQ ID NO: 7440 - protein, 717 aa, Bartonella tribocorum
MITKTMLSLSVAAGALFAAAPAFAQADAPQAAAETADQGGFGDIIVTAQRREQRLQDVPVSVTALTGEQLTGQGVTSTHDIAQSITGMTITESGGYVQPFIRGVGSTVTNLGEPGSAAFYIDGVYMPTVNGQLYQLANVESIQVLKGPQGTLFGRNANTGAIIITTKQPQFTPAGSFSASYGNYNSFVGSGFVTGPVSDTIAVSLAGNYDRHDGWFKNRNPANGLGKRVGDSKRWTIRGNVLIKASDNLDITLSGDAMDINDASPIIIQPIDRYQGYVPGALLPTGPYDYIGNEKVGYKVEQQGASGKLDWDLGGVKLVSTTAWRHYENHSIDYDSDTTPFRYSQINNNDVGNNFTQEILLNSDNKSNFSWVLGGFYLRQNGKLDPLYVLSGTTLTTIAVKQITDAYAVFADGTLTLGRFDLTGGIRYSYEKKVITGSLNGIQRLDHVKASWDSFTPRAVLAYHPTDDMMFYGSFSKGFKSGAFNANALSPVPIDPEKVDAYEIGGKLTLGRGFTVNVAGFHYKTKDLQVQALNPITNLIELRNAASVKSDGVDLDVVFAPTRKWSIKFGASYLKAKFSKFTNAQVFLPVPGGDGRNASAIVDVTGKRNVRSPDWTLNWAVDYTIDLPGGGTLVPSGNVYYSSKFYWTVDNRISEPQHVVINASLTWNLPGDRFSVTAFGRNITDELRFRNVSASAQADRRAADEPALYGVRASYKF

SEQ ID NO: 7441 - protein, 1245 aa, Bartonella tribocorum
MQIRQSRARTPYPVAFSLALLFLTSPSWAQQTTTPPPAAAEETAEDVIVLSPFEVSAEDESGYSAATTLAGNRLNTDLRDLGNAVSVITSQFLQDIGATNAETLLQYTTGTEVGTVYGNFAGLGDGSSINETSGSNPAGVSKFINPSSNTRVRGLTSADNTRDFYLTDIPWDGYNVDRVDMQRGANSILFGQGSPAGIINTASKQASFKNTNQVTARYGSFGSARGTIDINRVLIKGELAIRLNALYNDEKFKQEPAFSRDRRIYGAMRWEPAFLKKGGARTIVKANYEAGDVRSNRPRAVPPIDNISAWFYTGTYAGRDVRDQATTYNALNKQTFIPSQLQDDNTGLPNHGQMRPSWNFGPVSGQPNPYYQPWLGNFGQQFGGPMAFFDGTTNAAASYWVFEPTMNRGISSTGAIDRTVGGMPYQRPASIAPYDQFARQARLPFWEFGIYKQKSMTDASIFDFYNNLLDGPNKREWQNFRHYTLSLAQTFFDDRMGFDISYNKEDYNNGQLSIISDSRQAIYVDVNSVYANGTGDPGLTGAEPFSNGTPNPNVGRAFITDNGIGGNNSFRSEAENARLTGFATHDFTRGGNRSWVARALGQHTLTALVGKDKRKTDARAWQQYGTDDVYREFLALPNANTKFNDNAFVPNTVIYLGPSLSGRSSASGANLPRPQYMYTPVSGTVFTFDPTWKGTADPAAPWEYGYYPAANTQDGTRVDAHFSTQSENPANYVGWRNVPMKLYHSEEGYRDYLTNSARLTKSVVTSKVAVWQAKFWDNALVGTYGVRKDTAKSWGRAQDVNSPTSDRYGHLNLASDVYKLADQYDNRLDITSRSWSAVAHLTQFIGDRSPVRVTAFYSKSENFQPAANRVDVYGVAIGAPSGETTDQGVLLETRDGKYSLKINKYETKSINQSSTSLGGTWFIGASQSWSGNWVNIFEYDIRDGNTIQGRDPNPDPTNSRYNYGTAPGEDLAAAQAREARVIAAWRTWQRSVDPRFYSAWQMNLNDTSRDINATTPQGFAVTEDSISKGYEIEFSAVPTKNWRLTFNATKTEATRMNIGGTNLSAFISAYETALRTTPVGDLRIWWGGAGNETALYQWNNNIGSEYAQRKLQEGTNVPELREWRFNAVSNYDFDEGFLKGFNVGVGVRYESDIVIGYRPIASTVAGQANFDLANPYKGPTETNYDFWVGYTRKISRNIDWQIQLNVRNAFVGNELIPVTTQPDGSPAGYRIRPPQTWTLTNTFNF

SEQ ID NO: 7442 - protein, 992 aa, Bartonella tribocorum
MQRKKIFDSFKHWNVAILSVLMSFCMTAAFAQSGAVKGKVLDELGEPIIGANIVEKGTTNGTITDIDGNYTLSVNDLKKAILQVSFIGYNSVEEAVKGRSAVDVKLGASVVNLGEVVAIGYGTQTRREITGSVANISEENFNKGVNRDASDLLQGKVAGLTITSGSGDVTRSSQIQLRGTSTLQNDQGPMIVIDGVPGGDMSTVSPSDIESISVLKDASSAAIYGSRAAGGVILITTKRGSGSRTQINYDGYLTASTIANKPDMLNASEWRAANKALGKDISTYDKYNSDTDWFDEMTRVGVSQQHALSLSGGSSKSNYRASYTFLDRNGVARDNYMTRHSFRFQFQQRAINDRLRIGLTGAATLTDMQMPFSDDYILAYNMLPVYPVYNADGSYFTDANHNYDQGNPVQNQDQNYKKAANNYFYGQGDVQFSILDGLTTKVNLYKSRFSSDYSEWQDPRNSRGQGDTGKAIRRNRLWDRNLLEWTANYTKAFGSAEEHKVDAIVGYSWENNLYADQKSEATNFAVGSMGADNIQSGNLLKIGNVTSSRNEYKLISLFARAHYSFKERYMITATVRRDGSSKFGANHKWGTFPSVSAAWGISQESFMKDTKWINDLKLRAGYGITGNQDGLRPYKSLDLYSASGTYYNNGSWPTAFRPSQNANPNLKWEQTAMLNIGLDFTLFNSRLSGTIEWYDKRTKDMLYNYEVSTPTYVYNQIQANVGDMKNTGVEILLNLDVIRNKDFTWTTSLNLAHNKNEITKLSNELFSTGRVYVGDPWIRGASGVTSHVVEEGRPVGQFFMLKCNGLDENGKFIIEDINGDGQITDDDRTYVGDAQPDLTYGWNNTFNWKNWDASFFFRGTIGNKVLNNPLAAYGNNTYIDGTNVMDNDNLLTLSENSRVCSYYVENASFLRLDNLSIGYTFNTKKIDWLDKARLYVAGQNLFVITGYKGLDPEVENFRGEASDDNAGLSPGIEPRNYMPKARSFTFGVNLTF

SEQ ID NO: 7443 - protein, 848 aa, Bartonella tribocorum
MLSSALKPVLLAGTILATLPAAAAAQPGPAPAAAVYSIPSQDLSAALLSLASQSGRNILFNPAAVADKRSAPVNRADSFEAALDALLVGTGLVAQVAPDGSGTVTPLPAGSAPSRPGPGAPPPAAMGPVADALREPLEEIVVTAQKRESLLETVPTAIAVLDGAEAAKRGITDFGGLVDEVPGVSINYAFGGPGYGLLSIRGVGGADDYKPNGNPSVALHVDGIYQTSNAYLGIPLFDLERIEILKGPQGTLYGRNTTAGVVNAITRGVTDETEGYVDVEYGSYDYAAVKAAVGGRLSDRIGVRLAVLTEQGGGFMTGRGAGTLAGFQPVIGGVRQTQVPPITDPGPREGFGDKDIFAARGTIGLTLDDDTTLTLKLFGSRDRGDTRQYDRLPRRLDNTILNPGEDEDPYTFFSSQYFRQRINVSGLSGELEHRLADGLNLTILGGSQWSDRRVGGNGDGTPYPQYEFLFDEDLSQASIEARLADDVGGAIDWIAGVFYVSDDIDFNSTWTSFTVRSVYDSPYAQNRDSAAVFGQLDWNVTDSLRLGAGARYTRDTADYRGSNIDRNPWGISTFETSFATRSPFTWDRSFDDDNASGRLTAQYFVNDALNIFVSGGTGYRAGGFDGTSIFTVEETYPFKSETVRSLEAGLRWTGDRFRLSLDGFINRFRNLQATTRLSNDTNGRTNVGRAETRGVEASGFLRVLQTDRQTLDASASVAFLDSEITEFTSNRIADVRATVGDPLPGAPDVTAYASLTHSILFAGGWTLTSTLSVSHHGEETNRLNALPNNTMEAYTLVDARVELEALAGWSVYGYGRNITDEVYFPELNGASRLVGAPATYGVGFRYAF

SEQ ID NO: 7444 - protein, 856 aa, Bartonella tribocorum
MRYKWKRSYWVLIVSSCFVQVAVAGEEGRSWLLCQPSSYNENEKTLHTQYNEDVRTGNCILGTPDKNILFGMNKGVDALEMLSGLTMKNSSGTLVRKIQGLESKSGGNAVQNAQRRSIPVLKSPELIFVKNGARLENFVLDHNGKAYISNDGEIDSPGQSINNTVRNGAEIYVYAGGLSENSKIEQGGTENVQALKGKQGFSKNAVVKEGGQQSVGNGGKVEGTKIYGGEQLVFGEGDVGGQIKGSSASNTVIYGQGETLGQQKIYDGGITWNTKVMRGGVQEIAKKTQSAKNGGSAFDTQVFGGGKQRILKEGKAIGVTLNETALQEIYADGSVKNLTINDEAKSLVYAGGTLEGKTLVSHSGQLHLYAGKEQHRTTVEEVILNGKETKLYSITDEFDGKSSLIQKLSGEGSVLFAFTGSDPYYSQLHVNNLSGSLHFEFNTTLAQNRGDYLFIENGKGNHTLSVADSGVEITDPFSNKRDLITDRSGEAYFTLTDLSGEKIHAIDGGTYMYDLKQRKGENGKIWFLSADRISGPESSLPDPKDPLVSGGLSTTPSVDAVLSTGVAPGLIFNNELEIVRTGRGVLDKNKKDIGLWTYAIKSRDRIATGHMHFKLEQTGIVVGADQLNELMHGKLYVGGFGSYDQGRVAHARGGDSDLNTYSVGAYATYFDRRGWYLDGVLKYNYYRDNLKALSTNGLVVQSNYNQWAIGGSFEMGCRFEPAQSTWMQPYVKLTGLQVAGKKIILSNGMTADISSLTSLRSEVGLTAGHEFIMNAETLLTAYITAAWLRENINNNHTTINNRHKFITDLSGNAGKLGIGLNSFVNDNLTLYAEAHYLKGHKIKQALQGILGLRYIF

SEQ ID NO: 7445 - protein, 777 aa, Bordetella petrii
MPTLSAFFESKNLYLKQRALLLTPRALLSLSIASILSTTSYAAESDNLTVQQADVQQTADAQDTPSAEFDAIVVKAAREELEQAAGLSVISEEAIKKASVSNDIAEIVRKMPGVNLSGSSTSGQRGNQRQIDLRGMGPNNTLILIDGRPVTSRNAVRPGRASEQDTRGDSQWVPPSAIERIEVLRGPAAARYGSGSMGGVVNIITKSPTKKEFSITGHYESPESDLEGKDWRTNINMAGPLTDKLSFRTTLGYHDSDGDDPYINAKDAQVVEGRDGPSASVAAGVEGVENIDVRQLFEYAVDAMNTVGVEVSYSTQDNHWAGDSQFQNVNDTLVDLLAGDSTNKMRRYGAAFTHRGNYDDARSNSYLEFSRTDNERLAEGTAGGGEGQIQTPPEGEGFNWKKATYDTLNAKSEWDIFYDNHTLTAGAEFRGEKLNNPWVSELTFDDGFAFGDVETDPAKRDPKSDAYLIGAYIEDNYQLTPDWYVTPGLRYDYHSEAGSNWSPSLNTTWHFSPNWSVKAGISRAFKAPDLYRLDPNYIYYTKGNGCPSWVPTDQRGCQVLGNSELEHETSWNKELTFTYEDGTGLNAGLTYYHNAYDNRIGAGINRVAVDSATKRSVFQWENQGKAIIEGLEGFVKVPVTDNILWSTNLTGNIRSERKDNGEPLSLIPKYTVNSNINWDITPRWNADFGVSYYGAIEAPEVSVTTGDELTTLKLDREPYALANISTRYNLTDMITVGAGIKNLFDKQIMREGTGTNAGARTFNEPGRAYIFDVSFDF

SEQ ID NO: 7446 - protein, 388 aa, Bordetella petrii
MKKTLLAAALLAGFAGAAQAETSVTLYGIIDTGIGYNDVDFKVKGANADGSDFKYNHSRFGMINGVQNGSRWGLRGTEDLGDGLQAVFQLESGFSSANGNSAQDGRLFGRQATIGLQSESWGRLDFGRQTNIASKYFGSIDPFGAGFGQANIGMGMSAMNTVRYDNMVMYQTPSYSGFQFGIGYSFSANDKDADAVNRVGFATADNVRAITTGLRYVNGPLNVALSYDQLNASNNQAQDEVDATPRSYGIGGSYDFEVVKLALAYARTTDGWFGGQGYPVAVTLPSGDKFGGFGVNTFADGFKANSYLLGLSAPIGGASNVFGSWQMVDPSNDKLTGGDEKMNVFSLGYTYDLSKRTNLYAYGSYAKNFAFLEDAKSTAVGVGIRHRF

SEQ ID NO: 7447 - protein, 733 aa, Bordetella petrii
MLPYAYPKDTTEMTMRFNLLPLATAITLALNPLSVLAEEQSSTETKDQNIEKITVMGKYTVSRTIDTATGLGLSLQETPQSVSIMTAERIQDQALNTVVDVVNNTVGLSSSKTDNVRNGFMARGFEVQNYQIDGVPLSWSLGGDAGETVSDISLYERVEVVRGATGLLTGAGDPSASINLVRKHADSAELKGYVDVATGSWDKKQVTADVSNGLNDSGSVRGRMVAKYVNSDSYQDLYQDRKTILYGVVDSDITENTMLRVGGSYNNNNPKGAMWGALPAMFSDGSATDWDVSATTAADWSRWETTNINYFANLNHYFSNGWQLVANYNRMEYETTTKMIYMSGLLNKETGAGLTGQRYHSHGESNSDNFDFQLKGDYQLFNREHQFVAGALYSKQKSYADTYEPIREDMTGWDSKVVENFYDWRSNTFDEPQWSTDANRQLNMDTEQKGFYAATRLTITDDFKIIAGGRISSWNREGVSYGTSTNFGDDGVFVPYVGALYDINKEHRVYASYTEIFNPQNVTNAYGEYIDPLKGKAYEVGLKSAYLDDRLHTTVALFKIDQDNLATPDGTVTIDGKPVTNYKAAQGTESTGFELEVVGEFIDGWNISAGYSQFTAEDAEGSKVETTSPRKQFKLFTTYQFVDHLPELTVGGGVNWQSDSYSENGGVVIEQDAYSLVNLMARYNLAENMDLQLNLENLLDEKYYAYMSASGLSYSIYHYGTPRNVTVSFNYRF

SEQ ID NO: 7448 - protein, 537 aa, Bartonella tribocorum
MVIISMTHFASSCVRIILKLFQQLLVAPAALGLLAPVAANATELNINGVSDYAASGEQVTSITQFSDVYPTDWAYQALSNLIERYGCVAGYPNGTYRGNRAMTRFEAAALLNACLDRVTEVTDELKRLMKEFEKELAILKGRVDGLEARVGELEATQFSTTTKLSGLATFVVGANNFSGTKSKADPANRDFGATTFNYDLQLSLETSFTGKDLLITILRSGNFGENSVFGGNPNGLSTLETAFQEDSGANSVGIDKLYYQFPVANSLTFTLGARVGQEDMLAVWPSAYPSDPILDVTTLNGAPAAYNKNLGPGAGVSWSTDSGFSISANYVAAQGSSSDPNAGGIGTEFSEASGTVQLAYESENWNIAAIWSGVQSPSELVGGFGTTFAADNYFSGRKAFMNAWGIGGSWQPQESGWIPSISAGYGYNALYAKNVGDVTTSQSWNLGLEWSDVFLKGNNAGMAVGQPVFATDLKGDEVPADGNYVWEWWYQFQVTDNISVTPALFYLSRPEGQNTDLNGGDDTLSQLGGLVKTTFKF

SEQ ID NO: 7449 - protein, 148 aa, Bartonella tribocorum
MNTISSLETTDLPAAYHIEQRAHAFPWSEKTFASNQGERYLNFQLTQNGKMAAFAITQVVLDEATLFNIAVDPDYQRQGLGRALLEHLIDELEKRGVATLWLEVRASNAAAIALYESLGFNEATIRRNYYPTTDGREDAIIMALPISM

SEQ ID NO: 7450 - protein, 710 aa, Bartonella tribocorum
MYKKSLLASAIVVALMPSAYAEQQSQFNEVVVTATRSTQNKQDVAASIDTVSAQDIDNTLATDVKDALKYTPGVEVKSGSRFGISGFNIRGMEDSRILTVIDGVQQPVGYNPDASEQRKYSNAIEVDTLQAIEVNKGPSSTLYGSDALGGLVQFRTKNPSDVLINDEDGHRFGIKSTYTSVDEQFKNTLTWAMRQGKLETLLMATYAQGHETKSHDSGADIEGPGRGLTNPADTELGNLLAKAQYQANEDHRFGLTVEHYTKNYDEDELNYNGYAIMPGFVYSNNYNEDVNKRTRISLDHQWLMDTLLVDQSLVTLSYQDSSTLNKNYDTTPSSGARMRERDSADKAVQFDVQLNKLIDTDGLSHDVTYGGSYLNNAFSLQNTDHLYKTGTSRNGSTGVPDADIIKWGLFAQDQMYFLDEQLILTAGLRYDSFEATPKTDSAFTTEYKPNKDNAFTGKLGAVYHLQDNLAVFGQISQGFKAPTVYDLYYFYNQGAIIEANPDLKAERSIAYEIGTRGNNAYGNMEFALFVNDYKDFITQTKTGQSGGKDVISKYNIDEVQIYGAEFSSTLLLDTISPLPQGSYARLSIAYAHGEDKATGKEIDTVAPLTSVLGLGYEQADFGSALNVKMVASKNEWQVENNLDVAGYAVVDLAAYYVPVKDLTVRAGLFNLFDKKYWNYSDISGKTGTERFNDYDTQPGRNWGISLDYQF

SEQ ID NO: 7451 - protein, 780 aa, Bartonella tribocorum
MCKKSNKKNFLLCTIAGTLIFSHFGSTHAKTLLHHEIPTVRTTNGEEKKLNNVFVRGEYNAAIANTGRIIITNSIMHSDGTLLAGVAGGRLNAKGIIGKTKERGLSLTNGIINVEDSIINVTEHGKGYGIIFDYILSSKIKEGEEVVNKAILNNTKLLVRDGVGIVGPYYSKAVSNEVHLKNSEIRSDMLLKNKTAPGNTEPATFTLNADNSIIEGRVKTFPQNKTVFNLNNNSKWYLKISLFEMEDDFSLFDYKLLDIKQRAQSIVSVLNLHNSSIVFSAPHKLVNGHYQTLHVGKIQTAEDSRLQENRTSNLATVYNAIGDAKIYFNTEWSDGLEKEQQKTDRLFVHGNVSGTTTLYFKNLSKNEETKEESAVPLNTRGVSLVQVFGKAEENSFKLANGYTTMGGLPYKYMLNAYGPTSNRGKANAEQSLGGENKNFWDFRLQSATLDDEGEIRALVPQVASYLVMPNALFSAGLAELNNQNILLENMRTTLFEAKDKKEDNKKSGIFLSSYGHKITLSSNRSPLHYGYGADVHYTAIQAGMTLAALEGQNSTTHFGLLGTYGQLSFTPKGMEGADKSTLDKWSLAAYGNIQHNDGIYVNALFSYGAFKGNITTALIGNTAKLDGSHTVSASATIGHKLETDAKGLVFEPQAQLLYQRLMLGTLSDIDGFNVNMGKPHQWLLRIGGRLTQTIPSDEKGYATSFYGKLNLMKAFSNKSTVQIGDTFYLDAMGDSVEGGLGVNAQLSQNFALHADINYQHKLQKAGVSGINFSAGIRYQF

SEQ ID NO: 7452 - protein, 825 aa, Bartonella tribocorum
MCKKYIYKKNFLLCTIAGTFIFSYFAPTYANTQPPEIIDEFKLEKGEEKTLNNVFIRNGLSAVYASEKAIATITNSTIHSASFAFAVSKGGRVNAKGMKVNALYTGLSISNGIINIEDSVIETKRQSGIIFHTILDAFLKEGEEVVNKAILTNTKLLVRDGVGIWGPSSSKSVAEVQLRNSEIRSDVLLKNSVKKKTDSDPHPVSFVLTADNSIMEGRARTLEVNTTIFNLNNNSKWYLNVSQYDVNNDFSTLNFALHDIKQRALSTVSVLNLRNSSIVFNAPHTLARGQYQTLSVGRTIEVPNSQANRDSTRETVYNATGNARIYFNTEWSDGLEKGQQKTDRLLVHGDVSGTTTINFNGLSKGEPSEADASIPANMRGLSLIQVSGKADKNSFKLANGYVTMGALPYKYVLNAYGPTSSLGKAERAQSHLGEVSQQSKEKDSKTDTPPVVLGGMVLGIENNIKSESTSSSEQAESIQSHLRENQNFWDFRLQSATLDDEGRIRALVPQVASYLVMPTALFSAGLADVNNQNTLLNTMQETSFETKNHKNKGILFSAYGNKMTLSSHRTPLQYGYGADIHYAALQAGITLAALEDQNMTTNFGLLGTYGKLAFTPKGMEGADKSTLDKWSLTAYSGLRHNNGTYVHALFSYGMLKGNITTALIGKTAELTSADTFSASATIGQKFETSTKGLVFEPQAQVIYQRLMIDTFSDVDGFDVNMGNPHQWLVRIGGRLMQTTVPTENSSIFSFYGKLNIVKAFSNNATIQIGESFHLDAMGASLEGGLGVNAQLSQNIALHADVHYQQKLQKTGISGTSFSGGIRYQF

SEQ ID NO: 7453 - protein, 442 aa, Bartonella tribocorum
MHKNLAPRLIPALIAIAFSGGASASGFQLLEQNASGLGNSYAGSAAVAENASTIFYNPAGMTQLKGLQVSGGLTAIHTSYKFSDQGSSVGVLQNSGNGGDGGGWGYLPNAYISWEATKDLYLGLGIGAPFGLKTEYNNPWQGGAQSLKFDIKTVNINPSIAWRANEFVSVGAGINYQKLTAEYERQVAVASTSGLAVATMLSTTKATLNLDDDAWGWNVGALFSINPTTKIGVSYRSAVKYDLTGDFKFDGTLAQSSNPLLGGATKDRSAKATLKVPDTWILSATHALNDRVELLGDISWTGWSSIPKVDVYNAQTTGAGAVSGRIAQTLDTEFRDTWRVAAGANYRYTEALKFKFGIAYDQTPVKGASTRLVSLPDNNRIWLSFGTQWKPTKDSAVDLGIAHLFVKDSKIDNDQSAAGRGRVTGTFADSAWIFGLQYSAAF

SEQ ID NO: 7454 - protein, 595 aa, Bartonella tribocorum
MKKSFKKLGFVSLAASGVLLGSMNATDLETYAALQKSSHVFGNYAEKDKDSKLTSDSPTQQQDQKVAQNTASNDSQEATTLENTASTDNTTATTDETYTKSTDTTVAGAAQKVETDNTAVQSAEQTLKTDVAKVQADASAKDFDETTFQADQAAEQTAEKALQQAESKLNTDQQTLNTALQDQTKTPTPSTPPTKEEPKHTASSGTPPAPESPPAKKDETSGTPSASGSSVASQLTKDTTMVNNLKSVSVSAMNTTLSGVETMSQQTATIGNLLNSSTDLSSVIPNAQGLNSAFSTLESAQNTLKGYLNSSSATIGQLTNGSNAVVGALDKAINQVDMALADLSAADTQKTQAVTLATASDSPTTTTDAINFLNALKSNLMAQKDAFLNVHKNIQTAVAQAQETYTPSVINTNNYGQMYGVDAMAGYKWFFGKTKRFGFRSYGYYSYNHANLSFVGSQLGIMEGASQVNNFTYGVGFDVLYNFYESKEGYNTAGLFLGFGLGGDSFIVQGESYLKSQMHICNNTAGCSASMNTSYFQMPVEFGFRSNFSKHSGIEVGFKLPLFTNQFYKERGVDGSVDVFYKRNFSIYFNYMINF

SEQ ID NO: 7455 - protein, 988 aa, Bartonella tribocorum
MVYKMKMKNKSILYILCPLYIWPINCYSNYNINDMGDSIYNPFSIANNASQYYEFNHNRYEYIKHLHGRVLDKHSYNQQLMTPFGSTYIYATISDDTLSLYNRIADEGERNIQKKIPNYNVRETVYFSEELLPNELFISIDGGKTIKKINKENNPQLDLLYLSHISKNSKTVVGYAFAGARARLEQMVKNNSIFEDTIGCGTYNGCYVFAYNVYNNTFSILDRNMEIRYLTKDGNFILYEYKGDERKKLYIYDIYKKENFELTFDNVNKYLANHLEKAILLSPITEYPFLKGIKRRGVDIQKISDNGQVFIGQLNRDLPKKKLLDREYPKVAFITTASGPIRELSLSEFGSTKLADTSADGNYSVGWGDVWHNNYAIRLPTRTKTSSAIFSQALLYDFSNDKLINIGNLSTKKEESEFRNARALDITADGKYVVGWSETDEYNLKTIPKDLTGTGPHAFIMFHRHGFIYFNNHMYDLGTLDGGKDSEAHAISDDGRIIYGVATNERNNWRQVIWRNDEIDDKYFNTEQQEIADEKDKQAEQEKAEQEKAEQERLARLQAEQEKTEQERLARLQAEQEKAKQEKAEQERLARLQAEQEKAEQERLARLQAEQEKAEQEHLARLQAEQEKAEQERLARLQADKELPPVEDEQVQQAKAKVKEKETAKSSTAISKPIDVENSYKSMQLMAENSYKLIDMQQGQLRYLASATCSVGTEKACLSGFTHYQNIDKANAIQTGISGAYRFDINQTPLVVGLAIDSDSYSSLPTGYEYQGYPLPLIGFSVDLIPSLNPTSNGNALHLSLKGAYVNRKVTIKRPILDNTEAGKGHAKISGYYIDFQGYYPYTLNNLITVTPFAGLTFNQTSRSAYSETQGTKLAVHYQELNAHSLLAKIGLGIEYTVNAKLKLDSKAGLLWHLSHHQGDFQSHIDYLGQQKINYNDNKKQLAQRPFASVGLTYQLDKQSSVNTTTNWQMTPYRNQDIHMGIGYTYRF

SEQ ID NO: 7456 - protein, 596 aa, Bartonella tribocorum
MVNSDKGITNLHVPSDVIIDASMPAMIRNSGQMWNAEGKSQDTKAIIPDRSYAGIYQATIDFCKENGALDPKTMGSVPNVGLMAQKAEEYGSHDKTFQMAANGTVTVIDANGNVLMEQAVESGDIFRMCQVKDAPIQDWVKLAVNRARATGVATVFCDYYYGLELDFIGFNWDSGIKNYNLKYDFKHYLSEKTKLTYGINTVYYDFNPGKIKPNSPDSKINPKQLDKKYAFEPAIYIDAEQKLSDKISVNYGLRYSMFYRLGAQEINVYENNQAVTYDEDLKIYEKATPIGTRKYGRNETIASFDNLEPRFSIAYIINENQSVKASYNRMSQYLHLISNTQSPTPLDVWAPSDHFLKPQILDQYAIGYQKNSKNGKYSFEIESFYKDVQNRLDYIDGADLIANNAIEQVVLAGKSRAYGLEILARKNEGKLNGWISYTLSRSEQQTAGRTATEIGINDGKWYKTGWDKTHNLSVTGIYELNDKWSFGSIFSLQTGQPVTYPNGQYEFQGLLVPSYGERNANNLPAYHRLDISATLTPRNSKDKRIKGEWVFGIYNVYSRKNAASISFRQNADSGNNEAVRLSIFGIVPSVTYNFKF

SEQ ID NO: 7457 - protein, 1011 aa, Bartonella tribocorum
MIKVFRNRVYLYTFTTAILSLLQNGRGVCANAGEPYNITVVPVYPGARVSGFGYDNRISTHGNLVSGRRVGSLSGLSGERGDSGSIQGVTTGKTDKVLSGEGGDREGGKYVYKYDKLRGKTTLYKGLYYLCDDCEEDTIDSRSYKITSGNVSQYPSNTAITVKGKNAAVKGKNVTVSSEVSDKSFTRGVFVSEHGKIVLTNPIIKNAVTALNASNGAIKVHKGTIEASHRGVEAIGNNALVILEDTEVKTSDGKASISSYGGAGVLMNEGSVDFTNSHGVSSTLGGVVTLEGTAITGKGKAKNQENFAGFFVDVGGSVKFKGTADFTNVHGILSENTVNTFNSVPISEDLLKYSRVTEVNLTSSSVTVNGDTSYGIYFRGEKPRDEYRNNEDSNEQKTPPRLEAINLRRTKFSVPDSIAVYSTDATYGVVNLMQSELSGDSLLRVEKGALVKVLASASVLEGGAYVDDHSTAELYLGVGSKWILKERERSSPESGRKNDSSVSLVLLTNDSSIDFKKPKSALTYDYQTLRIGNGVGEVYRAKDGAHIYLNTYLNEGGALKDQKTDRLLIHGDAAGKTTVHVRSISESPGGYTGNGGNDQGISIIQVSGTANEDSFQLDGGYVALHGTPYQYKLYAYGPESTLGGSSSHQRLVKGDGDFWDFRLENQYLDSGPRPEPEPEPEPEGPVEPGVKDVVPQVPTYLLLPNGFFHAGLVNISNQNKHLERLRATSGGMSGIHENPALFLRGYAGHYRYSSNLSALEYGYGGELGYNALEAGVLLKTIENAYSNTFFGVIGAYERLSLQPLAVEQSQKSAFDKWSVTAYGTMQYDAGFYVDGLLSYGLFKGDVLTLARGKTATLKGNPLSVSLTGGQPFATGYEGFVFDPQVQVVYQHLRINPARDIDNFEIELGKLDQWTMRVGGRLTKTFPVTDEARLVSFYSKFYLAHGFDGKQSVHFKDAFQLGAFGSSLEAGLGFNARLSSKFALHGDLVYQHKLSKAGFSGTSFVGGLRYQF

SEQ ID NO: 7458 - protein, 914 aa, Bartonella tribocorum
MFKNCLYSWVFTAAIFSFLSNIDVEARSRSSVSLSCDESKLPYKCSDGAKHTISDKVYQLVKSSKEENGQDISLTSSAVIVAQQSNTIIQANRVQISGIEGVEDTYGVIASQGGKVVLSDSTLKDVSTGLRAESGTIEVNRGLVKATQVGIYAEKQGTSVLLTNAEIKVESQDIGQKAALFSGNDAVIKMKGGSIDVTDAAALYLGVRGSATLDGVTITSKSQQEMDKENANKEDGVAYAVLNVNQHGAISLKNTNVIATGVRALWIGLDANAQSSMGQEANISVSRVNIEDSKIIVSGNKHGMHFDMDKEDNEYQKGFVFLKKTTFEVPDGTAIHSYKSSGYIGVTEGTKISGDLLLTAEKESSVAILVDSSSLTGGTRVADDSIAELYLTGGSKWVLTKSKEINQQVSNLVSSISFVKLSDSSLIFETPTLQEYQTLYIGKGGEEVYSAQGNAHIYLNTHLNGDGLLNNQKTDRLLIDGDVAGKTTVHVQFIAGNQAEALGNGNAKSISIVQVSGKAAEDSFQLSSAYIVLEGLPYQYYLHAYGPSSSLGKAKISQRLVKGDGDFWDFRLESKYVQLTPNISIVPDSQLMVRNVVPQVPTYLFLPNALFHVGLMDIESQNKQLKVMRSVSSKLLKVEGSPVLSVHGYSGNYRYVSDLSKLEYGYGGDLGYKALEVDILLKTIEGTHSTTSFGIMATYGRLSLRPQDVENSQKSIFHKWLVTAYGSLESNAGFYVDGLLSYGLFEGDVLTFVRGKTATLKGNPLNVSLSAGKAFTTGDEGFIFDPQIQLIYQHLQFHKAHDIDRFDVEMGKLDQWAMRIGGRLTKMLAAFEKDRIVSFYGKLHVSHGFRGKQSVYFKDAFQLSAFGSSLEAGVGVYSQLSSKLILHSDLMYQHKLTKAGFSGIHFSGGLRYRF

SEQ ID NO: 7459 - protein, 465 aa, Bartonella tribocorum
MVNKNVNRGRGILVLKIGIALLPISYQPISFSEQFLDDSTLKGGLYYWQRDRSRKELNPESDKYKKYVDNLKHSTVNASLDYSSGYFQDVIGLDLAAFTAIELSNSGPAAPNEIGFSDAKTRWDEKWTGDRSGVSVYKAAAKMQYGPFWGRGGYIQPTGQTLLASHWSYMPGTYRGFEIGGVFDFAQQGALSLSYMWTDRYKAPWYRDMYNFREADGQTGISYLQSLGFKYDFKNNLVLEAAYGQAKGYMDQYFAKASYAVPVATRDLRMSYQFYGAKDKVTNGGINDVYDGLAFLQAVTFGYTYDQFDFRLEGTYVKAKGNQGYFLQRMTPGYATSNGRLDIWWDGRSDYNANNEKALFAGVMYDLAKWDLAGWKVGTSYIYGWDAKPSTNTQYAQDVKLKETAWNVDILYTVQTGKAKDTLFKLHFTKYDNHTDIPSYGGGFGNIFQDEKDIKFMVMMPFTIF

SEQ ID NO: 7460 - protein, 1040 aa, Bartonella tribocorum
MIKTTQSRWVRQSSRIALIVAAGMAATMARAQDAAPQDDNAQAAEEIVVTGSNIKGASDSGAIAVTTLGKEEIESFGASSTGEIMEYIAQAGSAEINGAADGPNDARGDVATVNLRGLGTGNTLILLNGRRIAAHAANQDIGSTPRQIVNVNAFPATGIDRVEVLRDGASALYGSDATAGVVNTILDADFSRNILSFEYSKLEGTGSDEISIDGGFGVEFNKGRTRLMLSGSYYDRNGLFSSELGPQFNSVDKRAFLGDSPFATETTDFRNTSTSSPFGQFQVGSVNADGVFVGRRVRQGTTALTSSSGVFHIQPCDFPGTRAELGTGSEGCMGLDDGSLDTALRYDFGANQPNNSLNEGVNIANDPVTAKGRQLISSARRYNAYANMEHEFEGGVELFAEALYYRATTSSNRAAQPVDSGLAFLIVPASNYWNPFGAVGSPNRLPGLNTSDVPAEGRDILLVNWRPTDLGPRFIDTQTETYRLLAGLRGQFGSWDWEGAVAMSGNRTEDTESNRLSKTLLVAELAKSTPDAINPFGGPNANTQEQWDRVRISNTNVGTTELMTADFRVSNSDAFDLIDGPVGLAFGVEWRHDYYEEDRDPRLDGTIIFDESNVSGVSDVVGVSPTRDSSAGRDVFSAFGEALIPLHRGEGTFINDLTLQLAVRGEYFNDIKDGAVKPKVALSWFPVEAFNLRAAYSQGFRVPNLVQLNRGDISRLNLGTEDYYRRDVTGDPVSTGDAYLASVRQSNPDLKNEDTETFVVGATLDLTKAFESNIFRRFAINVDYWRFEQTGVIGAFGDQEALALDFLLRQQGSSNPNVVRAPVTAADQAAFDAYNAANPDAPRQAAGQVQFIVDPYINLDSQVADGFDFGLSTSIDAGSAGTFRFGVEATYLNKLDVVRNDLLAALAQNPAFAGDFAELQVDRVKLDGNPRWRGTATFGWRLDDFSMGGSVRYVSDMIDTSADITVDGETVYWKVKEDWRVNLHGEYRFRLGGRRDVRLRLGVNNVFDSAPPLVDESLGYYPEYHSVKPREFYVQLRGSF

SEQ ID NO: 7461 - protein, 978 aa, Bartonella tribocorum
MASVVQQTTKLKGVVLDAKTGEPIIGANVLIKGTAVGTITDFDGNYEFEGTVGAKLVISFVGYKSIEVTATAHNQTIKLSEDSEALDEVVVVGYGMQRKSSITGSISSVKADKLKDITTPSVANMLQGKIAGAVVVPTSGRPGDGVSIRVRGIGSIRGNVEPLWVIDGVVGASSADLNPNDIESISILKDGSATALYGSRGANGVIQVTTKRATSGPSQIDLSVKFGVSQLQKGNLEMMSGAEYYDYVRTAYENAGTLDAQGWLQPYLRNRNFDWWDLATQNALTQNYNIGYRYGNEKIKAYLSADYYSEEGTIKGFDYDRFTIRSNTDYVVNDRLTLKSKISASYKETNNQEYSLAHTSYTPWDTPWDSQGNLKDGTQGVPTAADAPTANPDDYWYSDGGSNFLYDRALNWGKTRSNGLDLGLGLDFKIIDGLTFESNNRVGFSNNYSNSYVDPNSRSGAGTSGSYYDGQSNTRSIYTSQLLRFLKTFGEKHEINAYLGYDYDEYRYWDLSATAYKIFQGAEIINAGADDPTASGTKSESKNAAIYLNVNYSFDSKYLIQGMVRRDGSSKFGSDKRWATFWSVGAGWNMHKEKFLSQVEWINELKPRVSYGISGNQPGGAYEWATIFGYTSQYANEIAFLSNYQGNPDLSWEETANFDAGIDIRLFDRVSITLDYYLKKVKNLIYLRHLPAVTGFNRQTANNGKMENSGVELTITPELIKTKDWYWDISFNMGYNRNEVTYLPDGDDLTMQAVAVGYPYMNWYMKEWAGVDTMTGTPLWFKVDPDTGVKTVTGNYNEATNVLLDASPTPKVTGGLSTNLSWKGLSLNANFTFSAGAKIYNSMRAGALDRDAERPSQPAMKLPDGWSRWEKPGDIATHPQLRAGGNNGASNTSTRYLENGDYFKLKTLTLSYSLPKKWLHSLKISGANISVSGENLFTITKFSGQDPEILLSSSYNGNASGFGYPTVRRFSVGLNVNF

SEQ ID NO: 7462 - protein, 1057 aa, Bartonella tribocorum
MYKKEHLGEMYSHLWQKLIVGVLLVFVFSQCVFAQTFEIKGKISDKTTKEPLIGAAIEVKGKGTGTVADLDGQFVLSGVAATDKLIVTYLGYAKQEILVGSKKYFDILMSEDAAKVLDEVVVIGYGSVKKKDLTGSVSQIRPDKLSNESPATVEDILRMGAVGLHVGISNTAKGNTSLQIRGQRSLKANTSPLIVVDNMIFFGELSEINPQDIEQIDVLKDASASAIYGAKSANGVIIITTKKGKSEKPTIRLDASYGFVTMGANRDLYDAEGYLNFRSDLQNASNGYETPAKWLRPTAENLQKYGISIEEWRAYTGATTSVSDDETWLNRLGLFNKERENYFNGKTYDWYDASFQTGSRQDYNVSVSGNSKSLNYYFSLGYYDSKGVIVGDEYKTIRSNLKLNASITKFLEIGANVNFQNRTDGNLAIDWNRSCTANSPYALPYDEDGNLELRPMGVNPLNEGYNYWYDLQYSSLDRGYTVLNTILNAKIKLPFNINYTISFAPRFQWYWDRFHQSSQHPLWQTSHNGAVNREQSKRFDWLYNQVISWEYTFNEKHSFNLTLSHEAEEHRSWKDRIEARDFSPTDALGFHYVQNANKLKSAFSCYDDHSTGDALLGRVIYGYDDRYTGTFTVRRDGYSAFGSNNPRATFYSGAFAWNFANEKFFKWEAMSQGKLRLSYGTNGNREIGIYSALSGMSANGVYPYIDPTDNSIRESTRMYVNKMQNLNLKWEKTASWNVGLDFGFLGQRINGSIDAYYMPTTDVILDRSLPTITSFGSVTSNLGEIVNKGVEITLNSVNISRPNFEWSSTATFSLNRNEIKHLYGIYTDILDEHGNIIGQKEMDDVGNRWFIGHDINEIWDYKLLGIWQLGEEEEAAKYGQKPGDPKVLHKGDISVRPYGEEDKEFLGSRSPKFRWSFRNEFTLFKDFSLSMNLYSLWGHKTTDTEYLHGGDFIGRQNIWVQKYWTPENPTNEYASLKPTSKVANPVKIIDKSFIRLENISLAYRVPSKWLSKFSISALTLYGSVRNVAVWTKEWERWDPETEGPMPRTFTLGASVTF

SEQ ID NO: 7463 - protein, 247 aa, Bartonella tribocorum
MKTKALLCSTLVAVTALPTFAGETKLDVRFGHNTASDIRDSRVKFMHTFDTGFYFSAEAAQIHNDGYFAGNDSNDPDKNGLKAAAQEFEATYKFDLGEDWYWAPGLVMVTAPNWTEYRPYLKLGTTFDNGVSLTGRYRYNWSNDANGKNYLDGSGTTRGASNQFDLWISKNFGDVGLMYNPRYRYQDGVDQGTGRDDYWEHTIMVNYKLNETWTPYMELVSVDETYVDEQGNRENDYAVRLGFVMNL

SEQ ID NO: 7464 - protein, 1131 aa, Burkholderia mallei ATCC 10399
MLMTRHKKRKTMKRSGAKLLAPVVVAAAAAVAARPGWAQAAPYPDPGRRGDPASWRTPEFTNAWGLGAMHAEYAYAAGYTGANVAIGVLDSGYYAQHPELPDSRFVPVTAAGVSGVLNPNNNNHGTLVSGVVGGARDGVGMHGVAPDATVYEGNTNATDGFRFGVSDPKFPASDAKYFAEAYDALAAKGVRIISNSWGSQPANENYSTLNKLTDAYKLHEAVRTATGRGTWLDAAAKVSRDGVINNFSSGNTGYDNASLRGAYAYFHPELEGHWMTTTGYDQLSGQVYNQCGIAKWWCVMAPTGVPSTSYSGGAAAPTGATYANFNGTSAAAPHASAALALIMERFPYMTSEQALSVLFTTAQNMEPDPSRPDYTNNGLFSTVHPAKPGASGVPNAFGGWGLVDLRRAMNGPGQLLGTFNAALPAGTADVWSNDISDVALAARKREDDAEHRAWLDTLRTKGWEHGLPAGASDGDRIDYALGVARETAYQAREYQGSLVKSGGGTLTLAGANTYRGPTTVDGGELRIDGSIAARAVVNPAGRLTVNGRAADIAVNGGVATIAGTSANLSIDRQGRAAVTGTTADVRVASGFASLGGTSGNVAVGALGVAAITGRTADVAVDGGRASLDGASGNVAVGNGGVVSGSGTVRTLTAAANGTVAPGHSVGTLTVSGDVRFAPGSIYAVEVSPGGAGDRIVAGGRAQIDGGALALALENTPPPLTPEQSRSVLGRRFEILNAAGGVAGRFDAPSGYLFVNPVLAYGPTTVSLTIDRNATPFASVARTANERGVADALETADPGSAVYNSVLFAASAQAPQATLAQLTGEIYPAAYAALVNESRQVREAALERLWTARGAPGRAGAWARLLGAWGSARGGDVNGYTSSTGGFLAGADAALLDSVRAGGFAGYSHTGVNLRNQPSSASFDSFHLGAYAGWQPGALGVRIGAAHAWHRGGVDRAVQYGAVAENETTALHAETTQVFGEAGYRFALDGAATLEPFFGVAYVHLKNQGTTETGGAAALRVRQGNHDVTFSTLGVRGETRLGLTSRLQLTLQGSAGWQHALTDGQPSGTLAFATGSDTFTVSSVPVAKDAAVLNVGAGLELGKNGWLRVGYSGSLASRQSEHAVQGSLHWKF

SEQ ID NO: 7465 - protein, 358 aa, Burkholderia mallei ATCC 10399
MAVAGIGIGAAVPPALAQSSVTLYGIVDSGITYTNNQKGHSAWKATSGNEQAARWGLVGREDLGGGTSAIFRLENGFDIENGTASQGGRLFGRRTYIGLANDRWGAFTMGRQYNAVQETLAPLHIATVLGRYAHHPFDADDLDSTFRTNNSVQYQTPDWGGVRAIATYGFSNSTSFARNRTWSVGASYARGPLQLAAAYVRVDYPAIDATGAIASDNYYGFVKGVARQQIWGAGGAYAWGDATFGLLYTSALFSLQTGGAERFNNFEGSVRYRVTPAVQVALGETYTQVLASHAAAHDAHYLQTSAGIQYFLSKRTDVYLNVSYQRASSNAVAWIKGLDGASSTRTQIVAVTGIRHKF

SEQ ID NO: 7466 - protein, 756 aa, Burkholderia mallei ATCC 10399
MSRAPHAPSRRRAFGRGFAAAARAAHGAPVAHGAHACFAAASRRATAVERCVTALACAVTASGALAAEAEPADAARGPHRELPTVRVTSDGVHASPLSTPLAAGSRLKLASLDTPASVEAITSAQIAARGDRTIVDAVTRATGFSTAAAPGNGGTALSVRGFAGQESVTTLVDGVRLYPGAGTVTFPFSTWSAERIEVLRGPASVLYGEGAIGGVANVVTRRPRRERSTTLQAGIGTQGEKRVALDTTGALGARLSYRFHLSDERTRGFVERGDAHVTAVGGALKLDVDSRLSITLDYDYGRQKPATYFGVPATNGVLERALRERNYNVGDATIAYHDTWTRLAATYRAGNGVTLDAQLYYLATRRHWRNAESYALDPAARTVARSDYLEIFHRERQFGERFTARIDSRVFGRANRLVLGAEFNQIAFDGANNAPYRGESTVAAAGFDPGAFASPDPTLPRFRTRTHQAAAFIENRLEVLPRLAWVSGLRYDHLSFHRDDLIAGGAFDKTFAHTGWRSGLVYEIAPGLAAYAQYTTGAQGVGSLVTLSASQANYTLATGRQWEAGIKHEIDGARAYWTLAVYDIVKRGLVSVDPLNPARAQQIGRQSSRGVELAGGVRLPGGVTVDANAALLRARYDAFDQRVGDTVVQRAGNVPHDIAQQSANLWIGWAFAPGWRANAGLRYVGPRYGDDANRVPVPSYTVFDASLAWRATRDADLVLYARNLANRTYAASTLNGGAQWLLGPSRSAELVATLRF

SEQ ID NO: 7467 - protein, 190 aa, Coxiella burnetii
MKNIVLALIATVAVGLGTESLAQGAAVEEESGLYTNGDLVGVKPKVTNLGSIDDGGIIYKAGGGYQFNKYFALEGNYTRFPNLKSGRVIPEKSNTEIYAAGKAIIPLKKGYNVFAKIGAAQVSITTVPGMEDVSGINLSNTHSEILPYGGLGVGYSVSQKVGFNLQFAGTPEGDNIPARYAVMGGLSYNF

SEQ ID NO: 7468 - protein, 740 aa, Coxiella burnetii
MKRLISRTLIWFLLILCIPISLAAQRQIAGTVTDTKDRPIVLANVYPINSFDGMATDSLGRFRFTTSSTFPMRLVVSHINYHSDTLTIRKGDPMENIRIRLRETDDYKLSEVVVSVSAFGVGGKQNKTVLNPMDVYTNPSGNGDLSMALRQTPGLQDVGDREGFFVRGGASWETAVTIEGIRVKRFFGKNRFDAPARSRFETGMFSGLSLSTGGYGATEGGALSGLLRLRLAGKSPSSVGIGISPLFVNGGGGHLSRSNRFYIEQNASVSDAAYIRLLLKPEYKLPGTNRSYAYNARTIWNPTSQDEVKGLFLFVHDLSSSALRIPSPATAYMLYAGRNTYGFGMAVWRHDFEGGKTTSTLSAGYSEDHNRLHRQLEIEPDIESTFRTVERDANIRLRFDSRIKAWKLSYGSDYTYSEAKSSVREDKSSALPTLREHLVAAYAEALFPLSNRISATAGLRAEYSGLTESAIILPRLSATYKLSPSSRITLDAGGYAAPGDYYLSHGIVPQKREHSQQYNLTYEWRPSRTQVLRLQAYDKEYSRLTTLAPDGTASNLGKGYARGLDFFWKASGLIRSFEHWFSYSYTDARRQYLFSPDQERPDFVAKHTLSTVLKYWCAPISSLFNVSMSWRSGMTYHDPNIASPAYLNASLPANFSMSASYNYPFKYKKAGGVLVFSVHNLFNSDPTYGYRFGDKPIGGVYPSVRISTPYRQFYMVGLFINFGIDRRQEIMNTDIKIKSR

SEQ ID NO: 7469 - protein, 237 aa, Coxiella burnetii
MGRCILYLFCLLSALFLIPTNAAAGGIEVPHYIPIPFVYSGVYVEGLYGYASRDWESYLPYQTYVAALQGDGPPFGPFVKRGKGGSVAGVDVGYQWNRYFAAEIGWIHLPTVRYLVPSGLPVADGRISEHSWLGYIALKLAFPICGNLYAYSKVGAAGLNIRTRINFTPVNDLTQNGDFWSPLFAVGLQYYLNWYWFFTLQYLHVNGYGRASAGAIQKLPSPHSDLFTFSVGYKLAI

SEQ ID NO: 7470 - protein, 1010 aa, Coxiella burnetii
MRSTVLAGVAALTMGGAPVFAQETDEPEQTAEESPAAEDTIVVTGSRIARTGFDTTQPSEIIGSQEIELRGYTNAADAVLDIPGVFGNTPIGNQGSSGVGQNLPNLFGLGTNRTLTLIDGRRFVSSNSPVGGSGNPGSQVDLNNIPVAMIERVEVVKVGGAAVYGSDAVAGVVNYILRDDYEGFEIGADYSQWTEDNIADEYSIRALMGGNFDNGRGNIVASIEFNETSPVLESAVDDLAEGWSRFTPTAANRVVNPDTGTAPGSQTRVVPAATAGILSFSGLLTPGSAAITNVGVGRFPDGNFYQFDPAGSGNLVAYDPGLPTGNLVWASGGDGLRLEGITPLRSPFRRMNFSTFVDYQINDYVNFSMNVFANQFEATEPVNQPFYASGLFGATSDSLFFPVDYAYLNQSVRDTLVANGLSGFYLQKGFTDLGAKDIFNETTVMSYNFALDGMFSVLERDVSWELAYQTGSSSIVSQTGDLSEDRFFASLDVGINPATGQIDCRFNYDPTYDAPLAGGFGAIDDVGALGEECVPYNPFEGATQENVDYLIVNRTAVTEIEQEIVSGFLTSDIFALPAGNLGFATGFEYRREFADYRPGAGNQLNITRDGGGSPTTGEYFTTDVYAETYIPVLGGGFNPIPFIDYADIEASYRLMNNTRAGVDEAWAVGLSMGILEDLNFRANVARTVRAPAVTELFLPRVQSSQFAADPCSANNLNGGPRPAVRAANCAAEGLPPTFISQAQNATVSGFNGGNPQLNNETADSYNFGLVFSPRWVDGLTLSVDYINIAIEDAITSFTLTQIMQACYDSTNYPNSFCNAFTRLPNGQLPSINAFTSGYVNAAIQEFDSVELAARYQTELNDVFFLNQIESDLGTFDATLRVYNVQTNTTSSTGFDYNDTVGQRSNPNWRGDVRAQWYRGPVTAFVDVEYTGSGLVSKFAVPYQYIDETGNPYYNFDSYTTVDIGGSYDWNNVTFRASIQNVTDEGYTNAEKAHGYYNIGRIFNVGVTARF

SEQ ID NO: 7471 - protein, 248 aa, Coxiella burnetii
MLKKIVIGVTATAAFGIGAGALAGGSVDQSYNNTSGAGFYVRGEAGYGLVDKKSGTSKVNFTGVTLTENSHTNTKKSRGFNGRVAIGYAFNPYFSLESGFTYYHPAYRDVNIAGSALPLFSSVQAEGRQKINLYSIDLMGKATLPIDNFYAFIEGGVAYVHTKFAAFTETGTAVSPLLPPVTSSVAVKVPSSSKGYIRPKAGIGVGYNITQNIGVDISYSRVFGQGKINNTNYLPNLNAVTLGLTYKF

SEQ ID NO: 7472 - protein, 519 aa, Coxiella burnetii
MSVKKLLLMVGAVLLLASGAVAQDSFNNNLLEILQSKGILSSQEVSALQKKDAADPEAGAAVQEALVLLLKEKGVLTKEDAAFIFGGEAAQDDSPKLSQEASPDLGGKGSGRELVGVLDDGFCLKTRDGSSQFHLKGLLQADYKTYDYDLEPAGIGTDPGTDGFDIRRARLIAKGKLSPLFDFAMSYEFQGVSSRRLLDAYVNARIHDVFSLRAGQFKEPFGLEALSSDSDLFFTERSMGFGLNPGRDVGVMAFGGFWDNALYYRLGMFNGDGMDDATGGNVDEPEVCARIGATPFAHAGIPLLKGFHLGASGSYQRADANTVSLDISTAGRTDFFSVATNAKFSIIRNCDTLIRHGADAAWTYGPVALFGEYIQVRYDDIESKAQTFDAEMTGYYGAGAWIITGEPVLVSQGAIQPVIPANPLGDGGYGAFGLAFRYDNFDAGDKVYDTLVFVGDSVREAEAITFGFNWYLNQYARFSVEATHTTFDQPLLIYRDSSTGTSLYSDKEDMIISRFQLGF

SEQ ID NO: 7473 - protein, 973 aa, Coxiella burnetii
MLFCTCRYPHLWVPAFLFTLCKEKLMKRHLNTSYRLVWNHITGTLVVASELARSRGKRAGVAVALSLAAVTSVPALAADTVVQAGETVNDGTLTNHDNQIVLGTANGMTISTGLEYGPDNEANTGGQWIQNGGIANNTTVTGGGLQRVNAGGSVSDTVISAGGGQSLQGQAVNTTLNGGEQWVHEGGIATGTVINEKGWQAVKSGAMATDTVVNTGAEGGPDAENGDTGQFVRGNAVRTTINENGRQIVAAEGTANTTVVYAGGDQTVHGYALDTTLNGGNQYVHNGGTASGTVVNSDGWQIVKEGGLADFTIVNQKGKLQVNAGGTATNVTLKQGGALVTSTAATVTGSNRLGNFTVENGNADGVVLESGGRLDVLEGHSAWKTLVDDGGTLAVSAGGKATDVTMTSGGALIADSGATVEGTNASGKFSIDGISGQASGLLLENGGSFTVNAGGQAGNTTVGHRGTLTLAAGGSLSGRTQLSKGASMVLNGDVVSTGDIVNAGEIHFDNQTTPDAALSRAVAKGDSPVTFHKLTTSNLTGQGGTINMRVRLDGSNTSDQLVINGGQATGKTWLAFTNVGNSNLGVATTGQGIRVVDAQNGATTEEGAFALSRPLQAGAFNYTLNRDSDEDWYLRSENAYRAEVPLYASMLTQAMDYDRILAGSRSHQTGVNGENNSFRLSIQGGHLGHVNNGGIARGATPESSGSYGLVRLEGDLLRTEVAGMSLTTGVYGAAGHSSVDVKDDDGSRAGTVRDDAGSLGGYLNLVHTSSGLWADIVAQGTRHSMKASSDNNDFRARGWGWLGSLETGLPFSITDNLMLEPQLQYTWQGLSLDDGQDNAGYVKFGHGSAQHVRAGFRLGSHNDMNFGKGTSSRDTLRDSAKHSVRELPVNWWVQPSVIRTFSSRGDMSMGTAAAGSNMTFSPSQNGTTLDLQAGLEARVRENITLGVQAGYAHSVSGSSAEGYNGQATLNVTF

SEQ ID NO: 7474 - protein, 811 aa, Shewanella baltica
MKPFRCNLSAIARMACCCCTLAAIANSQTAPQTTALAQTTRAPQAQQVDSKDETNASPRERGRILIKRNPIASEYQIFGDIGSSPGADADAEGVDYRAFFPRANPADNPIDSTKVGYMLNFNDSSSRFKSGYTLGFNRALDSEKRWSASMQLKSSASDRKIEHYESVWQEDGDSGEYLLDRPRLSFDEIHTRNTIATAQLGYKPNERHSWYAKTYYQDYSDYSYRNRLELQFGNADRIRANETMAADGSVTRSSFKNARSRRYFGDTQNERERRHHTIGGAYTGAEWTIDYSLYSHKWDLNTVWNNWNFTESGLGLGYTIEDPHFPTISENDDTDLQNISAANFSSLRVHNTDTKDRDLAARLDAERKIQIGNQELWIQTGVLHREKERDTQQKISVFLPSSETNFTLQEVAYSGSGTSILDGSYTVPLGLDPQKSRSFVSSEQHYFSPNDYRSKVETAPQSYSARESVTSAYLQGIRTQGDLTIEFGGRIERTKTETRGTVVIPEPINDPNEGTELETILNPSSQTLQIIKNLYSRNDYNSFTPSAELTFQTTPYTNIKAAWYQLLMRPQYFNIVDYRRVSIPTRSISEGNPNLEPTEIDKFRLAWTRESVATGTLSIETYLIKVENFFYGSVSQESIQESGVPTPYRVSRVENGKEANIKGFEVQWRKTVSDFAFFDQVSTTLAYTFSDSEASVDSRPNESLPTPERSDHLFKVNWTGAIGDYSSSIDMTYQSEALDDLGNSRAEDKYREPVLNVSIQNSYSINQNTSVSLNLFNVTDHPERSYEGSPLRVTRNQYSSWFTSLIFTRSF

SEQ ID NO: 7475 - protein, 314 aa, Shewanella baltica
MMNVFCKTLLASALASATLASAYAAEPLTVYGKLNVTAQSNDEKGDATTTIQSNASRFGVKGNFELSSSLEAFYTVEYEVDTGAATSDNFKARNQFVGLKGAFGSFSVGRNDTLLKISQGNVDQFNDLSGDLKSLFKGDNRLGQTATYLSPSISGFVFGATYAAEGDADQQGQDGFSLAAMYGDAKLKKSPIYAAIAYDSDVKGYEILRASVQGKIADLTLGGMYQQQEETYKNALPVTTDSVNGYLFSAAYDIDAVTLKAQYQDMEDKGDSWSVGADYALAKPTKVFAFYTNRSLEASTDDDKYIGVGLEHKF

SEQ ID NO: 7476 - protein, 741 aa, Shewanella baltica
MELKITIMKTFPLSSIALVCRQAIVNPKLLLCSAMLASVPHAVADTVDADGKTKKHQKEIEIINVIGAKDLHDNRYKTQAMNTATGLDLSYLETPQSVTSITRQMMNDQQLNSVIDAMTSVAGINARPMDNDRYSISARGIAVTSILYDGVPTTYDTRFNYGDNLIDTAIYERVEVVRGATGLMTGAGNPSAAINLIRKRPTQEFMGSTSVSVGSWNNVRGMVDISSGLNDSGSVRGRVVAAYQDKDSFQDRYEQQRTTLYGIVETDIGDSTLFTLGVDYQDATPSGTMSGGLPLFYSDGSRTNYDRATSTAPDWGSAHTQGLNTFASLEHRFDNGWNLKGTYTYGDNSLEFDVLWATGYPDPMTNIGATAGSIAYVDGSRTQHNVDLRAEGQFQLFGQEHQLMFGWNGQRQEFANPYYYPTAAVPPLGDFRDPNFQYPKPQWKEAYTTGSFGETKQSAAYVATQLNLSDALAVLVGLRLNEWETDQDNFGSLYDFNISNELTTYFGLTYALTEQYSLYASYTDIFAPQTKQRIDKSYLDPVKGKNYEGGIKASLFDEALDMSLSVFEIRQDNVGVSTGDVIPGTTTQVYEGVNGTKTQGFEFESTGKITDDWNVYLGYTQFTSEDPKGKRISTISPRQQLKLFTTYTFGGDWHKLQIGAGVNWQSRVYQTVNSPLGKVEVEQGSYALASLMASYAFTEQLKLSANLHNALDKTYYSQVGQYSQFQYGTPRSASLTLDYRF

SEQ ID NO: 7477 - protein, 434 aa, Shewanella baltica
MKTFNKTLIAVSVALASTQTLAAGFQLNSQSATGIGRAFSGDAVIADNASVLSRNPAAMALFDEKALSFGVTYADISVTVKDVEKAGTPISFGSEHDAADSKVIPNFYYIQPLNDQWAFGLAAFSNFGTGTDTSALANNAVTIPGMGTVPAPVDLLGNTEVVTMDFNASLSYRFNDHFSVGAGLDLIYGQGKLSREGNLPLGPGGAMVNANLVDVDADGFAIGGIIGAVYEFNKDNRIGASYRLSPDFKATGDINTLNTQLGKVVSFDEINIPLPDIFQVAGFHQLTERFAIHYTAQLSTWGDFDQITVTDGTVGGTPVVSSAPLKQYVWDDSWLFSVGGTYTINDKWTARAGYMHDQGVVNDISSISIPDSNRNWFTAGLSYNLSTHSTVDMGLAFVRGEDTEVLESSAVIGDVIAHTRSDAVYYSVQYSYQF

SEQ ID NO: 7478 - protein, 666 aa, Shewanella baltica
MLLSRKKYLAQVITALCLLPAVPVTNALADTAPDKEKMMERIVVTASGFEQQIRDAPASISVITREDLDNRFYRDLTDAMLEVPGVVITGGADRQDISLRGMGSQYTLILVDGKRQSSRETRTNSDGPGVEGAWTPPLAAIDRIEIVRGPMSSLYGSDAIGGVINIITRKVPNEWQGEVRLDTTLQEKSTSGNVYQSNFFVNGGLIKDLLGMQLYGQYTQREEDNIYGGYRGRDATNLTARFALTPNENHDIMLEVGVSNQELDSSLGKTVTPLAPGEACGRRGCPQSSTTEYENSTISLSHTGRWDFGTSDSYIKHEVFDNKTRKMKITNTDVQSSLITTLGQSHTATFGAAFNHQDLTDETGNQVSNLTDISRRQWSVFSEDEWRIVDNFALTMGLRLDDDENFGHHVSPRVYGVWGLTDSTTLKGGVSTGFRAPSLRQTVPDWGQVSRGGNMYGNPDLQPETSVNYELGVYSDLTESITASAGVFYNEFKDKITRVACPATQCTDGPNQFGSDPTTYVNIDDAVTQGIELSIDYRIRSNLSFTGNYTYTDSEQKTGAYKGSPLNQLPKHLIQASFNYEPIDNLSTWLRVNYRGEESQPTTGPSSSSFIAPSYTLLDLGANYQLNDSLKFSAGIYNAFDKDITQEEYGYLEDGRRYWLGMTYSF

SEQ ID NO: 7479 - protein, 1012 aa, Shewanella baltica
MGCGGRHAFLRSVGGAVLAVAILPSSVSAAGRAPVFDVPAQPLAAALRALARQGRVQILFPAERLEGRRSRAVVGRFETARAFDLALADAGFAARRVDSRTFVIVARPRLSPPPPIEAPTADLEPIQVWGRRPEPGEIARRLATDLDAPTSVRSLSREDMERGGAQNLSEALGDLPGMTVINTGRSFIGGIDSASRGEGLYAAYRGLNAEYNLSMINGVSVAQGLPYSRGVQLNLLPPDAFQTVVVHKTGRADLDGDFIGAALDFQTPGPTDLSRSPWTAVTVGGRVETRARDYGESGLGETIRVEHGRRFGAAGQFGLYLAAAHEDRSFVNSELAGVMAAQNDRGWAYGVSGSAAGGAPDAENPQEGLVQTSLNVGVSSGRSRLQNYALALDWRAAPGLDLRLNATHAQARTEQNSTFSQVVSGAQSWIDDGSGVYRLSVRDLSTRVWYETNPDNVSLSTLSLKADAVSGRWRLTPYLFASRGESARPDHLEASAWINQNDGYNVGQTPRAFGGVTVQYRDGLPVPQWPQSVFDDLNQAGSVLVARRAGQRTEQFSEQMRYGGGFDLSFTPMQGPWRNLRIGAKLGRSDRDLTDRNWTNAFFGDIYQTAGLTWEALGIAKGTYAEVFPGLYDWSIPRIDHDRLEALFEANRTTESFDTCGALYVNNLNCNSQSGREIVQAVYVMATHATGAWETQFGLRQERARIVNRFWVLPDASEGETPGDWAANRSRYDMLLPSLNLSYRPNDRGVWRAAAWRSYSRPAFMQLGGGVRTETLDGVTTVTRGNPDLKSADAWNLDLSHQTWLPGGGALSLSAYAKQIDHYLYESGSSLDVGVVPDEAAVRVVMPRNGGRGDTRGLEMEWFQPLGDPFDLGGQASLDLNLSRQWSRVDLGQILGRSQPMLNAPEWLGNAELAYAQGRAAAYLSLNYTGAYLSAYDVLKAEGDWDNLWVRSVARLDARARWRFDERTRLDVIVTNLTGAYSYWAHVGRDGAALSDVVDSGRRVVVSLRSVF

SEQ ID NO: 7480 - protein, 878 aa, Shewanella baltica
MSEGQLFKSSLLALCIANALFGMSSTAVAAEQQEATAENMEVIQVRGIRRSIEASLNTKRFADSTVDAITSEDIGKFPDKNIGDALQRISGVTVDRQYGEVSGVTIRGTAPEQSRILLNGQTVASTSWYDLGPATRTFNMELLSAEQVNAVEVHKTPTARLEEGALGGTVDLKTRKPLDLDAHTYQVAGELSQSSLYDETDPSGSFLGSWKNDDEKFGILGAYSVEKITSGRQVLESLSGYYEYFAADPAQNQESTVGAWGIGSQAFRAERERTSAQVTLQFAPTDNTEFTLDYFNFELDIPHVNHNFLTVGARGSGSTNVVNNAQGGTASATILPAYASIIYNPVVRHAVNMKSDVLNLTGKYVGDSFTVSGVIGQSTSDGGTQGGSSSWWIPATDQGGKIGDPAFPNGQGSVDGGFSYDATGPYQVVLTSLDANDASQFKHAQEANYETTVQDHKVTYAQTDFEYQLDHDFINKIAVGIKYNTSDFERNAFNRNPAEILGFVPNGNLANWSDGVLSGLHSQSGGNVLDSYAKLDEDKWWAFISEKYANGELVEVADLGNTFTVEEDMLALYAQADFSGEFYRGNFGVRYVNTDQTSTGFADGKPYNESVNYDNWLPSINVAFDLKEDLILRASASSVMARNNYSDLKPGLAIAKNFGTATGGNPNLKPYKANQADLGIEWYFTESSMLSAALFYKDIDNVVFVTESTQYIEGCGASESEWDKCRVIAPANGGSGSVTGLEIQLQHNFESGFGFLTNYTYVDSKSTRPDGTEQMIEGVSENSFNGSLFYEDDLFSARIAYNWRSEYLGVGNIQNVLNDSYQQVDASIIWHAMENLDVSLEGVNLTNEVVQSYDVKYGLTQNTIEFGSRYFVGASYKF

SEQ ID NO: 7481 - protein, 254 aa, Shewanella baltica
MCNKNVVSILVSAILFSGSVYADINKTSVDLGYKFYTSDTKDDNPGVFNQPFVKLNHLGIADWGTYFANLKLENPAEIAENQKHVDGKTTIKSLLILENKLGESQFNFWTQNFISASETLVEDNLYLGLTHNAKVQNLSLNYGVGFNYTIGNFSPTSEKFNDLSGYAVVLNAKYPLELLGLKHSLSLNYEAQIDRDKAHQALFSYNSYGHQIITTLQTNITDSIFSKLYLTHYDSWGSQYNDGFEYGISIGYQF

SEQ ID NO: 7482 - protein, 799 aa, Shewanella baltica
MHSVEFGRSRPKKYRANYLSLMGLSFTVILSITAPQPSQAQTVDVDAKQINKLQHYQIKAGTLDAVLNSFALAANIDLSISSALTRGKTSLGLEGQYSIEAGLQKILAGTGLQVTSRLEGQYILGKATAAIVLAPITVISAAGYEQDIKNAPASISVLSGNDLEQRKFNSLQDIAREIPGVNVIGSGAQSGISIRGMEKVYTLVLVDGKRVRSDTGNPRGLNNEDLDSNFIPPVASIDRVEVVRGPMSSLYGSDAMGGIINIITKKTPEKWSASAGYGLRVPDSSAMGNQNQQDLYITGPLVKDLLGISLWGNQAVQDEDKYYGGYQESTKKTLGSKLRITPHRDHEVILDYSKASQRYIGNPGGVLLPNARGSIDREWTRDAWSIAYNALFDLGELELKYYEEDYERLTYPAAADFTTGSTNKVGDARFITGVDSHTLTFGGQWTNDKLTNGDLGNGTPRSFGTRSVSDISIFAEDEWELLTEKLYLTLGARLTDNEFFGHHVSPRAYLVFNHNDHWTFKGGIATGYKSPKIDQIDNTTGSQRGGGTSQFVIVGNPDLEPEQSTNYEIGALYTKDDTLNIGATLFFNDFSNKILNTNTFYFDDGNGGYIPAYCISGDVGTKDCPAWATWLNAKGAQIRGVELEGHWDITDTLALKASYTYTDSRIDADNVIINTPAGPRPFGDTLALLDGNSLVGIPNHNGSITLDYQPTDALSAFLRGNYEGEITRVSFERNTVDKSDKDLITLDAGLNYSLNRFISFNVGIDNITDATRFKVNNDTGAYRYSERGRSYFVSVKTQF

SEQ ID NO: 7483 - protein, 851 aa, Shewanella baltica
MIKSRSRLLAAASALAVAGACGPAFAQEAPAVEEIVVTAQKQQQQAIDVPIALTAFGGERLEALGVQDFADLSLFTPGFEVQDQSPNNPGFVMRGITSDSTDAFAEARVSVFQDGVSISKAQGSYVELFDLERVEVAKGPQSTLFGRGALIGGVNLIQAKASTAGFDGYAKVEAGDYSYRLGEAAVNVPLGEQAALRLAGRVRYRDGYVDNALGGDAFQSVDTRAARASLKLEPADRVSIDIIANYQEDDPTGTAFKSGGFSPTDPTTGRVLDDRRPQSAAALTAPANFQGGRQLGIDRKVWGVTGLASFELTPSLTLNSISAYREYESQETFDPDGLSLPILTGLNDGRGEQWSQELRLNFDGGGRVRGFVGAGLFKADDDQRTPIQFDERIALAVVTGQLNASAAGSGLPATAPAPAAVFGNTAFTGALLRGLVANLSGNRLVLTPAQATAIAANLRANHLEESTNTSDLDSFDLFADVSVDVTDRLEVSAGVRYTRDEKTTGFGSRVVGGRSVLGGAIGAAQLAESGTAQGLAQAQAIVGALQSPGVQQIPDSVLPLFGLTFQPTTGNGLVSEQDLTDDGVTWRLVARYELSGDANVYASYARGRRPEVLAASGPAAPGTAGRFTRVEAETVDSYEVGAKAALLDRRLRLDVSAYRYDYDNFQTVEQRGTLFVTTNAGKAKAYGVEGQADLAIARGLNLLATYAYSHARFESGAYDGNRFRLSPDHSASLAASWRTALGAGELEVRPSYTWQSKVYFDNSNDRPAFQQPPNVFVADNLVDEFQKAYGLLNLRVAWTADRAPVTLEAFVTNLTDEDYIIDAGNTGDNLGLPTFIAGPPRMAGVGISYRY

SEQ ID NO: 7484 - protein, 728 aa, Shewanella baltica
MPPLSVLTSWRSPLIPVLLSTLTLTVQANTDPKQDEKEDTEQIERLNVVGTYTRAAMNSATGLSMSLKETPQSVTLITEEMISDKGLITMESVLNHTPGVTMVGDASENSKIFVRGYALDSGVQIDGLITTSSSNVYSGSIDQGLDPVIAERVEVLKGAAGILSGLGEPSATVNFIRKRPTDDTRATASVSYGSWNTYRLEADVSGWLTDSGNVKGRFVSAVKKGDSFIDRYQRDTTVLYGVVETSLSTDTSLSLFADYQKSQTDGVYNWNSNPAFYTDGTAVDFGRSYSSSQDWTHWDVTQKSLMAEFKHRFDNDWSLVSAYRIANATIDALAFYPGDNIVKSTGEFVGPWGDTYAAQHDRESDTNSFNLYATGNFDLLGREHSAVIGFNYGDNEFDNINTNSAPQRRYNVADQGNYPKPNLPNSPTNGQKNEQSQSGVYGTVRINVLDSLKLMVGGRVSNWSYEKHDLVGNSTDATMEKTGIFIPYYGLVYDVTEQISVYASRTEIFKPGTYFGEDGQLLEPAEGTNVEGGIKVALFDDTLNMSAAVYETNKDNEPEYAGKGQLPSGDFIYESIDGITTKGYELEIAGRLTDLWDISGGYTHNDAEDEDGLRRQTYLPEDIFKLTTKYNFEDILPGVTAGASWRWQSSTFYQGTIWGVDGAPNVAYRQAQSAYSLVDLMFGYQITPSISMQVNINNIFDKNYNRSLWGYADFGEPRNATLSLRWTL

SEQ ID NO: 7485 - protein, 653 aa, Shewanella baltica
MITTARSALLLSTTILAGAATAQEADTQFLGTLRIDTAGAQTLLGNAEITEEEIEDRNPASAADVFVGESSVTASGGAAIAQKVFVNGIEESLLSVTIDGARQNKSAFHHSGNVLLDPQLLKSVEVSEGIAPADAGPNALAGGLAYETKDARDFLAPGETFGGLTTLRAGTNGEGFRRSLTLFGRQGGFEWLLSGTRHTGDAYEDGDGVTVPGTAPDVSALVAKIAFTSDTGKRLSFAASHTEDTGVRSGQAHPVFGFVTIRPDLTGVPGLVTVPVNAYSSRRSYTLTYTDEAPEGWFAPTLQLSYNEQETDAGDVQGTNTSLSGVAKNEWQLGNGTVTAGIDFFHETGEGRSFIPAGPFAGTYSGREELTSVGLFAQARQDLTDRLSVSYGGRFDYQAFTGADGTELSDTGVSVNGMLDYALTDTVSLNAGLATSWGGYELGEAALVNFITPWGYAGFQASQSQTARVGLRYDDGRWSVSGALFRTEINDIADILPTGGRRGATSDLTSQGFDGSIAFTGARGFARLNYTYADVTLTGSEGPLTSTSYYYGRPMGHVFGFEAGYDVTNEVRLGGNAQIALADSSASLAGYEVVNVFASYKPESVAGLELRLDVENVFDSTYVRRSADGVNAPNAIALNEPGRTISLTATMRF

SEQ ID NO: 7486 - protein, 2503 aa, Shewanella baltica
MLQHAYKMIHAFKHIMTRFCHSYLKMFIVGSFFAMTSLYASAQNRSFDFTTGDTVTLTNAGSALSNRTTFTLEFWAKFTNVSGTINLVDFTGGADAGGLILNSSKLTVDLECDFGCLTESNVLSLSTGTWYHIAVVFDNGTWDFYVDGVAQGINVLDQGARSSVPNYTGFGVTNLVFGLQNHGAVDDFVGSIDDIRMWSSARTQVQIQNNRSIELVGNESGLLGYWKLNEASGTTVNDSQTNSSMLTGTSSGIGYNATGAFVTDFVAPTVSSITASTANGTYKVGDVISVEVNFDEAVLVTGTPQLTLETGTTDRAINYASGSNSSTLTFNYTVQSGDTSADLDYVATNSLMLNSGTIRDAASNNATLTLPSPGTANSLGANRNIIIDGVAPTVSSVNASTADGTYKLGDIISIQVNFSEVVSVTGTPQLTLDTGTTDRTIDYASGSGSSALTFNYTIQSGDTSSDLDYAATNSLALNSGTIRDAATNNATLTLASPGAANSLGNNKALVVDGIVPSVTSTAPSGGAVSTDTSVDFTVNFSESVNNISIDDFALDTSGGATGTIVSVSASSGSSVNVIVSGITGNGTIKLNLNASTNISDAAGNAGPAAYTSGSTHTVAIPTAPYAPTIGAATAGIGQASVAFSAPANNGGAAITGYTVTSNPDGISAGGNGFTTSPITVTGLTNGTAYIFTVTATNAIGTSPASGVSNSVIPKVNQTITFTNPGAQNFGTSPTLTATSDSSLIVSFSSSTPAVCTITSSGTLTFLSTGSCTIDTDQSGNASTNAASTVSQTFMVNAVVPRAPTIGTATAGNAQASVNFTASASNGGATVTSYTVTSNPSGFTGTGVGSPISVIGLTNGVAYTFTVTATNSTGTGAASAASNSVTPASPQTITFADPGAQNFGTSPTLTATSDSGLTPTFTSSTTGVCTISSGGLLNFVSVGTCTINADQAGDSSYLAATTVSRSFSISAVVPGAPTAASATAGDTQASVTFSAPIFTGGAAITGYTATSNPGGFTGTSASSPLTLTGLTNGVAYTFTVTATNSVGTGAASAATSSTTPKAIQTITFADPGAQSFGTAPTLIASASSGLTVTFTSSTTGVCTITAGGALTFGSTGTCTIDANQAGDGSYLAAAQVSRSFTVNAVVPGVPTIGAASAADSQASVSFTAPIFNGGSSITGYTVTSSPGGFHASGAASPITVTGLANGSAYTFSVVATNAIGSSSASVASNSVTPNGAPFISGTPTLSVNQDASYQFTPTASDSVGDVLSFSIANKPAWATFNTTTGTLSGTPSNQDVGVTNGIIISVSDGALSASLPAFNLSVVNVNDAPTISSTAITAATQDAAYSYTFAASDTDVGDVLTFSAVTKPSWLSFNAATGLLSGTPGNADVGAHPVLLRVTDKDGLTADQSFSITVTNVNDAPVATSSTVTLEEDGSVTITLAAEDVDNDPLTYEVVNQPESGTLEQHGTVWLYTPEKDFNGTDVFSFIAKDAELSSEPATVTINVTPVNDDPQAVDDDYTLTSTANDIYALAVLANDVDVDGDTLTIDGAAADIGSVQITSEGLSFTAPEAYVGPVALRYTISDGNKGRASAKVNVLIEGAESANQPVITLPDDVDVNATGLFTRVKLGFAKAVDRNGHPLPVSLVNKSLFFAPGSYLAYWQAVDRDGNKAIKAQKVKVHPLISLNKDQLVGEGNEVVVSVHLNGVAPVYPLSVPYTVSGSAGSSDHDLVDGVIEVTSGQQAEIRFRTFEDGDVEGDEDVLISLDPSLNLGSKQQTQVLITEANIAPKVTLDVTQAGAHQFIVAQNGGDVRINADISDANMQDSLTSTWASGSLNLQSDDASMFFSPVSVLPGIYPVSVTVTDNGLPALSTTEKVYIVVRSSLPVLTGADTDGDLIPDVQEGFTDTDGDGIPDYLDAVNDCNIMPEGELQPVYFLAEGQAGVCLRLGNIALRQGQTGMQLLPTLVPEDSIAANVGGIFDFVATGLPQQGQSYSLVMPQRSPIPANAVYRKYQAQNGWKDFVIDARNSVASSEGERGFCPPPGDSRWTAGLTEGHWCVQLTLEDGGPNDDDGVANRTIVDPSGVSVILNGNHLPVANPDTASLPWNQSLDVDVLANDTDSDGDALTVTQVTSEFGTAVILANQQLSYTPATDFIGTDVLVYSITDGKGGTASSELTVIVSGNTAPTTVNDSAATDDRTSLLLDVLSNDSDPDGNVLTLVSATAQQGAVSVESNKLRYIPKAGFDGVDTVTYLISDGLGGEATGQVFITVKAYQEVVIDNKSGGGSMSLWALGLIITAGLIRRRELHKTLLGAVVLAGTVSQANAADNWYVEGFVGQAQVDSSRRDLQPQAAAGVVTSVDDKDTAFGLSVGYQWTPMVAIEFGYADFGNGSARIEGASLTPAQYHEQVKAVTPVLADGVMLGLRFTLLQHDAWRFEVPIGLFRWQADISSTMGNSRLTTELDGTDWYAGVRFSYQVSDAWSVGLGYQYVDIEPNDFLSYQLNLRYQF

SEQ ID NO: 7487 - protein, 402 aa, Shewanella baltica
MNKTLVATALAALFLAPTVSAIEIYKDDKNAVEIGGFIDARVINTQGETEVVNGASRINFGFSRELTHGWNAFAKLEWGVNPVGSSDIVYNNRFESVQDEFFYNRLGYAGISHDEYGTITIGKQWGAWYDVVYNTNYGFVWDGNAAGVYTFNKDDGAVNGVGRGDKVVQYRNSIGDVSFAVQAQLKNSSFYTCDIENITEEACEVEWNAGKKEAQQVTYDYTYGGSVTYKAADKLSLMVGINRGEFDIAYGNGDQKTAVDLIYGVGATWGDFDKDGLYVAANVHKEENHDTDNIGRLIKDAYGVETLVSYKFDNGLRPFVSYNILDAGKDYVIQPNFNADPNDVFKRQFVVVGLHFVWDPNTVLYVEARKDYSDFTSSDQAQEARMSLSEDDGIAIGIRYTL

SEQ ID NO: 7488 - protein, 697 aa, Shewanella baltica
MVFKYSVIGLAVGSALMTMPVMAEVSSDTNIERINVVGRTFNDYKVGTASGAMRGDIDLMDTPQSVNVIPDFVTDEQLATNLAEVLVNDSSVTAGTTRWNRQVFSIRGFELDSGNGYLINGHQQWSHYIQPIETLQQVEVLKGPSSMLYGQSGPGGLVNMVTKKPTYDSMLNVGVDTDGYGSTRAQIDAGGSLNDAQSIRYRGVLVKQDTTYWREYSTTEENQDRDRWLGYLNMEFDLTDDVLLSVKYDHTQDKASIDAGGWLDSQGNVIGNNKTIWDAPWAFTDNTVSNLGADLTWHISDDWKIKAGYNDQQFNRQRFDSAPQYTTAPFSNGYSIKPFDRYDDWQHKTAYIDFTGEFDFAGVQHQLLIGANYLDYLYQQQIQRGTSQTVIPGQPVIKPDLDYHLSSKGDPSEYKYYGFYLQDLMTVNQHWKLLAGVRYDEQKKDGLGQNSYAVSPKFGAIYSPMEHGSIYVNYSKSFTPQGAVNNQFDVNDELDLKPEYGIQYEVGTKWELFDDSLLLTAAVFDITVENITISEVLPTPIDSYTDITTQGGEQKHRGFEVGAQGQLSDDWFMTSSMMYLDAEYHTGDEREGKTPVDAPEWSANIWTRYEMTEYFAINFGAIYVGERFANTDNSISKDGYIRFDIGAAYTMDVMGKDVSVRANVRNLFDTDYIEGGQYNMVTIGQDRNFSVAAEVKF

SEQ ID NO: 7489 - protein, 322 aa, Shewanella baltica
MMNKKVLALAVAAITSAGAVNAAELYKDEAQSIEMGGRAEARLAMKDGDAADNTRIRLNFKGTTQISDGLYGVGFWEGEFTTNDAVNPNGNLENRYTYAGIGGNFGEVTYGKNDGALGVITDFTDIMAYHGNSAAYKLAVADREDNAIAYKGQFGDFAFKANYRFDDAAANQESNDGFSTSGIYAFGDSGFKLGAGYADQGTDNEAMVAGSMTMGDFYFAGTFTTGEVVDLDYTGFEVAGAYTMGKTVFTATYNNADHDTNALTVANNENADNFAVDATYFFNANFRTYISYNLNLLDDDASKGITKAMTEDEVALGMRYDF

SEQ ID NO: 7490 - protein, 723 aa, Shewanella baltica
MTFKSSLVALAILTALTQSAAAQDASDNSNKDQEIEKITVTASRMDKSPSAIPNTVTIIDRLQLEEQFRTTKDLSTIIGNLAPSFSPSRQKMSNTGETLRGRPPLIMIDGVPQSNPLRSGGREGQTIDPAMIERIEIIHGANAMHGLGAQGGIINYITKKPSGHNEHVVSFDVTVPDSMKSNGMSFGTSYAFSGESELVDMLGSVSYRNNGVYYDANHDLVGVDTTQGESMDSQSADFFIKLGHNFAESRIELMVNHYNMDNNGDWMPIAGDKPNGVPTGAIKQNQPWEAANNQVTTTSLTYTHENIAGQQLNLQLFNQDFKAVYGGGCFESFYDPAFEGSDQVIQCGVGSKGESLYYDQSRNSSVKWGLKSALIAKDIAGSGIDAAYGIDLFRDTTEQDLVKTGFSWVPESTYDNIAPYLQLDYDLIKNLTLSTGIRYEHAELSVDDYKTLWGAGNKQIAGGEASFNKTLLNIGISYKITPDIRIYTSYNEGFGMPDIGRILRDGKSFPGANPSISDSLALTPIVTDNVEVGADYQGKYLRAKISYYRSATDFGSRLALNSDGFYDVKREKSVIDGIEANVTAYLTSNDDLGMNIAIQQGEYDSNGDNKVDTDLDGANIAPNRINLYWTHNFDNEMSTRVQANYFMDRDFKNAAGTQYAEFDGYTTVDASFSMPLYTGTLSLGLQNLLNKDYFNYYSQTMGTNDRYFKGMGRTATIGYTLPF

SEQ ID NO: 7491 - protein, 449 aa, Shewanella baltica
MQKRLLTLAVTAALLSSTTQLHAAGFQLAEYSATGLGRAFAGEAAMADNASAQARNPAMLTYLEGRQLSTGGIYVMPNVDVTGDVSISSPLLGPDPVVMKGGDALDVADDALVPNFYYSNQLNDQWTWGLAVNSNYGLATELPATHAAAIFGNKTSVTTVEFNPNIAYRINDAVSVGAGVRIVYGEGEIGASLPGWVDGIKPALPAPVQAMLPPGGTELKSMKGDDVGYGWQLGASWQINPAHRLGFAYHSGVQLDLDGHASGVLYTGGQDVSIEGYLPLELPAFAEIASHHQLTDNWAMHASVNWTDWSVFDQLVAYFPGDVKPKGDLESDLVKEEHFEDNWRFALGTTYQVNNDWLVRAGVALDKTAANDEWRTTTIPDSDRLWFSVGAGYQATKNLNVDFAVTYIKATGDAPINEQQNLLGLAAVNFNGEASGDVWLAGIQMSYKM

SEQ ID NO: 7492 - protein, 710 aa, Shewanella baltica
MLNSKNRFRLTSVAMAITMSFTATVVAAEAKKIESTPEVIVVSGSVLGNSEVADLKTYTGNRSIITSDQIERTGVHSIDSALQQVPGLKIKDETGTGILPNISVRGLDSSRSGYAQVLLDGIPMTLAPYGHTGQSLFPATLFMIDRIDVARGGASVQYGPNNVGGVINLISKPIPDDWETHLHERMTFFGEGQTLFDTNISTGGAVNDDFALRLDGNITKGESFREHSDTDIKNLLLKTVWNIDERNSLDTSLQYYDAFSELPGALHTAAYEADSQQSLRPNDEFKADTKRLSMKYSHVLAGSDTIDYGEFDLTAFGNKSSRNFQWDFYDKNKDTDGNLGSSWSDTTQEATHLRNSPRDFTVVGIEPKMSLFIDGDVSQHIIAGARYVNEDITYQLNHIEKSTQAAVRPRDWQMDTDAMAYFISNKIGFLDDSLSVTPGLRYEDVRMTFTNLGQDYSQDNHVTELLPGITLGYEFTDAWFAYANAQRSLRTPQISQLWPKGQTLESELSWNYEAGIRFTPTERSNINLAAYRIDFKNKAEYDRNISMFVNIGQTKNQGIELEGTYSPLSLPELTLSGAYNYLDTEQLDGEYAGNELPSVSKHQLSASALYSIDDIDLGLMAYYYSQSFADLANTVTESVSGTEGEVPAYTVINFNISTEFFKQDNKGLKVGLSVNNLFDNDYYFRGLDVSPAGRVAAPGRSLSLDIGYRF

SEQ ID NO: 7493 - protein, 836 aa, Shewanella baltica
MRLGHSRTRHAGFRISTLALAIAASAVALAEEPVVLEHVEVVGQAASIDKALQDQRRSDSVTSVVHADGIGQLPDDNAAEALQRIPGLSVERDQGEGRFVSVRGIGPDLNAVTINGTLVPAPESKRRAVALDVLPAELVQSLSVVKTLTPDMDANSLGGTVQVESLSAFDHDGLFYSLSSEASYNDKSDQTSPKFSGAISERFSLGDGIDNFGVAAALSWQQRDFASDNLETGSAWDFSDGARLEELEQRAYDIRRERTGLGLNFDYKPDDESSYYLRTLYSRYKDTETRNAAGVEFADAQLPGESGEAEGWRELKSREETQQIQSYVFGGERNLGLWTVSGQLGYSKASEKTPEGIAGATFEGNDDFADVGFGGTRKPKLNVGSAFYDPANFTLDEVEWEKQKTTDTEKNIKLDLARDYEMSGYAAQAKFGGKLSRRKKDNDLEAWVYEDLGDFGLTDEQLNLGQFVKGEVDYGLGRFGPGISAKAIERLLAGLNKADFYDEEESRINDFKMREDINAAYLMNSVDIDDWRFIAGVRYEGTEFEAKGTGLRDDVYESIDSRKRYDHWLPGLHARYQLDEHTQIRAAWTNSVVRPTFGQLAPGFVIDGDEASFGNPDLKPLESSNFDLGIERYLGRAGVVSAFAFYKDIDNFVYATDLAGSGAWGDFSEANTFANGSSAKLYGIELAYSQKFDWLPAPWNGLLLGANATFSRSDARIEGQGSKRSIDLPNQSDRVGNLTLGWENDKLSLRLAANYKSRYLAEVAAVDDKAHDLYADSQLFVDFSAGYFLSDNLQLKFEAQNLTDESYYVYTGSRRYNAQYEEYGPTYSLGLTFTHF

SEQ ID NO: 7494 - protein, 250 aa, Shewanella baltica
MKKTCLCLALMLSPQAFAGDLVQWWDFSATALYGEDYDLAPSDKQATITLETAGGWKYGDWFAFQDFIYFKGNDTGMESTTYGEISPRFSASKILGEKIAFGPVTDLSLALTYEEGEGPVHSLLYGLGVDVAVPYFTYLNFNTYRRNGMSTGNNSDGWQFTPIFRIDIPVGSANIVLDGFIDWVFATDDNGYEQNFHFNPQLKYDLGKSLFGDHQANKLLVGIEYDLWTNKYGVKGVDQDTYSVIAQYHF

SEQ ID NO: 7495 - protein, 285 aa, Shewanella baltica
MKNVKTLALAATAVAAISGNAFAADRTDLHGSDYKWMQFNAMYSIGEKPENPASGDQHNYLEMEFGGRSGIFDLYGYVDIFNLANEKTSNGDKNPGSKTSKLFMKFAPRVSIDALTGKDLSFGPVQEVYFSTLFNWDGLNGEGVNSTFWGVGADVNVPWLGKTGMNLYGYYDMNAKEWNGYQFSANWFKPFYFFDDKSFLSFQGYIDYQFGADEAYWPAVENGPLVKGKSTNGGNIFFGLYWHSERYALGYGLKGFKDVYLLTDDGATGLESTGWSHYLSATYKF

SEQ ID NO: 7496 - protein, 713 aa, Shewanella baltica
MEDNKMAANSAYLSHPFKTSVISSSLAIAMGLSLAPQAMADDSELANIERLEVHGQQTENRNTLGSAENLLKGQGVDFSEAGGVSALPILNGMMGDRIKVLVDGADITASCANQMNPPLSYISANQITTAEVIAGVSPVSAGGDNIAGVIKVSSLNPKFGESDSIKWNSGDISTGYRSVSDTLLLGTNATVASKNISLSYQGAYEDANSYKDGNGDKVIDTLYRAQNHALTAAWHDDTQQVAIKLTHQNIPFQGFANQYMDMTDNKSYGALARYQLKLDDDGEFSAQFNWHGVKHEMGFFTPEKTGKMPMNTEGDDYSYQLHWRLPMGDDSTLLVGQEFYSYQLDDVWPAVPGTMMAPNDYININDGERRRAAVYGEWQQDLSPSWWLSAGVRFEYVTTNTGEVQAYSDMPMMGMPNMDAAAAQAFNEMDRERNDDLIDATLLARYQLSANQQLEFGLARKNRAPNLYERYSWGRGTMATTMIGWYGDGNGYVGNPDLKPETAHTLSAAYKYNGDSWQVSTTAWYTAVTDYIDAEVIGSFNRTSSADGKRNILQFTNLDANLYGARFNALYQFAETSTGKWQVLGKVNVTRSERDEGNEPLYQIKPLQTELALQHQLGNWENSLSWQWVATKDRVDDRRLENETDSYSLLNLNSSMKWQDLTVTFAVNNLFDSYYELPLGGVSVAEFKADNTNGFKQIAGAGRSFELSASYAF

SEQ ID NO: 7497 - protein, 413 aa, Shewanella baltica
MMNSRFSKLSMAVIVAVSSISPVVYSANFDGPDSVENIIAEQKAQKKSWRESLAEDGFTFGADYFALGLTSGDGVGSDSVNASSGVARLYGSWHLLGKDTQNSGSLVWKVEHRHAYGDTAPKDYSFGPLGYVGAIGPAYSDQGFRVTDLNWKQKINDGKGTIVVGWQDVTNYADVYALASPWSGFTNLAFSTGSGAMGLPDDGVLALSAGHMLGENFYVVGGIADANGKSDDIFDGFDTAFGSDASYFTTLELGWTALQEQIYTDNFHVTFWDFGDDTRHSNSLSAEGGSGVNFSWSQFTSGQVMPFVRGGFSEGDVALYDKSISVGMGYFGLGKPTNNLGVALNWAEVNGDSFAADAKAISGSTEQWTAEIYYNMQFGDHFQVTPDIQYIKDPAFSSESSAWVFGVRARIFI

SEQ ID NO: 7498 - protein, 192 aa, Shewanella baltica
MKNTILTLAAIISLASVSVYSHAENMKNNDVAENGIYVGANYGYLKVDGKDDFDDNSDVIQGLVGYRFNQYLAIEGGYVNFGDYGNSLSNAETDGYTAALKVSYPIVDRVELYAKGGQLWYSTDYDVLGFSGNKDDEGVFAGAGVAFKVTDRFLINAEYTWYDAGITVENVSNGADTDTDFKQASLGVEYRF

SEQ ID NO: 7499 - protein, 778 aa, Shewanella baltica
MTSFSLLCALLPGLALAEPREFDIAPQPLASALNRLAAQGGLQVIFDGNLVQGKSSRGVTGRHEPEAALSELLQGSGLTWRATGSTSVTLEPAAQSSGALELGATSIVGQAYSSVSPDDGYVAKRSSVGSKTDTPLIETPASVSVITREQIEAQQPKTVAQALRYTPGVNTELAGPQFVVDQLSIRGFQQGTGRMLRDGTRTFLPEFLGWDAPEPYGLERIEVLRGASSVLYGASDPGGQINLVSKRPTQQPLHEVQLQAGNLNYQQGAFDLGDALDDEGIWSYRLTGLFRETDAQTDHITNRRQYIAPALSYRPSANTEFTLLGEYQRQTGNFANSLPASGTVFRDARGRLDRDTYVGDSAYDFMTNEKTSLGYVFEHHFDETWTLRQNVRYSNYRQASSEIALFGPVGGGQYSRYSDQRKGDGRLFTVDTHVQADFATGPVEHTLLSGVDYNNGKFDQQQSLDFILQSFDPFQPVYGQPLSTVPFSFASYEQKLSQTGVYLQDQLRIDNWVLLLGGRYDWAVNQKDDRAPQTQKDEKFSGRAGLVYLFDNGLAPYVSYSESFLPVMGITADGTQLDPETGKQYELGLKYEPPGSNSLYTIAVFELTKQNVTETINGFSRQEGEVRSRGVELEARTELAPGFNLIGSYTWNDVEVTQSERGTQGNTPFRTPEHMASLWADYQLQGGSLNGLRLGAGTRYVGSTFGDAQNSFKVDSYVLVDAMVSYELGKLDALLKGVELALNASNLFDKEYVAGCFSDMGCQYGQQRTVYGTVTYNW

SEQ ID NO: 7500 - protein, 676 aa, Shewanella baltica
MPRFFRLSSCSLAIALVLSSAAIADPTSKSHSDTLKVVGSRTTIDSFKHPGVVTVIDASMPQKQTATTAGEMLQHIPGVTVTGASRTNGQNINIRGYDQYGVLILIDGIRQGIKGVHFNGTFLDPALIKKVSVIRSPATSLMGGEALGGVIAYQTVDAADLLAKDQNFGFRVSGFGATGYHSTGLEMSVFGRTEHLDGIFAFSKRKVGNIYHGNGSEAPNDEAINNLMLKTTAYLSDSQSLTTALRYFNNRALEPRMANQSAPNSNMNINPMINRSTIQRDAELTYRLQPQHLDWLDATTQLYYSEINVSDDVRREGYGSRKQATRGIKLENRSQLFTHSPAAHLLTYGVESYQQQQIPKGVIRSFPPAEINFSSGWLQDELTLRDLPVTLLAGTRFDRYKNSRENFADREVKNWSSSGAVTVNPTDWLMLFGAYHQAFRTPTLAELYNDSIHFSIPSKWFPVVNRWKPNPNLKPESNVTREAGFGLHFDDLLTDSDSMKLKASYFHIDAKDRITSEVKMPFISTYINIPRSKSWGWDASLDYQHPWFDWNLAYNRTRGINLDTRKFISSINPDTVTSRLNVPIANSGLSTGWIVTMAENTKFMKDNDAQNSSRKPNKPQAGYAVHDFYLSYRGQGRFKSVTTTAVLGNAFNKAYYSPQAIPQDGRNAKLLISYQW

SEQ ID NO: 7501 - protein, 685 aa, Shewanella baltica
MKHRAFKKNMIAALLSSIGMSTAAAAVEIASADAIEKITVYGEKIERSLKDTTSSVSVIDKETLDSGQYQSISNALSEIPNVVVLTGSVPDIRGVSGNGSASGFNSFTGGARARVSTLIDGVAEPFVADLTGDTGLWDIQQIEIFRGPQSTINGRNSIGGTVFIKTEDPTFDWHGAARLGYRNQDNYIDSAVMLSGPILDDELAFRISGQNVTGETYNKGLEYSTNPATFDQNELITNRWRGKVLWQPSAIDDLKVMYSFSFNDEKGDSGRNYFTGNDPWAYSPIFQRYIETKSATHSVKIDYDLGEGKAFDLVVAYMDYDWGFESYEPVVTAQQYVDMKDQSYTVDGKYSFGLNNRDLNGFIGLSYFERSQDFDSTGSSIYNGDDSSTSTSIYGEITYGLDDSLWVTLGGRVMRDEQTRNFSMRYQGNQLNENLDDGTTVTLPKLVLQYAITDNTTLAASARRGYNAGGGALSLAESEYYYYDEEFVDTFELSSRSEFLDGNVNLSANLFYNNFDGYQASNQARKITNVDKAVTYGIETALTAMLGNNWQLTTGVGLLDSEIKRADPNYGDVIGNQLNAAPHVTANLGIKYWLNDELTFGLSGNYVGEYFADINNTEDRVAGDYVVTRFSVDYQANNWRVSGFVNNLFDEQALTVNEPPSRSYVDGYDAIIDPRNIGVSVMYNF

SEQ ID NO: 7502 - protein, 355 aa, Shewanella baltica
MKQFKLTSAVLVLSFATPIFAVQANDTAATNDELRTELQQIQQRLAMLEAQEKEASVLSDTQFNFYGSLRPTFGLTHTNSDDVWDVGDANSRIGFAAEHQLGNGLVGFAKGEFKVDIKDDGDFGDARKAYVGLKGFFGSVAIGKQAVTQEIISDPVDIFNRSGTPLAYDSASPFRLNNLVTYRKEFGDLLFSADAQFDGNKGSGGSDFVNAGIRYKTDLIYIAAAFYNKELADGKDENTVGVTLAKSFNDLYLAAAYQNIEKDDIDGTTLDGSTLDVVASYPITDSYKIKLGVSRYDDGGNDITSAKYNAYNTTLEWHKTPQFSTFIEYQKTDFEYRETNDQFMLGMRYNFDYTF

SEQ ID NO: 7503 - protein, 867 aa, Shewanella baltica
MRSSVFLCAVFGLALSPVALAVANELEKTTEQSAADAPVERVAVTGSRLKGVDMEGANPLQSFTQDDITKRGYESVSEFLRDLPQASSAGTFSETGGVGGADGAPAGASGVSLRGLGSSSTLVLVNGRRVAVDSFSNGSDSFVNVNSIPLSAIERIDVLTDGASSIYGSDAIAGVINFILRKDFVGHELSAQYGDDTSAHDASRKNLTYAGGFATENSNTTVVVDYATRNAIFNSDRPVNVTFESSTRMTIDGEDYAESWCGDDTQKSGTRCNYDYVIQRAIQPDFDNIGTTFNHIYRLDNGFEFFAEGMYQKNTGSAYEAPAGYTVDVAGDSANIPQYVHDIDMLDGSVSDVITVRTRFPERRVQEYDTQSYRVLAGLRGELADWSWETAASYGKSTNEITNVAGYMNATKLDAAVAADEFNPFNLGRDSSAAQIAAQRDPGIRKGESEVLSLDFNISGDLFALPAGAVSSVFGGELRKEQIFDRPSINAVNNEIIGLGASDAEADRTQYAVYGEFNFPITDTLDVIAALRYDHYSDFGGDVNPKISMRYRPLEDLVLRASWSTGFRAPSLSQLGAGTSLSSQYINCGSAEPYNALCGTAGAEFGELEFDQETIGNKDLSAEKSAAINVGVSWNLTEALQLTVDYWRYEHDDIVDIDANTTLDACIKDSTKIVTSVAELGDEFGCVVDGQGDISFLRTGYFNVGNQNTDGVDYKLDYRLDTETAGEFKFYVAGTETLSFERQVTPSTPVEDLLGRLSGASEIARPESVLDLGTDWQLNDWSASLSGHYISSLGDGDFKFDNETVDSWLTFSASLGYELNEHHSFLVSVRNLTDEEPPYASSPTNGYASSVHDWLGRRWNVRYTFKF

SEQ ID NO: 7504 - protein, 908 aa, Shewanella baltica
MMRFKPSLLTLALIAAGASMHSYAADEAATDKTAKDENIEVIQVTGIRRSLQESQSLKMSSSSIVEAISAEDIGKLPDVSIAESLARLPGVSAQRLDGRANVISIRGMGPDFTTATLNGREQASVNDNRSVEFDQYPSELLNRVVVYKTPDASVMAQAIGGTVDMQTISPLAHGEQTIAVSLRGEMNDLGSLNSGSSDTGYRGSISYIDQFADDTIGVAIGYARMMSPNQEERWQAWGYPTNDNSDSVLGGAKPFVRSSELERDGVLAVFEYAPNTTYHSTLDIYYSKFTDDQRLRGIEIPGAWGTNGGVIPTTTDNGLVTEGVIKGAEVVIRNDVNKRDADSLSIGWNNKFNINDNWNVEADISMSRANRTDIGMESYSGTGRGTGVGAVDDLGFAYNGKGGYVFDHNLDYSDKNLIKLGDPLGWGSPLGANTQDGFINKPEIEDELKSFRLSAEYVLDGGAVRSVEFGVNRTNRDKTKLDKGYYLTLKGYDGSADYTMAVPDQYLLAPTSLDFFGMGNVLSYDSLAFYNDGNYTETDVADVDLSRATNSWAVQEKVTTGYVMANLESEVFGIPLTGNAGLQAVHTDQSSDGTVATVENGLVVLTPRTAGDSYVEWLPSVNLSFEVADSQVVRLAAARTLTRSRMDKMNANLNYTYSANPSGGNVNWSGNAGNPELRPWLARQYDLSYENYFSDQGYFSVAVFYKDLENFVYDQHTDFDFSTLFPQGPTDNPIGDVTQPQNGEGGYVQGVEASVSVDFGMFADVLSGFGTVISGSYNDSEVKETPTSNPTTLPGLSEKTLNATIYYENSGFEARISSRYRSDFLGEVTKISLQRENVNIKAETVVDAQIGYDFSESGIESLYGLSVQFQVNNLTNEPFTSYTSDDQRLVRDYQNYGRNFMLGANYKF

SEQ ID NO: 7505 - protein, 314 aa, Shewanella baltica
MPSRTQESEIGSMPMAPLVLSQTTDEESAEKTAEEQELDDAWRVYLDLYAFLPLQTTSTTTINENSTTADVPLSSIFDTLTGALTFKASAEYGRLGVFTGINHAANSASTSKSFVRETNNPLRNQLDLPAVLRQRNIKVNVDVDINQTIVDLAMRYRAGAIQKPHMEQGSTSFVGFAGARLIDANLSTKVDFRRDRTVSVDGVVVNRERSRNLERSASDSWGNTWVQPLIGMMATYAFNKEWQAFAYLDAGGFGLSGETDLSGTAQAGIAYALGNSAQASLSYKYFGLDYAGGSGNGYTTSQSGINLGLRWLFD

SEQ ID NO: 7506 - protein, 3025 aa, Shewanella baltica
MENNLSKVEKNLRSIAKRYKSVKYSLGLAILFLMMGVNAFSEEVVTQAVPTNEQIALSRENLKNSVGGLQSKINQARTENQKVLKGLRLELIQLMEQGNQVVKSPWASWQFGIGYTYNDWSGKYKGSGDKSEKYIYQGIYKSGNWKVKNAMDVAENMHTNGNPITPGNDNTSSWKRANNGSTGGVTIEKDNSIDSATNGNRKWGLVNLRDLREPINEVEILANVSPKEVTKNIKPINPNISEPPELPVPTVNPQVNTPLAAPTITNPEIVPPSIPSAPTINIGVTSPTITPLEVTTPSDVGTIAVNLSTVNPVDFALSPSVLSSDNARKYSDKDYNPSDWNGQTIDVNTTGMDGKYKVGNYISTWGRVKNLDKFNLTVNVKIEDTRAFMVDEGVVDPSPVGSPGGTPTTYKPFTFNGTINLEKSKNVGIDVQGTHTTYGKISGRNDSYNTIDKVANIRVINEGTIIGKSGTNNENQVGFGFNNFDTSSNNTRTEMINNGKIEIGASKSAGFQLRPESYYSDQRNKQSGLVIMSGENTGTITLNGYGSFGFLTVKNKQSGAEQVADYDNYKVKATAGGQIASRSKPSEMSYMKNSGTININSDGSVGVGLLHNIQAVEVGGTINIGTTSPTGTLANSGSDATKVEGAIGVYSEVETRPVRGREYARGSHGEQLFEADGVTPKVLKSYYDDHALENKEHTTASHTYTDAHGNSITVTNYTGKTVGTETVEVGSKIEVGDHAINSSGLRTKNSGSITLTSTGKVYVKGEKNYGAVTVGKLYNRYLKTKKDDYATAEADYGKINLEAGSLIQVTGKQSIGYVLKSGRGYNAGTIDVTGPSTNSATPSFAGSLGFYGEEGRFTNTSSGKIIAKGDVTHAVALVGNPSASASEVLTFTNNGLLSTTKKGNIGVYASGKYNFTHENVRGSSAAKISVGENALGIYAKGNTNGDGKLAIKAPIELANSGTGANAGTTMGIYTDGLAKVTYYNGSKITIGQSAIGMYSSDVNKFNDTFKIASGHVLEVSLGQNSTIGLLNGSMTTSLSLGKFLNNKTTDRINLIAFGQGASLFYATMGARAVLDEDYTVTNGQAASTSLLVGTKGSLVEIKEAKKIITNTNVGLIATKGTGTGAASSTAKNAGVYTSTRDSALAIYADESTGENTATGTITMQNKTSVGMLGQNSSTLKNAGKIEMQKQESAGIYGKDSNITNSGLLASNKGIYAKGTKSVGLYSYLTSATTTADKTVTNSGAIKMEGSSNEKSAAIYSKLDATATKKLTTTNSGTITVEQKSSVGIFAENGTTTVANSVITNTGTINMNNEKSVGIYAPKSTVTKVGKINLADAADGSTAVYISGQGKITDTSDAEISLGTKNQNRVAYYIKGQNTTLGSAATTIGKVTGYGVGVYLEGSTGDIAKINGSTSKLHYTAATGATGNGLIGLLLKGNTEIKDYVAGIKVGDTVPKTKTDAAKYAIGIYSMGQGTSATAYEINTSITTGANGVGLYADKDKSVTGSTSNIKYKGIIEVGNKTDAGIGIFIANGKVTLDNTTKIRLNGNAGVGVIATEGTEFTANKATVELIGTNISGVGAYGKKGSTININNWTFENNGNRAEEVRSEEGRAPIGADKSLKPKMVLSHVINGETSLASGKTVTSVDDGKYKAEENIGLMAEGIKNPTAPAPLTGWTNGDFEILNEGTINFSVAKKSTAIYVESARVKNDGVIKLGEGSTGIYGIYKDGTRKYEGHPANHKNKLEVTTTTNSKISLGNNSTGMYLVNAQKLDNLGGEIKSNTGATKNVGIYAINGKIDVKGTAAEKAEANAYNGNDANFNILTMNNKADITLGNGSVGIFSRGKDAAIAKRNIVTNTGSITVGKSLTGAPAVALYSENTKLDTNSTITVGENGIGFYGKNSEITAKGTANFQNKGVLAYLEKSKFVSYLGNLNATQNTMLYLKNSTANLDGKGTKVDMTVADKQTGAYIEGNSILTGIKTIQLGKNSSGLFIKNANFASQAEKITSPKEGAKGLLAINSNLTNDSKITLSGNNSIGIYSNAPSTKTVKNNGELTIAGKKTLGVFLKGGQTFVNNANINIADTTSTKDDEKTIGIYTADGTTNIKHNSGNIEVGHKSIGIYSTTNSAVEMNGGKIHVKDEAIGFYKQNGTLLLKGQINVDPHTATAKNSEPVGIFAKNGANVTDSASNITVGAKSYGFILDNNSTLINRYTSTGTGNVTLGNDSVFLYSNGKAILTNRRNIASSSDRLIGFYIKGNSTAKGDLTNYATIDFSNTKGSIGIYAPGGKATNSGRVLVGKTDDIDPITGKVYTDVSKIVYGIGMAADNGGHIINDTNGVIRVYGNKSIGMYGKGVGTTVENNGNILLDGSRATATNKIQSMTGVYVDDGATFINRGTIKTTDAYAGRKDSSGKNIVNKNVTGITGVAVMNGSTLENYGKIHIDADNSYGVVIRGKVDAKGNVTRYAVIKNYGEIKVRGKGTYGVSYKDISADDLHRLEELVNSKLTSDPKGQELRGSSGTDKSYEGVKITVKDGKPSFTRGGKPVSDKEVAKITEIIGKASSNLGLSDIGFYVDTLGRTKPIDIDGVVPPINSQLIIGTEYSTLTNKKEWFVTDNAIKPFLQQIQGRNFKLTSIAGSLTWLATPVLDNHGQIKGVAMSKLPYTAFVKKTDNAWNFADGLEQRYGMNALDSREKKLFNLLNTIGKNEQAVLVQAYDEMMGHQYANVQQRINATGVILDKEFKNLRAEGNASKDSNKIKTFGTRGEYNTDTAGVIDYKYNAYGVAYIHENEDIKLGRGTGWYTGIVHNTFKFKDIGNSKEQMLQAKVGLFKSVPFDDNNSLNWTISGEIFAGYNKMHRKFLVVNEIFNAKSKYYTYGIGIKNELSKEFRLSEDFSVRAFGALKLEYGRVSKIREKTGEVRLEVKHNDYISVKPEIGTELAYRHYFGTKTLRTSLGVAYENELGKLANGKNKARVVDTTADYFNVRGEKEDRRGNVKFDLNVGIDNQRVGLTGNVGYDTKGENVRGGVGLRVIF

SEQ ID NO: 7507 - protein, 435 aa, Shewanella baltica
MKFAKLGLAGIIVAGLATSSYGADSLFDAFKNGKTNGELRAWYFDRKVENAPTSSAGIFTTAAILGYVTDTFYGFSLGGTFEAVYAPEASSGAKNVYKSDMYASGAVLSEAYLQYGIAKTAVKAGRQYISTPLVTGSGTRIVKESFQGAMLTSKDLSDTTITGGYINKFQGRTGYATGDSVGDAPDFASRSIFLGISGSTTYEFNGAYTVAVINKSIPNLTLTGQYLNVGDVKVGTKKSDIHVYYTDAKYLLPMDGYKLEFALNFRGSQTEDPLSATIKYNGTYAAGKIAVSELAGFGASFVAATTSRDDAVIAGMGNGPSSYTATLIRASTATLTANTNSYRCDVTYDFSKIGLAGLKGALQYGWTNQNRVGTAATSSDYTSYAGSLDYAVPLLKGLSLAVQYEKQENETTKYTSNTKTSIDTDELRIKLAYKF

SEQ ID NO: 7508 - protein, 904 aa, Shewanella baltica
MTRSAVMTSMAISLASMATFSGLAAEAETEAMLPASAIKPQVSTPTAMERIAITGSRIQREEMASTAPMTVFTAQDIEKTGATSVEVLLQRMTASAGFAGNQTNAYWTEGGYGSTQVNLRGLGVNRTLVLLNGRRMLNSGTGANSSVDLNTIPISVVERIEVLKDGASAIYGADAVAGVVNIITRQQIEGVEFQARTGITEQNDGGQYKLDLALGHVGERGSAYVAMSYDKTQAVDMLSRAPCPLEEVNGELVCGGSSALPGGRGHFIDTNGNPIGDPLMLLPTGSAPYTSSHKDNTYQYFNAVQPNERVNLFAYGEYDLTASSQVFAEAMYTHRSSQLPATPQSVSGIVIPAWHESNPTDSDFLLQSRRLAEASRQFNIQADTWRLVTGLRGDLDNGWQWDAAVNFGSNRGSYEVTNVINNTRLADATDYSNCNIDPNVPCANFWGAGSLTPEMLDYFLFNMRDSGGNEQFSLTTNITGDLWQLPAGMMSFAAGLEHRNEKGWNDPDPLKISGEANTAQQDPIDGRYTADEIYLETLLPILSGLPFAKSVELTAALRYSYFDTFGGDTNYKMGLLWVINDAVTLRATQSTAFRVPNIPELFGGIDQGSMNTTDPCSEWVKLDPSSNRYANCMASNVPTNYKQEGTILTDRGGNAELEPEEANTFTAGIVWDLEFIEGLNITLDYYKIEINNAINSVNGSSKLAACYDSKGMTHPFCSDEHFVRDAMTGNITYLQTQLGNAANEVVSGVDMAMFYQKEMGNVVTNTTWELSYLDQYDLQTYAGAPVESRAGTIGYDGSYTKWRSNLYFDVTNDNWRFSYNIQYIGAADDQYANAGEIGDSVDALTYHNAQVHYQMDSNIAFTAGIDNLFDKQAPYHQSYTDGNTNTMTYDLMGRRYYIGMKWAL

SEQ ID NO: 7509 - protein, 354 aa, Shewanella baltica
MKKTFISASVASVLALASFGALAEGPSFYGRLELALTHTDTAATLQGGTNGIDTANYADENNAGTYLENNFSLLGVKGSEKIADGFEAIYQMEFQVENTSTTGDVFKARNTYLGLKTNAGTVLVGRNDTVFKQAEGGVDIFGNTNADIDRLISGQTRSADGMWYYSPKIAGLVTLNATYLFDDNDTTAKTSESLYALSATLGDKAFKDQNYYVAVAYNKGISGIDAYRGVAQVKLGQFKVGGLFQQSENVVNSDIDGNTYFVNVSYDLNGVNLKAEYGADDAGFGNFYKNVNKGGATGTDINVQNFNVGADYRLAKSTMVYGQYAMYRGDHVVAGNKVDLQDDNVFSVGVRYDF

SEQ ID NO: 7510 - protein, 354 aa, Shewanella baltica
MKKTLLTTAIISSLTLYSFTALADGPEFYGHADLAITNSDTGYATQNQKDGTVLENNFSWLGVKGSEAVSPYFDIIYQMEFGVENFDNSNKTFNARNTFLGIRSAAGTALVGRNDTVFKAAEGSLDLFGNTNADIDLLVAGQTRSADGISYYSPKIADLVTLNATYLMSDNYDQVDGNGDEVYSKDHMYALSATLGDKAFKAQNYYVAAAYSDGIDNVEAYRGVAQAKFGDVILGALYQHSEHVDDKFANLSGDTYFVNAAYLIGDLKLKMMYGKDDSGLGKYVSRYVGDQDNSGLEQVRDVDLQQFSVGADYRLSTKTMVYGHYTRFDGDLMLADVKQDLNDNIFTVGLRVDF

SEQ ID NO: 7511 - protein, 758 aa, Shewanella baltica
MKLALSSIALAVAGVCSPVMAAQLQGQVTDLQGAPIAGALVSIDGGTSTSTNPQGQYQLTVADNSHIHLHISNADFKHVDRDLQITTGAMTQDISLTKTAMENIVVTASPLARSALESTTPISVLTEDQLKLNIEPTLGDTLEKLPGVQASHFGAGASRPIIRGMGGPRVQVLENGLSVGDASTVSADHAVTAEAASAQQIEILRGPGTLLYGNGAIGGVVNVVDKRYHESPVDELSGQFGTRYDTASNGRTFNGDIDGGNGQFNWHVDGTHRITDDVDIPGNAIANLPETHGKLANSNQKLDDYAAGVGYTRDTGFVSVSGARTESNYGIPGRGEADAPDITIDLKKTAWQLHSGLLDPFAGFSKLRFDAGYTDYQHAEEEDGVAGTTFFNKQSEARLSLNNRPWGEWQGTMGLHAVHRDFAVEGEEALTPDSKTDTLAAFIVQERKVGDFRFELGGRLEHYRLAPDSMTLDTLNGEQNYQAEDLVDNDLTVSAGMVWDFDPAYNLGLSLTRAQRSATAEELYSYGPHDATQSFELGSQFSVENGQIITNSGNNDKEVANNIDLTLRKLEGAWTGSLSMAYNRVNNFYYEKNTGLIASDIVNGDAEGDLPVYQYTQGDAELYSLEAQASIPFNDTWSLDMFSDYTRGKLVDGGNLPLISPMRIGSTLNFDQQQWHAEVGAIGYAKQTDTAENETETAGYALVNAAVTYRLYTSAGDMLFYVKGTNLLDQDARPHTSLLKDYAPLMGRNFMLGVTYNF

SEQ ID NO: 7512 - protein, 187 aa, Shewanella baltica
MPKLSLISFIVGLTLASSIMSTNAFAGDSAHILGGSLGYGSQEFETKNGKYDAGDTLSGDLYYRYMLNENFGVEAGYLAGSGGVASALVSIISEIKNLSYNGVRTTAYGEYALSRGNSLYAKLGAAYTQVSYEMDKQEMDSSDVGFYGAVGWQYRFKSGFGLNLEYEYLPMKELELQGINFGMSYRF

SEQ ID NO: 7513 - protein, 427 aa, Shewanella baltica
MPRLTLLAAATAVAFTGFANAQDLTPQELQAQLTQLTQEVNQLKQQQAANATATPSSKPSAPAFEIGGRIQLDYNLFNGAYNAEHNGSSAQDIFPRRVRTFVEGELQDWDYKLLLEFAENTAEIVMARMRYSGFENGPKLQFGKLREDISLDALTSSNHIALIERSSLADTMSPYFRWGVSAYQYFPSTGLRYALGVYKNDAFGSDGKDETDDLNYALSSRVTWSQVKEPGQVLHAGLWYSARQMGGDDLSASFARGELRETNTRLINYVAGGETAAIDNLNQAGLELAFQHNALLLQGEYAQRSLNTQDPQSVLDGERYQAYYLQASYFLTGEQRSYSKGSAVFSQPKGVTDAWELAARFSSVDASSDFQGTKAQTYTLGVSYYFNPKIKVMANYIHSTVDGAGTIALVGNEDVGDAFAARLQYVF

SEQ ID NO: 7514 - protein, 352 aa, Shewanella baltica
MQFNGSFDLWGLEQKVVLGYQYSNQDFTAYARSTDTKMEIGNFFEWNGSMPEPVWNAPTLNEKYNIEQNALFAATYLNPIEPLKFILGGRFTNYEKNIYGRNSSIKYDHEFVPYAGVIYDFNDVYTAYASYTSIFQPQDNKDFDGNYLDPVEGNSTEVGLKSAWFDGRLNGTLALYHIKQDNLAQEAGQVTRNGVKETYYRAAKGATSEGFEVEVSGQITPDWNITAGYSQFSAKDANDADVNTQLPRKMIQSFTTYKLAGKLENITVGGGVNWQSSTYVNAKNPKKVIEKVEQGDYALVNLMARYQITKDFSAQLNINNVFNKKYYGVFPAYGQITLGAPRNAALTLQYKF

SEQ ID NO: 7515 - protein, 693 aa, Shewanella baltica
MHKTLLATLISGLLFASSLYAEETESDANIEVISIKGSRLDKAATATGLPLTLRDTPQSVTIIDQEFIQSFSLNNVADLMFLTPGISAQKIETNRYFFSARGNPITNFQFDGVPVNYSSFFNDASTDTVIFDRVEVVRGATGLLTGAGEPSAAINLIRKRPKSSPGGYLSAKLGSWDSYRVEGDSSVDITDDGDVQARFAAAYEKSDSFTDLAEDENLQIYGVVTARLSDSTLFTLGADYSDRDPKGSTWGALPLFYADGSLANDLPRSTTTAASWSSWKRHGTNVFSTLEHSFDNNWELKLDIEHREDKMDGHLLFLYGAPDKTTGLGMSASPMIYQSSRKQDAARLFASGPFELFGREHKLTTGLLYSKQDISADSYYTTDTLSVGNFFEWDGSIAEPNYPSTPTTQETEEIQKGAYIATQLSLHDQLTLLLGSRISQYRIDPGYEHNDVITPYAGLVYDITDSVSIYTSYTEIFQPQDAKDANNKRLDPTTGNNIELGSKADFFDERLTASVAVFKVQKENVAERDPNFKDPLPDGSFPMRAVDGTSNRGFEMELTGRPTEDWDLYFSYTYSESEKANGEAFGTHLPKNLVRLSTLYHFNGALEDLTLGGNLSWQSKIYVENAGPNGASSEQDSYFIANLMASYQITDDAIVRLNIRNVFDEKYYSSIDFYDQGFFGEPRNVELSLSYNF

SEQ ID NO: 7516 - protein, 653 aa, Shewanella baltica
MGTNPTKIALLIGSLCSFSVIAPAMAADASSTAKVDEHLVVIGRSDNTPLNIAANVNVIDAAAIEMSGATSVTEVLRGQSGIQISDNNIGTSFAMRGFSASTAVNNTLILLDGRRLNNIDIAAPSLNAIPLNQVERIEILSGSAGVLYGDQAVGGVINIVTKSPENTGGSVQLSGGSFDTYEGRGDVSGAINKDWRYFFTGSYNQGDNYRQHNANETGSILGRIQYKTATDSFFVETSYYDDDRENPGSLTKDQFKDNPRDSGNQKQYSHEMTTAARTGYQHQLNQNWALAADLDYSDTLVSSFNWGANSHNTRSLLMFSPKALANYSTRQGELNLVTGLDISRGKADFDTMARSNVQQMQSAYLQATVPLSHTLSYVVGGRYARVTDELVDGNVYPNGMDLDEDATAFEFGLNYRPSTEHRFYLRGDENFRFAKVDEQAYTSKNVFGLKPQTGRSYEAGWDWTLASQTLRVSLYRLDLEDEIVFDPSAEKPELGSFQGANVNADASRRYGASADWDWQVTQAMQLGLEYNYIDAEFTDGINDGKELSWVAKHTGRGYVSMDFAEHFQVFAEAIYTGDRFIEGDNGNEGDKLASYVLGNLALNYNRDAWLASLRIDNLFDKDYVSAGYYGGGIYNGYYSGRGRDIRLTLGYRF

SEQ ID NO: 7517 - protein, 696 aa, Shewanella baltica
MKKKPLVIAMAIALSSTALSFTLAAEENVKPVVQGDADKKLVTTEFDEVLVSATRISEKASETSRSVAVVGEEQLAVAQASSVANALKNEANITLTNGPRASSQGVEIRGLSGSRVLQTIDGARQNTGSGHRATYFMDPELLKSIEVLRGPASSLWGSGALGGVVAQNTKSAQDFLAPNETFGGYFKQGYETNGSRTKTSGAIYGQQDSIDWLLNGSYTDSNNIKTGNDETLSNSSSNGSSGLVKFGWQADEASRLELSARVNKINELVPSNPSAAASNSVPLVRRKTDDQNITLDYSFNPANNPYLDTKMQVYWNSTDYDEDRITKGQLDSTEYRTVGINLNNSSRLGNTLLTYGVDGFRDTIETTRDDSGQVGQRPGNIDGETTVWGAFTRADIELTQTLNLDAGLRYDSFKNDSNNLNLSSDDNELSPSLGLVWQTQSWLTLSARYDQAFRAPSVEEMYSSGTHYCIPPIPGFLPQGLCNTFATNPDLKSEKARNKEIKADLRFSELAGDDELALTFNIFRNDVDDFIVQQVSNPWHGIPGFEQTTSWNNVEDARLTGFEISGRYRIGQTRLAMNYGQTHGEDRKNGGDIEGIPANKFNVDLSQGIMEGDMKLGTRVTYVATQSNTPDDFKVAKYDDYTLWDVYVAWEPTMGAMAGVRVDFAIENIGDEKYQQAWQTLYQPGRNMKLSARYMF

SEQ ID NO: 7518 - protein, 858 aa, Shewanella baltica
MMTSKKQKFGLSAVSLAITLALSGSFISPQAMAEEEDAAVKNEGVEKIAVVGSRAAPRSIGDSPVPIDIISSDDLKKNGSTDMIDMLVTSVPSFNSRAQPISDAATLVRPVNLRGLPSDSTLVLVNGKRRHRAAVIAFQGGGINDGAQGPDISVIPGSALKQVEVLRDGAAAQYGSDAIAGVMNFVLKDNSDGGSITVTQGEYYEGDGATTTVEGDVGLPLTDNGFVNLSFQYKNADATSRSVQRPDAANLAEQGNTAINDPAQVWGNPEINDDYSVFINSGLDINANMHAYAFGNLSSRDAVGGFYYRYPQNRSNVYSNDDGQNLLVGAVNGVQSTCAAVPIPKNADGSDGNVLDTDAYKAMVADPNCFAMNQIFPGGYTPQFTGTIEDMSFFAGVKGDIGEWNYDFSAGTGSNKASFGLKNSLNPSLGLDTPTDFDTGAYEQVETTVNLDFSRFITIGGIEDISFASGFEWRNESFEISQGDEASWIAGPYANQGFNIGAHGFKGFGPESAGKNSRHNIGIYTDLEAYLSDDWLVGLALRYEDFSTFGDTLNYKLTLQYSATDELSFRASHSTGFRAPTVGQENVVNTQTSIIDGELIQTFIAPPTDPLAAFYGGEVLKPEESTSYALGAVYEYESFFLTVDYYNIGVEGRIAQSSKIDVEAKDYDALRAAGVEFPELIQGVSYYTNDFDTTTQGIDIVASYDAEILSGNAKFSLAYGWTDTSVDKYDPETTDEGKVRRLEDGIPAHRATLTWAQSWDQLSMSLRGNYFGEYYATHADDTSDWGSEMADAAVTIDLEVSYELFDGLTLAVGANNLFDQKAQKLKDGTLGELGGVYYESGPFDYNGGFYYGRVNYRF

SEQ ID NO: 7519 - protein, 944 aa, Shewanella baltica
MHYKYTLLSLAVGTALAATWSPAAHAQDGSEKTPKNLDRIQVTGSAIRSVDIETQQPIIAITRAMIEQQGFTTIADLLQNLTSTGAPTISRARALASGENVGGYYVNIRNLGATRSLVLVNGKRLGATTGGYQDLSQIPMSAVERIDVLKDGASALYGSDAIAGVVNIITRKNYEGLEVSMQHGQFSQGDGKDSTFSLVTGARGERGGYTLALEYQKSDPVFARDREFSRYGGAGPNYPGADWSNISQNGSWCDPALYKCNTGDAVFKTLNRGGNPKNPNDYHPITPAEFANGNEQMHLQTGIERRSLFLSTDYALTEQIKFTADIGYNERTTDQQIAGYPYQSTKFGTPLDAASVFNPIDHSIAFNRRLWEVPRTTESKLKSLRVAPSLSGYFELGSKAYDWEVGALFNRNEVTKTGRGDMSLIASRQALGPSYLDANGVARCGTAASPVSGCLAWNPLLPFGVAGAGSLSDPELQRFLFPTFNDTGITKTRSYFANISGPVIELPAGDLSVALGYQYRKEEGRFVPDAFAQSRQSTALGASTTAGDYSLNEFFAEVNVPVLRDLPFARELTVNLATRYSDYSNFGSTTNSKASFAWRPIEELMIRGTFAEGFRAPSISDLYGGLGTSFETYVDPCGTGATNSVNGNAACNAAGVPLGYQQLNQSLKPCASYPCATPDEFTTGSNPKLRPEESKSKTVGVVWSPRWVDGLDINLDWYSYKITNMIIQDSVDRILRDCYVLGNASRCGSVKRAGDGHITSMFYGLANLGSMETEGWDLGIRYRLPEFSFGRFTIDLQNSYVSKYDEQNQNSAGDTIMMGRIGQPGISRLRSNLGVNWQLGNFSTQYTVRYFSGMVENCVPNRPCTLPDRYAYGEPDALRKVGSNTFHDIQVSYKLPWDGTVALGSNNVFNHQGPIMFSKPSSSFPYYGGFDIGRTVYVKYSQRF

SEQ ID NO: 7520 - protein, 755 aa, Shewanella baltica
MELCRPKKVLPCACYYAQLRGYQIRTLSRMNSEKRLKSFSKKTPLLLSIALAASSSLAQQSNTAATAEISTNTPTRLPVVVVTAQKEREEVLSIPVSVTPVTRETIQNADIRTVREASIYAPNTFINEFSARAVSNPFFRGIGGSPQNPAVTTFIDGVPQLNSYSANVELVDVDQVEFIRGPQGALFGRNTAGGLINITSRRPTDLWTAYADANYGNYNFRDVRGTISGPLFQDQVGLSLSGGYSARDGYTVNDFTGHRLDSREAGFGKGQLLWKINDRLDLRLILSGEHDHDGDYALGDLGFIRAHPHHVDRDFEGFNHRDVISPTLLANYYGDNFDLSSISGGVWWKNEGLTDLDYTTVPGNTRDNVEEEHQFTQEFRFSSPKDRPIHLNDVLDLGWQGGVFAFSEDYQQSAANNTLIPNPFPSPIPTFIPLTQNSSADLDNWGVGVYGQAKLTAWEKLDFTAGLRFDYEDKHAELGNSLNPPFAPPGRVVASDNFSQFSPQFSLAYHFTTNHMAYASVARGFKAGGFNPPPTGFAAPPGTVEFGTEHSWNYEVGYKAQYFDGKVETTAALYYIDWRNLQLNQPIGLSGQYFIGNAGAADSKGVEFSALYHPYNWWDLFGSVGYNNAEFLSGSQNLGMNVGGNKLPYAPEYNANVGTQISWAPCTRATLYARAEVTVYGDFKYDATNIQGQSAYSLANFRAGVRGNHWFAEGWVNNAFDTHYVPIAIPYSTPSGYIGESGAPVTFGGRIGLTF

SEQ ID NO: 7521 - protein, 892 aa, Shewanella baltica
MNTKTIIKLWKGNEMRPSIFKKTVLATNIAILLGSAVSISAVAADAAATTAAPENIEKIEVRGIRASQQANLNAKRFSDSTVDAITAEDIGKFPDKNVAESLQRIPGVTIQRQFGEGAGVSIRGAGQDLTLTTLNGQNVASTGWFVLEPAKRSFNYELLPSELVGNLEVYKSSQADLAEGGVGGTVVVNTRKPLDMDSMTFFASAEAQYQSDSGETDPQFSGLGSWKNDDETFGVLVSGVMQNRSLQRQGDEAFWEWGAGPVAFEQERERSAIAATFQYAPSDSLNFVFNAMDMQMAADNTNYALWFTQADTSWSGAPGSGAWDNTEWLGGCGLCGGDKPDASQSGSQVAGPVNLAYWQARPREATMKSQVFDLKMEYSGDGYQFTTQIGDTSSTGGTDFEMVVEDGLGGTALNGATYDFTNGHQTWDLNGFDTATYDPGSLVMGTGSNFNKTPKTDDETYIQADIKFDVDLGVVNAIKTGLKYAKHNTTSRRFDFVQADDFNPIISTAGLNTGTFAVGTSEYDIIRFDPDALKDWAKSSIIGETEDFGSYREIDEDNYAAYVMANFASEGVRGNFGVRYAGTEATSTYYVDGKKTDSSANYGEWLPSLNVAFDLAPDLILRASAARVMARPQYDDMYVNPNVLGANDDVPNNQKWVVGNIGLKPFIANQIDLGIEWYFNEESLLSAALFMKDVKNFVTFSEYHADSADIPFTGTLKPDEVAGGWTVQEKANGESATIQGLELQYQQDFGNGFGSIVNYTYTDSETSPNTYTDRNPFLSDSSKHSYNLTGYFENDLFQVRLAYNWRSEYMIRETGSYGNRLHDAFGSLDLSAIWHVTDYMDIKLDGNNLLEEGSRQFGNNQFQSNLSGFTDGFPVFEYNMARRITLGASVRF

SEQ ID NO: 7522 - protein, 1302 aa, Shewanella baltica
MELQTHRKINRPLVSLALVGALVSITPQQSHAAFFTTVIIPAIVGGIATGAAVGTVSGLLSWGLKQAEEANKTPDKPDKVWRIQAGRGFNDFPNKQYDLYKSLLSSKIDGGWDWGNAARHYWVKDGQWNKLEVDMQNAVGTYNLSGLINFTGGDLDVNMQKATLRLGQFNGNSFTSFKDGANRTTRVDFNAKNILIDNFVEINNRVGSGAGRKASSTVLTLQASEKITSRENAEISLYDGATLNLVQSSNHSVDLYGKVWMGRLQYVGAYLAPSYSTINTSKVVGEMNFRHLAVGDQNAAQAGIIANKKTNIGVLDLWQSAGLNIIAPPEGGYESKTKDNPQNNPKNDTQKTEIQPTQVVDGPFAGGKDTVVNIFRLNTKSDGTLKAGGFKASLSTNAAHLHIGEGGVNLSNQASGRSLLVENLTGNITVEGALRVNNQVGGSAVAGSSANFEFKAGEDTNNGTATFNNDIHLGKAVNLRVDAHTAYFNGNIYLGKSTNLKVNGHSAHFKNIDASKSDNGLNTSTLDLSGVTDKVNINKLTTAATNVNIKNFDIKELVVTTRVQSFGQYTIFGENIGDKSRIGVVSLQTGYSPAYSGGVTFKGGKKLVIDEIYHAPWNYFDARNVTDVEINKKILFGAPGYIAGKTGLMFNNLTLNSNASMDYGKDLDLTIQGHFTNNQGTMNLFVQDGRVATLNAGHQASMIFNNVVDSATGFYKPLIKINNAQNLTKNKEHVLVKARNIDYNLVGVQGASYDNISASNTNLQDQFKERLALYNNNNRMDICVVRKNNLNDIKACGMAIGNQSMVNNPENYKYLEGKAWKNTGINKTANNTTIAVNLGNNSTPTSSESNTTNLPTNTTNKARFASYALIKNAPFARYSATPNLVAINKHDFGTIESVFELANRSDDIDTLYANSGGTGRNLLQTLLIDSHNAGYARTMIDATSANEITKQLNTATTTLNNIASLEHKTSGLQTLSLSNAMILNSRLVNLSRRHTNHIDSFAQRLQALKGQRFASLESAAEVLYQFAPKYEKPTNVWANAIGGASLNSGGNTSLYGTSAGVDAYLNGEVEAIVGGFGSYGYSSFSNQANSLNSGANNTNFGVYSRLFANQHEFDFEAQGALGSDQSSLNFKSTLLQDLNQSYHYLAYSAATRASYGYDFAFFRNALVLKPSVGVSYNHLGSTNFKSNSNQKVALSNGSSSQHLFNASANMEARYYYGDTSYFYMNAGVLQEFARFGSNNAASLNTFKVNATRNPLNTHARVMMGGELQLAKEVFLNLGVVYLHNLISNASHFASNLGMRYSF

SEQ ID NO: 7523 - protein, 189 aa, Shewanella baltica
MRHCDQSLVAHAAVGVGCSTSPYDRPPERAAGLIRIKAAAVPSRKTSRIHCIQREMPCVCALPFCLPASPPRASASPHWRNPKATGPLPSAPIRSLPSPTTAAWSAARSRRNISSPTTGIDVLAALPFQHDIAIRDLGRVGSTKHLPPVISLEYHFNAQGKLSRFVGAGIHYTCFFCAPTPTARWPAAI

SEQ ID NO: 7524 - protein, 554 aa, Shewanella baltica
MRYLRLRPLASAIVLTGCSNVAFAQLGQNLSVDVRSLALGNAVTADPPGISAIHFNPAALTKIEGLQTDVQGLIANFDIKREFSAPAGYNVFGYSDDPLVCNDGPEVASNLCTDYKGSVSGDVEYASIYVPILKKMVDLGEGVPLAAPTAGIAYKPPGSKITYATAIYAPLVAGFGSENGNPGNYMGQQVALERVTYLSPSLAFKVTDELSLGASIGMSYQAISIKTDLRFPNELIGVLRMVDEVVCAPFKDNNDVITDLLLLGICNAQEGMNPFNRFGQLKVSVEQALSPSYNLGLLWEPNDDFSFGMVYQSASKMRLKGKYFVDNEKAPRELIRGLNSSATGAVFARILGFPSSIPASESGLVSMDFEYPAHFQAGIKYKILPDLQVNFDVGWTDYSAWDKFRFEFDRQVAALKIAKLLSSDITDDSLALPLKFTSPWSWGIGFEYSATDRLKLRAGYEPRTSAIPNDKRNTLIPINNAQLFGLGIGYRFDTDTDIDLSVGFLRSRDNIPAGSSTLANQTGVSNILLNPYAGLDVKTNTKVTILGINYRTRW

SEQ ID NO: 7525 - protein, 384 aa, Shewanella baltica
MNKTCIALVLPVLLTATSSQAIELYKDSKNSLDLSGWLGFAALNDSHDTSVIDDLSRVRFSFERNEKHGWTAFATTEWGINMVSSDDSLVMQGGKLAAEKNEDFLYNRLGYVGMSHDEWGSLSFGKQWGVYYDIAGTTDLPNVFAGYSVGAYAFSDGGLTGTGRADSAFIYRNTLGPVHIALQYAAKTNGDIVLKNADGSEMADSELNFDSSYGASLTYSVTDKFKLLAGFNRGDFDGHLGNTQVDETNKIVGISAMYGDYYHYAENREASGLYVGFNAHQSKNNELVDGELYDATGVELMTAYQFDNGFVPMLVLSYLDLDTDATTPIQGKWTRQFAMLGLHYRYSNDTVMFAEMKLDFSKMDDAALEALEDNGFAVGINYFF

SEQ ID NO: 7526 - protein, 843 aa, Burkholderia mallei ATCC 10399
MGQVVAPKSLRSVAAFDLAYEKSAGISGKKVSAVASLIAAASVSSGAEAQQSNLPPVTVDAPVQRPRPTASKPTPDQVRARNALRRAAPRQQAQQAAPATPSGPADADPYADPAAPYKVDHVQAGGKFPEKLVDTPKSITVLSKEVLEDKNATTLKQAILSTAGVTLGSGEGGNAFGDRFFIRGFDARNDIFIDGVRDSGVSVRENFFTEQVEILRGPGSTFSGRGVAGGAINIVTKQATTAKSFYNMDTTFGTDQTKRVTLDVNQVIDPTLAVRVGGLFQDANVAGRDYVTDNRNGAFVATTWTPTDTVKVTGNYIHTELTGRPDFGVPYYRPSTTSTAGGPFPDFGANRNNWYGFVNRDFFRTGQDIGTINAEVQITPDLMISNKIRASRSTQNYIGTLPEAPKLVDPLSASTLSANPQSRFQVTDVFANQTEATYKFNDDVGFRHTLLGGVEYDRERSSIDSYTGLSSELTTGTPFSGSGSKTDVSVFAPQYTNLPFGIPSLTGSPTKIGIDTVSGYVMDSANYRDLVILNGGFRYDDYSINTRKLGSPGQQSAEFLIPNFNLGLTLKPAPNGSVYVAYATSANPVGAEFDGTSTAYGGLNPNLPGGNTQIFGPEKNKAIELGTKWELFDRHLLLTAALFQTTKENARESQNVGSAAAAAPLGCVYPTGTTGNISCITAGAAYRIRGIDLGVGGKITDKWSVFGGLVLMQSEVTQSLAPSANKALYPTNVGRPLANIAHESFSLLTKYQLTDVWELGGQAVYRSKIYGGTLLAANQGTSIPSYWRFDMFAEAKINKNWQVKLFVNNIFDKRYYDALYQSAAPFVLEAPGRAAYVVLSARY

SEQ ID NO: 7527 - protein, 771 aa, Neisseria meningitidis serogroup C
MPDWRARALAGRGCGWPSMCPRGHAGLRCAATTPKVFANDFHYRVWQSRFEQSVHIQEPPMKNLYGISAAALLAMSAPAHAQENSAEPADDTRIEETVVVTATRSSLPPSALPNTIQLIQNDALSLQAQLTGSAIEVVSTLVPSFSPTREKLSGAGETLRGRSPLYLIDGVPQSNPLRDGSRDGYTIDPFFIERVEVIFGSNAIQGIGATGGVVNYVTAAAPEEGEGWTGKLLAQIGAGSGFKGDGYDYRGGALAGRDFGALDLTLGVATQKRGAFYSGNGRRIGIDGAQGEVQDSDSLSFFGKAGFDLSPTRRLELMAQRFELEGDGDYVLVNGSRATDTPTTTIRGDQPGVIPTNTVLTTSLTYTDEDLLGGTLTSQAFYQDFESVFGGGSFATFQDPAIAPVGTLFDQSSNNSEKMGVRISYERTLDAVPGLNVRGGLDALNDQTYQELIVTGRNWVPETEFTSFAPFLQLNQALFGERVYISGGLRHEMAKLKVDDFETLYAYGPQQVEGGEPEFEKTLFNVGATAEIVDGLTVYTSYAQGFTMADVGRILRAVSTPDQDVDTFLNIEPVVSDNTEIGLEWRQGPLSASAAYFWSTSDLGALLVLRNDVFEVERQRTEIDGMELTGAWDTPVTGLKLSGGVAVLNGRTDSDGDDKVDIDLDGANISPDRVNLAADYETGPFTLRVQARSYLDRAFEGLPLNTDFDGHTLADAFLRYSAGFGDITLSASNLFDKQYVTYDSQTVQPTSNTRYFAGRGRMITLAFEKSF

SEQ ID NO: 7528 - protein, 358 aa, Neisseria meningitidis serogroup C
MKKSLIALLVATLPAAAFADVTIYGKIKGGVEYVDNGSTKQTNVDDLGSRIGFKGSEDLGNGLKTIWQVETGFAIDGNKDQYSKSSSGTFANRNSFIGLQGGFGTVRLGNVSNFLDSDMGTVDTWEYNSNALGLSMFTRDGTRLKNSVRYDLPTVVPGLTAALQYGVKETKGVANSDRETTVLGLGYENSGFFGKYAYTHQSKAVSSVTTAYALKDTANDKHRLEVGYNANNLFVGFGYQQAKGGADVAGQDWFDLVKTGMTASATPDANGKVKTREYALTAAYTFGAITPKFSYVRGDKVEVGGVKLDNTQYDQYVLGADYAISKRTTFGAQYGQIAVKGTGNKDLKAFGLNMVHAF

SEQ ID NO: 7529 - protein, 388 aa, Neisseria meningitidis serogroup C
MRKKLTALVLSALPLAAVADVSLYGEIKAGVEGRNYQLQLTEQPSRTQGQTSNQVKVTKAKSRVRTKISDFGSFIGFKGSEDLGEGLKAVWQLEQDVSVAGGGATRWGNRESFVGLAGEFGTLRAGRVANQFDDASKAIDPWDSNNVVASQLGIFKRHDDMPVSVRYDSPDFSGFSGSVQFVPAQNSKSAYKPAYVDEKKMVHAAVVGKPGSDVYYAGLNYKNGGFAGNYAFKYAKHANVGRDAFNLFLLGRIGDDDEAKGTDPLKNHQVHRLTGGYEEGGLNLALAAQLDLSENGDKTKNSTTEIAASASYRFGNAVPRISYAHGFDFIERGKKGENTSYDQIIAGVDYDFSKRTSAIVSGAWLKRNTGIGNYTQINAASVGLRHKF

SEQ ID NO: 7530 - protein, 799 aa, Neisseria meningitidis serogroup C
MPLLPFTLRPLLLALPLLIATPVMADDSPRRYDLPSGPLAQQLNRLASAAGIYIVGDGVLSQGKASAPLQGEFTPEQALERMLLGSGLIAVPSGERQYRLQPAAQGAGLQLAPTSVDAYRDSAYGAVNGYLATRASSASSASKTDSALLETPASVSVVTRDRIKAQGAQTVTEALSYTAGVHANVAGNNPTDNTLMVRGFQQINSDAYTDGLRNNNIGYYAPEPFGLERIEVLKGPASVIYGQGEPGGMINLVSKKPLFAAHREVGLSLGNHDRQQLSLDVGDLLDSQGTLAYRLVMLGRDADNEIEGIKDDRQYVAPSLTWAPNEDTSLTLLASYQKNTNLFTSNMAYSLFDGSNPNGRVPRHRSLNEPGFDREQSEMNNLGYELSHRINDTFSFRQNLRYSHMHGYQDQLFRNSGVINGNTLARYYELRDYNSDNYTLDNQLLANFNTGPLRHDLLLGADYLRGHRSQDVQHGDAPSINIYNPVRGVTIDTSRYTSLLSTARDDRQVGLYLQDQLHLDNWVATLGVRHDWARQDSTNRINGSHQVITDEATTARASFGYSFDMGLFPYVSYSESFKLASGNSFDGSPFEPETAKQYEVGIKYQPPGSENYITVAAFDLRRQNVATTDVEHLGFSVQQGEVTSRGVELEGVAKPLPGLNLITAYTYNDVEVTKDNPNALGVSNKGNAPVRVPRHLASLWVDYTLQGGPLAGLGGGLGVRYTGATSGDAQNTFEVPGYTLVDAMLSYDFGKANNGLQGLSAQLNVKNLTDKYYVAGCFATVACLLGTGRTVTADLTYRW

SEQ ID NO: 7531 - protein, 676 aa, Neisseria meningitidis serogroup C
MRAFFLSKAIYAHPVESEPLTAELDKINVTEYAKDLTGPTASVSQGRVSYVQLEKRPLLRIGELLEVVPGMIATQHSGPGKANQYFLRGFNLDHGTDFSASIDGIPLNLPTHAHGQGYLDLNSLIPEMVESIAFQKGPYYADVGDFSSAGNARIQTFNRLSQGIAKLAVGEDDFYRGLLADSSQLGKGDLVYAGEFNFYNGPWVHSNDSKQYKGLIKYTVGDSAQGLTLLGSAYHGRWKATDQIPQRAVEQGLISRLGTIDPTDGGESSRYSLGVNWRHHRANSSTHITAYGFYYDLDLYSNFTFFLEDPLNGDQIHQKDRRWVVGTEAEHTWFLAWGEREVANTIGLQFRHDAIGEVGLFHTRARKSLSTVRSDQVYQSRVGWYGESEIKWNDKFRSVVGLRGDFYNFDVNSRLPENTGDRTDFIASPKLSFILGPWAKTEYFINAGYGFHSNDARGVTATVDPETGMPLKQVNPLVRSQGAEGGLKNQGIPGLTTTLAVWYLALDSELVFVGDAGTTEPSGSSNRYGVEWTNSYQLISWLTLEADFAFSKAKFAGGGEVPNSLGRVISAGVTMDWPANTRFFGALRLRHYGDSPLTEGGNVKARSTTVLNLKAGYNAKQWEIALDVLNLLNSEDPDIAYFYDSRLPGEPSSGVPDILFHPVIPRSIRGSVVVRF

SEQ ID NO: 7532 - protein, 229 aa, Neisseria meningitidis serogroup C
MQADLAYAAERITHDYPKPTGTDKDKISTVSDYFRNIRAHSIHPRVSVGYDFGGWRIAADYASYRKWNNNKYSVNTKNVQKNDNGNRQDLKTENQENGTFHAVSSLGLSAIYDFKLNDKFDKFKPYIGVRVAYGHVRHSIDSTKKTTNVVTVAGAANTAPTIYYAPETQNAYHESHSIRRLGLGVIAGVGFDITPKLTLDTGYRYHNWGRLENTRFKTHEVSLGVRYRF

SEQ ID NO: 7533 - protein, 398 aa, Neisseria meningitidis serogroup C
MNAPHYPHYRFAILILSAASFGAGAAHAQSSVTLYGVVDDSIAYVNNQQGHSNVYLRDGNLYASKFGLRGDEDLGGGTHAIFDLQAGFNLNTGAQAAAGTIFNRQAYVGLRNDHYGTVTAGRQYTPYFLLVGPYASSSWLTGATGAHPGDIDGLDTTIRVNNSVTYTSPTLSGLTASAMYAFGGIAGATGKGNTFSAALRYANGPVGIAAGYLRINSSGSSAGFLNPATAASGSFAVSVLNQGYLSAKAVEQVAAAGNYTLGNLTMGLNYSNVKYLPGNGSAFTDTAVFNTYGALAAYRFTPTFSVAGAFAYTLASKANGVSGAARYQQYSLKESYSLSKRTTLYALQAYTHASGQTLGAQGAGHIVDAAPIVGDSQQLTPSTTHGQFVGMAGIAVTF

SEQ ID NO: 7534 - protein, 1519 aa, Neisseria meningitidis serogroup C
MKTTAYLKLSGSLIALTAAAVSQAHAQATGWTGGSSYNQDITGAAVTGDNLWHNALNWSNGLPNAATDVSIGLATMQLYYRRYECQGPGGVGDVDWCVDVIQGPRPTSWDIVLLSGTVGNAQNLYIGLSGGRGFQGSSAGPGHLINQSGLVVGLNMTVGETGTGRYDAIGTTAVGGNLVIGGQGIGTFNNDNPLNVGGHLTVGGYAQGTVTNTSTITVGGNITVGQDAQGTLTNSGNISAGGNLTVGGNDQGILTNTNATITIGGDITVGQDAQGTFTTNGNVSAGGNFTVGGNGQGTFTNTNATITVGGDITVGQDARGTFTTNGNVSAGGNLTVGGSGQGTFTNTNATISIGGDITVGQDAEGTFTTNGNVNAGGNLTVGGNGQGTFTNTNATISIGGDISVGQDGQGTLTNTGGTVTSGGDITIGVHGQGTATNTGTMSSVGNFIVGFEAEGNFTNTNTVSVGGNFTVGESGQGTVDNNGAATITVTGNTAIGENAAGIGILNLNDTSRLTTGGSMAVGEHGTGTLNIATGARAETTGRITLGTSVSGVGTVINNGTMINHEQMVVGDMGRGRLHTAAGATTTTTGDVTVGESATGMGFVSVRGRMDNGGRLDIGDHGDGYMVVHDGGRVTNRESVVGREGGGNGYVLVSDATSIWDNAYSLTLGSESESIGVLTINNDGEVQIRQGYGTLTIAEMEGSTGILNIGGLYPPTGLSFPIDTQVATYVAAAPLGQNVNSTAPLAAGTLDAAFVQFGKGAGSVNFNHTETEANDYRFKAGFIGNGQINHYGNFTVLDGDSSLFTGNAHVLGGIMVVNNVFGGHVTVDPAAILRIGHRNGVTGEVLNDIVNNGIVQFYRADTSRYSGVISGVGAVEQNGTGTTILTGENTYTGQTRINAGTLQLGDGGKSGSIDHTSGVVVNANGTLAFNRSDIKVFDRTITGTGTIAQIGTGLTRLTADNSGFTGQTRIDAGTLSVNGRLGGTVEVNDTGTLEGLGQVGTTTVHEGGTIAPGNSTDPNMQRVGRLTIEGNFTQEAGSFHDTDVLSTGQSDLLYVTGTAAISNDSYLKVSKIDPARYELERRYTVLTAEGGVTGDYILIGDTFVSTFYRLEDHYDANNVYLDVAQYRLFPEAGKTPNQIAAATGAQDLKAERDINGYPTNPLFRAIAYLPTDKKARYAFDQISGEIYASLQGAMLDDSHMVRDVMGDRIRSAFGDMGEKIVGYTPGIDIKDPTPQPVYGNDQEGPVIWGRGFGNWGEIEGDGNAAELKRDGRGLFLGADMPFRDMFRVGLLAGYDRTDYKVPDRNSSAASSNYHLGLYGGAEWWRLALQLGASFTWHKTEVAREIVFPGFAETASSEFDGGTAQLYADLGYRFRPAGLPSLQLQPFLGLAYANNKQGGYDEAGGYAALHGGADQSLGTGYGTLGLRAAQDFDLLDIQWTVHGSAAWRRAFSDAAPTATHHFNGSRDFTVFGTPQPIDTGLFKLGVDANLSEHWAMGFSYAGEYSSKVEFHNLRGDLNYKW

SEQ ID NO: 7535 - protein, 1068 aa, Neisseria meningitidis serogroup C
MRTTPTFPTKTFKPAAMALAVATTLSACLGGGGGGTSAPDFNAGGTGIGSNSRATTAKSAAISYAGIKNEMCKDRSMLCAGRDDVAVTDRDAKINAPPPNLHTGDFTNPNDAYKNLINLKPAIEAGYTGRGVEVGIVDTGESVGSISFPELYGRKEHGYNENYKNYTAYMRKEAPEDGDGKDIEASFDDEAVIETEAKPTDIRHVKEIGHIDVVSHIIGGRSVDGRPAGGIAPDATLHIMNTHDGTKNEIMSAAIRNAWVKLGERGVRIVNNSFGTTSRAGTADHFQIANSEEQYRQALLAYSGGDKTDEGIRLMQQSDYGNLSYHIRNKNMLFIFSASNDAQAQPNTLTLLPFYEKDAQKGIITVAGVDRSGEKFNGSNHCGITAMWCLSAPYEASVRFTRTNPIQIAGTSFSAPIVTGTAALLLQKYPWMSNDNLRTTLLTTAQDIGAVGVDSKFGWGLLDTGKAMNGPASFPFGDFTADTKGTSDIAYSFRNDISGTGGLIKKGGSQLQLHGNNTYTGKTVIEGGSLVLYGNNKSDMHVETKGALIYNGAASGGSLNSDGIVYLADTDRSGANETVHIKGDLQLGGEGTLYTRLGKLLKVDGTAMTGGKLYMSAGGKGAGYLNRTGQRVPFLSAAKIGRDYSFFTNIETDGGLLASLDSVEKTAGSEGDTLSYYVRRGNAARTASAAAHSAPAGLKHAVEQGGSNLENLMVELDASESSATPETVETAAADRTDMPGIRPYGATFRAAAAVQHANAADGVRIFNNLAATVYADSTAAHADMQGRRLKAVSDGLDHNATGLRVIAQTQQDGGTWEQGGVEGKMRGSTQTVGIAAKTGENTTAAATLGMGHSTWSENSANAKTDSISLFAGIRHDAGDIGYLKGLFSYGRYKNSISRSTGADEHAEGSVNGTLMQLGALGGVNVPFAATGDLTVEGGLRYDLLKQDAFAEKGSALGWSGNSITEGTLVGLAGLKLSQPLSDKAVLFATAGVERDLNGRDYTVTGGFTGATAATGKTGARNMPHTRLVAGLGADVEFGNGWNGLARYSYAGSKQYGNHSGRVGVGYRF

SEQ ID NO: 7536 - protein, 287 aa, Neisseria meningitidis serogroup C
MGVLWGNVAEKTPFFKTKNHIYLGFRLGTGANMRTSMWQQAYKDNPTCPGSVCYGKKLEAYYKGGKNLSYTGQIGDEIAIDKYHILGLRVWGDIEYAKAQLGQKVGGNTLLSQANYDPSAIKTYDSASNTQGSLNLQKTPSPQDFLFNNGHFMAFGLNVNVFVNLPIDTLLKLALKTEKMLFFKIGVFGGGGVEYAILWSSQYKNQNTNQDDKFFAAGGGFFVNFGGSLYIGKRNRFNVGLKIPYYSLSAQSWRNFGSSNVWQQQTIRQNFSVFRNKEVFVSYAFLF

SEQ ID NO: 7537 - protein, 751 aa, Neisseria meningitidis serogroup C
MNRRFQRTPLATALIALSAVPAATLAQQAPATAPTQQAAAATTLKEVVVSGAASRDDFNAGKTSLSKLPEDLHDVPQSVTIVNKALMESQGVNSLADALRNVPGITIGGAEGGQIGNNINLNGFSARTDIYLDGFRDRGQYYRDTFALDQVEVLMGPSSMLFGRGSTGGVINQVTKKPQLKAATEVTGSVTTNGLVRATADYNTPTGETSAFRISAMGQDGRPTTRDEMTVQDFGIAPSWRLGIGTPTEITLSALLQHNHDMPDYGFSNINGHPTSVDRNTFYGFTDDRTNQDIAALNASISHKFSPNLRLRNQTQFNYVETDARETAPNSVGSVSARGFTPLTTSALPLDQLFVRLQSHDRKIRDYSIYNQTELTANFDTGSIKHTLLVGAEIGHDGYNNQNYYRNGSCNGQPLVSGTTAATVGYVACEPVVNPTYTASPANAPASTGNLQGGSANTIAAYLNDSIELTKQWKAVAGLRYDRYIASVSNSINSSNDAGAPYFSTALASADQTVNFTSVRLGGIWQPTEAQSYYVSYGTSFNPSLEQLVGTVGQQSLDPEKNKSYEVGGKWDVMGGDLSLTSALFQITKDNARSQIDATTYALSGKIRVKGFRAGATGHITSKWQVFAGYTYLDGEIINGIAASTTGKVPTNTPKHTATAWTSYRFLPNWEVGGGAFYMSERFANNTNTVQVGSFVRWDGMIAYHQPKYDVRLNLFNIFDKMYYDALIQSDGGRSVPGTGRTAMLSFTYRM

SEQ ID NO: 7538 - protein, 260 aa, Neisseria meningitidis serogroup C
MNPAPKKPSLLFSSLLFSSAAQAAGEDHGRGPYVQADLAYAYEHITHDYPEQTDPSKGKISTVSDYFRNIRTHSIHPRVSVGYDFGGWRIAADYARYRKWNNNKYSVSIKELLRNKVNGNRTDRKTENQENGTFHAVSSLGLSAVYDFKLNDKFKPYIGARVAYGHVRHSIDSTKKTTEVTTILHGPGTTPTVYPGKNTQDAHRESDSIRRVGLGAVAGVGIDITPNLTLDAGYRYHYWGRLENTRFKTHEASLGVRYRF

SEQ ID NO: 7539 - protein, 725 aa, Neisseria meningitidis serogroup C
MTRFKYSLLFAALLPVYAQADVSVSDDPKPQESTELPTITVTADRTASSNDGYTVSGTHTPLGLPMTLREIPQSVSVITSQQMRDQNIKALDRALLQATGTSRQIYGSDRAGYNYLFARGSRIANYQINGIPVADALADTGNANTAAYERVEVVRGVAGLLDGTGEPSATVNLVRKRPTRKPLFEVRAEAGNRKHFGLGADVSGSLNAEGTLRGRLVSTFGRGDSWRQRERSRDAELYGILEYDIAPQTRVHAGMDYQQAKETADAPLSYAVYDSQGYATAFGPKDNPATNWANSRHRALNLFAGIEHRFNQDWKLKAEYDYTRSRFRQPYGVAGVLSIDHNTAATDLIPGYWHADPRTHSASVSLIGKYRLFGREHDLIAGINGYKYASNKYGERSIIPNAIPNAYEFSRTGAYPQPASFAQTIPQYGTRRQIGGYLATRFRAADNLSLILGGRYSRYRTGSYDSRTQGMTYVSANRFTPYTGIVFDLTGNLSLYGSYSSLFVPQSQKDEHGSYLKPVTGNNLEAGIKGEWLEGRLNASAAVYRARKNNLATAAGRDPSGNTYYRAANQAKTHGWEIEVGGRITPEWQIQAGYSQSKTRDQDGSRLNPDSVPERSFKLFTAYHFAPEAPSGWTIGAGVRWQSETHTDPATLRIPNPAAKARAADNSRQKAYAVADIMARYRFNPRAELSLNVDNLFNKHYRTQPDRHSYGALRTVNAAFTYRFK

SEQ ID NO: 7540 - protein, 907 aa, Neisseria meningitidis serogroup C
MQQQHLFRFNILCLSLMTALPAYAENVQAGQAQEKQLDTIQVKAKKQKTRRDNEVTGLGKLVKTADTLSKEQVLDIRDLTRYDPGIAVVEQGRGASSGYSIRGMDKNRVSLTVDGLAQIQSYTAQAALGGTRTAGSSGAINEIEYENVKAVEISKGSNSVEQGSGALAGSVAFQTKTADDVIGEGRQWGIQSKTAYSGKNRGLTQSIALAGRIGGAEALLIRTGRHAGEIRAHEAAGRGVQSFNRLAPVEDGSDYAYFVVEGECPDGYAACKDKPKKDVVGEDKRQTVSTRDYTGPNRFLADPLSYESRSWLFRPGFRFENKRHYIGGILERTQQTFDTRDMTVPAFLTKAVFDANSKQAGSLRGNGKYAGNHKYGGLFTNGENNAPVGAEYGTGVFYDETHTKSRYGLEYVYTNADKDTWADYARLSYDRQGIGLDNHFQQTHCSADGSDKYCRPSADKPFSYYKSDRVIYGESHRLLQAAFKKSFDTAKIRHNLSVNLGYDRFGSNLRHQDYYYQSANRAYSLKTPPQNNGKKTSPYWVSIGRGNVVTGQICRSGNNTYTDCTPRSINGKSYYAAVRDNVRLGRWADVGAGLRYDYRSTHSDDGSVSTGTHRTLSWNTGIVLKPADWLDLTYRTSTGFRLPSFAEMYGWRSGDKIKAVKIDPEKSFNKEAGIVFKGDFGNLEASWFDNAYRDLIVRGYEAEIKNGKEQAKGAPAYLNAQSARITGINILGKIDWNGVWDKLPEGWYSTFAYNRVRVRDIKKRADRTDIQSHLFDAIQPSRYVVGSGYDQPEGKWGVNGMLTYSKAKEITELLGSRALLNGNSRNTKATARRTRPWYIVDVSGYYTVKKHFTLRAGVYNLLNHRYVTWENVRQTAAGAVNQHKNVGVYNRYAAPGRNYTFSLEMKF

SEQ ID NO: 7541 - protein, 257 aa, Neisseria meningitidis serogroup C
MNPAPKKTLLFSSLLFSSLLFSSLLFSSLPQRRAGEDNGRGPYVQADLNYAYEHITHDYPGDNAKVFDDYRDVKTQSTHPRLSVGYDFGNWRIALDYARYNTWRHGKHIHAENTKTITPPQGKPVDTKTEIDHTDKGTFKAESNYGISAIYDFDTGTRFKPYVGARVGLGKIKHSIAVEDQLTLTIANIKKGPTDLHPPLHQSHSIRRVGFGAVAGVGIDITPNLTLDTGYRYHYWGHLENTRFKTHEASLGVRYRF

SEQ ID NO: 7542 - protein, 174 aa, Neisseria meningitidis serogroup C
MKKALATLIALAIPAAALAEGASGFYVQADAAHAKASSSLGSAKGFSPRISAGYRINDLRFAVDYTRYKNYKAPSTDFKLYSIGASAIYDFDTQSPVKPYLGARLSLNRASVDLGGSDSFSQTSTGLGVLTGVSYAVTPNVDLDAGYRYNYIGKVNTVKNVRSGELSAGVRVKF

SEQ ID NO: 7543 - protein, 139 aa, Neisseria meningitidis serogroup C
MFRAPNINELYTGVTGDSATVNDPCNGYTGGNTVACANVPTDGSYQQSDRQVSGKASGAAVAGYQLKPETGKSYDVGFVYDPQWIDGLWLRADWWRIDLQDTITTVSAQTVLNQCFANAASSFCALIHRNGNGTINYIG

SEQ ID NO: 7544 - protein, 724 aa, Neisseria meningitidis serogroup C
MVQTQRQSATGNFFKATLLSAAAGLSVLAPVALAQEEDADSVQEAVIVIAPEYVPTSSLTATKSGIPLVETPQSISVITRDQIDLLNFIDAQQAVRYVAGVSGENYGPDLRFDFISIRGFTPRQFVDGLATPVSTSIRSTGVDLYAFETLDILKGPASVLYGSAPPGGIYNQTSRRAEAETSGEVTLQYGTDDYKQIAATGTTALTDTISGRLTVLARDREAERDFVEAQRYLVAPALNIKLGPQTELDLLGYYQDDQVDGDTNGFLPIFGTLLPNPLGKVDPSVNLGEPDFNFYERDQYGVGFEFTHSFSEALQFDANLKYTDYAEYRDVIYGTGLLADNRTVTRGNSPYQEDVSNLAIDTRLSGDLTSGSITHRFLVGLDYRNVDNNAGYGFTGASSIDLFDPVYNQVPNISPGITTRFNEQEATQLGIYAQDQIKFGKLLLLASGRFDKVESEYLQAFTPFGSPAPSTSSDQEKFTYRIGANYLLDSGVSPYISYATSFEPVLGADINGDAFDPTIGTQVEAGVKYDGSNLRDGFDIFASAAVFNILQEDVVATSSSLSTPVFGIQLGEVEVSGAEFEFVARIDDALSLNGSYSFTDSEIKDSNTPLEIGQPLPVTPEHKFSFLVDYTVQGGSFRGLGYNVGVRYSSESAGSLPSAFNPVVYNSDELFLFDASIRYDTEKWRFAINSSNLLDDEYVARCASTSNCTYGAGRQVIASVTRKF

SEQ ID NO: 7545 - protein, 222 aa, Neisseria meningitidis serogroup C
MQADLAYAAERITHDYPKPTDPSKGKISTVSDYFRNIRTHSIHPRVSVGYDFGGWRIAADYARYRKWNNSKYSVSIKKLQNQYNKKTENQENGTFHAASSLGLSAVYDFKLNDKFKPYIGARVAYGHVRHSIDSTKKTTGFLTTAGARGAGSAVRPSYKSTQDAHHQSNSIRRVGLGVIAGVGFDITPNLTLDAGYRYHNWGRLENTRFKTHEASLGVRYRF

SEQ ID NO: 7546 - protein, 758 aa, Neisseria meningitidis serogroup C
MAQTTLKPIVLSILLINTPLLAQAHETEQSVDLETVSVVGKSRPRATSGLLHTSTASDKIISGDTLRQKAVNLGDALDGVPGIHASQYGGGASAPVIRGQTGRRIKVLNHHGETGDMADFSPDHAIMVDTALSQQVEILRGPVTLLYSSGNVAGLVDVADGKIPEKMPENGVSGELGLRLSSGNLEKLTSGGINIGLGKNFVLHTEGLYRKSGDYAVPRYRNLKRLPDSHADSQTGSIGLSWVGEKGFIGVAYSDRRDQYGLPAHSHEYDDCHADIIWQKSLINKRYLQLYPHLLTEEDIDYDNPGLSCGFHDDDNAHAHTHSGRPWIDLRNKRYELRAEWKQPFPGFEALRVHLNRNDYRHDEKAGDAVENFFNNQTQNARIELRHQPIGRLKGSWGVQYLQQKSSALSAISEAVKQPMLLDNKVQHYSFFGVEQANWDNFTLEGGVRVEKQKASIQYDKALIDRENYYNHPLPDLGAHRQTARSFALSGNWYFTPQHKLSLTASHQERLPSTQELYAHGKHVATNTFEVGNKHLNKERSNNIELALGYEGDRWQYNLALYRNRFGNYIYAQTLNDGRGPKSIEDDSEMKLVRYNQSGADFYGAEGEIYFKPTPRYRIGVSGDYVRGRLKNLPSLPGREDAYGNRPFIAQDDQNAPRVPAARLGFHLKASLTDRIDANLDYYRVFAQNKLARYETRTPGHHMLNLGANYRRNTRYGEWNWYVKADNLLNQSVYAHSSFLSDTPQMGRSFTGGVNVKF

SEQ ID NO: 7547 - protein, 212 aa, Brucella canis
MFKRSITAAALGAAVMAFAGSAFAADMMGRTDYTYNDPVAAGPHDWSGNYVGTQVGGSSSKFPSPFASRTGALGGIVVGKNMQNGNIVFGAELEGNFAEAEHRIGHGGTLQQSWNGNAKGKVGYAFDKTLVYGTAGYGVTRFKAKDNTTSAPGWEGGVLIGAGVEQALSGPLSVKAEYDFQRFNDVKSQVNGIEQRNNLKNHSIKAGLNYKF

SEQ ID NO: 7548 - protein, 620 aa, Brucella canis
MHILKLSALLASACAATLSPALAQDGGDKDDGVTLDTIVVTPLRRASSLQRSTSSVSVIDAADIERSAAPDLQSLLQTYSGISVKTNGGQGSSANIYMRGMSSKQTVVLVNGVRTASATSGSTALANIPLTSIERIEIARGAHSSQYGADAIGGVINIITKQGGACGERAWCGSVSTGVSHPWGGYASGSLQGRSSDGIDYAVGAAFTGTQGYDFTTPEAFGHEPDDDGFLQGSFNFALSKDFDWGKIYADGLFSRGRNQYDATAPAFNEADSTAFTGKVGTRIDHTADWSSTVEFNTGIDNSRNFRKGIEGSDRFETRRYGVFASTEKSFDTGKVSHVVTGGVEAYREKINTTIDYDETGRDLAAVFGQYSLEYDALRFDGGIRYDHNGQFGNVTTYNLGASYEILPDLVLRSSYATGFRAPTFNELYYPGFANPDLQPEKSRSVEVGLNWQATASTSLDMALYQTRLSDAIMSTAPSYIPYNIASAKVTGLEATLSHRFNEQWGIKGMVDLKRPVDEDSGNDLPYRERFKAAAEVNFKPVEKLDLTARVLYGGSRYTNAKNTKKLGDYVTADFVALYSIDKQSQLKFSVENIFDKDYETSSGYVAPGRTITIGLTRNF

SEQ ID NO: 7549 - protein, 228 aa, Brucella canis
MKLKALLFASTVVLVAATGANAADAVIEQEPAPVVVAPTFTWNGAYLGGQIGYAWGKSHFSYDPTDLGDIKPDGFLGGLYAGYNFDLGNSVVLGIDGDVTYNDVSKNIDFLDENNAAATFENRLRWSGAVRARAGYAVDRFLPYIAGGVAFGSLRNRGEFEGAGFSQSKTLTGWTIGAGMDYAATDNVILRLEYRYTDYGNKDYGFDDAAVTNNFKTNDIRFGVAYKF

SEQ ID NO: 7550 - protein, 274 aa, Brucella canis
MNRSRIFYAGLIASAALIVSFSVASATDLPETVPEVVIAPPAVGGWYLRGDIGYSWNGFKRAEYAPLGDCDTCNGLGRGGDTLYGDLNGSFLIGGGAGYQVTDYFRTDLTLDYMTRSRFSGHVSGPDCNGDTGCASDERSHYSALSILANAYVDLGNLGGVTPYVGAGIGGTRVNWSDLVDITSGFSQEGAANWRFTYALMAGASVDLTHNLKLDAGYRYRHVNGGKMFEGNQWTDAGYDKGLNIHDIRVGLRYMFGGSDNAAYASQAASTIVD

SEQ ID NO: 7551 - protein, 213 aa, Brucella canis
MRTLKSLVIASAALLPFSATAFAADAIQEQPPVPAPVEMAPQYSWAGGYTGLYLGYGWNKAKTDTVGTVKPDDMKAGAYAGWNFQQDQFVYGVEGDAGYSWAKKTKDGLEVKQGFEGSLRARLGYDLNPVMPYITAGVAGSQVKLDNGFDDESKFRVGWTAGAGLEAKLTDNILGRVEYRYTQFGNKTYDLGNESVRNKLDTHDIRVGVGYKF

SEQ ID NO: 7552 - protein, 296 aa, Brucella canis
MFTAIEQKISSHDYGVNCSYRFVAGEKGYFRILGGGSYQELKGEQTRLIPGISPNMNPTKFPFPGPVRVASLDAEDQSVGWRLGAAYEIPEYAMRATLVYQSEVKYDLEGTIDNLVLNPITGRGMPLNVESDVATPQSVEFKFQTGIAPDWLAFGSVKWTDWSSITSVDFVSSDNKIAPKGTKITSLNLYYQDGWTVSGGVGHKFNDQWSAAATVTWDRGTSTGLTSQTDVWLFGLGTNYKPTDQFEVRLAGAAGWLSAGDLDDTMIAGVSNPTGSKGEFGNDFVGALSLTAKVKF

SEQ ID NO: 7553 - protein, 240 aa, Brucella canis
MKSVILASIAAMFATSAMAADVVVSEPSAPTAAPVDTFSWTGGYIGINAGYAGGKFKHPFSSFDKEDNEQVSGSLDATAGGFVGGVQAGYNWQLDNGVVLGAETDFQGSSVTGSISAGASGLEGKAETKVEWFGTVRARLGYTATERLMVYGTGGLAYGKVKSAFNLGDDASALHTWSDKTKAGWTLGAGAEYAINNNWTLKSEYLYTDLGKRNLVDVDNSFLESKVNFHTVRVGLNYKF

SEQ ID NO: 7554 - protein, 284 aa, Brucella canis
MKRGCAIAVMICGLITSVSAASAADLIVQEPVFEPLPQPALAGWYLRGDIGYNFKSKTGGKWDFWNQFEEPYRGVDDTFNYDDFSLKGGASYGVGVGYRFNDMLRTDLTLDYFRASINGRTNCRSYVKSSHGLNPVEDNCHYEDNSKASVWTAMANAYVDLPRVGPLTPYLGAGIGAAYVKYDTWKTSEICPTCTLQSDKDGFDSWRFAMALMAGVSYDLTDQLKLDLGYRYLRVNGGNAYGYDEQDRQVINQYGQGAGADGPQAKDNGFNIHTVRAGLRYEFR

SEQ ID NO: 7555 - protein, 661 aa, Brucella canis
MKFTRTLVLASTFLLATVATSQAQEVKRDTKKRGEVVLKPITIISHGKDNIEATGGTVLTYKDIEKLQPANVSELFSRQSSIAVSGGGGPSKRIHILGMEQSNLAVSVDGVPQTATSWHHTGSNVIDPAFLKRVEVEAGAAAADSGFGAAAGAIRYETVNALDLLEPGKTFGARIIGSYGTNGRGFSGSTAAYGLKDGFDWLLMLHGTSGHNYKNGDGTEILGTEPAARNILGKAGYEFDGNRIDIGYERSRDKADRLIKMNMGLPGDTEYPLEVARDSVNIKYTRTDATDMWDPEVQFYYNRNDYWRNDYQNRTNGNMILKEDLYGGKLQNTFTIDYGKITAGIDFGKHDYNTDNYGHNDRRYRKFNTQQVGAFTQGRFEFDNGFSLSTGARYDYSRFADWNDEVFSDSGASVNGTLSYKFNEHIEVFAGASRTWLGYVLGDYGYVHARNNAFYTDPTFSPGRARNYKAGVNFGGADWSAGITLFDTRIAGLPNYDSQKLGNDPEEYRSRGFTLNARYIWNYTTIGATFTKAKVTAGDDPVLPNSGSFMPIGDMATLFIDQEIPDYNMKVGATLAWAGRISDEAATAANFYDQPAYTVVNAYAEWNPPAVKNMTLRVGVENLFNENYYERTSFAPSQKRGGIDPVWAPGRTFTFQTAFKF

SEQ ID NO: 7556 - protein, 726 aa, Salmonella arizonae
MGMRVKKFIWLITVVSTGVNSPLSAAESTDDNGETMVVESTAEQVLKQQPGVSIITRDDIQKNPPVNDLADIIRKMPGVNLTGNSASGTRGNNRQIDIRGMGPENTLVLIDGVPVTSRNSVRYSWRGERDTRGDTNWVPPEMVERIEVIRGPAVARYGSGAAGGVVNIITKRPTNDWHGSLSLYTNQPESSKEGDTRRGNFSLSGPLAGDTLTMRLYGNLNRTDADSWDINSSAGTKNAAGREGVTNKDINSVFSWKMTPQQILDFEAGYSRQGNIYAGDTQNSTSNAVTKSLAQSGRETNRLYRQNYGLTHNGIWDWGQSRLGFYYEKTDNTRMNEGLSGGGEGRITNDQTFTTNRLTSYRTSGEVNVPVIWLFEQTLTVGAEWNRDELNDPSSTSLTVKDSNIAGIPGSAANRSSKNKSEISALYVEDNIEPMAGTNIIPGLRFDYLSESGSNFSPSLNLSQELGEYVKVKAGIARAFKAPNLYQTSEGYLLYSKGNGCPKDITSGGCYLVGNKNLDPEISINKEIGLEFTVDDYHASVTYFRNDYQNKIVAGDQIIGRSASGAYVLQWQNGGKALIEGIEASMAVPLMPDRLNWNTNATYMIASEQKDTGNPLSIIPKYTVNTFLDWTITSALSANVNWTLYGKQKPRTHAESRSEETKGLSGKALGAYSLVGANVNYDINKNLRLNVGISNIFDKQIYRSAEGANTYNEPGRAYYAGVTASF

SEQ ID NO: 7557 - protein, 1000 aa, Salmonella arizonae
MKNFIFSLFVLLMLPAYMSGQAQAIKGKVVDSSGMGIPGAIIASSDARATADADFDGNFTINAKPGDILKISMLGFDSVSVPATAAPMTITLKEAGDTALKEVVVIGYGTRKKIDNTSAVSSLKSEEITKMKVSNATQAIQGKAAGVQVTSSNTPGGTPSVIIRGVGTALGGRNPLYVVDGMPTDNINNINTNDITSYEVLKDASALAIYGTRGANGVIMITTKAGKGKMTIDFDSYSGFKSALKKVKMANSEEFARYSNAAFNDPAKFSLNQPINTNWYDEITRTGTYSENNLALSGSSESIKYFLSAGNYQEKGILNGTDYSRTTIRSNNEYKISERLKLSQNFSVSSIKNTPKPLSAFTTAYRQSPIVPVRYADGKYGVPFVNNGVAAETGSQFNSVGNPVSAIDYNNEKQQTVILQGGLKLDFDITKSLKFTSQFNGEFYTYKQYNYVDNLAIWLAADPNRVVDAYDPKSNINTLTRNRDQYFNWNLSNYFTYNKVFAEIHDVEVTAGIEANVIGTREKLGITRKNVEANSNYWALDGVPYAANVVGYTDVALNQQKLSSYFARFQYKLMDRYLFTGTVRRDGSSQFSEGNRWGTFPSFGAGWIVTKENFLSNVKGLDLLKIRGSWGRLGNQKVPLNNQTFTSGLNYGPDSGSGITVDSAVDPNLSWEIVEELSAGFDIEMFNNRLKGSFDVYDKNTTNAILYVLPYSTSGLTQRTATHVGEVSNKGYEIALRWDDKINDNLSYWVGGNFSHNKNKLASLNNPSIAPIVAGNLGNGQNTKILDITSVGQPIGSFYMYEYAGIDPTNGQMLYYNASGNKVAQGALNEVNDKKYVGSVLPTANYGVTLGLTYKAIDFSVDGYGTGGAKVYNGKKAQRFSGENVEASLTRDFWTPTNTTASNPAPFNQVPVASTYYLESADFFRINNITVGYKLPLNENGFINYCRIYVNAVNPFITQKFSGFSPEALGDGELVTGTQGVELDAYPSLRSFVIGANLKF

SEQ ID NO: 7558 - protein, 1363 aa, Salmonella arizonae
MNKIYALKYSSLTGGLIAVSELSKKVTGKTGRRLMTVSLVLSVTLSALPGKASTVSAEIPYQTFRDFAENKGVFTPGVTGIEINDNNGNKVGVLDVPMLDFSSLSRDGHTTLIHPGYVVSAKHGGLQSVSSATFGYDQIYKIVDNNLAGIDFSAPRLNKLVTEVIPADIQGKDKFNNNRYTAFYRAGVGSQYIRYANGTDKLLQAYTPEKAYLTGGTVGKPYYTHYNGMKMISANPGNTFDKNQGPLASYGQSGDSGSPLYAWDNIDKKWVLAGVTLHNYGVKGARNDWLLIPHDFISQKLQDDLKPIIVASPEENILRWEFDRSRGTGTLSQGEKIFSMTGSVNGNANTGNNLVFSGNEGKIELVSSVEQGAGYLQFDKDYTVLTNNNSTWTGAGIIVGDEANVKWGVNGIAGDNLHKVGSGTLTVNGHGENKGGLKVGDGVVVLEQQPDANQKQQAFSHINIASGRATVKLNGANQVDADNISWGYRGGKLDLNGYDFTFSRLQAADYGAEISNDNQTDKSIVTLSLSPLKAEEINVVVNNINIMGGTGKPGDLYYTTFDGNYYLLKSNRYGSALFGALNNQSEWQRLGKDKEKAIGLYTQMKMQESAPLSYIYHGKITGNTSVEIPKLAGNDILTLDGSVSISGDMSKQDGALIFQGHPVIHAGQTVSASQSDWENREFSLNNLNLNNADFSLSRNAFMNGNIRAVNQSTVIIGGDTVFTDKNDGTGNDVISVEGKSAAAGTSSYTGHITLEQKSALDIRDNFRGGVTSEDSHINVSSSSVLFSDASSFINSSLNIHKGGALTAQGGLFTSGSIDIGDASLLLTGTPVNSDDAAFLPTINMADGGFKLMSDSSVLKARDQASVVGDIISDKQATISFETESGKEGMLSEKASRGLAVGLLSGFNTAYRGAIHAPSASATMNNTWWQLTGDSSLRSLKNTGSMTYFTGSAANKAFHTLTVDELTTNGTAYAMRTDLKNADKLVVNQKLSGKDNILLVDFLNKPTGEKLDIELVSAPGNSSKDVFKGSEQAIGFSNVTPVITAKDAGDKTTWNLTGYRMAENPAATQSASGLASVGYKSFLSEVNNLNKRMGDLRDINGEAGAWARIMSGTGSAGGGFSDNHTHVQVGVDKKHELDGLDLFTGFTVTHTDSSASADAFKGKTKSVGAGLYASAMFDSGAYIDLIGKYVHHDNEYTATFAGLGIRDYSTHSWYAGAEAGYRCHVTEDTWIEPQAELVYGAVSGKQFAWKDQGMHLSMKDRDYNPLIGRTGVDVGKSFSGKDWKVTARAGLGYQFDLLANGETVLRDASGEKRIKGEKDSRMLMSVGLNAEIRDNVRFGLEFEKSAFGKYNVDNAVNANFRYSF

SEQ ID NO: 7559 - protein, 390 aa, Salmonella arizonae
MTNGRNLFAACGALALLAAGVATPALADDALTLKVDYMADVAGVVRGGTAHKARVLDNLKVSADVDLEKALGWSGATFRMSALNNSGAMPNDDAGSLQGVNNIEVSKQRARLFEAFIEQSFGDGQGSALVGLYDVNSEFYANESAGLLIAPAFGIGSELAATGPNGPSIFPSTALSARLRWTTKSGGYVQGAVINAHAGVPGDPGGADFSFDHGVLAIGEAGWSGAGKLAVGGWAYSKRQDDWRDVTAAGDPVPRRAYGAYVLAERRIKGGEDEPGRITAFARAGVSDGVTSPFRGGWQAGILIEQPVASRPASQASFGINQAFLSRRERANGWDAGLDTGRTETALEATYADTFGPITLQPDLQYVIRPAGNRDARNAVVATLRVKVGF

SEQ ID NO: 7560 - protein, 269 aa, Salmonella arizonae
MRIFGSSAGCLSVLFGLAFGLPALAEPSVDLDGPTAGWRYSGLLEQPDAPRVAYPTPPIDRGGQRGRSLIEGHLRELVGTERAQRLVVNGNPLPLYTDGAGRFVRPYAFGHGSNGVQVGSADGKILKRVQFYEANRSQLPPRVRVVLGWDDPKAELDLHIVTPDGQHAYWAHPRLSNSGGLDPDGVDGPGPEMFTMGAPLHGTYLIYVNYWGNLNNQGYNFQAGSNVQDVITAQVNLVFNENSVDEKHETFVVPLRTIGDLVLVKTFTY

SEQ ID NO: 7561 - protein, 769 aa, Salmonella arizonae
MKINRASARLLAHASLVAATFAVAQPALAQSADVQADASAEDGNEIIVTAQKRAQSLSDVSLSVAAVGTEQLAANNTVNLEGLQTLVPSISFGNDFNFAKLFIRGIGLSSSLPGVDPSVALHVDGVVVSLAQAQLGSMFDLERVEVLRGPQGTLYGRNATGGAVNLITAKPTDTLDGYVRQTIGGDALLIQTDAAIGGPIAEGVRARLAVQRIHRDGYGINEYTGNEIDNANQWSVRGHLQFLPTDKLSILLTGELHTEDDRSLAVKFREVSFPGTSTASLTALGQRTNADGSQASFAKNVRNLNTNFDPINDRKQYAFTGIVDYDASDAVSLKSLTTYRNFRAIFFHDFDMSSYRGYPLAETTSVRTSANHWQPVFQHQFSQELQANVETDKLHAVVAAFYLKEKIRVENHIGYDVLTNTDPYRVQFDGKLDVETWAAFANVTYDLSDQFSIKLGGRYSWEKRHINNNSGIGTAATGFVLDPLQWNTSKTWTDFSPSAGFEFRPNDDVMAYFNWSRGFKSGTAEIGSRRSATATTPFVNPEKVEAFEGGVKYSAGSMQANLAVFYHKLKNGQFQRTFPIPNPPFFASALENAAESRAYGAEFELRWRPVQGLSLDASAAYLNSKFTKFFSKNPLNAALFGPGGSSLPDEDLSGNYTRMSPKWTFNFNPTYQVPLNSGASVTLGANVSYRSKQYHTEFNDDRMAADSYAMVDANVKYRHSDDRTSVNLWVRNLTDKLVWAGSYAVATSRTIGGTLMPPRTYGVTLGYEF

SEQ ID NO: 7562 - protein, 614 aa, Salmonella arizonae
MIKKATLLTAFSVTAFSAWAQDTSPDTLVVTANRFQQPRSAVLAPVTIVTRQDIERWQSTSVNDVLRRLPGVDIAQSGGAGQNSSIFIRGTNSSHVLVLIDGVRLNLAGVSGSADLSQFPVSLVQRIEYIRGPRSAIYGSDAIGGVVNIITTRDNPGTELTAGWGSNSYQNYDISTQQQLGENTRATLIGDYEYTKGFDVVAKGGTGMQAQPDRDGFLSKTLYGALEHTFSERWSGFVRGYGYDNRTDYDAYYSPGSPLIDTRKLYSQSWDAGLRFNGERIQSQLVSSYSHSKDYNYDPHYGRYDTSATLDEMKQYNVQWTNSVVVGHGNVGAGVDWQKQTTTPGTGYVPEGYDQRNTGVYLTGLQQLGDFTLEAAARSDDNSQFGRHGTWQTSAGWEFIEGYRFIASYGTSYKAPNLGQLYGYYGNPNLNPEKSKQWEGAFEGLTAGVSWRISGYRNDINDMIDYDDHLQKYYNEGKARIKGIEATANFDTGPLTHTVSYDYVDARNTITDTPLPRRSKQMAKYQLDWDVYDFDWGVTYQYLGSRYDSDYSAYPYRTVKMGGVSLWDLTVAYPVTSHLTVRGKIANLFDKDYETVYGYQTAGREYTLSGSYTF

SEQ ID NO: 7563 - protein, 354 aa, Salmonella arizonae
MDDNEAQKMKKTAIAIAVALAGFATVAQAAPKDNTWYTGAKLGWSQYHDTGFINNNGPTHENQLGAGAFGGYQVNPYVGFEMGYDWLGRMPYKGSVENGAYKAQGVQLTAKLGYPITDDLDIYTRLGGMVWRADTKSNVYGKNHDTGVSPVFAGGVEYAITPEIATRLEYQWTNNIGDAHTIGTRPDNGMLSLGVSYRFGQGEAAPVVAPAPAPAPEVQTKHFTLKSDVLFNFNKATLKPEGQAALDQLYSQLSNLDPKDGSVVVLGYTDRIGSDAYNQGLSERRAQSVVDYLISKGIPADKISARGMGESNPVTGNTCDNVKQRAALIDCLAPDRRVEIEVKGIKDVVTQPQA

SEQ ID NO: 7564 - protein, 363 aa, Salmonella arizonae
MMKRKILAAVIPALLAAATANAAEIYNKDGNKLDLYGKAVGRHVWTTTGDSKNADQTYAQIGFKGETQINTDLTGFGQWEYRTKADRAEGEQQNSNLVRLAFAGLKYAEVGSIDYGRNYGIVYDVESYTDMAPYFSGETWGGAYTDNYMTSRAGGLLTYRNSDFFGLVDGLSFGIQYQGKNQDNHSINSQNGDGVGYTMAYEFDGFGVTAAYSNSKRTNDQQDRDGNGDRAESWAVGAKYDANNVYLAAVYAETRNMSIVENTVTDTVEMANKTQNLEVVAQYQFDFGLRPAISYVQSKGKQLNGADGSADLAKYIQTGATYYFNKNMNVWVDYRFNLLDENDYSSSYVGTDDQAAVGITYQF

SEQ ID NO: 7565 - protein, 315 aa, Salmonella arizonae
MKLKFLGLALCVPAIFTTHATTNYPLFIPDNISTDISLGSLSGKTKERVYHPKEGGRKISQLDWKYSNATIVRGGIDWKLIPKVSFGVSGWTTLGNQKASMVDKDWNNSNTPQVWTDQSWHPNTHLRDANEFELNLKGWLLNNLDYRLGLIAGYQESRYSFNAMGGSYIYSENGGDRNKKGAHPSGERTIGYKQLFKIPYIGLTANYRHENFEFGAELKYSGWVRSSDTDKHYQTETIFKDEIKNQNYCSVAANIGYYVTPSAKFYIEGSRNYISNKKGDTSLYEQSTNISGTIKNSASIEYIGFLTSGGIKYIF

SEQ ID NO: 7566 - protein, 745 aa, Salmonella arizonae
MGSIHTLAGIRILRAAALAGASLLALTVGAAAQQATARLEELSVEGSGRGAGATGQGQAAQRGPDGRAAPEDPRGPVQGYVATRSATATKTNTPLIETPQSITVVGREQIDAQKAQTLTQATQYTAGVYSGTFGADTRVDYFTLRGFIASDYGIYRDGLQVLNYGFGTFRVETFGLERIEVLRGPAAVLFGAGNPGGIINQITKRPTTQPFGYVELGGGSFGQAYGAFDIGGPVDDSGHWFYRLTGFGRQGGTQVDGAPDDRAYIAPALTYRPDAGTSLTILTSYQRDSTAVTANFLPYSGTVRRNLSGLRIPRSLNVGDPAINTFQREQAFAGYEFEHAFDETWTFRQNLRYSFSDAFQNSYLNQTGYADPATETTLSRYQFLTSSKVGIFQVDNQAEARFFDGMFAHDLLIGLDYKHYSLHDNQGTNFAAGYAVPGLSLLNPIYGQIRGRPAPYLVNADTFQQLGIYAQDQIKLTDRLTLVLGGRQDFADNVVRDRLSPANSSSRSDEAFSGRAALIYNFPEGLAPYVSYSTSFQPQIGSDANGQSYAPEYGEQVEVGVKFEPVGYGFFLTAAAFDLVRQNVLQPIPGTFFSAPLGEVRSRGVEVQAVANLAEGLNLVGAFTAYDLQTIKGNADQVGRTPTRIPEVLASVFADYTIPTGDWRGFGFGGGVRYVGRSFADVANTLTVPDYVLFDAQIHYNWGNWRAAINATNIGDRRFVSSCISANECFYGEARRVLGSISYKW

SEQ ID NO: 7567 - protein, 378 aa, Salmonella arizonae
MKLTKTLLAGAILAGIGGTAYAETSVTLYGLIDVGITYQRGKVGTDDVNRPQYGGDYQSRIGMTDGIQSGSRWGLRGTEDLGDGLSAVFVLESGFGARNGESKQGDRLFGRQATIGLNHESFGRLDLGRQTNIASKYFADIDPFSLSYLNSTMGSAFSAADTVRYDNMVMYQTPSWSGFQAGVGYSFSTDDVEGPTGFEEDDNNRAITAGVRYVGGPLQVAFTYDQQFRAPSQPQPQQFILGAAYDFEVLKLSLAYGRTKDGVFLGQGFDLGGGAANPNTPAKGLGNTNDRFTWDGLKINSYLVGVSAPIGGASNVFASWQRADPNKGLENMDIYSVGYTYDLSKRTNLYAVGSYADGYAFVDGNKMTTVGVGLRHRF

SEQ ID NO: 7568 - protein, 360 aa, Salmonella arizonae
MRQSWRRLAPLAVTLCAVAAPAAAEIDWDVYGRVDVSAEYYAGGSYSAGDLASNSSRLGLRVAHTLDTGLTVYGRVERALDYNRGDGADLGARDAYLGLTDDWGVLRLGYMDTPMKEIRSRVDLFGSQLGNARNVVRAGHSPHFDQRFPNAIRYSSPEQSGWGVDLQGSFDWEDRDESDDPYPADGNDRTAISTALRYTGERFWAALGYERVAGRDEAPSSADAYRLGLEWRATDALRLTALVQATGDAYELDDDTYSDTLAYGAGLLYALEDDLDLRLQYYTLDVDASGHGASLVSVGPVFHASERLRLYATATYLGNDDASDLVPWEVGRTAGPSAEEAGIGTGRSAWAVGSGIRFDF

SEQ ID NO: 7569 - protein, 442 aa, Salmonella arizonae
MVMSQKTLFNKTALAVAVALVSTSAWSAGFQLNEFSSSGLGRAYSGEGAIADDAGNASRNPALIMMFDRPTFSAGAIFVDPGVDISGRSPTGADLKSDNIAPTAWVPNMHFVAPINDQFGWGASVTSNYGLATEFNNDYAAGAFGGKTDLETLNLNLSGAYRLDNHWSFGVGFDAVYAKAKIERYAGDLGKVVAGSGALPPALAQRVAGIPADTQIAYLKGDEWGFGWNAGILYELDKNNRYGFTYRSEVKIDFDGDYKSSLPSAYNQILGNFGLPMGTNGQTTGGSLSLHLPEMWELSGYNKVAPQWAVHYSLTYTSWSQFQELKATNSKGDTLFYKDESFRDAYRIALGTTYYMDDNWTFRTGIAFDDSPVPADKRSISIPDQDRFWLSAGATYAFNKDASIDAGISYMHGQKVNFKEGPYEFSSEGKAWLYGMNFNYAF

SEQ ID NO: 7570 - protein, 356 aa, Salmonella arizonae
MKKHYVAALLALAAPIAGAQTSVTLYGVADIGFEFLNHANANGNTLTRMNSGNVSGSRWGLRGAEGLGGTLKAIFALENGFDLDTGVMSQGGRLFGRQAFVGLEDQWGRITLGRQQSALYDLLINYEPMVLAARYSALGMDPALVGRYDNTAKYTGKFGPVTAIAFYSFARGSTITSATGSAIAGETPGDVKSDRAMGGGLEYASGPFGATLIYDQQQGTRGITGQNSDQTDRRIAAAANFSFGNSTILAGYRWFNGDIGGSRRNDLYWLGYRYNATPALTLTGAGYYFNNRRNGQDPWELVASANYALSKRTDAFLTVGYVRNKDNSNLGLNGFGSTITPGASQLGASMSIRHKF

SEQ ID NO: 7571 - protein, 923 aa, Salmonella arizonae
MAASHTSRMSSAFHTNFFSWRAPTWPPGSGPAPPPSENLMTFAPVHPARRPRHAVLMLAVTAALTSATVQAQQAGATFTQTTELDRVQVLGSYASSLERALNDKRYAPSVIDSIEAEDIGKLPAQNVAEALQRLPGVTIERDRGEGVYVRVRGLGPNFQVTTLNGQTMAVNENVRNSGQTGRQFRFDTLPAELVSGLEVIKSPTAALDEGAIGGVVNVKTFRPLQLGNAETHLSAELSHPQLADENDPRVSGLYNWVNADKSLGVLFAAAYAERSLRQDRVNETYWEHYADGIDGNGDGIADTGAIYAPSAIRPTLELEQRKRIGVASSIQFAPSEALEFNLDLFYARQQVDYDEFAIGTGWEPRNMRNLSIAGNAVTAFDYQNGQVQLSRETSGMTDENRSVRFSGAWQGNAWKLQGTGFVSRAHSWNDAPIRRTRLRTGTTVDQRVVFPTASGNNLPQWSFTDGYDPTDPAQTPGRRLEWRIIDAVDHERALQFDADRMLEGGVFSALKLGAKYRTRERRYDRTDLVNNSIAGRRFDASYFYPSLPVSDMLDGGNGQLPRQWLAPSEAPFWGDWPTAADLANSPTSEDLQNSYRVLEDISSAYAMLEFSTPLGGRDVRGNVGVRGVHTQQRTEGHANLDGAAQPVVFERSYNDVLPSLNVAYDLRPTMVLRGAAAKVITRPDLTDLSSKLTFNSSGEVLTASGGNPNLEPFEALQYDLTFEWYTSPSSALVAGVFYKDISRFVQTQFSNLDYQGRRYLLSSKVNGGKAKVQGVELAWQQVFTGLPAPFDGLGMQANYTWTDSEANYVDGDTTFQDALEVVAKNSYNLVGFYEKGPLSVRLSYSWRDDIVNSVGTADIATNNTRAYGTLDGNISWQITPALAVFANAINLTGEVQNMYVGDHLFSGYTDYGRTYSLGLRANF

SEQ ID NO: 7572 - protein, 792 aa, Salmonella arizonae
MMIRRNGAWRHGRFALSLLMSSAAFHSQVNALPIGMEAADAAPLLIERKADLRPFRTEASALLGEHIAQGPPAEPDPTPQSAPTVEDDGSEADLEEVVVTATRTRERLSDVARTVYVVPRRTIEQQSILTGSVVDILGNTVPGFGPPKENRVGNTLRGRDPQVLIDGIPVISNYASFYELSYIAPIAIEQIEVVGGPTAIYGDGATGGTINILTRRSTEKPQATTRAGFDLGLSNTAGGAGKFVEQFFSSQAGPVDFTIAASYRGSGNFYDAAGNRTPSLSDTLDTKNAYSAYGRFGFKLTPEQKLQLVASYSADTRYVNSFASPAVNSCCGVQQSRAIARNVVLESGYGQPVLQNFLAALDYTHENLWGSKLFAQVSYRDAFEVGIPYDFRFTPDGSGGIFDSFLRFLKGSEQVTTARAQVETPLADNLKILWGTDFKNDPVGAGIFELFDSKVFDESNQSILRTSGLVTIAPAYRVASLGAFLQTQWNISEQWVASGGLRFENVTIEAKDFFSEFAGGLVRGGSLDDSATVFNLGIVYKPTTETSIYANFAQGFSVPNFGSALFGVPSGFVLSDSLRALQPQIVDNYEIGFRGRWRSVQATLAAFFNYSALGTSTVQTGATTYENSRSPQRNYGVEATLDYQPAPGWRLGTLFGWSEGEQDFFGDGNFYPLNSFAVPPLKATAYIEHQTAPGWSNRLQLLYSGNRDRAYNALVDGFRVEGAPIYDYATVDYIGNIKFGSGTLEVGIKNLLNNLYSPVYSQAYSSFGFGPTDRFNVAARGVTLNVAYTIDY

SEQ ID NO: 7573 - protein, 372 aa, Salmonella arizonae
MKVKVLSLLVPALLVAGAANAAEIYNKDGNKLDLFGKVDGLHYFSDDKGNDGDQTYMRIGFKGETQVNDQVTGYGQWEYQVQGNTSESENQSWTRVAFAGLKFGDAGSFDYGRNYGVIYDVTSWTDVLPEFGGDTYGADNFLQSRANGVATYRNQDFFGLVDGLNFALQYQGKNGSVSGENDSGRSTLKQNGDGYGASLTYDLGEGFSVGGAMSSSKRTADQNAAGVYGEGDHAEVYSGGLKYDANNIYLAAQYSQTYNATRFGNSQGSSDIYGFANKAQNFEVVAQYQFDFGLRPSVAYLQSKGKDVSNNTTNFGDQDLLKYVDVGATYYFNKNMSTYVDYKINLLDENNFTKQAGVGTDDIVALGLVYQF

SEQ ID NO: 7574 - protein, 650 aa, Salmonella arizonae
MSAVTLAWPVAAATDDGETMVVTASAIEQNLKDAPASISVITQQDLQRRPVQNLKDVLKEVPGVQLTNEGDNRKGVSIRGLDSSYTLILIDGKRVNSRNAVFRHNDFDLNWIPVDAIERIEVVRGPMSSLYGSDALGGVVNIITKKIGQKWHGSVTVDSTIQEHRDRGDTYNGQFFTSGPLIDGVLGMKAYGSLAKRGKDEQQSSATTTTGETPRIEGFTSRDGNVEFAWTPNENHDVTAGYGFDRQDRDSDSLDKNRLERQNYALSHNGRWDLGNSELKFYGEKVENKNPGNSSPITSESNSIDGKYVLPLASVNQFLTFGGEWRHDKLSDAVNLTGGSSTKTSASQYALFLEDEWRIFEPLALTTGIRMDDHETYGDHWSPRAYLVYNATDTLTVKGGWATAFKAPSLLQLSPDWATNSCRGGCRIIGSPDLKPETSESWELGLYYRGEEGILEGVEASVTTFRNDVDNRISISRTPDVNAAPGYSNFVGFETNSRGQRVPVFRYYNVNKARIQGVETELKVPFNEAWKLSLNYTYNDGRDVSNGGNKPLSDLPFHTANGTLDWKPVQLEDWSFYVSGNYTGRKRADSATAKTPGGYVVWDTGAAWQATKNVKLRAGVLNVGDKDLKRDDYGYTEDGRRYFMAVDYRF

SEQ ID NO: 7575 - protein, 468 aa, Salmonella arizonae
MRTFSGKRSTLALAIAGITAMSGLVVVPQAQAEGFIDDSTLTGGIYYWQRERDRKDVTDDDKYKTNLSHATWNANLDFQSGYAADMFGLDIAAFTAIEMAENGDSGHPNEIAFSKKNKGYDEDYSGDKSGISLYKAAAKFKYGPTWARAGYIQPTGQTLLAPHWSFMPGTYQGAEAGANFDYGDAGALSFSYMWANQYKAPWHTDVDKFYQADKKTKVDYLHSIGAKYDFKNDLVLEAAFGQSEGYVDQYFAKASYKFDLGGNPFTTSYQFYGARDKVDDRSVNDIYDGTAWLQALTFGYKVAEVVDLRLEGTWVKADGQQGYFLQRMTPTYASSNGRLDIWWDNRSDFNANGEKAVFFGAMYDLKNWNLPGWAVGASYVYAWDAKPSTWQITPDAYYDKNRTIEESSYSLDAVYTLQEGRAKGTMFKLHFTEYDNHSNIPSWGGGYGNIFQDERDVKFMVIAPFTIF

SEQ ID NO: 7576 - protein, 991 aa, Salmonella arizonae
MYVRNMKHKILSLFFFLSLITSPVLGQSTGKLVGKIVDSESGDPVFGTVIIVRSIKAATRSDFDGKYELNLPPGEHSVEFQMIGFATQFKKITISPGARVSMNVVMGAQVLDTVEVKGRGLENSESALLALQRKSGVVSDAISEEAIKKSPDSSAGDVLRRVTGITLVGGRFIFVRGLGERYSNTILNDSVIPSPEPDKRIVPLDLFPAGVIKNIRVIKTASAEDSAEFSGGIVKIETKEYPDTLSLSVSLGVGKNTQVAGHKFKTFDTGEMNNNFGLVSKKQELPDMISGLPKAIPFVEGDRFGGIPTNLMKVGALSFNQEWSPKEEDSPFNKSFSISAGNSFKTEKWGRFGILAGTTYNRSYNYREEANARFQASNPISIYLKDSNMLRPLNQNNLKIYGEEVLWGNNLNLAYEPKIGQQFFIKTLYSVQSDKIVREGDGANYIDNFNFKSTNLNFISRTIFNNTLGGEHEVRAFSARPHKVEWNVNYALAERDEPDARNQAWSQGGTDLANGYRRLGNNPDGTRYFSSTADTVRSQSLKYEIPFNQWDGLQSKLKFGISNLDRFKHFEFREIAQRNFTGSDRDVIYPIPGEVIYNPLAYANGNRKIYERASGNNAYDASQALRAAFAQLEVPILAKLKSIVGVRYEDSYQKTKTYDLKNSWNGFNTSYGCKTNSEEERLLLVRANICDATNVGIGELRTKDKLPSANVVWEFAKDMNLRLGYSQTLTRPDLRELSPFGFAAYFQADRIFGNASLQRTYIHNYDLRWEYYITNTDYIGVGAFFKNLSNPIELIGLPVAGSASLVYKYANAQQATIRGIELDYRKELLWWLRVEANVFFIKSRVDVIDSKIYGLISTGQVDPLSTYAAYSPTTLNRPLQGQSDFVANLKVDVFVSKSKKHNIGFYYNYFSDRIALVGSDGVPNAIQKGTGTSDVVYTYRHNDRLDFRSSVRNVMNTQFKITQTDPLTGQEYVFQKYRTGLDVSFSATYKL

SEQ ID NO: 7577 - protein, 649 aa, Salmonella arizonae
MNKKIFLIVMAGLLCSKGLLAEEMVKSYTGDEVVVTSSRVEESKKNVTSSITVIGREEIEQSSAHDLGELLAEKSIGHIQKYPGTMTSVGIRGFRTETHGNDLMGKVLVLLNGRRAGTGNLAKISTGNIERIEIIRGPAAVQYGSAAIGGIVNVITSRGNGKPGLFFKQEFGSNDYTRTTMGADGKSAGVDYSGSVSFSDAGDYKTGAGDEYKNTGYSDRTVGNVNIGYEFLPHHRIGVIYNYFDVRKAGSPSYLSQNDLDAYTSQKAYSTDFIYEGSTGNRRFSWMARYFTGRDEYLYADPGTSYSSTNDVEHKGAQAQLTYDDESLRVTAGVDWIRYDLESTLAPYSSEYENPAYFLLGKYGFMSDRLVLTAGLRYDQYDVTISEGQGSSRRTDNLAEQVGLAWNVSDALKLRASYAEGFRMPSARELVADFYSWGTHYIGNPDLKPEKSRSYEAGVDIDYRNVKSSLTWFTTDFRDKIQSTAVDGAMSWINIGGATVSGLEAEFSLALHPFGEEWKIEPYVNCTWLTKYRDEDTGELLTYTPDLSATTGIRVSDQRGFSSVFNLAYTGETRVQNWEDWSGDIVVKGGYAVANISVSKKFLVDEDKKNGRGITIKGEIDNLFDREFQYVKGYTMPGRTFTIGLGADI

SEQ ID NO: 7578 - protein, 935 aa, Salmonella arizonae
MMIARTADQRRGWTILLGAASIMALATPAAAQEEAPAPAATAASDIVVTGTRVRDPNLKSSSPVTAVTNQALLLSGSPTVDRLLNNLPQIAPSQNATSNRGDGIVSVDLRKLGPSRTLVLVNGRRMVPSSGLGIVDLNSIPSALLERVEVVTGGASAVYGSDALAGVVNFILDKKYEGLGLRAETGVSDRGDGTNRLIEGTLGASFDDGRGNVVLSAGFSRRGEVRAADRKGFGVSINGGSATAPAGRIDNIGLNPNLTAGSFLGTGGTARDYAFTPDGNGIRGFINSLPTATTPGDRYNFSNKEFLQIPLERLSMAALGSYELAPSIEAFVETYFTHNKVNMRQGESPLTNGTLSPTNPLLPQVARDMLAARPNPTANASFQRRLTELGPRLQTVTTDALQINAGLRGQLWENWDWEAYYGYGRSDQTRTIRGGASQSRINASLLGCPAGTVQVLGCRLIDFFGPNSLTAADLAYIGVDNAKDKTLFTRNAASASITGPIFTLPAGAVNVALGAEYRKDSFQYQPDDIRRRGDLAGFDPSRPTAGSYDVKEVFGELVAPLLADIPGIHRLTLEVGARYADYSSVGTVFTFKAGGSWEPFADLRLRSLYQRATRAPSVFELFQGGDTSAQTFTDPCATIAPTGSVLPAPSAAVATICQLQGLADPRTNGFTQVSRTLDVNSVGNANLREETSRTITAGAVFTPHWLPGLTLSVDYYRIKVSDYINRAFSGVNGVIANCFASGVTTATALAAQPACQLLARRASGELTATLPLANVQTLKTSGLDIQANYALPLDRIGLGDVGTIDLAGTATYLRDYKTVGQDYVGRISQNFGGIPKWRTSVDLGWRNDDAGVRLQWRRIGGMVEDISQRHIPAVNYFDLNGRLEVGERIEFYGGINNLFDRKAPLVPNQIFNSDTQNYDIVGRYLFIGAKLRFRP

SEQ ID NO: 7579 - protein, 755 aa, Salmonella arizonae
MSKKAFVAGLLNGAAMVLCAAPVLAQAPVASRPVEAAQVDEIVVTANKREERLKDVPVTVSVVSGDQVAKQNVNEVTDLTRSVPSLNSAGPFGALSIRGVGSISFARSAEGSVGVVVDGVALANTSTNPPQLFDVARVEVLEGPQGTLFGRNTSAGVVNITTVAPDPSGFSASAHADVGERHTYAGRGVVNIPLADNAALRVSGSLSQAPRLQHNLFDDSWYEVQGKSVRGRLLWEPSEPVSVNLIADYSQFDRKGGVPWSVYQSTPGSRLSQRLAACGVVVGPRNQDGCTDGGYHQTTKSYGVSGQVDADLGALTLTSISAYRESDTGSSASDVDSVPINRLNINESPVNIRNFSQEFRLTSPVGQRIEYVVGLYGFDSRLRGSNTQRGVLLGDAGVPAVVGQIQTTRSSTQSYAAFGNATINVLPSLRLLVGARYGHEDVSALTTGRLASGAVAPILSIATIQGKAKDDYISYRLGAQYDLDADVMVYATYTKGYKGPSVNDQTGVGAAPIIVRPEIPHASELGVKANLIDGRLTASLAAFHNRITDFQAQFFDTTAGAFIFGNAPKLVTKGVSFNLIGRPMAGLTLNAGALYNDAKYGAGYRVSCAQGQTAAQGCVTVSPTISYDDAQGNPLVGAPKWKLTAFSEYTHTLTGGWDGFVQADVAYTSKINFDAAYSPQNTSKAATIVGGRIGVRTADERLGVSLYARNLFDTYRPVVRFATPTARQQLDPLSFSQISGPESRRTVGVSLDAKF

SEQ ID NO: 7580 - protein, 230 aa, Salmonella arizonae
MKKLKSLILLSSVISTSVFAGAYVENREAYNLASDQGEVMLRVGYNFDMGAGIMLTNTYNFQRKDELKHGYNEIEGWYPLFKPTDKLTIQPGGLINDKSIGSGGAVYLDVNYKFMPWFNLTVRNRYNHNNYSSTDLNGELDNNDSYEIGNYWNFIITDKFSYTFEPHYFYNLNDFNSSNGTKHHWEITNTFRYRINEHWLPYIELRWLDRNVEPYHREQNQIRIGAKYFF

SEQ ID NO: 7581 - protein, 325 aa, Salmonella arizonae
MACLCLANISWATVCANSTGVAEDEHYDLSNIFNSTNNQPGQIVVLPEKSGWVGVSAICPPGTLVNYTYRSYVTNFIVQETIDNYKYMQLHDYLLGAMSLVDSVMDIQFPPQNYIRMGTDPNVSQNLPFGVMDSRLIFRLKVIRPFINMVEIPRQVMFTVYVTSTPYDPLVTPVYTISFGGRVEVPQNCELNAGQIVEFDFGDIGASLFSAAGPGNRPAGVMPQTKSIAVKCTNVAAQAYLTMRLEASAVSGQAMVSDNQDLGFIVADQNDTPITPNDLNSVIPFRLDAAAAANVTLRAWPISITGQKPTEGPFSALGYLRVDYQ

SEQ ID NO: 7582 - protein, 287 aa, Salmonella arizonae
MKKTLLAVSAALALTSSFTANAAENDQPQYLSDWWHQSVNVVGSYHTRFSPKLNNDVYLEYEAFAKKDWFDFYGYIDIPKTFDWGNGNDKGIWSDGSPLFMEIEPRFSIDKLTGADLSFGPFKEWYFANNYIYDMGDNKASRQSTWYMGLGTDIDTGLPMGLSLNVYAKYQWQNYGASNENEWDGYRFKVKYFVPITDLWGGKLSYIGFTNFDWGSDLGDDPNRTSNSIASSHILALNYDHWHYSVVARYFHNGGQWQNGAKLNWGDGDFSAKSTGWGGYLVVGYNF

SEQ ID NO: 7583 - protein, 987 aa, Salmonella arizonae
MNEQSLLARSIRTILMAGVSSAFIAAPALAQDAQQDDQDVVVSASGQEVVQSENAQVEERIQVTGSRIGRIGAEAPSPVTVISGDDLVETGAMNIGEVLSRLPALATTFTLANSGRFIGTAGISTLNLRNMGTDRTLVLVNGKRHVASAPGSSSVDTNTIPSAWIDRVEIITGGASAVYGADAVTGVVNFILKKNVEGLDVTATRGYAENSDYSNEKYTFSYGTAFAGGKGNIAVSAEYNAQDSLNALDNPWTATSTASMRYEALYGPRTEDQLDDPAYPDNIVVPNAGYYAISNQGTVWDPFTGGILGTFNPDGSYRDTYIGDVNDTARLYCQDCDYINLRRYSEVQPEFSRVNYNLKGNYEFTQDVNMYWNAKYVKSEGQNIGQPFFRFFSTGAAADNYPYLFKRDNPFLPEALASQMDELGVPFLGLNRMYDDAGRRIEENTRETKRAVIGFDGMLNQDWSYDVSLVWGKSDIERVNGANVILQNMEWALDAVEDETGNIVCRSEEARADGCVPFNPFGLGMASQASQDYVTTTSVGTSEIEQTVFNATFSNSFLYELPAGHIGFAGGVEYRDESSVTVEDPFAKTGATFFNALGETDGQYDVSEIFGEISVPLLRDMFMVQHLNFDAAVRYADYSTIGGATAWKVGLDWTISDELRSRFTYSEAIRAPNIDELFSGQSQSFAGVDDPCKVSNLAQLSADGRARREANCAALGVPADFDSNYDSATLETLVGGNPDLSEETSESITAGFVYSPEWLEGFSATVDYWEIDIDDTISGIGFQTILNRCVDAETIDNQFCNLITRDPDTSEITLIRGFALNIARSLNSGVDFEFAYDFDALGGQFRTNLIGTYTIEAKDYPFADEPDNYTDYAGVLGDQDLQMQLSVQYGIDNWTFGTTTRYVDRVNLYDPTSLETNPNPSNEMQYGTYVITDVTAGYKFDNGLGLTLGVDNFFNRELPGYTTGTGAGSAIYDNIGRFAYLRASLSF

SEQ ID NO: 7584 - protein, 319 aa, Salmonella arizonae
MEMFMNKINKALSLTLATLVSMPVLAENINTDDFSFGGRIEARAALTDSDFNDKSRVRLNGQGKHEINDALTAVGKFEYELTQEDSSSDTTVKNNIRYGYVGVETAYGTLTYGTQDNAVTYLTNFTDVAEVYSGETNKGITASGDRAEDTILYSVIKGDLTFNASVNLKETENGGGLMVAYKLLPSVELSAGYAATETAVGASESSDVYMIGARYTNGGILVSGLVQKGTLADADFDAVDAFASYGFGENTVSVSYNYLSADEPSVGDVNFVAFEYGRYIGDIAAYAGYKVALNNDTTAGADYNSSNADEFIVGARYSF

SEQ ID NO: 7585 - protein, 717 aa, Salmonella arizonae
MKLVFESDSLPRRLARAVLYTHCTLGCLLVLNPASAADTTTLPGITVSPEQAGTLKSPASTGSNLDLTPMQTPASVSVITREQLEQRGDANLVDAITRSAGISGMGHPGNSGSSLSARGFTDTTSVMRLYDGTRQYGGVGVSFPFDTWSIDRIEVLRGPASVIYGDGAIGAVVNVIPKKPTRGPIQNEVQATIGTDNTQRLGFGSGGAINDKLSYRVDLSGDRSDGWVDMGDSRNLSFSGALQLDVSADFRLKLSYAQGRQEPMRYFGTPLINGQQLEALRKKNYNVSDSKIQYDDRWTELSAEWTPNADTTVRSKLYYIDSKRQWRNAEAYNYDAASGLIKRSDDTQIMHDQTQIGNTTDATFRGHLFGLKNQVSVGFDVSASSFQHTNNTYKGTPNPANVDPYNPIPGYFISDEAYIPRYRNKADQYSVFAENRLELNDKWSVLGGLRYDHADVSRTDLVSGTPAFDQKYSNVGWRLGTVYNIEPDTALYAQYSEAADPVGGLLMITAANSKFDLSTGKQIEVGVKQAFWGKKGEWTLAAYNIKKNNLLSRDTTNPALRIQVGQQSSTGLEGTLALAFAPGWQLDANAAILRAKFDDFNDSVGGVAVSRSGNVPPNVAERLANVWLSWNFVPDWTASGGLRYVGKRYADNANTLVMPAYTTTDLALQWKASRDTTLTLRGFNVFDKQYFTTAYYSGTQWFNGPGRRIELTANYRF

SEQ ID NO: 7586 - protein, 729 aa, Salmonella arizonae
MARLKTAQPNSSLRKIAVVVATAVSGMSVYAQAAVQPKEETITVTAAPAAQESAWGPAPTIAAKVSATTTKTDTPIEKTPQSVSVVTNEEMQMHQFQSVKEALGYTPGVTVSSRGASNTYDFVIIRGFSSVGLSQNNYLDGLKLQGNFYNDAVIDPYMLERVELMRGPTSVLYGKSNPGGIISMVSKRPTTEPLKEIQFKMGTDNLFQTGFDFSDSLDDNGEFSYRLTGLARSTNEQQKSSESQRYAIAPSFTWRPDEKTNFTFLSYFQNEPETGYYGWLPKEGTVEPLPNGKRLPTDFNEGASNNTYSRNEKMVGYSFEHGFNDTFTVRQNLRFVEMKTAQKSVYGTGIAADGHTLNRGTIVDNERLQNFSVDTQLESKFATGDIDHTLLTGVDFMRMRNDINATFGSAPSIDLYNNYHPEYFAFGGAEPYQMNESKQTGLYVQDQAEWNKWVFTLGGRYDWSKQATTVRQNSTTPTEGYIERNDHQFTWRGGVNYVFDNGISPYFSYSQSFEPSAFDLWSTPRVSYKPSKGEQYEAGVKYVPKDMPVVVTGAVYQLTKTNNLTADPTNPLAQVPAGEIRARGVELEAKAALTANINMTASYTYTDAEYTKDTNLKGNTPEQVPEHMASLWGDYTFNEGPLSGLTLGTGGRFIGSSYGDPANSFKVGSAAVMDAVVKYDLARFGMAGSSIAVNVNNLLDREYVASCFQTYGCFWGAERQVVATATFRF

SEQ ID NO: 7587 - protein, 996 aa, Salmonella arizonae
MKKFTVKPIAAAMSGLALVSLSQSLIAQETVDPTVEEVVVTGYAKSIQNALDVKRNADTVVQAISAADIGGLPDVSIADALGRVPSITVTRSGGQASTIQIRGMGEGFVFSTLNGREQVSPNGTRAMEFSQFPSELIQSVEVYMSPKASLIEGGVAGSVELKTANPLEMSENQKVMVSVRGSFNDQAEDIYGADPYGRRLSISYQKKLFDDTLGVAVGYAHMYQPRAAVRFEHYNLDQALNLWDEANLGINVLDSNLNQVDPSQRPTLVAISDGFELFQTGGEETRDGYVASVQYEPNDQLAVQADIFYSDFESNSFNRGFRVQPIAQADIANVILWNNIAVIGGEFGVYDSIQQRDSFNFQINNNDVTQKNDLLSSGLNVKWKEDALTLSLDLSHSDSSGNQAEAVTRAHLYREAENLVPGQDPYERDPNQSVSYLLDGINLPSISMNRDYTYFDEQGVSNVRLTSYERYPRISDDKIDAVRFDVKYDTELGLLKSVETGVRYSERNHKERRQVFVYGTDGAGSSRYYQSDFSLPITTDTADIVNWKGDFSHFPSFLAIDGDAIIQSASNLGLVRGITPVPTEENLDPEAPRRSITPAARWGEDRAWSMLQRADIDENVTAVYLQANIETTLAGRDLTGNIGVRHVRSDQSSRAIVNVNGDVNAGAVEICDELGECRTDYAYKDIGIKYSDTLPSINLNYSLADSHQLRLAMARVLSRAPINRLAAPDSTGSVELRGDIPYFNYGSNTSPFLKPFIADQIDLSYEWYLEETNGAIVIAGYHREIKSFIQDITIENFDFRAAGFDVPDTWPVELGGLVSEVEVQNGTYSTSINNLDGGFIRGLELSYTQTFNFLPELFSGLGLTASYSWTDSEITVVNPVDSDLNSGTLPFPGLVENSAKLTVFYSYGGFETRVSTTYQDSFVGETRNINLNPIVYAPETVVDYQAAYKFDNGLDLVFSINNLTNEPNRNYMFNEDLTRTLQWFGRTFYLGANYTF

SEQ ID NO: 7588 - protein, 258 aa, Salmonella arizonae
MKIISRFKDFYDYKVAKYGVDEKLVYNRKTYYDYYKILHINILTDENGRVSIEDFNNNLKENIKYFKHNNHNKVLIVGEKIVHLFFTEDKVYTHFDIKNPEKIADHIYKYWAYYTDTKEIIFNDEKKFEFFITFNDIWNDLFSYNRKRFLSYLNTPNDDILFNEPMILIEYVGKADRKTVRFDNSIYKITYNPNLSQMGIYFDEDFIWQSLVEFLSNKRSEKEITPEVSNKNKILSKGFDLKTSFRPNMKKKKHKGDV

SEQ ID NO: 7589 - protein, 373 aa, Salmonella arizonae
MRKLAILAALASTALAAPSFARDNAWYVGVEGGGLLQEDMKFDVGPSTLSPGGRATVDSKTGFDVDGIVGYDFGMFRLEGEVGYKRDRVNSFTTSASRTPAAVGGAGAPAGTYPDASGKNSALSFMVNGLLDFGGEEGFSGYIGGGAGIARVKFAGYNVSGDDFLNDSDSKFAWQAIAGVRYPVSTNVDVGLKYRYFNVKDAKVFDRLGAEYEGTWRSHSLLLSLVYNFGEPAAPPPPPPPPPPPPPPPPPPPPPPPVVETPGPFIVFFDWDKSDITAEAASILDNAANAYATTGQARVQLAGHADKSGSDQYNVGLSQRRADAVKAYLAGKGVPDSAITTEAFGESRPLVDTADGVREPQNRRVEITFGAGM

SEQ ID NO: 7590 - protein, 713 aa, Salmonella arizonae
MELRVGLLAVLLATVSRVALAQDATALERLEVRASNANATIGTAVEDYAGGQVARGGRVGFLGNRDFMDTPFNITSYTAATIENQNAKTVADVLANDPSVRSTHASGGMLDSFYIRGFPLNEGNFGEVAFDGVYGVAPTYRLFTDYIERVEVLKGPTALLYGISPNSSVGGTVNIVPKRASDVDLTRVTTDYASDLYGGGHLDVSRRFGDQRQFGVRFNGSYHGGDTAIDNHSLDVAVGALALDYEGEDFRATLDVVGQRQDIDAPLRPFFPFGSFEIPDAPAGRSNIQEPWEWARTDDLSWLGRVEYDVSDAVTVFAAVGGGNSRVERLFGTPLLLNSAGDVSVTPQNFVFDVDRLTAEAGVRAEFETAAIDHSVTFQVSGLQQSLARGSNSGTAQLTNIFDPLPRPEQDVPQPTHVPRVSENIFHGFALSDTMSMFDERVQLTLGGRWQHIDTENYSPVTGDVSSSSDESALTPLAGIVVKPWENVAFYANYVEGLSVGDTAPTTAVNSGETLAPYRSRQYEVGTKVDLGRVAVTVSAFQIEKPFGVLEARGSDLVFVEGGEQRNRGVELNVFGEVTPEIRVLGGVTFIHGEITKTNDDATRGNTPIGVPSLQVNLGAEWDTPFLTGLTLTGNVIHTDEQFVNTANTQEIPSWTRLDLGARYLTEISERPVTLRANVENVFDLDYWSGVASFGTISQGAPLTVKVSMTTDF

SEQ ID NO: 7591 - protein, 185 aa, Salmonella arizonae
MVHWRRSRPPEVPPLGGCLVRWQPGGAVTVGSDTVLGVEIGYAVTPNWTARLDVGSPVETDLGGAGTLSPLGKLGSVKGGPAILTMTYSPGMLGPIRPFFGGGLTYLRVFSTKDGAVQNLKVDDGLGTALTIGADWPLSDGYSIGFSVQKLFLKVKATGTAGGAPVRADVKLDPVLTFLSLRKQF

SEQ ID NO: 7592 - protein, 764 aa, Salmonella arizonae
MGMFQTTTKATGRTLLLCTVGAVALTIQIPQGAHAQSNLPAVTVDAPRAERARTARPVATTRAGTTRRIAARRDARPPAPVAPVPYVTPSTGTLGALPASYAGGQVANGGQVGFLGNRSLLDTPFSQTNYTAKLMQDQQARTIRDVVANDPSVRAVTSAGGGQDGYFIRGFYYDVGDLALNGMYGMAPFWSVGANFVERVEILKGPTALLTGISPLGAVGGSINLVTKKAPDYDITQLTATYASRSQFGLQADVARRYGEHKEWGVRFNGSYSDGKTPFDRQSSEFGNAVLGLDYRGENVRVSADVGYQANNLNPPIRFFSFQSSVVPLPPAPAANSNAIPDWAYWKPKDTFATVKAEVDVTPGLTVYGAAGYHQAKIDFKFLSPTIINQAGDYGSRPFAGEQTFTAKTGEVGVRGEADTGAINHKFVVNYGVFDRPNENSYLASPGLVGSNVYNYKAIPEPLFSIPSSSSVSLKQWSVGAADTMSILNGGVQAVVGVRRQHVSNSSTDLLTGVTTGQDGAAWSPAYALLIRPLSNVTLYANYIEGLQPGTTVGIGYDNVGQVFPPFQTKQVETGVKVDFGKISVTGSLFEIKQPSAIASSANGVLTLSADGEQRNRGAELNVFGELAPGLRLLGGATFMDGVLEKTDRGLNDGNRAPGVARVNVNLGAEVDVPGIDGFTLTGRVVHTGWTYANAANTQVLPAWTRFDLGARYTFLSPWNGKPIVVRAAIENVENVAYYASSYSGSAIGLGAPRTYLLSTTFNF

SEQ ID NO: 7593 - protein, 380 aa, Salmonella arizonae
MKRKVLALVIPALLAAGAAHAAEVYNKDGNKLDLYGKVDGLHYFSDNSGSDGDQTYVRFGFKGETQINDQLTGYGQWEYNVQANTTEGEGANSWTRLAFAGLKFGDYGSFDYGRNYGVLYDVEGWTDMLPEFGGDSYTYADNYMTGRANGVATYRNTDFFGLVDGLSFALQYQGNNENSGNGNEGTNNRTDDDDFRRENGDGFGISTTYDFGMGFSAGAAYTTSDRTNDQVSRGEQYAKGDKADAWTAGLKYDANNIYLATMYSETRNMTPYGSLDSYAHGGVANKTQNFEVTAQYQFDFGLRPAVSFLMSKGKDLVNNGVNDDKDLVKYADVGATYYFNKNFSTYVDYKINLLDDDDNFYADNGINTDDVVALGMVYQF

SEQ ID NO: 7594 - protein, 183 aa, Salmonella arizonae
MKIALTTLISASLLSVPVLANNFDSQHRVGIGYNQTQVDDWLTDDTVDWGNGIKLEYGYEFNRIVGINVSYATNSDDENVEGIKAEIDGYKFQVDADIGYKFELDGFSLKPYGVLGLARQSEDNSISILDKKWTESYNDTSFVVGLGGRAEFGPHLYTDMRFEFASYDDVDYETFSWTVGYRF

SEQ ID NO: 7595 - protein, 171 aa, Salmonella paratyphi B
MKKIACLSALAAVLAFSAGSAVAATSTVTGGYAQSDAQGVANKMNGFNLKYRYEQDDNPLGVIGSFTYTEKDRTNGAGDYNKGQYYGITAGPAYRLNDWASIYGVVGVGYGKFQTTDYPTYKHDTSDYGFSYGAGLQFNPMENVALDFSYEQSRIRSVDVGTWIAGVGYRF

SEQ ID NO: 7596 - protein, 1923 aa, Salmonella paratyphi B
MQKKKLISIAIALTLQSYYIPAIAAENNDDEKECPSNISSLPKEKRAKLSPTCLATPENDNHWGWVAGGVAALVAGVAIGVENNGGGDSNHSYTPPTPDNGGDDNVIPPDDSGDDDVTPPDDSGDDDVTPPDDSGDDDVTPPDDSGDDDVTPPDDSGDDDVTPPDDSGDDDVTPPDDSGDDDVTPPDDSGDDDVTPPDDSGDDDVTPPDDSGDDDDTPPDDSVITFSNGVTIDKGKDTLTFDSFKLDNGSVLEGAVWNYSEQDNQWQLTTADGKTLNVTGWDVTDANAAVIEGTQENGLYWKYDSRGYLIIADDNTTVISGDDQAHNSDRGMDISGQDRTGVIISGDRTVNTLTGDSSVTDGATGMVISGDGTTNTISGHSTVDNATGALISGNGTTTNFAGDIAVSGGGTAIIIDGDNATIKNTGTSNISGAGSTGTVIDGNNARVNNDGDMTITDGGTGGHITGDNVVIDNAGSTTVSGADATALYIEGDNALVINEGNQTISGGAVGTRIDGDDAHTTNTGDIAVDGAGSAAVIINGDNGSLTQAGDLLVTDGAMGIITYGTGNEAKNTGNATVRDADSVGFVVAGEKNTFKNKGDIDVSLNGTGALVSGDMSQVTLDGDINVVSVQDSEGVFSSATGVSVSGDSNAVDITGNVNISADYGQDDLAAGAPPLTGVVVGGNGNTVTLNGALNIDDNDLSAASGQYLDVVGLSVTGDDNDVEIDGGINITHSEDPLDGTSADITGISVSGNSTVTLNGHSTIDTNTVVGGHVVLARVNNGGSLILGDDSVVDVNVSYIPTGYYTYNALLMADGEGTSIENKGDITSHGVYSVIRADNGSEVSNSGDILVYATSSNSSEDRAAITRASGEGSAVHNKAGGDITLISDQTPQGSGGIEVYPLKWYTHTFYAMMASDYGDVVNDEGATIHLQGAGVYGVTASRGKALNEGDIYLDGLVPTLDDENNITSTSYWQPSSLYLTSSGMVAGSTDADGDATAINTGNITVNNAGFGMMALNGGTAINQGVITLTADDGVTGQADELVGMAALNGGVVINDTSGVINIDADYGQAFLSDSSSYIINNGSINLNGSPMDDTDSHMGGTPTDKIWIQSLPGSGDSDTRTSDTGFFTAGTLANYGTETLNGDVDVNGGWLYNEAGASLTVNGTVTINGGANALANYGTLDADAISTWHSLFNEADGSITTDLLTLNGDVTFYNNGDFTGSIAGTSYQQEIVNTGDMTVAEDGKSLVSGSFYFYNEEDATLTNSGSAVEGGENTIINLTRANDSLTQVNSGTITATNGYSAITTANGSNDPKWIWNTATGVINGINPDAPLINLGRGYNFGNQGTINVQGDNAVAISGGTSSYVINLVNSGTINVGTVQGKEDGTNGTGLIGIKGNGNATTINNTADGVINVYADDSYAFGGKTKAIINNGEINLLCDSGCDIYAPGTTGTQNDHNGTADIVIPDATTAPTEGSIPTPPADPNAPQQLSNYIVGTNADGSSGTLKANNLVIGDNVKVDTGFTSGTADTTVVVDNAFTGSNIQGADNITSTSVVWNAQGSQDADGNVDVTMTKNAYADVATDSSVSDVASALDAGYTNNELYTSLNVGTTAELNSALKQVSGAQATTVFREARVLSNRFTMLADAAPQIKDGLAFNVVAKGDPRAELGNDTQYDMLALRQTLDLTASQNLTLEYGIARLDGDGSKTAGDNGLTGGYSQFFGLKHSMAFDEGLAWNNSLRYDVHNLDSSRSVAYGDVNKIADSDMRQQYLEFRSEGAKTFTMMSDTLKVTPYAGVKFRHTMEDGYKERSAGDFNLSMNSGNETAVDSIVGLKLDYAGKDGWSATATLEGGPNLSYSKSQRTASLQGAAGQSFGVDDGQKGGGINGLATIGVKYSSNDTALHLDAYQWKEDGISDKGFMLNVKKTFR

SEQ ID NO: 7597 - protein, 392 aa, Salmonella paratyphi B
MNRKVLALLVPALLVAGAANAAEIYNKNGNKLDLYGKVDGLRYFSDNAGDDGDQSYARIGFKGETQINDMLTGYGQWEYNIKVNTTEGEGANSWTRLGFAGLKFGEYGSFDYGRNYGVIYDIEAWTDALPEFGGDTYTQTDVYMLGRTNGVATYRNTDFFGLVEGLNFALQYQGNNENGGAGEGTGNGGNRKLSRENGDGFGMSTSYDFDFGLSLGAAYSSSDRSDNQVARGYGDGMNERNNYAGGETAEAWTIGAKYDAYNVYLAAMYAETRNMTYYGGGNGEGNGGIANKTQNFEVVAQYQFDFGLRPSIAYLQSKGKDLGGQEVHRGNWRYTDKDLVKYVDVGMTYYFNKNMSTYVDYKINLQNEDDDFYANNGIATDDIVGVGLVYQF

SEQ ID NO: 7598 - protein, 468 aa, Salmonella paratyphi B
MRTFSGKRSTLALAIAGITAMSGWIVVPQAQASGFFDDSTLTGGIYYWQRERDRKDVTDGDKYKTNLSHATWNANLDFQSGYAADMFGLDIAAFTAIEMAENGDSGHPNEIAFSKKNKGYDEDYSGDKSGISLYKAAAKFKYGPVWARAGYIQPTGQTLLAPHWSFMPGTYQGAEAGASFDYGDAGALSFSYMWTNEYKAPWHTEMDKFYQADKKTNVDYLHSIGAKYDFKNDLVLEAAFGQSEGYVDQYFAKASYKFDLGGNPFTTSYQFYGARDKVDDRSVNDIYDGTAWLQALTFGYKVAEVVDLRLEGTWVKADGQQGYFLQRMTPTYASSNGRLDIWWDNRSDFNANGEKAVFFGAMYDLKNWDLPGWAVGASYVYAWDAKPATWQSNPDAYYDKNRTIEESSYSLDAVYTLQEGRAKGTMFKLHFTEYDNHSNIPSWGGGYGNIFQDERDVKFIVIAPFTIF

SEQ ID NO: 7599 - protein, 234 aa, Salmonella paratyphi B
MIVRKRRGRRTLRCLAGLMACSFFINTTYAWQQEYIAEAAPGHTTERYTWDSDHQPNYNDILAERIQSTQNTVGLVLSLADETPLDATSGIIMGWNFPLSRRVTTGPVAALHYDGSTSSMYNEYGDSATTLALTDPLWHASVSTLGWRVNSQFGDVRPWAQISYNQQFGENIWKAQSGLSRMTAGNQAGNWLDVTVGADVLLNPHMAAYAAFSQAENSATDSDYLYTLGVSARF

SEQ ID NO: 7600 - protein, 246 aa, Salmonella paratyphi B
MMIIPALDLIDGTVVRLHQGDYGKQRDYGNDPLPRLQDYAAQGAEVLHLVDLTGAKDPAKRQIPLIKTLVAGVNVPVQVGGGVRSEEDVAALLEAGVARVVVGSTAVKSQDMVKGWFERFGADALVLALDVRIDEQGNKQVAVSGWQENSGVSLEQLVETYLPVGLKHVLCTDISRDGTLAGSNVSLYEEVCARYPQVAFQSSGGIGDIDDVAALRGTGVRGVIVGRALLEGKFTVKEAIACWQNA

SEQ ID NO: 7601 - protein, 751 aa, Salmonella paratyphi B
MNKKIHSLTLLVNLGIYGAALPVMAEDKTDSAALTNEDTIVVTAAQQNLQAPGVSTITADEIRKNPPARDVSEIIRTMPGVNLTGNSTSGQRGNNRQIDIRGMGPENTLILIDGKPVTSRNSVRLGWRGERDTRGDTAWVPPEMIERIEVLRGPAAARFGNGAAGGVVNIITKKGGSEWHGSWNTYFNAPEHKDEGATKRTNFSLNGPLGGDFSFRLYGNLDKTQADARNINQGHQSERTGSYADTLPAGREGVINKDINGVVRWDFAPLQSLELEAGYSRQGNLYAGDTQNTNTNQLVKDNYGKETNRLYRQNYSLTWNGGWNNGVTTSNWVQYEHTRNSRMPEGLAGGTEGIFDPKASQKYADADLNDVTLHSEVSLPFDLLVNQNLTLGTEWAQQRMKDELSNSQTFMGGNIPGYSSTNRNPYSKAEIFSLFAENNMELTDSTMLTPGLRFDHHSIVGDNWSPSLNLSQGLGDDFTLKMGIARAYKAPSLYQTNPNYILYSKGQGCYATGAGTGIGCYMMGNDDLKAETSINKEIGLEFKRDGWLAGITWFRNDYRNKIEAGTVPLQRINNGKTDVYQWENVPKAVVEGLEGTLNVPVSDTVNWTNNVTYMLQSKNKETGERLSIIPQYTLNSTLSWQVRQDISLQSTFTWYGKQEPKKYDYQGNPVTGTDKQAVSPYSIVGLSATWDVTKNVSLTGGVDNLFDKRLWREGNAQTVRDTQTGAYMAGAGAYTYNEPGRTWYMSINTHF

SEQ ID NO: 7602 - protein, 656 aa, Salmonella paratyphi B
MTQKRTLLKYGILSLALAAPLSACAFDSLTVIGDSLSDTGNNGRWTWDSGQNKLYDEQLAERYGLELSPSSNGGSNYAAGGATATPELNPQDNTADQVRQWLAKTGGKADHNGLYIHWVGGNDLAAAIAQPTMAQQIAGNSATSAAAQVGLLLDAGAGLVVVPNVPNISATPMLLEAVITAGLGAAAPPALKAALDALAEGATPDFASRQQAIRKALLAAAATVSSNPFIQQLLVEQLLAGYEKAAGQASALTDYYNQMEEKGLEQHGGNIARADINGLFKEILANPQAFGLTNTVGMACPPGVSASACSSAMPGFNASQDYLFADHLHPGPQVHTIIAQYIQSIIAAPVQATYLNQSVQSMAQGSRTTLDSRYQQLRQGENPVGSLGMFGGYSGGYQRYDNNEADGNGNHNNLTVGVDYQLNEQVLLGGLIAGSLDKQHPDDNYRYDARGFQAAVFSHLRAGQAWLDSDLHYLSAKFSNIQRSITLGALRRVEEGETNGRLWGARLTSGYDFVMMPWLTTGPMLQYAWDYSHVNGYSEKLNTSTSMRFGDQNAHSQVGSAGWRLDLRHSIIHSWAQINYRRQFGDDTYVANGGLKSTALTFSRDGKAQDKNWVDIAIGADFPLSATVSAFAGLSQTAGLSDGNQTRYNVGFSARF

SEQ ID NO: 7603 - protein, 955 aa, Salmonella paratyphi B
MPTPQNYSFIAIAVSAALASMVFPSQAAWVDVDSLPSSGLVSQLPPELQAIIPAQASTGFTKVGTMPNYVYQWNTGTIPVYGNGLTLNGPGAEAFEHTVTVIQNSGTGNPGVIFGNDLTIRTQSANAANNGRDVDGIRTHGANTPDNPVFIITGDRTNIYVDGQDGDGINAGYNSLGQGWTGSANIYVGDDLYIKTTGSQGRGITANAMRDASRAKNTIVVGNRAHIVTTGDSSEGLRTGQSGSLIRLGDDATIETSGASSTGIYAASSSRTELGNNATITVNGASAHAVYATNATVNLGENATISVNSASKAASYSKAPAGLYALSRGAINLAGGAAITMAGDNSSESYAISTETGGIVDGSSGGRFVIDGDIRAAGATAASGTLPQQNSTIKLNMTDNSRWDGASYITSATAGTGVISVQMSDATWNMTSSSTLTDLTLNSGATINFSHEDGEPWQTLTINEDYVGNGGKLVFNTVLNDDDSETDRLQVLGNTSGNTFVAVNNIGGAGAQTIEGIEIVNVAGNSNGTFEKASRIVAGAYDYNVVQKGKNWYLTSYIEPDEPIIPDPVDPVIPDPVVPDPVDPDPVDPVIPDPVTPDPVDPDPVDPEPVDPVIPDPTIPDIGQSDTPPITEHQFRPEVGSYLANNYAANTLFMTRLHDRLGETQYTDMLTGEKKVTSLWMRNVGAHTRFNDGSGQLKTRINSYVLQLGGDLAQWSTDGLDRWHIGAMAGYANSQNRTLSSVSDYHSRGQVTGYSVGLYGTWYANNIDRSGAYVDTWMLYNWFDNKVMGQDQAAEKYKSKGITASVEAGYSFRLGESAHQSYWLQPKAQVVWMGVQADDNREANGTLVKDDTAGNLLTRMGVKAYINGHNAIDDNKSREFQPFVEANWIHNTQPASVKMDDVSSDMRGTKNIGELKVGIEGQVTPRLNVWGNVAQQVGDTGYSDTRGMLGMKYSF

SEQ ID NO: 7604 - protein, 377 aa, Salmonella paratyphi B
MTIKITALAASIGAAVAFMPFATQAEITVLKQDPQAGNPLSRLNFTVGGSIRPQFQNMTGNDGANGYKRNGFDGGTRFRFAADYYLFDDISWISYYELGVNIPAVFDWDNHYAKGATDTTRRMLYTGFKSATWGTLTFGQQNSIYYDVVGAKTDIWDYDMIGQAPGNGINGDYDGSYRTRKSLKYKKSIGNVDLYASYLFSDDYNANNGLNYKRKGGGSLGADYHLTDDLTWGTAWNYTRAEMRGNGNKTYDQNIVGTALSWTPENWTIAAGGGWYQNFMTTKKVSVNDYFAGDAWGLEYFVGYAFPIGQYAVKAIQPYFMGDRIEYVNGRDYLRTDNGVGITFQLDYGFRVDYEHVFTSSTDNLGDMNLVRLRYDF

SEQ ID NO: 7605 - protein, 212 aa, Salmonella paratyphi B
MKKFTVAALALTTLLSGSAFAHEAGEFFMRAGPATVRPTEGAGGTLGHLNGFDVSNNTQLGLTFTYMATDNIGVELLAATPFRHKVGTGATGDIATVHLLPPTLMAQWYFGDSSSKVRPYVGVGVNYTTFFDNDFNDNGKKTGLSDLSFKDSWGAAGQVGVDYLINRDWLIGASVWYMDIDTTANYKMGGVQQHDSVRLDPWVFMFSAGYRF

SEQ ID NO: 7606 - protein, 287 aa, Salmonella paratyphi B
MKKTLLAVSAALALTSSFTANAAENDQPQYLSDWWHQSVNVVGSYHTRFSPKLNNDVYLEYEAFAKKDWFDFYGYIDIPKTFDWGNGNDKGIWSDGSPLFMEIEPRFSIDKLTGADLSFGPFKEWYFANNYIYDMGDNKASRQSTWYMGLGTDIDTGLPMGLSLNVYAKYQWQNYGASNENEWDGYRFKVKYFVPITDLWGGKLNYIGFTNFDWGSDLGDDPNRTSNSIASSHILALNYDHWHYSVVARYFHNGGQWQNGAKLNWGDGDFSAKSTGWGGYLVVGYNF

SEQ ID NO: 7607 - protein, 970 aa, Salmonella paratyphi B
MHSWKKKLVVSQLALACTLAITSQANATTYDTWTYYDNPTTALDWTNMDNPGTVDGNYVNYSGFVYYNNTNGDFDQSFNGDTVNGTISTYYLNHDYTDGTNGNANQLDIANSVIHGSITSILPGGYLAHNGAYDMGYGYRQPGDAVIDTTWHDGDVFTLNIANSTIDDDYEALYFTDYYKDGDVTKSTNGLFDVSEGVAVNLDVESNINISNNSRVAGIALSQGNTYNEAYTTESHTWDNNINVSNSTVTSGSNTILESSGYGHFGNSDEPSDYTGPGDVALSFQDSSSSDYAMKNNAYFSNSTLMGDVAFTSTWNANFDPIGHDSNGDNVPDTNGGWADDGLNVDELNLTLDNGSKWVGQATIDAKTIYPANMYDVAVNSLDPAGTAEANGWNRIVDNKVFQSGVFNVTLNNGSEWDTTGDSLIDTLAVNNGSQVNISNSDLTSDTIDLTNGSSLNIGEGGYVDTDHLTIDSYSTVDLTESTGWSTYSNLYANTITVTNGGVLDVNVGQFDTEVFSTDKLELTSGNTADHNGNVVSGVFNIHSSDYVLNADLVNDRTWDTTQANYGYGTIAMNSDGHLTINGNGDINNGDELDNSSVDNVVAATGNYKVRIDNATGAGSVADYKGNELIYVNDVNTDATFSAANKADLGAYTYQAKQEGNTVVLEQMELTDYANMALSIPSANTNIWNLEQDTVGTRLTNARHGLADNGGAWVSYFGGNFNGDNGTINYDQDVNGIMVGVDTKVDGNNAKWIVGAAAGFAKGDLSDRTGQVDQDSQSAYIYSSARFANNIFVDGNLSYSHFNNDLSANMSDGTYVDGNTSSDAWGFGLKLGYDLKLGDAGYVTPYGSVSGLFQSGDDYQLSNDMKVDGQSYDSMRYELGVDAGYTFTYSEDQALTPYFKLAYVYDDSNNDADVNGDSIDNGVEGSAVRVGLGTQFSFTKNFSAYTDANYLGGGDVDQDWSANVGVKYTW

SEQ ID NO: 7608 - protein, 698 aa, Salmonella paratyphi B
MFMFATTRMALLIGGAIGGATFPLFAQETTKNDTVIVTSPVQSGATKLATPDIETPQSVSIITRQQFEEQGATSVRQAVSYTPGVYSNQIGASNRFDYIVLRGFSDGSLDNVYLDGLKMMGDTNSHSSLVVDPWFLEDIEVVRGPASVLYGRSSPGGIVSLTSRKPAFDAGGEVKLFAGNNNQRGAAFDVTGPLDDNERVAARLSGMTRYADSQFTPLKEERYALMPSLTWRITDRTRLDLMAYLHRDPEGGSHSGLPYQGTVVPYNGGKISNTFFEGEDDYDKYDRRENMVGYNIEHLFDNGWSVRQKLRYLHTKVTLNQVYAAGWLNETALNRGYSGSGEKMSAIALDNQLDGSVDTGAINHRLLVGIDYQDRSNHTTGYYGAFPPIDAFNPVYGAQPDYITLYSREQHKLRQTGYYLQDQMSWDRWRFTLGGRYDRVSVSNIDKLHDSRSDLDKNNVSTRAALLYLFDNGVAPYLSYSTAFTPTSFADENGNVLEPMKGKQWEAGVKYEPPGGNSQFSAAVYRINQTNIATKEEPTDPYRSIGEIESKGVELEAISHLSDSVRLQAAYTYTDIRYKKSSPQEQGKRAVYAPRNQASAWLSYDVKSGLLEGLTLGSGIRYVNGVTSDRLNTHTLPSYTLVDMVVGYDLSSIGLNGLSAQLNVNNLTDKRYVAACNSLSYCYFGAERSIVGSVSWAF

SEQ ID NO: 7609 - protein, 174 aa, Salmonella paratyphi B
MKRRSSFLVFLGLLLASPLALANDQHTVSFGYAQTHLSSLKNSDSKDLRGFNFKYRYEFNETWGMLGSFTATRNEMENYTWKEGKLHKNGSDSVDYGSLMFGPTYRFNDYVSLYGNACIATMKFNKHSKEDSFAYGAGVIFNPVKSISIDASWEASRFFAVDTNTFGVSVGYRF

SEQ ID NO: 7610 - protein, 762 aa, Salmonella paratyphi B
MSIHSKSVARDPFTLATKQKFLNLSLLSLSILSVWGQAHAETVSSTARSSEDVAQLETVVVTATRREESLQKVPVAVSVISGKELDKQQRNSLETLVTQVPSVNFRAGASNKDTSLFVRGIGTVTTSPGVEPSVSTVIDGVVYSRPGQATLDLLDVERIEVLRGPQGTLFGKNASAGVVNIVTKNPTSETSGYIDAYATNDGEQRIKLGASGTLIPEKLTANVSALLGNFDGNVDNLTTNQDVNGYKNYGFRTKFEYTPTDSLVLGFTADYLHKKGSAPTGIVVKNTDANYAAALSPVVASPTNRSTVENTQASTDDTNQGVALTADWTLTNHQLSSITAFRQWKNTQIGDSDQLAAPTPNFAGIADLGHVNSKQFSQEIRIKPLDHGFFDYVAGLYFSKNKNDETYQRESTWYNNASNAYVLDFGKAIYNTDSTNYAAFGEGTFHFTNRLRWIAGLRVTRDELSYDHSRVSTVPSSIGVRNAIRSSFSSDGSTSETGVSGRIGPQYDFTPNILGYFTYSRGYKGPAYNVYFNMQQNDTPVIDPETANSYELGLKSQWLNNRLRVNVALFNTDYDNYQANFRTLDPNGFPITRLVNAGSVSTYGAEIDSVYKINPNWALNFSGAYTHARIDDFKCPAADTSCPNVNGKPLPFSPDWKFNTQLDRYFTLANNKQIELSTQYAWQSKVQFSLDQNQNTIQGAYGLLNASIALADTASDWRLALNVRNITDKSYATLLSTNGSRITRQVSRDDERYFGISFRKNF

SEQ ID NO: 7611 - protein, 239 aa, Salmonella paratyphi B
MKNFFAVCIIPLVVAWSATASAKEGIYITGKAGTSVVNVYGINSTFSQDEIVNGHATLPDRTKGVFGGGVAIGYDFYDPFQLPVRLELGTTFRGETDAKGGQDIIAFGQPVHINVKNQVRMTTYMVNGYYDFHNSTAFTPYISAGVGLAHVKLSNNTIPVGFGINETLSASKNNFAWGAGIGAKYAVTDNIMIDASYKYINAGKVSISKNHYAGDEHTAYDADTKAASNDFMLGITYAF

SEQ ID NO: 7612 - protein, 777 aa, Salmonella paratyphi B
MPLYPPRQGTPGTPAHFRFAAGYAGPARPPCRMAPIVAAAALLGAPPAGAESPASAYAPTLATRADLTLDPVVVTATRSRTALSRTPASVSVVSDTDLEEQQADNLKEALRYEPGVTVRRSAFRPTSAASSGSTGGLGGNQGINIRGLDGNRILLMEDGIRLPAAFAYGPLNAGRGDYADMALLRSIEILRGPASSLYGSDGLTGAVNFTTKNPQDLLDVFGKASYFGLRSGYDSTDRSFGTTVSTALGGERFQGMLIADGRRGHAVDNQGSNGSVGAARTTPNPQDTYNTALLGKLVFKATASDTFKLTGESVRQRIDSDALSAVTSTLRSLRSADRLENQRVSLDYDYADADNRWFQRVHSLIYFRRAEIEQAQDETNAASQRSRDNHYRDRTFGLSSQLESSFLTGTLSHKLVYGVDASVSRIDSDRSGTGPAASDNFANKVFPDTGYTLLGAFVQDEIRRGGLSVIPALRYDSYRLTPRNPGDPLYTGAQAGSSDGALSPKLALMYAFAPAATAYVQYARGFRTPTPDQVNNSFTSTAGARVYYRSIGNPGLKPETSDTVEVGLRGKLDTTQGPMHYSVAAFAGRYRNFIDQVTIGGSITSPANPLTYQYVNVSRAFIRGVEARGEWRLPVGVKLRAAAAYTRGTAEDANGASTPLNSINPLQAVFGARYEPGERWFAQTDMTWQMAKSPSAIRPPGTGATADFATPSSLVVDVSGGYRLNRHATLYLAVRNVFDRKVWNWSDVAGLGLANSTVLDAYTAPGRTFAASVKIEF

SEQ ID NO: 7613 - protein, 200 aa, Salmonella paratyphi B
MWKVTADFGVNFKEAEFYSFIESNVLNHAVAGRNHTVSAMTHVRLFDSDYTFFGKIYGQWDNSWGDDLDMFYGAGYLGWSGRWGFFKPYIGLHNQSGDYVSQKYGQTSGWNGYVIGWTAAYNFNLFGEDFVLSDWNEIELDRNDAYTEQQFGRNGLNGGLTLAWKFYPRWKATVTYRYFANKLGYDGYGDQMIYMVGYSF

SEQ ID NO: 7614 - protein, 721 aa, Salmonella paratyphi B
MSRFPLIRLHLSGIFMKIISVRQRLYPALLLPLTFSPVLQAASAPNEQTMIVTATPQTVSELDTPAAVSVIEGEDMRLATPRVNLSESLTSVPGLQVQNRQNYAQDLQISIRGFGSRSAFGVRGIRLYVDGIPATMPDGQGQISNIDINSIQDVEVLRGPFSALYGNASGGVINVTTETGRQPPTLEASSYYGSYGSWRYGLKATGAMGDGTQPGDVDYTVSTTRFTTHGYRDHSGARKNLANAKLGVRLDDVSKLSLIFNSVDIKADDPGGLTESEWKADPQQAPRAEQYNTRKTIKQTQAGLRYERQLSAQDDISVMAYAGERETTQYQSIPLVAQLKPAQAGGVITLQRHYQGIDSRWTHRGELGVPVTFTGGVNYENMSENRKGYNNFRLNNGTPEFGHKGDLRRDERNLMWNVDPYLQTQWQLTQKLSLDAGVRYSSVWFDSNDHYIAPGNGDDSGDASYHHWLPAGSLKYALTDAWNLYLAAGRGFETPTINELSYRADGQSGFNFDLQPSTNDTVEVGSKTRIGNGLLTAALFQTDTDDEIVVASSMGGRTTYKNAGKTRRQGAELALDQRFAGDWRVKASWTWLDATYRSNVCQGQNCDGNRMPGIARNMGFASLGFIPDEGWYAGTDVRYMGDIMANDENTAKAPSYTVVGLNTGYKFNYSQLTVDIFGRVDNLFDKEYIGSVIVNESNGRYYEPAPGRNYGVGINLAWQFE

SEQ ID NO: 7615 - protein, 67 aa, Salmonella paratyphi B
MKLKLVAVAVTSLLAAGVVNAAEVYNKDGNKLDLYGKVHAQHYFSDDNGSDGDKTYARLGFKGETQI

SEQ ID NO: 7616 - protein, 375 aa, Salmonella paratyphi B
MTKVSKRVTICAWAAMSPALTCGAAYAQSSVTLYGIVDESVRYMTHVNKNGDSSVGLGNGGMSESRWGLRGVENLGGGWSTFFKLENRIYINSGQSDPTLPFFNEAQIGVQSSTYGKLIFGRMPNVLIEGITIGGYGSNPWIPYDFSFQPEVTMSGGIWTSNQVQYQARAHDVMLSVAYAFGGVAGHTSYGSQFGAAAAYAPNGGPVNLGGAYEETRDSVNGSTAKAWTFGASYTWNQTRFALGYIVNQNDAGFSNFANGPFTAPVLAALKYTDFSRRRMILGGITQQVGAAWHFAANVWRTLQDGKTSAQDGSAWQYQLVADYSLSKRTDVYLEGDYALYRGDLIGAQLQGVNGVGLAQKGSQIGLMTGLRHLF

SEQ ID NO: 7617 - protein, 223 aa, Salmonella paratyphi B
MRKSLFLLLPLVVTNAHAVYVDVRHEYLDDSKANYDRAYISHRFANGVGFAIEAISKSGGDDTNKVFNDLETQGNEYTISYQFKTGDVAWQPGFVLETGNGYSTYKPYFRATWTLNESWWVGARYRFEYVRRSSDIRDDDTINRMDVWAGYKWNNFDWTIEGIYKKADKYDLYDGGKDNYEYNFRTAYIIDQWSPFVEVGNVSVNSNSDERQTRFRVGIGYTF

SEQ ID NO: 7618 - protein, 388 aa, Salmonella paratyphi B
MKRKVLALVIPALLAAGAAHAAEIYNKDGNKLDLYGKVDGLHYFSDDSSKDGDQTYMRVGFKGETQINDQLTGYGQWEYNVQANTTEGEGANSWTRLAFAGLKFGDYGSFDYGRNYGVLYDVEGWTDMLPEFGGDSYTYADNYMTGRANGVATYRNTDFFGLVDGLNFALQYQGKNERQSADDVNIGTNNRNDSDDIRYDNGDGFGISTTYDIGMGFSAGAAYTTSDRTNEQVNASSTIAGRTIAGGDKADAWTAGLKYDANNIYLATMYSETRNMTPYGKTDKGYDGGVANKTQNFEVTAQYQFDFGLRPAVSFLMSKGKDLTYNNVNGDDKDLVKYADVGATYYFNKNFSTYVDYKINLLDDDDPFYKDAGISTDDIVALGMVYQF

SEQ ID NO: 7619 - protein, 724 aa, Salmonella paratyphi B
MRVKKFIWLITVVSTGINSPLSAAESTDDNGETIVVESTAEQVLKQQPSVSIITRDDIQKNPPVNDLADIIRKMPGVNLTGNSASGTRGNNRQIDIRGMGPENTLVLIDGVPVTSRNSVRYSWRGERDTRGDTNWVPPEMVERIEVIRGPAAARYGSGAAGGVVNIITKRPTNDWHGSLSLYTNQPESSKEGDTRRGNFSLSGPLAGDTLTMRLYGNLNRTDADSWDINSSAGTKNAAGREGVTNKDINSVFSWKMTPQQLLDFEAGYSRQGNIYAGDTQNSTSNAVTKSLAQSGRETNRLYRQNYGLTHNGIWDWGQSRLGFYYEKTDNTRMNEGLSGGGEGRITNDQTFTTNRLTSYRTSGEVNVPVIWLFEQTLTVGAEWNRDELNDPSSTSLTVKDSNIAGIPGSAANRSSKNKSEISALYVEDNIEPMAGTNIIPGLRFDYLSESGSNFSPSLNLSQELGEYVKVKAGIARAFKAPNLYQTSEGYLLYSKGNGCPKDITSGGCYLVGNKNLDPEISINKEIGLEFTVDDYHASVTYFRNDYQNKIVAGDQIIGRSASGAYVLQWQNGGKALIEGIEASMAVPLMPDRLNWNTNATYMITSEQKDTGNPLSIIPKYTVNTFLDWTITSALSANVNWTLYGKQKPRTHAESRSEETKGLSGKALGAYSLVGANVNYDINKNLRLNVGISNIFDKQIYRSAEGANTYNEPGRAYYAGVTASF

SEQ ID NO: 7620 - protein, 614 aa, Salmonella paratyphi B
MIKKATLLTAFSVTAFSAWAQDTSPDTLVVTANRFQQPRSAVLAPVTIVTRQDIERWQSTSVNDVLRRLPGVDIAQSGGAGQNSSIFIRGTNSSHVLVLIDGVRLNLAGVSGSADLSQFPVSLVQRIEYIRGPRSAIYGSDAIGGVVNIITTRDNPGTELTAGWGSNSYQNYDISTQQQLGENTRATLIGDYEYTKGFDVVAKGGTGMQAQPDRDGFLSKTLYGALEHTFSDRWSGFVRGYGYDNRTDYDAYYSPGSPLIDTRKLYSQSWDAGLRFNGERIQSQLVSSYSHSKDYNYDPHYGRYDTSATLDEMKQYNVQWTNSVVVGHGNVGAGVDWQKQTTTPGTGYVPEGYDQRNTGVYLTGLQQLGDFTLEAAARSDDNSQFGRHGTWQTSAGWEFIEGYRFIASYGTSYKAPNLGQLYGYYGNPNLNPEKSKQWEGAFEGLTAGVSWRISGYRNDINDMIDYDDHLQKYYNEGKARIKGIEATANFDTGPLTHTVSYDYVDARNAITDTPLPRRSKQMAKYQLDWDVYDFDWGVTYQYLGSRYDSDYSAYPYRTVKMGGVSLWDLTVAYPVTSHLTVRGKIANLFDKDYETVYGYQTAGREYTLSGSYTF

SEQ ID NO: 7621 - protein, 747 aa, Salmonella paratyphi B
MARLKTAQPNSSLRKIAVVVATAVSGMSVYAQAAVQPKEETITVTAAPAAQESAWGPAATIAARQSATATKTDTPIQKVPQSISVVTAEEMALHQPKSVKEALSYTPGVAVGTRGASNTYDYLIIRGFAADGQSQNNYLNGLKMQGNFYNDAVIDPYMLERAEVMRGPVSVLYGKSSPGGLLNMVSKRPTTEPLKEIQFKMGTDSLFQTGFDFSDALDEEGVYSYRLTGLARSANAQQDRAEEQRYAIAPAFTWRPDDKTNFTFLSYFQNEPETGYYGWLPKEGTVEPLPNGKRLPTDFNEGAKNNTYSRNEKMVGYSFDHEFNDIFTVRQNLRYAENKVSQNSVYGYGVCSDPANGYSKQCAALAPADKGHYLARKYVVDDEKLQNFSVDTQLQSKFATGEVDHTLLTGVDFMRMRNDINAWFGYDDSVPLLDLYNPVYTDFDFASRDPATSGPYQILNKQKQTGLYVQDQAQWDKVLVTLGGRYDWADQESLNRTTGITSKRDDKQFTWRGGVNYLFDNGITPYFSYSESFEPASQTGENGKIFAPPKGKQYEAGVKYVPNDRPIVITGAVYQLTKTNNLMADSAGSFFSVEGGEIRARGVELEAKAALSASINVVGSYTYTDAEYTTDTTYKGNTPAQVPKHMASLWGDYTFFDGPLSGLTLGTGGRFTGSSYGDPANSFKVGSYTVVDALVRYDLARVGMAGSNVALHVNNLFDREYVASCFQTYGCFWGAERQVVATATFRF

SEQ ID NO: 7622 - protein, 795 aa, Salmonella paratyphi B
MRNMSKVLVRRSAMLLGGTILATSGTALAQQANTEGDNDIVVTASKREENLQDVPLAITAIGNERLSELQVKEFQDVVKFLPSVTIQTAAPGFSQVYFRGVASGENANHSASLPTVGTYLDEMPITTIQGALDIHAYDLARVEALAGPQGTLYGASSMAGTIKLVTNRPDPSGTYGSVGLELNSVAHGDVGGVAEGFVNAPLGERAALRLVGWYRHDAGYIDNIAGSRTYPTSDITQDNAALVEKNYNDVDTYGARLALGIDLDDDWTIRPTLMGQVQKTNGSFAQERSTAVSDDLQTVQYNPENSKDRWIQAALTIEGKLGNWDLTVTGGHLRRKTEVESDYSDYAYFYDALYGYGAYFYDNNGDLISPNQYIQGIDRYKKSFVEARVASPADARIRFIGGLFWQRQSHNIEQNYIIDNLTDLFTVTGTDSNIWLTKQLRIDRDYAAFGEISFDITDKLTLTGGGRVYKFDNSLVGFFGYNANFSSRTGEAACFAGPIISGTPCTNLDKRTKDSDFIHKLNLTYKFSDDALVYATWSRGFRPGGINRRGTLPPYGPDTLDNYEFGWKTNWGPVRFNGAIYQEDWTDIQLSFLGLNGLTEIRNAGVARIRGIEIDLGYRRNGFSINAGMSYNDAEIRRDFCRIANDSFDCTLPGSDGADNALLAPKGTSLPVTPKFKGNVVARYEFPVGGMDAHVQFAVNHIGKRRSDLRTFENSLKGFFDAYTTADLSVGVKGDDWKAELFATNLFDENGVINSGVQCLETTCGDPDGISSTGGVFYDTVIRPRLIGIKVSKDF

SEQ ID NO: 7623 - protein, 404 aa, Salmonella paratyphi B
MKKILTALCLSALMPLTALAQHEEDTENGIVSLAGREGFTIASKKGDFVFKPYLLVQTSANFNWYDDEGLDKAYNQDNVANSGFAIPYAVLGFTGKAFGKVSFNLSLNAAATGAALLQQAWFDVELKKQFSIRVGKFKTPFSHAYLTTLGETLMPSLPLSLTAPVILPYSLNAVTPNIGTGFDLGVEVHGLLADKFGYEVGLFNGTGISVNTAGKTFSDDWHIPSLLYAGRFTYMPKGVMPSTQGNLNRLNEDKLMLGVSTSLNVESENESTNDYRAGLEFAMLKRKLYLGAEMYYMHVGFTKRQKIDQGYHYLGGYVQGGYFVTSRLQATARYDFFNRNGMDTNGFMNMPAVGVNYFFKGCNLKLQAMYQFVGRWGHDTQLDRDNDDLGIATHNATVMLQYTF

SEQ ID NO: 7624 - protein, 185 aa, Salmonella paratyphi B
MKNIILSTLVITTSVLVVNIAQADTNAFSVGYAQSKVQDFKNIRGVNVKYRYEDDSPVSFISSLSYLYGDRQASGSVEPEGIHYHDKFEVKYGSLMVGPAYRLSDNFSLYALAGVGTVKATFKEHSTQDGDSFSNKISSRKTGFAWGAGVQMNPLENIVVDVGYEGSNISSTKINGFNVGVGYRF

SEQ ID NO: 7625 - protein, 1046 aa, Salmonella paratyphi B
MPVRFSVRFRSLQAVRVARRRTTLIRKPCFGPAASALLGLFPFSPLLAADEPLALDDLVVTAARSAQSLRDSLAAVSLIERDDIERSQAQSVPELLKKVPGVSIANNGGPGKSTSVYLRGTESDHVLVLIDGVRVGSVTSGTAAWQDLPVEMIERIEVVRGPRSSLYGSEAIGGVIQIFTRKGGDGAPRPFFSAGYGTHDSYTGSLGVSGGNAHGWYSLALSSADSDGINVKRPGASGYESDADGYRNHSASLRAGWRFDNGLELEGSFLRAKSHNDYDQVNSRRTSGFSANADGEQNVVSGRARFSPLAFWQVTLQAGRNEDKSDTYQDGHFYSRFDSRRDSASWQNDLTLAEGHILTLGVDYQREEVNGSTDYDEDSRENNGAFIQYLGEYGRHDWQVSLRRDNNEQFGQHETGNIAYGYALTDALRATISYGSAFKAPTFNELYYPFYGIADLEEETSHSLEVGLSGSHAWGHWSLNAYRTKVNDLIVYDSSIQGPANLDEARIRGLELEVGSRTFGWDWSANYSLLEPENSGSGTNDGNELPRRAAQMFNLELDRRFGDFAVGATLHAEGRRYDDVANDDELSGYATVDLRGEYRISPEWRLQARVANLLDADYQTAWTTTSRGRRCTLPSAIRRCEAPPAGGPEPYKEKAHAQSVLPQPTDRRCAAGPADGRDPWSSLRHSRSAERLLGGVLPRRRPAAPALGVPGAVPGSLAARLRRHRLDGRERLVPVAGLLAAGAGLRLAVAGRTPLCPPATRQPGRARPGGGLRRFRLLPVLRRRFLLLLRPLRGADLRRLRAAPDRLLPAQPGRPGPLRGPRRAALRGLRHPPEDAAGAGRARMSESPERDARHKARMQRKKAVVDARIARAGDEHGLLLVHTGNGKGKSSAAFGMAARALGHGMRVGVVQFVKGAASTGEEAFFRRFPEQVCYHVMGEGFTWEIQDRQRDIDRAREAWKVARELLGDPSIGLVLLDELNIALKYGYLELEPVLADIRARPWHQHVVATGRGAPPGLIEAADTVTEMSPVKHAFQAGVKAQKGIEF

SEQ ID NO: 7626 - protein, 459 aa, Salmonella paratyphi B
MKKGYSQYHALKKGLLKTALLFSLPLSMALAEDNGFYMGVGYQIGGAQQNINNKGSTLRNNVIDDFRQVGVGMAGGNGLLALATNTTMDALLGIGNQIVNTNKVISNDNAELTQFKKVLPQIEQRFETNKNAYSVQALQVYLSNALYNLVNNSNNGSNNGVAPEYAGIIKVLYGSQNEFSLLATESVALLNALTRVNLDSNSVFLKGLLAQMQLFNDTSSTKLGQIAEGLEKSGGAGSMFQKDVKTISDRIATYQENLKQLGGMLNNYDEPYLPQFGPGKSSQHGVINGFGIQMGYKQFFGSKRNIGLRYYAFFDYGFTQLGSLSSAVKANIFTYGAGTDFLWNIFRRVFSDQSLNVGVFGGIQIAGNTWGSSLRGQIENSFKETPTPTNFQFLFNLGLRAHFASTMHRRFLSASQSIQHGMEFGVKIPAINQRYLRANGADVDYRRLYAFYINYTIGF

SEQ ID NO: 7627 - protein, 435 aa, Salmonella paratyphi B
MSQKTLFTKSALAVAVAIISTQAWSAGFQLNEFSSSGLGRAYSGEGAIADDAGNVSRNPALITMFDRPTFSAGAVYIDPDVNISGTSPSRRTLDADNIAPTAWVPNVHFVAPINDQFGWGASITSNYGLATEFNDTYAGGSVGGTTDLETMNLNLSGAYRLNEAWSFGLGFDAVYARAKIERFAGDLGQLVAAQNPALAPVAGQILSDTKIAHLNGNQWGFGWNAGILYELDKNNRYALTYRSEVKIDFKGNYSSDLPIAINRFNLPIPTATGGATQSGYLTLNLPEMWEVSGYNRVAPQWAIHYSLAYTSWSQFQELKAKSTAGDTLFEKHEGFKDAYRIALGTTYYYDDNWTFRTGIAFDDSPVPAQNRSISIPDQDRFWLSAGTTYAFNKDASVDVGVSYMHGQSVKINEGPYQFESEGKAWLFGTNFNYAF

SEQ ID NO: 7628 - protein, 378 aa, Salmonella paratyphi B
MKVKVLSLLVPALLVAGAANAAEIYNKDGNKLDLFGKVDGLHYFSDDKGSDGDQTYMRIGFKGETQVNDQLTGYGQWEYQIQGNQTEGSNDSWTRVAFAGLKFADAGSFDYGRNYGVTYDVTSWTDVLPEFGGDTYGADNFMQQRGNGYATYRNTDFFGLVDGLDFALQYQGKNGSVSGENTNGRSLLNQNGDGYGGSLTYAIGEGFSVGGAITTSKRTADQNNTANARLYGNGDRATVYTGGLKYDANNIYLAAQYSQTYNATRFGTSNGSNPSTSYGFANKAQNFEVVAQYQFDFGLRPSVAYLQSKGKDISNGYGASYGDQDIVKYVDVGATYYFNKNMSTYVDYKINLLDKNDFTRDAGINTDDIVALGLVYQF

SEQ ID NO: 7629 - protein, 724 aa, Salmonella paratyphi B
MSFIQYRRDKHLPSTAAPSLLAMGMAMAFMPAAFAAEDTVIVEGATTADAVNREEQDYSVKTTAAGTKMPMTQRDIPQSVSIVSQQRMEDQQLQTLGEVMTNTLGISGSQADSDRISYYSRGFEIDNYMVDGIPTYFESRWNLGDALTDTALYERVEVVRGANGLMTGTGNPSASINMIRKHATSREFKGNVSTEYGSWNKQRYVMDLQSPLTADGNVRGRIVAGYQNNDSWLDRYNSEKAFFSGIVDADLGTTTSLSAGYEYQKIDVNSPTWGGLPRWNTDGSKNSYDRARSTAPDWAYNNKEINKFFVTLKQRFAESWQATLNATHTEVKFDSKMMYIDALVDKETGTLVSPYGASYPVVGGTGWNSGKRKVDAIDLFADGAYELFGRQHNMMFGGSYSKQNNRYFSAWANVFPDDIGNFSAFNGNFPQTHWAPQNLAQDDTTHMKSLYAATRISLADPLHLILGARYTNWRVDTLTYSMEKNHTTPYAGLIYDINDNWSAYASYTSIFQPQNKRDKAGQYLAPITGNNYEAGLKSDWMNSRLTTTLSVFRIEQDNVAQATTIPIPGSNGEFAWKSTDGTVSKGVEFEVNGAITDNWQMTFGATRYVAEDNEGNAVNPNLPRTSVKLFTRYRLPAIPELTVGGGVNWQNRVYKDTTTPYGTFRAEQGSYALVDLFTRYQVTKNFSVQGNINNLFDKTYDTNIDGSIVYGAPRNVSLTANYQF

SEQ ID NO: 7630 - protein, 663 aa, Salmonella paratyphi B
MFRFNPFVRVGLCMSAVTLAWPVAAATDDGETMVVTASAIEQNLKDAPASISVITQQDLQRRPVQNLKDVLKEVPGVQLTNEGDNRKGVSIRGLDSSYTLILIDGKRVNSRNAVFRHNDFDLNWIPVDAIERIEVVRGPMSSLYGSDALGGVVNIITKKIGQKWHGSVTVDSTIQEHRDRGDTYNGQFFTSGPLIDGVLGMKAYGSLAKREKDEQQSSATTATGETPRIEGFTSRDGNVEFAWTPNENHDVTAGYGFDRQDRDSDSLDKNRLERQNYALSHNGRWDLGNSELKFYGEKVENKNPGNSSPITSESNSIDGKYVLPLAAVNQFLTFGGEWRHDKLSDAVNLTGGSSTKTSASQYALFLEDEWRIFEPLALTTGIRMDDHETYGDHWSPRAYLVYNATDTLTVKGGWATAFKAPSLLQLSPDWATNSCRGGCRIVGSPDLKPETSESWELGLYYRGEEGILEGVEASVTTFRNDVDNRISISRTPDVNAAPGYSNFVGFETNSRGQRVPVFRYYNVNKARIQGVETELKVPFNEAWKLSLNYTYNDGRDVSNGGNKPLSDLPFHTANGTLDWKPAQLEDWSFYVSGKYTGRKRADSATAKTPGGYVVWDTGAAWQATKNVKLRAGVLNVGDKDLKRDDYGYTEDGRRYFMAVDYRF

SEQ ID NO: 7631 - protein, 230 aa, Salmonella paratyphi B
MKINKYLLGMVSFIAFSSYLQAATLDYRHEYADRTRINKDRIAIIEKLPNGIGFYVDASVKSGGVDGEQDKHLSDLVANAIELGVSYNYKVTDNFVLQPGFIFESGPDTSIYKPYLRGQYNFDSGVYMAGRYRYDYARKTANYSDDEKTNRFDTYIGYLFDELKLEYNFTWMDSDQIKFDNKKTNYEHNVALAWKLNKSFTPYVEVGNVAVRNNTDERQTRYRVGLQYHF

SEQ ID NO: 7632 - protein, 369 aa, Salmonella paratyphi B
MLSRWRYSWRILDDNEAQKMKKTAIAIAVALAGFATVAQAAPKDNTWYAGAKLGWSQYHDTGFINNDGPTHENQLGAGAFGGYQVNPYVGFEMGYDWLGRMPYKGDNINGAYKAQGVQLTAKLGYPITDDLDVYTRLGGMVWRADTKSNVPGGASTKDHDTGVSPVFAGGIEYAITPEIATRLEYQWTNNIGDANTIGTRPDNGLLSVGVSYRFGQQEAAPVVAPAPAPAPEVQTKHFTLKSDVLFNFNKATLKPEGQQALDQLYSQLSNLDPKDGSVVVLGFTDRIGSDAYNQGLSEKRAQSVVDYLISKGIPSDKISARGMGESNPVTGNTCDNVKPRAALIDCLAPDRRVEIEVKGVKDVVTQPQA

SEQ ID NO: 7633 - protein, 746 aa, Salmonella paratyphi B
MMKRKHLWVLNPCLLAMIAPAAAWAEEQKSEEQMVVSASRAHRTVAEMAQTTWVIESQEIEQQVQGGKEIKDMLAQLIPGMDVSGQGRTNYGMNLRGRSMMVMIDGVRLNSSRSDSRQLDSIDPFNIDHIEVISGATSLYGGGSTGGLINIVTKKGQKEQQVELQIGGKTGFGGHNDHDENVAAAVSGGNDNASGRLSVSYQRYGGWYDGKGNEVLIDNTQTGLQYSDRLDVMGTGTINIDDHQQLQLTTQYYKSQSDGDHGLFLGENFSAVTGSAKAYNSGNLNSDRIPGTERHLINLQYSNTDFLGQDLVAQVYYRDESLTFYPFPTLAGKAPDYYVSSIGASQQKTDFYGGKLTLNSKPIDALTLTYGIDAEHESFNSNQQFFDLAKAQQSGGMDLQNAYNTGRYPGYTTSNLATFMQASYDINPIFTLSGGVRYQYTENKIDDFVGYNQQQAIATGGATSADAIPGGKTDYNNALFNAGLLAHLTERQQTWVNFSQGYEIPDPGKYYGNGTYSLNNGHYQLNKSVNVGDSKLEGIKVNSYELGWRYTGDNLRTQIAGYYSLSDKSISINKTDMTINVNSDKRRIYGVEGAVDYFFEDSDWSAGTNFNFIRSETKVNGEWKKLLVDTASPSKVTAYVGWAPGDWNLRLQSQQSFDVSDDGDYTKVGSTQGRKIDGYNTIDFLGSYALPVGKLSFSVENLLDKEYTTVWGQRAPILYSPTYGSPELYSYKGRGRTFGLNYSVLF

SEQ ID NO: 7634 - protein, 596 aa, Coxiella burnetii
MEIMNSIMKYQLYTAVIMALSVSSVCGQTPRNTETKRPDTLRRELTIVNDQTVEMEHADPLPAAYKAIEPRLKPFRPEYNKRTFGFVPEVSSSGRNNLPNILPTEGHMKHRGYLNIGIGHTLNQRMDAGYRLIDAEQERLNLFLSYRGMKSAFNTGDFDGDRKDRRMMAGVDYEQRRPSFVLATGLYYSNHYFNNYGRGATTNVGSIPQLSTPVTPQMDNGTHNVRVYLGAKNDVIDARIDYRFFRSIPYLGTDPMKALTEHTPELNVTMSNELSDDIKLGVEVRTGGLFFAKNSEMIQTGVLSETDRNLYYVEGAPTIGFVGDSDNMQWNIQAGVGISSHFGAKGRLFFWPKLDASLSIFPSWRVYAKAFGGVIRNGLADVMQEEMPYLMPNTIVLPSRNALTAQLGVKGNIADVVRMEVYGDFSKLTGVPFYTPTLPLYNPSDLYQYNVSFLPIYADGSRWRAGGKLEYSYRDMLRFLVDASYGKWNLDGGLVASMQPDLILKAEVGVHPIAPLDVRLRYTQLNGRYRYSFGSAGSEALGIGNVHLLSADVSYKLKKNLSLYLKIDNMLAETTELIGYYPMQPFHCFAGFSWTF

SEQ ID NO: 7635 - protein, 181 aa, Coxiella burnetii
MKRLITLILVSLAIPPIYAGGAVDTPFLNSGPYVGLHGGVALPSESDLNAGPVVGAQVGYRMGNVRIEGALSYYSNSLEANSDAKLRMTTLMANGYYDFNFNAPLVPFVGVGVGWVHAWRTNNGVLLNRGTDNNEFAYQGIAGVSFRVSPRVTLGVDYRYLGWTDGNGSQNLIEMSVNYQF

SEQ ID NO: 7636 - protein, 797 aa, Coxiella burnetii
MGRAVFPASLRGRVAQSSDAGSEISGATVSAVAGLIAVASFSGAEAQQAPLPSVTVEAPAARAKPSASRPSADQVRARSALRRAARQPQQQKPPAGPQTPPDANPYADAAAPYKVDRVASGKFTEKLVNTPKTITVMSKEVMEDKHITTLKEVGRSTAGVTLGSGEGGNAFGDRFFIRGFDARNDIFIDGIRDPAVSVRENFFTEQVEILRGPASAYAGRGTAGGAINIITKQAGDRNFYNAESTIGTDQTKRVTLDVNQKISPTFSVRTGGLFQDANVAGRDHVTDDRWGGFISTKWTPNDSLKVTTNYVHTDLSGYPDFGVPFYKQGNIPVTSAGIPRNTWYGFLNRDFQAARQDFGTLVGELKLSDSVTFSSKLRGEHSELNYIGTLPNTTAAQTASPDPTKWTFTASPQSRYQLVDNWSNQNDLTFKYDTGPVKHTTVVGTEFSKENISIDRYAGLTSEAFGAQGTSSGALTLQNMYSPGYTNLPFTTVGYLTGNPTRYDVDSKSAYVIDTANWRDTLILSTGLRYDGYAMRSSNNTASATVDSDLINYNVGLVYKPMPIGSLYAAYATSANPFGSELDGTATDYGGIPPNSTIILGPERNKGAEVGTKWELFDRHLLLTGALFQTTKDNARETVNGLLTSGAAYRIQGFDLEAEGKITDRWSVFGGLVLMQSKVTESGVASNVGLQLANIAHQSLSVLSKYKFDDGWEIGGQAVYRSKVYGGTFAANTGNELPSYWRFDAFIEKQFDKNWSAKLYAQNLTNQLYYDTFYRSNVPFTAVAPGRAFYVITTAKF

SEQ ID NO: 7637 - protein, 231 aa, Coxiella burnetii
MSVKKLVTLATLTMASVGVTSAALAGGPDYVPAPSYAGVYLEGNLGYAYRPWRKDATTVVGLAKQAGLLGSSSRGNGGFTFGADLGYQFNQYFAVEGGWFYLPKVKFTTTGVVNGLAAGTYTVKSGMAYAALKGMAPVYENTYVFGKLGVAYTYNRANAGLPTNKIPATFGSRSRFWNPLFAAGVQYYFTPNWSVNAQYTFVPGYRNASSKRFVAPVTHLFTVGLGYKFLM

SEQ ID NO: 7638 - protein, 189 aa, Coxiella burnetii
MKIVLALIATVAVGLGTESLAQGAAVEEESGLYTNGDLVGVKPKVTNLGSIDDGGIIYKAGGGYQFNKYFALEGNYTRFPNLKSGRVIPEKSNTEIYAAGKAIIPLKKGYNVFAKIGAAQVSITTVPGMEDVSGINLSNTHSEILPYGGLGVGYSVSQKVGFNLQFAGTPEGDNIPARYAVMGGLSYNF

SEQ ID NO: 7639 - protein, 563 aa, Coxiella burnetii
MVFSFRRTTALLATTTLVSLLPLCGHARAADQMQIMERQIQAMQAQLSTMKKEHAEEVKRARAVLGRQREEAENNPYAQRGRYIGQPRPAAQPLISVRPAKAGADDGRPPSDRADVSSWSDFQRATAQDEEVTVGGIKVGFPGGRPTIQSSDGAYALSIGLAYHEDFGGFFNSGPRAGESRGAFNGFTSNQRRLRIPFMFRYKNWVAAVTPDFGANHNDGYVGLYEGNLNYTGLHNTVLTVGYFQPRVTEEDSESSNDFFTLERPSITDMVRNIAAGDARFSVGGLHYEKRWWVAGYFTGQEWGHRNASDMSSTYYGGGSGSTVDSQTGATLRVAGRPVVTKDVDLHVGASAISAFKVACNTGSDPNHCTRSTSFGQRPEFDIGEANLAATGTIRNASQVWAAGPELGLRWRRLIVKGEYYHVGVQRSAPGLKSASFQGWYGSAAYTLFGNPRMYNIKEGAFGAPGVKASEEFNPALNQWGALEVVGHYSVIDLNSNLNDANSKNVIRGGQQTVWTGGLNWYPNRHFRLMLDYSHFIVSRSNQATNTAGRTGNSIAARIQAAF

SEQ ID NO: 7640 - protein, 325 aa, Pseudomonas fluorescens
MKLKNTLGIAIGSIVAVTSFGVLAQGQGAVEGELFYKKQYNDSVKHNEDGFNPGARIGYFLTDDLSLDLNYDKTNHTRSNDGTGNQKIKGDTGSLLATYHFGQAGVDSLRPYVSGGFGHQSRTNVLADGHSGRDQSTLAIIGTGVKYYFTDNLFARAGVEADYAMDNGKWDYSALVGLGVNFGGNAGKVAPAPAPVPEPTPEPEAPVAEVVRVELDVKFDFDKSVVKPNSYADIKNLADFMKQYPQTTTVVEGHTDSVGPDAYNQKLSERRANAVKQVLTSQYGVESSRVQSVGYGESRPVADNATEAGRAVNRRVEAQVEAQAK

SEQ ID NO: 7641 - protein, 313 aa, Pasteurella multocida
ATVYNQDGTKVDVNGSVRLILKKEKNERGDLVDNGSRVSFKASHDLGEGLSALAYAELRFSTKVKKTVKEGPSQVERIGNDVHVKRLYAGFAYEGLGTLTFGNQLTIGDDVGVSDFTYFLGGINNLLSSGEKAINFKSAEFNGFTFGGAYVFSADADKQAPRDGRGFVVAGLYNRKMGDVGFALEAGYSQKYVTVAKEEKAFMVGTELSYAGLALGVDYAQSKVTNVEGKKRELEVGLTYDINDKAKVYTDLIWAKGGPKGATTRDRSIILGAGYKLHKQVETFVEGGWGREKDANGVTTKGNVVGAGLRVHF

SEQ ID NO: 7642 - protein, 158 aa, Klebsiella pneumoniae
KKDNSDYSPLKASFLAGGGAFGYKMDDIRVDVEGVYSYLNKNNVTDARFTPDTIADSVTAISGLVNVYYDIAIEDMPITPYVGVGVGAAYISTPLKDAVNDQKSKFGFAGQVKAGVSYDVTPEVKLYAGARYFGSYGANFDKSGGEKDKGGYTVLYST

SEQ ID NO: 7643 - protein, 363 aa, Yersinia pestis bv. Antiqua
MKKSSAIVLAAGSLLAGSAFAQTSVTLYGIADVSVRYTTHADASGHGKTELTDGAVTQSRWGLKGAEALGNNLKAIFQLENGYSLDTGKLNSANTLFNRQAYVGLSGDFGAVKLGRQYTEGFNFFGDYDPLTIGNYTANAWPFFLTQFRANNVMSYGGKFGGLDVGASYGFGETAGSMTSNQYWGARAAYSYGPFGIGGVYQEIRNQAGERQQMFGAAGKYSIGPAKIFLGYLGGKDRTGVIDNGFMNQSAASTGAGAQTAITAGALNNPRKDHLGYVGTTYQATPALAVTGAFYYDYIENKNGIAGNGGHRYAGVLLAEYSLSKRTQVYGTVDYNHVSGGATTELPGANNQLGVAAGIRHIF

SEQ ID NO: 7644 - protein, 761 aa, Yersinia pestis bv. Antiqua
MNNHKIWRLSAVAVALLISGNSYADQTLHFAQQPHNTGDHTVIAAPEVNNFSLADLTANAEGQAVDATNAGALSLRVEPTQGDAQANGVLVTSGTFTNQAQGSITVSASSQDQHAVASGLQATDAYWSTLRNQGSIRATSNSLHGSAEVYGIQAGLAFSDAAGDHYGDHMMLSNEGVMQVSATAEQDAFASGIYTNAGNGVVNNGRLDVSAHASAGDARATGLHTLSANPGVDPDPWNPANPTHLMSNNGSLSVTASGNNATASAISTEGEGVYIYNNGTLIVDAFSESAQGGASAYGIHVLNGSATINSSGRILATATGGSQQQAYEVMADGSVVNIERYTLALGNETPWAVSNGGSIVLGNGTQGADLVLMAGQASEGFAYGKEYSLDNLAYDTTSGQQSTVGGSIAGLYGITPDIKVIHSGSSSSSLGSAALVYAPDVSHAGVSALAQRSSMEQASNIISSQLHSQLVSNAGCNQKLESADSCVFITPYAGEYRRDPVTSGYSGQRYGVLLGQNQHFGDFQLGWHGGYESASTDFNGTSVGRKEEINTLMLGVQGGMKLSESLFIAATSTWFSSDTDYSDSNTYYGVGSQNGSYDSSGLYTDVSVGNSWQLNRNYAMTPMVGLTHIWQQRDGYTVSSNNKNYDLIDTRYSSYSDHAVALHAGVRLDGRYPLTNETLLKPFFNVGFQQMLYGDEITIDQSIPNSPVVGVSTKDKTTQGTFDLGMALVSDNGVSASLQLSGMVNSDRQDFTGWANLGWAF

SEQ ID NO: 7645 - protein, 727 aa, Yersinia pestis bv. Antiqua
MLAANVSLLGCAYAATDENNSQKKERENNPANTTITVTASPLRHAGVTEDSGSYNTSSMSTATGLNISARETPQSVSVLTKQRMRDQNLNSVESAVNNITGISVRQFDSDRFGFTSRGMAVNNVMRDGVATFYDTRFNYGDNTLDTDMFDRIEVVRGAAGLMAGPGNPSAVINLVRKRPTQDFRGSVSAGVGSWEKWRTALDISGPLNSEGSVRGRFVTAYEDKNSFVNRYDQSKNPFYGILEIDVTPNTLFTFGADTQRTLTRGGMFGGLPLFNSAGGRTNYAQSATTASDWASAETRTQTLFSSLQHNFDNGWNIKGTFTFDNDKLRQDVMWPTGYPDPQTNIGMRPGSLSLIDGARRQQNYDIQVNGQYSLFGRQHQLGLGWNRQRQNIDNDYYLATCNATRTCPDLGDFTQPGWQYPKPVWSDKRAYGSKGRSDQSSQYVVTQLSLIDPLTLILGGRLTTWETRGDNFGTPQNARYKNEFVPYSGLTYDINRDLSVYTSYTEIFNPENRRDRNNTLLAPVSGQNYEAGLKGVAFDNSLDYSLAVFEIRQNNMPVPDTTAPRLPDNSQPYFAVDGTKTRGFEAEVSGKMTEDWNISAGYTQYNVKLPSSNTQTPVTPVTPRKVLKLFTTYTLPGQLSDLTLGGGVNWQSQIARNLSSPIGIQQIGQGSFAIYSLMSRYQFTPQLSLTVNLDNLFNQHYYTQIGQYNQYLLGAPRNVDATVRYTF

SEQ ID NO: 7646 - protein, 1268 aa, Yersinia pestis bv. Antiqua
MLKHFRLGLFTANVQADTGSQHSFSRVPAAAINPITLAIVVAFSTIALPPMALAACTSPGVGTYVCEGENTDGIILSGTDIAVETQPGFSIIVPENGDPALSLVGSGTISYLDTNSSALDTTGADSLYIQNDTHTTGQSSSINVQTNGSMGSGINISNHSGADSTVQVDVSGTLFGDLNGSPALLIYSSAENNSTILMNINTIFGDVGIRSDNTSFNGTAITNVDIANDINATYSGATINNSGSGGTSVVNFNSKSIITELDALNIYNTNYSGAVITNVDIDGDVISTTSQATSFYNDAYNGSANFTFRANNVTGEYSGISINNSSHNSANNNHDNAVITDILLTGDLTSTSGSGLQINSYMDDGDIKVSAQLENIYSYYEALSVRADTLTGNLQFNIDVSGNIVAENGLGFMVMGGASEGNSTMIINANNISSGSQALNIYNYSGLGSAFTAVTATGHLVSEQGIGAMFSTYVSQGDATAVINLNDITTAGSGVKIDTIANGGNSTTYLTVVGQINSSLYDGIDLRATATEGNTLVSIDVNNIASEYDAIHLDNKNYTTGADNGTSTIDLITRGALVSQQGYGINIETNTADTYVTVGGLVHGGNGTAIGIHRLDNIQTSATLELQSGYALEGVTQALVFNGSYAEINDAALDLANSHLVLGGAGDAAFDLTRIDNREEAILDGDPNRITGFGTLTKTNNSIWTLTGANMADGDANAFLSANIAGGILVLDNATLGLTPDAGALTGATVNRLSAADIAADPTLVATETGALTLAEGGALSSLGDSVLSGNLISAGGILLSNHYTGGNGAATDDRLTVTGTYFGENNGSGEGAWLALDTVLGDDDSATDRLVINGDATGTTSVRVNNAGGLGDKTLNGINLITVDGLAQDDTFLLAGDYVTTDGYQAVVGGAYAYTLQADGEAATAGRNWYLSSELMLTEGVRYQAGVPLYEQYPQVLAALNTLPTLQQRVGNRYGAPGALADLDFDNNQWAWGRIEGSHQVTDPARSTSGSQREIDVWKLQTGIDVPLYQSQDGSLLTGGVNFSYGKAKADIHSFFGDGRINSAGYGLGTSLTWYGNNGVYVDGQLQTMWFDSDLSSRTAGHAVASGNNGRGYTSAIEAGKGYALGNGLSLTPQMQVTYSRVDFDTFRDPFDSEVSLQEGDSLRGRIGVSLDKETTWSAKDGTTRRSHIYSHLDLHNEFLNGSKVQVSGVEFATRDERQSVGLGAGGTYEWQNGRYAVYGNVNLLGATRNVSDNYAVGGTIGARVSW

SEQ ID NO: 7647 - protein, 784 aa, Yersinia pestis bv. Antiqua
MANSTIARLLAASCLTVVASQGLTTPLHAAEASSGVADDPAEIIVTANKREESARTVPMSLTIASGDKLLSAGVRSPEDLVKIVPGLTVQPSPFNTPVYTMRGIGFYETSLSAAPTVAVYVDEVPLPFSATTKLAVLDLQRVEVLKGPQGTLFGQNTTGGAINYIAAQPTSTLAAGADLTLSRFSTYDAQGFVSGPLSDKVSARVAARVVQGGAWQKSITRNDDLGKVKQLQGRAIVTWDAGPDFTVRAMVSAWQDRGDTQAPQLLVDSCGASTAGTCGNPEAAAFRAYPRPPHDNRSADWGAGVYGRANKRDDSFVQGSLRLEKGLTDNLKLISITSYSRYKTDSVQDFDGTMLNSADNNTTGYIHAFSQELRLNADFDKVRITSGLNYDRFNVYDRIFYNIGQSVSADPLYFVPGHLLPEYTYSFTHQISKTYAAFLNGEVQLSDRVKVTAGARYTNVKRSFSGCSFVLGVTADWFNQIFGTSLVDGQCSVFTPNFPQTYDPLLFDKLNEDNLSWNAVVDYKLSDKAMVYGRIAKGYKAGSFPTASVVSYTGLLPVHQESVLTYELGLKASLPDRLGELTIAGFYNDYKNKQLRSRKPDPLFGTLDGLVQIPSSWSKGIEASLTLRPVEGLTLSAGGTYLETRVTKYDGFDAFGTPTNFKGQRFPYAPKWSLVGDAEYRFPLGTGHEGYAGVSAVYNSATSSVLSNRDTAFTAADTRQVIKAYTLIDVRAGVSFGENKVKVGAFVRNLTNKYYWTNVLDSLSSIVRFTGMPRTYGLQASWRY

SEQ ID NO: 7648 - protein, 534 aa, Yersinia pestis bv. Antiqua
MNYKDDTRITGATVSDKGLVAIKPLNNTNIVADTIHYKGDVLAVNKGKVELDFTPNIRLVGRLDNFSGLTDSKHKNLFENYVANLDSKSAGEINFNLAKDALWTMTGQSWLDKLEGQGTIDFNNDAKTSGRALHIGELAGANKFLMHLNKDGIHSDMLYVKKGTSTPQEVVVKNLSEVLDSMNYGERLRFATVTNSKNEFVNGKKYIDDTHLMEDALTVEYSAHNGDKNNKDDYNKSFNGSEMTAEKAGDDYVNKTYTDNRQNVYLVKQATGNPSRNVKNINDMFDSTAHYAFTLDTYAKREGERAFSTLDKKEGDWIRLTHTRVIQSNAFRFHNNDFEIGYDRFSLNEQEKKRKWGISLDYGHGRTSLWNTFGKDKIRKYELALYNTTQYIDKEGDETGYIDNVLKIGKLRNRVIARNHMGQLWGKGKYSNTLFSISTEYGRRKFLDDDKLWRITPQVQLQYSYLRGTGYRIDNGINVNLSHANSLIGRLGLDVVRKFDGGKKLFYIKGNIFHEFLGSRSFKAFEGKSHYAQK

SEQ ID NO: 7649 - protein, 232 aa, Yersinia pestis bv. Antiqua
MIIKKSGGRWQLSLLVSVVISAFFLNTAYAWQQEYIVDTQPGHSTERYTWDSDHQPDYNDILSQRIQSSQRALGLEVNLAEETPVDVTSSMSMGWNFPLYQQVTTGPVAALHYDGTTTSMYNEFGDSTTTLTDPLWHASVSTLGWRVDSRLGDLRPWAQISYNQQFGENIWKAQSGLSRMTATNQNGNWLDVTVGADMLLNQNIAAYAALSQAENTTNNSDYLYTMGVSARF

SEQ ID NO: 7650 - protein, 435 aa, Yersinia pestis bv. Antiqua
MLACLITVSGTSSQAASFQLAEISTSGLLGMAYAGNAAVADNASVVATNPALMTEFKHPQISVGGILVDANVDVSGKINGSVDAPHKDIIPNAIVPNIYFVTPINSQFSLGGGLNVNYGLKSQYNDKFNGGMFGGSTKLTALNFNLSGAYNLGNGISLGLGLNAIHSDAEINRYLGAGKQILIEAGKQAQNIIPSLSENTSIAHIKGKKWSLGWNVGLAYQLDENHRWGVAYHAPVDVKFSGQYSNQLPEALNPLLQAHSSLKLPISQATGGKAIPGNLTLNLPAYWELSGFHKLTDQLAMQYSYKYTGWKRLKSLDAYANDGKLLFQKIENFSNSSRYAIGFSYDVAQDLTLRTGFAYDKNASVKHPSISIPDTTRTWYSIGATYRFTPNVSFDVGLAHLRGKKNQFTEGTLVKGAFEVAARANLYGLSISYGF

SEQ ID NO: 7651 - protein, 726 aa, Yersinia pestis bv. Antiqua
MKHKHLWVLNPCLLVMLTPAAWAEDQLVVSANRSHRSVAEMAQTTWVIEGLELEQQVQGGLEIKDILAQLIPGIDVSSQGRTNYGMNMRGRSIMVMIDGVRLNSSRSDSRQLDSIDPFNIAHIEVISGATSLYGGGSTGGLINIVTKKGQEGKQVELQIGGKTGFNSHNDHDENISAAMSGGTERAFGRFSVSYQRYGGWYDGKGNEVLIDNTQTGLQYSNRLDVMGTGTLNIDENQQLQLTTQYFNSESDGKHGLYLGQNFSAVTGTGQASNSAALNSDRIPGTERHLINLQYSNTDFWGQDLVAQVYYRDESLTFYPFPTLKDGKVSTIGASQQKTDFYGSKLTLNSEPIDSLTLTYGIDLEHESFNANQQFFNLAKAQQSGGMTLENAYNVGRYPSYTTTNLAPFLQTRYDINPIFTLSGGVRYQYTENKVDDFVGYAQQQAIASGSATSADPVPGGKTDYNNFLFNAGLLAHLTESQQTWFNFSQGFEIPDLAKYYGSGSYTLVNGHYQLQNSVNVNDSKLEGIKVDSYELGWRYTGDNLRTQMAGYYSLSDQTISINKTDMTINVLPDKRRIYGVEGAVDYFFDNSEWSAGATFNLIKSETKVSGKWQKLTIDAASPSKATAYIGWAPGDWNLRVQSQQTFDVSDSKGDKIDGYNTIDFLSSYALPVGKLSFSIENLLDKEYTTVWGQRAPILYSPTYGSPNLYSYKGRGRTFGVNYSVLF

SEQ ID NO: 7652 - protein, 638 aa, Yersinia pestis bv. Antiqua
MDKTLLAGAISLSLVILPVQVLAFTPNVVGITVNDEVVIHGIQNVRDGGVINNGLVSDNAAITVTNGSSAGTANNTTVGDKGWLQITGALATGTIVNQGGLLDTKTAGTVIDSQINDGGHMTLGLNSQSKGYLNIAAGAELFVTNNDPYISDVTTHNPALPANVMIENLNVAGLVEIGPSWKGTSIVPLPLSDVLGPVLVTRINNVTLQGGDINLMAYSAGGQFNRLEIENLSGQGNFAMTTQLASNTGDFITVSQQATGQFGITVQDSGKEPQSADNLALVHINRGDAQFRLLNTGGVVDLGVYQYGLYSQESNGSTDWYLATSTEELPGTTPNVTAPMLSSAAQGVLNMAAAPRHILNAELSTLRQRQGELKADAEGTVGVWARYLTDDSRLSDNKNIAFKNTLSGMEIGADKQLGLNRGNMLIGAFTSYSSSDVKSTHDANGDIRSYGGGLYLTYLDQSGFYVDTVLKANRFNNKMNTQETRGEYNQNALTTSVESGYQWPVYANLVLEPYGKVSYSRIGSADYTLSNGMVAEVAKADSVQGELGTVLAASYSINQMTIKPYIKLAITREFTKSNAVAINNIGFDNDFSGNVGKYGVGINATVANNTAIFAEVDYLNGSKIETPVTANIGFRLRF

SEQ ID NO: 7653 - protein, 1458 aa, Yersinia pestis bv. Antiqua
MKNSNTLNTRLLPLSILISSLVSGGAMAVSQIATTDTPAVTPIKSTLTGPFERNSAGTSFGSNVDVDVIDNTSTATRVIAETTPEAESTIGEATGQEGGNATAVIPPTTTPSEQEITEPEQPGLLDKIKDLLGLGEITQEQADALEKNVKTKVEKVDAQTAAKLALESAQAEAQKAAEDALYLKTENVSYQAFAQTEEKIKKEADEAKKKQDKTKEDAIKAVKVNNTPLVPGDKDIAEKVTKAVTDTTKVQGEKAVTLATKITDAKVAQEKKDANTEALAEIDGRLISVSNALIQATGTDKGPLDQKLKEAQQAKTEQDGKELASGGYKELFEEDKKTSGYFGIAENDNGSGQQEKLAEAKKNRDAYNKAAKKELDAIAKAQKAVEAIDAQIVKLKKDKGDIEQEQSTEKGKTGGLDIALSGANDAKDAAQGEFDTAKNAAELAETAAKAIEAAKITDKAVEDATAAYKEAADKAEQTKTALEAAEKAKEDADKLVVTNTGLLNDADQALEQLVTAQNNAQPTLDLPAIDVTIAPAKTQDVIEGTSAIATQVAGGTQNVAKGGKAIDSVITKDGIVNLAAGANAKGTEVTKGTLNNNGGVDTDTVVSTEGKLVLTGGSETAIATSTGAKVAEGGVVTAGDHSVIEKMISSGNVTASGNNTIVRDTTINDGKLSLAGTATANNTTFNGGIFSVEGDTAATKTNMTGGKFAVTGNAKIEETVVSAGDVSLADKATANNTTLTGGTFAAAGDTAVSATNMTGGTFTVAGDTAATKTKMTGGEFAVTGNAKIEDTVLNASDFSLADKATANNTTLTDGTFTVAGDAAVTATNMSGGKFAVKGKAKIKDTQLSAGNFTLAENATANDTTLNGGKFDVSNEATATNTTINNGLFTLKDGAHADSTTVNSGTFVMADQSTANGIQLVDSAFTLASGAKASGITKLTGGQAQVAGSLESLSLTGGRADFANSAKASGLLDISADSQIIMNRGADTAQANLNLAGRLELLASDVAQAVAQPVARAAMELSNARAVMPAPAMPVPAAAPVAHFALNDVVMTGGTVDMSNAKNAQLTMASLNGTGNFNLGSVMQSDSVAPLNVSGDANGDFIIAMNSSGQAPTNLNVVNTNGGDARFALANGPVALGNYMTNLAKDANGNFVLTADKSAMTPGTAGILAVANTTPVIFNAELSSIQQRLDKQSTETNQSGMWGSYLNNNFAVKGRAANFDQKLNGMTLGGDKATALADGVLSVGGFASYSSSDIKTDYQSKGKVDSHSFGAYAQYLANSGYYMNAVVKNNQFSQDVNITSINGSASGVSNFSGMGIALKAGKHFNFNEAYVSPYVAMSAFSSGKSNISLSNGMEAQSSSTRSAMGTLGVNAGYRFVMNNGAELKPYAIFAVDHEFAKNNQVTVNQEVFDNNLSGTRVNTGAGMNVNITPNLSVGSEVKLSSGKDIKTPVTINLNVGYSF

SEQ ID NO: 7654 - protein, 482 aa, Yersinia pestis bv. Antiqua
MKWIASTTLACTAGTCGSAFAQSSVTLYGVIDASIHYTHITGGASNQVKLQSGQISVIQLEDAGQGRSGRRHERAVQPAERVQREYREDEFRAAVLAQGLCRLDGWIRHVDGRPSAGYVEGSRVASAGRQFSRVFHGARGRRQRGRFGAQQQCRQMGEPVMGRVAGGRDVRLRRCGGIGRGRAGLQRRAFVYRRATDCRGRLHALDNGNALRSTRGASSADTIFLSRANNAYATASAVNIARTGAPTRWAPLHWTGITATPSICPTQARRTARPSATTTVRFVAWQASPAWLLQTGYNYLKSHGASSATYQQVTLAADYARSKRTDIYAAASYVHASGKSGAGGGFERLCQWREVDSRTRDRRHSPPVLSAAHRRGAAPYESLSRDDHVQDLPSIVLLDSTDSISKIHGLQHASATGSILIIMGRRICVSNSLKNIIMVLLSFAGMSRRACDRVRHGVFQKKCAEDDPEVFSNRSADVSGMQ

SEQ ID NO: 7655 - protein, 179 aa, Yersinia pestis bv. Antiqua
MNKTLLVSSLIACLSIASVNVYAEGESSISIGYAQSRVKEDGYKLDKNPRGFNLKYRYEFNNDWGVIGSFAQTRRGFEESVDGFKLIDGDFKYYSVTAGPVFRINEYVSLYGLLGAGHGKAKVSSIFGQSESRSKTSLAYGAGLQFNPHPNFVIDASYEYSKLDDVKVGTWMLGAGYRF

SEQ ID NO: 7656 - protein, 394 aa, Ehrlichia sp. P-Mtn
PAPVFSFDDYDAKDNSESSIGNLARVTPRMRRESIDDFEEIPLDVLEAAETSTNITDNIGKDIQEILDDESEDTDIEQLIDSLGQTVRLQPRTSRPIENMSQAGAISKNTNTALSDAMVSSQFILLDTGSSLVQQITQTELSANKENNVWVSNTTYDRHYSSTQYRQFSAKRSQIQIGIDHYLSKNTQVGTVLSYVRNSNVFDQASGKNTFVQANTYGKYYFDYGWYISGDIGVGQLRSQLQTQQKAKFNRIATQAGIMIGNRIDINRFEILPSIGVRYSYLSSIDYKLGSDSLKVDSISIKTALAKLDLAYQFNIGEFALKPILSMAYVINSGEGIVNIGGQNYRYKSDNQQQYSAGMALNYRNLTFNINGGAIKGRQLSNQKFLQIKMQVSF

SEQ ID NO: 7657 - protein, 243 aa, Ehrlichia sp. P-Mtn
PAQEDSSTRANVYISAKYMPTASHFGKMSIKEDSKDTKAVYGIKKDWDGVKSTASTSLFTEKDYSFKYENNPFLGFAGAIGYSMNGPRIEFEVSYETFDVKNPGGKYKNDAHMYCALDTATGSSAAANTSVMVKNENLTDISLMLNACYDIVLDGMPVSPYVCAGIGTDLVSVINATNPKLSYQGKLGISYSINPEASIFIGGHFHRVIGNEFHDITTHKIFHNSTPTSNPGFASAILDVCHF

SEQ ID NO: 7658 - protein, 232 aa, Ehrlichia sp. P-Mtn
PAQEDSSTRANVYISAKYMPTASHFGKMSIKEDSKDTKAVYGIKKDWDGVKSTASTSLFTEKDYSFKYENNPFLGFAGAIGYSMNGPRIEFEVSYETFDVKNPGGKYKNDAHMYCALDTATGSSAAANTSVMVKNENLTDISLMLNACYDIVLDGMPVSPYVCAGIGTDLVSVINATNPKLSYQGKLGISYSINPEASIFIGGHFHRVIGNEFHDITTHKVFFSSGTPANPG

SEQ ID NO: 7659 - protein, 633 aa, Vibrio tubiashii
IEEETMEVSATSIEQNRTHQVDLDQAQRNLAMDMADVLRDEPAIQIGGGTRNAQRFYLRGIEASNLNIRIDGASQGRNLFQHRGATGGMDADLLKAVTVETLPSSDQGGGGLGGSIKFETLDAQDLGTGDRPVGARLKVSHSSVDDAIAGAATGYGLYGTSGLLVHISGTNSEDYTSGDGDEVHGSAGRDRDYFAKFSLVDQAGHSLRLSAEKNENSGLYRWGAGDSSYDDTATLNYQISERQTQVLDYRYTMPSSTLVDVRLNLFHNEQSLENSDNNTETETEGYGGELRNTAHFSLGATDHELTVGGDFYQEDGSYEASGSSRGDDNRSETFGLFIQERMAIGRLHLSAGLRYDDYSADFGAETIDGDELSPSAGAEFELGYGLTLFGGYGESVRSSGVIPVQWLVSAVDDATFNQQPGKDSYGKSFEPETSQRYEGGLRFERDNLLRRGDSFEAELTVFKTEIDDLIAQIGGRRGAPVSGFYNDDTIEVNGWELRLAWQLSDFRTSVSYTRARAEDDNGDLIGASVGNRTAATTGDRLMWDTSWQVRPDFSCGYTLDAMAGLDKDDIDRSGYVLHHLQAEWTTSIDGLSVQLAVRNLFDRRYSDQTSVGTDSTAVYEPGRDVRLAMTYHF

SEQ ID NO: 7660 - protein, 149 aa, Vibrio tubiashii
LDVYTRLVGMVWRADATQTNPTYGRISNHDTGVSPLAAVGVEYAVTKNWATRLDYRWVNNIGDAGTVGARPDNSMLTVGVSYRFGQHEAAPVVAPAPAPAPVVETKRFTLKSDVLFTFNKSTLKPEGQQALDQLYTQLSNLDPKDGSVV

SEQ ID NO: 7661 - protein, 197 aa, Methylobacterium extorquens
MLKTTTALMTATTLLTAPAFAGNVQEPVAEPVIATPVAPPAPTSPNWTGFYGGGQIGYGDVDTSAAGVEGDGLIGGVIAGYDYDFGNNWVVGAGLDYDFADIDLGGAASLEEVFRAKARAGYKIGNGLLYGTGGYAWADTDTFGDDDGYFVGAGYEHMVTENVSLGGEVLYHQFDDFGTSGADVDATTVQARASFRF

SEQ ID NO: 7662 - protein, 776 aa, Methylobacterium extorquens
MRSHPAARRVAWLLAASPLALSGLAAAQTAGESVTLEELAVTGEGTPQSQAATGSGAPGFGVSGPPGAAALGIERPIGQVVTAVGREGTIANRPATSIGTVLLDSPGVTLRQGNGGRDVVISIRGNNARATGVTRNMVVLEDGFPVTQPDGASRFDLVDPRAYSRIDVFRGPQSALFGNFATGGALAFRTRTGREIDGYEIGVDAGSFGYLSNYFSVGGVSGPYEISLFASDVRANGYQDHSSYDTQTINLLASYTPSPDNRFTLKVINNEVTANIPARSSLDQFRINPYQRGCDAAATAAPGCTTFGLLANGAFGPRVPVTASEGAFRRNDRRTIIAGRWEHDLDAQTAWRVQVGFDERNYNQPFYTTSGRGSLPSYFVQTDLTRRGELFGLPAVGSVTLAYSAVDIAASVYNRAPYGGARLGTLIGLQEALQSNLGGRARLELELAPQWTAVAGLGAEESSIIGRNRTFATTAAGTVSTLAQADRHFLNVAPELALVYRPDPDWALRGRVATGYATPSFSSMFVNATGLPGNNTDLKTQENLGFDLGTDFMPLPGLRLSLTGFYEFFHNEFVTQSPGAGLLNYTFNAPASEHRGIEVGADWTFAPGWRGVLAYTFDDQVYTDYVEQLSAAALTARFDRAGNRIPGVPAHQLLARVGYDVPAGALAGLGGFAEVVAQDGYFIDNANFLKVPGFAILNLNIHYASPLRNGYARRIDLYGEVRNVLDTTYVGSANPLANTLNAATGAQNGRAALAGTTGSIFAGPPRTFVAGMKLSF

SEQ ID NO: 7663 - protein, 851 aa, Methylobacterium extorquens
MASRARRFSQGRMAGIALAGVSVAVMAQAAAQAGEAKRPRGPTILAEAPLGGAPVRLAIPKGSLEAGLVAFTEQAGVKLVYPTELTARLETPGLAGEFAPLDALTKLLDGTGLTYRPAGASTITLVNPRYVQLGAAPAGAVTLDELHVEGQAQARGRAAAAGLPPPTGTVGQPPVPYAGGQVGSGARVGLLGNRSVLKTPFSITGYTEKLIADQQAVSLADVVLNNSSVRNDAPPYSERDSYFIRGFSVTNLDTAFDGLFYLANPRRTFTEGLERVEVLLGPTALLSGGTGRVGGTINLIPKRAYDEPFARLTTTYISDAQIWTHADLGRRFGESKEWGVRFNGAYRTGATPLDNNAIEVGVAALGLDYRGDRFRASLDMTHSTQNVTAPTSLFNAVAPGIQIPRAPNNRTNTANPFEYNDSRYGMITGRAEYDVLPDTTVYIAGGASRYNEDFLTSNYRVTSVTGQATNLLAIQPQEIQGLTGEVGLRTRFSTGFLNHQVNIAAVEANNKNFRSGFVPPVFTPYTINIYNPVYLPTGSIPTIGLPRSAAQPLFAQLSARSVAVADTLSFFGDDRFLLTLGGRYQEIDQQGFATRPGPTQGQVTSNYQEGRFSPAITFVLSPFENLSFYGNYIESLDPVAAAPLAAINANVLFPPAVGRQKEIGVKYDFGTIAATAALFEIELPNAFTDPGTRIYSVSGRQRNRGVELNVFGEVVPGLRLLGGVTFIDAELVNTPGGQFNGRAAPGVPDTAFNLYAEYDLPPWLAPGLTLTGRAIYTSSMFYDQANTQSVPDWTRFDAGLRYTTEGVNGKPVVFRALVQNLLDDSYWASAARGFLAVGAPRTFIVSASVDF

SEQ ID NO: 7664 - protein, 986 aa, Methylobacterium extorquens
MSSAKTLQISYIGMQTQEVAIKPNLKVILKSDTELLDEVTVVAYGTKRKQDLVGSISSVKNEIISNSQAASVSNALEGAVAGLQVVSSSGQPGQDADIVLRGIGSISASNNALIVVDGVPFNGKLSDINPTDIASVNVSKDAVSNSLYGSRAAGGVVMITTKTGRKDKVSINFDGSWGVAQRAYKDYDMATDPGEFYRLTWYGIRNTYWAAGNSIEDSNLAASQDLLGELGNYNAYIIPQGEYLVTPDGKLNPNARLRYDDTFADALFDNAFRQEYNVSASGGNDRTDFYVSMGYLDNDSYVLGSSYERFTARANVNSQLKSWLKVGTNVGYSKATQNGVQENAGTASNPFAVARSWAPIFPVHAYDTEGNMKYYEDGRPMYDAGNGETDGTSKRPTATNQNVIANMREDIRESVYNNLTSRSYIEISFLKNFKFTANYSYDFTNDSETLYYTPTIGDGQSFGGRGTQASINTTTTNFNQILAYSNVFGDYHHLSAKVGHEYYKYEYDYFDGQKTNFFNPSNPELNNGGQMQYINSYKVNHNIEGYFGMADYDYNNKYYISAAFRRDGTSRFLDRWGNFWSVGAAWRISNEAFMDGTDAWLNDLKIRASYGTQGNENILSDEGYAYVYTPYQDQYTVTWNGAELGYSPEFYGNPDLTWEKQKTFDVGVDFRLFDRVYGSFEYFYRRTDDMLFKRPVAFSTAGRPYNWENLGAMKNTGIEFDVNVDIFNQPDLKWTVSLVGSHYKNRILTLPEENRKDGITSGPFNLREGKSRFEYYTYMYAGMDEKGNAMWYMDETNDKGEVIGRTTTTTYAEATRYFIGKSALPDFNGGFSTTFSYKGIDLSIATAFQIGGYAYDYSYLDGMSSSFYVGHNKDMWKTFNPETGTGSLPIWNADNASNSFTQQSDLNLIKASYFSIRNITLGYTLPKNLMQKFGIEKLRIYATADNLALWSKRQGFDPRVAMAGADDKYGGYSPMRVISGGINLTF

SEQ ID NO: 7665 - protein, 684 aa, Methylobacterium extorquens
MLAAGLATPGAWAQETSADNAATLPAVRVTGSQETATGPVTGYVARRSATGTKTDTALRETPQAITVIPREQIVDQGAQNVQDTMNYAAGVRPNAYGVDNRADYVRVRGVEPVQYLDGLRQFFSYNNPRTEVYALERVEVLRGPSSMLYGQGSTGGVLNLVSKRPQPEAQREIGVILGNHNRKEIQADLTGPLTEDGQWLYRVVAVARDSGTQVQYAPDDRLMLAPSLTWQPSAATSLTLQGYFQKDKAGTTQSFLPWNGSVSYNPNGQVPTRRFVSEPGFDAYDTEQFSLGWLFEHKFNDRWTVRQNFRNTISKVDYKSMYPDSYSNPEDPYLDPAQTTLNRYWYVHKPRMRTLLADQNLEGKLNWGATEHTVLFGADYSRYRETGEEGSGLGSPLNVYHPVYGNIPDYETADTPKTKQQQLGFYAQDQIRYRNWIFLAGIRHDRAQTDVEGSDRETDNATTKRFGLLYAADNGLSPYISYSESFTPIAGTDVHSNRWKPMRGKQWELGLKYMPPDSDLEASAAIYDLREKNRQVPDPTNPNNQVQTGKTKTKGVELELRGRVTKQVDVIANYIYTDIDPALEGVPKHMASLWTKYRFALAGLNGFSAGAGVRYLGAFTDGGAPETPSVTLFDAMLAYDSGTWRYALNVNNIADKTYEVTCLRRGDCFYGQRRTVTLSAAYRF

SEQ ID NO: 7666 - protein, 961 aa, Methylobacterium extorquens
MQGDSREECAAYHSGDDSGHRVARSRHRRDVHESICNIAWEGKMLNHKRSALSLALAVVLAPTLASAQSTQSTTTPATTAATNLDTVQVTGIRRGIENAIAVKQDATSVVEAISAEDIGKLPDVSIAESISRLPGLAAQRVAGRAQVISVRGLSPDFATTLLNGREVVSTGDNRGVEFDQYPSELVNGVTVYKTPDAALVGQGLSGTIDMQTARPLSFGERVIAVSGRYQKSSLGRAANVDPYGNRFSASYIDQFLDKTLGIAIGYAHSDMPIQENQVGLYEPWTTEHTDKGERPGVGAGTYFSDGIKALRRTGNNKRDGVMATIQFRPNNSWTSTFDAFHTEAEQIDTANQFELNLSNYNGNYTPGLLVSNPQINANGSFTGGTASGVYPLVRGMYNKRKDKIDAFGWNNEFNFGGVKLVADLNYSKATRAELNLENNLQLTPMPQLDTVGVSIRQNGFSQISPGLNYSNPDALFLTNTIYGSGYGKVPQVEDRLKGGKLAATIALPEAIASWAPDLDIGVNYADRRKVKTQSEGNILLGAQGDANIASDLQYRPVDLSFAGLGTIPAWNVPAAVGRYMTFNPVDNLDYLIPKSWTVQEKITTAWARLNINTDIGVVGVRGNIGVQMQHTDQSSDSRYWDSSQPAGSNIQPYSAGRTYNDWLPSLNLAFMFPHQQTLRFAAAKQVARPRVDQMRAGLEFGVDTGTGRPGGSGGNPLLDPWRATALDLSYEKYFGEKAYVAAAIFYKDLKSYVYTQSVDNYDFTALLGSYVPPPGMTAPVLTTGTFSAPQNGKGGTLKGLELTASFPLDMLTDSLRGFGVQASATFNKSDITILDPESASSVGSDPISLPGLSKRVYNFTAYYERSGFEARVSQRRRSDFIGEIGNFNGNRSLRYVVGENVTDAQVSYTFSDSSALRGLTLLLQGSNLTNEPYRTYAGSKDRPLEYIEWGRTYMLGVNYKF

SEQ ID NO: 7667 - protein, 715 aa, Methylobacterium extorquens
MPFRHRAVPRAALPSTLLVSGLVLSAPVLAQAPPESAALSEISVSASPATGRPAGPAETAGSLTVPSVAAQRAAVNATVGSVAFVDAATFQNRYANTVRDVLKDVPGVFVQERYGQEMRLSIRGSGIARGFHVRGIELLQDGIPLNLADGSGDFYQIDPLSLRSAEVYKGGNALTFGATTLGGAVNFVTPTAYTALSPNSVRIDGGSFNTIREHFQLSRISGPADVLISGTATNSDGFRDHETQRTRNVNANLGYRLAPGVETRFFLGFYDTDQKLPGSLSLFDALNNPRLANPAALAGNQSRKVTTERIANRTSFELEVGRLDIDSWAIHKNLYHPIFQVIDQDGWTYGVAPRWAGTFDLGGFRNDLILGLRAFAGINDARQFVNVAGFRGAQTLDARQSASNYEAYAENRFWFRPDMALMTGAKLFSANRTFSDKGGLPASPAARFANVTYEGINPKLGLLWQPLPEIQVFADITRSRDVPDFSDLVQANLLGTTFVPLEAQRAWTYEAGSRGRIDRLSWDVTLYRAEVRDALINFTPNPGLNIPAATFNAPRTRHQGVEAAVTLDLATDLTGVGDRLAVTQIWTHNDFRFVADPVFGNNRIAGVPVNVLRTVLGYRHPSGFHLAPTLDWVPQGAFADHANTLKVPGYALLGLQAGIDFANGVSLFVDARNLTDERYVSDISTVTNAATVAGGPVAFFPGNGRSVFGGVRASF

SEQ ID NO: 7668 - protein, 653 aa, Methylobacterium extorquens
MSRRSLPAGCACIVLSTGVTLAAQADELGYELSERDYLSEIPHIYSASRLPQQLEDAAGALTVLDREFIRLTGARELTEVFRWVPGFQVATSAGGRPVVAYHGLSGQISQRMQVYVDGRSVYAPYLFGGVDWSALSVPLDEIERIEIQRGSNSVTYGANAFLGVIHIVTRAAAQSVGVRAEVVQGSAGVADRHIRWGHAQPAAQWRIAAGQRSDDGLAGRPDGYRTNYLDLRAEFQPSSTQEWSITSGITRSHLGSGFEKRVGDPPRTEIAESASLQARYRQTVDPGQEWSVTMSSTQDSGDDSFDIPLLDKGSLHIDGRRRANRYALDYQHFKDLSPQWRASWGLGYRQDSVTAFQLFNSGAPQTNASWLGFLNAEWRPSTHWTLNFGSLVERDRLAPTQWAPRLAINWKPLAAHTFKLGYSSAFRTPSIFEQRADWRIQNEGNTLDIRYLSSGGLLPERVNAWDLVYLGQWREQGLTLDARLFQEKLSRIVTGRLTLLPMGATFAPNAAAYDLRNNASAINRGVEYQLSWRPAGGTIVSWNQYFARPQASPAVIAQTIARRSTGLLVSHAWPRGWTTGLGYTSMSSMRWLGEPTQVGAQRFASLRVARSLRVNGSHVHVAVRWFQPLGQSDEFRELQRERRKLWLAVSLEY

SEQ ID NO: 7669 - protein, 759 aa, Methylobacterium extorquens
MGSSKFVRGASLIAIAGAFAAVPPAYAQGQAGVEAQSGQDGSSGGLEEIVVTAQKRSENAQKVAATVTVVNAEALVAGGVTDLRGVASFLPMTNLSQENVVTQAFIRGIGQTSDAETNDPAVATNIDGVYQSRYTLSGSMFDIERVEVLAGPQGTLYGRNAAGGAINITTKLPQFTPGGEARFEIGNYNRFHGFGAINVPLSQQVALRGAVDYLRHDGYLSNGQNAKDNLAARLTALIEPDSDLTIVLRGEYQHTGGDGDGIVLRPLLKKSDPWFQPEIPGEDFYVHRKVYKGNAEIKYQVGGPANLSVTYIPAYTYYDLSYRSPIGYNQRYYPNPGVAGNPLTGFAGALENLGDTGRQLTNELRLAGDTGRLNFVLGLFQFRQSAHGPGVSFEIYNPGVFSGGSFRPYSFASGGPQNDLNVVTNSKAIFGQATYAVTDALRFTVGGRYSWDKRHADGVSQGLVPIANIALPPIVYDLRLSDNRFDWKVGVEADVAPHSMAYATVQTGYIGSGFNITSNAAASTFKPETLTAYTVGLKNSLFGNSLRLNLEAFYYDYRQLQVSAYNSASGSALLYNVPKSEIYGLQVDTTWKAGPNTTFTANLGYLHATIKRGVLPPGAVYTCGVPGAIPAELCNGNSLIDYSGFTLPNAPRWSGSTSVTQIFPLASGAAIEARGSMNFESKSWGLFSHLEGLDKPAFAKIDASLTYRSSDERWALGLWVRNLTNNARYVTPTTTNVYGLNTWFIDAPRTAGMKAELSF

SEQ ID NO: 7670 - protein, 226 aa, Methylobacterium extorquens
MAARSSRLAAMFGVLGVGLLGVSTSSQAAEPAMKTVPESGLTAGSFLVRGRVVGSIPVGQFSRVEPIGGRVITPARALPDLDVTYFLSDHFAVAGQFGVVSTKTSIRGSLIGDLTIGSTWSFAMTGAVQFHFLPHGPFNPYIGAGAGYTHPIAYEPDKPLITEMRADPQLGPMLQAGFDYHLGGNWYANMEIKKIFLPPQVSRIGSGTTTVRLDMLIIGAGIGYRF

SEQ ID NO: 7671 - protein, 718 aa, Methylobacterium extorquens
MRVLLVLSLLLFGTQIIAQHQISGAIKGQRGLPITGANVYIVGSYDGATTNLEGKFSFSTSETGIKTLYVSFLSFEDYSLTANLSEFKNLEIKLKEDVNMLDAVMLSTGTFEAGENSRVTALKPLDVVTTASALGDFLGALQTLPGTSTVGEDGRLFIRGGGADETQIFIDGMRVFAPYTPTANNIPTRGRFSPFLFKGISFSTGGYSAEYGQALSGVLKLNTIDEPDQEKTEVSLMTVGLGVGNTQKWDKSSLSINTNYTNLAPYTEALPNRNEWLSPIQSMNGEIIYRYKTNNSDILKLYGGYSYTDLDLIQQNINFEEGFRFANENRNLYINGSYKSFLGKSWILNTGFSLSNDNNKLQVGEDLIDNNDNSAHLKIKLRKRINNNFEFNFGSEYFITDFDENFESNLLGNFDYGFQSNISAGFGEVDIFFSKKLAMNLGGRIDHYELWNQTLFSPRGSIAYKSGEFSQFSFAYGKFFQNPSADFLKFNDTITAENASHFIANFQYVKSKKIFRVEAYHKTYADLVKFDTEFPTFTSSYNSTGSGYASGVDLFWRDNESFKNLEYWASYSYLDTERDYRNFLEKARPAFASEHNLSLVAKYWIEDWKSQLGFSHVFASGRNYTDPNSNGFLNRETKNFNSLSFNWAYLIDKQKILYFAVSNVLGTRNIFGYNYANEMDMSGVFQREAILPNTDQFFFVGFFWTLSDDKKSNQLNNL

SEQ ID NO: 7672 - protein, 724 aa, Methylobacterium extorquens
MRRRGTNEVAFALLAGTAVAVALPARAQPLVPVEASPAAVALDELAVEGLGRGALRLEPQGGVTVGYLGKATRSATKTPTPLLDTPQSVSVITREQILDQGFQSIGEATRYVPGVIQAQGEGNRDELIIRGQRSNADFFVNGIRDDVQYYRDLYNIQRIEVLKGPNAMIFGRGGGGGVINRVLKEADGVPTREIVAQGGQFANKRVALDVGDRVSDSVFFRMNGVFEDTATYRDFVDIRRYGVNPTMTFLLGPQTTLRLSYEYFHDDRTTDRGIPSQFGRPYRYRDNRATYFGNPFLSPTYVNAHIATAQLDHVFENGVVMRSQSRIADYEKFYQNVFPGGAVNAAGTAVNISAYNSQTDRTNYFNQTDFTYQFLTGPVKHTLLGGFELGYQEGLSFRQEGFFALPGAPQTLVVNPLAPVTRVGVNFRNTTGANSVYDLGLAAAYVQDQVELNEYVQLIGGLRFDHFDFSATDRGTRATNARVDDLVSPRAGLVVKPLPNLAFYTSYSISYLPSSGDQFSTLSPGLAIAQPEKFENTEVGVKYDVSPVLQLTGALFNLDRSNQRIADPNRAGFFLTSGQTNTQGAEIGANGYVTDWWSVAGGYAFTDARIANRLSDTIVAGNFVGLVPLNSFTLWNKFDIDPSFSVGVGFINQSHSFATSDNTVRLPSYSRFDLGLFYRISENARAQVNIENLFDRNYIVSAHNNNNILPGAPRTVRAQIIVRW

SEQ ID NO: 7673 - protein, 703 aa, Methylobacterium extorquens
MFKARAGIIAKQGAVSAGLAAILGFHAGAGMGADLAERARPRFIDWSGFYAGVQGSAGASFGNYDFGPTTIGSRRVRSISTGDATGSRDLGGDATTAVGGAFAGWNWQDGALVYGIEADLVGANLKRGARSDAMGFGYEGIDPPFALIREKTDVFGAARARLGYAFGNNLIYATAGLTGANGRVLATYPDLAGGPTATATRNVSYLGFTLGAGVQFAVDPHLSLGIDYRYSDLGESGRFGLGALPGLDGGPVTTRTSFVSNKMMARLIWHPQALTLVPEEDDETPKDARFSLHGQTTFVNQGVTGFRAPYRGPQSLVPDQAQATTTATLFLGLKLFEGTELYYNPEFSQGFGLSRTLGVAGFVNGEAQKAGAPFPKLRSNRYFVRQTFGLGGETEEVPDGPNSVAGTRNVERITVIAGKFALGDFFDGNAYAHDPRVDFMNWGLWAAAAWDFPANLPGFTQGVMVEYNRAEFAIRAAYTQVPKEPSSDVLDPRVFERAGAVIEFEERHTLPVLDQPGRLRLGLFSNVGNTANFRQVVALTQSGAFADINTAAAATREPRRKSGAYVNLEQALTADLGLFARASVNDGRNENLNFTDIDGSVSGGLSLKGAAWGRPQDTVGVGAAANRISTAHRAYFANGGLGLLIGDGRLDNYAPERAVEVYYALNLTKAVTMTFDYQHIENPAYNRDRGPADFFGTRLHTDF

SEQ ID NO: 7674 - protein, 701 aa, Methylobacterium extorquens
MSRKNWAAAPMAIVVGTAGLSSAEAQELSLPAIEVSGQRTTAPFRAPESTSATRTETDVMEIPFAVSSVDTKLIRTVAATRGDDLYDWVAGVARQNNFGGLWDNYAVRGFAGDGGTSGTDYLVNGFSWNRGMSVPRDTATLERMEVLKGPASALYGRGDPGGLISYTTKQPQFAPSNTIGVSAGSYGALRQTLDSTGPVTKSLAYRFIAMNEDNGSFRDTVSSKRYLFAPSFTWDIGDDTTLHYEFETARQRAPLDRGVVAVNGQLGAVPASRFMGEPRDGDYDVRNSGHQLTLEHRFNADWSINAGFAQRDTDLSGRSSEAFALQPDGRTLWRRYRQVAFHSNDLQGRVEVAGKARTGAIGHMFVMGVDAYRFNYDQFVARSTPTAAAPYAIDIFNPVYGQPAPVPRTATNLLERDDGQGLYAQDTLAFGPHWKVLAGLRWDRFHQSVENRLKGVTTSQLQTAVSPRLGIVYEASPSLSLYANTAYSFRPNNGADVNGRAFDPEKGHGYEAGVKWAGTRWLATVAAFYVNKRNVLTADPANAGFSRAAGEVRSRGVEFEWNGELGHGLRGIVNLAYVDAQVTRDSVLTPGARLVDIPRLSGSALLMYETALPLVDKAGAGAGVIYVGRRAGNTANTQDGFDLPAYATVQLNGYVQVNKHLRASVVLNNLFNRTYYVSSYNSLWVTPGAPRSLFASLSYTF

SEQ ID NO: 7675 - protein, 726 aa, Methylobacterium extorquens
MSNAAISRACRIGWQPRLLALAAAATCASTAAFAQARESTMEEVVVSASGFEQELKNAPASISVVTRQELETKNFRDLAEALQGVEGIDVMGGTGKTGGLDISIRGMPSDYTLILIDGRRQNVAGDVTPNGFGAALTSFMPPISAIERIEVIRGPMSTLYGSDAMGGVINIITRKVSKEWGGEVSVGMGLPQDSEWGNQYRGNFYVNGPIKQDLLGLAVRGSTYSRDASDWVLAPGAAQPAGARNPAPAQSRQHSLGAKLTLTPNRYHDIWLDVDQGRTWYNNEDGRLGNRDAEAPRNPPGYKDALRFNRDQVTIGHTGRLGFGTLESSLMHTETETIGRTIPGAAVPTNDPRRGADRELKTTNLVLDSKLVAPVGDAHMLTVGGQFWDAKLKDGLLPQSHKQTMWSLFVEDEWRLRQGLTATLGGRYDHHDAFGGQFSPRAYLVWDATANWTFKGGVSQGFKAPRLNQLIDGVSGVSGQGTTINIGNPNLKPETSTNVELSALFDNKAGWTSSATFFHNDVKDKIASGGSCATAAISSCAYNPTADYAINVDKAKTWGLELSSRAQLAKDWAVKAGYTWTNSEVIEGGRKNGQLANTAKHIANAQLDWTPSSQWRLWARGEYRSKSPRFSGSYDNLSNANKAVFDAVGDIKGYALFHLGGSYQVNKSLSLNASIFNLFDKDFRKYQQVSVNGTPTWVNSYFQGGSSVSGVTQAGRTFWITANMKF

SEQ ID NO: 7676 - protein, 127 aa, Methylobacterium extorquens
MIASYAYTDAKITRDNSFAVGNRLPIAPLHGASFWSAYRIGEGPLEGWGVGAGLFAVGERFEDLDNSFILPGYTRVDAALYYRRGWLNAAINFKNLLGAQYIESAIGRTAIYPGAPFTVQGTLEVRF

SEQ ID NO: 7677 - protein, 719 aa, Methylobacterium extorquens
MRIRYVSGTLGMFFTLFSNAQVVSDTIKSVDLSEVVVTGSYRHAQEKKTTLTLELFQKDYLNRHFTGNLVQTLKNVPGVHSMDIGAGFSKPMIRGLGFNRIAVSENGIKQEGQQWGADHGLEIDAFNVDEVRILKGPSSLLYGSDAMGGVIEILPLLPQKENRFFGEAALLGKSVNGTVGGSLMLGIEKNAWLVRVRFSEQHYGDYHVPVDTIVYLTQLVPVYGRKLKNTAGFERNVSVMGDYRKKFYQMNIAVSNVYQKMGFFLGAHGIPDISRLEDDENSRNIELPYSKVNHLKVTTHQQYLWNGIQLSGDFGYQFNHREEWSAFHTHYDTQMMPAKDPDRELVFKLHTFSSSLKLRLSSSSSWEHMAGWNMQIQKNAIGGYSFLLPEYKRFTTGAFWLTTFRLDNQLSVTGGIRYDRGRIDIAAFEDPYLVEYLHRQGYEEEVIQAYRWRSYPVDRAYGNYSCSAGVVWTPAAGHLLKMNVGRSFRLPGVNELASNGVHHGTFRHEKGDATLSSEQGWQIDASYTLAYKKMELVVSSFASWFDNYIYLRPMGEWSVLPHAGQIYQYSGARALFMGGEINFNMDFLRHFNYRLVGEYVYTYNRDEHTALSFSPPVSMRNILTWNKKDFQLYAELQSIASQNRIARNEDRTPGACLIHLGGSIHIPMAKADIEISLGIRNLSDVKYYNHLSFYRKVEIPEPGRSFQISIKVPFKQLLK

SEQ ID NO: 7678 - protein, 728 aa, Methylobacterium extorquens
MAGSALAAFTLVPLAHAQDASEGSSTTVLERLQVRGGGEDATGVADTPLATETSSEDIENAQITSIEDLGRRLEPGVGFNSSNGSVNIRGLDGARVLTAIDGIQIPYLEDGARGADGGINSFDFNSLEAIDIVRGGDSSRGGSGALGGAMILRTLEPEDLIQEGRDTGGYLRSIYDSKDSSISGFAGIAARMGNSSVLFQGGYRSGNETESNGNVGGYGPTRTEANPADYDENNLLFKLRQATEGGHTFGLTAERYDIDTDTDLMSEQTPTGNYRPGDWWGSEGTRRERLSFDYNYEAADDASFFDTANAVVYWQRLRRSSGTSGSRYTSVIGPYSRLSEVTNESYGLSGLGEKTLELGGLSHKFTVGGNFSTGTTSQYSSGQDSCATAPSFTCNFLHTNQADMPDVDSTQFGIYIDDEITIGDSRFSLTPGIRFDWYDHSPKDTAAYQVNPNYTGLPAGQDDYQFSPKLLGKYEVTSEFDVFAQWAMAFRAPTASELYLDYGAPGTYLSIGNADLDPESSHGFEIGGTYDNGSLRGRATAFYNRYKNFIDTRSLSTAEQTALGIAPGTYPFGVTQSINRASVEIYGAEFSIEKQFDNGFSLNGGLAYARGVDRDTGEVLGSVAPFKAVIGAGYATETWGANVNWIGVASVSENSTANFKAPSYGIVDATAWWKPEKLNGFSVQAGVYNIFDETYYDAVSLRDVTMNQPEEYYSEPGRSFKVSITQRF

SEQ ID NO: 7679 - protein, 792 aa, Methylobacterium extorquens
MARNRTTSGRAGQDRGVIRPAAVSVFLGVAGVAAGLTLPALAQNYSFSDVRIEGNQRVDATTVLGFARINRGQAVSGGQLNEAYQRLADSGLFETVEIVPQGGTLVIRVQEYPTINVINFEGNARIKDENLATLIQSQSRRAYNPSQAEADAAAITEAYRVQGRIAATVTPKIIRRSGNRVDLVFDIAEGKVVEIERLSFVGNRAYSDRRLRQVLETKQAGLLRSVIASDTFIAERIELDKQLLRDFYLSRGFIDFEVLDATAEVTRERDAFFLTFTVQEGQSYSFGQVTASSEVEGVDAADFSNALRIRRGVTYSPSVVENNIARLESLALQKGLNFIRVEPRITRNERNQTLDVNFALVRGERIFVERIDIEGNTTTLDQVVRRQFRTVEGDPFNPREVRQSAERIRALGYFANADVNTQPGSSPDQVVVNVDVEEQPTGSLSFGVSYGVSSGAGFSIGFSEQNFLGRGQILGLDISTGTDNINTQINFVEPAFLGRDLRFRFNTYYRETDNQYSRYDTRRIGISPSIEFPISENGRLEMRYTLSQDKIQNVDRGLDDDGDTDASSIILRKEEDRGALIASSLGYTYSWDSNRGGMNPTGRNLLRFTQDFAGVGGDVEYVSTTALALTERKVWNEELTVRAVLEGGVLNMIGDDSSRVTDRFFGNGKIRGFEPNGIGPRDLNVGNEDALGGNYFAVARLEAEFPLGLPEEYGFMGGVFMDAGSVWSLDDVNGGENGDDPVDDDFHLRSSVGVSVFWTTPIGPLRFNFAKAIEKQDYDKEQFFDLTISTRF

SEQ ID NO: 7680 - protein, 486 aa, Methylobacterium extorquens
MLERMTQTRARRRRGVRIGTAGALLAASLTTATGVSAQQPSPVGQFNDQTQPRTDPRIAEKPSDPVRVGPLAPWATHMAERGLTFDINIYNFYQANPSAGLRTGEQSNSTYFVLSMTADMQRIANISGGTIKFTQTFFGNVRNLNMAADIGDTTVGYQPPFNPNNNRLSLLTYQQKLLDDRLVIEVGRTHPDRYYGLPPCNSINSCFQDLFYINAGFTSPLYAVWGANAAYQLSPTSYVQAGAFSVNPGTNALSGYDFGYERLSGALVMTEIGTKTDYTMTAYPGRASLTGFFNTADHDDNFKTVFGTSKGLNPGAPVLQKSGTSGIVLTGTQTVWRADGGLVANPHPTAISLYTGTGYSFDPTVPIRFNSFVGVRLDAPDQSRPNDSYGLKMNWQRLSENYTQFLSDANFISGGSGAPYSRDKFVFEANAHFDVGAGVIIEPVVQYVVNPNSFWNPFTARRAKDGFYAGATLVVPLGTLLGLAPG

SEQ ID NO: 7681 - protein, 493 aa, Methylobacterium extorquens
MRDCLKTSPMPNVLSPPARLLLFGAGLACALPLLDAPALAQSPSAVESFTGEAGPRTNPEAIGVAPDGKVKWHGPLAPYAASLALAGLSFDVNVYDFFFSNPSAGLRPGQLSNSAYYLLSLDADLDKLAGVPGGWFHITQTFFGLRWNNRNMGADIGDTTIGYQPTFNRDFARLSILTYEQRLLDDRLAIEVGRTHPNRYYALPPCQSSVSCFQDILQINAGLSSPLYGVWGANVAYKTSPDDYIQAGAFAVTGRANFTSGWDFGHEPLNGVVTLAEIGHATTFVTDPYPSRVALTGFYNTADHEDNLRTVFGTSKGLNPGDPVRLRSGTSGVILTGSQVFWRADGGAEVGNLNPTSLQAYTSLAYAPDPTVPIRWNAFAGLTLQAPDQSRPHDRYGVKVNWQRISADYAQFLGDANFISGGSGEIYSRDKLVFEANAHLALGKNIFFEPVVQYLVNGNSFWNPFTPNRTKDGFYVGATLIVPLGQLLGLAPG

SEQ ID NO: 7682 - protein, 446 aa, Methylobacterium extorquens
MTCPALDVPMPPRRALRCLASAAAPSLALAAVPILASILTCSAGPAAAGETSGKKAEAKPPVTLDEKGITVRLDDGSTFRIGGRLQGDFGTGRVQQRGFGTVFEEPAAIRRAWIETYYSLKDFEFAFQYDFNERRVPVSDAIVAYKGFQDVIITQGNFKEPFSLDQLISDNVSQFTERSQADAFVPARNFGSAIGTHGANWTAVTGVFGGNINTGLQNNGIASTTRVTYTPWLSENKNDVLHLGLAGSYRTLGDDDSSLSLSSRSEAFLFARPLVNTRTIRDATAIGRVGVEAAWQQGPFRLQGEYILTDIERRDGRPPLLFQGGYIQASVVLNDKGRPYRVVPTYGSDYGVFTGVTIEERQRVSRGGTGLFELGVRYSAIDLESREVRGGVEHDFTAGANWYPEPNIRFVFDYIRSHAEPSAESLNFGRRTVDADLFIGRAQLTW

SEQ ID NO: 7683 - protein, 885 aa, Methylobacterium extorquens
MRGGRRGAQLALGLGLALLGTAALPLHAQDGADAASQQQTALRRVRLDIPAQALNRALLQFAEQAGVQVFFDSQRFAGLGSAAVHGEYVLADGLSQMLQGSPVEYRFSGKDQLSLIRVSQDDLVRMSPSVISAARPDDWVYQTPHSVGVIGREQIERNPPRHAADMLEETPGVYSSVSQQDPGLSVNIRGIQDYGRVNMSVDGMRQNYQQSGHQQRNGTLYVDPELLSEVVIDKGASSAMGGAGVIGGIANFRTLEARDLVKPGKQVGGRIRVTSGLGGDANGTHFIGSAAFAIGTDAWDMLVAASERHLGDYDPGTKGSIGELRTGAWFNPEAGQRVKHTPVAYSGYVMRSRLAKLGVALPQDQRLQFSYLTTQVSYDDANMLDTGNQALWEKLGSSDVRAQNFAIDYSYAPDNPLVDFRAKLYYVDNRNRQQTLQRGITPGYSITYQTDTYGVQAQNTSSFALGDLSTLRANYGLEFFYDKVRPDSSQPRASSSAVGFPAAEGMTPKGDRALGSLFARLDYDYDDWLNLNAGLRYDRYRLRGDTGFNARTFILGTTRQTDMPLQYAVDREEGRFSPTFGLSVRPGVDWLQLFATYGKGWRPPAVTESLITGRPHGGGAENMYPNPFLGPERSKAWEVGFNVLKENLWFSDDRLGLKVAYFDTRVDDFIFMGMGMQPPGYGMAGIGNSAYVNNLDTTRFRGVEYQLDYDAGLAYGQFSYTHMIGSNDFCSKTAWLGGVTQTVKGSGRRAPVIDMRPDEQANAATHCSAVLGSAEHMPMDRGSLTLGMRFFDRRLDVGARARYSEGYSVSGGGAPTVSQTGVYPADWKEYTVYDLYGSYRVSDELTLRLAMENVTDRAYLVPLGDVLAFTLGRGRTLQGTLEYQF

SEQ ID NO: 7684 - protein, 441 aa, Methylobacterium extorquens
MTGGTIRALGLAGAVAAASVAGATGAQAGAFGLREQSAQGLGVAFAGAASGGAGVSSIFWNPATVTMRPGFASEQSLSFINLSGEITPTVGTAPGLLPFGSSGEVGQGAVVPSGATSYQLTDRLWVGIQTGAPYGLVTKPRQDWAGSVYARSSRIFSLAFNPVVGFKVNDWLSVAAGPSVEYFRLTLRQAVPVPGTFPGLYPSGFIKGESWGVGFTAGVLVTPAAGTAIGVGYRSSVHHDIEGSIGFPDPRQAIALGQVRANLNTPEKVSVGLTQAINPVTRINLGFEWDNWSRLGDVGIVSRALGVTVNHLPLNFKDSFFYSIGAEYDWSPNLTLRAGFGYDNVPIDFSNRSARLPDSDRYVVSIGGSYRWSETVLLTASYAHAFFDRGLLLAGPGRDYNIGNIPLAASTDVSADVVSVGFRYQWDAPAAVAPAPLVRKF

SEQ ID NO: 7685 - protein, 502 aa, Methylobacterium extorquens
MKRRLLTALLLSSALVLPCAQAQAQTVAELQRQINELKALIKAQSEAQGRGGRGPLRQANARNTDAGTFPAAGRPKESAIGQPAAPGPVPHRFAIDEPETWYDALVPPAPQLLADDPRQAGRPKTWFERLSLRGYTQLRGNEFLSGDDTAPSGVSRLRSVHDSGITDRNNFTFRRVRLVLQGDIHERVFLYIQPDFAVGVGDRQHFTQLRDAYADVFLDDERRTKLRFGQQKVPYGWENLQSSQNRLTLDRSDAINSGVPGERDIGITFYYTPAHVQRIWDRLAKGGQKLFGNYGALGVGIYNGQTINRVEGNNDLMTVMMATWPFELDGLGEAFKGQVVEVGGSAYRNRFRPEATFGSSTALGNSFDDERVGVHAMLYPQPFGLQGEWNWGRGPEFDPVARAILTKPLQGGYVQAMYKVDHSPVGPFMPYIRWQTYDGGWKVGTNAPRLDTDEVELGVEFQPIKSVELTLAYANMKRREASSSRFGRAEGDLFRGQLQINY

SEQ ID NO: 7686 - protein, 744 aa, Methylobacterium extorquens
MRNAQVALLDPLGQKIATVASDDEGRFRMRSVAPGVYQLGAAAPALRSPSHRLSVRDGLPIEIELRLSPQLSESVGVATEGNNSGGSSGTTLAGEAVRRAATPLRGGALRAAVAATPGWTSEDNGLIHYRGVDDGLLFVLDGIPVYERLDAQFGVGFDPVNVRSVRVLSGYVPPQFGLRSGGVIEVRSEAGSIDSWSGILETGVGGHRGQALSGLLQGPTGRNASLTLSLGGERSRRFLDPVSLDNLHNQGSTGGGQAEFIWAPGPSVVSLRAGHARSSFDVPHDEEQEAAGQDQRQKLDQTFGTLNWQRSWSSAVVSQLALFGRFTNGRLLGSASDTPLFSQADREQDRLGLLAALAYERGRHRLKGGFEASRLRLHESFGFFVTDPDAGEGAGLSENVLEHHANDPFDFEGSVRRPIYSFYVQDSWRPADRLTVDLGLRYDRSHLLLRESQWSPRLGVSYRFGQATFRASLNRFFQPPQTEFLLLSSSPDAQELSPFADELGAGGAEIRAERQTAIEAGCELWLGAALRADITVWQRRIQNQGDPNVFLGTTIIFPNSVDRGRAKGLDVRVELPRRAGLSGFLTYTLSKIDQFGPINGGLFLEEEIIEIGPGTKFTPDHDQRHALSGQLSYENERRGLWVAVGGRYRSGTPLEVSEEGLVKLVERPGADLVDLEQQRVKPYAVFDVQAGQRLIRRKRFELSARASVLNLSDARYAFNFGNPFSGTHFGAPRGARLDLRLALR

SEQ ID NO: 7687 - protein, 703 aa, Methylobacterium extorquens
MFEARKRAIGERRAVSVGLAALLGFHAGAAAATDLAERARPRFLDWSGLYAGVQGSAGASFGNYDIGPTTIGTRRVRTISTGDATGSRDLGGDATTVAAGAFAGWNWQDGAIVYGLEADLAGTNLKRGARSDAPGFGYEAVDPPFALVREKTDLFGAARARLGYAFGNNLIYATFGLTGANGRVLATYPDLSGGPTATAARNVSYLGYTLGAGVQFAVDPHLSLGIDYRYSDLGESARFGLGTLPGADGGPVTTRTGFVSNKMMARLIWHPEALALVPDEEDEPPKDARFSLHGQTTFVNQGVTGFRAPYRGPQSLVPDQAQATTTATLFLGLKLFEGTELYYNPEFSQGFGLSRTLGVAGFVNGEAQKAGAPFPKLRSNRYFVRQTFGLGGETEAVPDGPNSIAGTRDVERITVIAGKFALGDFFDGNAYAHDPRVDFMNWGLWASAAWDFPANLPGFTQGVMVEYNRADFAVRAAYTQVPKEPSSDVLDPRVFERAGAVIEFEERHTLPLLDQPGRLRLGLFSNVGNTANFRQVVALTQSGDFADINTAAAATREPRRKSGAYLNLEQALTADLGLFARASVNDGRNESLSFTDIDGSVSGGLSLKGTAWGRPQDTIGFGAAANRVSPSHRAYFANGGLGLLIGDGRLDRYAPERAVEVYYALNLTKAVTMSFDYQHVENPAYNRDRGPADFIGTRLHTDF

SEQ ID NO: 7688 - protein, 658 aa, Methylobacterium extorquens
MIASGISVSTQNAFADDATSLNNTQKTQDSSVDLTGIVVTASPGGVAQDINDAPASISVITREELESKPYRDLADALSSIPGLTTTGGSDHKEISIRGMSSAYTLTLIDGKRTDSRETSRLSDGLGQMNAWTPPISAIERIEIVRGPMSSLYGADAMGGVINIITRKVAKEWSGEVSTDALLQENSQSGNANQGSFFLTGPIKQDLLGLQLYGQYSKRDEDDIYNGYRDSKRNNITAKLALTPTPDHDIIFAANHTEQRVTQEPGKSIDPNCATYSYFGCATPYDKKVDVDRFSLSHTGRWTLGTSETYVQQETFNVSSQDVRLKNTEFRTSLAMPLEDHLVTVGGGSRHNKLHDSFSNRVTNQYDITRKQNSLFAEDDWYLTDTFTLTAGARLDDDNRYGHHWSPRVYGVWGITPQWTLKGGVTSGFKSPDMTKVASGYASASGLGNIYGNEDLKPEKSLSQEIGILYNHNGVTGGLTLFNNKFEDKITTVACNTRCTAAPSGTNSLTYANVDKAITRGVEASLGLPLSSNITWDNSYTFTYSKQESGLYKGKPLNKLPRHQLTSTLNYQPTDELTTWARLAYRGKDSDNVGGTAQLLSPVESPSFTTFDIGANYEINQTLSLRAAIYNLANQRISYNKYGFVEDARRYWLGITAKF

SEQ ID NO: 7689 - protein, 287 aa, Methylobacterium extorquens
MRRRTKILALARSLTLVASVGVPCLAQAADLLPPPPMPEPLPEPEVFAGGWYLRVDGGYGSLDLRKSIAEDVSHPPKPYDYAVVQDKVSNQYFIGGGVGYQINPWLRVDATGEYRFRSKWTFVAEDKTFGDTGGYNVTSGKFDSIVGLANGYVDLGTWYGVTPFVGAGVGVAHHSFGGVTDKGFGAYEGGYGIGRHNERTNFAWALHAGLGYAVTQNIRFEAAYRYLNMGEATTGVVTCAPDCPKTVYRVKELEAHDVKVGLRYLFGAPVAVAAVDYAPPPPLVRKY

SEQ ID NO: 7690 - protein, 386 aa, Methylobacterium extorquens
MAVNTISEGTILKRQYLALSIATAACAAPQAHAQSSVQLYGLIDLSVPTYRSHANAKGDHVIGMGLGGEPWFSGSRWGLKGAEDIGGGTKVIFRLESEYTVADGNMEDPGQIFDRDAWVGVENDTFGKLTAGFQNTIARDAAAIYGDPYGSAKLTTEEGGWTNANNFKQMIFYAAGATGTRYNNGLAWKKLFGNGIFASAGYAFSNSTSFGQNSTYQVALGYNGGPFNVSGFFSHVNHAGYANKSFSVGGNYTFDIFRVNAGYFRYLGDQGALGQRQDNAWTVSFKVAPKGALDYELGYQQMRVHNAAYNSDGNVPNANIGDFSLTSGVGNGFKETLYGSVFYHLSKRTELYLAGDYMRLHGGYTVASTHGATNQLELTTGIRTRF

SEQ ID NO: 7691 - protein, 284 aa, Brucella suis
MKRGCAIAVMICGLITSVSAASAADLIVQEPVFEPLPQPALAGWYLRGDIGYNFKSKTGGKWNFWNQFEEPYRGVDDTFNYDDFSLKGGASYGVGVGYRFNDMLRTDLTLDYFRASINGRTNCPSYVKSSHGLNPVEDNCHYEDNSKASVWTAMANAYVDLPRVGPLTPYLGAGIGAAYVKYDTWKTSEICPTCTLQSDKDGFDSWRFAMALMAGVSYDLTDQLKLDLGYRYLRVNGGNAYGYDEQDRQVINQYGQGAGADGPQAKDNGFNIHTVRAGLRYEFR

SEQ ID NO: 7692 - protein, 721 aa, Brucella suis
MRIIYIIFNLMNIPPRSFKLTVIACAICYANLTYAQDAQVQALQTIQVKASNAEQSSEQTKAYNVKNSSSATKLNIEAKETPQTINVVTRQQIEDFGLTSTRDVLKNTPGVTVSNQETERTTYMARGFEISNILTDGVGFPLSGYNYNNTNPDTYFYDRVEVVKGADSLTNAFGDPSATINNIRKRPTQEFQASGGVSYGSWDTQRYEADVSGSILPSGKVRGRIMGYEQTGDSYLDRYSAEKNGFAGIVEADLTDSTLLTAVNSQEQNKPNANNWGALPLLDANGKQISYDRSYNPNPDWAHWDNETQNAFVELKQKLNDQWNAKLTYNYLDTKHNSRLLYYYGYPKSDGSGVSLTPWGGQEHQEKHAVDFNLEGTYKLFNREHEATLGYSYVRNHQQDKQSTGTINDSNVIKSTTTDWASWTPQSITWSDFTEAANYKQNINSIYAATRLHLNEDLKLLLGANYVQAESKGESYGSPMSYSESKVSPYVGLTYNFTPEYTGYMSYTSIFRPQTGIDKDTNQALKPIEGKSYEMGVKSSWLDDRLTGTLSVFKIETKHYLLRNSDGNPLNRKVPTSDLESQGVEVGLSGQITDNVNLSLGYAQFSIKDTKNGGDEEPYNPNQTLNLLTTYTPPVLPKLKVGAGLQWQDGIKLYDSNVNGTIKQDAYALVNLMASYEVNDHITLQANGNNIFDKKYLNSFPDGQAFYGAPANYTVAVKFKY

SEQ ID NO: 7693 - protein, 264 aa, Brucella suis
MKLTRTLAFSMVAGMAALAPGAGRAQTATPSAYVSAPVVAPVMAPPPSHGGHCGIFETCASTKIGLGKGDFLIRLSALGVLPEDRDSKVWAGGAVLPGARAKTTRQVMPELTFEYFFTDHISADLIAASTRHEVAVEGSALGHIDAGSAWVLPPTITIAYHFRPHKRFNPYVGVGATLAFFHNESPAGGLVKKLNVGTTGGPSFNVGFDYQLVGNWFFNFDVKQMFMRMHAWANDGGGVDGVPRIKVHDSLDPTVVGAGIEYRF

SEQ ID NO: 7694 - protein, 240 aa, Brucella suis
MKSVILASIAAMFATSAMAADVVVSEPSAPTAAPVDTFSWTGGYIGINAGYAGGKFKHPFSSFDKEDGEHVSGSPDVTAGGFVGGVQAGYNWQLDNGVVLGAETDFQGLSVTGSISAGASSLEGNAETKVEWFGTVRARLGYTATERLMVYGTGGLAYGKVKSAFNLGDDAPALHTWSDKTKAGWTLGAGAEYAINNNWTLKSEYLYTDLGKRNLVDVDNSFLESKVNFHTVRVGLNYKF

SEQ ID NO: 7695 - protein, 940 aa, Moraxella catarrhalis
MPKYKLLSASIAFSLLMSHQAYAHDEAFDKLSTKIAGQSQSWYQHLDAQVVTPFPKKGTLEAEVDRKISWDMQNNTTAERLALAKEDKNQSFAHVSHEFRKSALKEFAPHITDEQFVNIFKNLEYLSANAIYSDDFNVGRMRAYDFILKDKYLRGRPYQVMDREGKYIEGYENLKTYIDSQGRERKNSSYPSGHTSNGFGQAVVMAMAFPERGQEVFSRALQYGESRVIVGAHFPTDTMTSRLSRYYYMAQLLNDDEIAQGLVGHIKQARQPFEESCQNAPLKSCLEMLPQDLHEQYKASDYQIGYYGTLKSDEKASRLKPEEMPGTAEALLRLRFNYLDGDARRQVLASTAYPKNSHAHMGDLDNKNHTWGLINLPKAYDGISHIYQDIETTTQDKHLDFAGFSLEDTWKNDISGTGRLILNHPGELTLSGNNTFAGATVKQGHLKFTGNNALADDSYINQGTMSVTGQFQSKVVLNHDAKMMIFGQSDQPTTVQEIELSAKDSWIYVAPKGVFQVNANSQENNTTTDSQISIQTLSGVGHVMVEDHSNLHIDKLSGETIFAINPSDAPVKINELKGRHGIGIPSHISKDKNHQSLLKVDNNQGSFYLIDTNNNVVDAAEQGAYAYQLVMRPNNTLQLSQFANDNSPIASSMTKTALNTGMGSLYTLSSQMNHLGSMNNRQSVWLNHRYQENNIKSHNTQFDLKLNQTTLGAGSKVGQTYLGAYINKSEGDVDHVFGGKNDLDATGFGVYLNRLLPNQQEIFLQGAWQNVRQKIHAKQANHDNLTASIKDNTWAIALGAQQQMKFHNVDFQPSFEISHISTNPKSFRYDQMPNLQINPKKASMTTVNIGTKISKNYGLLQPYLKAKMFYQDTKQDLNIIDMNNEVSWWSTDLSGFGFAGALGVTSQINSRFFISGEASAQYQEEVKTPIEAKLSLNYQF

SEQ ID NO: 7696 - protein, 940 aa, Moraxella catarrhalis
MPKYKLLSASIAFSLLMSHQAYAHDEAFDKLSTKIAGQSQSWYQHLDAQVVTPFPKKGTLEAEVDRKISWDMQNNTTAERLALAEEDKNQSFAHVSHEFRKSALKEFAPHITDEQFVNIFKNLVYLSANAIYSDDSNVGRMRAYDFILKDKYLRGRPYQVMDREGNYIEGYENLKTYIDSQGRERKNSSYPSGHTSNGFGQAVVMAMAFPERGQEVFSRALQYGESRVIVGAHFPTDTMTSRLARYYYMAQLLNDDEIAQGLVRYIKQARQPFEESCQNAPLKSCLEMLPQDLHEQYKASDYQIGYYGTLKSDEKASRLEPEEMPGTAEALLRLRFNYLDGDARRQVLASTAYPKNSHAHMGDLDNKNHTWGLINLPKAYDGISHIYKDIETTTQDKHLDFAGFSLEDTWKNDISGTGRLILNHPGELTLSGNNTFAGATVKQGHLKFTGNNALADDSYINQGTMSVTGQFQSKVVLNHDAKMMIVGQSDQPTTVQEIELSAKDSWIYGAPKGVFQVNANSQENNTTTDSQISIQTLSGVGHVMVEDHSNLHIDKLSGETIFAINPSDAPVKINELKGRHGIGIPSHISKDKNHQSLLKVDNNQGSFYLIDTNNNVVDAAEQGAYAYQLVMRPNNTLQLSQFANDNSPIASSMTKTALNTGMGSLYTLSSQMNHLGSMNNRQSVWLNHRYQENNIKSHNTQFDLKLNQTTLGAGSQVGQTYLGAYINKSEGDVDHVFGGKNDLDATGFGVYLNRLLPNQQEIFLQGAWQNVRQKIHAKQANHDNLTASIKDNTWAIVLGAQQQMKFHNVDFQPSFEIGHIQTNPKSFRYDQMPNLQINPKKASMTTVNIGTKISKNYGLLQPYLKAKMFYQDTKQDLNIIDMNNEVSWWSTDLSGFGFAGALGVTSQINSRFFISGEASAQYQEEVKTPIEAKLSLNYQF

SEQ ID NO: 7697 - protein, 940 aa, Moraxella catarrhalis
MPKYKLLSASIAFSLLMSHQAYAHDEAFDKLSTKIAGQSQSWYQHLDAQVVTPFPKKGTLEAEVDRKISWDMQNNTTAERLALAKEDKNQSFAHVSHEFRKSALKEFAPHITDEQFVNIFKNLVYLSANAIYSDDFNVGRMRAYDFILKDKYLRGRPYQVMDREGNYIEGYENLKTYIDSQGRERKNSSYPSGHTSNGFGQAVVMAMAFPERGQEVFSRALQYGESRVIVGAHFPTDTMTSRLARYYYMAQLLNDDEIAQGLVRYIKQARQPFEESCQNAPLKSCLEMLPQDLHEQYKASDYQIGYYGTLKSDEKASRLKPEEMPSTAGALLRLRFNYLDGDARRQVLASTAYPKNSHAHMGDLDNKNHTWGLINLPKAYDGISHIYQDIETTTQDKHLDFAGFSLEDTWKNDISGTGRLILNHPGELTLSGNNTFAGATVKQGHLKFTGNNALADDSYINQGTMSVTGQFQSKVVLNHDAKMMIVGQSDQPTTVQEIELSAKDSWIYVAPKGVFQVNANSQENNTTTDSQISIQTLSGVGHVMVEDHSNLHIDKLSGETIFAINPSDAPVKINELKGRHGVGIPSHISKDKNHQSLLKVDNNQGSFYLIDTNNNVVDAAEQGAYAYQLVMRPNNTLQLSQFANDNSPIASSMTKTALNTGMGSLYTLSSQMNHLGSMNNRQSVWLNHRYQENNIKSHNTQFDLKLNQTTLGAGSKVGQTYLGAYINKSEGDVDHVFGGKNDLDATGFGVYLNRLLPNQQEIFLQGAWQNVRQKIHAKQANHDNLTASIKDNTWAIVLGAQQQMKFHNVDFQPSFEIGHIQTNPKSFRYDQMPNLQINPKKASMTTVNIGTKISKNYGLLQPYLKAKMFYQDTKQDLNIIDMNNEVSWWSTDLSGFGFAGALGVTSQINSRFFISGEASAQYQEEVKTPIEAKLSLNYQF

SEQ ID NO: 7698 - protein, 940 aa, Moraxella catarrhalis
MPKYKLLSASIAFSLLMSHQAYAHDEAFDKLSTKIAGQSQSWYQHLDAQVVTPFPKKGTLEAEVDRKISWDMQNNTTAERLALAEEDKNQSFAHVSHEFRKSALKEFAPHITDEQFVNIFKNLEYLSANAIYSDDFNVGRMRAYDFILKDKYLRGRPYQVMDREGKYIEGYENLKTYIDSQGRERKNSSYPSGHTSNGFGQAVVMAMAFPERGQEVFSRALQYGESRVIVGAHFPTDTMTSRLARYYYMAQLLNDDEIAQGLVRYIKQARQPFEESCQNAPLKSCLEMLPQDLHEQYKASDYHIGYYGTLKSDEKASRLEPEEMPGTAEALLRLRFNYLDGDARRQVLASTAYPKNSHAHMGDLDNKNHTWGLINLPKAYDGISHIYKDIETTTQDKHLDFAGFSLEDTWKNDISGTGRLILNHPGELTLSGNNTFAGATVKQGHLKFTGNNALADDSYINQGTMSVTGQFQSKVVLNHDAKMMIFGQSDQPTTVQEIELSAKDSWIYVAPKGVFQVNANSQENNTTTDSQISIQTLSGVGHVMVEDHSNLHIDKLSGETIFAINPSDAPVKINELKGRHGIGIPSHISKDKNHQSLLKVDNNQGSFYLIDTNNNVVDAAEQGAYAYQLVMRPNNTLQLSQFANDNSPIASSMTKTALNTGMGSLYTLSSQMNHLGSMNNRQSVWLNHRYQENNIKSHNTQFDLKLNQTTLGAGSQVGQTYLGAYINKSEGDVDHVFGGKNDLDATGFGVYLNRLLPNQQEIFLQGAWQNVRQKIHAKQANHDNLTASIKDNTWAIVLGAQQQMKFHNVDFQPSFEIGHIQTNPKSFRYDQMPNLQINPKKASMTTVNIGTKISKNYGLLQPYLKAKMFYQDTKQDLNIIDMNNEVSWWSTDLSGFGFAGALGVTSQINSRFFISGEASAQYQEEVKTPIEAKLSLNYQF

SEQ ID NO: 7699 - protein, 793 aa, Moraxella catarrhalis
MPKVITPVRFAAFLFFQAIATTAAAADEGLVGLSLEELLNIEVSTGSLLKNSTDDAPAAITIIRKDQIEISGAKNLANLLEQHVPGMMLMSHSEGDKIGLRGLIAAENYKLLLLVNGKNITNMVYEGAILEIDQWDMGDIERVEVIRGPGSVTYGTGAIAGIINIITKTPHSDSPAFSVGLASNNTYQSRGISAQFNKSVNQFGAYGFLSYRKTDGYQKPDYFSMSPSDETDIRFVGKRPTDTLGPQAYLADGVDRPQIKAHLGLEYGENFSSWLRYTQSGQTRFFIQQRAKEDAQGYVVGTVNRRSPSTRSLVFSTTYNLVLSDVSNVASSLTYDSQEYIRHDYLNPRWSLTHENNVRDYGFAQNRLRGTVLYEYTPDDKFNIVAGYEYANIDVHAPWGKSSDHLLIQEGVHFVSDVDSSVYLQDLTLNNRPNPDRVLEVGSGINSETHSLLLETRFNVSERNQLFYAHRVDFPDVAETMFSPRLSWVNKVNPENTLVATVQRAQRMMPLRAQYQNHLMQEESKLETLDGAEVSYTNRYYSNTSLNVRSFYNDISAVGFTGSNLEFLTDVKIGGVEFTGSYTTQTTELTFSHAYLGVLDVAMNESLKTGASRNNISFADYYYIPRGDIPVLLESYGNGLNNIVSHTSKFLISKKFLNNRLIAHANAQIFWDFDGSYDEMEMYQRAYDTFNTAELPAEDLALFTEQKRQFERERYLLDKTDSYKLDYALNVSLSYTHSLNKKADVRVKLFAENILHSKNRYNVSTGSSRFYPERFNFMVEPVAIGMSVTLDLN

SEQ ID NO: 7700 - protein, 654 aa, Helicobacter pylori
MKKLFIPLLLFSALEANEKNGFFIEAGFETGLLEGTQTQEKRHTTTKNTYATYNYLPTDTVLKRAASLFTNAEAISKLKFSSLSPVRVLYMYNGQLTIENFLPYNLNNVKLSFTDAQGNVIDLGVIETIPKHSKIVLPGEAFDSLKIDPYTLFLPKIEATSTSVSDANTQRVFETLNKIKTNLIVNYRNENKFKDHENHWEAFTPQTAEEFTNLMLNMIAVLDSQSWGDAILNAPFEFTNKGGGGECDTSKENDCVNPGTNGLVNSKVDQQYVLNKQDIVNKFRNKADLDVVVLKDSGVVGLGSDITPSNNDDGKHYGQLGVVASALDPKKLFGNDLKTIKLEDLRTILHEFSHTKGYTHNGNMTYQRVPTGQNENGKPKDSDGLPYNVCSLYGGSNQPAFPSNYPNSIYHNCADVPAGFLGVTAAVWQQLINQNALPINYANLGSQTNYNLNASLNTQDLANSMLSTIQKTFVTSSVTNHYSSSASQSFRSPILGVNAKIGYQNYFNDFIGLAYYGIIKYNYSKALNQKFQQLSYGGGIDLLLDFITTYSNKNSPIDIQTRRNFSSSFGIFGGLRGLYNSYYVLNKVKGSGNLDVATGLNYRYKHSKYSVGISIPLIQRKASVVSSGSDYTNSFVFNEGASHFKVFFNYGWVF

SEQ ID NO: 7701 - protein, 661 aa, Helicobacter pylori
MRKLFIPLLLFSALEANEKNGFFIEAGFETGLLEGTQTQEKRHTTTKNTYATYNYLPTDTILKRAANLFTNAEAISKLKFSSLSPIRVLYMYNGQLTIENFLPYNLSNVKLSFTDAQGNAIDLGVIETIPKHSKIILPGEAFDSLKIDPYTYTLFLPKIEATSTSVSDANTQRVFETLNKIKTNLVVNYRNENKFEGHQSHWEAFTPQTAEEFTNLMLNMIAVLDSQSWGDAILNAPFEFTNKGGGGECDTNKENDCVNPGTNGLVNSQNKSYVLNKQDIVNKFRNKADLDVVVLKDSGVVGLGSDITPNNNDDGKHYGQLGVVASALDPKKLFGNDLKTIKLEDLRTILHEFSHTKGYTHNGNMTYQRVPVTKDGQVENDNNGKPKDSDGLPYNVCSLYGGQGQSAFPSNYPNSIYHNCADVPAGFLGVTAAVWQQLINQNALPINYANLGSQTNYNLNASLNTQDLANSMLNTIQKTFVTSSVTNHYSSSASQSFRSPILGVNAKIGYQNYFNDFIGLAYYGIVKYNYSKALNQKFQQLSYGGGIDLLVDFITTYSNKNNPTGVQTKRNFSSSFGIFGGLRGLYNSYYVLNKVKGSGNLDVATGLNYRYKHSKYSVGISIPLIQRKASVVSSGSDYTNSFVFNEGASHFKVFFNYGWVF

SEQ ID NO: 7702 - protein, 667 aa, Helicobacter pylori
MKKLFIPLLLFSALEANEKNGFFIEAGFETGLLEGTQTQEKRHTTTKNTYATYDYLPTDSVLKRAANLFTNTDITKLKFSTKNPVSVHMGLTNPNPSNGAKSKVTMVVENFLPYNLNNVRLFFKDNKGKVIDLGVLETIPKHSKIVLPENIFDKIKLDDPYFFPTFEATSTSISDANTQRVFETLNKIKTDLVVNYRNENKFKDHENHWEAFTPQTAEEFTNLMLNMIAVLDSQSWGDAILNAPFEFTNKGGEECDTSKENECVNPGTNGLVNSQNKSYVLNKQDIVNKFRNKADLDVIVLKDSGVVGLGSDITPSNNDDGKHYGQLGVVASALDPKKLFGNNLKTINLADLRTILHEFSHTKGYGHNGNMTYQRVPVMKNGQVEKDNNGKPKDSDGLPYNVCSLYGGSNQSAFPSNYPNSIYHNCADVPAGFLGVTAAVWQQLINQNALPIDYANLSAQTNYNLNASLNTQDLANSMLSTIQKTFVTSSVTNHYFSSASQSFRSPILGVNAKIGYQNYFNDFIGLAYYGIVKYNYSKALNQKFQQLSYGGGIDLLLDFITTYSNKNSPIGVQTKWNFSSSFGIFGGLRGLYNSYYVLNKVKGSGNLDVATGLNYRYKHSKYSVGISIPLIQRKASVVSSGSDYTNSFVFNEGASHFKVFFNYGWIF

SEQ ID NO: 7703 - protein, 653 aa, Helicobacter pylori
MKKLFIPLLLFSALEANEKNGFFIEAGFETGLLEGTQTQEKRHTTTKNTYATYNYLPTDTILKRAANLFTNAEAISKLKFSSLSPVRVLYMYNGQLTIENFLPYNLSNVKLSFTDAQGNVIDLGVIETIPKHSKIVLPGEAFDSLKIDPYTLFLPKIEATSTSISDANTQRVFETLNKIKTNLVVNYRNENKFKDHENHWEAFTPQTAEEFTNLMLNMIAVLDSQSWGDAILNAPFEFTNKGGGGECDTSKENECVNPGTNGLVNSQNKSYVLNKQDIVNKFRNKADLDVVVLKDSGVVGLGSDITPSNNDDGKHYGQLGVVASALDPKKLFGDNLKTINLEDLRTILHEFSHTKGYGHNGNMTYQRVPTGQNENGKPKDSDGLPYNVCSLYGGSNQPAFPSNYPNSIYHNCADVPAGFLGVTAAVWQQLINQNALPINYANLGSQTNYNLNASLNTQDLANSMLGTIQKTFVTSSVTNHYSSSASQSFRSPILGVNAKIGYQNYFNDFIGLAYYGIIKYNYSKALNQKFQQLSYGGGIDLLLDFITTYSNKNSPIDIQTRRNFSSSFGIFGGLRGLYNSYYVLNKVKGSGNLDVATGLNYRYKHSKYSVGISIPLIQRKASVVSSGSDYTNSFVFNEGASHFKVFFNYGWVF

SEQ ID NO: 7704 - protein, 653 aa, Helicobacter pylori
MKKLFIPLLLFSALEANEKNGFFIEAGFETGLLEGTQTQEKRHTTTKNTYATYNYLPTDTILKRAANLFTNAEAISKLKFSSLSPVRVLYMYNGQLTIENFLPYNLSNVKLSFKDAQGNTIDLGVIETIPKHSKIVLPGEAFDSLKIDPYTLFLPKIEATSTSISDANTQRVFETLNKIKTNLVVNYRNENKFKDHENHWEAFTPQTAEEFTNLMLNMIAVLDSQSWGDAILNAPFEFTNKGGGGECDTSKENDCVNPGTNGLVNSQNKSYVLNKQDIVNKFRNKADLDVVILKDSGVVGLGSDITPSNNHDGKHYGQLGVVASALEPQKLFGNDLKTINLADLRTILHEFSHTKGYTHNGNMTYQRVPTGQNENGKPKDSDGLPYNVCSLYGGSNQPAFPSNYPNSIYHNCADVPAGFLGVTAAVWQQLINQNALPIDYANLSAQKNYNLNASLNTQDLANSMLGTIQKTFVTSSVTNHYFSSASQSFRSPILGVNAKIGYQNYFNDFIGLAYYGIVKYNYSKALNQKFQQLSYGGGIDLLLDFITTYSNKNSPVGVQTRKNFSSSFGIFGGLRGLYNSYYVLNKVKGSGNLDVATGLNYRYKHSKYSVGISIPLIQRKAKVVSTNGDYTNSFVFNEGASHFKVFFNYGWVF

SEQ ID NO: 7705 - protein, 658 aa, Helicobacter pylori
MRKLFIPLLLFSALEANEKNGFFIEAGFETGLLEGAQTQEKRHTTTKNTYATYNYLPTDTILKRAANLFTNAEAISKLKFSSLSPVRVLYMYNGQLTIENFLPYNLNNVKLSFTDAQGNVINLGVIETIPKHSKIVLPGEAFDSLKIDPYTLFLPKIEATSTSISDANTQRVFETLNKIKTNLVVNYRNENKFEGHQNHWEAFTPQTAEEFTNLMLNMIAVLDSQSWGDAILNAPFEFTNKGGGECDTSKENDCVNPGTNGLVNSQNKSYVLNKQDIVNKFRNKADLDVVILKDSGVVGLGSDITPSNNDDGKHYGQLGVVASALDPKKLFGNDLKTINLADLRTILHEFSHTKGYTHNGNMTYQRVPVTKDGQVENDNNGKPKDSDGLPYNVCSLYGGSNQPAFPSNYPNSIYHNCADVPAGFLGVTAAVWQQLINQNALPINYANLGSQTNYNLNASLNTQDLANSMLGTIQKTFVTSSVTNHYSSSASQSFRSPILGVNAKIGYQNYFNDFIGLAYYGIIKYNYSKALNQKFQQLSYGGGIDLLLDFITTYSNKNSPIGVQTRKNFSSSFGIFGGLRGLYNSYYVLNKVKGSGNLDVATGLNYRYKHSKYSVGISIPLIQRKASVISSGGDYTNSFVFNEGASHFKVFFNYGWVF

SEQ ID NO: 7706 - protein, 654 aa, Helicobacter pylori
MKKLFIPLLLFSALEANEKNGFFIEAGFETGLLEGTQTQEKRHTTTKNTYATYNYLPTDTILKRAANLFTNAEAISKLKFSSLSPVRVFYMYNGQLTIENFLPYNLSNVKLSFTDAQGNVIDLGVIETIPKHSKIVLPGEAFDSLKIDPYTFFLPKIEATSTSISDANTQRVFETLNKIKTDLVVNYRNENKFKDHENHWEAFTPQTAEEFTNLMLNMIAVLDSQSWGDAILNAPFEFTNKGGGGECDTSKENECVNPGTNGRVNSKVDQKYVLNKQDIVNKFRNKADLDVVILKDSGVVGLGSDITPSNNDDGKHYGQLGVVASALDPKKLFGDNLKTINLADLRTILHEFSHTKGYTHNGNMTYQRVPTGQNENGKPKDSDGLPYNVCSLYGGSNQPAFPSNYPNSIYHNCADVPAGFLGVTAAVWQQLINQNALPINYANLSAQTNYNLNASLNTQDLANSMLGTIQKTFVTSSVTNHYSSSASQNFRSPILGVNAKIGYQNYFNDFIGLAYYGIVKYNYSKALNQKVQQLSYGGGIDLLLDFITTYSNKNSPIDIQTRRNFSSSFGIFGGLRGLYNSYYVLNKVKGSGNLDVATGLNYRYKHSKYSVGISIPLIQRKASVVSSGGDYTNSFVFNEGASHFKVFFNYGWVF

SEQ ID NO: 7707 - protein, 650 aa, Helicobacter pylori
MKKLFIPLLLFSALEANEKNGFFIEAGFETGLLEGAQTQEKRHTTTKNTYATYNYLPTDTILKRAASLFTNAEAISKLKFSSLSPVRVLYMYNGQLTIENFLPYNLSNVKLSFTDAQGNVIDLGVIETIPKHSKIVLPGEAFDSLKIDPYTLFLPKIEATSTSVSDANTQRVFETLNKIKTDLVVNYRNENKFKDHENHWEAFTPQTAEEFTNLMLNMIAVLDSQSWGDAILNAPFEFTNSPTDCDNDPSKCVNPGTNGVVNSQNKNYVLNKQDIVNKFRNKADLDVVVLKDSGVVGLGSDITPSNNDDGKHYGQLGVVASALEPKKLFGNDLKTINLEDLRTILHEFSHTKGYTHNGNMTYQRVPTGQNENGKPKDSDGLPYNVCSLYGGQGQSAFPSNYPNSIYHNCADVPAGFLGVTAAVWQQLINQNALPIDYANLSAQKNYNLNASLNTQDLANSMLSTIQKTFVTSSVTNHYFSSASQSFRSPILGVNAKIGYQNYFNDFIGLAYYGIIKYNYSKALNQKFQQLSYGGGIDLLLDFITTYSNKNSPIDIQTRRNFSSSFGIFGGLRGLYNSYYVLNKVKGSGNLDVATGLNYRYKHSKYSVGISIPLIQRKASVVSSGSDYTNSFVFNEGASHFKVFFNYGWVF

SEQ ID NO: 7708 - protein, 661 aa, Helicobacter pylori
MRKLFIPLLLFSALEANEKNGFFIEAGFETGLLEGTQTQEKRHTTTKNTYATYNYLPTDTILKRATNLFTDAKSISQLNFSSLSPIKVLYIGGKLTIENFLPYNLSNVKLSFTDAQGNVIDLGVIETIPKHSKIVLPGEAFDSLKKAFDKIDPYTFFLPKFEATSTSVSDANTQRVFETLNKIKTNLIMKYSSENPNNFNTCPYNNNGNTKNDCWQPFTPQTAEEFTNLMLNMIAVLDSQSWGDAILNAPFDFTNSPTDCDNDPSKCVNPGINGRVDSKVDQQYVLNKQGIVNNFRKKIEIDAVVLKNSGVVGLANGYGNDGEYGTLGVEAYALDPTKLFGNNLKTINLEDLRTILHEFSHTKGYTHNGNMTYQRVPTGQNENGKPKDSDGLPYNVCSLYGGQGQSAFPSNYPNSIYHNCADVPAGFLGVTAAVWQQLINQNALPINFANLSNQTNYNLNASLNTQDLANSMLSTIQKTFVTSSVTNHYFSSASQNFRSPILGVNAKIGYQNYFNDFIGLAYYGIIKYNYAKANDQKVQQLSYGGGIDLLVDFITTYSNKNSPIDIQTRRNFSSSFGIFGGLRGLYNSYYALNKVKGSGNLDVATGLNYRYKHSKYSVGISIPLIQRKARVVSSNSDYTNSLVFNEGASHFKVFFNYGWVF

SEQ ID NO: 7709 - protein, 653 aa, Helicobacter pylori
MKKLFIPLLLFSALEANEKNGFFIEAGFETGLLEGTQTQEKRHTTTKNTYATYNYLPTDTILKRAASLFTNAEAISKLKFSSLSPVRVLYMYNGQLTIENFLPYNLNNVKLSFTDAQGNAIDLGVIETIPKHSKIVLPGEAFDSLKIDPYTFFLPKFEATSTSISDANTQRVFETLNKIKTDLVVNYRNENKFKDHENHWEAFTPQTAEEFTNLMLNMIAVLDSQSWGDAILNAPFEFTNKGGGGECDTNKENDCVNPGTNGLVNSQNQQYVLNKQDIVNKFRNKADLDVVVLKDSGVVGLGSDITPSNNDDGKHYGQLGVVASALDPKKLFGNDLKTINLADLRTILHEFSHTKGYTHNGNMTYQRVPTGQNENGKPKDSDGLPYNVCSLYGGSGQSAFPSNYPNSIYHNCADVPAGFLGVTAAVWQQLINQNALPIDYANLSAQTNYNLNASLNTQDLANSMLGTIQKTFVTSSVTNHYSSSASQSFRSPILGVNAKIGYQNYFNDFIGLAYYGIIKYNYSKALNQKFQQLSYGGGIDLLLDFITTYSNKNNPTGIQTRKNFSSSFGIFGGLRGLYNSYYVLNKVKGSGNLDVATGLNYRYKHSKYSVGISIPLIQRKASVVSSGGDYTNSFVFNEGASHFKVFFNYGWVF

SEQ ID NO: 7710 - protein, 649 aa, Helicobacter pylori
MRKLFIPLLLFSALEANEKNGFFIEAGFETGLLEGAQTQEKRHTTTKNTYATYNYLPTDTILKRAANLFTNAEAISKLKFSSLSPVRVLYMYNGQLTIENFLPYNLNNVKLSFTDAQGNVIDLGVIETIPKHSKIVLPGEAFDSLKIDPYTFFLPKIEATSTSISDANTQRVFETLNKIKTNLVVNYRNENKFKDHENHWEAFTPQTAEEFTNLMLNMIAVLDSQSWGDAILNAPFEFTNKGGEEECDTSKENECVNPGVNGVVNSQNKSYVLNKQDIVNKFRNKADLDAVVLKNSGVVGLANGYGNDGEYGTLGVEAYALEPQKLFGNDLKTINLADLRTILHEFSHTKGYTHNGNMTYQRVPTGHNGSDNKPSDSDGLPYNVCSLYGGQGQSAFPSNYPNSIYHNCADVPAGFLGVTAAVWQQLINQNALPINYANLGSQTNYNLNASLNTQDLANSMLSTIQKTFVTSSVTNHYFSSTSQSFRSPILGVNAKIGYQNYFNDFIGLAYYGIVKYNYSKALNQKFQQLSYGGGIDLLLDFITTYSNKNSPIDIQTRRNFSSSFGIFGGLRGLYNSYYVLNKVKGSGNLDVATGLNYRYKHSKYSVGISIPLIQRKASVVSSGGDYTNSFVFNEGASHFKVFFNYGWVF

SEQ ID NO: 7711 - protein, 656 aa, Helicobacter pylori
MKKLFIPLLLFSALEANEKNGFFIEAGFETGLLEGAQTQEKRHTTTKNTYATYNYLPTDTILKRAANLFTNAEAISKLKFSSLSPVRVLYMYNGQLTIENFLPYNLSNVKLSFTDAQGNAIDLGVIETIPKHSKIVLPGEAFDSLKIDPYTLFLPKIEATSTSVSDANTQRVFETLNKIKTNLVVNYRNENKFKDHENHWEAFTPQTAEEFTNLMLNMIAVLDSQSWGDAILNAPFEFTNSPTDCDNDSSKCVNPGTNGLVNSQNKSYVLNKQDIVNKFRNKADLDVVVLKDSGVVGLGSDITPSNNDDGKHYGQLGVVASALDPKKLFGNDLKTINLEDLRTILHEFSHTKGYTHNGNMTYQRVPVMKDGQVEKDNNGKPKDSDGLPYNVCSLYGKSNQPAFPSNYPNSIYHNCADVPAGFLGVTAAVWQQLINQNALPIDYANLNAQTNYNLNASLNTQDLANSMLSTIQKTFVTSSVTNHYSSSTSQSFRSPILGVNAKIGYQNYFNDFIGLAYYGIIKYNYAKAINQKVQQLSYGGGIDLLLDFITTYSNKNNPTGIQTKRNFSSSFGIFGGLRGLYNSYYVLNKVKGSGNLDVATGLNYRYKHSKYSVGISIPLIQRKASVVSSGSDYTNSFVFNEGASHFKVFFNYGWVF

SEQ ID NO: 7712 - protein, 660 aa, Helicobacter pylori
MKKLFIPLLLFSALEANEKNGFFIEAGFETGLLEGTQTQEKRHTTTKNTYATYSYLPTDAVLKRAANLFTNAEAISKLKFSSLSPVRVLYMYNGQLTIENFLPYNLSNVKLSFTDAQGNVIDLGVIETIPKHSKIVLPGEVFDSLKVDPYTLFLPKIEATSTSISDANTQRVFETLNKIKTNLVVNYRNENKFKDHENHWEAFTPQTAEEFTNLMLNMIAVLDSQSWGDAILNAPFEFTNKGGGGECDTSKENDCVNPGTNGLVNSKVDQKYVLNKQDIVNKFRNKADLDVVILKDSGVVGLGSDITPSNNDDGKHYGQLGVVASALDPKKLFGNDLKTINLEDLRTILHEFSHTKGYTHNGNMTYQRVPVTKDGQVEKDNNDKPKDSDGLPYNVCSLYGGSNQPAFPSNYPNSIYHNCADVPAGFLGVTAAVWQQLINQNALPINYANLGSQTNYNLNASLNTQDLANSMLSTIQKTFVTSSVTNHYSSSASQSFRSPILGVNAKIGYQNYFNDFIGLAYYGIIKYNYSKALNQKFQQLSYGGGIDLLLDFITTYSNKNSPTGIQTRRNFSSSFGIFGGLRGLYNSYYVLNKVKGSGNLDVATGLNYRYKHSKYSVGISIPLIQRKASVVSSGSDYTNSFVFNEGASHFKVFFNYGWVF

SEQ ID NO: 7713 - protein, 660 aa, Helicobacter pylori
MKKLFIPLLLFSALEANEKNGFFIEAGFETGLLEGAQTQEKRHTTTKNTYATYDYLPTDSVLKRAANLFTDAKSISQLTFSSLSPVKVLYVSGKLTIENFLPYNLSNVKLSFTDAQGNVIDLGVIETIPKHSNIVLPGEAFDSLKEAFDKIGPYTFFFPKFEATSTSISDTNTQRVFETLNKIKTNLIMKYSNKNPNNFNTCPYNNNGNTKNDCWQNFTPQTAEEFTNLMLNMIAVLDSQSWGDAILNAPFEFTNSPTDCDNDPSKCVNPGVNGRVDTKVDQQYILNKQGIINNFRKKIEIDAVVLKNSGVVGLANGYGNDGEYGTLGVEAYALEPPNSLAQPLKPSLADLRTILHEFSHTKGYTHNGNMTYQRVPTGQNENGKPKDSDGLPYNVCSLYGGQGQSAFPSNYPNSIYHNCADVPAGFLGVTAAVWQQLINQNALPINYANLGSQTNYNLNASLNTQDLANSMLGTIQKTFVTSSVTNHYFSSASQSFRSPILGVNAKIGYQNYFNDFIGLAYYGIVKYNYSKALNQKFQQLSYGGGIDLLLDFIPTYSNKNNPTGVQTRKNFSSSFGIFGGLRGLYNSYYVLNKVKGSGNLDVATGLNYRYKHSKYSVGISIPLIQRKASVVSSGSDYTNSFVFNEGASHFKVFFNYGWVF

SEQ ID NO: 7714 - protein, 653 aa, Helicobacter pylori
MRKLFIPLLLFSALEANEKNGFFIEAGFETGLLEGAQTQEKRHTTTKNTYATYDYLPTDSVLKRAANLFTHAEAISKLKFSSLSPVRVLHMYNGQLTIENFLPYNLNNVKLSFTDAQGNVIDLGVIETIPKHSKIVLPGEAFDSLKVDPYTLFLPKIEATSTSISDANTQRVFETLNKIKTNLVVNYRNENKFEGHQNHWEAFTPQTAEEFTNLMLNMIAVLDSQSWGDAILNAPFEFTNKGGGGECDTSKENDCVNPGTNGLVNSQNQQYVLNKQDIVNKFRNKADLDVVILKDSGVVGLGSDITPSNNDDGKHYGQLGVVASALDPKKLFGNDLKTINLEDLRTILHEFSHTKGYTHNGNMTYPRVPTGQNENGKPKDSDSLPYNVCSLYGGSNQSAFPSNYPNSIYHNCADVPAGFLGVTAAVWQQLINQNALPINYANLGSQTNYNLNASLNTQDLANSMLGTIQKTFVTSSVTNHYFSSASQSFRSPILGVNAKIGYQNYFNDFIGLAYYGIIKYNYSKALNQKFQQLSYGGGIDLLLDFITTYSNKNSPIDIQTRRNFSSSFGIFGGLRGLYNSYYVLNKVKGSGNLDVATGLNYRYKHSKYSVGISIPLIQRKASVVSSGSDYTNSFVFNEGASHFKVFFNYGWVF

SEQ ID NO: 7715 - protein, 658 aa, Helicobacter pylori
MRKLFIPLLLFSALEANEKNGFFIEAGFETGLLEGAQTQEKRHTTTKNTYATYDYLPTDSVLKRAANLFTNAEAISKLKFSSLSPVKVLYIGGKLTIENFLPYNLNNVKVSFTDAQGNTIDLGVIETIPQHSKIVLPGEAFDSLKEAFDKIGPYTFFLPKFEATSTSVSDANTQRVFETLNKIKTDLVVNYRNENKFKDHENHWEAFTPQTAEEFTNLMLNMIAVLDSQSWGDAILNAPFEFTNKGGGGECDTSKESECVNPGVNGRVDSKVDQQYVLNKPDIVNKFRNKADLDVLVLKDSGVVGLGSDITPSNNDDGKHYGQLGGVASALDPKKLFGNDLKTIHLADLTTILHEFSHTKGYGHNGYMTYQRVPTGQNENGKPKDSDGLPYNVCSLYGGQGQSAFPSNYPNSIYHNCADVPAGFLGVTAAVWQQLINQNALPIDYANLNAQTNYNLNASLNTQDLANSMLGTIQKTFVTSSVTNHYFSSASQSFRSPILGVNAKIGYQNYFNDFIGLAYYGIIKYNYSKALNQKFQQLSYGGGIDLLLDFITTYSNKNSPTGVQTRKNFSSSFGIFGGLRGLYNSYYVLNKVKGSGNLDVATGLNYRYKHSKYSVGISIPLIQRKAGVVSSGSDYTNSFVFNEGASHFKVFFNYGWVF

SEQ ID NO: 7716 - protein, 667 aa, Helicobacter pylori
MRKLFIPLLLFSALEANEKNGFFIEAGFETGLLEGAQTQEKRHTTTKNTYATYDYLPTDSVLKRAANLFTDAKSISQLTFSSLSPVKVLYVGGKLTIENFLPYNLSNVKLSFTDAQGNVIDLGVIETIPKHSKIVLPGEAFDSLKEAFDKIGPYTFFFPKFEATSTSVSDANTQRVFETLNKIKTNLIMKYSNKNPNNFNTCPYNNNGNTKNDCWQNFTPQTAEEFTNLMLNMIAVLDSQSWGDAILNAPFEFTNSPTDCDNDPSKCVNPGVNGRVDTKVDQQYILNKQGIINNFRKKIEIDAVVLKNSGVVGLANGYGNDGEYGTLGVEAYALEPQKLFGNNLKTINLPDLRTILHEFSHTKGYGHNGNMTYQRVPVTKDGQVEKDNNGKPKDSDGLPYNVCSLYGGSNQPAFPSNYPNSIYHNCADVPAGFLGVTAAVWQQLINQNALPIDYANLSTQTNYNLNASLNTQDLANSMLGTIQKTFVTSSVTNHYSSSASQSFRSPILGVNAKIGYQNYFNDFIGLAYYGIIKYNYCKAINQKVQQLSYGGGIDLLLDFITTYSNKNSPTGVQTRKNFSSSFGIFGGLRGLYNSYYVLNKVKGSGNLDVATGLNYRYKHSKYSVGISIPLIQRKASVVSSGSDYTNSFVFNEGASHFKVFFNYGWVF

SEQ ID NO: 7717 - protein, 653 aa, Helicobacter pylori
MRKLFIPLLLFSALEANEKNGFFIEAGFETGLLEGTQTQEKRHTTTKNTYATYNYLPTDTILKRAANLFTNAEAISKLTFSSLSPVRVLYMYNGQLTIENFLPYNLSNVKLSFKDAQGNVIDLGVIETIPKHSKIVLPGEAFDSLKIDPYTLFLPKIEATSTSISDTNTQRVFETLNKIKTDLVVNYRNENKFKDHENHWEAFTPQTAEEFTNLMLNMIAVLDSQSWGDAILNAPFEFTNKGGGGECDTSKENECVNPGTNGVVNSQNQQYVLNKQDIVNKFRNKADLDVVVLKDSGVVGLGSDITPSNNDDGKHYGQLGVEAYALEPQKLFGNDLKTINLADLRTILHEFSHTKGYTHNGNMTYQRVPTGQNENGKPKDSDGLPYNVCSLYGGSNQPAFPSNYPNSIYHNCADVPAGFLGVTAAVWQQLINQNALPINFANLSAQTNYNLNASLNTQDLANSMLGTIQKTFVTSSVTNHYFSSASQSFRSPILGVNAKIGYQNYFNDFIGLAYYGIIKYNYSKALNQKFQQLSYGGGIDLLLDFITTYSNKNSPTGVQTRKNFSSSFGIFGGLRGLYNSYYVLNKVKGSGNLDVATGLNYRYKHSKYSVGISIPLIQRKAKVVSTNGDYTNSFVFNEGASHFKVFFNYGWIF

SEQ ID NO: 7718 - protein, 657 aa, Helicobacter pylori
MRKLFIPLLLFSALEANEKNGFFIEAGFETGLLEGTQTQEKRHTTTKNTYATYDYLPTDSVLKRAANLFTNAEAISKLKFSSLSPVRVLYMYNGQLTIENFLPYNLNNVKLSFKDAQGNTIDLGVIETIPKHSKIVLPGEAFDSLKIDPYTLFLPKIETTSTSISDTNTQRVFETLNKIKTNLIMKYSNENPNNFNTCPYNNNGNTKNDCWQNFTPQTAEEFTNLMLNMIAVLDSQSWGDAILNAPFEFTNSSTDCDSDPSKCVNPGVNGRVDTKVDQQYILNKQGIINNFRKKIEIDAVVLKNSGVVGLANGYGNDGEYGTLGVVASALDPKKLFGNDLKTINLEDLRTILHEFSHTKGYTHNGNMTYQRVPTGQSENGKPKDSDGLPYNVCSLYGGSNQSAFPSNYPNSIYHNCADVPAGFLGVTAAVWQQLINQNALPIDYANLSAQTNYNLNASLNTQDLANSMLSTIQKTFVTSSVTNHYFSSASQSFRSPILGVNAKIGYQNYFNDFIGLAYYGIVKYNYSKALNQKFQQLSYGGGIDLLLDFITTYSNKNSPIGVQTKRNFSSSFGIFGGLRGLYNSYYVLNKVKGSGNLDVATGLNYRYKHSKYSVGISIPLIQRKASVVSSGSDYTNSFVFNEGASHFKVFFNYGWVF

SEQ ID NO: 7719 - protein, 649 aa, Helicobacter pylori
MRKLFIPLLLFSALEANEKNGFFIEAGFETGLLEGTQTQEKRHTTTKNTYATYDYLPTDSVLKRAANLFTNAEAISKLKFSSLSPVRVLYMYNGQLTIENFLPYNLSNVKLSFTDAQGNTIDLGVIETIPKHSKIVLPGEAFDSLKIDPYTLFLPKIEATSTSISDANTQRVFETLNKIKTDLVVNYRNENKFKDHENHWEAFTPQTAEEFTNLMLNMIAVLDSQSWGDAILNAPFEFTNKGGEGECDTSKENDCVNPGVNGRVDTKVDQQYILNKQGIINNFRKKIEIDAVVLKNSGVVGLANGYGTDGEYGTLGVEAYALDPKKLFGDNLKTINLEDLRPILHEFSHTKGYGNNGNMTYQRVPTGQNENGKPKDSDGLPYNVCSLYGGSNQSAFPSNYPNSIYHNCADVPAGFLGVTAAVWQQLINQNALPIDYANLSTQKNYNLNASLNTQDLANSMLSTIQKTFVTSSVTNHYFSSASQSFRSPILGVNAKIGYQNYFNDFIGLAYYGIVKYNYSKALNQKFQQLSYGGGIDLLLDFITTYSNKNSPIGVQTRKNFSSSFGIFGGLRGLYNSYYVLNKVKGSGNLDVATGLNYRYKHSKYSVGISIPLIQRKASVVSSGSDYTNSFVFNEGASHFKVFFNYGWVF

SEQ ID NO: 7720 - protein, 660 aa, Helicobacter pylori
MRKLFIPLLLFSALEANEKNGFFIEAGFETGLLEGTQTQEKRHTTTKNTYATYNYLPTDTILKRAANLFTNAEAISKLKFSSLSPVRVLYIGGQLTIENFLPYNLSNVKLSFTDAQGNAIDLGVIETIPKHSKIVLPGEAFDSLKEAFDKNPHTFFFPKFEATSTSVSDANTQRVFETLNKIKTNLIMKYSNENPNNFNTCPYNNNGNTKNDCWQNFTPQTAEEFTNLMLNMIAVLDSQSWGDAILNAPFEFTNSSTDCDNDPSKCVNPGVNGRVDSKVDQQYILNKQGIINNFRKKIEIDAVVLKNSGVVGLANGYGNDGEYGTLGVEAYALEPQKLFGNDLKTINLEDLRTILHEFSHTKGYGHNGNMTYQRVPTGQNENGKPKDSDGLPYNVCSLYGGSGQSAFPSNYPNSIYHNCADVPAGFLGVTAAVWQQLINQNALPIDYANLSAQTNYNLNASLNTQDLANSMLGTIQKTFVTSSVTNHYSSSASQSFRSPILGVNAKIGYQNYFNDFIGLAYYGIIKYNYSKALNQKFQQLSYGGGIDLLLDFITTYSNKNNPTGIQTRKNFSSSFGIFGGLRGLYNSYYVLNKVKGSGNLDVATGLNYRYKHSKYSVGISIPLIQRKASVVSSGGDYTNSFVFNEGASHFKVFFNYGWVF

SEQ ID NO: 7721 - protein, 661 aa, Helicobacter pylori
MKKLFIPLLLFSALEANEKNGFFIEAGFETGLLEGTQTQEKRHTTTKNTYATYNYLPTDSVLKRAANLFTDAKSISQLNFSSLSPVKVLYIGGKLTIENFLPYNLSNVKLSFTDAQGNTIDLGVIETIPKHSKIVLPGEAFDSLKEAFDKIGPYTFFLPKFEATSTSVSDANTQRVFETLNNIKTNLIMKYSNENPSNFNTCPYNNNGNTKNDCWQNFTPQTAEEFTNLMLNMIAVLDSQSWGDAILNAPFEFTNSSTDCDNDPSKCVNPGVNGRVDTKVDQQYILNKQGIINNFRKKIEIDAVVLKNSGVVGLANGYGNDGEYGTLGVEAYALEPQKLFSDNLKTINLEDLRTILHEFSHTKGYGHNGNMTYQRVPTGQNENGKPKDSDGLPYNVCSLYGGSNQPAFPSNYPNSIYHNCADVPAGFLGVTAAVWQQLINQNALPIDYANLSAQTNYNLNASLNTQDLANSMLGTIQKTFVTSSVTNHYSSSASQSFRSPILGVNAKIGYQNYFNDFIGLAYYGIIKYNYSKALNQKFQQLSYGGGIDLLLDFITTYSNKNSPTGVQTRKNFSSSFGIFGGLRGLYNSYYVLNKVKGSGNLDVATGLNYRYKHSKYSVGISIPLIQRKASVVSSGSDYTNSFVFNEGASHFKVFFNYGWVF

SEQ ID NO: 7722 - protein, 667 aa, Helicobacter pylori
MRKLFIPLLLFSALEANEKNGFFIEAGFETGLLEGTQTQEKRHTTTKNTYATYNYLPTDTILKRAANLFTDAKSISQLTFSSLSPVKVLYIGGQLTIENFLPYNLNNVKLSFKDAQGNVIDLGVIETIPKHSKIVLPGEAFDSLKEAFDKIGPYTFFFPKFEATSTSISDANTQRVFETLNNIKTNLIMKYSNENPNNFNTCPYNNNGNTKNDCWQNFTPQTAEEFTNLMLNMITVLDSQSWGDAILNAPFEFTNSPTDCDNDPSKCVNPGVNGRVDSKVDQQYVLNKQGIVNNFRKKIEIDAVVLKNSGVVGLANGYGNDGEYGTLGVEAYALEPQKLFGNDLKTINLADLRTILHEFSHTKGYTHNGNMTYQRVPVMKNGQVERDNNGKPKDSDGLPYNVCSLYGGSNQPAFPSNYPNSIYHNCADVPAGFLGVTAAVWQQLINQNALPIDYANLSAQKNYNLNASLNTQDLANSMLGTIQKTFVTSSVTNHYFSSASQSFRSPILGVNAKIGYQNYFNDFIGLAYYGIVKYNYSKALNQKFQQLSYGGGIDLLLDFITTYSNKNSPVGVQTRKNFSSSFGIFGGLRGLYNSYYVLNKVKGSGNLDVATGLNYRYKHSKYSVGISIPLIQRKAKVVSTNGDYTNSFVFNEGASHFKVFFNYGWVF

SEQ ID NO: 7723 - protein, 659 aa, Helicobacter pylori
MRKLFIPLLLFSALEANEKNGFFIEAGFETGLLEGAQTQEKRHTTTKNTYATYNYLPTDTILKRAANLFTNAEAISKLKFSSLSPVRVLYMYNGQLTIENFLPYNLNNVKLSFKDAQGNVIDLGVIETIPKHSKIILPGEAFDSLKIDPYTLFLPKIEATSTSVSDANTQRVFETLNKIKTDLVVNYRNENKFKDHENHWEAFTPQTAEEFTNLMLNMIAVLDSQSWGDAILNAPFEFTNKGGGGECDTSKENECVNPGTNGLVNSQNKSYVLNKQDIVNKFRNKADLDVVVLKDSGVVGLGSDITPSNNDDGKHYGQLGVVASALEPQKLFGNDLKTINLEDLRTILHEFSHTKGYGHNGNMTYQRVPVMKDGQVEKDNNGKPKDSDGLPYNVCSLYGGSNQPAFPSNYPNSIYHNCTDVPAGFLGVTAAVWQQLINQNALPINYANLGSQTNYNLNASLNTQDLANSMLGTIQKTFVTSSVTNHYFSSASQSFRSPILGVNAKIGYQNYFNDFIGLAYYGIIKYNYSKALNQKFQQLSYGGGIDLLLDFITTYSNKNSPTGIQTRRNFSSSFGIFGGLRGLYNSYYVLNKVKGSGNLDVATGLNYRYKHSKYSVGISIPLIQRKASVVSSGSDYTNSFVFNEGASHFKVFFNYGWVF

SEQ ID NO: 7724 - protein, 652 aa, Helicobacter pylori
MRKLFIPLLLFSALEANEKNGFFIEAGFETGLLEGTQTQEKRHTTTKNTYATYNYLPTDTILKRAANLFTNAEAISKLKFSSLSPVRVLYMYNGQLTIENFLPYNLNNVKLSFTDAQGNVIDLGVIETIPKHSKIVLPGDAFDSLKVDPYTLFLPKIEATSTSISDANTQRVFETLNKIKTNLVVNYRNENKFEGHENHWEAFTPQTAEEFTNLMLNMITVLDSQSWGDAILNAPFEFTNKGGEECDTSKENDCVNPGTNGRVNSQNKSYVLNKQDIVNKFRNKADLDVVVLKDSGVVGLGSDITPSNNDDGKHYGQLGVVASALDPKKLFGNDLKTINLADLRTILHEFSHTKGYGHNGNMTYQRVPTGQNENGKPKDSDGLPYNVCSLYGGSNQPAFPSNYPNSIYHNCADVPAGFLGVTAAVWQQLINQNALPINYANLGSQTNYNLNASLNTQDLANAMLGTIQKTFVTSSVTNHYSSSASQSFRSPILGVNAKIGYQNYFNDFIGLAYYGIVKYNYSKAVNQKFQQLSYGGGIDLLLDFITTYSNKNSPTGVQTKRNFSSSFGIFGGLRGLYNSYYVLNKVKGSGNLDVATGLNYRYKHSKYSVGISIPLIQRKASVVSSGSDYTNSFVFNEGASHFKVFFNYGWVF

SEQ ID NO: 7725 - protein, 657 aa, Helicobacter pylori
MRKLFIPLLLFSALEANEKNGFFIEAGFETGLLEGTQTQEKRHTTTKNTYATYNYLPTDTILKRAANLFTNAEAISKLKFSSLSPVRVLYMYNGQLTIENFLPYNLNNVKLSFTDAQGNVIDLGVIETIPKHSKIVLPGEAFDSLKIDPYTLFLPKIEATSTSISDANTQRVFETLNKIKTNLVVNYRNENKFKDHENHWEAFTPQTAEEFTNLMLNMIAVLDSQSWGDAILNAPFEFTNSPTDCDNDPSKCVNPGTNGLVNSKVDQKYVLNKQDIVNKFKNKADLDVIVLKDSGVVGLGSDITPSNNDDGKHYGQLGVVASALDPKKLFGDNLKTINLEDLRTILHEFSHTKGYGHNGNMTYQRVPVTKDGQVEKDSNGKPKDSDGLPYNVCSLYGGSNQPAFPSNYPNSIYHNCADVPAGFLGVTAAVWQQLINQNALPINYANLGSQTNYNLNASLNTQDLANSMLSTIQKTFVTSSVTNHHFSNASQSFRSPILGVNAKIGYQNYFNDFIGLAYYGIIKYNYAKAVNQKVQQLSYGGGIDLLLDFITTYSNKNSPTGIQTKRNFSSSFGIFGGLRGLYNSYYVLNKVKGSGNLDVATGLNYRYKHSKYSVGISIPLIQRKASVVSSGGDYTNSFVFNEGASHFKVFFNYGWVF

SEQ ID NO: 7726 - protein, 661 aa, Helicobacter pylori
MRKLFIPLLLFSALEANEKNGFFIEAGFETGLLEGAQTQEKRHTTTKNTYATYNYLPTDTILKRAANLFTDAKSISQLNFSSLSPVKVLYIGGKLTIENFLPYNLSNVKLSFKDAQGNAIDLGVIETIPKHSKIVLPGEAFDSLKEAFDKIDPYTFFFPKFEATSTSVSDANTQRVFETLNKIKTNLIMKYSNENPNNFNTCPYNNNGNTKNDCWQSFTPQTAEEFTNLMLNMIAVLDSQSWGDAILNAPFEFTNSSTDCDSDPSKCVNPGVNGRVDTKVDQQYILNKQGIINNFRKKIEIDAVVLKNSGVVGLANGYGNDGEYGTLGVEAYALDPKKLFGTDLKTINLEDLRTILHEFSHTKGYGHNENMTYQRVPTGQMANGKPKDSDGLPYNVCSLYGKSDQPAFPSNYPNSIYHNCADVPAGFLGVTAAVWQQLINQNALPINYANLGSQTNYNLNASLNTQDLANSMLGTIQKTFVTSSVTNHYFSSASQSFRSPILGVNAKIGYQNYFNDFIGLAYYGIVKYNYSKALNQKVQQLSYGGGIDLLLDFITTYSNKNSPIGIQTRRNFSSSFGIFGGLRGLYNSYYVLNKVKGSGNLDVATGLNYRYKHSKYSVGISIPLIQRKASVVSSGSDYTNSFVFNEGASHFKVFFNYGWVF

SEQ ID NO: 7727 - protein, 661 aa, Helicobacter pylori
MRKLFIPLLLFSALEANEKNGFFIEAGFETGLLEGAQTQEKRHTTTKNTYATYNYLPTDTILKRAANLFTNAEAISKLKFSSLSPVKVLYIGGQLTIENFLPYNLNNVKLSFTDAQGNVIDLGVIETIPKHSKIVLPGEAFDSLKEAFDKIGPYTFFFPKFEATSTSVSDANTQRVFETLNKIKTNLIMKYSNENPNNFNTCPYNNNGNTKNDCWQPFTPQTAEEFTNLMLNMIAVLDSQSWGDAILNAPFEFTNSSADCDNDSSKCVNPGTNGLVDSKVDQKYVLNKQGIVNNFRKKIEIDAVVLKNSGVVGLANGYGNDGEYGTLGVEAYALDPKKLFGNDLKTINLEDLRTILHEFSHTKGYTHNGNMTYQRVPTGQNENGKPKDSDGLPYNVCSLYGGSNQSAFPSNYPNSIYHNCTDVPAGFLGVTAAVWQQLINQNALPINYANLGSQTNYNLNASLNTQDLANSMLSTIQKTFVTSSVTNHYSSSASQSFRSPILGVNAKIGYQNYFNDFIGLAYYGIIKYNYAKAINQKVQQLSYGGGIDLLVDFITTYSNKNSPTGVRTRRNFSSSFGIFGGLRGLYNSYYVLNKVKGSGNLDVATGLNYRYKHSKYSVGISIPLIQRKASVVSSGSDYTNSFVFNEGASHFKVFFNYGWVF

SEQ ID NO: 7728 - protein, 652 aa, Helicobacter pylori
MRKLFIPLLLFSALEANEKNGFFIEAGFETGLLEGTQTQEKRHTTTKNTYATYDYLPTDSVLKRAANLFTNAEAISKLKFSSLSPVRVLYMYNGQLTIENFLPYNLSNVKLSFTDAQGNVILGVIETIPKHSKIVLPGEAFDSLKIDPYTLFLPKIEATSTSISDANTQRVFETLNKIKTDLVVNYRNENKFEGHQNHWEAFTPQTAEEFTNLMLNMIAVLDSQSWGDAILNAPFEFTNKGGGGECDTSKENDCVNPGVNGRVNSQNKSYVLNKQDIVNKFRNKADLDVVVLKDSGVVGLGSDITPSNNDDGKHYGQLGVVASALEPQKLFGNNLKTINLADLRTILHEFSHTKGYTHNGNMTYQRVPTGQNENGKPKDSDGLPYNVCSLYGGSNQPAFPSNYPNSIYHNCADVPAGFLGVTAAVWQQLINQNALPIDYANLSAQKNYNLNASLNTQDLANSMLSTIQKTFVTSSVTNHYFSSASQSFRSPILGVNAKIGYQNYFNDFIGLAYYGIVKYNYSKALNQKFQQLSYGGGIDLLLDFITSYSNKNSPIGVQTRRNFSSSFGIFGGLRGLYNSYYVLNKVKGSGNLDVATGLNYRYKHSKYSVGISIPLIQRKASVVSSGGDYTNSFVFNEGASHFKVFFNYGWVF

SEQ ID NO: 7729 - protein, 659 aa, Helicobacter pylori
MRKLFIPLLLFSALEANEKNGFFIEAGFETGLLEGTQTQEKRHTTTKNTYATYNYLPTDSVLKRAANLFTNAEAISKLKFSSLSPIRVLYMYNGQLTIENFLPYNLSNVKLSFTDAQGNVIDLGVIETIPKHSKIVLPGEAFDSLKIDPYTFFLPKIEATSTSISDANTQRVFETLNKIKTNLVVNYRNENKFKDHENHWEAFTPQTAEEFTNLMLNMIAVLDSQSWGDAILNAPFEFTNKGGGGECDTSKENDCVNPGTNGLVNSQNKSYVLNKQDIVNKFRNKADLDVVILKDSGVVGLGSDITPSNNDDGKHYGQLGVVASALDPKKLFGNDLKTIKLEDLRTILHEFSHTKGYTHNGNMTYQRVPVMKDGQVEKDNNGKPKDSDGLPYNVCSLYGKSDQPAFPSNYPNSIYHNCADVPAGFLGVTAAVWQQLINQNALPIDYANLSAQTNYNLNASLNTQDLANSMLSTIQKTFVTSSVTNHYSSSTSQSFRSPILGVNAKIGYQNYFNDFIGLAYYGIVKYNYSKALNQKFQQLSYGGGIDLLVDFITTYSNKNNPTGVQTRKNFSSSFGIFGGLRGLYNSYYVLNKVKGSGNLDVATGLNYRYKHSKYSVGISIPLIQRKASVVSSGSDYTNSFVFNEGASHFKVFFNYGWVF

SEQ ID NO: 7730 - protein, 661 aa, Helicobacter pylori
MRKLFIPLLLFSALEANEKNGFFIEAGFETGLLEGAQTQEKRHTTTKSTYATYSYLPTDTILKRAANLFTDAKSISQLNFSSLSPVKVLYIGGKLTIENFLPYNLNNVKLSFTDAQGNVIDLGVIETIPKHSKIVLPGEAFDSLKEAFDKIDPYTFFFPKFEATSTSVSDANTQRVFETLNKIKTNLIMKYSNENPSNFNTCPYNNNGNIKNDCWQNFTPQTAEEFTNLMLNMIAVLDSQSWGDAILNAPFEFTNSPTDCDNDPSKCVNPGVNGRVDSKVDQQYVLNKQGIINNFRKKIEIDAVVLKNSGVVGLANGYGNDGEYGTLGVEAYALEPQKLFGDDLKTINLADLRTILHEFSHTKGYTHNGNMTYQRVPTGQTENGKPKDSDGLPYNVCSLYGGQGQSAFPSNYPNSIYHNCADVPAGFLGVTAAVWQQLVNQNALPINYANLGSQTNYNLNASLNTQDLANSMLGTIQKTFVTSSVTNHYSSSASQSFRSPILGVNAKIGYQNYFNDFIGLAYYGIIKYNYSKALNQKFQQLSYGGGIDLLLDFITTYSNKNSPIGVQTRRNFSSSFGIFGGLRGLYNSYYVLNKVKGNGNLDVATGLNYRYKHSKYSVGISIPLIQRKASVVSSGSDYTNSFVFNEGASHFKVFFNYGWVF

SEQ ID NO: 7731 - protein, 661 aa, Helicobacter pylori
MKKLFIPLLLFSALEANEKNGFFIEAGFETGLLEGVQTQEKRHTTTKNTYATYNYLPTDTILKRAANLFTDAKSISQLTFSSLSPVKVLYIGGKLTIENFLPYNLSNVKLSFTDAQGNVIDLGVIETIPKHSKIVLPGEAFDSLKEAFDKIGPYTFFFPKFEATSTSISDTNTQRVFETLNKIKTNLIMKYSNENPSNFNTCPYNNNDNTKNDCWQNFTPQTAEEFTNLMLNMIAVLDSQSWGDAILNAPFEFTNSSTDCDSDPSKCVNPGVNGRVDTKVDQQYILNKQGIINNFRKKIEIDAVVLKNSGVVGLANGYGNDGEYGTLGVEAYALEPPKLFSNNLKTINLADLRTILHEFSHTKGYTHNGNMTYQRVPTGQNENGKPKDSDGLPYNVCSLYGGQGQSAFPSNYPNSIYHNCADVPAGFLGVTAAVWQQLINQNALPINYANLGSQTNYNLNASLNTQDLANSMLNTIQKTFVTSSVTNHYSSSASQSFRSPILGVNAKIGYQNYFNDFIGLAYYGIIKYNYSKALNQKFQQLSYGGGIDLLLDFITTYSNKNSPTGIQTKRNFSSSFGIFGGLRGLYNSYYVLNKVKGSGNLDVATGLNYRYKHSKYSVGISIPLIQRKASVVSSGSDYTNSFVFNEGASHFKVFFNYGWVF

SEQ ID NO: 7732 - protein, 661 aa, Helicobacter pylori
MKKLFIPLLLCNALEANQKNGFFIEAGFETGLLEGTQTQEQRRTTTKNTYATNNYLPTDAVLKRAANLFTDAKSISQLNFSSLSPVKVLYIGGKLTIENFLPYNLNNVKLSFTDAQGNVIDLGVIETIPKHSKIVLPGEAFDSLKEAFDKIDPYTFFFPKFEATSTSVSDANTQRVFETLNKIKTNLIMKYSNENPNNFNTCPYNNNGNTKNDCWQPFTPQTAEEFTNLMLNMIAVLDSQSWGDAILNAPFDFTNSSTDCNNDPSKCVNPGINGRVDSKVDQQYVLNKQGIVNNFRKKIEIDAVVLKNSGVVGLANGYGNDGEYGTLGVEAYALEPTKLFGNNLKTINLEDLRTILHEFSHTKGYGHNGNMTYQRVPTGQNENGKPKDSDGLPYNVCSLYGGQGQSAFPSNYPNSIYHNCADVPAGFLGVTAAVWQQLINQNALPINFANLGSQTNYNLNASLNTQDLANSMLSTIQKTFVASSVTNHYFSSASQSFRSPILGVNAKIGYQNYFNDFIGLAYYGIIKYNYAKVANQKVQQLSYGGGIDLLVDFITTYSNKNSPTGIQTRRNFSSSFGIFGGLRGLYNSYYALNKVKGSGNLDVATGLNYRYKHSKYSVGISIPLIQRKASIVSSDGDYTNSFVFNEGASHFKVFFNYGWVF

SEQ ID NO: 7733 - protein, 660 aa, Helicobacter pylori
MRKLFIPLLLFSALEANEKNGFFIEAGFETGLLEGTQTQEKRHTTTKNTYATYNYLPTDTILKRAANLFTNAEAISKLNFSSLSPVKVLYIGGKLTIENFLPYNLSNVKLSFTDAQGNAIDLGVIETIPKYSKIVLPGEAFDSLKEAFDKIDPYTFFFPKFEATSTSVSDANTQRVFETLNKIKTNLIMKYSNKNPSNFNTCPYNNGNTKNDCWQNFTPQTAEEFTNLMLNMIAVLDSQSWGDAILNAPFEFTNSSADCDNDPSKCVNPGVNGRVDSKVDQQYILNKQGIINNFRKKIEIDAVVLKNSGVVGLANGYGNDGEYGTLGVEAYALDPKKLFGDNLKTINLEDLRTILHEFSHTKGYTHNGNMTYQRVPTGQNENGKPKDSDGLPYNVCSLYGKSNQPAFPSNYPNSIYHNCADVPAGFLGVTAAVWQQLINQNALPINFANLNSQTNYNLNASLNTQDLANSMLSTIQKTFVTSSVTNHYFSSASQSFRSPILGVNAKIGYQNYFNDFIGLAYYGIVKYNYSKALNQKFQQLSYGGGIDLLLDFITTYSNKNNPTGVQTRKNFSSSFGIFGGLRGLYNSYYVLNKVKGSGNLDVATGLNYRYKHSKYSVGISIPLIQRKASVVSSGGDYTNSFVFNEGASHFKVFFNYGWVF

SEQ ID NO: 7734 - protein, 661 aa, Helicobacter pylori
MRKLFIPLLLFSTLEANEKNGFFIEAGFETGLLEGTQTQEKRHTTTKNTYATYNYLPTDTILKRAANLFTDAKSISQLNFSSLSPVKVLYIGGKLTIENFLPYNLSNVKLSFTDAQGNVIDLGVIETIPKHSKIVLPGEAFDSLKEAFDKIGPYTFFLPKFEATSTSVSDANTQRVFETLNKIKTNLIMKYSNENPSNFNTCPYNNNGNTKNDCWQPFTPQTAEEFTNLMLNMIAVLDSQSWGDAILNAPFEFTNSSTDCDNDPSKCVNPGINGRVDSKVDQQYVLNKQGIVNNFRKKIEIDAVVLKNSGVVGLANGYGNDGEYGTLGVEAYALEPTKLFGNNLKTINLEDLRTILHEFSHTKGYGHNGNMTYQRVPTGQNENGKPKDSDGLPYNVCSLYGGQGQSAFPSNYPNSIYHNCADVPAGFLGVTAAVWQQLINQNALPINFANLGSQTNYNLNASLNTQDLANSMLSTIQKTFVTSSVTNHYFSSASQSFRSPILGVNAKIGYQNYFNDFIGLAYYGIIKYNYAKAANQKVQQLSYGGGIDLLVDFITTYSNKNSPIDIQTRRNFSSSFGIFGGLRGLYNSYYALNKVKGSGNLDVATGLNYRYKHSKYSVGISIPLIQRKASIVSSDGDYTNSFVFNEGASHFKVFFNYGWVF

SEQ ID NO: 7735 - protein, 668 aa, Helicobacter pylori
MRKLFIPLLLFSALEANEKNGFFIEAGFETGLLEGTQTQEKRHTTTKNTYATYNYLPTDTILKRAANLFTNAEAISKLKFSSLSPVRVLYMYNGQLTIENFLPYNLNNVKLSFTDAQGNTIDLGVIETIPKHSKIVLPGEAFDSLKEAFDKIDPYTLFLPKFEATSTSISDTNTQRVFETLNNIKTNLIMKYSNENPNNFNTCPYNNNGNTKNDCWQNFTPQTAEEFTNLMLNMIAVLDSQSWGDAILNAPFEFTNSSTDCDSDPSKCVNPGVNGRVDTKVDQQYILNKQGIINNFRKKIEIDAVVLKNSGVVGLANGYGNDGEYGTLGVEAYALDPKKLFGNDLKTINLEDLRTILHEFSHTKGYGHNGNMTYQRVPVTKDGQVEKDSNGKPKDSDGLPYNVCSLYGGSNQPAFPSNYPNSIYHNCADVPAGFLGVTAAVWQQLINQNALPINYANLGSQTNYNLNASLNTQDLANSMLSTIQKTFVTSSVTNHHFSNASQSFRSPILGVNAKIGYQNYFNDFIGLAYYGIIKYNYAKAVNQKVQQLSYGGGIDLLLDFITTYSNKNSPTGIQTKRNFSSSFGIFGGLRGLYNSYYVLNKVKGSGNLDVATGLNYRYKHSKYSVGISIPLIQRKASVVSSGGDYTNSFVFNEGASHFKVFFNYGWVF

SEQ ID NO: 7736 - protein, 661 aa, Helicobacter pylori
MRKLFIPLLLFSALEANEKNGFFIEAGFETGLLEGTQTQEKRHTTTKNTYATYNYLPTDTILKRAANLFTDAKSISQLNFSSLSPVKVLYMCGKLTIENFLPYNLNNVKLSFTDAQGNVIDLGVIETIPKHSKIVLPGEAFDSLKEAFDKIDPYTFFLPKFEATSTSVSDANTQRVFETLNKIKTNLIMKYSNENPSNFNTCPYNNNGNTKNDCWQPFTPQTAEEFTNLMLNMIAVLDSQSWGDAILNAPFDFTNSSTDCDNDPSKCVNPGINGRVDSKIDQQYVLNKQGIVNNFRKKIEIDAVVLKNSGVVGLANGYGNDGEYGTLGVEAYALDPTKLFGNNLKTINLADLRTILHEFSHTKGYGHNGNMTYQRVPTGQNENGKPKDSDGLPYNVCSLYGGQGQSAFPSNYPNSIYHNCADVPAGFLGVTAAVWQQLINQNALPINFANLGSQTNYNLNASLNTQDLANSMLSTIQKTFVTSSVTNHYFSSASQSFRSPILGVNAKIGYQNYFNDFIGLAYYGIIKYNYAKVANQKVQQLSYGGGIDLLVDFITTYSNKNSPIDIQTRKNFSSSFGIFGGLRGLYNSYYVLNKVKGSGNLDVATGLNYRYKHSKYSVGISIPLIQRKASVVSSNGDYTNSFVFNEGASHFKVFFNYGWVF

SEQ ID NO: 7737 - protein, 650 aa, Helicobacter pylori
MRKLFIPLLLFSALEANEKNGFFIEAGFETGLLEGTQTQEKRHTTTKNTYATYSYLPADSVLKRAANLFTNAEAISKLKFSSLSPIRVLYMYNGQLTIENFLPYNLSNVKLSFKDAQGNTIDLGVIETIPKHSKIVLPGEAFDSLKIDPYTLFLPKIEATSTSISDTNTQRVFETLNKIKTDLVVNYRNENKFKDHENHWEAFTPQTAEEFTNLMLNMIAVLDSQSWGDAILNAPFEFTNSSTDCDNDPSKCVNPGVNGVVNSQNKSYVLNKQDIVNKFRNKADLDVVVLKDSGVVGLGSDITPSNNDDGKHYGQLGVEAYALDPKKLFGNDLKTINLADLRTILHEFSHTKGYTHNGNMTYQRVPTGQTENGKPKDSDGLPYNVCSLYGGSNQPAFPSNYPNSIYHNCADVPAGFLGVTAAVWQQLINQNALPIDYANLSAQTNYNLNASLNTQDLANSMLSTIQKTFVTSSVTNHYFSSASQSFRSPILGVNAKIGYQNYFNDFIGLAYYGIVKYNYSKALNQKFQQLSYGGGIDLLLDFITTYSNKNSPIGIQTRRNFSSSFGIFGGLRGLYNSYYVLNKVKGSGNLDVATGLNYRYKHSKYSVGISIPLIQRKASVVSSGSDYTNSFVFNEGASHFKVFFNYGWVF

SEQ ID NO: 7738 - protein, 660 aa, Helicobacter pylori
MRKLFIPLLLFSALEANEKNGFFIEAGFETGLLEGAQTQEKRHTTTKNTYATYSYLPTDTILKRAANLFTNAEAISQLNFSSLSPVKVLYIGGKLTIENFLPYNLSNVKLSFTDAQGNAIDLGVIETIPKHSKIVLPGEAFDSLKEAFDKITYSFFFPKFEATSTSISDTNTQRVFETLNKIKTNLIMKYSNENPNNFNTCPYNNNGNTKNDCWQNFTPQTAEEFTNLMLNMIAVLDSQSWGDAILNAPFEFTNSSTDCDNDPSKCVNPGVNGRVDTKVDQQYILNKQGIINNFRKKIEIDAVVLKNSGVVGLANGYGNDGEYGTLGVEAYALDPKKLFGNDLKTINLEDLRTILHEFSHTKGYTHNGNMTYQRVPTGQTENGKPKDSDGLPYNVCSLYGGQGQSAFPSNYPNSIYHNCADVPAGFLGVTAAVWQQLINQNALPINYANLGSQTNYNLNASLNTQDLANSMLSTIQKTFVTSSVTNHYSSSASQSFRSPILGVNAKIGYQNYFNDFIGLAYYGIVKYNYSKALNQKFQQLSYGGGIDLLLDFITTYSNKNSPTDIQTRKNFSSSFGIFGGLRGLYNSYYVLNKVKGSGNLDVATGLNYRYKHSKYSVGISIPLIQRKASVVSNGGDYTNSFVFNEGASHFKVFFNYGWVF

SEQ ID NO: 7739 - protein, 658 aa, Helicobacter pylori
MRKLFIPLLLFSALEANEKNGFFIEAGFETGLLEGTQTQEKRHTTTKNTYATYSYLPTDTILKRAANLFTDAKSISQLTFSSLSPVKVLYIGGKLTIENFLPYNLSNVKLSFTDAQGNAIDLGVIETIPKHSKIVLPGEAFDSLKEAFDKIDPYTFFLPKIEATSTSISDTNTQRVFETLNKIKTDLVVNYRNENKFKDHENHWEAFTPQTAEEFTNLMLNMIAVLDSQSWGDAILNAPFEFTNKGGGGECDTSKENDCVNPGTNGRVNSQNKSYVLNKQDIVNKFRNKADLDVVVLKDSGVVGLGSDITPSNNDDGKHYGQLGVVASALDPKKLFGNNLKTINLADLRTILHEFSHTKGYTHNGNMTYQRVPTGHNGSDNKPKDSDGLPYNVCSLYGGSNQPAFPSNYPNSIYHNCADVPAGFLGVTAAVWQQLINQNALPIDYANLSAQTNYNLNASLNTQDLANSMLSTIQKTFVTSSVTNHYFSSASQSFRSPILGVNAKIGYQNYFNDFIGLAYYGIVKYNYSKALNQKFQQLSYGGGIDLLLDFITTYSNKNSPIGVQTKRNFSSSFGIFGGLRGLYNSYYVLNKVKGSGNLDVATGLNYRYKHSKYSVGISIPLIQRKASVVSSGSDYTNSFVFNEGASHFKVFFNYGWVF

SEQ ID NO: 7740 - protein, 661 aa, Helicobacter pylori
MRKLFIPLLLFSALEANEKNGFFIEAGFETGLLEGTQTQEKRHTTTKNTYATYNYLPTDSVLKRAANLFTDAKSISQLNFSSLSPVKVLYIGGQLTIENFLPYNLSNVKLSFTDAQGNAIDLGVIETIPKHSKIVLPGEAFDSLKEAFDKIGPYTFFLPKFEATSTSISDANTQRVFETLNKIKTNLIMKYSNENPSNFNTCPYNNNGNTKNDCWQNFTPQTAEEFTNLMLNMIAVLDSQSWGDAILNAPFEFTNSSTDCDNDPSKCVNPGVNGRVDTKVDQQYILNKQGIINNFRKKIEIDAVVLKNSGVVGLANGYGNDGEYGTLGVEAYALEPQKLFGNDLKTINLADLRTILHEFSHTKGYTHNGNMTYQRVPTGQTENGKPKDSDGLPYNVCSLYGGSNQPAFPSNYPNSIYHNCADVPAGFLGVTAAVWQQLINQNALPIDYANLNAQTNYNLNASLNTQDLANSMLSTIQKTFVTSSVTNHYFSSASQSFRSPILGVNAKIGYQNYFNDFIGLAYYGIVKYNYSKALNQKVQQLSYGGGIDLLLDFITTYSNKNSPIGVQTKRNFSSSFGIFGGLRGLYNSYYVLNKVKGSGNLDVATGLNYRYKHSKYSVGISIPLIQRKASVVSSGSDYTNSFVFNEGASHFKVFFNYGWVF

SEQ ID NO: 7741 - protein, 653 aa, Helicobacter pylori
MRKLFIPLLLFSALEANEKNGFFIEAGFETGLLEGTQTQEKRHTTTKNTYATYNYLPTDSVLKRAANLFTNAEAISKLKFSSLSPVRVLYMYNGQLTIENFLPYNLSNVKLSFKDAQGTTIDLGVIETIPKHSKIVLPGEAFDSLKIDPYTLFLPKIEATSTSISDANTQRVFETLNKIKTNLVVNYRNENKFEGHQNHWEAFTPQTAEEFTNLMLNMIAVLDSQSWGDAILNAPFEFTNKGGGGECDTSKENECVNPGTNGLVNSQNKSYVLNKQDIVNKFRNKADLDVIVLKDSGVVGLGSDITPSNNDDGKHYGQLGVVASALDPKKLFGDNLKTINLADLRTILHEFSHTKGYTHNGNMTYQRVPTGQNENGKPKDSDGLPYNVCSLYGGQGQSAFPSNYPNSIYHNCADVPAGFLGVTAAVWQQLINQNALPINYANLSSQTNYNLNASLNTQDLANSMLSTIQKTFVTSSVTNHYFSSASQSFRSPILGVNAKIGYQNYFNDFIGLAYYGIVKYNYSKALNQKFQQLSYGGGIDLLLDFITTYSNKNNPTGVQTRKNFSSSFGIFGGLRGLYNSYYVLNKVKGSGNLDVATGLNYRYKHSKYSVGISIPLIQRKASVISSGSDYTNSFVFNEGASHFKVFFNYGWVF

SEQ ID NO: 7742 - protein, 668 aa, Helicobacter pylori
MRKLFIPLLLFSALEANEKNGFFIEAGFETGLLEGTQTQEKRHTTTKNTYATYNYLPTDTILKRAANLFTDAKSISQLTFSSLSPVKVLYIGGKLTIENFLPYNLSNVKLSFTDAQGNVIDLGVIETIPKHSKIVLPGEAFDSLKEAFDKIGPYTFFLPKFEATSTSISDTNTQRVFETLNKIKTNLIMKYSNENPNNFNTCPYNNNGNTKNDCWQNFTPQTAEEFTNLMLNMIAVLDSQSWGDAILNAPFEFTNKGGGGECDTSKENDCVNPGTNGLVNSQNKSYVLNKQDIVNKFRNKADLDVVVLKDSGVVGLGSDITPSNNDDGKHYGQLGVEASALDPKKLFGNDLKTINLADLRTILHEFSHTKGYTHNGNMTYQRVPTGQNENGKPKDSDGLPYNVCSLYGGQGQSAFPSNYPNSIYHNCADVPAGFLGVTAAVWQQLINQNALPINYANLGSQTNYNLNASLNTQNLANSMLGTIQKTFVTSSVTNHYSSSASQSFRSPILGVNAKIGYQNYFNDFIGLAYYGIIKYNYSKALNQKFQQLSYGGGIDLLLDFITTYSNKNSPIGVQTRKNFSSSFGIFGGLRGLYNSYYVLNKVKGSGNLDVATGLNYRYKHSKYSVGISIPLIQRKASVVSSGSDYTNSFVFNEGASHFKVFFNYGWVF

SEQ ID NO: 7743 - protein, 654 aa, Helicobacter pylori
MKKLFIPLLLFSALEANEKNGFFIEAGFETGLLEGTQTQEKRHTTTKNTYATYNYLPTDTILKRAANLFTNAEAISKLKFSSLSPVRVLYMYNGQLTIENFLPYNLNNVKRSFTDAQGNTIDLGVIETIPKHSKIILPGEAFDSLKIDPYTLFLPKIEATSTSISDTNTQRVFETLNKIKTDLVVNYRNENKFKDHENHWEAFTPQTAEEFTNLMLNMIAVLDSQSWGDAILNAPFEFTNKGGGGECDTSKENDCVNPGTNGLVNSKVDQQYVLNKQDIVNKFRNKADLDVVVLKDSGVVGLGSDITPSNNDDGKHYGQLGVVASALHPKKLFGNDLKTINLADLRTILHEFSHTKGYTHNGNMTYQRVPTGQTENGKPKDSDGLPYNVCSRFNGSGQPAFPSNYPNSIYHNCADVPAGFLGVTAAVWQQLINQNALPINYANLGSQTNYNLNASLNTQDLANSMLNTIQKTFVTSSVTNHYSSSASQSFRSPILGVNAKIGYQNYFNDFIGLAYYGIIKYNYSKALNQKFQQLSYGGGIDLLVDFITTYSNKNSPTGVQTRRNFSSSFGIFGGLRGLYNSYYVLNKVKGSGNLDVATGLNYRYKHSKYSVGISIPLIQRKASIVSSGGDYTNSFVFNEGASHFKVFFNYGWVF

SEQ ID NO: 7744 - protein, 658 aa, Helicobacter pylori
MRKLFIPLLLFSALEANQKNGFFIEAGFETGLLEGTQTQEQRRTTTKNTYATYNYLPTDTILKRAANLFTNAEAISKLKFSSLSPIRVLYMYNGQLTIENFLPYNLSNVKLSFTDAQGNVIDLGVIETIPKHSKIVLPGEAFDSLKEAFDKIDPYTFFFPKFEATSTSVSDANTQRVFETLNKIKTNLVVNYRNENKFEGHQNHWEAFTPQTAEEFTNLMLNMIAVLDSQSWGDAILNAPFEFTNKGGGGECDTNKENDCVNPGTNGLVNSQNKSYVLNKQDIVNKFRNKADLDVVILKDSGVVGLGSDITPSNNDDGKHYGQLGVVASALDPKKLFGNDLKTIKLEDLRTILHEFSHTKGYTHNGNMTYQRVPTGQNENGKPKDSDGLPYNVCSLYGGQGQSTFPSNYPNSIYHNCADVPAGFLGVTAAVWQQLINQNALPINYANLGSQTNYNLNASLNTQDLANSMLSTIQKTFVTSSVTNHYSSSASQSFRSPILGVNAKIGYQNYFNDFIGLAYYGIIKYNYAKAINQKVQQLSYGGGIDLLLDFITTYSNKNNPTDIQTKRNFSSSFGIFGGLRGLYNSYYVLNKVKGSGNLDVATGLNYRYKHSKYSVGISIPLIQRKASVVSSGGDYTNSFVFNEGASHFKVFFNYGWVF

SEQ ID NO: 7745 - protein, 658 aa, Helicobacter pylori
MRKLFTSLLLFSALEANEKNGFFIEAGFETGLLEGTQTQEKRHTTTKNTYATYNYLPTDSVLKRAANLFTNAEAISKLKFSSLSPIRVLYMYNGQLTIENFLPYNLSNVKLSFKDAQGNTIDLGVIETIPKHSKIVLPGEAFDSLKIDPYTLFLPKIEATSTSISDTNTQRVFETLNKIKTDLVVNYRNENKFKDHENHWEAFTPQTAEEFTNLMLNMIAVLDSQSWGDAILNAPFEFTNKGGEECDTSKENECVNPGTNGLVNSQNKSYVLNKQDIVNKFRNKADLDVVILKDSGVVGLGSDITPSNNDDGKHYGQLGVVASALDPKKLFGNNLKTINLEDLRTILHEFSHTKGYTHNGNMTYQRVPVMKNGQVERDNNGKPKDSDGLPYNVCSLYGGSNQPAFPSNYPNSIYHNCADVPAGFLGVTAAVWQQLINQNALPIDYANLSAQTNYNLNASLNTQDLANSMLSTIQKTFVTSSVTNHYFSSASQSFRSPILGVNAKIGYQNYFNDFIGLAYYGIVKYNYSKALNQKVQQLSYGGGIDLLLDFITTYSNKNSPIGIQTKRNFSSSFGIFGGLRGLYNSYYVLNKVKGSGNLDVATGLNYRYKHSKYSVGISIPLIQRKAKVVSSGSDYTNSFVFNEGASHFKVFFNYGWIF

SEQ ID NO: 7746 - protein, 661 aa, Helicobacter pylori
MKKLFIPLLLFSALEANEKNGFFIEAGFETGLLEGAQTQEKRHTTTKNTYATYNYLPTDTILKRAANLFTDAKSISQLNFSSLSPVKVLYIGGKLTIENFLPYNLSKSVQSFTDAQGNVIDLGVIETIPKHSKIVLPGEAFDSLKEAFDKIDPYTFFLPKFEATSTSISDTNTQRVFETLNKIKTNLIMKYSNENPSNFNTCPYNNNGNTKNDCWQNFTPQTAEEFTNLMLNMIAVLDSQSWGDAILNAPFEFTNSSTDCDNDPSKCVNPGVNGRVDSKVDQQYILNKQGIINNFRKKIEIDAVVLKNSGVVGLANGYGNDGEYGTLGVEAYALEPQKLFGNDLKTINLADLRTILHEFSHTKGYGHNGNMTYQRVPTGQNENGKPKDSDGLPYNVCSLYGGSNQPAFPSNYPNSIYHNCADVPAGFLGVTAAVWQQLINQNALPINYANLGSQTNYNLNASLNTQDLANSMLSTIQKTFVTSSVTNHYFSSASQSFRSPILGVNAKIGYQNYFNDFIGLAYYGIIKYNYSKALNQKFQQLSYGGGIDLLLDFITTYSNKNSPTGVQTEKNFSSSFGIFGGLRGLYNSYYVLNKVKGSGNLDVATGLNYRYKHSKYSVGISIPLIQRKASVVSSSSDYTNSFVFNEGASHFKVFFNYGWVF

SEQ ID NO: 7747 - protein, 658 aa, Helicobacter pylori
MKKLFIPLLLFSALEANEKNGFFIEAGFETGLLEGAQTQEKRHTTTKNTYATYNYLPTDTILKRAANLFTDAKSISQLNFSSLSPVKVLYIGGKLTIENFLPYNLNNVKLSFTDAQGNVIDLGVIETIPQHSKIVLPGEAFDSLKEAFDKIGPYTFFLPKFEATSTSVSDANTQRVFETLNKIKTDLVVNYRNENKFKDHENHWEAFTPQTAEEFTNLMLNMIAVLDSQSWGDAILNAPFEFTNKGGGGECDTSKESECVNPGVNGRVDSKVDQQYVLNKQDIVNKFRNKADLDVVVLKDSGVVGLGSDITPSNNDDGKHYGPLGVVASALDPKKLFGNDLKTINLAELRTILHEFSHTKGYGHNGNMTYQRVPTGPNENGKPKDSDGLPYNVCSLYGGQGQSAFPSNYPNSIYHNCADVPAGFLGVTAAVWQQLINQNALPIDYANLNAQTNYNLNASLNTQDLANSMLGTIQKTFVTSSVTNHYFSSASQSFRSPILGVNAKIGYQNYFNDFIGLAYYGIIKYNYSKALNQKFQQLSYGGGIDLLLDFITTYSNKNSPTGVQTRKNFSSSFGIFGGLRGLYNSYYVLNKVKGSGNLDVATGLNYRYKHSKYSVGISIPLIQRKAGVVSSGSDYTNSFVFNEGASHFKVFFNYGWVF

SEQ ID NO: 7748 - protein, 659 aa, Helicobacter pylori
MKKLFIPLLLFSALEANEKNGFFIEAGFETGLLEGTQTQEKRHTTTKNTYATYNYLPTDSVLKRAANLFTNAEAISKLKFSSLSPIRVLYMYNGQLTIENFLPYNLSNVKLSFTDAQGNVIDLGVIETIPKHSKIVLPGEAFDSLKIDPYTFFLPKIEATSTSISDANTQRVFETLNKIKTNLVVNYRNENKFKDHENHWEAFTPQTAEEFTNLMLNMIAVLDSQSWGDAILNAPFEFTNKGGEGECDTSKENECVNPGTNGLVNSQNQQYVLNKQDIVNKFRNKADLDVVVLKDSGVVGLGSDITPSNNDDGKHYGQLGVVASALDPKKLFGNDLKTINLADLRTILHEFSHTKGYGHNGNMTYQRVPVTKDGQVERDNNGKPKDSDGLPYNVCSLYGGQGQSAFPSSYPNSIYHNCADVPAGFLGVTAAVWQQLINQNALPIDYANLNAQTNYNLNASLNTQDLANSMLSTIQKTFVTSSVTNHYSSSASQSFRSPILGVNAKIGYQNYFNDFIGLAYYGIVKYNYSKALNQKFQQLSYGGGIDSLLDFITTYSNKNSPIGVQTKRNFSSSFGIFGGLRGLYNSYYVLNKVKGSGNLDVATGLNYRYKHSKYSVGISIPLIQRKASVVSSGSDYTNSFVFNEGASHFKVFFNYGWVF

SEQ ID NO: 7749 - protein, 669 aa, Helicobacter pylori
MKKLFIPLLLFSALEANEKNGFFIEAGFETGLLEGAQTQEKRHTTTKNTYATYNYLPTDTILKRAANLFTDAKSISQLNFSSLSPVKVLYMYNGQLTIENFLPYNLSNVKLSFTDTQGNVIDLGVIETIPKHSKIVLPGEAFNSLKEAFDKIDPYTFFFPKFEATSTSVSDANTQRVFETLNKIKTNLIMKYSNENPNNFNTCPYNNNGNTKNDCWQNFTPQTAEEFTNLMLNMIAVLDSQSWGDAILNAPFEFTNKGGGGECDTSKENDCVNPGTNGLVNSQNKSYVLNKQDIVNKFRNKADLDVVILKDSGVVGLGSDITPSNNDDGKHYGQLGVVASALDPKKLFGNDLKTINLADLRTILHEFSHTKGYTHNGNMTYQRVPTGQNENGKPKDSDGLPYNVCSLYGGANQPAFPSNYPNSIYHNCADVPAGFLGVTAAVWQQLINQNALPISYANLGSQTNYNLNASLNTQDLANSMLSTIQKTFVTSSVTNHYSSSASQSFRSPILGVNAKIGYQNYFNDFIGLAYYGIIKYNYAKAINQKVQQLSYGGGIDLLLDFITTYSNKNSPIGIQTRRNFSSSFGIFGGLRGLYNSYYVLNKVKGSGNLDVATGLNYRYKHSKYSVGISIPLIQRKASVVSSGGDYTNSFVFNEGASHFKVFFNYGWVF

SEQ ID NO: 7750 - protein, 652 aa, Helicobacter pylori
MKKLFIPLLLFSALEANEKNGFFIEAGFETGLLEGTQTQEKRYTTTKNTYATYDYLPTDTILKRAANLFTNAEAISKLKFSSLSPVRVLYMYNGQLTIENFLPYNLSNVKLSFKDAQGNVIDLGVIETIPKHSKIVLPGEAFDSLKIDPYTLFLPKIEATSTSISDANTQRVFETLNKIKTNLVVNYRNENKFKDHENHWEAFTPQTAEEFTNLMLNMIAVLDSQSWGDAILNAPFEFTNKGGEECDTSKENECVNPGTNGLVNSQNKSYVLNKQDIVNKFRNKADLDVVILKDSGVVGLGSDITPSNNDDGKHYGQLGVVASALDPKKLFGNDLKTINLADLRTILHDFSHTKGYTHNGNMTYQRVPTGKTENGKPKDSDGLPYNVCSLYGGQGQSAFPSNYPNSIYHNCADVPAGFLGVTAAVWQQLINQNALPINYANLGSQTNYNLNASLNTQDLANSMLGTIQKTFVTSSVTNHYSSSASQSFRSPILGVNAKIGYQNYFNDFIGLAYYGIVKYNYSKAVNQKFQQLSYGGGIDLLLDFITTYSNKNSPIDIQTRRNFSSSFGIFGGLRGLYNSYYVLNKVKGSGNLDVATGLNYRYKHSKYSVGISIPLIQRKAKVVSSGSDYTNSFVFNEGASHFKVFFNYGWVF

SEQ ID NO: 7751 - protein, 665 aa, Helicobacter pylori
MKKLFIPLLLFSALEANEKNGFFIEAGFETGLLEGTQTQEKRHTTTKNTYATYNYLPTDTILKRAANLFTNAEAISKLKFSSLSPVRVLYMYNGYNGQLTIENFLPYNLNNVKLSFTDAQGNVIDLGVIETIPKHSKIVLPGEAFDSLKEAFDKIDPYTFFFPKFEATSTSISDTNTQRVFETLNNIKTNLIMKYSNENPSNFNTCPYNNNGNTKNDCWQNFTPQTAEEFTNLMLNMIAVLDSQSWGDAILNAPFEFTNSSTDCDNDPSKCVNPGVNGRVDTKVDQQYILNKQGIINNFRKKIEIDAVVLKNSGVVGLANGYGNDGEYGTLGVEAYALEPQKLFGNDLKTINLADLRTILHEFSHTKGYGHNGNMTYQRVPTGQNENGKPKDSDGLPYNVCSLYGGSNQPAFPSNYPNSIYHNCADVPAGFLGVTAAVWQQLINQNALPIDYANLNAQTNYNLNASLNTQDLANSMLSTIQKTFVTSSVTNHYFSSASQSFRSPILGVNAKIGYQNYFNDFIGLAYYGIVKYNYSKALNQKFQQLSYGGGIDLLLDFITTYSNKNSPTGIQTRKNFSSSFGIFGGLRGLYNSYYVLNKVKGSGNLDVATGLNYRYKHSKYSVGISIPLIQRKASVVSSGGDYTNSFVFNEGASHFKVFFNYGWVF

SEQ ID NO: 7752 - protein, 661 aa, Helicobacter pylori
MRKLFIPLLLFSALEANEKNGFFIEAGFETGLLEGTQTQEKRHTTTKNTYATYNYLPTDSVLKRAANLFTDAKSISQLNFSSLSPVKVLYSGGKLTIENFLPYNLSNVKLSFTDAQGNAIDLGVIETIPKHSKIVLPGEAFDSLKEAFDKIGPYTFFFPKFEATSTSISDTNTQRVFETLNNIKTNLIMKYSNENPSNFNTCPYNNNGNTKNDCWQNFTPQTAEEFTNLMLNMIAVLDSQSWGDAILNAPFEFTNSSTDCDNDPSKCVNPGVNGRVDTKVDQQYILNKQGIINNFRKKIEIDAVVLKNSGVVGLANGYGNDGEYGTLGVEAYALEPQKLFGNDLKTINLEDLRTILHEFSHTKGYTHNGNMTYQRVPPGQLENGKPKDSDGLPYNVCSLYGGSNQPAFPSNYPNSIYHNCADVPAGFLGVTAAVWQQLINQNALPIDYANLSAQTNYNLNASLNTQDLANSMLSTIQKTFVTSSVTNHYFSSASQSFRSPILGVNAKIGYQNYFNDFIGLAYYSIVKYNYSKALNQKVQQLSYGGGIDLLLDFITTYSNKNSPIGVQTKRNFSSSFGIFGGLRGLYNSYYVLNKVKGSGNLDVATGLNYRYKHSKYSVGISIPLIQRKASVVSSGSDYTNSFVFNEGASHFKVFFNYGWVF

SEQ ID NO: 7753 - protein, 661 aa, Helicobacter pylori
MKKLFIPLLLFSTLEANEKNGFFIEAGFETGLLEGAQTQEKRHTTTKNTYATYSYLPTDSVLKRAANLFTDAKSISQLNFSSLSPVKVLYIGGQLTIENFLPYNLSNVKLSFKDAQGNVIDLGVIETIPKHSKIVLPGEAFDSLKEAFDKIGPYTFFFPKFEATSTSISDTNTQRVFETLNKIKTNLIMKYSNENPSNFNTCPYNNNGNTKNDCWQNFTPQTAEEFTNLMLNMIAVLDSQSWGDAILNAPFEFTNSSTDCDNDPSKCVNPGVNGRVDTKVDQQYILNKQGIINNFRKKIEIDAVVLKNSGVVGLANGYGNDGEYGTLGVEAYALEPQKLFGNDLKTINLEDLRTILHEFSHTKGYGHNGNMTYQRVPTGQNENGKPKDSDGLPYNVCSLYGGSNQPAFPSNYPNSIYHNCADVPAGFLGVTAAVWQQLINQNALPIDYANLSAQKNYNLNASLNTQDLANSMLGTIQKTFVTSSVTNHYFSSASQSFRSPILGVNAKIGYQNYFNDFIGLAYYGIVKYNYSKALNQKFQQLSYGGGIDLLLDFITTYSNKNSPIGVQTRRNFSSSFGIFGGLRGLYNSYYVLNKVKGSGNLDVATGLNYRYKHSKYSVGISIPLIQRKASVVSSGGDYTNSFVFNEGASHFKVFFNYGWVF

SEQ ID NO: 7754 - protein, 654 aa, Helicobacter pylori
MRKLFIPLLLFSALEANEKNGFFIEAGFETGLLEGAQTQEKRHTTTKNTYATYNYLPTDTILKRAANLFTNAEAISKLKFSSLSPVRVLYMYNGQLTIENFLPYNLSNVKLSFTDAQGKVIDLGVIETIPKHSKIVLPGEAFDSLKIDPYTLFLPKIEATSTSISDANTQRVFETLNKIKTNLVVNYRNENKFKDHENHWEAFTPQTAEEFTNLMLNMIAVLDSQSWGDAILNAPFEFTNKGGGGECDTSKENECVNPGTNGVVNSQNKSYVLNKQDIVNKFRNKADLDVVILKDSGVVGLGSDITPSTNDDGKHYGQLGVVASALDPKKLFGNDLKTINLADLRTILHEFSHTKGYGHNGNMTYQRVPTGHNGSDNKPSDSDGLPYNVCSLYGGSNQPAFPSNYPNSIYHNCADVPAGFLGVTAAVWQQLINQNALPIDYANLNAQTNYNLNASLNTQDLANSMLSTIQKTFVTSSVTNHYSSSASQSFRSPILGVNAKIGYQNYFNDFIGLAYYGIIKYNYSKALNQKFQQLSYGGGIDLLLDFITTYSNKNSPIGVQTRRNFSSSFGIFGGLRGLYNSYYVLNKVKGSGNLDVATGLNYRYKHSKYSVGISIPLIQRKAKVVSSGSDYTNSFVFNEGASHFKVFFNYGWVF

SEQ ID NO: 7755 - protein, 652 aa, Helicobacter pylori
MRKLFIPLLLFSALEANEKNGFFIEAGFETGLLEGVQTQEKRHTTTKNTYATYNYLPTDTILKRAANLFTNAEAISKLKFSSLSPVRVLYMYNGQLTIENFLPYNLNNVKLSFTDAQGNVIDLGVIETIPKHSKIVLPGEAFDSLKIDPYTLFLPKIEATSTSISDANTQRVFETLNKIKTNLVVNYRNENKFKDHENHWEAFTPQTAEEFTNLMLNMIAVLDSQSWGDAILNAPFEFTNKGGGGECDTSNECVNPGTNGLVNSKVDQKYVLNKQDIVNKFRNKADLDVIVLKDSGVVGLGSDITPSNNDDGKHYGQLGVVASALDPKKLFGNDLKTIKLEDLRTILHEFSHTKGYTHNGNMTYQRVPTGQNENGKPKDSDGLPYNVCSLYGKSNQPAFPSNYPNSIYHNCADVPAGFLGVTAAVWQQLINQNALPINFANLGSQTNYNLNASLNTQDLANSMLSTIQKTFVTSSVTNHYYSSASQSFRSPILGVNAKIGYQNYFNDFIGLAYYGIIKYNYAKAINQKVQQLSYGGGIDLLVDFITTYSNKNSPTGIQTKKNFSSSFGIFGGLRGLYNSYYVLNKVKGSGNLDVATGLNYRYKHSKYSVGISIPLIQRKASVVSSGGDYTNSFVFNEGASHFKVFFNYGWVF

SEQ ID NO: 7756 - protein, 664 aa, Helicobacter pylori
MRKLFIPLLLFSALEANEKNGFFIEAGFETGLLEGAQTQEKRHTTTKNTYATYNYLPTDTILKRAASLFTNAEAISQLKFSSLSPVRVLYMYKGQLTIENFLPYNLNNVKLSFKDAQGNVIDLGVIETIPKHSKIVLPGEAFDSLKEAFDKIDPYTFFFPKFEATSTSISDANTQRVFETLNKIKTDLVVNYRNENKFKDHENHWEAFTPQTAEEFTNLMLNMIAVLDSQSWGDAILNAPFEFTNKGGGGECDTSKENDCVNPGTNGVVNSQNKNYVLNKQDIVNKFRNKADLDVVILKDSGVVGLGSDITPSNNDDGKHYGQLGVVASALEPKKLFSANLKTINLADLRTILHEFSHTKGYGHNGNMTYQRVPVMKNGQVERDNNGKPKDSDGLPYNVCSLYGGSGQSAFPSNYPNSIYHNCADVPAGFLGVTAAVWQQLINQNALPIDYANLSAQTNYNLNASLNTQDLANSMLSTIQKTFVTSSVTNHYFSSASQSFRSPILGVNAKIGYQNYFNDFMGLAYYGIIKYNYSKALNQKFQQLSYGGGIDLLLDFITTYSNKNSPIGVQTRRNFSSSFGIFGGLRGLYNSYYVLNKVKGSGNLDVATGLNYRYKHSKYSVGISIPLIQRKASVVSSGSDYTNSFVFNEGASHFKVFFNYGWVF

SEQ ID NO: 7757 - protein, 661 aa, Helicobacter pylori
MRKLFIPLLLFSALEANEKNGFFIEAGFETGLLEGAQTQEKRHTTTKNTYATYDYLPTDSVLKRAANLFTDAKSISQLTFSSLSPVKVLYVGGKLTIENFLPYNLSNVKLSFTDAQGNVIDLGVIETIPKHSKIVLPGEAFDSLKEAFDKIGPYTFFFPKFEATSTSISDTNTQRVFETLNKIKTNLIMKYSNENPSNFNTCPYNNNGNTKNDCWQNFTPQTAEEFTNLMLNMIAVLDSQSWGDAILNAPFEFTNSSTDCDNDPSKCVNPGVNGRVDSKVDQQYILNKQGIINNFRKKIEIDAVVLKNSGVVGLANGYGNDGEYGTLGVEAYALEPQKLLGNDLKTINLEDLRTILHEFSHTKGYTHNGNMTYQRVPTGQNENGKPKDSDGLPYNVCSLYGGQGQSAFPSNYPNSIYHNCADVPAGFLGVTAAVWQQLINQNALPIDYANLSAQTNYNLNASLNTQDLANSMLGTIQKTFVTSSVTNHYFSSASQSFRSPILGVNAKIGYQNYFNDFIGLAYYGIVKYNYSKALNQKFQQLSYGGGIDLLLDFITTYSNKNSPIGIQTRRNFSSSFGIFGGLRGLYNSYYVLNKVKGSGNLDVATGLNYRYKHSKYSVGISIPLIQRKASVVSSSGDYTNSFVFNEGASHFKVFFNYGWVF

SEQ ID NO: 7758 - protein, 653 aa, Helicobacter pylori
MRKLFIPLLLFSALEANEKNGFFIEAGFETGLLEGTQTQEKRHTTTKNTYATYNYLPTDTILKRAANLFTNAEAISKLKFSSLSPVRVLYMYNGQLTIENFLPYNLSNVKLSFKDAQGNVIDLGVIETIPKHSKIVLPGEAFDSLKIDPYTLFLPKIEATSTSISDANTQRVFETLNKIKTDLVVNYRNENKFKDHENHWEAFTPQTAEEFTNLMLNMIAVLDSQSWGDAILNAPFEFTNKGGGGECDTSKENDCVNPGVNGVVNSQNKSYVLNKQDIVNKFRNKADLDVVVLKDSGVVGLGSDITPSNNDDGKHYGQLGVVASALDPKKLFGSDLKTINLADLRTILHEFSHTKGYTHNGNMTYQRVPTGQTENGKPKDSDGLPYNVCSLYGGSNQPAFPSNYPNSIYHNCADVPAGFLGVTAAVWQQLINQNALPIDYANLSAQTNYNLNASLNTQDLANSMLSTIQKTFVTSSVTNHYFSSASQSFRSPILGVNAKIGYQNYFNDFIGLAYYGIVKYNYSKALNQKVQQLSYGGGIDLLLDFITTYSNKNSPIGIQTRRNFSSSFGIFGGLRGLYNSYYVLNKVKGSGNLDVATGLNYRYKHSKYSVGISIPLIQRKASVVSSGSDYTNSFVFNEGASHFKVFFNYGWVF

SEQ ID NO: 7759 - protein, 661 aa, Helicobacter pylori
MKKLFIPLLLFSALEANEKNGFFIEAGFETGLLEGTQTQEKRHTTTKNTYATYNYLPTDTILKRAANLFTDAKSISQLNFSSLSPVKVLYIGGKLTIENFLPYNLSNVKLSFTDAQGNVIDLGVIETIPKHSKIVLPGEAFDSLKEAFDKIGPYTFFFPKFEATSTSVSDANTQRVFETLNNIKTNLIMKYSNKNPSNFNTCPYNNNGNTKNDCWQNFTPQTAEEFTNLMLNMIAVLDSQSWGDAILNAPFEFTNSSTDCDNDPSKCVNPGTNGLVDSKVDQQYVLNKQGIINNFRKKIEIDAVVLKNSGVVGLANGYGNDGEYGTLGVVASALDPKKLFGNDLKTINLADLRTILHEFSHTKGYTHNGNMTYQRVPTGQTENGKPKDSDGLPYNVCSLYGGSNQPAFPSNYPNSIYHNCADVPAGFLGVTAAVWQQLINQNALPINYANLGSQTNYNLNASLNTQDLANSMLSTIQKTFVTSSVTNHYSSSASQSFRSPILGVNAKIGYQNYFNDFIGLAYYGIVKYNYSKALNQKFQQLSYGGGIDLLVDFITTYSNKNNPTGIQTKKNFSSSFGIFGGLRGLYNSYYVLNKVKGSGNLDVATGLNYRYKHSKYSVGISIPLIQRKASVVSSGSDYTNSFVFNEGASHFKVFFNYGWVF

SEQ ID NO: 7760 - protein, 667 aa, Helicobacter pylori
MKKLFIPLLLFSALEANEKNGFFIEAGFETGLLEGTQTQEKRHTTTKNTYATYNYLPTDTILKRAANLFTDAKSISQLNFSSLSPVKVLYIGGKLTIENFLPYNLNNVKLSFTDAQGNTIDLGVIETIPKHSKIVLPGDAFDSLKEAFDKIDPYTFFLPKFEATSTSVSDANTQRVFETLNKIKTNLIMKYSNENPSNFNTCPYNNNGNTKNDCWQPFTPQTAEEFTNLMLNMIAVLDSQSWGDAILNAPFEFTNSPTDCDNDPSKCVNPGINGRVDSKVDQQYVLNKQGIVNNFRKKIEIDAVVLKNSGVVGLANGYGNDGEYGTLGVEASALDPQKLFGNDLKTINLEDLRTILHEFSHTKGYGHNGNMTYQRVPVMKNGQVERDNNGKPKDSDGLPYNVCSLYGGQGQSAFPSNYSNSIYHNCADVPAGFLGVTAAVWQQLINQNALPINYANLNSQTNYNLNASLNTQDLANSMLSTIQKTFLTSSVTNHYSSSASQSFRSPILGVNAKIGYQNYFNDFIGLAYYGIIKYNYAKAINQKVQQLSYGGGIDLLLDFITTYSNKNNPIGIQTRKNFSSSFGIFGGLRGLYNSYYVLNKVKGSGNLDVATGLNYRYKHSKYSVGISIPLIQRKASVISSGGDYTNSFVFNEGASHFKVFFNYGWVF

SEQ ID NO: 7761 - protein, 652 aa, Helicobacter pylori
MKKLFIPLLLFSALEANEKNGFFIEAGFETGLLEGTQTQEKRHTTTKNTYATYNYLPTDTILKRAASLFTDAKSISQLNFSSLSPVRASASMLNGSLTIENFLPYNLNNVKLSLKDAQGNVIDLGVIETIPKHSKIVLPEKLFDGLKQIGPYIFQQIEVSSTQVSDANTQRVFETLNNIKTNLIMKYSNKNPSNFNTCPYNNNGNTKNDCWQNFTPQTAEEFTNLMLNMIAVLDSQSWGDAILNAPFEFTNSSTDCDSDPSKCVNPGVNGRVDTKVDQQYILNKQGIINNFRKKIEIDAVVLKNSGVVGLANGYGNDGEYGTLGVEAYALEPQKLFGNDLKTINLADLRTILHEFSHTKGYGHNGNMTYQRVPTGQTENGKPKDSDGLPYNVCSLYGGQGQSAFPSNYPNSIYHNCADVPAGFLGVTAAVWQQLINQNALPIDYANLSTQTNYNLNASLNTQDLANSMLSTIQKTFVTSSVTNHYSSSASQSFRSPILGVNAKIGYQNYFNDFIGLAYYGIVKYNYSKALNQKFQQLSYGGGIDLLLDFITTYSNKNSPTGIQTRKNFSSSFGIFGGLRGLYNSYYVLNKVKGSGNLDVATGLNYRYKHSKYSVGISIPLIQRKASVVSSGSDYTNSFVFNEGASHFKVFFI

SEQ ID NO: 7762 - protein, 661 aa, Helicobacter pylori
MRKLFIPLLLFSALEANEKNGFFIEAGFETGLLEGTQTQEKRHTTTKNTYATYNYLPTDTILKRAANLFTDAKSISQLNFSSLSPVKVLYVGGKLTIENFLPYNLSNVKLSFTDAQGNAIDLGVIETIPKHSKIVLPGEAFDSLKEAFDKIGPYTFFLPKFEATSTSISDANTQRVFETLNNIKTNLIMKYSNENPSNFNTCPYNNNGNTKNDCWQNFTPQTAEEFTNLMLNMIAVLDSQSWGDAILNAPFEFTNSPTDCDNDSSKCVNPGVNGRVDSKVDQQYILNKQGIVNNFRKKIEIDAVVLKNSGVVGLANGYGNDGEYGTLGVEAYALEPQKLFGNDLKTINLEDLRTILHEFSHTKGYTHNGNMTYQRVPTGQNENGKPKDSDGLPYNVCSLYGGSNQPAFPSNYPNSIYHNCADVPAGFLGVTAAVWQQLINQNALPINYANLGSQTNYNLNASLNTQDLANSMLGTIQKTFVTSSVTNHYFSSASQSFRSPILGVNAKIGYQNYFNDFIGLAYYGIVKYNYSKALNQKFQQLSYGGGIDLLLDFITTYSNKNSPIDIQTRRNFSSSFGIFGGLRGLYNSYYVLNKVKGSGNLDVATGLNYRYKHSKYSVGISIPLIQRKASVVSSGSDYTNSFVFNEGASHFKVFFNYGWVF

SEQ ID NO: 7763 - protein, 668 aa, Helicobacter pylori
MRKLFIPLLLFSALEANEKNGFFIEAGFETGLLEGTQTQEKRHTTTKNTYATYNYLPTDTILKRAANLFTDAKSISQLTFSSLSPVKVLYIGGKLTIENFLPYNLSNVKLSFTDAQGNVIDLGVIETIPKHSKIVLPGEAFDSLKEAFDKIGPYTFFLPKFEATSTSISDTNTQRVFETLNKIKTNLIMKYSNENPNNFNTCPYNNNGNTKNDCWQNFTPQTAEEFTNLMLNMIAVLDSQSWGDAILNAPFEFTNKGGGGECDTSKENDCVNPGTNGLVNSQNKSYVLNKQDIVNKFRNKADLDVVVLKDSGVVGLGSDITPSNNDDGKHYGQLGVEASALDPKKLFGNDLKTINLADLRTILHEFSHTKGYTHNGNMTYPRVPTGQNENGKPKDSDGLPYNVCSLYGGQGQSAFPSNYPNSIYHNCADVPAGFLGVTAAVWQQLINQNALPINYANLGSQTNYNLNASLNTQNLANSMLGTIQKTFVTSSVTNHYSSSASQSFRSPILGVNAKIGYQNYFNDFIGLAYYGIIKYNYSKALNQKFQQLSYGGGIDLLLDFITTYSNKNSPIGVQTRKNFSSSFGIFGGLRGLYNSYYVLNKVKGSGNLDVATGLNYRYKHSKYSVGISIPLIQRKASVVSSGSDYTNSFVFNEGASHFKVFFNYGWVF

SEQ ID NO: 7764 - protein, 661 aa, Helicobacter pylori
MKKLFIPLLLFSALEANEKNGFFIEAGFETGLLEGTQTQEKRHTTTKNTYATYNYLPTDTILKRAANLFTDAKSISQLNFSSLSPVKVLYIGGKLTIENFLPYNLSNVKLSFTDAQGNVIDLGVIETIPKHSKIVLPGEAFDSLKEAFDKIGPYTFFLPKFEATSTSVSDANTQRVFETLNNIKTNLIMKYSNKNPNNFNTCPYNNNGNTKNDCWQNFTPQTAEEFTNLMLNMIAVLDSQSWGDAILNAPFEFTNSSTDCDNDPSKCVNPGTNGRVDSKVDQQYILNKQGIINNFRKKIEIDAVVLKNSGVVGLANGYGNDGEYGTLGVEAYALEPQKLFSDNLKTINLADLRTILHEFSHTKGYTHNGNMTYQRVPTGQTENGKPKDSDGLPYNVCSLYGGSGQSTFPSNYPNSIYHNCADVPAGFLGVTAAVWQQLINQNALPIDYANLSAQTNYNLNASLNTQDLANSMLGTIQKTFVTSSVTNHYSSSASQSFRSPILGVNAKIGYQNYFNDFIGLAYYGIIKYNYAKAINQKVQQLSYGGGIDLLLDFITTYSNKNSPTGIQTKRNFSSSFGIFGGLRGLYNSYYVLNKVKGSGNLDVATGLNYRYKHSKYSVGISIPLIQRKASVVSSGSDYTNSFVFNEGASHFKVFFNYGWVF

SEQ ID NO: 7765 - protein, 661 aa, Helicobacter pylori
MKKLFIPLLLFSALEANEKNGFFIEAGFETGLLEGTQTQEKRHTTTKNTYATYNYLPTDTILKRAANLFTDAKSISQLNFSSLSPVKVLYIGGKLTIENFLPYNLSNVKLSFTDAQGNVIDLGVIETIPKHSKIVLPGEAFDSLKEAFDKISPYTFFFPKFETTSTSISDTNTQRVFETLNKIKTNLIMKYSNENPSNFNTCPYNNNGNTKNDCWQNFTPQTAEEFTNLMLNMIAVLDSQSWGDAILNAPFEFTNSSADCDNDPSKCVNPGVNGRVDTKVDQQYILNKQGIINNFRKKIEIDAVVLKNSGVVGLANGYGNDGEYGTLGVEAYALEPPKLFGNDLKTINLADLRTILHEFSHTKAIGHNGNMTYQRVPTGQNENGKPKDSDGLPYNVCSLYGGSNQPAFPSNYPNSIYHNCADVPAGFLGVTAAVWQQLINQNALPINYANLSAQTNYNLNASLNTQDLANSMLNTIQKTFVTSSVTNHYFSSASQSFRSPILGVNAKIGYQNYFNDFIGLAYYGIIKYNYSKALNQKFQQLSYGGGIDLLLDFITTYSNKNNPTGVQTRRNFSSSFGIFGGLRGLYNSYYVLNKVKGSGNLDVATGLNYRYKHSKYSVGISIPLIQRKASVVSSGGDYTNSFVFNEGASHFKVFFNYGWVF

SEQ ID NO: 7766 - protein, 661 aa, Helicobacter pylori
MRKLFIPLLLFSALEANEKNGFFIEAGFETGLLEGAQTQEKRHTTTKNTYATYDYLPADTILKRAANLFTDAKSISQLTFSSLSPVKVLYIGGKLTIENFLPYNLSNVKLSFKDAQGNTIDLGVIETIPKHSKIVLPGEAFDSLKEAFDKIGPYTFFFPKFEATSTSVSDTNTQRVFETLNNIKTNLIMKYSNENPSNFNTCPYNNNGNTKNDCWQNFTPQTAEEFTNLMLNMIAVLDSQSWGDAILNAPFEFTNSSTDCDNDPSKCVNPGVNGRVDTKVNQQYILNKQGIINNFRKKIEIDAVVLKNSGVVGLANGYGNDGEYGTLGVEAYALEPQKLFGNNLKTINLADLRTILHEFSHTKGYTHNGNMTYQRVPTGQNENGKPKDSDGLPYNVCSLYGGQGQSAFPSNYPNSIYHNCADVPAGFLGVTAAVWQQLINQNALPIDYANLNAQTNYNLNASLNTQDLANSMLGTIQKTFVTSSVTNHYSSSASQSFRSPILGVNAKIGYQNYFNDFIGLAYYGIVKYNYSKALNQKFQQLSYGGGIDLLVDFITTYSNKNSPTGVQARRNFSSSFGIFGGLRGLYNSYYVLNKVKGSGNLDVATGLNYRYKHSKYSVGISIPLIQRKAKVVSTNGDYTNSFVFNEGASHFKVFFNYGWVF

SEQ ID NO: 7767 - protein, 661 aa, Helicobacter pylori
MRKLFIPLLLFSALEANEKNGFFIEAGFETGLLEGAQTQEKRHTTTKNTYATYDYLPTDSVLKRAANLFTDAKSISQLTFSSLSPVKVLYVGGKLTIENFLPYNLSNVKLSFTDAQGNVIDLGVIETIPKHSKIVLPGEAFDSLKEAFDKIGPYTFFFPKFEATSTSISDTNTQRVFETLNKIKTNLIMKYSNENPSNFNTCPYNNNGNTKNDCWQNFTPQTAEEFTNLMLNMIAVLDSQSWGDAILNAPFEFTNSSTDCDNDPSKCVNPGVNGRVDSKVDQQYILNKQGIINNFRKKIEIDAVVLKNSGVVGLANGYGNDGEYGTLGVEAYALEPQKLFGNDLKTINLEDLGTILHEFSHTKGYTHNGYMTYQRVPTGQNENGKPKDSDGLPYNVCSLYGGQGQSAFPSNYPNSIYHNCADVPAGFLGVTAAVWQQLINQNALPIDYANLSAQTNYNLNASLNTQDLANSMLGTIQKTFVTSSVTNHYFSSASQSFRSPILGVNAKIGYQNYFNDFIGLAYYGIVKYNYSKALNQKFQQLSYGGGIDLLLDFITTYSNKNSPIGIQTRRNFSSSFGIFGGLRGLYNSYYVLNKVKGSGNLDVATGLNYRYKHSKYSVGISIPLIQRKASVVSSSGDYTNSFVFNEGASHFKVFFNYGWVF

SEQ ID NO: 7768 - protein, 668 aa, Helicobacter pylori
MRKLFIPLLLFSALEANEKNGFFIEAGFETGLLEGAQTQEKRHTTTKNTYATYNYLPTDSVLKRAANLFTDAKSISQLNFSSLSPVKVLYIGGKLTIENFLPYNLSNVKLSFTDAQGNTIDLGVIETIPKHSKIVLPGEAFNSLKEAFDKIGPYTLFLPKIEATSTSVSDANTQRVFETLNKIKTNLIMKYSNENPSNFNTCPYNNNGNTKNDCWQNFTPQTAEEFTNLMLNMIAVLDSQSWGDAILNAPFEFTNKGGGGECDTSKENDCVNPGTNGVVNSQNKNYVLNKQDIVNKFRNKADLDVVILKDSGVVGLGSDITPSNNDDGKHYGQLGVVASALEPKKLFGNNLKTINLEDLRTILHEFQHTKGYTHNGNMTYQRVPTGQNENGKPKDSDGLPYNVCSLYGGQGQSAFPSNYPNSIYHNCADVPAGFLGVTAAVWQQLINQNALPINYANLNSQTNYNLNASLNTQDLANSMLGTIQKTFVTSSVTNHYFSSASQSFRSPILGVNAKIGYQNYFNDFIGLAYYGIIKYNYSKALNQKFQQLSYGGGIDLLLDFITTYSNKNSPIDIQTRRNFSSSFGVFGGLRGLYNSYYVLNKVKGSGNLDVATGLNYRYKHSKYSVGISIPLIQRKASVVSSGSDYTNSFVFNEGASHFKVFFNYGWVF

SEQ ID NO: 7769 - protein, 661 aa, Helicobacter pylori
MRKLFIPLLLFSALEANEKNGFFIEAGFETGLLEGAQTQEKRHTTTKNTYATYNYLPTDSVLKRAANLFADAKSISQLNFSSLSPVKVLYIGGQLTIENFLPYNLSNVKLSFTDAQGNVIDLGVIETIPKHSKIVLPGEAFDSLKEAFDKIGPYTFFLPKFETTSTSISDANTQRVFETLNRIKTNLIMKYSNENPNNFNTCPYNNNGNTKNDCWQNFTPQTAEEFTNLMLNMIAVLDSQSWGDAILNAPFEFTNSPTDCDNDPSKCVNPGVNGRVDSKVDQQYVLNKQGIINNFRKKIEIDAVVLKNSGVVGLANGYGNDGEYGTLGVEAYALEPQKLFGNDLKTINLADLRTILHEFSHTKGYGHNGNMTYQRVPTGQTENGKPKDSDGLPYNVCSLYGGSNQPAFPSNYPNSIYHNCADVPAGFLGVTAAVWQQLINQNALPIDYANLSAQTNYNLNASLNTQDLANSMLGTIQKTFVTSSVTNHYFSSASQSFRSPILGVNAKIGYQNYFNDFIGLAYYGIIKYNYSKALNQKFQQLSYGGGIDLLLDFITTYSNKNNPTGVQTRRNFSSSFGIFGGLRGLYNSYYVLNKVKGSGNLDVATGLNYRYKHSKYSVGISIPLIQRKASVVSSGGDYTNSFVFNEGASHFKVFFNYGWVF

SEQ ID NO: 7770 - protein, 674 aa, Helicobacter pylori
MKKLFIPLLLFSALEANEKNGFFIEAGFETGLLEGTQTQEKRHTTTKNTYATYNYLPTDSVLKRAANLFTDAKSISQLNFSSLSPVKVLYIGGKLTIENFLPYNLSHVKLSFTDAQGNTIDLGVIETIPKHSKIVLPGEAFDSLKEAFDKIGPYTFFLPKFEATSTSISDANTQRVFETLNKIKTNLIMKYSNENPSNFNTCPYNNNGNTKNDCWQNFTPQTAEEFTNLMLNMIAVLDSQSWGDAILNAPFEFTNKGGGEECDTSKENDCVNPGTNGLVNSQNQQYVLNKQDIVNKFRNKADLDVIILKDSGVVGLGSDITPSNNDDGKHYGQLGVEAYALEPQKLFGNNLKTINLADLRTIWHEFSHTKGYGHNGNMTYQRVPVMKNGQVERDNNGKPKDSDGLPYNVCSLYGGSNQPAFPSNYPNSIYHNCADVPAGFLGVTAAVWQQLINQNALPINYANLGSQTNYNLNASLNTQDLANSMLGTIQKTFVTSSVTDHYSSSASQSFRSPILGVNAKIGYQNYFNDFIGLAYYGIIKYNYSKALNQKFQQLSYGGGIDLLLDFITTYSNKNSPIDIQTRRNFSSSFGIFGGLRGLYNSYYVLNKVKGSGNLDVATGLNYRYKHSKYSVGISIPLIQRKASVVSSGSDYTNSFVFNEGSSHFKVFFNYGWVF

SEQ ID NO: 7771 - protein, 654 aa, Helicobacter pylori
MKKLFIPLLLFSALEANEKNGFFIEAGFETGLLEGTQTQEKRHTTTKNTYATYDYLPTDTILKRAANLFTNAEAISKLKFSSLSPVRVLYMYNGQLTIENFLPYNLNNVKLSFTDAQGNTIDLGVIETIPKHSKIVLPGEAFDSLKVDPYTLFLPKIEATSTSISDANTQRVFETLNKIKTNLVVNYRNENKFEGHQNHWEAFTPQTAEEFTNLMLNMIAVLDSQSWGDAILNAPFEFTNKGGGGECDTSKENECVNPGTNGLVNSKVDQQYVLNKQDIVNKFRNKADLDVVVLKDSGVVGLGSDITPSNNDDGKHYGQLGVGAFALDPKKLFGHDLKTINLEDLRTILHEFSHTKGYTHNGNMTYQRVPTGQNENGKPKDSDGLPYNVCSLYGGQGQSAFPSNYPNSIYHNCADVPAGFLGVTAAVWQQLINQNALPINYANLGSQTNYNLNASLNTQDLANSMLGTIQKTFVTSSVTNHYSSSASQSFRSPILGVNAKIGYQNYFNDFIGLAYYGIVKYNYSKALNQKFQQLSYGGGIDLLLDFITTYSNKNNPTGVQTRRNFSSSFGIFGGLRGLYNSYYVLNKVKGSGNLDVATGLNYRYKHSKYSVGISIPLIQRKASVVSSGGGYTNSFVFNEGASHFKVFFNYGWVF

SEQ ID NO: 7772 - protein, 661 aa, Helicobacter pylori
MKKLFIPLLLFSTLEANEKNGFFIEAGFETGLLEGAQTQEKRHTTTKNTYATYSYLPTDSVLKRAANLFTDAKSISQLNFSSLSPVKVLYIGGQLTIENFLPYNLSNVKLSFKDAQGNVIDLGVIETIPKHSKIVLPGEAFDSLKEAFDKIGPYTFFFPKFEATSTSISDTNTQRVFETLNKIKTNLIMKYSNENPSNFNTCPYNNNGNTKNDCWQNFTPQTAEEFTNLMLNMIAVLDSQSWGDAILNAPFEFTNSSTDCDNDPSKCVNPGVNGRVDTKVDQQYILNKQGIINNFRKKIEIDAVVLKNSGVVGLANGYGNDGEYGTLGVEAYALEPQKLFGNDLKTINLEDLRPIWHEFSHTKGYGHNGNMTYQRVPTGQNENGKPKDSDGLPYNVCSLYGGSNQPAFPSNYPNSIYHNCADVPAGFLGVTAAVWQQLINQNALPIDYANLSAQKNYNLNASLNTQDLANSMLGTIQKTFVTSSVTNHYFSSASQSFRSPILGVNAKIGYQNYFNDFIGLAYYGIVKYNYSKALNQKFQQLSYGGGIDLLLDFITTYSNKNSPIGVQTRRNFSSSFGIFGGLRGLYNSYYVLNKVKGSGNLDVATGLNYRYKHSKYSVGISIPLIQRKASVVSSGGDYTNSFVFNEGASHFKVFFNYGWVF

SEQ ID NO: 7773 - protein, 659 aa, Helicobacter pylori
MKKLFIPLLLFSALESNEKNGFFIEAGFETGLLEGAQTQEKRHTTTKNTYATYNYLPTDTILKRAANLFTNAEAISKLKFSSLSPVRVLYMYNGQLTIENFLPYNLSNVKLSFTDAQGNVIDLGVIETIPKHSKIVLPGEAFDSLKIDPYTLFLPKIEATSTSVSDANTQRVFETLNKIKTDLVVNYRNENKFKDHENHWEAFTPQTAEEFTNLMLNMIAVLDSQSWGDAILNAPFEFTNKGGGGECDTSKENECVNPGTNGLVNSQNKSYVLNKQDIVNKFRNKADLDVVILKDSGVVGLGSDITPSNNDDGKHYGQLGVVASALDPKKLFGNDLKTINLEDLRTILHEFSHTKGYTHNGNMTYQRVPVMKNGQVEKDNNGKPKDSDGLPYNVCSLYGGSNQPAFPSNYPNSIYHNCADVPAGFLGVTAAVWQQLINQNALPINYANLGSQTNYNLNASLNTQDLANSMLNTIQKTFVTSSVTNHYFSSASQSFRSPILGVNAKIGYQNYFNDFIGLAYYGIVKYNYSKALNQKFQQLSYGGGIDLLLDFITTYSNKNSPTGVQTRKNFSSSFGIFGGLRGLYNSYYVLNKVKGSGNLDVATGLNYRYKHSKYSVGISIPLIQRKASVVSSGSDYTNSFVFNEGASHFKVFFNYGWVF

SEQ ID NO: 7774 - protein, 661 aa, Helicobacter pylori
MRKLFIPLLLFSALEANEKDGFFIEAGFETGLLEGTQTQEKRHTTTKNTYATYSYLPTDSVLKRAANLFTDAKSISQLNFSSLSPVKVLYIGGQLTIENFLPYNLSNVKLSFTDAQGNAIDLGVIETIPKHSKIVLPGEAFDSLKEAFDKISPYTFFFPKFETTSTSISDTNTQRVFETLNKIKTNLIMKYSNENPNNFNTCPYNNNGNTKNDCWQNFTPQTAEEFTNLMLNMIAVLDSQSWGDAILNAPFEFTNSSTDCDNDPSKCVNPGVNGRVDTKVDQQYILNKQGIINNFRKKIEIDAVVLKNSGVVGLANGYGNDGEYGTLGVEAYALEPPKLFGNNLKTINLADLRTILHEFSHTKGYGHNGNMTYQRVPTGQTENGKPKDSDGLPYNVCSLYGGSNQPAFPSNYPNSIYHNCADVPAGFLGVTAAVWQQLINQNALPIDYANLSAQTNYNLNASLNTQDLANSMLSTIQKTFVTSSVTNHYFSSASQSFRSPILGVNAKIGYQNYFNDFIGLAYYGIVKYNYSKALNQKFQQLSYGGGIDLLLDFITTYSNKNSPIDIQTRRNFSSSFGIFGGLRGLYNSYYVLNKVKGSGNLDVATGLNYRYKHSKYSVGISIPLIQRKAKVVSSGSDYTNSFVFNEGASHFKVFFNYGWVF

SEQ ID NO: 7775 - protein, 661 aa, Helicobacter pylori
MRKLFIPLLLCSMLEANEKNGFFIEAGFETGLLEGAQTQEKRHTTTKNTYATYNYLPTDTILKRATNLFTDAKSISQLNFSSLSPVKVLYIGGKLTIENFLPYNLSNVKISFTDAQGNVINLGVIETIPKHSKIVLPGEAFDSLKKAFDKIDPYTFFLPKFEATSTSVSDANTQRVFETLNKIKTNLIMKYSSENPSNFNTCPYNNNGNTKNDCWQPFTPQTAEEFTNLILNMIAVLDSQSWGDAILNAPFEFTNSSTDCDNDPSKCVNPGINGRVDSKVDQQYVLNKQGIVNNFRKKIEIDAVVLKNSGVVGLANGYGNDGEYGTLGVEAYALEPTKLFGNNLKTINLADLRTILHEFSHTKGYGHNGNMTYQRVPTGQNENGKPKDSDGLPYNVCSLYGGQGQSAFPSNYPNSIYHNCADVPAGFLGVTAAVWQQLINQNALPINFANLGSQTNYNLNASLNTQDLANSMLSTIQKTFVTSSVTNHYFSSASQNFRSPILGVNAKIGYQNYFNDFIGLAYYGIIKYNYAKAANQKVQQLSYGGGIDLLVDFITTYSNKNSPIDIQTRRNFSSSFGIFGGLRGLYNSYYALNKVKGSGNLDVATGLNYRYKHSKYSVGISIPLIQRKASIVSSNGDYTNSFVFNEGASHFKVFFNYGWVF

SEQ ID NO: 7776 - protein, 668 aa, Helicobacter pylori
MRKLFIPLLLFSALEANEKNGFFIEAGFETGLLEGAQTQEKRHTTTKNTYATYNYLPTDTILKRVANLFTDAKSISQLNFSSLSPVKVLYIGGKLTIENFLPYNLNNVKLSFTDAQGNVIDLGVIETIPKHSKIVLPGEAFDSLKEAFDKIGPYTFFLPKLEATSTSVSDANTQRVFETLNKIKTNLIMKYSSENPSNFNTCPYNNNSNTKNDCWQPFTPQTAEEFTNLMLNMIAVLDSQSWGDAILNAPFEFTNKGGGGECDTSKENDCVNPGTNGLVNSQNQQYVLNKQDIVNKFRNKADLDVVILKDSGVVGLGSDITPSNNDDGKHYGQLGVVASALDPKKLFGNDLKTINLEDLGTILHEFSHTKGYGHNGNMTYQRVPTGQTENGKPKDSDGLPYNVCSLYGGSNQPAFPSNYPNSIYHNCADVPAGFLGVTAAVWQQLINQNALPIDYANLSAQTNYNLNASLNTQDLANSMLGTIQKTFVTSSVTNHYSSSASQSFRSPILGVNAKIGYQNYFNDFIGLAYYGIVKYNYSKALNQKFQQLSYGGGIDLLLDFITTYSNKNSPIDIQTRRNFSSSFGIFGGLRGLYNSYYVLNKVKGSGNLDVATGLNYRYKHSKYSVGISIPLIQRKASVVSSGSDYTNSFVFNEGASHFKVFFNYGWVF

SEQ ID NO: 7777 - protein, 653 aa, Helicobacter pylori
MRKLFIPLLLFSALEANEKNGFFIEAGFETGLLEGAQTQEKRHTTTKNTYATYDYLPTDSVLKRAANLFTNAEAISKLKFSSLSPVRVLYMYNGQLTIENFLPYNLNNVKLSFTDAQGNVIDLGVIETIPQHSKIVLPGEAFDSLKVDPYTLFLPKIEATSTSISDANTQRVFETLNKIKTNLVVNYRNENKFEGHQNHWEAFTPQTAEEFTNLMLNMIAVLDSQSWGDAILNAPFEFTNKGGGGECDTSKENDCVNPGTNGLVNSQNQQYVLNKQDIVNKFRNKADLDVVILKDSGVVGLGSDITPSNNDDGKHYGQLGVVASALDPKKLFGNDLKTINLEDLRTILHEFSHTKGYTHNGNMTYQRVPTGQNENGKPKDSDSLPYNVCSLYGGSTQSAFPSNYPNSIYHNCADVPAGFLGVTAAVWQQLINQNALPINYANLGSQTNYNLNASLNTQDLANSMLGTIQKTFVTSSVTNHYFSSASQSFRSPILGVNAKIGYQNYFNDFIGLAYYGIIKYNYSKALNQKFQQLSYGGGIDLLLDFITTYSNKNSPIDIQTRRNFSSSFGIFGGLRGLYNSYYVLNKVKGSGNLDVATGLNYRYKHSKYSVGISIPLIQRKASVVSSGSDYTNSFVFNEGASHFKVFFNYGWVF

SEQ ID NO: 7778 - protein, 661 aa, Helicobacter pylori
MRKLFIPLLLFSALEANEKNGFFIEAGFETGLLEGTQTQEKRHTTTKNTYATYNYLPTDSVLKRAANLFTDAKSISQLNFSSLSPVKVLYIGGQLTIENFLPYNLSNVKLSFKDAQGNVIDLGVIETIPKHSKIVLPGEAFDSLKEAFDKIDPYTFFLPKFEATSTSISDANTQRVFETLNNIKTNLIMKYSNKNPNNFNTCPYNNNGNTKNDCWQNFTPQTAEEFTNLMLNMIAVLDSQSWGDAILNAPFEFTNSSTDCDNDPSKCVNPGVNGRVDTKVDQQYILNKQGIINNFRKKIEIDAVVLKNSGVVGLANGYGNDGEYGTLGVEAYALEPKKLFGNDLKTINLADLRTILHEFSHTKGYTHNGNMTYQRVPTGQTENGKPKDSDGLPYNVCSLYGGSNQPAFPSNYPNSIYHNCADVPAGFLGVTAAVWQQLINQNALPIDYANLSAQTNYNLNASLNTQDLANSMLSTIQKTFVTSSVTNHYFSSASQSFRSPILGVNAKIGYQNYFNDFIGLAYYGIVKYNYSKALNQKFQQLSYGGGIDLLLDFITTYSNKNSPIGIQTRRNFSSSFGIFGGLRGLYNSYYVLNKVKGSGNLDVATGLNYRYKHSKYSVGISIPLIQRKASVVSSGSDYTNSFVFNEGASHFKVFFNYGWIF

SEQ ID NO: 7779 - protein, 670 aa, Helicobacter pylori
MRKLFFLIVAACLLVTDAIAQKKDTIAYGLNLDEVQIVARRIRHANEANAGAKVTHLEPELLQINKTRSFSELLTENSATYIKSLGTGALSTASFRGGSAAQTRVNWNGINITPPMSGVFDFSQFPVFFADNVNLYYGSSHVKSGTGAVGGSVNIFNDPEWGKGVTGKFFGEYGSYNTYTGGTQINVSGKRVVSKTRLFYQHSDNDYTYINKVLTNEAFREKRQDAKYSQWSAMQEGYFKLNPYAQLAAVGWIQQGKRMLPQPLGIVGKTHEQQNETNIRGYVGFDYVRGIHEFHVKGAWLYYRLKYDKWFDGGLFDPEGNINSSQTWQGVADYSCAPVDELVLNATLTYTHDLVNVSSYIDVDSAKYLIDDVYYNIPVPEPPLKHHRNVLSLQASANWTLLPWLQLHGQYMFEQNNSRNVSTWSAGFATNFFDKTFYVKGSMSYNYRFPSMNDLYWRPGGNPDVKPEDGYSYDAAIGYKNDLTSWMTLNAEASGYLMHIDNWILWLPKDGNQWIWTPQNKRNVLSMGAEFTGKMVLSFGDFKTTLSGNFSWARSRTRKKQHVDDNSYMQQIPYVPELKWNARLAFDYKKAFCSWQTTYIGKRYVTTDESYSTRPYTVHNLLVGYLWKLGNGMQLTSQVRVDNILNTYYESTQYYPMPLRNVLCSLMFEF

SEQ ID NO: 7780 - protein, 664 aa, Helicobacter pylori
MRKLFIPLLLFSALEANEKNGFFIEAGFETGLLEGTQTQEKRHTTTKNTYATYSYLPTDSVLKRATNLFTDAKSISQLNFSSLSPVKVLYIGGKLTIENFLPYNLSNVKLSFKDAQGNAIDLGVIETIPKHSKIVLPGEAFDSLKETFDKIDPYTFFLPKFEATSTSISDANTQRVFETLNNIKTNLIMKYSNENPSNFNTCPYNNNGNTKNDCWQNFTPQTAEEFTNLMLNMIAVLDSQSWGDAILNAPFEFTNKGGGGECDTSKENDCVNPGINGRVDTKVDQQYILNKQGIINNFRKKIEIDAVVLKNSGVVGLANGYGNDGEYGTLGVEAYALEPQKLFGNNLKTINLEDLRTILHEFSHTKGYTHNGNMTYQRVPTGQNNNGKPKDSDGLPYNVCSLYGGSNQPAFPSNYPNSIYHNCADVPAGFLGVTAAVWQQLINQNALPIDYANLSAQTNYNLNASLNTQDLANSMLSTIQKTFVTSSVTNHYFSSASQSFRSPILGVNAKIGYQNYFNDFIGLAYYGIVKYNYSKALNQKFQQLSYGGGIDLLLDFITTYSNKNSPIGVQTKRNFSSSFGIFGGLRGLYNSYYVLNKVKGSGNLDVATGLNYRYKHSKYSVGISIPLIQRKASVVSSGSDYTNSFVFNEGASHFKVFFNYGWVF

SEQ ID NO: 7781 - protein, 661 aa, Helicobacter pylori
MRKLFIPLLLFSALEANEKNGFFIEAGFETGLLEGTQTQEKRHTTTKNTYATYNYLPTDSVLKRAANLFTDAKSISQLNFSSLSPVKVLYIGGQLTIENFLPYNLSNVKLSFTDAQGNAIDLGVIETIPKHSKIVLPGEAFDSLKEAFDKIGPYTFFLPKFEATSTSISDANTQRVFETLNKIKTNLIMKYSNENPSNFNTCPYNNNGNTKNDCWQNFTPQTAEEFTNLMLNMIAVLDSQSWGDAILNAPFEFTNSSTDCDNDPSKCVNPGVNGRVDTKVDQQYILNKQGIINNFRKKIEIDAVVLKNSGVVGLANGYGNDGEYGTLGVEAYALEPQKLFGNDLKTINLADLRTILHEFSHTKGYTHNGNMTYQRVPTGQNENGKPKDSDGLPYNVCSLYGGQGQSAFPSNYPNSIYHNCADVPAGFLGVTAAVWQQLINQNALPINYANLGSQTNYNLNASLNTQDLANSMLGTIQKTFVTSSVTNHYSSSASQSFRSPILGVNAKIGYQNYFNDFIGLAYYGIIKYNYSKALNQKFQQLSYGGGIDLLLDFITTYSNKNNPTGIQTRKNFSSSFGIFGGLRGLYNSYYVLNKVKGSGNLDVATGLNYRYKHSKYSVGISIPLIQRKAKVVSTNGDYTNSFVFNEGASHFKVFFNYGWVF

SEQ ID NO: 7782 - protein, 665 aa, Helicobacter pylori
MRKLFIPLLLFNALEANEKNGFFIEAGFETGLLEGTQTQEKRHTTTKNTYATYNYLPTDSVLKRAANLFADAKSISQLKFSSLSPVRVVYMYNGQLTIENFLPYNLSDVQLSFKDAQGNVIDLGVIETIPKHSKIVLPGEAFDSLKIGPYTLFLPKIEATSTSISDANTQRVFETLNKIKTNLIMKYSNENPSNFNTCPYNNNGNTKNDCWQPFTPQTAEEFTNLMLNMIAVLDSQSWGDAILNAPFEFTNSPTDCDSDPSKCVNPGTNGLVNSQNKSYVLNKQDIVNKFRNKADLDVVVLKDSGVVGLGSDITPSNNDDGKHYGQLGVVASALDPKKLFGNDLKTINLADLRTILHEFSHTKGYTHNGNMTYQRVPVMKDGQVEKDNNGKPKDSDGLPYNVCSLYGGQGQSAFPSNYPNSIYHNCADVPAGFLGVTAAVWQQLINQNALPIDYANLNAQTNYNLNASLNTQDLANSMLGTIQKTFVTSSVTNHYFSSASQSFRSPILGVNAKIGYQNYFNDFIGLAYYGIIKYNYSKALNQKFQQLSYGGGIDLLLDFITTYSNKNSPIGVQRNFSSSFGIFGGLRGLYNSYYVLNKVKGSGNLDVATGLNYRYKHSKYSVGISIPLIQRKASVVSSGSDYTNSFVFNEGASHFKVFFNYGWVF

SEQ ID NO: 7783 - protein, 666 aa, Helicobacter pylori
MRKLFIPLLLFSALEANEKDGFFIEAGFETGLLEGTQTQEKRHTTTKNTYATYDYLPTDTILKRAANLFTNTEAISKLKFSSLSPVRVLYMYNGQLTIENFLPYNLNNVKLSFKDAQGNVIDLGVIETIPKHSKIVLPGEAFDSLKEAFDKIGPYTFFFPKFEATSTSISDANTQRVFETLNKIKTNLIMKYSNENPSNFNTCPYNNNGNTKNDCWQNFTPQTAEEFTNLMLNMIAVLDSQSWGDAILNAPFEFTNSSTDCDNDPSKCVNPGVNGRVNSQNKSYVLNKQDIVNKFRNKADLDVIVLKDSGVVGLGSDITPSNNDDGKHYGQLGVVASALEPPKLFGNDLKTINLEDLGTIWHEFSHTKGYGHNGNMTYQRVPTGQNENGKPKDSDGLPYNVCSLYGGSNQPAFPSNYPNSIYHNCADVPAGFLGVTAAVWQQLINQNALPIDYANLNAQKNYNLNASLNTQDLANSMLSTIQKTFVTSSVTNHYFSSASQSFRSPILGVNAKIGYQNYFNDFIGLAYYGIVKYNYSKALNQKVQQLSYGGGIDLLLDFITTYSNKNSPIGVQTKRNFSSSFGIFGGLRGLYNSYYVLNKVKGSGNLDVATGLNYRYKHSKYSVGISIPLIQRKASVVSSGSDYTNSFVFNEGASHFKVFFNYGWIF

SEQ ID NO: 7784 - protein, 661 aa, Helicobacter pylori
MRKLFIPLLLFSALEANEKNGFFIEAGFETGLLEGTQTQEKRHTTTKNTYATYNYLPADSVLKRAANLFTDAKSISQLTFSSLSPVKVLYISGKLTIENFLPYNLSNVKVSFTDAQGNAIDLGVIETIPKHSKIVLPGEAFDSLKEAFDKISPYTFFFPKFEATSTSISDTNTQRVFETLNKIKTNLIMKYSNENPNNFNTCPYNNNGNTKNDCWQNFTPQTAEEFTNLMLNMIAVLDSQSWGDAILNAPFEFTNSSTDCDNDPSKCVNPGINGRVDTKVDQQYILNKQGIINNFRKKIEIDAVVLKNSGVVGLANGYGNDGEYGTLGVEAYALEPPKLFGNNLKTINLEDLRPILHEFSHTKGYGHNGNMTYQRVPTGQNENGKPKDSDGLPYNVCSLYGGSNQPAFPSNYPNSIYHNCADVPAGFLGVTAAVWQQLINQNALPINYANLGSQTNYNLNASLNTQDLANSMLGTIQKTFVTSSVTNHYFSSASQSFRSPILGVNAKIGYQNYFNDFIGLAYYGIVKYNYSKALNQKVQQLSYGGGIDLLLDFITTYSNKNSPIGIQTKRNFSSSFGIFGGLRGLYNSYYVLNKVKGSGNLDVATGLNYRYKHSKYSVGISIPLIQRKASVVSSGSDYTNSFVFNEGASHFKVFFNYGWVF

SEQ ID NO: 7785 - protein, 661 aa, Helicobacter pylori
MRKLFIPLLLFSALEANEKNGFFIEAGFETGLLEGTQTQEKRHTTTKNTYATYDYLPTDTILKRATNLFTDAKSISQLTFSSLSPVKVLYVGGKLTIENFLPYNLSNVKLSFTDAQGNVIDLGVIETIPKHSKIVLPGEAFDSLKEAFDKIDPYTLFLPKFEATSTSISDTNTQRVFETLNNIKTNLIMKYSNENPNNFNTCPYNNNGNTKNDCWQNFTPQTAEEFTNLMLNMIAVLDSQSWGDAILNAPFEFTNSSTDCDSDPSKCVNPGVNGRVDTKVDQQYILNKQGIINNFRKKIEIDAVVLKNSGVVGLANGYGNDGEYGTLGVEAYALDPKKLFGNDLKTINLEDLRTILHEFSHTKGYTHNGNMTYQRVPTGQNENGKPKDSDGLPYNVCSLYGGQGQSAFPSNYPNSIYHNCADVPAGFLGVTAAVWQQLINQNALPINYANLSSQTNYNLNASLNTQDLANSMLSTIQKTFVTSSVTNHYFSSASQSFRSPILGVNAKIGYQNYFNDFIGLAYYGIVKYNYSKALNQKFQQLSYGGGIDLLLDFITTYSNKNNPTGVQTRKNFSSSFGIFGGLRGLYNSYYVLNKVKGSGNLDVATGLNYRYKHSKYSVGISIPLIQRKASVISSGSDYTNSFVFNEGASHFKVFFNYGWVF

SEQ ID NO: 7786 - protein, 652 aa, Helicobacter pylori
MRKLFIPLLLFSALEANEKNGFFIEAGFETGLLEGVQTQEKRHTTTKNTYATYNYLPTDAVLKRAANLFTNAEAISKLKFSSLSPVRVLYMLNGQLTIENFLPYNLSNVKLSFTDAQGNVIDLGVIETIPKHSKIVLPGEAFDSLKVDPYTLFLPKIKATSTSVSDANTQRVFETLNKIKTDLVVNYRNENKFKDHENHWEAFTPQTAEEFTNLMLNMIAVLDSQSWGDAILNAPFDFTNKGGEECDTNKENECVNPGTNGRVNSQNASYVLNKQDIVNKFRNKADLDVVVLKDSGVVGLGSDITPSNNDDGKHYGQLGVVASALDPKKLFGNNLKTINLEDLRTILHEFSHTKGYGHNGNMTYQRVPTGQNENGKPKDSDGLPYNVCSLYGGQGQSAFPSNYPNSIYHNCADVPAGFLGVTAAVWQQLINQNALPINFANLGSQTNYNLNASLNTQDLANSMLSTIQKTFVTSSVTNHYSSSASQNFRSPILGVNAKIGYQNYFNDFIGLAYYGIIKYNYAKASSEKVQQLSYGGGIDLLLDFITSYSNKNSPIDIQTRRNFSSSFGIFGGLRGLYNSYYALNKVKGSGNLDVATGLNYRYKHSKYSIGISIPLIQRKASIVSSDGDYTDSFVFNEGASHFKVFFNYGWVF

SEQ ID NO: 7787 - protein, 652 aa, Helicobacter pylori
MRKLFIPLLLFSALEANEKNGFFIEAGFETGLLEGTQTQEKRHTTTKNTYATYSYLPTDAVLKRAANLFTNAEAISKLKFSSLSPVRVLYMYNGQLTIENFLPYNLSNVKLSFTDAQGNTIDLGVIETIPKHSKIILPGEAFDSLKIDPYTLFLPKIEATSTSISDANTQRVFETLNKIKTDLVVNYRNENKFKDHENHWEAFTPQTAEEFTNLMLNMIAVLDSQSWGDAILNAPFEFTNKGGEECDTSKENDCVNPGVNGVVNSQNKSYVLNKQDIVNKFRNKADLDVIVLKDSGVVGLGSDITPSNNDDGKHYGQLGVVASALDPKKLFGNNLKTINLEDLRTILHEFSHTKGYTHNGNMTYQRVPTGQNENGKPKDSDGLPYNVCSLYGGSNQPAFPSNYPNSIYHNCADVPAGFLGVTAAVWQQLINQNALPIDYANLNAQTNYNLNASLNMQDLANSMLGTIQKTFVTSSVTNHYSSSASQSFRSPILGVNAKIGYQNYFNDFIGLAYYGIIKYNYAKAVNQKVQQLSYGGGIDLLVDFITTYSNKNSPIDIQTRRNFSSSFGIFGGLRGLYNSYYVLNKVKGSGNLDVATGLNYRYKHSKYSVGISIPLIQRKASVVSSGSDYTNSFVFNEGASHFKVFFNYGWVF

SEQ ID NO: 7788 - protein, 661 aa, Helicobacter pylori
MRKLFIPLLLFSALEANEKNGFFIEAGFETGLLEGTQTQEKRHTTTKNTYATYNYLPTDTILKRAANLFTDAKSISQLNFSSLSPVKVLYIGGKLTIENFLPYNLSNVKLSFTDAQGNVIDLGVIETIPQHSKIVLPGEAFDSLKEAFDKIGPYTFFLPKFEATSTSVSDANTQRVFETLNKIKTNLIMKYSNENPSNFNTCPYNNNGNTKNDCWQNFTPQTAEEFTNLMLNMIAVLDSQSWGDAILNAPFEFTNSSADCDNDPSKCVNPGVNGRVDTKVDQQYILNKQGIINNFRKKIEIDAVVLKNSGVVGLANGYGNDGEYGTLGVEAYALEPQKLFGNNLKTINLADLRTILHEFSHTKGYGHNGNMTYQRVPTGQNENGKPKDSDGLPYNVCSLYGGSNQSAFPSNYPNSIYHNCADVPAGFLGVTAAVWQQLINQNALPINYANLGSQTNYNLNASLNTQDLANSMLGTIQKTFVTSSVTNHYSSSASQSFRSPILGVNAKIGYQNYFNDFIGLAYYGIIKYNYSKALNQKFYQLSYGGGIDLLLDFITTYSNKNSPTGIQTRKNFSSSFGIFGGLRGLYNSYYVLNKVKGSGNLDVATGLNYRYKHSKYSVGISIPLIQRKASVVSSGSDYTNSFVFNEGASHFKVFFNYGWVF

SEQ ID NO: 7789 - protein, 201 aa, Wolbachia endosymbiont of Solenopsis saevissima
GPISDEETSYYIRLQYNGEVLPLFTKIEGIEYKKGTDSHNPLKASFIAGGAFGYKMDDIRVDVEGVYSQLSKNNVDGAALTPADAIADSLTAISGLVNVYYDIAIEDMPITPYIGGGVGAAYISTPLKTAVNGQNSKFGFAGQVKAGVSYDVTPEVKLYAGARYFGSYGANFDKSGGEKDKGGHTVLYSTVGAEAGVAFNF

SEQ ID NO: 7790 - protein, 201 aa, Wolbachia endosymbiont of Solenopsis saevissima
GPISDEETSYYIRLQYNGEILPLFTKVDGITYKKDNSDYSPLKASFLAGGGAFGYKMDDIRVDVEGVYSYLNKNNVTDARFTPDTIADSVTAISGLVNVYYDIAIEDMPITPYVGVGVGAAYISTPLKDAVNDQKSKFGFAGQVKAGVSYDVTPEVKLYAGARYFGSYGANFDKSVGEKDKGGHTVLYSTVGAEAGVAFNF

SEQ ID NO: 7791 - protein, 161 aa, Wolbachia endosymbiont of Ostrinia furnacalis
  misc_feature (97)..(97): Xaa can be any naturally occurring amino acid
EILPLFTKIEGIEYKKGTDSHNPLKASFIAGGGAFGYKMDDIRVDVEGVYSQLSKNNVDGAALTPADAIADSLTAISGLVNVYYDIAIEDMHITPYXGGGVGAAYISTPLKTAVNGQNSKFGFAGQVKAGVSYDVTPEVKLYAGARYFGSYGANFDKSGGE

SEQ ID NO: 7792 - protein, 200 aa, Wolbachia endosymbiont of Ostrinia furnacalis
GPISDEETSYYVRLQYNGEVLPFKTRIDGIEYKKGTEVHDPLKASFMAGGAAFGYKMDDIRVDVEGLYSQLNKNDVSGATFTPTTVANSVAAFSGLVNVYYDIAIEDMPITPYVGVGVGAAYISNPSEASAVKDQKGFGFAYQAKAGVSYDVTPEIKLFAGARYFGSYGASFNKEAVSATKEINVLYSAVGAEAGVAFNF

SEQ ID NO: 7793 - protein, 344 aa, Aeromonas hydrophila
MMKMAPSLIAIAMAAMGATAAHAADDIYFGAGAGAAHFNGLNKIGGGGYAGTEDAAAANAFVGYNFTENFGTEFGYQYAGRGNTDGLRYENQGATLSGIARLPLGGDFSAFAEGGAYWAHTDGLGTSDTKVSPLAGLGVTYKVNDALDLQARYRYMWDVADLHAGDAPDDVRYKSNQSVATLEAVYHPFRTSYVAPAPAPVVEEAPAPAPQVVEKNFALNSDVLFAFGKDSLKPEGVAALNGLYQQIVEFQPKDGNAVVVGYTDRIGSDAYNQKLSEARARTVANFLVSKGMAASKVAVEGRGEANPVTGTKCNGVKAKTQLISCLAPDRRVEVRVSGVQEVQK

SEQ ID NO: 7794 - protein, 1533 aa, Chlamydophila abortus
MIEKKVSRFQKSTFSHSVVLAILVSTGMITNNDKLYGYVPASEVILDTLSMPKAELEVPSAGIFKKEKPIHAQGPKKGETDQETSLLDNTSTCVYKVLVAEDEQRQHLENTSTIFQTCNVLSWENLDTRSTNAEAEKGKTSPQYAVEDLQQGLAFCYKNAPEHLLDANTPGFLGIALKGTRMKSGLSFTNLKSTAAGAAVYSEEDVLFESFKEKLVFDGCESQAGGGAVSGRSIAIHGCHALTIANSKTDVELKPTSGESSDFSLGGGAFNANQVHPVHKSRFASGDVVFLDNQGSVLLSGNHADKANGGAVACGNFICSVNHSDIHYLDNYALSGGAVSSSKSMDFCGNLGSIEFLNNQALASSEGSLFLGGGALAAGERISFLNNHGILCSKNTAKCRGGALLSREVRIVENVGSSLFKENTAEVTGGAISSQHQVEIDQNFGNVTFEGNTSKFGGGAIYCLLPAQPDTDAQEPRIGSGDIKIVDNVGEVHFTSNANLLDSQETHSYLGGGALYGSNVLISGNIGVITFSKNQAGQCESSSTHIGGGAIFAHEVVTLSGNSGEVTFSYNKGQILPLPLSPTPAEESSTSNAPIESSTPVNLGVRGGGAIFAKSISVEDNSAFVSFSENSMEIRDNQAQKENPLGGGALFGLDSVGLKNNVDLAFSNNRVSGGNSSGGAILSKEVAIAHNGKVQFTRNCAKFLGGAVCALGDTLRIENNESTVSFVGNRTIAAGGALASAAGAVSISQNLGKVEFKDNFVFGDPYIENLEKGQINSEGHHSGGGAIFAKTSVVIRGNDNKVLFSGNSAGCFGGAILTGSLTSTESQERFAAKVESDNTKVVITENTGDVIFSGNSTTASKHPEHNLFGGGAIHTQDLIIKNNEGSVAFYNNYAPTGGAVRISEKGSVVLQALGGDIVFQGNRNSEDVSNGMYFSGKESKLVEVSAAGETSVIFSDAIVFEDLTLRKGTKDHEDALNDPTLIFNSKAKDDAEITHSGNVRFSHATSKIPQVALLESGTLMLSNKAQLWLCGLKQEKGSEILLSAGTVLRIFDPNAKPTEKIESPTSNVYYSAHESVKQPENKTLADINSIGIDLASFVSSDDETPVPPQIIVPKGMTIGSGSLDLNLLDSVGAGYENHALLGKETDITLLSFKSASSVLDTPDLDHALEELRVKVSVPTITEDTYGHMGRWSDPQVVDGKLMINWKPTSYKLNPEKSGAIVLNSLWGHCGDLRSLKQQQLAHNITAQRMELDFSTNIWGSGMGTFTNCATIGKVDGFTHRAGGYALGLDTQLIEDFLIGGSFAQFFGYTDSQSYSSRSDQSGYLGSGYLGIFTGSWLFKGMLIYSNMHNDLNTQYPQPNLGGSKGSWDSRGILADAHVDYRYIVNSRRLISSIVSAVVPFVEAEYVYVNFPKFTEIGSEARTFDEGHLQNVAIPFGVTLEHNYSRGQRSEVNSVSFSYAIDVYRQEPNVLIHLPEASYSWNGVGSNLARKSMKAQFSNDTEWNSYFSTFLGFTYEWREHTIAYDLNCGMRLIF

SEQ ID NO: 7795 - protein, 684 aa, Yersinia pestis biovar Orientalis str. IP275
MCCFHLIIMKKIDVYHENFPLENSIRLDRIFFILAKESAMKLNLITSALLFSTIHSSFAVEPIKTELTPIEVYSAYAIPVNQDQTASSLTVLTEKDFAGRNAAYVSDVLKTVPGVAFGINGGRGATTSLFLRGADSNHTTVIIDGVRMNPINGNGFDFGGLALSNIERIEVLRGEQSALWGSNAMGGVIYITTKSGLYKEKPFNVDFDLGTGSRNTRDASATISGYNKGFYYALHGDSHRTKGISALSSNRFNYTALDGTKVTTGGAGEQDGFHRDNASIRLGYDDANKGLELLAQHSSQSAHYDNSLAEERLFNDYMRTRETLFKLAGYWGSEHELFKHSLSASHLKTDNDTFSLWASAYDAKRLNTNYQLDINFDRDGATTQSFSILGEYQKSKYDSTSYTDEKALNEKSIAAEYRLFHENGHSLSLSGRYTDNSKYDDTFTGRIAGAYRLSPNLKTHASFASAVQNPTFIEYFGYYGSYAANEGLKAERSRGGDIGLLIESTDKHHSLDITYFARNVDNFISSELVDPVYYIYRSINLEGTTKIRGVEIAYNGQLTDNLTAYANYTFTRSKDSQGDSLVRRPKHQANAGLNYQITEKFGSNVNIAYVGKRIDNYYEETYPYAVHAVNMPSYTLLNLGVNYQLTSNINIYANLNNLFDKKYENILGYGQDGRNVYVGLKGSF

SEQ ID NO: 7796 - protein, 205 aa, Yersinia pestis biovar Orientalis str. IP275
MVSFASYTKNGNGIVTLRNKIFIILAFIFGQLSFACVAGANDNVSEKGWFSTFKDNVAQTWNEPEHYDLYIPAITWHARFAYDKEKTDRYNERPWGAGFGQSRWDEKGNWHGLYLMAFKDSYNKWEPIGGYGWEKTWRPLSDDNFRLGLGYTAGFTARDNWKYIPVPVLLPLASIGYGPATFQMTYIPGTYNNGNVYFAWMRFQF

SEQ ID NO: 7797 - protein, 310 aa, Yersinia pestis biovar Orientalis str. IP275
MLDANKLQQAVDQAYTQFHSLNGGQNADYIPFLANVPGQLAAVAIVTCDGNVYSAGDSDYRFALESISKVCTLALALEDVGPQAVQDKIGADPTGLPFNSVIALELHGGKPLSPLVNAGAIATTSLINAENVEQRWQRILHIQQQLAGEQVALSDEVNQSEQTTNFHNRAIAWLLYSAGYLYCDAMEACDVYTRQCSTLLNTIELATLGATLAAGGVNPLTHKRVLQADNVPYILAEMMMEGLYGRSGDWAYRVGLPGKSGVGGGILAVVPGVMGIAAFSPPLDEDGNSVRGQKMVASVAKQLGYNVFKG

SEQ ID NO: 7798 - protein, 794 aa, Yersinia pestis biovar Orientalis str. IP275
MIGVAAVMLIPDSADAQPVSGGEDLPQVRVTAPKRQAKKRTTHRTPVHTAPAPAVTAAPSNVRVNPIVGDAHGVTGYQAPAQAGMARLGVPLANTPQTVNVVTQQVIQDQRLLTMEDALRTVPGITFGAGEGGNQGDTPIIRGFAARGDMFRDGLRDPGWYTRDMFSSDRVEVYKGPSGFAFGRGSTGGAINTVSKLPQATTFVNGTVSGVSSGGYRADVDANGTRGNLSGRLAAMYQDIPVQDRNHIFARRWGVAPSVKAEFTPDTRGIFSYVYQGEDGVPDYGHRYLPAPVYSSATGAMTNPGYFGNGAATPPMPVPRQVFYGVTGGPLADRQLTNTHIATARFEHDFSDTLKISNATRYVSVNRMARPTAPRGEAQADNVSPITPGYPVELMTIGRQHFETLTDNTLLINQTDLTGKFWTGGLEHTFTLGAVASQQTRDQMRANYCVPGNLACRTNAFAPVDTAYGGPNNGFLLPNRTVSTDYGVYGFDQVKFNEYFELLGSIRYDDFRTTYTNLAVVPPASQQLNRVDQMVAWRVGGVFHPTHNSSVYAAYGVSNNPAAEFDVLSAAGNNAANSTLAPERNTTAEVGAKADVLNGRLTLSGAVFRIEKTNLRIPIDPASNTALVLGGLARVDGVEVGAAGKLTDKWGLFAGYSYLHSQIVNTTDLAQLGNQLPQTPPHNFTLWTTYELTPLWTVGGGATYAARTFSNIQNTNYVPNYWKLDLMTSYRVTKDSMLQLNIYNLTDELYYAQYYAGHAVPAAGRTAMLTYRYSFVPPPPVPDYPVKAERYVSK

SEQ ID NO: 7799 - protein, 1256 aa, Yersinia pestis biovar Orientalis str. IP275
MFMPFREFISSHVGRHPLFNRAPVAVINPITLAIIVAFSTLALPQTARASCNNSGGSTYICEGENNAGIILSGTDITVETQLGFGIIEPGDIDPALSLIGSGAISYLDTNSSALDTAGAYSLSIQNDTSMIGQSTSTNVQANGSIGSGIYISSQSRDNSTIQVDLSGMLSSGLNGTPALSIDSLADNDSTIILNIHAISGIAGIQSDNNSRYGTAITNVDIANDINVEYSGASIQNYSNSGTSILNLNSKSISTDFDALDINNSNYSGEVMTDINIDGDISSANSQAARIYNHTNSGLSSLRFRANNVTGEYAGLYIDNSSQNGAVTDIILTGDLTATSGSALYANTYSEEGNVETAIKLNNVYSLYDALNIYGYNQTGNTLFDLDVSGTVTSENGTGIKVMGTTFEGNSTILINVNNITSSSQSLDINNYNSSGSALSAITATGHLAAEWGQGVTFQTYSSLGDATTLIHVNDITSMGNGIYSLTEASRGTVTTDVTVTGQINVSDGEGITLNTQTIDGNTLVNIDVNNIASEYDAIHLYNNNNTTGVDNGTGVDNGTSTIDLITRGALVSQQGYGINLETNTADTYVTVGGLVHGGNGSAIGIHRLDNIQTSATLELQSGYALEGATQSLVFTGNYVDINDAALDLANSHLVLGGAGDAAFDLTRIDNREEAILDGDPNRITGFGTLTKTNNSIWTLTGANMADGDANAFLSANIAGGILVLDNATLGLTPATTILNRLSAADIAADPTLVATETGALTLAEGGALSSLGDSVLSGNLISAGGILLSNHYTGGNGAATDDRLTVTGTYFGENNGSGEGAWLALDTVLGDDDSATDRLVINGDATGTTSVRVNNAGGLGDKTLNGINLITVDGLAQDDTFLLAGDYVTTDGYQAVVAGAYAYTLQADGEAATAGRNWYLSSELMLTEGVRYQVGVPLYEQYPQVLAALNTLPTLQQRVGNRYGAPGALADLNFDDNQWAWGRIEGSHQVTDPARSTSGSQREIDVWKLQTGIDVPLYQSQGGSLLTGGVNFTYGKAKADIHSFFGDGRINSAGYGLGTSLTWYGNNGVYVDGQLQTMWFDSDLSSRTAGHAVASGNNGRGYTSAIEAGKGYALGNGLSLTPQMQVTYSRVDFDTFRDPFDSEVSLQEGDSLRGRIGVSLDKETTWSAKDGTTRRSHIYSHLDLHNEFLNGSKVQVSGVEFATRDERQSVGLGAGGTYEWQNGRYAVYGNVNLLGATRNVSDNYAVGGTIGARVSW

SEQ ID NO: 7800 - protein, 360 aa, Yersinia pestis biovar Orientalis str. IP275
MKNIAMALAATLGIIPALSSAAEIYNKDGNKLDFYGRVAAKYLFKKQSNEDATYVRIGFKGETKINSQLTGFGQWEYNIAANNTESQGDKGNKTRLGFAGLKLADYGSFDYGRNYGVVYDVLSYTDMLPEFGGDSMAATDNYMTARSTGLATYRNDNFFGLVEGLKVAAQYQGRNEDGDVTRNERSIQKANGDGFGLSFNYQNIQGSGVSFAGAYSSSNRTEGQKELVNSAAGDKAQAWATGLKYDANQAYIAAMYGETLNMTPYKRLIANKTQNVELVAQYQFENGIRPSLAYIQSKGKDLAGVGDTDLVKYAEIGVTYHFNKNMYTYVDYKINLLDNDKNPLGLNTDDVVAVNLTYRF

SEQ ID NO: 7801 - protein, 312 aa, Yersinia pestis biovar Orientalis str. IP275
MKKSSIVATIITILSGSANAASSQLIPNISPDSFTVAASTGMLSGKSHEMLYDAETGRKISQLDWKIKNVAILKGDISWDPYSFLTLNARGWTSLASGSGNMDDYDWMNENQSEWTDHSSHPATNVNHANEYDLNVKGWLLQDENYKAGITAGYQETRFSWTATGGSYSYNNGAYTGNFPKGVRVIGYNQRFSMPYIGLAGQYRINDFELNALFKFSDWVRAHDNDEHYMRDLTFREKTSGSRYYGTVINAGYYVTPNAKVFAEFTYSKYDEGKGGTQIIDKNSGDSVSIGGDAAGISNKNYTVTAGLQYRF

SEQ ID NO: 7802 - protein, 84 aa, Sphingopyxis macrogoltabida
MAGVAYSRVSTFSGDYLRVTDNKGKTHDVLTGSDDGRHSNTSLAWGAGVQFNPTESVAIDIAYEGSGSGDWRTDGFIVGVGYKF

SEQ ID NO: 7803 - protein, 178 aa, Halomonas sp. 40
MKKTLLASSLIACLSIASVNVYAASESSISIGYAQSHVKENGYTLDNDPKGFNLKYRYELDDNWGVIGSFAYTHQGYDFFYGSNKFGHGDVDYYSVTMGPSFRINEYVSLYGLLGAAHGKVKASVFDESISASKTSMAYGAGVQFNPLPNFVIDASYEYSKLDSIKVGTWMLGAGYRF

SEQ ID NO: 7804 - protein, 196 aa, Wolbachia pipientis
SYYVRLQYNGEFLPLFTKVDGITYKKDKSDYSPLKPSFIAGGGAFGYKMDDIRVDVEGVYSYLNKNDVKDVTFDPANTIADSVTAISGLVNVYYDIAIEDMPITPYIGVGVGAAYISTPLEPAVNDQKSKFGFAGQVKAGVSYDVTPEVKLYAGARYFGSYGAHFDGEKVDPRDANKKVADKGAYKVLYSTVGAEA

SEQ ID NO: 7805 - protein, 199 aa, Escherichia coli O26:H11
MRKLYAAILSAAICLAVSGAPAWASEHQSTLSAGYLHVSTNVPGSDELNGINVKYRYEFTDTLGMVTSFSYAGDKNRQLTRYSDTRWHEDSVRNRWFSVMAGPSVRVNEWFSAYAMAGVAYSRVSTFSGDYLRVTDNKGKTHDVLTGSDDGRHSNTSLAWGAGVQFNPTESVAIDIAYEGSGSGDWRTDGFIVGVGYKF

SEQ ID NO: 7806 - protein, 199 aa, Escherichia coli O111:H-
MRKLYAAILSAAICLAVSGAPAWASEHQSTLSAGYLHVSTNVPGSDELNGINVKYRYEFTDTLGMVTSFSYAGDRNRQLTHYSDTRWHEDSVRNRWFSVMAGPSVRVNEWFSAYAMAGVAYSRVSTFSGDYLRVTDNKGKTHDVLTGSDDGRHSNTSLAWGAGVQFNPTESVAIDIAYEGSGSGDWRTDGFIVGVGYKF

SEQ ID NO: 7807 - protein, 199 aa, Escherichia coli O103:H2
MRKLYAAILSAAICLAVSGAPAWASEHQSTLSAGYLHASTNVSGSDDLNGINVKYRYEFTDTLGLVTSFSYAGDKNRQLTRYSDTRWHEDSVRNRWFSVMAGPSVRVNEWFSAYAMAGVAYSRVSTFSGDYLSVTDNKGKTHDVLTGSDDGRHSNTSLAWGAGVPFNPTESVAIDVAYEGSGSGDWRTDGFIVGVGYKF

SEQ ID NO: 7808 - protein, 441 aa, Yersinia pestis biovar Orientalis str. F1991016
MLAAMAPAVSAADIPAWNGSALGFEAGQQGLLGDMLGIRPILEENGFHYNLGYLNEMAYNAGGGYNHDKHLAYIDQVSLTFTQDLERWTGIPDARLEGNIVNRNHDDNLTTKRLQDPRVSFNDLSQESWGGGSITRLGWLTFARSFDDRRLTWRIGMMNKVQTFDQIIPCDFQLLTQCGGKSANSLTWNNWNIHTWGTTLEYKLTPTVTLKGGVMEQNPQATARSHAWSWSTKGSKGILLPMEIETRPLINGLPGAYNLGVVWTNAPQSDLYSGKSGGAGATDPQGYAEHDSTWFMYAGLNQQITRHADDPLRGMSVSLSGSLSDQRSNYIHSAVAASMRYRGLFDARPEDWIGFGLTWIDMSSHYARNQRYMNQISGATDYNDPAYQPVAGHSLNGELYYRFRPVSWLELQPGLQYWHRPGGVAQTQDAWVVEWKTVVTF

SEQ ID NO: 7809 - protein, 1259 aa, Yersinia pestis biovar Orientalis str. F1991016
MPFRAFISSHAGRHPLFNCAPVAVINPITLAIIVAFSTLTLPQTARATCTSSGVGTYVCEGENNAGISLNGTDIAVETLPGFGITEPGDIDPALSLIGSGAISYLDTNSSVLDTAGAYSLFIQNDTSMIGQSTSTNVQANGSIGSGVYINNQSSDDSTIRVDLSGMLSSGLNGTPALAIYSLADNDSTITLNIHAISGIAGIQSDNNSLYGTAITNVDIANDINVEYSGASIRNYSNSGTSILNFNSKSIRTDLDALDINNSSYSGEVMTDINIDGDISSANSQAARIYNYTNGGLSSLRFRANNVTGEYAGLYIDNSSQNGAVTDIILTGDLTATSGSALHANTFSEEGNIETAIKLNNVYSLYNALNINGHNQTGNILLDLDVSGTITSENGTGIKVMGTTFEGNSTILINVNNITSSSQSLDINNYSSSGSALSAITATGHLATEWGQGVTFQTYSSLGDATTLIHVNDITSMGNGIYSLTEASRGTATTDVTVTGQINVSDGEGITLNMQTIDGNTLVNIDVNNIASEYDAIHLYNNNYTTGVDDGTGVDNGTSTIDLITRGALVSQQGYGINIETNTADTYVTVGGLVHGGNGTAIGLHRLENVQTSATLELQSGYALEGATQSLVFTGNYVDINDAALDLANSHLVLGGAGDAAFDLGRIDNREEAILDGDPNRITGFGTLTKTNNSIWTLTGTNMADGDTNAFLSANIAGGILVLDNATLGLTPTAGALTGPTVNRLSAADIAADPTLVATETGALTLSEGGALSSLGDSVLSGNLISAGGILLSNTYTGGNGAATDDRLTVTGTYLGENNGSGEGAWLALDTVLGDDDSATDRLVINGDATGTTSVRVNNAGGLGDKTLNGINLITVDGLAQDDTFLLAGDYVTTDGYQAVVAGAYAYTLQADGEAATAGRNWYLSSELMLTEGVRYQVGVPLYEQYPQVLAALNTLPTLQQRVGNRYGAPGALADLNFDDNQWAWGRIEGSHQVTDPARSTSGSQREIDVWKLQTGIDVPLYQSQGGSLLTGGVNFTYGKAKADIHSFFGDGRINSAGYGLGTSLTWYGNNGVYVDGQLQTMWFDSDLSSRTAGHAVASGNNGRGYTSAIEAGKGYALGNGLSLTPQMQVTYSRVDFDTFRDPFDSEVSLQEGDSLRGRLGVSLDKETTWSAKDGTTRRSHIYSHLDLHNEFLNGSKVQVSGVEFATRDERQSVGLGAGGTYEWQNGRYAVYGNVNLLGATRNVSDNYAVGGTIGARVSW

SEQ ID NO: 7810 - protein, 751 aa, Chlamydophila abortus
MASFPSRTMTVNRTTAAPARRRRAKVGLGVGLGVTLFAAQAAVAQGDTPAPGAEAAGNATLPAITVSGERGQSLRAREASVAGLDDAPLRDTPASVNVITRALIDDQQAKRLSDVVRNDASVVNDYAPVGYFEGFAIRGFPVDLASAIRIDGLTVSGEQNVPLENKERVEILKGLAGIDSGVVAPGGVINFVTKRSANVASVTGGVDSRGSTSAAVDLGRRFGSDHQFGFRINAAKENMHSYIDGTNGRRTFGSIAADWDISPRASLQLNAEFQQWIQRSAPGYQLLGGTVVPSVKTTSKALGTQPWAKPVTTDALNLNARFDYQFNDDWKAYIAAGRSRTMIDDNSAFAYGCSYAASCAAGATSPFFFGANGDYDVYDFRSPGEYRRNDDLRVVTTGKFATGPLRHELTLGVSVQRRVVHMADAVYDYVGSENIYGPDLTFPPSPNSPGPSYPRLDAWQYGVFGLDRISIGEHWQVLAGGKEVLLRQRSWSSLDGETTHTDRSVFLPQVALVYKPVSVLSLYASYSKALSLGDQAPVRATNAYAFLPPVESHQIEVGAKYDWLDRLSLTAAVFSISKPFQFADPDASGTSYTFVQRGTQRHQGIELGAAGRVTERLGLTASVAAIRARAYDSGSPAYEGHQIINVPALRASLYADYAVPGVAGLNVLGGVEYSAARNANEEGTARVPSWFVFNLGARYTTKIGGHRTVLRVSVDNLFNKFYWRDAGEQQGDAYLFPGAPRTARVSLTYDF

SEQ ID NO: 7811 - protein, 1008 aa, Chlamydophila caviae
MASFAPSFFSRGCLLALATTGGFSAVVNAASPWRVVDGSTLDVTHGYTGTTAGDYPLFSSGDGSLLQTSLTGLSFSTTGNSLYAANIRAGGSARLDGTLLTTNGIQAHAVNVDGGNLVMNSGNITVAGSYSAGVFGRNGAQLSLNNLEISANGPRSGGVTLTDGTLTMSHSTIVATDANRKGISLTSSNAEFAHATLENVNIFLRGTGVQAALEVSNGRVEGNAVNISTNGENRGVEIYNSDGGRGSVLLNNSNISTQKGDGIYILNGQVMLDNTTVNTQGGMAVNLNVAAQASIRGGSFTTQSNYRDALWIATADSSADVTGATFTTHGVGSHAFNAHFGPATLTDSSLNTSGTGGYGLYSESRVQGNNLHITTLGRRSIGVFAARGGIINLDNARIETADSDSSGLLVYPGSVINGNGLSVTTAGQDSHALWALTGTLNISNSTLTTQGNAAGLYIRNTSSGGVSNVVLDNVMLSSGLGPAIKTNGAALKLTIKNGSQLTAGNGVLLENLAGSGVDPNDSRVVDLIADNRVVLNGDIRSAVENPVDVALSRATLLNGAVNGVNRLNLSDSSRWTVTHDSTLRALNNDGQVVFRHADGAFQTLSLDSLSGNGAFVMNTDLAALTGDLITVSGEANGEHLLMIKNSGREPDITDSALTLVTTGSGKSHFALNNGAVDAGTYQYELQQRDNDWVLAQKYDAEEKPVVTPVTHTALGLFNATPTLWYGELTGLRTRMGEVRQGKQRGGAWVRTLGSRYQVNDRAGLGYRQTQSGISVGVDNARDTNNGQWLTGLFSGVSRNALDFSQGSTGTINSFFIGGYNTWLLESGWFVDALLKANNFSSHADVRMTDGEKTRGGYNTPGFGLSLEVGRQFVLDSGWFVEPSLQLATLWVKGQSYTFDNGLQATSGVAKSQQAILNGVLGRTLPLENGMTLQPWLRMAAIQEFVNSNPVSINGNGFNNDLSGTRGEYGMGLSLQLTPDVQMYTDARYSKGDKIESPWGANLGVRWSW

SEQ ID NO: 7812 - protein, 402 aa, Chlamydophila felis
MAFSQAVSGLNAAATNLDVIGNNIANSATYGFKSGTASFADMFAGSKVGLGVKVAGITQDFTDGTTTNTGRGLDVAISQNGFFRLVDSNGSVFYSRNGQFKLDENRNLVNMQGLQLTGYPATGTPPTIQQGANPTNISIPNTLMAAKTTTTASMQINLNSSDPLPTVTPFSASNADSYNKKGSVTVFDSQGNAHDMSVYFVKTGDNNWQVYTQDSSDPNSIAKTATTLEFNANGTLVDGAMANNIATGAINGAEPATFSLSFLNSMQQNTGANNIVATTQNGYKPGDLVSYQINDDGTVVGNYSNEQTQLLGQIVLANFANNEGLASEGDNVWSATQSSGVALLGTAGTGNFGTLTNGALEASNVDLSKELVNMIVAQRNYQSNAQTIKTQDQILNTLVNLR

SEQ ID NO: 7813 - protein, 345 aa, Chlamydia muridarum
MNGIHTRRALGRACLGGALALASAAADATVTLYGRIDTDIEYQKGPDGGATQMTDNASRWGLRGSEELGGGLRAAFGLEQGFGADNGVATTPQFRNAFVGLQGGFGAIALGRLDSATIVGSPIYSQVTQNIDFAIHDAGATAIGTRVLNARNRVSNALGYMTPSFGGFSLRARMNLGGPDPATPNTRSPVQAEDDFRQFDLGLNYSAGKFAAGLGYSRDAKSGGLVANDFRDKVQAVASYDFTVINLYGIVGRDRYAGTATTRTDVPYWLVGFSVPYGAHKVTVNYMQRAVQRDPQGRLSKVQASYGYSLSKRTMPYVFFDREDPNSHKSGDTVTTVGVGIQHKF

SEQ ID NO: 7814 - protein, 354 aa, Chlamydia pneumoniae
MISERPRLIGILEMQCANRRTRRIWQRAAPLAGALLLAMMQHAAHGQELLLMGGAHTNPPIHGDDDGSAVYAYSYQQNLTDNWYATYTYLNEGHVSGHHRDGHSAQLWWRWLTPGRQFALSVGAGPYLFFDTTEAQDDGSYRNHHGLALQASAAATWYVNGGPWMVQARYNRTRAWSSFSSNTALLGVGYQLDHGRRDGPFIAGTRITALTGDELTVFLGARIVNSFESETGFAAAVEYRHGFWRGVEGTISYFSESSSDLVQRRGVAAQAWLNGGFFDDRLTLGVGAGPYYATTLHVRGPDAEISPSRWSALLTLSASYRLSDHWLGRLSWNRVITGYDRDADLFLAGVGYRF

SEQ ID NO: 7815 - protein, 701 aa, Chlamydia trachomatis
MPYSPPRPLLRGALPRALLAATALALPGSALAQQVPAAASAVELPTISVQAAPGGSLTVPSESQARANIELTPGGAEVVGAMTWDDTQAKTIKDMLDFVPGVFAQPKWGEDTRLSIRGSGISRSAHLRGIQLFQDGVPLSSVDGGGDFQEIDPTAFQYVEVFKGANGYQFGANALGGAINFVTPTGRTASPFEARFDIGSFGFYRLQASSGGAQGAFDGFVTGSWLTQEGFRDHSAGENTRGSANFGIQLNESLETRFYLNATNVNQQIPGAVSKTVALNSPQTANPTNVLLNYQRNIESVRLANKTTALLSDTTKLEAGVFYTNKDLNHPIFQVLNYNYEEYGAFTRLVDERSIGGFNNRLVLGINYGTGTTDAKRYNNVAGIAGALAYWSNDSATTTTYYFEDHFYLAPNFAFVGAGQFLTASLDRTAFYKAVSGGNDYNLFLPKGGFVYEMAPGAQVFGNVSRSGEIPTFSELTDFGSVVIGNLKAQTATTVEIGTRGRQPTYSWDVSLYRSWVQNELQCQDPGNTQGLTCTVVNLGSTIHQGLELGFGVQVLKDLFTPGPITDSIWLNVAYTYSDFYFDNDPVWGNNRLPGIPPHYLRAELLYKHPSGFYAGPNVEWVPVAYYVDDANTLDTSPYALLNFRTGYDNGKGPAVYLDARNLLNVNYIASVSVTGRASPNQALFEPGNGRSVVVGTRFKF

SEQ ID NO: 7816 - protein, 442 aa, Chlamydia trachomatis
MQAAHHHYHRYTDKLHRQNHKKDLISPKPTEQEACNTSSLSKELIPLSEQRGLLSPICDFISERPCLHGVSVRNLKQALKNSAGTQIALDWSILPQWFNPRVSHAPKLSIRDFGYSAHQTVTEATPPCWQNCFNPSAAVTIYDSSYGKGVFQISYTLVRYWRENAATAGDAMMLAGSINDYPSRQNIFSQFTFSQNFPNERVSLTIGQYSLYAIDGTLYNNDQQLGFISYALSQNPTATYSSGSLGAYLQVAPTASTSLQIGFQDAYNISGSSIKWSNLTKNRYNFHGFASWAPRCCLGSGQYSVLLYVTRQVPEQMEQTMGWSVNASQHISSKLYVFGRYSGVTGHVFPINRTYSFGMASANLFNRNPQDLFGIACAFNNVHLSASPNTKRKYETVIEGFATIGCGPYLSFAPDFQLYLYPALRPNKQSARVYSVRANLAI

SEQ ID NO: 7817 - protein, 442 aa, Chlamydia trachomatis
MQAAHHHYHRYTDKLHRQNHKKDLISPKPTEQEACNTPSLSKELIPLSEQRGLLSPIYDFISERLCLHGVSVRNLKQALKNSAGTQIALDWSILPQWFNPRVSHAPKLSIRDFGYSAHQTVTEATPPCWQNCFNPSAAVTIYDSSYGKGVFQISYTLVHYWRENAATAGDAMMLAGSINDYPSRQNIFSQFTFSQNFPNERVSLTIGQYSLYAIDGTLYNNDQQLGFISYALSQNPTATYSSGSLGAYLQVAPTASTSLQIGFQDAYNISGSSIKWSNLTKNRYNFHGFASWAPRCCLGSGQYSVLLYVTRQVPEQMEQTMGWSVNASQYISSKLYVFGRYSGVTGHVFPINRTYSCGMVSANLFNRNPQDLFGIACAFNNVHLSASPNAKRKYETVIEGFATIGCGPYLSFAPDFQLYLYPALRPNKQSARVYSVRANLAI

SEQ ID NO: 7818 - protein, 1287 aa, Escherichia coli
MNKAYSIIWSHSRQAWIVASELARGHGFVLAKNTLLVLAVVSTIGNAFAVNISGIVSSGGTVSSGETQIVYSGGETSNATVNSGGTQIVNNGGKTTATTVNSSGSQNVGTSGATISTIVNSGGIQRVSSGGVASATNLSGGAQNIYNLGHASNTVIFSGGNQTIFSGGITDSTNISSGGQQRVSSGGVASNTTINSSGAQNILSGGSAISTHISSGGNQYISAGANATETIVNSGGFQRVNSGAVATGTVLSGGTQNVSSGGSAISTSVYNSGVQTVFAGATVTDTTVNSGGNQNISSGGIVSETTVNVSGTQNIYSGGSALSANIKGSQIVNSEGTAINTLVSDGGYQHIRNGGIASGTIVNQSGYVNISSGGYAESTIINSGGTLRVLSDGYARGTILNNSGRENVSNGGVSYNAMINTGGNQYIYSDGEATAAIVNTSGFQRINSGGTASGTKLSGGNQNVSSGGKAIDAEVYSGGKQTVYSGGEVSGTQIFNGGMVNVSGGTASGANVNLSGRLNAFAGNVVGTILNQEGRQYVYSGATATSTVGNNEGREYVLSGGITDGTVLNSGGLQAVSSGGKASATVINEGGAQFVYDGGQVTGTNIKNGGTIRVDSGASALNIALSSGGNLFTSTGATLPELTTMAALSVSQNHASNIVLENGGLLAVTSGGTATDTTVNSAGRLRIDDGGTINGTTTINADGIVAGTNIQNDGNFILNLAENYDFETELSGSGVLVKDNTGIMTYAGTLTQAQGVNVKNGGIIFDSAVVNADMAVNQNAYINISDQATINGSVNNNGSIVINNSIINGNITNDADLSFGTAKLLSATVNGSLVNNKNIILNPTKESAGNTLTVSNYTGTPGSVISLGGVLEGDNSLTDRLVVKGNTSGQSDIVYVNEDGSGGQTRDGINIISVEGNSDAEFSLKNRVVAGAYDYTLQKGNESGTDNKGWYLTSHLPTSDTRQYRPENGSYATNMALANSLFLMDLNERKQFRAMSDNTQPESASVWMKITGGRSSGKLNDGQNKTTTNQFINQLGGDIYKFHAEQLGDFTLGIMGGYANAKGKTINYTSNKAARNTLDGYSVGVYGTWYQNGENATGLFAETWMQYNWFNASVKGDGLEEEKYNLNGLTTSAGGGYNLNVHTWTSPEGITGEFWLQPHLRAVWMGVTPDTHQEDNGTVVQGAGKNNIQTKAGIRASWKVKSTLDKDTGREFRPYIEANWIHNTHEFGVKMSDDSQLLSGSRNQGEIKTGIEGVITQNLSVNGGVAYQAGGHGSNAISGALGIKYSF

SEQ ID NO: 7819 - protein, 178 aa, Yersinia enterocolitica
MKKTLLASSLIACLSIASVNVYAASESSISIGYAQSHVKENGDTLDNDPKGFNLKYRYELDDNWGVIGSFAYTHQGYDFFYGSNKFGHGDVDYYSVTMGPSFRINEYVSLYGLLGAAHGKVKASVFDESISASKTSMAYGAGVQFNPLPNFVIDASYEYSKLDSTKVGTWMLGAGYRF

SEQ ID NO: 7820 - protein, 702 aa, Yersinia pseudotuberculosis
MVFKYSVVGLAVGSALMAMPVMAEAPNDENIERINVTGRTFNDYKVGSASGAMRGDIDLMDTPQSVNVIPDFVTDEQLATNLAEVLVNDSSVTAGTTRWNRQVFSIRGFELDSGNGYLINGHQQWSHYVQPIETLQQVEVLKGPSSMLYGQSGPGGLVNMVTKKPTYDSMLNLGFDTDGYGSTRAQLDAGGSLNEAQSVRYRGVLVKQDTKYWREYSTTDENQERDRWLGYLNLEFDISDDLLLSLKYDHTQDKTGIDAGGWLDKQGNVVGQRKTIWDAPWAFTDNTVSNLGADLTWHMNDDWKVKLGYNDQQFNRQRFDSAPQYNEDPFTSGYSIRPFDRYDDWQHKTAYVDFTGEFALAGMEHQLLIGANYLDYFYQQQIARGAAQTVIPGQPVIQPDLDYHTGKKGTPNEYKYYGFYLQDLMTINEQWKLLAGVRYDEQKKDGFGENSYAVSPKFGVIYSPMTNGSIYVNYSKSFTPQGGITDPLNVNHDTNLKPEYGIQYEVGTKWELFDDSLLLTAAVFDVTLENISINEVLTASDPRSEDGKYTSITTQGGEQKHRGFEVGAQGKLGDSWFVTSSMMYLDAEYQTGDEREGKTPIDAPEWSANIWTRYEVTDNFAMNFGAIYVGERFADVNNTISKDGYVRFDIGAAYTMDIMGKDVSIRANVRNLFDTDYIDGGQYNMVTLGQDRNFSVALEAKF

SEQ ID NO: 7821 - protein, 230 aa, Pseudomonas oleovorans
MSFSNYKVIAMPVLVANFVLGAATAWANENYPAKSAGYNQGDWVASFNFSKVYVGEELGDLNVGGGALPNADVSIGNDTTLTFDIAFFVSSNIAVDFFVGVPARAKFQGEKSISSLGRVSEVDYGPAILSLQYHYDSFERLYPYVGVGVGRVLFFDKTDGALSSFDIKDKWAPAFQVGLRYDLGNSWMLNSDVRYIPFKTDVTGTLGPVPVSTKIEVDPFILSLGASYVF

SEQ ID NO: 7822 - protein, 1267 aa, Yersinia pestis biovar Orientalis str. F1991016
MHIQFREPISTSPAQPDAGRQHLFSRVPAAVMNPITLAIIVAFSTLVLPQTAWAACNSSGVGTYVCEGENNTAISLFGTDIAVETRPGFGITEHEITDSALSLTGSGTISYLDTNSSALDTDSRYSLYIKNDTLITEQSASINVQSNGSISSGVYIDNQSSDDSTIRVDLSGILSSSLSGAPALSIFSSAGNDSTIILNTHAISGVTGIQSDNNSQNGATITHVDVTGDINVENSGVSIRNAANGGTSIINFNSKSINTEYNSFYIQNTNYVGGVITDINIDGDISSANSQAARIYNYTNGGLASLRFRANNVTGSTGLYIDNSSQNGAVTDIILTGDLTATSGSALQANAYSDEGNIETAIKLNNVYSLYDALNISDYTRSGNILHDLDISGTITAENGTGIKVMGAAGEGSSTMLINVNNITSSSQSLDINNYNFLGSAFSAITATGHLTAEWGQGAMLQTHSSLGDATTLIHFNDITAMSSGISLINEANQGTSTADITVTGQINVSHGEGITLNALTTDGRTLVNVDVNNIASEYDAIRLYNYNDNYATGVDDGTGADNGTSTIDLITRGALVSQQGYGINIETNTADTYVTVGGLVHGGNGTAIGIHRLDNIQTSATLELQSGYALEGVTQALVFTGSYAEINDAALDLANSHLVLGGAGDAAFDLTRIDNREEAILDGDPNRITGFGTLTKTNNSIWTLTGANMADGDANAFLSANIAGGILVLDNATLGLTPDAGALTGATVNRLSAADIAADPTRVATETGALTLAEGGALSSLGDSVLSGNLISAGGILLSNHYTGGNGAATDDRLTVTGTYFGENNGSGEGAWLALDTVLGDDDSATDRLVINGDATGTTSVRVNNAGGLGDKTLNGINLITVDGLAQDDTFLLAGDYVTTDGYQAVVAGAYAYTLQADGEAATAGRNWYLSSELMLTEGVRYQVGVPLYEQYPQVLAALNTLPTLQQRVGNRYGAPGALADLNFDDNQWAWGRIEGSHQVTDPARSTSGSQREIDVWKLQTGIDVPLYQSQGGSLLTGGVNFTYGKAKADIHSFFGDGRINSAGYGLGTSLTWYGNNGVYVDGQLQTMWFDSDLSSRTAGHAVASGNNGRGYTSAIEAGKGYTLSHGLSLTPQMQVTYSRVDFDTFRDPFDSEVSLQEGDSLRGRLGVSLNKETTWSAKDGTTRRSHIYSHLDLHNEFLNGSKVQVSGVEFATRDERQSVGLGAGGTYEWQNGRYAVYGNVNLLGATRNISDNYAVGGTIGARVSW

SEQ ID NO: 7823 - protein, 179 aa, Yersinia pestis biovar Orientalis str. F1991016
MNKTLLVSSLIACLSIASVNVYAEGESSISIGYAQSRVKDDGYKLDKNPRGFNLKYRYEFNNDWGVIGSFAQTRRGFEESVDGFKLIDGDFKYYSVTAGPVFRINEYVSLYGLLGAGHGKAKVSSIFGQSESRSKTSLAYGAGLQFNPHPNFVIDASYEYSKLDDVKVGTWMLGAGYRF

SEQ ID NO: 7824 - protein, 975 aa, Chlamydia trachomatis
MNRVIEIHAHYDQRQLSQSPNTNFLVHHPYLTLIPKFLLGALIVYAPYSFAEMELAISGHKQGKDRDTFTMISSCPEGTNYIINRKLILSDFSLLNKVSSGGAFRNLAGKISFLGKNSSASIHFKHININGFGAGVFSESSIEFTDLRKLVAFGSESTGGIFTAKEDISFKNNHHIAFRNNITKGNGGVIQLQGDMKGSVSFVDQRGAIIFTNNQAVTSSSMKHSGRGGAISGDFAGSRILFLNNQQITFEGNSAVHGGAIYNKNGLVEFLGNAGPLAFKENTTIANGGAIYTSNFKANQQTSPILFSQNHANKKGGAIYAQYVNLEQNQDTIRFEKNTAKEGGGAITSSQCSITAHNTIIFSDNAARDLGGGAILLEGKKPSLTLIAHSGNIAFSGNTMLHITKKASLDRHNSILIKEAPYKIQLAANKNHSIHFFDPVMALSASSSPIQINAPEYETPFFSPKGMIVFSGANLLDDAREDVANRTSIFNQPVHLYNGTLSIENGAHLIVQSFKQTGGRISLSPGSSLALYTMNSFFHGNISSKEPLEINGLSFGVDISPSNLQAEIRAGNAPLRLSGSPSIHDPEGLFYENRDTATSPYQMEILLTSDKTVDISKFTTDSLVTNKQSGFQGAWHFSWQPNTINNTKQKILRASWLPTGEYVLESNRVGRAVPNSLWSTFLLLQTASHNLSDHLCNNRSLIPTSYFGVLIGGTGAEMSTHSSEEESFISRLGATGTSIIRLTPSLTLSGGGSHMFGDSFVADLPEHITSEGIVQNVGLTHVWGPLTVNSTLCAALDHNAMVRICSKKDHTYGKWDTFGMRGTLGASYTFLEYDQTMRVFSFANIEATNILQRAFTETGYNPRSFSKTKLLNIAIPIGIGYEFCLGNSSFALLGKGSIGYSRDIKRENPSTLAHLAMNDFAWTTNGCSVPTSAHTLANQLILRYKACSLYITAYTINREGKNLSNSLSCGGYVGF

SEQ ID NO: 7825 - protein, 1749 aa, Chlamydia trachomatis
MKWLSATAVFAAVLPSVSGFCFPEPKELNFSRVGTSSSTTFTETVGEAGAEYIVSSNASFTKFTNIPTTNTTTPTNSNSSSSNRETASVSKDSDSTTTTPDPKGGGAFYNAHSGVLSFMTRSGTEGSLTLSEIKMTGEGGAIFSQGELLFTDLTGLTIQNNLSQLSGGAIFGGSTISLSGITKATFSSNSAEVPAPVKKPTKPEAQTAGETSGSSSSSGNDSASSSSSSKAEPAAANLQSHFICATATPAAQTDTETSTPSHKPGSGGAIYAKGDLTIADSQKVLFSINKATKDGGAIFAEKDVSFENITSLKVQTNGAEEKGGAIYAKGDLSIQSSKQSLFNSNYSKQGGGALYVEGNINFQDLEEIRIKYNKAGTFKTKKITLPSKAQASAGNADAWASSSPQSSSGATTVSDSGDSSSGSNSDTSKTVPVTAKGGGLYTDKNLSITNITGIIEIANNKATDVGGGAYVKGTLTCKNSHRLQFLKNSSDKQGGGIYGEDNITLSNLTGKTLFQENTAKKEGGGLFIKGTDKALTMTGLDSFCLINNTSEKHGGGAFVTKEISQTYTSDVETIPGITPVHGETVITGNKSTGGNGGGVCTKRLALSNLQSISISGNSAAENGGGAYTCPDSFPTADTAEQPAAASAATSTPESDPVASTALSTPSSSTVSSLTLLAASSQASPATSNEKTQDPNADTDLLIDYVVDTTISKNTAKKGGGIYAKKAKMSRIDQLNISENSATEIGGGICCKESLKLDALVSLSVTENLVGKEGGGLHAKTVNISNLKSGFSFSNNKANSSSTGVATTASAPAAAAASLQAAAAAAPSSPATPTYSGVVGGAIYGEQVTFSQCSGTCQFSGNQAIDNNPSQSSLNVQGGAIYAKTSLSIRSSDAGTSYIFSGNSVSTGKSQTTGQIAGGAIYSPTVTLNCPATFSNNTASMATPKTSSSSGNSIKDTIGGAIAGTAITLSGVSRFSGNTADLGAAIGTLANANTPRATSGSQNSITEKITLKNSSFIFERNQANKRGAIYSPSVSIKGNNITFNQNTSTHDGSAIYFTKDAKIESLGSVLFTGNKVTATQASSATSGQNTNTANYGAAIFGDPGTTQSPQTDAILTLLASSGNITFSNNSLQNNQGGTPASKFCSIAGYVKLSLQATKGKTISFFDCVHTSTKKTGSTQNVYETLDINKKENSKPYTGTIVFSSELHENKSYIPQNAILHNGTLVLKEKTELHVVSFEQKEGSKLIMEPGAVLSNQNIANGALAINGLTIDLSSMGTPQAGEIFSPPELRIVATTSSASGRSGVSRSIPTNPKGISAAAPSGSAATTPTMSENKVFLTGDLTLIDPNGNFYQNPMLGSDLDVPLIKLPTNTSDVQVYDLTLSGDLFPQKGYMGTWTLNSNPQTGKLQARWTFDTYRRWVYIPRDNHFYANSILGSQNSMIVVKQGLINNMLNNARFDDIAYNNFWVSGVGTFLAQQGTPLSEEFSYYSRGTSVAIDAKPRQDFILGAAFSKMVGKTKAIKKMHNYFHKGSEYSYQASVYGGKFLYFLLNKQHGWALPFLIQGVVSYGHIKHDTTILYPSIHERNKGDWEDLGWLADLRISMDLKEPSKDSSKRITVYGELEYSSIRQKQFTEIDYDPRHFDDCAYRNLSLPVGCAVEGAIMNCNILMYNKLALAYMPSIYRNNPVCKYRVLSSNEAGQVICGVPTRTSARAEYSTQLYLGPFWTLYGNYTIDVGMYTLSQMTSCGARMIF

SEQ ID NO: 7826 - protein, 1774 aa, Chlamydia trachomatis
MKFLSATAVFAAVLSSVTEASSIQDQIKNTDCNVSKVGYSTSQAFTDMMLADNTEYRAADSVSFYDFSTSSGLPRKHLSSSSEASPTTEGVSSSSSGENTENSQDSAPSSGETDKKTEEELDNGGIIYAREKLTISESQDSLSNPSIELHDNSFFFGEGEVIFDHRVALKNGGAIYGEKEVVFENIKSLLVEVNIAVEKGGSVYAKERVSLENVTEATFSSNGGEQGGGGIYSEQDMLISDCNNVHFQGNAAGATAVKQCLDEEMIVLLTECVDSLSEDTLDSTPETEQTKSNGNQDGSSETKDTQVSESPESTPSPDDVLGKGGGIYTEKSLTITGITGTIDFVSNIATDSGAGVFTKENLSCTNTNSLQFLKNSAGQHGGGAYVTQTMSVTNTTSESITTPPLVGEVIFSENTAKGHGGGICTNKLSLSNLKTVTLTKNSAKESGGAIFTDLASIPTTDTPESSTPSSSSPASTPEVVASAKINRFFASTAEPAAPSLTEAESDQTDQTETSDTNSDIDVSIENILNVAINQNTSAKKGGAIYGKKAKLSRINNLELSGNSSQDVGGGLCLTESVEFDAIGSLLSHYNSAAKEGGVIHSKTVTLSNLKSTFTFADNTVKAIVESTPEAPEEIPPVEGEESTATENPNSNTEGSSANTNLEGSQGDTADTGTGVVNNESQDTSDTGNAESGEQLQDSTQSNEENTLPNSSIDQSNENTDESSDSHTEEITDESVSSSSKSGSSTPQDGGAASSGAPSGDQSISANACLAKSYAASTDSSPVSNSSGSDVTASSDNPDSSSSGDSAGDSEGPTEPEAGSTTETPTLIGGGAIYGETVKIENFSGQGIFSGNKAIDNTTEGSSSKSNVLGGAVYAKTLFNLDSGSSRRTVTFSGNTVSSQSTTGQVAGGAIYSPTVTIATPVVFSKNSATNNANNATDTQRKDTFGGAIGATSAVSLSGGAHFLENVADLGSAIGLVPDTQNTETVKLESGSYYFEKNKALKRATIYAPVVSIKAYTATFNQNRSLEEGSAIYFTKEASIESLGSVLFTGNLVTPTLSTTTEGTPATTSGDVTKYGAAIFGQIASSNGSQTDNLPLKLIASGGNICFRNNEYRPTSSDTGTSTFCSIAGDVKLTMQAAKGKTISFFDAIRTSTKKTGTQATAYDTLDINKSEDSETVNSAFTGTILFSSELHENKSYIPQNVVLHSGSLVLKPNTELHVISFEQKEGSSLVMTPGSVLSNQTVADGALVINNMTIDLSSVEKNGIAEGNIFTPPELRIIDTTTSGSGGTPSTDSESNQNSDDTKEQNNNDASNQGESANGSSSPAVAAAHTSRTRNFAAAATATPTTTPTATTTTSNQVILGGEIKLIDPNGTFFQNPALRSDQQISLLVLPTDSSKMQAQKIVLTGDIAPQKGYTGTLTLDPDQLQNGTISALWKFDSYRQWAYVPRDNHFYANSILGSQMSMVTVKQGLLNDKMNLARFDEVSYNNLWISGLGTMLSQVGTPTSEEFTYYSRGASVALDAKPAHDVIVGAAFSKMIGKTKSLKRENNYTHKGSEYSYQASVYGGKPFHFVINKKTEKSLPLLLQGVISYGYIKHDTVTHYPTIRERNQGEWEDLGWLTALRVSSVLRTPAQGDTKRITVYGELEYSSIRQKQFTETEYDPRYFDNCTYRNLAIPMGLAFEGELSGNDILMYNRFSVAYMPSIYRNSPTCKYQVLSSGEGGEIICGVPTRNSARGEYSTQLYPGPLWTLYGSYTIEADAHTLAHMMNCGARMTF

SEQ ID NO: 7827 - protein, 1531 aa, Chlamydia trachomatis
MSSEKDIKSTCSKFSLSVVAAILASVSGLASCVDLHAGGQSVNELVYVGPQAVLLLDQIRDLFVGSKDSQAEGQYRLIVGDPSSFQEKDADTLPGKVEQSTLFSVTNPVVFQGVDQQDQVSSQGLICSFTSSNLDSPRDGESFLGIAFVGDSSKAGITLTDVKASLSGAALYSTEDLIFEKIKGGLEFASCSSLEQGGACAAQSILIHDCQGLQVKHCTTAVNAEGSSANDHLGFGGGAFFVTGSLSGEKSLYMPAGDMVVANCDGAISFEGNSANFANGGAIAASGKVLFVANDKKTSFIENRALSGGAIAASSDIAFQNCAELVFKGNCAIGTEDKGSLGGGAISSLGTVLLQGNHGITCDKNESASQGGAIFGKNCQISDNEGPVVFRDSTACLGGGAIAAQEIVSIQNNQAGISFEGGKASFGGGIACGSFSSAGGASVLGTIDISKNLGAISFSRTLCTTSDLGQMEYQGGGALFGENISLSENAGVLTFKDNIVKTFASNGKILGGGAILATGKVEITNNSEGISFTGNARAPQALPTQEEFPLFSKKERRPLSSGYSGGGAILGREVAILHNAAVVFEQNRLQCSEEEATLLGCCGGGAVHGMDSTSIVGNSSVRFGNNYAMGQGVSGGALLSKTVQLAGNGSVDFSRNIASLGGGALQASEGNCELVDNGYVLFRDNRGRVYGGAISCLRGDVVISGNKGRVEFKDNIATRLYVEETVEKVEEVEPAPEQKDNNELSFFGSAEQSFITAANQALFASEDGDLSPESSISSEELVKRRECAGGAIFAKRVRIVDNQEAIVFSNNFSDIYGGAIFTGSLREEDKLDGQIPEVLISGNAGDVVFSGNSSKRDEHLPHTGGGAICTQNLTISQNTGNVLFYNNVACSGGAVRIEDHGNVLLEAFGGDIVFKGNSSFRAQGSDAIYFAGKESHITALNATEGHAIVFHDALVFENLEERKSAEVLLINSRENPGYTGSIRFLEAESKVPQCIHVQQGSLELLNGATLCSYGFKQDAGAKLVLAAGAKLKILDSGAPVQQGHAISKPEAEIESSSEPEGAHSLWIAKNAQTTVPMVDIHTISVDLASFSSSQQEGTVEAPQVIVPGGSYVRSGELNLELVNTTGTGYENHALLKNEAKVPLMSFVASGDEASAEISNLSVSDLQIHVVTPEIEEDTYGHMGDWSEAKIQDGTLVISWNPTGYRLDPQKAGALVFNALWEEGAVLSALKNARFAHNLTAQRMEFDYSTNVWGFAFGGFRTLSAENLVAIDGYKGAYGGASAGVDIQLMEDFVLGVSGAAFLGKMDSQKFDAEVSRKGVVGSVYTGFLAGSWFFKGQYSLGETQNDMKTRYGVLGESSASWTSRGVLADALVEYRSLVGPVRPTFYALHFNPYVEVSYASMKFPGFTEQGREARSFEDASLTNITIPLGMKFELAFIKGQFSEVNSLGISYAWEAYRKVEGGAVQLLEAGFDWEGAPMDLPRQELRVALENNTEWSSYFSTVLGLTAFCGGFTSTDSKLGYEANTGLRLIF

SEQ ID NO: 7828 - protein, 965 aa, Chlamydia trachomatis
MKKAFFFFLIGSSLSGLAREVPSRIFLMPNSVPDPTKESLSNKISLTGDTHNLTNCYLDNLRYILAILQKTPNEGAAVTITDYLSFFDTQKEGIYFAKNLTPESGGAIGYASPNSPTVEIRDTIGPVIFENNTCCRPFTSSNPNAAVNKIREGGAIHAQNLYINHNHDVVGFMKNFSYVRGGAISTAHTFVVSENQSCFLFMDNICIQTNTAGKGGAIYAGTSNSFESNNCDLFFINNACCAGGAIFSPICSLTGNRGNIVFYNNRCFKNVETASSESSDGGAIKVTTRLDVTGNRGRIFFSDNITKNYGGAIYAPVVTLVDNGPTYFINNIANNKGGAIYIDGTSNSKISADRHAIIFNENIVTNVTNANGTSTSANPPRRNAITVASSSGEILLGAGSSQNLIFYDPIEVSNAGVSVSFNKEADQTGSVVFSGATVNSADFHQRNLQTKTPAPLTLSNGFLCIEDHAQLTVNRFTQTGGVVSLGNGAVLSCYKNGAGNSASNASITLKHIGLNLSSILKSGAEIPLLWVEPTNNSNNYTADTAATFSLSDVKLSLIDDYGNSPYESTDLTHALSSQPMLSISEASDNQLRSDDMDFSGLNVPHYGWQGLWSWGWAKTQDPEPASSATITDPKKANRFHRTLLLTWLPAGYVPSPKHRSPLIANTLWGNMLLATESLKNSAELTPSDHPFWGITGGGLGMMVYQDPRENHPGFHMRSSGYSAGMIAGQTHTFSLKFSQTYTKLNERYAKNNVSSKNYSCQGEMLFSLQEGFLLAKLVGLYSYGDHNCHHFYTQGENLTSQGTFRSQTMGGAVFFDLPMKPFGSTHILTAPFLGALGIYSSLSHFTEVGAYPRSFSTKTPLINVLVPIGVKGSFMNATQRPQAWTVELAYQPVLYRQELEIATQLLASKGIWFGSGSPSSRHAMSYKISQQTQPLSWLTLHFQYHGFYSSSTFCNYLNGEIALRF

SEQ ID NO: 7829 - protein, 1032 aa, Chlamydia trachomatis
MIKRTSLSFACLSFFYLSTISILQANETDTLQFRRFTFSDREIQFVLDPVSLITAQNVTFSNINSWGRGVCTIADNTQTQIFSNSINTTSAAGGVFDMVTISFTASNNANLLFCNNYCTHNKGGGAIRSKGPIRFSNNQDVLFYNNTTAGAQYTGTGNKSEKNRGGALYAKNITLTGNRTLAFINNMSGDCGGAIAANTQISITDTAKGVLFENNHTLNHIPDTRAENMARGGAICSRKSSCSISNNLGPIIFNYNQGGKGGAISATQCVISNNEERIVFSNNSSIGWNKSTHASNGGAIQTAQGFTLQNNKGPIYFDSNTAAHAGGAIDCGYIDIRNNGPIYFLNNSAAWGAAFNLSKLRPATNYIHTGTGDIVFNNNVVFKFDANLLGMRKLFHINNNTQTPYTLSLGAKEDTRIYFYDLFQWERVREPNNAQVSPSSRNVITINPIEEFSGAVVFSYKQMSSDIKTLMGTEHNYIREAPTTLKFGTLAIEDGAELEFFDIPFTQNPTSLLALGSGATLTVGKHGKLNITNLGVILPIILKEGKSPPCIRVNPQDMTQNTDTGQTPSSTSSISTPMIIFNGRLSIVDENYESVYDSMDLSRGKAEQPILSIETTNDGQLGPNWQNSLNTSLLSPPHYGYQGLWTPNWITTTYTITLNNNSSAPTSANSIAEQKKTSETFTPNSTTTAGIPSIKASAGSGSGSSTTTDVQVTRHTLTVNWTPVGYIVDPIRRGDLIANSLVHSGRNMTMGLRSLLPDNSWFALQGAATTLFTKQQKRLSYHGYSSASKGYTVSSQASGAHGHKFLLSFSQSSDKMKEKETNNRLSSRYYLSALCFAHPMFDRIALIGAAACNYGTHNMRSFYGTKRSSKGKFHSTTLGASLRCELRDSMPLRSIMLTPFAQALFSRTKPGAIRESGDLARLFTLEQAHTAIVSPIGIKGAYSSDTWPTLSWEMELAYQPTLYWKRPLLNTLLIQNNGSWVTTNTPLAKHSFYGRGSHSLKFSHLKLFANYQAEVATSTVSHYINAGGALVF

SEQ ID NO: 7830 - protein, 1013 aa, Chlamydia trachomatis
MQTSFHKFFLSMILAYSCCSLNGGGYAAEIMVPQGIYDGETLTVSFPYTVIGDPSGTTVFSAGELTLKNLDNSIAALPLSCFGNLLGSFTVLGRGHSLTFENIRTSTNGAALSNSAADGLFTIEGFKELSFSNCNSLLAVLPAATTNKGSQTPTTTSTPSNGTIYSKTDLLLLNNEKFSFYSNLVSGDGGAIDAKSLTVQGISKLCVFQENTAQADGGACQVVTSFSAMANEAPIAFVANVAGVRGGGIAAVQDGQQGVSSSTSTEDPVVSFSRNTAVEFDGNVARVGGGIYSYGNVAFLNNGKTLFLNNVASPVYIAAKQPTNGQASNTSNNYGDGGAIFCKNGAQAAGSNNSGSVSFDGEGVVFFSSNVAAGKGGAIYAKKLSVANCGPVQFLRNIANDGGAIYLGESGELSLSADYGDIIFDGNLKRTAKENAADVNGVTVSSQAISMGSGGKITTLRAKAGHQILFNDPIEMANGNNQPAQSSKLLKINDGEGYTGDIVFANGSSTLYQNVTIEQGRIVLREKAKLSVNSLSQTGGSLYMEAGSTLDFVTPQPPQQPPAANQLITLSNLHLSLSSLLANNTVTNPPTNPPAQDSHPAVIGSTTAGSVTISGPIFFEDLDDTAYDRYDWLGSNQKINVLKLQLGTKPPANAPSDLTLGNEMPKYGYQGSWKLAWDPNTANNGPYTLKATWTKTGYNPGPERVASLVPNSLWGSILDIRSAHSAIQASVDGRSYCRGLWVSGVSNFFYHDRDALGQGYRYISGGYSLGANSYFGSSMFGLAFTEVFGRSKDYVVCRSNHHACIGSVYLSTKQALCGSYLFGDAFIRASYGFGNQHMKTSYTFAEESDVRWDNNCLAGEIGAGLPIVITPSKLYLNELRPFVQAEFSYADHESFTEEGDQARAFKSGHLLNLSVPVGVKFDRCSSTHPNKYSFMAAYICDAYRTISGTETTLLSHQETWTTDAFHLARHGVVVRGSMYASLTSNIEVYGHGRYEYRDASRGYGLSAGSRVRF

SEQ ID NO: 7831 - protein, 1009 aa, Chlamydia trachomatis
MPFSLRSTSFCFLACLCSYSYGFASSPQVLTPNVTTPFKGDDVYLNGDCAFVNVYAGAEEGSIISANGDNLTITGQNHTLSFTDSQGPVLQNYAFISAGETLTLRDFSSLMFSKNVSCGEKGMISGKTVSISGAGEVIFWDNSVGYSPLSTVPTSSSTPLAPTVSDARKGSIFSVETSLEISGVKKGVMFDNNAGNFGTVFRGKNNNNAGGGGSGSATPSSTTFTVKNCKGKVSFTDNVASCGGGVVYKGIVLFKDNEGGIFFRGNTAYDDLRILATTNQDQNTETGGGGGVICSPDDSVKFEGNKGSIVFDYNFAKGRGGSILTKEFSLVADDSVVFSNNTAEKGGGAIYAPTINMSTNGGSILFERNRAAEGGAICVSAASSGSTGKLTLSASDGDIVFSGNMTSDRPGERSAVRILSSGTTVALNASGLSKLIFHDPVVQNNSAAAASTPSPSSSSTPAAVTINQSGNGSVIFTAESLTPSEKLQVLNSTSNFPGTLTVSGGELVVTEGATLTTGTITATSGRVTLGSGASLSAVAGAANNNYTCTVSKLGIDLESFLTPNYKTAILGAYGTVTVKKGSTLDLVMENEAEVYDNPLFVGSLTIPFVTLSSSSSSSASNGVTMKRVTINDADAAHYGYQGSWSADWTKPPLAPDAKGMVPPNTSNTLYLTWRPASNYGEYRLDPQRKGELVPNSLWVAGSALRTFTNGLKEHYVSRDVGFVASLHALGDYILNYTQDDRDGFLARYGGFQATAACHYENGSIFGVAFGQLYGQTKSRMYYSKDAGNMTMLSCFGRSYVDIKGTETVVYWETAYGYSVHRMHTQYFNDKTQKFDHSKCHWHNNNYYAFVGAEHNFLEYCIPTRQFARDYELAGFMRFEMAGGWSSATQETGSLTRYFARGAGHNMSLPIGIVAHVVSHVRRSPLSKLTLNMGYRPDIWRVTPHCNMEIIANGVKTPIQGSPLARHAFFLEVHDTLYIHHFGRAYMNYSLDARRRQTAHFVSMGLNRIF

SEQ ID NO: 7832 - protein, 878 aa, Chlamydia trachomatis
MRPDHMNFCCLCAAILSSTAVLFGQDPLGETALLTKNPNHVVCTFFEDCTMESLFPALCAHASQDDPLYVLGNSYCWFVSKLHITDPKEALFKEKGDLSIQNFRFLSFTDCSSKESSPSIIHQKNGQLSLRNNGSMSFCRNHAEGSGGAISADAFSLQHNYLFTAFEENSSKGNGGAIQAQTFSLSRNVSPISFARNRADLNGGAICCSNLICSGNVNPLFFTGNSATNGGAICCISDLNTSEKGSLSLACNQETLFASNSAKEKGGAIYAKHMVLRYNGPVSFINNSAKIGGAIAIQSGGSLSILAGEGSVLFQNNSQRTSDQGLVRNAIYLEKDAILSSLEARNGDILFFDPIVQESSSKESPLPSSLQASVTSPTPATASPLVIQTSANRSVIFSSERLSEEEKTPDNLTSQLQQPIELKSGRLVLKDRAVLSAPSLSQDPQALLIMEAGTSLKTSSDLKLATLSIPLHSLDTEKSVTIHAPNLSIQKIFLSNSGDENFYENVELLSKEQNNIPLLTLPKEQSHLHLPDGNLSSHFGYQGDWTFSWKDSDEGHSLIANWTPKNYVPHPERQSTLVANTLWNTYSDMQAVQSMINTTAHGGAYLFGTWGSAVSNLFYAHDSSGKPIDNWHHRSLGYLFGISTHSLDDHSFCLAAGQLLGKSSDSFITSTETTSYIATVQAQLATSLMKISAQACYNESIHELKTKYRSFSKEGFGSWHSVAVSGEVCALIPIVSNGSGLFSSFSIFSKLQGFSGTQDGFEESSGEIRSFSASSFRNISLPIGITFEKKSQKTRNYYYFLGAYIQDLKRDVESGPVVLLKNAVSWDAPMANLASRAYMFRLTNQRALHRLQTLLNVSYVLRGQSHSYSLDLGATHRF

SEQ ID NO: 7833 - protein, 1034 aa, Chlamydia trachomatis
MIKRTSLSFACLSFFYLSTISILQANETDTLQFRRFTFSDREIQFVLDPASLITAQNIVLSNLQSNGTGACTISGNTQTQIFSNSVNTTADSGGAFDMVTTSFTASDNANLLFCNNYCTHNKGGGAIRSGGPIRFLNNQDVLFYNNISAGAKYVGTGDHNEKNRGGALYATTITLTGNRTLAFINNMSGDCGGAISADTQISITDTVKGILFENNHTLNHIPYTQAENMARGGAICSRRDLCSISNNSGPIVFNYNQGGKGGAISATRCVIDNNKERIIFSNNSSLGWSQSSSASNGGAIQTTQGFTLRNNKGSIYFDSNTATHAGGAINCGYIDIRDNGPVYFLNNSAAWGAAFNLSKPRSATNYIHTGTGDIVFNNNVVFTLDGNLLGKRKLFHINNNEITPYTLSLGAKKDTRIYFYDLFQWERVKENTSNNPPSPTSRNTITVNPETEFSGAVVFSYNQMSSDIRTLMGKEHNYIKEAPTTLKFGTLAIEDDAELEIFNIPFTQNPTSLLALGSGATLTVGKHGKLNITNLGVILPIILKEGKSPPCIRVNPQDMTQNTGTGQTPSSTSSISTPMIIFNGRLSIVDENYESVYDSMDLSRGKAEQLILSIETTNDGQLDSNWQSSLNTSLLSPPHYGYQGLWTPNWITTTYTITLNNNSSAPTSATSIAEQKKTSETFTPSNTTTASIPNIKASAGSGSGSASNSGEVTITKHTLVVNWAPVGYIVDPIRRGDLIANSLVHSGRNMTMGLRSLLPDNSWFALQGAATTLFTKQQKRLSYHGYSSASKGYTVSSQASGAHGHKFLLSFSQSSDKMKEKETNNRLSSRYYLSALCFEHPMFDRIALIGAAACNYGTHNMRSFYGTKKSSKGKFHSTTLGASLRCELRDSMPLRSIMLTPFAQALFSRTEPASIRESGDLARLFTLEQAHTAVVSPIGIKGAYSSDTWPTLSWEMELAYQPTLYWKRPLLNTLLIQNNGSWVTTNTPLAKHSFYGRGSHSLKFSHLKLFANYQAEVATSTVSHYINAGGALVF

SEQ ID NO: 7834 - protein, 1013 aa, Chlamydia trachomatis
MQTSFHKFFLSMILAYSCCSLNGGGYAAEIMVPQGIYDGETLTVSFPYTVIGDPSGTTVFSAGELTLKNLDNSIAALPLSCFGNLLGSFTVLGRGHSLTFENIRTSTNGAALSNSAADGLFTIEGFKELSFSNCNSLLAVLPAATTNKGSQTPTTTSTPSNGTIYSKTDLLLLNNEKFSFYSNLVSGDGGAIDAKSLTVQGISKLCVFQENTAQADGGACQVVTSFSAMANEAPIAFVANVAGVRGGGIAAVQDGQQGVSSSTSTEDPVVSFSRNTAVEFDGNVARVGGGIYSYGNVAFLNNGKTLFLNNVASPVYIAAKQPTNGQASNTSNNYGDGGAIFCKNGAQAAGSNNSGSVSFDGEGVVFFSSNVAAGKGGAIYAKKLSVANCGPVQFLRNIANDGGAIYLGESGELSLSADYGDIIFDGNLKRTAKENAADVNGVTVSSQAISMGSGGKITTLRAKAGHQILFNDPIEMANGNNQPAQSSKLLKINDGEGYTGDIVFANGSSTLYQNVTIEQGRIVLREKAKLSVNSLSQTGGSLYMEAGSTLDFVTPQPPQQPPAANQLITLSNLHLSLSSLLANNAVTNPPTNPPAQDSHPAVIGSTTAGSVTISGPIFFEDLDDTAYDRYDWLGSNQKINVLKLQLGTKPPANAPSDLTLGNEMPKYGYQGSWKLAWDPNTANNGPYTLKATWTKTGYNPGPERVASLVPNSLWGSILDIRSAHSAIQASVDGRSYCRGLWVSGVSNFFYHDRDALGQGYRYISGGYSLGANSYFGSSMFGLAFTEVFGRSKDYVVCRSNHHACIGSVYLSTKQALCGSYLFGDAFIRASYGFGNQHMKTSYTFAEESDVRWDNNCLAGEIGAGLPIVITPSKLYLNELRPFVQAEFSYADHESFTEEGDQARAFKSGHLLNLSVPVGVKFDRCSSTHPNKYSFMAAYICDAYRTISGTETTLLSHQETWTTDAFHLARHGVVVRGSMYASLTSNIEVYGHGRYEYRDASRGYGLSAGSRVRF

SEQ ID NO: 7835 - protein, 716 aa, Chlamydia trachomatis
MPFSHLSLIALAVSSILTQPTYANTIADDSIEKITVSGDQYNQYKPSSTNVASKLGILAKETPQAISVVGQQQIKDFALSNMNDVLNNTAAINVEQIETDRTYYNARGFAVNNIQIDGLGLPLINDNTHGQMDMALYDQVEIVRGANGIMTGAGSPSATISLKRKRPTTDLMVNFSTTFGSWDKQRFESDISGAITDSLRARAVLSQDKSESYLDRYSTNSQLVYGVLDYAFNADTLITFGHSEHSNQSKGNLWGALTLYYGDGTATDYAINTNTSANWSRWDVNESRSFIDFSHNISPDWQLRLMYNRVRTDEDSELFYTYLTDSAVGLDPKTGLGLTGYASEYDINDKQDMFDAYVSGSFNAFGRAHELVAGASYARLDYIDVSLYDFHTGNGFPTMPRIEDFTGNTPYPEFIDGLTGGQVENTQTSAYLSARFNLADGLHLLTGMRYNRWQTQGESYNKPQLRDDDKVVPYLGLTYVLTDAITAYSSYTETFMSQKERDANWDLIAPLTGQATEVGIKADLFDGDALLTAAWFDIKQVNLAVPAAKAPNPVTGIEEDVYKAADGISSKGIEFEVAGKLSDTLNGVVGLTDFAIDGDEQVSAYTVKRSVDISLTWSPTLLDGLRFGVNAKWQEAIWRNQGVVSALYANAGQEIITHQPAVTRINLMASYDINKHLALAFNANNITNKKYLNSLQWAQGFYAPPQHYSVSLNWAF

SEQ ID NO: 7836 - protein, 1749 aa, Chlamydia trachomatis
MKWLSATAVFAAVLPSVSGFCFPEPKELNFSRVGTSSSTTFTETVGEAGAEYIVSSNASFTKFTNIPTTNTTTPTNSNSSSSNRETASVSKDSDSTTTTPDPKGGGAFYNAHSGVLSFMTRSGTEGSLTLSEIKMTGEGGAIFSQGELLFTDLTGLTIQNNLSQLSGGAIFGGSTISLSGITKATFSSNSAEVPAPVKKPTKPEAQTAGETSGSSSSSGNDSVSSSSSSKAEPAAANLQSHFICATATPAAQTDTETSTPSHKPGSGGAIYAKGDLTIADSQKVLFSINKATKDGGAIFAEKDVSFENITSLKVQTNGAEEKGGAIYAKGDLSIQSSKQSLFNSNYSKQGGGALYVEGDINFQDLEEIRIKYNKAGTFKTKKITLPSKAQASAGNADAWASSSPQSSSGATTVSDSGDSSSGSNSDTSKTVPVTAKGGGLYTDKNLSITNITGIIEIANNKATDVGGGAYVKGTLTCKNSHRLQFLKNSSDKQGGGIYGEDNITLSNLTGKTLFQENTAKKEGGGLFIKGTDKALTMTGLDSFCLINNTSEKHGGGAFVTKEISQTYTSDVETIPGITPVHGETVITGNKSTGGNGGGVCTKRLALSNLQSISISGNSAAENGGGAYTCPDSFPTADTAEQPAAASAATSTPESDPVASTALSTPSSSTVSSLTLLAASSQASPATSNEKTQDPNADTDLLIDYVVDTTISKNTAKKGGGIYAKKAKMSRIDQLNISENSATEIGGGICCKKSLKLDALVSLSVTENLVGKEGGGLHAKTVNISNLKSGFSFSNNKANSSSTGVATTASAPAAAAASLQAAAAAAPSSPATPTYSGVVGGAIYGEQVTFSQCSGTCQFSGNQAIDNNPSQSSLNVQGGAIYAKTSLSIRSSDAGTSYIFSGNSVSTGKSQTTGQIAGGAIYSPTVTLNCPATFSNNTASMATPKTSSSSGNSIKDTIGGAIAGTAITLSGVSRFSGNTADLGAAIGTLANANTPRATSGSQNSITEKITLKNSSFIFERNQANKRGAIYSPSVSIKGNNITFNQNTSTHDGSAIYFTKDAKIESLGSVLFTGNKVTATQASSATSGQNTNTANYGAAIFGDPGTTQSPQTDAILTLLASSGNITFSNNSLQNNQGGTPASKFCSIAGYVKLSLQATKGKTISFFDCVHTSTKKTGSTQNVYETLDINKKENSKPYTGTIVFSSELHENKSYIPQNAILHNGTLVLKEKTELHVVSFEQKEGSKLIMEPGAVLSNQNIANGALAINGLTIDLSSMGTPQAGEIFSPPELRIVATTSSASGRSGVSRSIPTNPKGISAAAPSGSAATTPTMSENKVFLTGDLTLIDPNGNFYQNPMLGSDLDVPLIKLPTNTSDVQVYDLTLSGDLFPQKGYMGTWTLNSNPQTGKLQARWTFDTYRRWVYIPRDNHFYANSILGSQNSMIVVKQGLINNMLNNARFDDIAYNNFWVSGVGTFLAQQGTPLSEEFSYYSRGTSVAIDAKPRQDFILGAAFSKMVGKTKAIKKMHNYFHKGSEYSYQASVYGGKFLYFLLNKQHGWALPFLIQGVVSYGHIKHDTTILYPSIHERNKGDWEDLGWLADLRISMDLKEPSKDSSKRITVYGELEYSSIRQKQFTEIDYDPRHFDDCAYRNLSLPVGCAVEGAIMNCNILMYNKLALAYMPSIYRNNPVCKYRVLSSNEAGQVICGVPTRTSARAEYSTQLYLGPFWTLYGNYTIDVGMYTLSQMTSCGARMIF

SEQ ID NO: 7837 - protein, 1774 aa, Chlamydia trachomatis
MKFLSATAVFAAVLSSVTEASSIQDQIKNTDCNVSKVGYSTSQAFTDMMLADNTEYRAADSVSFYDFSTSSGLPRKHLSSSSEASPTTEGVSSSSSGENTENSQDSAPSSGETDKKTEEELDNGGIIYAREKLTISESQDSLSNQSIELHDNSFFFGEGEVIFDHRVALKNGGAIYGEKEVVFENIKSLLVKVNIAVEKGGSVYAKERVSLENVTEATFSSNGGEQGGGGIYSEQDMLISDCNNVHFQGNAAGATAVKQCLDEEMIVLLTECVDSLSEDTLDSTPETEQTKSNGNQDGSSETEDTQVSESPESTPSPDDVLGKGGGIYTEKSLTITGITGTIDFVSNIATDSGAGVFTKENLSCTNTNSLQFLKNSAGQHGGGAYVTQTMSVTNTTSESITTPPLVGEVIFSENTAKGHGGGICTNKLSLSNLKTVTLTKNSAKESGGAIFTDLASIPTTDTPESSTPSSSSPASTPEVVASAKINRFFASTAEPAAPSLTEAESDQTDQTETSDTNSDIDVSIENILNVAINQNTSAKKGGAIYGKKAKLSRINNLELSGNSSQDVGGGLCLTESVEFDAIGSLLSHYNSAAKEGGAIHSKTVTLSNLKSTFTFADNTVKAIVESTPEAPEEIPPVEGEESTATENPNSNTEGSSANTNLEGSQGDTADTGTGVVNNESQDTSDTGNAESGEQLQDSTQSNEENTLPNSSIDQSNENTDESSDSHTEEITDESVSSSSKSGSSTPQDGGAASSGAPSGDQSISANACLAKSYAASTDSSPVSNSSGSDVTASSDNPDSSSSGDSAGDSEGPTEPEAGSTTETPTLIGGGAIYGETVKIENFSGQGIFSGNKAIDNTTEGSSSKSDVLGGAVYAKTLFNLDSGSSRRTVTFSGNTVSSQSTTGQVAGGAIYSPTVTIATPVVFSKNSATNNANNATDTQRKDTFGGAIGATSAVSLSGGAHFLENVADLGSAIGLVPDTQNTETVKLESGSYYFEKNKALKRATIYAPVVSIKAYTATFNQNRSLEEGSAIYFTKEASIESLGSVLFTGNLVTPTLSTTTEGTPATTSGDVTKYGAAIFGQIASSNGSQTDNLPLKLIASGGNICFRNNEYRPTSSDTGTSTFCSIAGDVKLTMQAAKGKTISFFDAIRTSTKKTGTQATAYDTLDINKSEDSETVNSAFTGTILFSSELHENKSYIPQNVVLHSGSLVLKPNTELHVISFEQKEGSSLVMTPGSVLSNQTVADGALVINNMTIDLSSVEKNGIAEGNIFTPPELRIIDTTTSGSGGTPSTDSESNQNSDDTKEQNNNDASNQGESANGSSSPAVAAAHTSRTRNFAAAATATPTTTPTATTTTSNQVILGGEIKLIDPNGTFFQNPALRSDQQISLLVLPTDSSKMQAQKIVLTGDIAPQKGYTGTLTLDPDQLQNGTISALWKFDSYRQWAYVPRDNHFYANSILGSQMSMVTVKQGLLNDKMNLARFDEVSYNNLWISGLGTMLSQVGTPTSEEFTYYSRGASVALDAKPAHDVIVGAAFSKMIGKTKSLKRENNYTHKGSEYSYQASVYGGKPFHFVINKKTEKSLPLLLQGVISYGYIKHDTVTHYPTIRERNQGEWEDLGWLTALRVSSVLRTPAQGDTKRITVYGELEYSSIRQKQFTETEYDPRYFDNCTYRNLAIPMGLAFEGELSGNDILMYNRFSVAYMPSIYRNSPTCKYQVLSSGEGGEIICGVPTRNSARGEYSTQLYPGPLWTLYGSYTIEADAHTLAHMMNCGARMTF

SEQ ID NO: 7838 - protein, 358 aa, Actinobacillus pleuropneumoniae
MKKTLVALAVTAFAASASAVTVYDAEGTKVQIDGSLRLVLEQASSKTKYANGKTAKNKNAHSQLRNAGSRFGVRVNHDLGNDFYALGRLEIRFDKNNSDDQFGDLYAKRAYVGLGSKQYGEVTFGRQLTIADDYGQTDDYEYGIVPSYIATSGNQVIRYDYKGIEGLQIGANYNFAEKRNARGEVSVNELKNAYGLGAVYETQLGGNTFNVEGGIGRSNYATGTNHKHYQDGYELALGYAIGDFKLVSDFGYKYEKNGAARTKAFFVAPGFQYQVIPASRIYGNYLYERAETTVDEKDAAKAKKHGFLLGVDYQLHKQVVAFVEGKYVQSKDYIAGNGYKYTGKEIDKAIGVGMRVFW

SEQ ID NO: 7839 - protein, 581 aa, Actinobacillus pleuropneumoniae
MFNIVCKSLFIAPVLLGVNVLMAQVVSASPVAGDVETQQEADDNSSITQVTSVSQLSDVQPTDWAFQALQSLVERYGCIAGYPDSSFRGNRAITRYEFAAGLNACLNRINELIGTSTADLVTKEDLATLQRLQEEFAEGLAELRGRVDGLEGRTAILESQQFSTTTKLNAEVILTVGSVFGGDRALNSDQWRTINAQPAGTARENAKNSAYGAAGRNLQDNAILSDRVRLNLVSSFTGKDRLFARLEANNTTAFNAPVTGTNMSRLGWDATGNLDNSVQLGKLFYRFPVGDKLNIIIDAIGGEFYDNFNTINPLLASAPTGAVSRFGRFSPIYRASNTGSASNTGSGISAIFQLSNAVTFSAGYLARRGSEPTPGRGLFDGSYGALAQLEFQPNTNLTLGLSYAHSYFSGEAGDVTVSGAYGSAFANTPFGSAVSTSANYYGLQTSYRFNPQFIVSGWVGYTQAIAEASSGTTVNRGDQADIWNWAVTLAFPDLGKKGNLGGLIFGQPPRVTSNDFGPANLTATSARREDTDTSFHVEALYRYQLNNNISITPGLIVIFNPENNSNNDTIYTGVVRTTFRF

SEQ ID NO: 7840 - protein, 809 aa, Actinobacillus pleuropneumoniae
MNHTARKRQGWQRSVSQKLAGAVVQGIACMGASAPLLLMPAWATAAAQAQADFDIPAGPLAPALAHFGQSAHILLSYPTALTEGRSTSGLAGRFDIDQGLAILLAGTGLEASRGANASYSLQASASTGALELSAVSISGKAPGSTTEGTGLYTTYSSSSSTRLNLTPRETPQSLTVMTRQRLDDQRLTNLTDALEATPGITVVRDGLGSESDSYWSRGFAIQNYEVDGVPTSTRLDNYSQSMAMFDRVEIVRGATGLISGMGNPSATINLIRKRPTAEAQASITGEAGNWDRYGTGFDVSGPLTETGNIRGRFVADYKTEKAWIDRYNQQSQLMYGITEFDLSEDTLLTVGFSYLRSDIDSPLRSGLPTRFSTGERTNLKRSLNAAPDWSYNDHEQTSFFTSIEQQLGNGWSGKIELTHAENKFDELFNFAMGELNPDGSGLSQLPVRFSGTPRQDNLDLYATGPFSLFGREHELITGMTLSQYRENTPSWGGWRYDYAGSPAGAIDNLFNWDGKSAKPAFVESGKSSIDEDQYAAYLTSRFSVTDDLSLILGSRLINWKRDTSDRPYGGEETEVNREENGVFIPYAGVGYDLDDTWSLYASYTKIFNPQGAWVTDESNKPLDPMEGVGYELGIKGTHLNGKLNSSLAVFKLEQDNLAIWQHDNVYSAEQDTTSKGIELELNGELAEGWQASAGYSYSVTTDADDQRINTNLPRNSFKTFTSYRLHGPLDKITIGGGVNWQSKVGADLHTFSQGSYAVTNLMARYDINQHLSASVNLNNVFDREYYSQSGLYGVYGTPRNVMTSFKYSF

SEQ ID NO: 7841 - protein, 426 aa, Actinobacillus pleuropneumoniae
MIVIFRRASLVLSALYCACQTAQAAFIHDGSGSLELRNFYFDRDFHGDSATQSRRGEWAQGFMLRLQSGYTDGVVGFGLDAAGMLGLKLDSSPDRSGSGLLPRGSDKRAADDYAKAVATFKARLAQSELKAGGLSPQLPLLASNSSRLFPQWFNGVQLVSKDLDRFTFTLLQVDATKLRDSTDYEDLTAMAQQGAYSATVTSDRLRYAGVDYQPLNNLTLSLHTSVLEDLFRRDFAGFKFKTRLGPGDVFTEWRWFNAREQGRALLGGVDNQTLSTNFGYSVQGHTFSGGYQKVRGDTAYAYVGGTDTYLFSEQQVSTFALANERAWMLRYDYNFAAVGIPGLTFNVRYVKGDQVDPQRIASVKGRALAAGDGEGREWERTTDITYVVQSGALRNVSLRWRNASMRSNFADAADENRVIVGYTFEF

SEQ ID NO: 7842 - protein, 700 aa, Actinobacillus pleuropneumoniae
MRFSMPAPFRLTPVTLGLSAFLSSGFAYSATELPATSISAEAQADDPRVKVSNTATRTSTPVRYVPQAIDSIKTANFANYGTNDLGDALSGMPNVSSGGDTRFDSLRIRGFDASNDFYLDGIRDDSQYKRDLHNIERVEVLKGPAAVLYGRGSQGGIVNRVSKAPEFGRRSTIEAQGGSEDLRSLYADLSTDPSDNISLRLNMGNMDENSFRDGVSGNRQLFAPSMSWQLTPDLNWLVQYEYSRYNRTPDRGIPGVGGRPADVGRDTTYGNDHDFIDDKTQSLRSKLSYEINDNWQLRHTLGVFKLDSDFDNTYLTGYTPTTKKVTRQHWQQDLTTRNVFNNVELEGGFETFGLEHRLLTGLETGSQRRDPTLYNAATSGRGSSAVPSLDLYTPNRDLRHTGRMQVSSSSHTEVESRAVYVQDQLRLNDQWQLLAGLRYDTFDIESTNKLRNISEDRDSHSTSPRFGVVWTPLQNHSFYASWTKTFSPVGGGLIGITPGAAGNTNDLSPELTKQKEIGVKSDWLDDRLSTTLAIYELELYNRRTTDPNDPTLTVLSGLQRSRGIELTGTGKIVGNWYLRGGVGVQDATIEKDNNGLEGKRVNNVAKRNGSLFLTWKPEMGWYAETGLTLVGQRYADNANTTVLPGYGRWDALVGYRHKDWDLRGALNNITDREYYSSATSAFQIQPGAPRSLVVTGTYSF

SEQ ID NO: 7843 - protein, 368 aa, Actinobacillus pleuropneumoniae
MKKSLVALAVLSAAAVAQAAPQQNTFYAGAKVGWATFHEGVRQFNDKYSNDARYNQDTTNLGINRNSVAYGVFGGYQILNQNNFGLATELGYDYYGRVRGNDGEFRAMKHSAHGLNLALKPSYEVLPNLDVYGKVGVAVVRNDYKEYDKEEPTEKTHKLKASTILGAGVEYAILPEVAARVEYQYLNKAGNLNKALVRSGTQDVDFQYAPDIHSVTAGLSYRFGQGAVAPVVEPEVVTKNFAFSSDVLFDFGKSSLKPAAATALDAANTEIANLGLATPAIQVNGYTDRIGKEASNLKLSQRRAETVANYLVSKGQNPANVTAVGYGEANPVTGATCDAVKGRKALIACLAPDRRVEVQVQGAKNVAM

SEQ ID NO: 7844 - protein, 376 aa, Actinobacillus pleuropneumoniae
MKKTALALFASAFMASSASAVELFNLDSTGTKAEFIGSARLKWTSTSAKDTYQNGAAVRNHVNKPVQNNGSRFGFRLTQQLGSGVYALGRVEWRLRGADERGVSSSQHDLDHIYAHQLYAGLGHKQYGEVTYGNQTVITDEVKQTDIPNTLSLSDGLLVSGARRSVQYVYKGIEGLKVGAYYGGHNQRSNTNMDLSQDRKDVWGFGSIYNHKFDDVQSVQVATGFSRERFERIGSAPAYDRNAYSVGAAYTYDKTTFGVDLERRKTENQSVQGNERTEKEVRTLVYHRLTDDWRAYGMYAYKTNRLERAIGRDNNEKKHQFMVGTEYYLPKVVDQLKTKLFVEWQATRTKHPEAKVARGVNKSRDYTTVVGFRAYW

SEQ ID NO: 7845 - protein, 935 aa, Actinobacillus pleuropneumoniae
MKNKLNLISLALLSLFAVQSYAEQAVQLNDVYVTGTKKKAHKKENEVTGLGKVVKTPDTLSKEQVLGIRDLTRYDPGISVVEQGRGATTGYSIRGVDRNRVGLALDGLPQIQSYVSQYSRSSSGAINEIEYENLRSIQISKGASSSEFGSGSLGGSVQFRTKEVSDIIKPGQSWGLDTKSAYSSKNQQWLNSLAFAGTHNGFDALVIYTHRDGKETKAHKNAESRSQNITRVGVETNELDTSNRYTATTNNQHTYGWFLIKDECPTLDCTPKQMARVTKDTPSFRSYPEYTPEEKQAYENQKHITERLNAQDYTGEYRALPDPLKYKSDSWLVKLGYTFSPKHYVAGTYEHSKQRYDTRDMTYTAYWQPSDLLRTGRNWYPMNNAKGLYRDNALDGVAIDYFTEDGVKSSKGLRWAKARFIDEWHTRDRLGALYRYTNQDGNRLIDRLSLSFDQQKINLSTRLRENNCSEYPTIDKNCRATLDKLWSSTKNEQSSYEEKHDTIQLSLDKTVQTGLGKHQLNMLLGSDRFNSTLKRHEILSEFSVGSWGLVRDIGYRNGSYNNPYVYELKDQAIYSKNECDYSGTIAGRADCATSKIKGHNHYIALRDNFAITKYLDIGLGYRFDKHKFRSTHRWANQGDYKNSAWNIGIVAKPTSFLSLSYRASSGFRVPSFQELFGLRYDGAMKGSSDAYQKTEKLSPEKSLNQEVAATFKGDFGVVEVSYFKNDYKQLIAPAERMHQTQSMINYFNVQDIKLDGINLIGKLDWNGVFDKIPEGIYTTLAYSKMRVKEVKNYQGYMNIRSPLLDTIQPARYVVGVGYDQPDEKWGVNLTMTHSSGKNPNELRGNEQVGFANYERTATKKRTRSWHTFDLTGYITPWKHTTVRAGVYNLMNYRYTTWESVRQSSLNAIHQHTNVKDYARYAAPGRNYVVSFEMKF

SEQ ID NO: 7846 - protein, 932 aa, Actinobacillus pleuropneumoniae
MLEKYYFNKSCIAIAISTFLSTSVAYADSLESPHSGIKLSDEISSKYSGKGVKLGVLDGGFVVQHPLNSSKLHPSSFKLTSPDGKVLTYDPSYLQFEVKPVEQNGKKDLTALFETHGLGVSGVISAKASKKDGFKGGVAKDAEIHIATNTPNRSLAELIAEAQQSESEDEGQGDSKNQKPNFDELAKDDLLLTKEKRLSFERLEWATALNKLVERNLFAINNSWNLDPISDNIADFDKLYHSLSTDKQNSLLQAVLNAKRKNTLLVFAAGNESKKQVGVMAMLPRYLPELEKHYLSVVAVDNKNNLAEYSNHCGVSKNWCVAAPGNLAILNAIPDNKLKPQYSLDKEEGTSLATPVVTGALAILKERFNYLVPTQIRDTLLTTATDLGEKGVDDKYGWGVINIAKAINGPSQFLNDETVNVTRDDRWKNDFSSKFKFTKQGEKSLDLAGKNNIARIDVEQGRLNLSGMTQSKQVKNNAHLGVNQTEIRQGYMATENSQLTLLDSNGLIGKDKAIIQLNGSLKIADKLTENSKQGSISATVVKLHDKASYQGGFTKLIDNKNLANKGLMQDLYFKQSEIIAKVNSNKAFTDPNASDNAKSGLSLLNQLRTSSFAYRQGVYNDWLQSALEQKKLGQLHYAVSNHIYADALALLRHQNAKQLSHVQHNLFTAAYSPQKTSVWLEHSGQKHSKVAIKQNSSTLGLSHKFNDNALLSATLMRKNHHMDKDFAHADLKQTSLNIGLRYPLADHWFSELALQFGQQKYNQRRWYKKSQLGQAQNKGHHMGGEIRVGYQFMPQTWIIEPSLGVQFIQTRMKALNEKGELAINTTALHYNDINLTPSVKLKYTVKFEQGSISPYVGLNYLHRVKGKESKITSQLNGYPLQSYATQKRNHALNLEAGMQFQYKNWFVSANVDYDRIKSTNAFGWKTNIGLTF

SEQ ID NO: 7847 - protein, 364 aa, Actinobacillus pleuropneumoniae
MKKSLVALTVLSAAAVAQAAPQQNTFYAGAKAGWASFHDGIEQLDSAKNTDRGTKYGINRNSVTYGVFGGYQILNQDKLGLAAELGYDYFGRVRGSEKPNGKADKKTFRHAAHGATIALKPSYEVLPDLDVYGKVGIALVNNTYKTFNAAQEKVKTRRFQSSLILGAGVEYAILPELAARVEYQWLNNAGKASYSTLNRMGATDYRSDISSVSAGLSYRFGQGAVPVAAPAVETKNFAFSSDVLFAFGKSNLKPAAATALDAMQTEINNAGLSNAAIQVNGYTDRIGKEASNLKLSQRRAETVANYIVSKGALAANVTAVGYGEANPVTGATCDKVKGRKALIACLAPDRRVEVQVQGTKEVTM

SEQ ID NO: 7848 - protein, 690 aa, Actinobacillus pleuropneumoniae
  misc_feature (112)..(112): Xaa can be any naturally occurring amino acid
  misc_feature (114)..(114): Xaa can be any naturally occurring amino acid
  misc_feature (126)..(126): Xaa can be any naturally occurring amino acid
  misc_feature (129)..(129): Xaa can be any naturally occurring amino acid
  misc_feature (132)..(132): Xaa can be any naturally occurring amino acid
  misc_feature (409)..(409): Xaa can be any naturally occurring amino acid
MKKTFFYSTVASAVALAISPAIAQETAVLDEVSVVSSGSMYKMGEVPVHQAKSAVAISREDLDKQDVKKADEIGRYQAGFANQAFGNDTNTNWFRVRGAEVSQAVDGLPTFXYXFFTPYVETFGLXAVXVTXGAYSMTSGAANSCGLINYVTNVRTQIKLVAVNFKRISAAIICTASVRIIPAKLPMMKMFAIVSPTDGEWKDTDNKTVYIAPSLEWDISERTRLSILTSYQKDSGTPSSNFYPQEGTLRALPDGSYYSRNLNFGDPLNDHEENKQYGIGYELSHDFGNGLRANSSYRYNHVENNHRGGYIYPSAYAADWSAVAPSANGYNVSGQTVFNQGKAISHSTDNRISWDFKNDWLKNTVVVGTDYRHNKVDAQYSLYALGYTANLRDYRASWNQTGTPVGTDXHIKSRQLGFYLQNQARIADKYLLGFGIRHDRARQNEYTSDQTIKNNHTSYSGSLMYEGAYGLNPYFSYSESFRLPVGLSGNQSLYDPNITRQYELGVKYLPTWLDGVITLAGFRAKDTGALVNNGTGATISSADPIYRKGFELQADVNLTENWNATLAYTYTKAESEAATGEKTRQSLIPTNTLAARTAYNFTDGVLNGLTVGAGVRYLGHSVTSKGSLYSHARVPSATVVDLMARYNINQNWSAQLNVDNVGNRKYVAACDYYCYYGAERKVNATVSYKF

SEQ ID NO: 7849 - protein, 1655 aa, Rickettsia rickettsii
MAQKPNFLKKLISAGLVTASTATIVASFAGSAMGAAIQQNRTTNAVATTVDGVGFDQTAVPANVAVPLNAVITAGVNKGITLNTPAGSFNGLFLNTANNLDVTVREDTTLGFITNVVNNANHFNLMLNAGKTLTITGQGITNVQAAATKNANNVVAQVNNGAAIDNNDLQGVGRIDCGAAASTLVFNLANPTTQKAPLILGDNAVIVNGANGTLNVTNGFIKVSSKSFATVNVINIGDGQGIMFNTDADNVNTLNLQANGATITFNGTDGTGRLVLLSKNAAATDFNVTGSLGGNLKGIIEFNTVAVNGQLKANAGANAAVIGTNNGAGRAAGFVVSVDNGKVATIDGQVYAKDMVIQSANAVGQVNFRHIVDVGTDGTTAFKTAASKVAITQNSNFGTTDFGNLAAQIIVPNTMTLNGNFTGDASNPGNTAGVITFDANGTLASASADANVAVTNNITAIEASGAGVVQLSGTHAAELRLGNAGSVFKLADGTVINGKVNQTALVGGALAAGTITLDGSATITGDIGNAGGAAALQGITLANDATKTLTLGGANIIGANGGTINFQANGGTIKLTSTQNNIVVDFDLAIATDQTGVVDASSLTNAQTLTINGKIGTVGANNKTLGQFNIGSSKTVLSDGDVAINELVIGNNGAVQFAHNTYLITRTTNAAGQGKIIFNPVVNNNTTLATGTNLGSATNPLAEINFGSKGAANVDTVLNVGKGVNLYATNITTTDANVGSFIFNAGGTNIVSGTVGGQQGNKFNTVALDNGTTVKFLGNATFNGNTTIAANSTLQIGGNYTADFVASADGTGIVEFVNTGPITVTLNKQAAPVNALKQITVSGPGNVVINEIGNAGNYHGAVTDTIAFENSSLGAVVFLPRGIPFNDAGNRIPLTIKSTVGNKTATGFDVPSVIVLGVDSVIADGQVIGDQNNIVGLGLGSDNDIIVNATTLYAGIGTINNNQGTVTLSGGIPNTPGTVYGLGTGIGASKFKQVTFTTDYNNLGNIIATNATINDGVTVTTGGIAGIGFDGKITLGSVNGNGNVRFVDGILSHSTSMIGTTKANNGTVTYLGNAFVGNIGDSDTPVASVRFTGSDGGAGLQGNIYSQVIDFGTYNLGISNSNVILGGGTTAINGKINLRTNTLTFASGTSTWGNNTSIETTLTLANGNIGNIVILEGAQVNATTTGTTTIKVQDNANANFSGTQTYTLIQGGARFNGTLGGPNFVVTGSNRFVNYGLIRAANQDYVITRTNNAENVVTNDIANSSFGGAPGVGQNVTTFVNATNTAAYNNLLLAKNSANSANFVGAIVTDTSAAITNAQLDVAKDIQAQLGNRLGALRYLGTPETAEMAGPEAGAIPAAVAAGDEAVDNVAYGIWAKPFYTDAHQSKKGGLAGYKAKTTGVVIGLDTLANDNLMIGAAIGITKTDIKHQDYKKGDKTDVNGFSFSLYGAQQLVKNFFAQGSAIFSLNQVKNKSQRYFFDANGNMSKQIAAGHYDNMTFGGNLTVGYDYNAMQGVLVTPMAGLSYLKSSDENYKETGTTVANKQVNSKFSDRTDLIVGAKVAGSTMNITDLAVYPEVHAFVVHKVTGRLSKTQSVLDGQVTPCISQPDRTAKTSYNLGLSASIRSDAKMEYGIGYDAQISSKYTAHQGTLKVRVNF

SEQ ID NO: 7850 - protein, 606 aa, Rickettsia rickettsii
MNVFHFVTSSLLVPFALSPLSIAVAQESTGATLDPIVVTATLGPKTVGESLASVTVIDEEEIRSKAPADFADLLRGQPGINVVGNGSFGKSTSVFIRGVQNAGTVLLIDGVKLHSATGGGASWQYVPTDLIQRVEVVRGPRSSLYGADAMGGVVQAFSLDPEQGQRGWVEAGAGNFDTQKVSAGGSGSVGNTTFSLSGLHKESDGTAIIENGEDKGFRNTAGLGRVVHTLDNGGEASIMLLQSEGNTEYEGGNIDYLIRTVGFGLMTPLTDSWRMGIQFAESRDETESFTNFGDSIYNTRLRQARWENTLSFNVHELVVGAERQQDEVSSSQNYSETSRTNTAVFSQLRLNFGPVDTQLSLRGDDNEAYGTNKTGGLALGYSFDRSHRVRASYGTAFRAPTFNDLYWPLSFNYQGNPDLEPEKSDSYELGVSGNYQVWFWDLAVYQMNIENLISSGQIGTVDTRVNVDEARIRGAELGGGYKHDGWRAAVALTYMDPEDRNTKNQLARRAKQTARFDLDKTINNVVLGGSVIVEGDRYDNAANTEQLAGFGTLDIRAGWSFSSNWSTRLTLVNALDKEYSTAERFDGVKYISAGRTAMLSVRYDIQ

SEQ ID NO: 7851 - protein, 258 aa, Rickettsia rickettsii
MLILISPAKTLDYQSPLTTTRYTLPELLDNSQQLIHEARKLTPPQISTLMRISDKLAGINAARFHDWQPDFTPANARQAILAFKGDVYTGLQAETFSEDDFDFAQQHLRMLSGLYGVLRPLDLMQPYRLEMGIRLENARGKDLYQFWGDIITNKLNEALAAQGDNVVINLASDEYFKSVKPKKLNAEIIKPVFLDEKNGKFKIISFYAKKARGLMSRFIIENRLTKPEQLTGFNSEGYFFDEDSSSNGELVFKRYEQR

SEQ ID NO: 7852 - protein, 1866 aa, Rickettsia rickettsii
MNKLTEQHLLKKSRFLKYSLLASIAVGAAIPFEGMAMSKEAFRIDLSNKLLNHVSQLKGHKDTTNTPQQIGTVIVPEPEINTYTPSEIREMKISNKPKASNPLKDVPIEDHYKVVARSKSDVGKARKVRPITRRKTFAGIEKTKQSQNTYTPESTEQMPQKPEIIITASSPTVSPASNSFITAPNTPNTTLISPEHYTTAPGTPSSTPVTPYQPTSDSKPNDSLGANTPPNTNSKAARRLSFSSSDPQQQAVQSSSQVKSEVPPKPTFVPLPIKKGSTEIVAGMVSNISRVNEMIGIKLAEVTQAIKDTTGKKDKERLQKLYRQLTSTQKTTEVLKSRAEEIETKIKIGKNKDKIKKLEKELTSKNNKADRLFQKIEKIDIPANKVSIKSQETVPVTTASTEVSAFQAQQARINEARQSIFNKNKSSGDNARKSNAGTKREKKKQEAQKQLSEIKKQEKAVKTASDKAKEVAASAKEETSRTALRAMQDKMNGDSEQLNKIEENLKLLTPVVYNSSTGPTYKQSPKAKPTIPLSHGVQRILGEQPEDEEGYLVPIKVQQQPYTVMLPNQEIEDPIPSHSKDIYEAKVSQYINYLNRIQPNQSNQAQIDSVIDSLATEMRKFSADQFSQKLDEIAHLAGIKAYEGLFEKLYEIQQARIPETQKVYEQAEISQSYAEYEENSRKSSTPVLSPSSSAKSVISSNFEEKSALLQTTTTDESLRSDNNWKNSAPYSSSPTLNKRGLEYLDLAGDAFVQNLKQSDTLTIETLDLITPTQNTTVAKSDSSRKNNVSGSIPEIQQLQSEKMRTETLGVQDDLGLDLHYAPQETLTEESTYLVSSKKKQGNIIKRAVSKVESILHTNYSENRKRKRDGETSKQRTVDQEGEFGHAWGNENHKESSLSVVSGFTKKATQLISLLDAKRTAILQTTSPSQRKSLSLVLQEIENDYREAIKISQELQQVLIRKPEDIKAYNAKAEKKLDAIKSRADKHFDNIETDVDIGFNPNGGNSHSMPTANMDSLPKNLAVTPPINVGSLYNSPQAQQFREDHKNIIINDRSQGRLNLVDSTITKGTQPLSNLSTIYESVSDENLASETIYKTEQPKPSISYTNTSKRKLPIPLFRSAELDKKLEYLDLEDKLLEVEEARIVKEKQAIAKLNQYQDPENLEFKRLAMEALDLSLKESQLKAKRKAIGAEFSLNEKSSSTDVSIRSYSIDDISSVLSGAESNLSRSPSVSGLEDLNNMQLGELKSKKELELDTLNKEKIWLDLDTESKPKVTESKPVFSCSSSVGSINSFSNDDLSSRDVVAPVDTLNIEINKDYVDTYIRVLSNKIQKIEELSGSSSRSEELNHIKEAMAYISNRIQDVEELDEKMLLVINSQLQEHDEKISSLLREEATDILAQLLLQEMLVSDGKSESTLPAGDEEQEDTEVSRQLSSLPADGKSESTLPAGDEEQEDTEVSRQLSSLPALASSNESALALSDDREKECLALGDGSEDEESYDSGFEEEEETIGQLSDSDGGNLKITEVDKVIPLEQEAKKEMQMQISENAPTLNQAKVVNTIVNNMIRNRLDVNMSNNMAVGAGDEEESHIKRGLWMRGMYGTNNHGRVENMTGYRGTNKGATIGFDAEIDNNIVGIAYSNVHSVFKFKNSKNNDKELINSHVVSIYGQKELPKNFALQALVSASKNFIKDKTTYSYGDTKIKSNVKHRNHSYNAEALLHYNYLLQGKLVITPNIGLRYGKSRDGVYNETGVNVQEIALTMKENNILSGIVGTKVTVPLKDALKFNNLGLTFQGAVEHNFKEKTQRINRVVKIFDNTFKHNYLIPKQPKTSYNLGTGIIGSIKNTTISLDYNYYLNKHYRSHQGSVKLKVNL

SEQ ID NO: 7853 - protein, 1860 aa, Rickettsia rickettsii
MNLQNSHSKKYVLTFFMSICLLTSSFLSTSARAANFKDLVSKTPTWEKYNLKQQQNIWDNLTPNEKIKKWQEADLVPSFTQAQDDLGINYKETDLSSFVDKTRHKARQARAKILLYIERIKQQDFDTKKQEYINQGVVPTYIEAATNLGISYDPSKIDNNVENDQKVRRTEKDKKAVIELYISLINRDIKYKHYVDNDIIPEMKEVRTALNMNKDDAESFVASIRTEIMENAKGQYIADSHIPTKKELKNRFGISRGDNRDDYIKSIRLKVMDKEKPQYIADNSIPTEKELEKKFGADKDEATNYIASIATQMMLGKKSYYIDNNIIPNADELMNEFKIEDIKANSYIHQIRAGIDAKQLLNNNDTTTKQSAGHSQKKSGSKHNWYMSNQGTHNTETSSGVSRTSSGIFTGRKEKQPYFFDPISTFKTHFNHKKNKGNLTQSQHNINRIIQQEENIEEFKNLIKTNPIAALNLEVDSSYKQEAVTTILSDFNDDTIQRVLFSNNTGQLDFNTNIDVKNRPILKKLENSSSEEKTKFTERIQDYATRNISNSQFEEKARLDLIKLAASKDKSSVENFLALQLELKNKMQPHIVKSTYILTPEIVKEINIELKNKGLIIDSLTKDDMIKLAKALNKQTLNSAIKVILSDSNILSNETNKILGLAVGNNANNLEQTQSGIPNPPPLPLNGGIPNPPPLPLNGGIPNPPPLPLNGSMPPPPPPLNSQDFSSNSNNFDLNKLQAEYPHIHSLYIQFTRNTTVQPKVPLQPTTPSATTSTDRSTPETAYAKLYAAYRTETGGKKAYDLQDQLIKRQADLTNVIRQILTESYANQGADAKTLVNLFSISTPEIAEKAKEAFNTLVQDPYIQDITVNGKKTTTSEEIIKNLFNEDTDDAVKRILLSSCKISGELKRPIKLEFNKSELIRELQSKQNPFKQLEFAYTNAQYFDQDIFGNRVEELINNPHILTTAQQATFLITEDTHLRKTINSDQAQAKLDDLRTAILSTIKFEELITANLPQHAFIAIVKEKKPELLQEFLNATTIKLTGNNNLDQLRLALPSFTGMSNEQIRILTRKLNMPIILKALHECSQEKAKKHIHTGNMPPPPPPLPLPDSQDLELAYLKSLGITKSNANTSTFKTTPKIYNFSSDIAVRYKEFALSGQKAAGHKAKYSDANLLKKAIVESVAFEHSKKLPKAHQNNKYFAKIQEAADTMHSSFIGPRTEIGQEVHNIYTSKLLELAKDKEFIKYVKDDIILSKKLTEAFTSVDSDFIDPRTKLEQKIHNIYTQQLTKYPEEAVKEAFNTANSDFIGPRTEIGQEVRNIYTSKLLELTKDKELFLFVAQLLVESTELEQKYGSDIQSENSNNDETIGRLDLKTLRLFQQKNETTNDESSTKDDTQPEDSNKKSEQSDSKTVLSPRLFCSNDSKNDKSSDDKKSLLALRSSDENDKGYETDESDDKKSLLVLRSSDEDDKGYETDESDDKKSLLALRSSDEDDKGYETDEEELEESNSITDEELKKDIVLESKDEAIDVSFKTEAITEQDEATQRQQVSDDTSRKVAILVKATSTLHKPVHYNILSDRLKVAAIGAGDEEASINRGVWISGLYGINTQETWKNIPKYQSCTTGITIGTDAEFINRHDVIGIAYSRLESLIKYNKKLGKTTVNGHLLSIYGLKELIKGFSLQAITSYGHNYIKNRSKSINNIIGKYQNNNLSFQTLLNYKYRTKYDLYFIPNIGFKYDYSRASNYKEYNVDIENLMIQKKSNQSFESSLGGKIVFKPIVTTNNIVLTPSLYGNIEHHFNNKNTKVNAKATFKGQTLQEKIIIPKQPKLGYNIGSNILMSRKNINVLLEYNYYTHKKYQSHQGLL

SEQ ID NO: 7854 - protein, 1047 aa, Acaryochloris marina
MTNILIAGRQSDPSISATFIKKVFRQQRLIMAMIISFLPFIAVAQETNLPQINSTLTGVVTDGKTKEPLMGAVVRIQGTTNQTSTDKNGAFRLLTGQRFPYTLNVSFIGYENVSLVVNQGPVNIALQESANQLSDVVVVGYGTQKKSDLTGAIASISENEFKKTPVTALDNGLRGRASGVQVTSTSNQPGGGTSIRIRGSNSVNTGSEPLYVIDGFPIYNDNNGFSSGAVSGPKTNALALINPNDIVSVEILKDASATAIYGSRGANGVVLVTTKKGQAGTDKVEFSSYVGTQKVGKTIPVLNATDFARLVNESNGSAIYSDAQIAGFGKGTDWQNEIFRTAPIQNYQLGVSGGDQKTKYAISLNYFDQQGIVINSGFKRYAARFNFEKKITDQLTVGATLTASRTGGNQVLSATGGGEGTIGVVAAALSFSPILSVYKPDGTYVLESDRGIAMGNPVATARELTNTSFTNRTLANVFAELKIVNGLSLRSSIGADLLSNKEKYYAPRTILAGYNVLGLGRTGSLNTSSWLNENTLAYTYAREKHSLNALVGFTVQKNNTENLIASASGFVNDNLKADNLGSGAVINSPVTNVTSFSLLSYLGRINYAYDNKYLLTLTLRADGSSKFGSNNKYGYFPSGSLAWKLSEEDFIRDLGVFSNLKLRGSYGRTGNQEIASFQSLAGLSGFSYIIGDKVVKGFAPGNIPNPDLKWETTSQSDIGLDMGFFNNRLNLTVDAYYKKTSDMLLYINVPWSTGYSSALQNIGSLENKGLELALNANIIDQGFKWNANFNISANKNKVLDLGSVSQILTGEINGYLKITDPIVIQPGEPLGSFFGYVSDGIFQNAAEVAASAQPTAVPGDRRYKDTNGDGKLDATDRQFLGTAQPKFFGGMSHDFSYKSFDLSLSFNWVSGNKILNSTRAELDLPTGQKNSSERVNGRWTSSNPGNDIPRANLNRAFLFSDAQLEGGSYLRLNTITLGYHLPSGLLKAVKVRNVKVYATALNLLTITDYTGYDPESNQSGQNNILRGIDSDAYPSAKTFLVGVNVGF

SEQ ID NO: 7855 - protein, 768 aa, Acaryochloris marina
MNTGNLRAKVLPITSLASTAPAKTALAIFMATYLASAYAADGQNASSTPQAKAGTLPTVMVEAGTVEEVNYTGKKASTSTKLDIDIKETPQSVSVITRKQIDDMGASNLGQLLLYTTGVVLTGDNSERTNFSIRGFNVGDGWNSNLLQYDGVPINASNVASSKPDMAMVETIEVLRGAAGLMQGSGEPSGTINIIRKKPTAELQANAAFTYGSWNTYRLEGDVSNSLNESGTVRGRLVGVSQDGDSYMTAVTREINLIYGIVSADLTENTLLNVGYKRQAEDSIAAHNLPRNPITGEDLELSRKNCSCNYGDYWDKENTDAFIDLSHQFDSGWSVKGAYVKANYQMDMMFTSLAPVSAAQFDPANPQGNVNKYAYQYDQNLDVADVFAKGPFTLFGREHQFVIGSNYQKSDNPGRWTSWDVVLEDYSLWNRVGTAPAPLLTVDLNTYNPYLLPYIPARYDQDGGRSYEERIQTGTYITTRLSLADPLNLILGVRQSDFEYDYQYKSNVTNQLVPSRGNHYEKNHITTPYVGLTYDLNNTYTLYASFTDTFVVQSARDINNNLLDPIQGNVYEAGIKGSFNDSRLMASLAAFRINQINRSIRDESSAGQCPQNGGDGYCNISAGKVISEGIEAELRGEVLPGLNMSLGYTYNTTEYEKDPANQGRVFNETTPEHIARVFATYLFANELTIGAGVNYQSEWLTGRYGAISARQEAYALVNIMASYPINETFTVSVNADNALDEKYYSYLSSTSNRYGEPRNMKVTLRATF

SEQ ID NO: 7856 - protein, 418 aa, Acaryochloris marina
MHSIMKPSLITLLVLSSQAQAAGFQLAEQSATGMGRAFAGEAAIADNASVLSRNAAAMTRFDTMAFSGGFIYVRPDVNIEGTTRVPTPKGPVSLDAAAHDIADDAWVPNAYLIVPLNDQWRLGLAATSYYGLGVKMPDNYNAGHFGNVSDIKTVDLGASLAYRVNRVWSVGAGLSAIQGEGEVGGTFPSNNQIAKHLKGDGWAMGWNLGTLLELSEATRIGLSYRHDVTLKLSGDAIGIDQNGQPFTDTGSLDLPLPATAELALFHQLTPALALHSSINWTNWSKFVQLESELDHHGVMHIKDEHWEDSWRYALGLTYQLAPQWQLRSGLAYDRSPVPADRRTISIPDSDRVWYSAGVGYQIDRNLSLDLGVTLIDGKKVEVSETMQLKPGIPQTTSTFQGTSEGDAWLAGLQLNYLF

SEQ ID NO: 7857 - protein, 824 aa, Acaryochloris marina
MTRKQARRERRSIAARPPPNGPDIGGAGSRSSEDFPAMPPTRFRFYFRLGIKCCSAATTWSPSNKSHKINKHTLAACKAAYVNAPCWFRGAGPRIGTTMSNAAQGRRPVTPGSAPLITGSRALLGLALFCPLSVQAQTVPPEGAEAVLSELSVTGTGERAGGPVVGYRATRSATATRTDTALRDTPQSIQVVPREVLVDQQNVRLTDALTNVSNVQPGGTIQGRSDTYILRGFRTQTYAIDGLVLNPANTFQPTQRDLANVERIEVLKGPASVLYGQGDPGGLINIVTRQPTLTPSADLTVQGGSFGFRRVQGSVSGAIPSVEGLAARFSFGTQNEATFRDFGGPENSRHFFAPAFVWTPDASTRVYLNAEFTRQHSQYDEGLIAFGGRVPLDNISRFYGEPWSRYYGESNSITLLAEHDVNENLTLRQAINGQWGSFNLLATRATGVNAAGTTVTRRLTEGDSIYHSIDSRTEALGRFIDPFGFRHTALAGFEIVDGFRHPFTTQGTATSVSFLNPIRGSVPQIGTLTLQSDLRQKLSLFGLYMQDQIEFFPGLQLVLGVRFDTADQLYFQRTPTTRTIPPEQNLTGVSPRVGLVWRPLEPLTLYGSYTTSFVPQTANVLNVASPPPETGEQVEVGARFDLIPDRLTVSAAAFRILRTNVAASDPVNTGFSIITGEQRSQGFEGDIVGEILPGWKVIGGIGYLDAEVTKDATIAIGNRLPAAPVFSASVWSTYQFQGGPLHGWGFGGGLTYVGERFGDITNTYKVGAYARLDATVFYEIDPTWRLAVNGRNLTDRRYIEQPFNQFNNQPGAPLTVLASLTARY

SEQ ID NO: 7858 - protein, 158 aa, Acaryochloris marina
MRDPNDQERIILTGLQRTDGIELSSRALLTDEFSLRGGIGLQDAKYVEADASEQGKRPTNVSRLNGELFVAYQSASDGWFGETGFVAVGDRYADRTNTTKLPGYARFDARLGYQWQAWRTQLSVENLLDKDYYLSATSSTQIQPGAPREFYLTASYQF

SEQ ID NO: 7859 - protein, 595 aa, Acaryochloris marina
MSKRVYKALVLTQSVLIVGSVGTYSAIAVELKSDQEMLSDASKDTIKKLDFAINYQLPDLDQSFAQVPVNPHNGFGVVQPDSVDRDSQTQLNQYFQEGRNSRKKQQVTSVSQLSDVQPTDWAFQALQSLVERYGCIAGYPDGTYKGNRALTRYEFAAGINACLERINELISASTTDLVTREDLAKLQRLMEEFAAELATIRGRVTVLEARAAELEANQFSTTTKLAGEVIFWISDTFGDRAQYTIAGGPNVEDSDDPTQAFFGYRVRLDFETSFTGEDLLLTRLQASDVNDLTSPGLTNTLMTIPSVDDGVSEGFELDDLFYVFPVLGGKGEVYFGAKSLDLDDVQDPLSPISEETTGVISAFARYNPTTFRGPQGTGAALKYAFNDQFKLNISYLANDAANPSEGFGLFNGAFSASAQFIYQPSDNLAFAVDYNRRYFNPDEVFVGGGTGSFIANKPFGDSATTSDNLGFQFNWRLFKNFEFGGWFGSTWADQKQGGDDRATVINWATTLAFPDLLKEGDMLGVVVGMPPKMIYHSIDDLEEDDDTSIHIETFYRFQINEYIGITPGFYLITDPEHDSRNDTIFVGVLRTLFQF

SEQ ID NO: 7860 - protein, 747 aa, Acaryochloris marina
MLTRPISLHRFRPHPWRRDQTMARVFLNVSNNVSRIYRDSLFVTTAIVLIGIAASPAASQSATDASATALEPIVIQGGAASDSKADRTSVAAKNSSAATKINTPLVETPRSVSVTTEKEIEQRGAQSIIEAVRYSAGVTTGPNGFDPRFDQIFIRGFNITTVGDYRDSLRQPYINYGMFRTDPYQLQRVEVIKGPVSVLYGSGSPGGLVNKISKLPTEEPIHEVGISYSTKDRAQAMFDFGGPISEGNDDFLYRIVGLARHGDNNFDIADDRYFLAPSFTWKPDEGTSFTLYGLAQSDETDANVGAITTVDGKILDIRQSDPDYDYQKVKQQQIGYQFEHEFDNGLTFRQNLRYSHLDLRARYLGVSSWTGTVAHRNASSIRDEMNVFQVDNQLEAKFDTGPLAHTMLFGLDYTNLQSNWGYGIGAVNSAFDFDIANPTYGVSGATPAYDFIVADADMRQVGVYALDQIEAGNWRFNLGGRQTWVNQTRDTTYPSFGLNDSEDVNKNAFSWQAGALYLFDNGIAPFVSYATSFDPVTNRSASGKILEPTEGEQYELGVKYQPPGTDILLSAVAYHIVEKNKPVLVNPLTLAYDSLGEVTGKGIELEARAAIADGLDIIAAYTYNHSEVTGGDNEGNTPAFTPAHVASLWANYTFQETNPFNGLSVGAGVRYVSENWTDTANTSKNPSSFYVDASAAYDFGAIDKNYEGLTAAFNIRNIADQRDTVCNEGFCYLGQGRNMTATLKYRW

SEQ ID NO: 7861 - protein, 330 aa, Acaryochloris marina
MSMIIAAPIFYSHAEPLEAIESISTSEEKEEADGIDIFDWPKKQDNQAAQEKRVIRLSEEEETQKPVEETYPTEEKRFQIGVSSTAIVQQILSGGEKRAFFPEGSLDLFCLYKPSDLTTLFLDLEAIGGNGPDEHADSLSGLNDDAGAFRYNNGTDRLSIREMWFETKLFGQQVALVAGKIDLTNYFDSNAVANDETTMFITSAFVNNLALEAPHNGPGAVSIYEMENGLNFRLGLQSADSDNMGLGIGKGFYGIGEVGLHADSLFGREGNYRLWFKINGDRFPCAKKTAQLLPLVIQKQMMGLKNLQPRYTTVLSLTGTLPLRHYFRPF

SEQ ID NO: 7862 - protein, 718 aa, Acaryochloris marina
MFGLGAMSAAAQAPTQQTQVQSLPEIAIDAPSRGTRSGVSHPSRRSASQQARPPASAPTAAAASTSAGAAPTPMSAPQDQAASARIISGAELNAVPFSRVGEVLEAVPGLVVTQHSGEGKANQYFLRGFNLDHGTDLAITVDGMPVNMPTHGHGHGYADINFMIPELISAMTLRKGPYFADVGDFGSAGAVSIDYLRAMPKTLAGVTLGSFGYRRLLGAGSTKAGEGTLLAAFEANSYNGPWDVPDNIRKLNGVLRYSQGTPTDGFSLTGMAYANRWTSTDQVAQRALDQGIIGRYGSLDPTDGGIANRFSLSGRFARSSDIGQTDINAYVIRSSLQLYNNFTYFLDDPIKGDQFNQYDRRTVVGLSGAQRFDYRFAGLPVETRVGLQSRADAISLGLTKTLQRDWLSTVRADDVQEQSLGLWTDTTVRWTDWLRTSAGVREDFFNGRVSSDTPANSGSASASMTSPKVGIVLGPWVSTEFYGNAGTGLHSNDIRGATITVDPTDKTTPLDRVPLLVRSKGAELGVRNRSITGLTTALAVFVLDFDSELLFVGDAGTTEPSRPSRRVGVEWTNQYRPLPWLGVDLDLAYTRARFTDVDPAGNMIPGAPAWVASAGLTFGRETGWFGALKGRYFGVRPLVEDGSERSLASLIFNARAGYRFDNGLRLQLDALNLFNAKTNQIEYYYLSRLPGEPLGGVGDRHVHPAEPLALRLTLAGAF

SEQ ID NO: 7863 - protein, 743 aa, Acaryochloris marina
MKKVAVLILLLITLTINAQEKKAVAKTLDSIQQLDEVIISTTKIFGNKYVAKNRTGSAYYLSPKELQKFSFTDVNRALRTVPGVSIYEEDGFGLRPNISLRGTSPERSSKITIMEDGILIAPAPYSASSAYYFPTIARMEAVEVLKGSSQVQYGPFTTGGAINMISSQIPTEFGGKIRASYGSFNSQQLHAKVGGGNNTFGYMVEYLNYGSDGFKTLPSGKDTGFDKNDVVAKFSVNLFPNASVKQSLEFKFQYSDEVGNETYLGLTEADFNANPFSRYASSNEDKMTTDHTQYAITHKADFSNNVRLTTTAYRNNFSRNWYKLNDITFNGDKQSIANILDDPNTLSDHFAIVNGSVNSGADAIGVKANNRAYYSQGIQSKLDYHWYNGDAFHDIEFGVRFHYDEEDRFQWVDQYSISNTGDLTLTTAGVPGTDANRISSANAFASFITYRLKYNNWTFTPGLRYENISLKRQDYGKSDVDRTGVNLSERENNVDVFIPGIGTNYKFSNDFSIFGGIHKGFSPPGNQDGQEPEESINYELGTRFNFLGISGEVVGFFNDYSNLLGSDLAATGGTGSLDQFNAGEVNVNGLELLVNYNFAKANAALSLPLSFGYTYTNTEFQNSFGSSNDLWGTVTVGDELPYIPKHQFNVGFSLEHTKFELNFNGRFNGEFRTLAGSGAIADSERVDSNFIVDVSGKYYVTKNLNLTANIINLLDETYAVSRVPAGLRPGHPFGAYAGLEFRF

SEQ ID NO: 7864 - protein, 2342 aa, Acaryochloris marina
MQKNIFLKVLVLLLGTQMSLSAKSIIPHFTTGLDDNHSYQIGINWLWLKQKSPNSFSNNIDGSNHDGLTTKTKNGDYIDKNLLKRHITEIENEKFLLGSGYEVPHFLAKNKMGGNELEITNFNTENIKKDISIKKPSYENKDWNLKDMLPNAKSTNPLFNIPTVGLISMPDIAKPKNIDEVNINIKGSGAVLSSDAYYLNTKGGDQGNFSQVTLEKGVFLKISSKYKEGFLKIKDYKATMPLFYNNYNQPIGDSEEKDTFYANDDEKHFLYTLRTAPYNTFKKDVKIYMDSKSYNTDTGCCNYEFGFAVVGETNGNNNFKKKNISEINQEVLDKDPTGKLIDVALPYFMPKALKINRETDKSKVPLVYFENEGIAEIGETAKGFLMMVVNHSTSDKLHIYNNSGDIVLLPRDDDEDKKAAVFFHSPDVPNGNTSAIYTNTGNINLFGMHTVGYLATAREGKYLNYNTLSFINDGNFVLNGLNSIGMAIAGDRGDLQPGSNVHAFKPIILRGDKTIGFYNENDALNEGNKSFSTMKIVIGDKGNETDIYESKIVKDDWDVPEEINIKEDDEEGIWFDPQSNIADNDEESVDNAIAMIYNPNSKNSVMDNFVRTDIQINANSTNGIGIYAKRGTIKLLNDITDDKIKDSFDKKIVDKIKENFKNGTNHVININGGKNNAALYAKQDQNNPSVIIYNGDININAGKDFEGENSTDNKAILAADQGEIEFQGKLNVGKEDSLITSNAVVYSDDAKVTIKNGSDINMYLADNSNGFYASNSLNPTNQNPQNSQPQIKIEKKVAVNLNGNGVGITAGNGGHIDLSGATINATGLKSALASIGNTSYINAQNAVINYNGDSYATYSSQKNAKIDLNKVTINLKGNSYGIALDYDKANNTYDVKGLMGKVNIKPLSDKVNLFTIKDYNDLRSSRFNNEDGALNLEDEGTIGVGTFSYKIDRSDPNGAKATLALIDGLENFLIDSDIDKSLAGKKGDKISKMQTNDEKIAFNFAKNIKIQRANITLDSGKTVKAIMDETELKNLSMSKPFAIAVSAGPNAKKKNETSITLKDNSKVIVNSKDQKEAGVGLYIDFGRVNTDKSSSIKVGSSNTKNATGIYAVSSDVTNDGTIQTNSSLSIGAMLYAQNTKPYSRAFIDQIGGASKLNGFITNNGDIVVNGERSAGIYVDNNFNKVQNSYTGTNNKNINVNAANSMAMASSNSTLINKGNINLNKNSSSSIAMYGKEFQDETQNINSSSTLKNSGLIYINSNHSAGMLNKSVNNDSSTQLLDGGRIISSKDASKVTAISGKNIDVKNGSTIDLKGKNSVGIYANNSSAVNIEENAEISVGDESIILYSKSGDKTNINYNIKNTEISDKNQTAIYLENSKENANKLTLVQNSVFNVNGENSKALHLKSIGNPSNYSFDDITFNLKGKNNVAVLAEGSTNVSLGANSKINMDELAYGSIGLALQDSDNKTITITNKGTINVAKSDKDNKIYSAAIALFSPGIAINNGTINTDDESVGMYGIENKNVNLQNEGEININKNAVAMYIKNGAATNSGKINVNGENGVGMYAKKGSLINSGEILANSQGAGMFSDEDAKISNLNKILLNKENSIGIYTKNEATNKGNISLLGDSSVGIFAKNILNEGVINLSSKGENDKFSAALMGKNIKNTGTINLNKEYEVGMYGIGTSTNKAVLTNDGVINLNANNQIGMYAKFANIKNSGDINVNAQNSIGIYANNSVIDNTGKITLNADNSVGVYMVNGSYFKNRGEIKIIGNSKSVVKDDEEIDIALPGIASFRPNEVHKDKFKGVDIAVNKNTKDFEDFNIKYDNETYNTENSVKLSKSQIANNLDLSLSNKTTNIEIPKNLDNKSKEKRVKKNIVAMYADTSGVNLTKPIKGLDNLSKNDKIILYVGAEAANYTNKKVINLDQSLMKPFIDELDKSTAIKAVYSGSLTWQAFATFDKNAKNNHKIKSFVMSKIPYVNFIKKDSKYKDLYIALDKKYEKAIVGSNDKKIFNKLNLLGKNEEFKLHKNLKSLGGFEYASTQTRAYSSADIYDREFNDLMRWDTNTTDTTKFKVFGANTKRNQRVDGVLGYDKNAYGLFVLNNFDLQMDGTSNGVFGGIAKERYEFNNDYKSKEDALTAQIGYYVDRKVLNEEINHLLKISATGSTREMKRYTLDKDFWAKSKYYTLGFDVKNSFYKEYKFDSGFKISPYTGVDLGYGIIENIKEKSGNTLLLDVNSKDYYSIRPNLGVELGYTHLLDENSYFNILLDSRIYKEFGKINRANNLARFKDTNSYFSLPKEDKEDKGAEFTLVGKYENGNFGASLKGGYQTQFKDRFIGLDLRIKF

SEQ ID NO: 7865 - protein, 1033 aa, Acaryochloris marina
MSKFLSLLCSLLICVATYAQEITVNGKVTANGEEMPGVTVAVKGGTHGTITSIDGSYSLQVEAKSTLVFSFIGYETVEMPVKGQKVINVDLKESSIAMEEVVIAVPYGTAKKSTFTGSASVIDKKIVAASQVSSVSKALQGTVAGLQSFSTSGQPGEDANIYIRGVGSANASQTPLYVVDGVPYDGKLSSISSQDIASVTVLKDAAAASLYGSRAANGVIMITTKQGQNGSAPTIQLSAKYGFSSRAVRDYDQLSTNDYFMLQWEALRNSYIDNGSDPVEAAQKASSIVATTQTGGLGINPYGTNYPQPIGTDGKIVAGATPLWNDSWEDALTQDAHYTDLNASVSGGSEKTKYYFSLGYLDDQGAYICSGFKRYNLRSNITTDLRKWLQVGLNVATSHSIQNYPKQNDTAIGNIVLAARDIPSFYPVYERDMTTGEYILDENGNRVYDYGTYRKGSYNGYNFAQSMLYDKKEYKRDAASIRGYLQITPIEGLSYKMSLNIDYDSKFTHNYNNPTYGKQPLTGSVEKGNDRTTGMTYNNVINWNHTFKEDHDVRLMAGQEYYEFNTSNFSGSRTGVITDGYFEPDVASTLSSFGGNSDQYKLLSFFGSAEYSYKSKYFVSASVRTDGSSRFHPDHRWGTFWSFGGSWKISREKFLEEASNNWLSNLTLRASYGAQGNDNVGYYAYKALYSIGSSLGESTLHASRLETPELSWETNLNLNVGLDFGFWSNRLNGTIEFFQRSSKDLLFARDLVPSSGFSSIDANIGKLKNYGWEFTISGTPVMTKDWTWKLSLNATTYKNEIVELPTDVMWQSSKKWVKGGSLYDFWLYEWAGVNPENGKPQWYYTAEDGSRQVTEDYSSLTPDDKVKVGSSLPKLSGGFQSDLSWKNLSLSMLFSYAIGGKLYNNDKISMMSVKGGNGSSMSEDMLNRWTPENRYTDIPRLSYNQTSYFTSSSSRWLVNRSFLRLKTVTLSYTLPKNWIHFATLKDASIFVQGENLLTFSHQQGLDPEQPISGVVSYRYPAMKTFSFGINVTL

SEQ ID NO: 7866 - protein, 1042 aa, Acaryochloris marina
MRIYLRLLVVSLLLFAGNIVYAEAQQEKRVTGTVTSEGEPLPGVSVQLKGASSGTITDIDGKYSIEIPATGTLVFRFVGMRTVEQPVNNRSVINVTLESESKELEEVMVVAYATAKKYSFTGAASTMKAGEIEKLQTSSISRVLEGTVSGVQASAASGQPGTDAEIRIRGIGSINASSAPLYVVDGVPFDGSVNSINPDDISSMTVLKDAASAALYGSRGANGVIIITTKQGDQNTKATVKVKASLGGSNRAVRDYDRVSTDQYFELYWEALRNQYAKSADYTPATAAAQASKDLVTKLMGGGPNPYGPQYAQPVGTDGKLVAGARPLWNSDWSDAMEQQALRTELNLSVSGGGKANQYFFSAGYLNDKGIALESGYQRFNLRSNITSEMTSWLKGGVNLSFAHSMQNYPVSSDSKTSNVITAGRTMPGFYPIYEMNTDGSYKLDENGDRIYDFGSYRPSGSMANWNLPATLPLDKSERMKDEVSGRTFLEATIIEGLKFKTSFNFDLINYNTLDYTNPQLGPAKENGGGVSRMNTRTFSWTWNNIATYDKTIGEHHFNVLAGVEAYSYRYDELTASRSKMAQPDMPELVVGSQLTGGSGYRIDYALVGYLTQALYDYQNKYFFSASYRRDGSSRFAPETRWGNFWSLGTSWRIDREEFMASTSDWLSALTLKMSYGAQGNDNLGTYYASKGLYTIVSNLGENALVSDRMATPNLKWETNLNFNVGIDFSLFNNRFSGSFDFFTRRSKDLLYSRPIAPSLGYGSIDENVGALKNTGIEMVLNGTIINQNGWVWKLGMNLTHYKNKVTDLPLKDMPRSGVNKLQVGRSVYDFYMIEWAGIDPENGDPLWYKDEVDANKNPTGKRVTTNDYGSADYYYVDKSSLPKVYGGFNTSLSWKGFDLSAIFAYSIGGYIYNRDVTMILHNGSLEGRDWSTEILRRWTPDNRYTDVPALSTTSNNWNSASTRFLQNNSYMRLKNLTLSYNLPKQWISKLSLSSVQVYVQGDNLFTIHRNQGLDPEQGITGITYYRYPAMRTISGGINVSF

SEQ ID NO: 7867 - protein, 236 aa, Brucella suis
MNIKSLLLASTVVLVAATGAKAADAVIEQEPAPVVVAPTFTWNGAYLGGQIGYGWGRSTLSDEDTSIRVKPDGFLGGLYAGYNFDMGNNFVLGVDGDITYNDLDASHSDTDPDLDLTTGVDSKLRWSGAVRARMGVAMDRWMPYIAGGVAFGNVKNSVSLTDGIESIGVSQSKTMTGWAAGAGVDYAATDNVIVRLEYRYTDYGHKDFSVVDGDLSSGVMLALHVERCGPSCASWN

SEQ ID NO: 7868 - protein, 620 aa, Brucella suis
MHILKLSALLASACAATLSPALAQDGGDKDDGVRLDTIVVTPLRRASSLQRSTSSVSVIDAADIERSAAPDLQSLLQTYSGISVKTNGGQGSSADIYMRGMSSKQTVVLVNGVRTASATSGSTALANIPLTSIERIEIARGAHSSQYGADAIGGVINIITKQGGACGERAWCGSVSTGVSHPWGGYASGSLQGRSSDGIDYAVGAAFTGTQGYDFTTPEAFGHEPDDDGFLQGSFNFALSKDFDWGKIYADGLFSRGRNQYDATAPASNEADSTAFTGKVGTRIDHTADWSSTVEFSTGIDNSRNFRKGIEGSDRFETRRYGVFASTEKSFDTGKVSHVVTGGVEAYREKINTTIDYDETGRDLAAVFGQYSLEYDALRFDGGIRYDHNGQFGNVTTYNLGASYEILPDLVLRSSYATGFRAPTFNELYYPGFANPDLQPEKSRSVEVGLNWQATASTSLDMALYQTRLSDAIMSTAPSYIPYNIASAKVTGLEATLSHRFNEQWGIKGMVDLKRPVDEDSGNDLPYRERFKAAAEVNFKPVEKLDLTARVLYGGSRYTNAKNTKKLGDYVTADFVALYSIDKQSQLKFSVENIFDKDYETSSGYVAPGRTITIGLTRNF

SEQ ID NO: 7869 - protein, 296 aa, Brucella suis
MFTAIEQKISSHDYGVNCSYRFVAGEKGYFRILGGVSYQELKGEQTRLIPGISPNMNPTKFPFPGPVRVASLDAEDQLVGWRLGAAYEIPEYAMRATLVYQSEVKYDLEGTIDNLVLNPITGRGMPLNVESDVATPQSVEFKFQTGIAPDWLAFGSVKWTDWSSITSVDFVSSDNKIAPKGTKITSLNLYYQDGWTVSGGVGHKFNDQWSAAATVTWDRGTSTGLTSQTDVWLFGLGTNYKPTDQFEVRLAGAAGWLSAGDLDDTMIAGVSNPTGSKGEFGNDFVGALSLTAKVKF

SEQ ID NO: 7870 - protein, 183 aa, Wolbachia endosymbiont of Sitobion miscanthi
EILPLFTKVDGITYKKDNSDYSPLKASFLAGGGAFGYKMDDIRVDVEGVYSYLNKNNVTDAKFTPDTIADSVTAISGLVNVYYDIAIEDMPITPYVGVGVGAAYISTPLKDAVNDQKSKFGFAGQVKAGVSYDVTPEVKLYAGARYFGSYGANFDKSGGEKDKGGHTVLYSTVGAEAGVAFNF

SEQ ID NO: 7871 - protein, 178 aa, Wolbachia endosymbiont of Sitobion miscanthi
EILPFYTKVDGITNATGKEKDSPLTRSFIAGGGAFGYKMDDIRVDVEGLYSQLAKDTAVVNTSETNVADSLTAFSGLVNVYYDIAIEDMPITPYVGVGVGAAYISNPSKADAVKDQKGFGFAYQAKAGVSYDVTPEIKLFAGARYFGSYGASFDKAAKDDTGIKNVVYSTVGAEAGVA

SEQ ID NO: 7872 - protein, 183 aa, Wolbachia endosymbiont of Sitobion miscanthi
EILPLFTKVDGITYKKDNSDYSPLKASFLAGGGAFGYKMDDIRVDVEGVYSYLNKNNVTDAKFTPDTIADSVTAISGLVNVYYDIAIEDMPITPYVGVGVGAAYISTPLKDAVNDQKSKFGFAGQIKAGVSYDVTPEVKLYAGARYFGSYGTNFDKSGGEKDKGGHTVPYSTVGAEAGVAFNF

SEQ ID NO: 7873 - protein, 165 aa, Wolbachia endosymbiont of Sitobion miscanthi
EILPLFTKVDGITYKKDNSDYSPLKASFIAGGGAFGYKMDDIRVDVEGVYSYLNKNDVTDAKFTPDTIADSLTAISGLVNVYYDIAIEDMPITPYIGVGVGAAYISTPLKDAVNDQKSKFGFAGQVKAGVSYDVTPEVKLYAGARYFGSFGAHFDKDAAAGKDKG

SEQ ID NO: 7874 - protein, 182 aa, Wolbachia endosymbiont of Sitobion miscanthi
EILPLFTKVDGITYKKGNSDYSPLKASFIAGGGAFGYKMDDIRVDVEGVYSYLNKNDVTDAKFTPDAIADSLTAISGLVNVYYDIAIEDMPITPYIGVGVGAAYISTPLATAVSSQNGKFAFAGQARAGVSYDVTPEVKLYAGARYFGSYGANFDKTNKDGKGELKVLYSTVGAEAGVAFNF

SEQ ID NO: 7875 - protein, 183 aa, Wolbachia endosymbiont of Sitobion miscanthi
EILPLFTRVDGITYKKDNSDYSPLKASFLAGGGAFGYKMDDIRVDVEGVYLYLNKNNVTDAKFTPVTIADSVTAISGLVNVYYDIAIEDMPITPYVGVGAGAAYISTPLKDAVNDQKSKFGFAGQVKAGVSYDVTPEVKLYAGARYFGSYGANFDKSGGEKDKGGHTVLYSTVGAEAGVAFNF

SEQ ID NO: 7876 - protein, 183 aa, Wolbachia endosymbiont of Sitobion miscanthi
EILPLFTKVDGITYKKDNSDYGPLKASFLAGGGAFGYKMDDIRVDVEGVYSYLNKNNVTDAKFTPDTIADGVTAISGLVNVYYDIAIEDMPITPYVGVGVGAAYISTPLKDAVNDQKSKFGFAGQVKAVVSYDVTPEVKLYAGARYFGSYGTNFDKSGGEKDKGGHTVPYSTVGAEAGVAFNF

SEQ ID NO: 7877 - protein, 147 aa, Wolbachia endosymbiont of Sitobion miscanthi
GPISDEETSYYVRLQYNGEVLPFKTRIDGIEYKKGTEVHDPLKASFMAGGAAFGYKMDDIRVDVEGLYSQLNKNDVSGATFTPTTVANSVAAFSGLVNVYYDIAIEDMPITPYVGVGVGAAYISNPSEASAVKDQKGFGSAYQAKAG

SEQ ID NO: 7878 - protein, 203 aa, Wolbachia endosymbiont of Sitobion miscanthi
GPISDEETSYYVRLQYNGGILPLFTKIEGIEYKKATDIHNPLKASFIAGGGAFGYKMDDIRVDVEGLYSQLNKNDVTGAAFNPDTVADSLTAISGLVNVYYDIAIEDMPITLYVGVGVGAAYISTPLKDAVNGQKSKFGFAGQVNAGVSYDVTPEVKLYAGARYFGSFGAHFDKDTAAASKDKGELKVLYSTVGAEAGVAFNF

SEQ ID NO: 7879 - protein, 147 aa, Wolbachia endosymbiont of Sitobion miscanthi
GPISDEETSYYVRLQYNGEVLPFKTRIDGIEYKKGTEVHDPLKASFMAGGAAFGYKMDDIRVDVEGLYSQLNKNDVSGATFTPTTVANSVAAFPGLVNVYYDIAIEDMPITPYVGVGVGAAYISNPSEASAVKDQKGFGFAYQAKAG

SEQ ID NO: 7880 - protein, 683 aa, Enterobacteria phage Min27
MKSIAPLALCMAYSCCASANENITQQELETITVVAIKGNGIKISSTAVVNLPGTANDPIKGLEALPGVILAPSNSGGPIAEPAIRGSSSQDNLYLTDGLDMGYVFHNDGASVYNPLLIESFELKTAAWQPNLTNANGGVILTQLRDAGSLGNQTVLDLGLYRSGFLYEKVLSESFAYYLSYRESLVHIYVDNFIEDEEFSFAVPPRNRDYQAKFNWQLSDQDSLIFAANGAKDYIEIAFDENGRDINKNPDLKSGERYENYYHSQAISWQRYNQEYDSSNSINFLQQKQQEREGDIFSWQADIANIIIRSDTRYYADNFTFAVGGLIKSTKIDYFNSGRLLPCNTEFEICPVTYFSDKFSDQGDLSIVDYSFYSNIESDLTPTISSQLGAAFIGSDLNDEQYLEPRIRVLWQLYNNHQLHFAYGVHHTWVNDYRLLANTLGNKKLHASKSNQIVIGLNTTLSKNWQLTTELYYKDFSDLVIANPLAQKRNPHQIINPSIETYLNVASGDSYGAELMLNKSFSEDWLGWLSIAFSKTERDNPLIDKKFNSEFDLPWVVNLVLNYQINQQWSAGFKWRFQSGRRYTAVNSATPYYEQDQQDPLFYIPEYDSFNASSVKNYHRLDLRIDYKTQLMGLDSSIYFELMNVYAFKAIQEFEYNKDYSSYEKDYQFPDMPLPSVGMTLNF

SEQ ID NO: 7881 - protein, 178 aa, Wolbachia endosymbiont of Spodoptera exigua
EILPLFTKVDGITYKKDNSDYSPLKASFLAGGGAFGYKMDDIRVDVEGVYSYLNKNNVTDAKFTPDTIADSVTAISGLVNVYYNIAIEDMPITPYVGVGVGAAYISTPLKDAVNDQKSKFGFAGQVKAGVSYDVTPEVKLYAGARYFGSYGANFDKSGGEKDKGGHTVLYSTVGAEAG

SEQ ID NO: 7882 - protein, 182 aa, Wolbachia endosymbiont of Rhagoletis cerasi
SYYVRLQYNGEILPFYTKVDGITNAKDKEKDSPLTRSFIAGGGAFGYKMDDIRVDVEGLYSQLAKDTAVVNTSETNVADSLTAFSGLVNVYYDIAIEDMPITPYVGVGVGAAYISNPSKADAVKDQKGFGFAYQAKAGVSYDVTPEIKLFAGARYFGSYGASFDKAAKDDTGIKNVVYSTVG

SEQ ID NO: 7883 - protein, 1494 aa, Yersinia pestis biovar Antiqua str. UG05-0454
MKNSNTLNTRLLPLSILISSLVSGGAMAVSQIATTDTPAVTPIKSTLTGPFERNSAGTSFGSNVDVDVIDNTSTATRVIAETTPEAESTIGEATGQEGGNATAVIPPTTTPSEQEITEPEQPGLLDKIKDLLGLGEITQEQADALEKNVKTKVEKVDAQTAAKLALESAQAEAQKAAEDALYLKTENVSYQAFAQTEEKIKKEADEAKKKQDKTKEDAIKAVKVNNTPLVPGDKDIAEKVTKAVTDTTKVQGEKAVTLATKITDAKVAQEKKDANTEALAEIDGRLISVSNALIQATGTDKGPLDQKLKEAQQAKTEQDGKELASGGYKELFEEDKKTSGYFGIAENDNGSGQQEKLAEAKKNRDAYNKAAKKELDAIAKAQKAVEAIDAQIVKLKKDKGDIEQEQSTEKGKTGGLDIALSGANDAKDAAQGEFDTAKNAAELAETAAKAIEAAKITDKAVEDATAAYKEAADKAEQTKTALEAAEKAKEDADKLVVTNTGLLNDADQALEQLVTAQNNAQPTLDLPAIDVTIAPAKTQDVIEGTSAIATQVAGGTQNVAKGGKAIDSVITKDGIVNLAAGANAKGTEVTKGTLNNNGGVDTDTVVSTEGKLVLTGGSETAIATSTGAKVAEGGVVTAGDHSVIEKMISSGNVTASGNNTIVRDTTINDGKLSLAGTATANNTTFNGGIFSVEGDTAATKTNMTGGKFAVTGNAKIEETVVSAGDVSLADKATANNTTLTGGTFAAAGDTAVSATNMTGGKFAVTGNATIKDTVLSASDFSLADKVTANNTTLTGGTFTVAGDTAATKTKMTGGEFAVTGNAKIEDTVLNASDFSLADKATANNTTLTDGTFTVAGDAAVTATNMSGGKFAVKGKAKIKDTQLSAGNFTLAENATANDTTLNGGKFDVSNEATATNTTINNGLFTLKDGAHADSTTVNSGTFVMADQSTANGIQLVDSAFTLASGAKASGITKLTGGQAQVAGSLESLSLTGGRADFANSAKASGLLDISADSQIIMNRGADTAQANLNLAGRLELLASDVAQAVAQPVARAAMELSNARAVMPAPAMPVPAAAPVAHFALNDVVMTGGTVDMSNAKNAQLTMASLNGTGNFNLGSVMQSDSVAPLNVSGDANGDFIIAMNSSGQAPTNLNVVNTNGGDARFALANGPVALGNYMTNLAKDANGNFVLTADKSAMTPGTAGILAVANTTPVIFNAELSSIQQRLDKQSTETNQSGMWGSYLNNNFAVKGRAANFDQKLNGMTLGGDKATALADGVLSVGGFASYSSSDIKTDYQSKGKVDSHSFGAYAQYLANSGYYMNAVVKNNQFSQDVNITSINGSASGVSNFSGMGIALKAGKHFNFNEAYVSPYVAMSAFSSGKSNISLSNGMEAQSSSTRSAMGTLGVNAGYRFVMNNGAELKPYAIFAVDHEFAKNNQVTVNQEVFDNNLSGTRVNTGAGMNVNITPNLSVGSEVKLSSGKDIKTPVTINLNVGYSF

SEQ ID NO: 7884 - protein, 761 aa, Yersinia pestis biovar Antiqua str. UG05-0454
MNNHKIWRLSAVAVALLISGNGYADQTFHFAQQPHNTGDHTVIAAPEVNNFSLADLTANAEGQAVDATNAGALSLRVEPTQGDAQANGVLVTSGTFTNQAQGSITVSASSQDQHAVASGLQATDAYWSTLRNQGSIRATSNSLHGSAEAYGIQAGLAFSDAAGDHYGDHMMLSNEGVMQVSATAEQDAFASGIYTNAGNGVVNNGRLDVSAHASAGDARATGLHTLSANPGVDPDPWNPANPTHLMSNNGSLSVTASGNNATASAISTEGEGVYIYNNGTLIVDAFSESAQGSASAYGIHVLNGSATINSSGRILATATGGSQQQAYEVMADGSVVNIERYTLALSNETPWAVSNGGSIVLGNGTQGADLVLMAGQASEGFAYGKEYSLDNLAYDTTSGQQSTVGGSIAGLYGITPDIKVIHSGSSSSSLGSAALVYAPDVSHAGVSALAQRSSMEQASNIISSQLHSQLVSNAGCNQKLESADSCVFITPYAGEYRRDPVTSGYSGQRYGVLLGQNQHFGDFQLGWHGGYESASTDFNGTSVGRKEEINTLMLGVQGGMKLSESLFIAATSTWFSSDTDYSDSNTYYGVGSQSGSYDSSGLYTDVSVGNSWQLNRNYAMTPMVGLTHIWQQRDGYIVSSNNSNYDLIDTRYSSYSDHAVALHAGVRLDGRYPLTNETLLKPFFNVGLQQMLYGDEITIDQSIPNSPVVGVSTKDKTTQGTFDLGMALVSDNGVSASLQLSGMVNSDRQDFTGWANLGWAF

SEQ ID NO: 7885 - protein, 407 aa, Yersinia pestis biovar Antiqua str. UG05-0454
MRHAAIASRAAPSPQYAPRPRAAGFPYRSSGRLFAGIAAADTASRRDRRQTDAARHGEPHVTTPRFLCKAAAATLAASGIAAHAQSTLALYGALDVGVQYLTHADGHRAAVRLQNYGILPSQIGLKGHEDLGGGWRALFKLEQGISVNDGTATAPGYAFFRGAYVGVAGPAGTVTLGRQFSVLFDKTLFYDPLWYASYSGQAVIVPLSANFVDRSVKYQSPTFGGFDVEALAATAGVAGNTRAGRVLELGGQYTSNGLSVGAVLHQAHGDTSTSADASGRRRELGTLAARYAFAALPLTVYAGIERMTGDLDAPRTVVWGGARYIAPNGIGVNAGVYHTDSRTPTTGHPTLFVASTTYALSKRTVAYVNLGYARNGGQSSQTVYEYDPTPLAGASQFGAMAGFYHLF

SEQ ID NO: 7886 - protein, 1059 aa, Yersinia pestis biovar Antiqua str. UG05-0454
MGTVTDIDGKFTINDVPSSARTLKISYIGMKTQEIPIKTGTIRILMKPDAEVLEEVVVTGMQKMDKRLFTGAATKLDAEGVKLNGMADISRGLEGRAAGVSVQNVSGTFGTAPKIRVRGATSIYGSSKPLWVVDGVIMEDAVEVSADQLSSGDAETLISSAIAGLNADDIESFQILKDGSATSIYGARAMAGVIVVTTKKGKAGVSRISYTGEFTTRLVPSYNDFNIMNSQDQMGVYKEMQQKGWLNFAETSRTAESGVYGKMYQLINTYDPTTGQYALLNTDEAKNAYLREAEMRNTDWFDTLFSPSLSQNHSVSLSSGTEKSSFYASLSAMHDPGWYKQSGVDRYTANLNMNHNILKNLSINLISSASYRKQKAPGTLGQDIDLVNGQVKREFDINPYSYALNTSRTLDPNTYYTSNYADFNILNELDNNYMELNIADLKFQGELKWKPITGLELSALGAVKYQSTSQEHNIKDQSNQASAYRAGLDDKTIMDRNPFLYKNPDNPYALPISILPEGGIYQRRDYKMLGYDFRATASWNHVFNDIHITNFFAGTEINSTDRSKNYYQGWGMQYSMGEIPYYVYEFFKKGIEDGNNYYSLSQTRSRSAAFFANATYSYKGRYTVNGTARYEGTNRMGKSRSARWLPTWNVSGAWNAHEEKFFSNLTSVLSHFTLKASYSLTADRGPADVTNSQAIITSYSPYRPFTSIQESGLYIKELENSELTYEKKHELNIGADMGFLNNRINLAVDWYKRNNYDLIGIVNTQGAGGQILKYANIASMKSHGIEFTLSTKNIKTKDFNWNTDFIFSNAKNEVTDLKQNANVMELISGNGFAKQGYPVRGLFSIPFVGLDKDGIPVIINEKGEATSTDINFQERQNTGFLKYEGPTDPTITGSLGNMFSYKGFRLNLFITYSFGNVIRLNPVFKAYYSDLTAMTREFKNRWTLPGDEAKTNVPAILSKRMYDSNEDLKYAYNAYNYSTERIAKGDFIRLKEISLAYDFPKAWINPLKLTDLSLKVQATNLFLIYADDKLNGQDPEFFNAGGVASPVPRQFTITLRLGL

SEQ ID NO: 7887 - protein, 76 aa, Yersinia pestis biovar Antiqua str. UG05-0454
MISILAKKLLQDITKRGSARVSSLSLVPRSENMAAAIRRVNSMQYDVYTQTEVSNGKPSRRFRQFCRRPRKSIRSR

SEQ ID NO: 7888 - protein, 635 aa, Yersinia pestis biovar Antiqua str. UG05-0454
LLNYGILSLALATPLSAWAFDSLTVIGDSLSDTGNNGRWTWDSGQNKLYDEQLAERYGLTLSPSSNGGSNYAAGGATATPELNPQDNTADQVRQWLAKTGGKADHNGLYIHWVGGNDLAAAITQPAMARQIAGNSATNAAAQVGLLLDAGAGLVVVPNIPDISATPMLLEAVITAGLGAAAPPALKAALDALARGTTPDLASRQQAIRKALLAAAATVSSDPFIQQQLVEQLLAGYETAAGQASALTDYYNQMEEKGLEQHGGNIARADINGLFKEILANPQAFGLTNTVGMACPPGVSASACSSTMSGFNASQDYLFADHLHPGPQVHTIIAQYIQSIIAAPVQATYLNQSVQSMVQGSRTTLDSRYQQLRQGENPVGSLGMFGGYSGGYQRYDNNEAEGHGNHNNLTVGVDYQLNEQVLLGGLIAGSLDKQRPDDNYRYDARSFQAAVFSHLRAGQAWLDGDLHYLAAKFSNIQRSITLGALRRVEEGETNGRLWGARLTSGYDFVVMPWLTTGPMLQYAWDYSHVNGYSEKLNTSTSMRFGDQNAHSQVGSAGWRLDLRDSVIHSWAQINYRRQFGDDTYVANGGLKSTALTFSRAGKAQDKNWVDIEIGADFPLSATVSAFAGVAQTAGLS

SEQ ID NO: 7889 - protein, 146 aa, Yersinia pestis biovar Orientalis str. MG05-1020
NRHGVEKYEVAARWDDIVQWQLSSRLALSLDGEVNLANWRALSSRPSSQLTEFGVSPIFRLSYAGEYATPFVEASVGLRVLSHTEIADGHRMGSAFQFSDMVGVGIAFGKAQRLAIGYRFQHLSNAGIRQPNPGTNFSMGYVRYRF

SEQ ID NO: 7890 - protein, 816 aa, Yersinia pestis biovar Mediaevalis str. K1973002
MMVFFSRSFFFVSAFCLSAGCFAQSVASEPADLPASTVDQKETITSEKDSVELVGDSSVGESISRRPDLSFANVTINGQGSGLSLGSIPADAVESVEVMKAVTPDLDADTRNGAISLKTKPTYEQELTAKGTLELEYKASDGSLSNEEIFSWGGRLNEAGTWGGRLNVRQEIDHFAIDDIRNDWDTEVVDGQPAFVMTESRIERFHRKSDEWELGGSLDFKASELVSFSARANWELQDREFYAPRLRYQYGDGTYVSVDSTRASVQGASVQRMANGWSNEDREIEAAVGGVFENDFLEAEFQYVYLEEKLYQPNFFQLDFVREGVDLSYDLTNPRFPVTVSTDGTDLDDASLFVFEDMNDQQEWRNEESDTVVTLDLKWKDLGSDNQGFVKGGFKSRARDLTRVSADRIFEGFVADEYTLADVLYAGEIDSVVEGQYRLGSIPSIESGRKFLQDHADEFFYSDYRTRERADSNSYLADETVDSLYAMFSWEIKKWRSILGWRREQTHVSFRANEVIVGADLDDADEDGDLQETVYLGTNPTNGDNSYSNDFPNFHLRYQWNEKLSVIGSFTNTIKRPGYGEVVPYRRVNRDESEVSEGNPNLKPTLYENLDFSLDYAISELNRFSVELFRKSVEDIVFEAESTVVSGAYAGYELSRRENGPTATIQGAKLTWQAPLRMSVLPEGLSFNANYILNDTETEYPGRPGEFLPVTHLPDAEFRMTLNYQSEKTFTQLMYQRTDVSLLRVGDDPSEDRFEHSRNRINLDFSYQIKPKLRYFVVARDLRSEPNSVRFEGDESRLVRYRNFHWSVRTGLKFEL

SEQ ID NO: 7891 - protein, 1264 aa, Yersinia pestis biovar Mediaevalis str. K1973002
MHIQFREPISTSPAQPDAGRQHLFSRVPAAVMNPITLAIIVAFSTLVLPQTAWAACNSSGVGTYVCEGENNTAISLFGTDIAVETRPGFGITEHEITDSALSLTGSGTISYLDTNSSALDTDSRYSLYIKNDTLITEQSASINVQSNGSISSGVYIDNQSSDDSTIRVDLSGILSSSLSGAPALSIFSSAGNDSTIILNTHAISGVTGIQSDNNSQNGATITHVDVTGDINVENSGVSIRNAANGGTSIINFNSKSINTEYDSFYIQNTNYVGGVITDINIDGDISSANSQAARIYNYTNGGLASLRFRANNVTGSTGLYIDNSSQNGAVTDIILTGDLTATSGSALQANAYSDEGNIETAIKLNNVYSLYDALNISDYTRSGNILHDLDISGTITAENGTGIKVMGAAGEGSSTMLINVNNITSSSQSLDINNYNFLGSAFSAITATGHLTAEWGQGAMLQTHSSLGDATTLIHFNDITAMSSGISLINEANQGTSTTDITVTGQINVSHGEGITLNALTTDGRTLVNVDVNNIASEYDAIRLYNYNYNDNYATGVDDGTGADNGTSTIDLITRGALVSQQGYGINIETNTADTYVTVGGLVHGGNGTAIGIHRLDNIQTSATLELQSGYALEGVTQALVFNGSYAEINDAALDLANSHLVLGGTGDAAFDLTRIDNREEAILDGDPNRITGFGTLTKTNNSIWTLTGANMADGDANAFLSANIAGGILVLDNATLGLTPATTILNRLSAADIAADPTLVATETGALTLAEGGALSSLGDSVLSGNLISAGGILLSNTYTGGNGAATDDRLTVTGTYFGENNGSGEGAWLALDTVLGDDDSATDRLVINGDATGTTSVRVNNAGGLGDKTLNGINLITVDGLAQDDTFLLAGDYVTTDGYQAVVAGAYAYTLQADGEAATAGRNWYLSSELMLTEGVRYQVGVPLYEQYPQVLAALNTLPTLQQRVGNRYGAPGALADLNFDDNQWAWGRIEGSHQVTDPARSTSGSQREIDVWKLQTGIDVPLYQSQGGSLLTGGVNFTYGKAKADIHSFFGDGRINSAGYGLGTSLTWYGNNGVYVDGQLQTMWFDSDLSSRTAGHAVASGNNGRGYTSAIEAGKGYALGNGLSLTPQMQVTYSRVDFDTFRDPFDSEVSLQEGDSLRGRLGVSLDKETTWSAKDGTTRRSHIYSHLDLHNEFLNGSKVQVSGVEFATRDERQSVGLGAGGTYEWQNGRYAVYGNVNLLGATRNVSDNYAVGGTIGARVSW

SEQ ID NO: 7892 - protein, 673 aa, Yersinia pestis biovar Antiqua str. B42003004
MKMTRLYPLALGGLLLPAIANAQTSQQDESTLVVTASKQSSRSASANNVSSTVVSAPELSDAGVTASDKLPRVLPGLNIENSGNMLFSTISLRGVSSAQDFYNPAVTLYVDGVPQLSTNTIQALTDVQSVELLRGPQGTLYGKSAQGGIINIVTQQPDSTPRGYIEGGVSSRDSYRSKFNLSGPIQDGLLYGSVTLLRQVDDGDMINPATGSDDLGGTRASIGNVKLRLAPDDQPWEMGFAASRECTRATQDAYVGWNDIKGRKLSISDGSPDPYMRRCTDSQTLSGKYTTDDWVFNLISAWQQQHYSRAFPSGSLIVNMPQRWNQDVQELRAATLGDARTVDMVFGLYRQNTREKLNSAYDMPTMPYLSSTGYTTAETLAAYSDLTWHLTDRFDIGGGVRFSHDKSSTQYHGSMLGNPFGDQGKSNDDQVLGQLSAGYMLTDDWRVYTRVAQGYKPSGYNIVPTAGLDAKPFVAEKSINYELGTRYETADVTLQAATFYTHTKDMQLYSGPVGMQTLSNAGKADATGVELEAKWRFAPGWSWDINGNVIRSEFTNDSELYHGNRVPFVPRYGAGSSVNGVIDTRYGALMPRLAVNLVGPHYFDGDNQLRQGTYATLDSSLGWQATERMNISVYVDNLFDRRYRTYGYMNGSSAVAQVNMGRTVGINTRIDFF

SEQ ID NO: 7893 - protein, 264 aa, Yersinia pestis biovar Antiqua str. B42003004
RLRCEDGKGSTLGARDTFLGLQGDWGKVRFGRMLTPLYEIVDWPYSNPGLGRVFDWGGDVAGHYDRKGDIARYDSPAFGGLTFNISAGRGDVGTKSSNHFGAAAHYNAADIVTFHVGYENNSNFKYDYKTKDTAGKDVDNTFLTDATAYIVGFELPLPAGFGLAGAYKYTEGASKTVKGQEGEQGQYSLIGQYWNGPWGFKVGYAANLESEVNGVEQKDDDEVLSAQLMYVKNGFVPYIRVGQHDAYDSADKKGFVRVGLEYGF

SEQ ID NO: 7894 - protein, 1268 aa, Yersinia pestis biovar Antiqua str. E1979001
MLKHFRLGLFTANVQADTGSQHSFSRVPAAAINPITLAIVVAFSTIALPPMALAACTSPGVGTYVCEGENTDGIILSGTDIAVETQPGFSIIVPENGDPALSLVGSGTISYLDTNSSALDTTGADSLYIQNDTHTTGQSSSINVQTNGSMGSGINISNHSGADSTVQVDVSGTLFGDLNGSPALLIYSSAENNSTILMNINTIFGDVGIRSDNTSFNGTAITNVDIANDINATYSGATINNSGSGGTSVVNFNSKSIITELDALNIYNTNYSGAVITNVDIDGDVISTTSQATSFYNDAYNGSANFTFRANNVTGEYSGISINNSSHNSANNNHDNAVITDILLTGDLTSTSGSGLQINSYMDDGDIKVSAQLENIYSYYEALSVRADTLTGNLQFNIDVSGNIVAENGLGFMVMGGASEGNSTMIINANNISSGSQALNIYNYSGLGSAFTAVTATGHLVSEQGIGAMFSTYVSQGDATAVINLNDITTAGSGVKIDTIANGGNSTTYLTVVGQINSSLYDGIDLRATATEGNTLVSIDVNNIASEYDAIHLDNKNYTTGADNGTSTIDLITRGALVSQQGYGINIETNTADTYVTVGGLVHGGNGTAIGIHRLDNIQTSATLELQSGYALEGVTQALVFNGSYAEINDAALDLANSHLVLGGAGDAAFDLTRIDNREEAILDGDPNRIIGFGTLTKTNNSIWTLTGANMADGDANAFLSANIAGGILVLDNATLGLTPDAGALTGATVNRLSAADIAADPTLVATETGALTLAEGGALSSLGDSVLSGNLISAGGILLSNHYTGGNGAATDDRLTVTGTYFGENNGSGEGAWLALDTVLGDDDSATDRLVINGDATGTTSVRVNNAGGLGDKTLNGINLITVDGLAQDDTFLLAGDYVTTDGYQAVVGGAYAYTLQADGEAATAGRNWYLSSELMLTEGVRYQAGVPLYEQYPQVLAALNTLPTLQQRVGNRYGAPGALADLDFDNNQWAWGRIEGSHQVTDPARSTSGSQREIDVWKLQTGIDVPLYQSQDGSLLTGGVNFSYGKAKADIHSFFGDGRINSAGYGLGTSLTWYGNNGVYVDGQLQTMWFDSDLSSRTAGHAVASGNNGRGYTSAIEAGKGYALGNGLSLTPQMQVTYSRVDFDTFRDPFDSEVSLQEGDSLRGRIGVSLDKETTWSAKDGTTRRSHIYSHLDLHNEFLNGSKVQVSGVEFATRDERQSVGLGAGGTYEWQNGRYAVYGNVNLLGATRNVSDNYAVGGTIGARVSW

SEQ ID NO: 7895 - protein, 967 aa, Yersinia pestis biovar Antiqua str. E1979001
MNTHTPRKFLPALFLAPAIALSLSAQEAAPAPGEPASAQAVGADQPIVLERFTVDVTRDQGYVAVDSLAGGRTNTPIRLTPAAMSSVTRAFIDDLGIRDVREALRWAPNVLPEDPLAGRGFGGQAFQPWAFNFRGVGAGQQGGAGPTRNYFTFFENADAYNIERVEFTRGPNGILFGLGTVGGTLSTYTKVPRLDKTFISPAVIADDNGGLRFELDYNLAANDQLAIRLNALHDDGRGWRNGDDSQKRAIDLAFLYKLSDRTTLRLEIEGFRSTQTLISSTIGDKASGWDGQTASETWGALPIGSARTVKISAAGGWGDWLNAFPVYTPGLGKGLMLWAPWTNDPDPANPAQTVRTYHGGYASTSSLLDPGQALIWAPYKGWYPDQIKLPWETAYSSTAAIPLRPSREWTYGHGRGTNDYENLTAFIDHSFNESLDLQIGFFTYDTSTVAKDYEGTGGASVDINRQLPDGTSNPNFGKPFADFFLSKQTQDRSVDEIRAQLNYNYRGELFGAGFNQLLAVSASERRTKISARQYLGQIANSTWVDNPRDWVHNMIFGRIYLDRPNDFQDVPDVINGYSVAYLPKADGYWFDFDDKFDLTSYALFSNSRFFDEKLSVVLGVRYDSYDEDLRELRRGPDLSDRLVSESDSGTTYTAGAIYYFGWLGVFANYSENILPPSAGSQPYLSGSRPGPEQNQGYDYGLRISTKDGKYYANISRYDSQSQNRNVENPVDIRGVWQAYNIARGANRDDGFGAVAYSDTTAMDASGYEFEVTANPLSNLRLQASYSLPDTEIVDFYPMTRAHVQENLPTWQQQLDATTDPLHASDLRNAISRTQDKLAQSVAGAPQQRSVDYTASFFANYTFTNDMLDGFSFGAGASYTGKPYAATYAGEKYYGSSVHSVDAVLAYETTIGRAKARFAINVQNVFDYDEPLVLDYHNDYTDMSGRHIRNGYFYQTPRTFRFTARFTF

SEQ ID NO: 7896 - protein, 158 aa, Yersinia pestis biovar Antiqua str. E1979001
AAGREGGADIHLGYRTNRIERLDWLGKPQVHAMVSINTNNTSNFAAVGFNWKVELGQPGGFYLRPGIGLAYTDGKAGLPPANAPNLTPEERARRTWLYYNRIDFGSKVLFEPELALGYQVNDKVSVELSYTHLSNGQIFHQGKNQGLDDAGVRLVYAF

SEQ ID NO: 7897 - protein, 316 aa, Microcystis aeruginosa
MSKLDTFIQHAVNAVPVSGTSLISSLYGDSLSHRGGEIWLGSLAALLEGLGFGERFVRTALFRLNKEGWLDVSRIGRRSFYSLSDKGLRLTRRAESKIYRAEQPAWDGKWLLLLSEGLDKSTLADVKKQLIWQGFGALAPSLMASPSQKLADVQTLLHEAGVADNVICFEAQIPLALSRAALRARVEECWHLTEQNAMYETFIQSFRPLVPLLKEAADELTPERAFHIQLLLIHFYRRVVLKDPLLPEELLPAHWAGHTARQLCINIYQRVAPAALAFVSEKGETSVGELPAPGSLYFQRFGGLNIEQEALCQFIR

SEQ ID NO: 7898 - protein, 573 aa, Microcystis aeruginosa
MGHYPASLGGDRPFNTGGYAVNTIAGAASLPAKVDYTGNKPVFTLPSQLLTELGDINSYALKTISSEGNYRREGDLKVIRADGKYEFNDSFKLSAGARYSERSVDDFEFDRAAPLYGSAASNGTGCLVKWKAFDVPLSDSSCSAGNAAGFYTAGLTRKANDPTLNGEVKLFNPGVAGVPSMYVLDPKAMDHALAFQNRFYPGNVEIMNPGASFNVGVKQTSAYLQADFKGEVFGLGFTGNAGVKVIQTKLDITQYVTGSPRPYGVANLLAGSVETNRKFTDVLPAMNVAFDVAENVKLRFAASETMTLLDLNQWGGGLNPTYAIDTTNPGSPVFRVTGGSQNGNPALDPWRAKNFEGSLEYYLGSASMLSVGAFYMKVDSFIQNGSIVRTDLPDNDGVVRNRTVSISTQVQGDGGTLKGLEAGAKLAFNDLSFMPAMLSNFGVDTNFTYAPSKSGKKDLAGASIPFQDNSKYQANLAAYYQDDRLQARIAWNYRSRRAVSQDFGGTTGLEMYQAPTNYLDASVSYDVKPNLTVYVQGTNLTSEYEKYYLTWKDEHAYNNVFEARYVAGVRFKY

SEQ ID NO: 7899 - protein, 675 aa, Microcystis aeruginosa
MFWCRFSPFPLSLSVDDSVNSTQDNTMNRRTLAIVMAAMLASPTLHAAETGSDYLGNEIVVTSSRVPQPKKELTSNVTIITKEEINESSANDLSELLAEKNLGQIQKYPGTLTSVGIRGFRTESHGNDLMGKVLVLLDGRRAGTGNLAKIMTANVERIEIIRGPAAVQYGSAAIGGVINVITAKGSGAPSASIEQKIGSNDFSMTEATIQGKSGRFDYSGSISKSDSGSYKTAKGETYQNTGYHDQKMASLNVGYEIADGQRIGMIVHSFDVDKAGSPGYFSLPDLNAYTVQNNHSVDFRYDGTTSSRTLSWMARYFTGKDEYRYVDPNWGESTNNVDQQGAQAQVSWQPGALRLTAGFDWLKYELDSTSAPTWASYENPAGFLLGKYGLFDERLILTAGVRYDDYHVDMKEGEGTSKSRDNFAHQAGVAWQATDFLKLRGSYAEGFRMPSARELAAHITSWGTTYIGNPDLKPESSETYEVGMDLTWKGLNGSLTWFSTDYKDMIQTKAIAPTTYTYINVGSSTVSGIEAELSKVFALEGSSWTLEPYAGYTYLLRYRDNQTGDDLLYTPQWNASTGLRVHDGCGFNGAFNLAYTGKTLVQNWETGFGEVVPKGGFTVVDLSVSKKFPFGGKGVKGPGITVRAEINNLFDREYQYVKGYPMPGRTFVFGLKADI

SEQ ID NO: 7900 - protein, 520 aa, Microcystis aeruginosa
MKIKQNFLTAAILLGFSGPVLANSLENLSSNPMAQVTSVNQLRDVSPTAWAFEALRSLVERYGCIVGYPDRTFRGERALTRWEFAAGLNACLNTLERLIQEGVAVLKEDLDKIKRLVSEFETELAALGARVDNLENRVAFLENNQFSTTTKLTGEVVMALYGVATGEKNGGEGIPQVPAFGYRARLELNTSFTGKDLLYTRLATGNIADLADTTGTFESTLAFTQPDGNDLLLEVLNYSFPVTENIYLWLEATGGAKDDFTNTLNFLDGDGASGALSTFGTRNPLYFAPGQTGLGLQGNYGALQFSAGYLAGDANDPNPGAGLFNGSYTALAQVGYVPGENFGIALSYLHGYNQLDTGTGSQRSNFRFFTEELFGEAVPTINNSLGLQFTWRIVDGFVLGGWGGYTKARTLSTLDGQLERGDLDIWNWAVTLAFPDLFKEGNTAGIIVGMQPWVSSSSIRLNDGSATNDPDTSFHIEGFYEWKLTDNIALTPGVIVITSPNSNNNNSTLVIGTIRTTFTF

SEQ ID NO: 7901 - protein, 683 aa, Pseudomonas putida
MSKFYLTLLASACSSLSLATASADELTDLTELSLEDLLAIQVTSVAKRPQPANESAAAIFVITQKEIRQSGAKTLPELLRYVPGVEVAEVENHSTAISARGSNFRFSTKLLVLIDGRTIYTSILPGVQWDLERLPVEDIQRIEVVRGPGATLFGANAMNGVINIVTKHAAQMLGTSVSGTAGVTGPSDQVLSTMTVRHGMRVGEDGALRLYATGHNTPALSTKEGEVIDDEDLALQVGFRFDYEPTEIDAITVQGDYNYTDFDSTLDYDNVFGVSSFRPRTTGEIAEKANILARWSRTLSPDSKLTFQSYVDYLSRSEFGGEFEQTTVDFDMSHYFSTGKRWETVWGLGYRVYSDDSTDGGSVDFADNSRTTDIVSAFVQQEAFFANKKLHFSLGTKLEHNDFTGFEYQPSFRGIWVSDNQWSLWGAISRAVRTPSRYETSAIYTTGVYPPAGDVPLPASYPVFGNEDLDAETLIAYEIGWRKSWGNGHSIDLTGYYFDYDDLFLIGPIQAPEILFGPFGPGGMIVPYQIIQPVDVENARKLEIFGAEASLELQLSADWDLKLTGDVKDTSVKDGPINDAQLPQFFQGFTPHYQATLQSNYHFTDQFFGHLALRQVGPLEENPTPSYTDLDLRLAYRVNSQFEFSIEGDNLLEPLRTEFTPLIYPVPTGYVERRLSTSLSVRF

SEQ ID NO: 7902 - protein, 427 aa, Pseudomonas putida
MESLTLQPIARVDGTINLPGSKSVSNRALLLAALAHGKTVLTNLLDSDDVRHMLNALTALGVSYTLSADRTRCEIIGNGGPLHAEGALELFLGNAGTAMRPLAAALCLGSNDIVLTGEPRMKERPIGHLVDALRLGGAKITYLEQENYPPLRLQGGFTGGNVDVDGSVSSQFLTALLMTAPLAPEDTVIRIKGDLVSKPYIDITLNLMKTFGVEIENQHYQQFVVKGGQSYQSPGTYLVEGDASSASYFLAAAAIKGGTVKVTGIGRNSMQGDIRFADVLEKMGATICWGDDYISCTRGELNAIDMDMNHIPDAAMTIATAALFAKGTTTLRNIYNWRVKETDRLFAMATELRKVGAEVEEGHDYIRITPPEKLNFAEIATYNDHRMAMCFSLVALSDTPVTILDPKCTAKTFPDYFEQLARISQAA

SEQ ID NO: 7903 - protein, 810 aa, Pseudomonas putida
MSRAVDRILRPSLMALAIAVAAPLASTALFAAEQSAPRAYNLPSAPLATTLNQIASQAGIALAIDPALVSGRSSAPVSGQYDGLGALQAALRGTGLQLQQSSAGSYSLVAVPDGTLALPETTVDAASVSESAWGPVDGYLAKRTAAGTKTDTALVEVPRSISVATREQMKDRGVHSLDDAVRYMPGIVSASFGSDTRYDWMRVRGFEPTQFLDGLPLPRGVYANPKAETWNLDRLALLRGPASSLYGQTPPGGLLDMVSRRPQAESEHEIELQYGSDNHRQINFASTGKIDDDGRFLYGVSGVIRDGGTQIDHIDDKRYNIAPSLTWNIDEDTTLTLLTQFTRDDTGATSQFRPIQGTKIDMPFGKISHHKNLGDPDYEFYDRTYYALGYAFEHRINDVWQFRQNLRYTKTDLSFQTITPGSYYEPGGPVKDDGTVSRMSTNTDEDISQFAVDNNFQADFTTGDISHTLLLGLDHQRINTNYLSIFGFNVPDSNVINPVYGVPITRPDRSTAFYDYNQKSRQTGLYVQDQMALGNWRLTLGGREDWVHTGTKYFNQGDATNTQRDKKFSGNAAISYVFDSGFVPYLSYAESFQPTSNASASATESLKPTEGQQWELGIKYQPPGSNTLLSAAVYDLTQKNVSVTNNVGGVTVTSQTGEVKVHGLELEAVSDVTENLKVIAAYTLAKSEVQDGLYKGNRLQLMPNQQASVWGDYTWHSGVLDGFGIGLGARYTGNTYGDQGNTYLGKAKAYTVFDASVHYDLGRLDTSLKGASVAVTATNLLNKDYLSTCDSYYCYYGDERSVVASATYKF

SEQ ID NO: 7904 - protein, 810 aa, Pseudomonas putida
MPHLTPLALSLAIGSLALPALAAAPLDTVVVVGTHRSDLTALQSAAPVDVLRGEKLQQTGAQDLSGALTALSPSFNYPQSPQGAFAGSIAQGASLRGLASDQVLVLVNGKRRHTSANVTRQGLVNGRGAAAVDLSLIPLSAVERVEILRDGAAAQYGSDAIAGVINIVLKERDDGGNIGYRFGGYDKGDGLQRKLSGWKGLALPNDGFLTLAFDAGSQDPASDTRDDNRLFYPGSTSTNTPREQNNRYRNWRWGSGNVSDQYNVTANAEMGLGEGLSAYGLATYAHKNTDAENFFDPPTTLRNNYGSVALARYPDGRLPITRYSLEDYAVTGGLRYEDETLGHFDLALNHGNNRLDSTDRDAINPSWGSASASTIYTGRREADQTNLTLDWTRDFATDLLFKPLTVSAGLAWREENYQLTAGDAQGWQNGPLFNTVDPLTGRRIPGYYSGITQVDAASLDRRVIGAYFDLEGQLSEKLQAGFALRSEHYSDFGDTTNGKLSLRYDFTPEIAARASASTGYRAPSLVQAGLSSFSVQVVEQPPGSGNWVEVQQRTLRADSPEARLLGGKALKPEESTNFSVGLVWRPLPNASLTVDAYRIDIDNRITLSDQLPAAVVGPIFAGTPYANIQSAAFYTNIADTRTDGIELAGHYQLDLGAWGRLDLNGGYARSNTRITGLDDVGGIPGNQIIGRNTQGLIEDGTPKDKLTLGANWLYDGWSVTVAQRRYGQWQNRNAANPALDQTFGAQWVTDLDVAYRFGLGLTLSVGAINLFDSHPDKLEGAQLYGVQKYSITSPEGAQGAFYYTSLSYDF

SEQ ID NO: 7905 - protein, 344 aa, Pseudomonas putida
MKLKNTLGLAIGSLVAATSIGAMAQGQGAVETEIFYKKEFFDSQRDFKNDGNLFGGSIGYFLTDDVELRLGYDEVHNARGEDGKNIKGSNTALDAVYHFNNPYDAIRPYVSAGFSHQSLGQTGRGGRDHSTFANVGAGAKWYITDMFYARAGVEAQYNIDQGDTEWAPSVGVGLNFGGSPKQAEAAPAPVAEVCSDSDNDGVCDNVDKCPDTPANVTVDADGCPAVAEVVRVELDVKFDFDKSVVKPNSYGDIKNLADFMKQYPQTTTVVEGHTDSVGPDAYNQKLSERRANAVKQVLTQQYGVESSRVDSVGYGETRPVADNATEEGRAVNRRVEAQVEAQAK

SEQ ID NO: 7906 - protein, 910 aa, Pseudomonas putida
MNTRRFTPKLLPLSICLGMAASAQPLLAQQQDDIEEVIVLGSFRESLATALVAKRNNAAAIDSIVADDIASFPDNNLAESLQRIPGINIDRVGGEGKQISVRGLSADFTRVRINGMETISTGVNNRGRAFDFNIFASELFNRIDVRKSQSAAVEEGSLGATVDLSTGRPLDYESFTLVTSVQGGYNDQAESFDPRFTGLVSVTNEPGTFGALFSLAYSEREVYQYGHNSGRWEANNSNPANVNNWANSADLPTEVNQAVHPRFPRQLDRTINLDRLGMTGALQWQPNDDTSLSLDLMYADMNQVQSEFTLTPISLARTGATGRKETTVNDYFYDAERNGLLYADLSGVDVRNENYRQDWTTQFHQVSLSLDHSFSDNLRLKALAGTSESDHKVHSEMTAIFERYNADMSYDYRNSMTNPLVAYGFDTTSPDNYWVAELRDRPADTTNTFDTVRGQVEYDFAVGAVDMTLNTGVSWKEFSFDNNQYTRDRALINQNNHTSLAVSVPSGCGITLDDLQVTGDMGSVYTPSGGAPSYLLPNLDKVAAQYGLLTDSTCFPLVANEGADRSVTEESLGFHVQLDFSTELAGMPFRGDLGVRDVETDQTSNGLVSGARQEIKRSYSDTLPAINLVLEPVENVLVRAAWSEVMSRPGLGNLTPGGSVDRFNRVLTAGNPYLDPFRAKATDLSVEWYFAEEALLSLAYFDKDIESFPVSIRKDLAWSEIRALGYSDSLLEPGPATVNDIFNYRTSVNGDGGFLEGWELQYQQPITVGPAWLQNFGIKANYTYIESELDSRDSNGNRIVTRMNGQSKISWNTTLWYENKAGFSGRVSWTYRDAYQTANNTTAVSGVDTTASTKVVDAAFSYALNDNIKLTFDALNLTDETETWLLGDYNYLDTQVYSGRQFYVGAQYSF

SEQ ID NO: 7907 - protein, 395 aa, Pseudomonas putida
MHNNNKHLPPRFLAAAIASFSALGLSSVAEAEIMLYDKDQTTFSTDGYINAFYVNSEVDREGEQFDRRQSRVKMGFLPNYLGFNMGKQVDDLKLGARASFWVTINDSETNGTDTAIDVRQFYGTVANPEWGEVLIGKDFGLFARSNILLDELLAGYGQVSDTLGLVDGGGVSFGNIGSGYPYPFPTSQITYRTPVMEGLRVAVGIMDPVDTNDSSPTGKAYQENPRTESEITYQFDLGGAQIYSWVNGSYQTSDNTDSTVETITSKGVGYGVQAKMGGWSLTGSGFQAKGINPFFTNNAGEPVLRNVDSDGYLLQGSYKFGKNRVALSYGKTKDDGNGAVGSGADYETRGVALFHDINDNLKLVAEYNQFSIDGHDTSAQNEDTDTFAVGAVLTW

SEQ ID NO: 7908 - protein, 796 aa, Pseudomonas putida
MKFSPRCVPLWFGLVALPAFAVAPLATAAEQLQAYAFAQPAQPLAQALNAFSRTTGQSVVYTLELPGVQAPALKGRFSAEQALQQLLGNAGLAWRRVDARTLTLEPADTSGALNLQATTVTSQQDDYSYQPLASASIMRGQGPNQDIPQAINVVPAQVIRDQAPRNLDDALANVSGITQGNNFGGTSDTVMKRGFGDNRDGSIMRDGMPVVQGRNLNASTERVEVLKGPASLLYGIQDPGGVINVVSKRPQLQQYNALTVRGSTYGSGKNGSGGGLDSTGALGDSNFAYRLVVDHEDEDYWRNYGVHRESLVAPSLAWLGEDTQVVLAYEHREFLYPFDRGTAFGNNGHPLNIPATRRLDEPFNDMEGRSDLYRLEVDHQLADDWKLHFGYSFNRETYDASQVRVTGVNETQGTLTRSIDGTHNAMSRDQFVTLSLNGNVELAGMQHDLLFGIDHEDRKIFRGDLIRQTPQSTFSYLDPVYGQEVEGTNVRASDSDQTDKLRTDALFVQDALHLNEHWILVAGARFQQYDQYAGRGRPFKANTDISGQAWVPHAGIVYKVDDQLSFYGSYSESFKPNSTIAPLTGNVVLDASVAPEEGKSWELGAKLDMPGRITGTLALFDITKRNVLVSNFDAVTSETVYSNAGEVSSRGVELDVTGQISERWSLIGSYALTDAKVTKDPDLEGNRLQNVARHSGSLSAVYDFGSLFGGDRLRFGAGARYVGERSGNATNTFDLPSYTVADAFATYETKLDEHNVRLQLNVKNLFDKVYYSSAVNQYFVAIGDARQVSLSSTFEF

SEQ ID NO: 7909 - protein, 801 aa, Pseudomonas putida
MPLRALLAGGLVACVATAAEAAGARHRLSISPKSYADALIDLGIQANVSIVGTSACGRGGPVALQGRYTVEEALARLLDGAPCQFRIVDARTVRITPAPTPAAPPVERPPADQPMLVSELVVTAAKRPASLDLLPAGVSAVSRAQIAATGAGDVGQTIGQVAGVLTTNLGPGRDKLLIRALSDGTFTGRARSTVSTYLDHAPLNYNAPDPDLRLVDIERIEVVRGPQGALYGSGSLSGVYRIITRKPDPEAVAGGVGATFAATKGGDPSEEVEGYLNLPLAGGRAAVRLVAYHDERGGYLDDTPPGATNVDRTVRDGGRLAVRLRLGDTWRVDALAATQHLRSDNAQYVNVVLSTGASRGNRIREGHDNDFTHGAVTIQGDLGGVSLVSSSAYVHHTFTSQYDASSVDDPLLPGGAFNAAPADTVVYLENTRVNMLVEDLVLRSRTGGRFRWLAGVYGSLTLERSPSSADIFAPGAPRVPAYREHRKDRVSELALYGEVDYALAPGWTLSVGGRLFGSWVRTSADVWTWAPNGPRVVAYERRFQGVSPKISLQREIGERGAAYALISEGHRPGGFNTAGITPLREIRTTFGADRLRNYEAGLKLRFFDGRMAVRSAAYFAEWRDIQTDQYRITGLAYTANVADAETFGLEGEIGYDWDFGLSVQANALLADSRVTDKNPNFTGRVADELPAVPDVSGGVIAIYQRPFRDDLVLRLVGEASYVGRSALSFDATINRPMAGYVRARLSAELAADGWSAAAFVSNPLDDDSDTFAYGNPFSFRGLRQVTPQRPRTIGVRLAANF

SEQ ID NO: 7910 - protein, 209 aa, Pseudomonas putida
MFIININKVGDIKVFKKALVIALMGVSSFTFAGNWQVKFGGSVIAPSEDTTTPLGVVKADHEYAFTPSVEYFFGQSPFSAELLLATPINHDVLLNGEKKVRIKQLPPTITAKYHFKNSTRFTPYIGIGATAFIPWDEQGVAVKVKEDFGVAGQVGFNFQPADAKNWGVFVDVRYADISPEVTIDPSVANYKFDLDINPFVYTLGYSYKF

SEQ ID NO: 7911 - protein, 743 aa, Pseudomonas putida
MSGLRVGGLVLGCAFSVSIAAAAEPLPPVSTRAGDLAPAEWNRIAQAAGSQVAPSQPVAQQAGETEADLKDEPIDLDEVTVTGTGRARRQSETTTPIYIIDQKEIEQKGSRTLGDAIRNVPGVTTNIFGAGSDVHNGYFIRGVPTTSTAILIDGRPITNLNQEHYDPSEIPVNNVERIEVMPSGGTTLYGSTALGGVINVITRKPTRPIEGQLSVEFGSYGYSKYGAYYQGKSGPVTYNFNYENFNTLNSFFYRVERPVGILSGTRPNGDVNMRSYNLDVGYEIDARNTITLNTYLRNFAKGISPFSIVDTRQNVFGGQSAEQLGLNADHQSRLLTDTWGIGLTWDSKLGQGNDSNLQFRVSVDRALNRELDRIGDDFSTEIYLLGLRGSHAWQVSPGWGITYGFDFLREIGRSGVTTIATGTSTTDYDTSLDRPALFFLNDFKLASNVTLTAGARYSITSQFGNSFDPNIGIRWQVAPNFALRTNFNQGFKAPNFHDLYGKTVHKGNPNLLPERGSFFDAGIDWQPTPTTNLRFTTFIANISNLMSLNLADPRFADFAYFQSLGYIFNDRVRVNYPSVYNTGFEMGFNWRMAPSWEFFLTNTYTDSRVVEGLRPEINQTQQALVPFLMGRAGFSYEDPNGFRAAVFANVVGGRSVDTYHVGPGDAEAFDPAGNPIFISHIAKLPPGSLLPGYTTVDLSLRVPVAQAIVLNAYIDNLLNTYYERSYGGPAPGTNFRVGLKTTF

SEQ ID NO: 7912 - protein, 444 aa, Pseudomonas putida
MYKSSLALAVALGVLAQQAGAAGFVEDSKLSLSSRTMYFNDDNRESGIDQKESGQGFKLDYLSGFTQGTVGFGVDVQALWGIHLDGGRGSRPDANNTFFPSDSDGSAVHDWARIGGNAKARFSKTEVHYGSALAPMLPILVSNDGRLLPQTFEGGTLQSKEIDNLTINAGQLTHAMGRASSNRTGLSVSGAFRDSNKFQFAGGDYKLTPDLTLQYYYSNLEDFYKQHFLGATHVFKIADNQSFKTDLRYFDSSSDGKNGQTGYAFDNNGGYAKNSGEVDNKTWSAMFTYTLGGHALMLGHQQVGDDGGFVWLNQGSVRKDGSTSSLEGNGGASFYLFTDSMINQFARAGENTTFGQYSYDFAALGVPGLKASVSYLRGDDVRNRSGDGTYNEWERDARVDYTLQEGTLKGLGFSLRQGVYRGSGESALDKDQTRFIVNYTYNFL

SEQ ID NO: 7913 - protein, 723 aa, Pseudomonas putida
MSINKKQFPRYAIMYFSLITRSIFCLLMFYAVNALAISLEADDEEALLSLYGDEEMISLATGNSKPISRAPAIATVITAEDIKEIGATDIDQVLETVPGLHVARSPRGYNPIYTFRGIFSQFNSQVLMLINGIPITNLFAGDRNQVWGGLPVQSIARVEVIRGPGSAIYGADAFAGVINIITKAKEDIAGTEVGGRAGSFNSWDGWALHGDSWGGFDVAVMLEYGDTDGQRRTIDEDAQTFFDSQFNTDASLAPGSVNLQRENFDARVDISREHWRLRAGLQRRQNVGTGAGVAQALDPSGRFASDRWNADLTYHNPEFFSENWDVTAQLSYFNTSQEVEQNVRLFPPGADFNSAPGIDFPEGVIGNPEVFERHARFKVSTFYTGFEQHQIHAGTGMRYGDLYDVKEVKNYEFDFETGLPRPLGGLRDVTGDLSQVFLRERDRKNYYVFLQDVWNFANDWEFTAGVRYDHFSDFGDTVNPRLALVWATRYNLTTKLLYGRAFRAPSFAELFNINNPVAIGNPNLDPETIETVELAFDYRPSNALRLALSLFHYRWDDIIQFVSDPGTSVNVAENAGRQKGFGMELEADWALTSNFHLLGNYAFQHSTDEKTGKNAGHAPQHQIYLRGSWEFLPHWRLTPQFNWVIDRSRTASDSRPAINNYSIFDLTLRRTAIKRHWEVAFSVRNLFDSDAREPSPAGNPGALIPNDLPLSGRSFFGEIRFRF

SEQ ID NO: 7914 - protein, 689 aa, Pseudomonas putida
MLVPCRLSPLTLGLSLLFSASLASAATTTLPESSVTADSEREKDNPRVKEVSTATRTSTPVRYVPQAIDTVKTANVLDYGSNTLGKALEGIPNVSSGADTRFDSVRIRGFEASNDFYLDGIRDDSQYIRDLHNIERVEVLKGPAAVLYGRGSQGGIVNRVSKAPEPGRRSTIEAQAGSEDLRSLYADLSADPSDTVSLRLNMGNQDNNSFRDGIDGSRQLFAPSISWQITPDLNWLVQYEYSRYNRTPDRGIPSVNGRPADVSRSATYGDHRDYIDDRAQSLRSRLNYQLNETWQLRHTLGLFKLDSEFDNTYVTGYNAGTNTLTRQRWQQDLNTRNLFNNLEAESDFDTLGLEHKLLLGLEFGNQRRDPLLYSAGSQNLPGLGKPSQPHNGTLAVSSNNHTVVDSRGVYLQDQIRLNDQWQVLAGVRFDQFEVETTNKDGLREPQDSNSTSPRLGMVYTPWRDHSFYASWSKTFSPVGGGLIGITPGAPGNTNDTRPEQTRQKEIGVKSDWLDQRLTTTLAIYELELYNRRTRDPNDPNIILLSGMQRSRGIELTATGNIVGNWYVRGGIGLQDATIVKDNNGQEGNRINDVAKRNGSLFVTWKPELGWYAETGLTLVGERYADNQNTTVLPGYGRWDALAGYRTHDWDVRAALSNIADKTYYSSATSAAQIQVGDPRSLVVTGSYSF

SEQ ID NO: 7915 - protein, 439 aa, Pseudomonas putida
MLKTRISLVALAMIAATQAQANDQADSKGFVEDSHANVLLRNAFINRDKKHGTNDQSQWGQGVIANFSSGFTQGTVGVGVDAFGLYALRLDGGKGRNGGGGIDFFKRENTVNERERSDAANDLARAGGAIKFRISNTVLKYGDQMPALPVLQYDDSRLLPESFSGTLITSKEIKGLELNAGRFTSEVRKSAQGHDSGGLKAINVFGGSYKFTDNFTASLYTADNEDVMKKHYLGLNYVHPIAADQSLTLDFNGYKSDIDKKFAEGRLTGDSNTIWSLAATYAYGPHSFTLAYQRSTGDTGYNYGGYQNDGGFSDGGSTIYLANSYWSDFNAEDERSWQLGYGLDFGAFGVPGLTYKIAYVVGDNINTRTLTKADGYGEGKERELFSQIRYVVQEGPAKDLSIKLRGSFLRTNNAVQQNRNYTDDGNEVRVFVEYPISIF

SEQ ID NO: 7916 - protein, 1926 aa, Pseudomonas putida
MNPMQKKKLISIAIALTLQSYYIPAIAAENNDDEKECPSNISSLPKEKRAKLSPTCLATPENDNHWGWVAGGVAALVAGVAIGVENNGGGDSNHSYTPPTPDNGGDDNVIPPDDSGDDDVTPPDDSGDDDVTPPDDSGDDDVTPPDDSGDDDVTPPDDSGDDDVTPPDDSGDDDVTPPDDSGDDDVTPPDDSGDDDVTPPDDSGDDDVTPPDDSGDDDDTPPDDSVITFSNGVTIDKGKDTLTFDSFKLDNGSVLEGAVWNYSEQDNQWQLTTADGKTLNVTGWDVTDANAAVIEGTQENGLYWKYDSRGYLIIADDNTTVISGDDQAHNSDRGMDISGQDRTGVIISGDRTVNTLTGDSSVTDGATGMVISGDGTTNTISGHSTVDNATGALISGNGTTTNFAGDIAVSGGGTAIIIDGDNATIKNTGTSNISGAGSTGTVIDGNNARVNNDGDMTITDGGTGGHITGDNVVIDNAGSTTVSGADATALYIEGDNALVINEGNQTISGGAVGTRIDGDDAHTTNTGDIAVDGAGSAAVIINGDNGSLTQAGDLLVTDGAMGIITYGTGNEAKNTGNATVRDADSVGFVVAGEKNTFKNKGDIDVSLNGTGALVSGDMSQVTLDGDINVVSVQDSEGVFSSATGVSVSGDSNAVDITGNVNISADYGQDDLAAGAPPLTGVVVGGNGNTVTLNGALNIDDNDLSAASGQYLDVVGLSVTGDDNDVEIDGGINITHSEDPLDGTSADITGISVSGNSTVTLNGHSTIDTNTVVGGHVVLARVNNGGSLILGDDSVVDVNVSYIPTGYYTYNALLMADGEGTSIENKGDITSHGVYSVIRADNGSEVSNSGDILVYATSSNSSEDRAAITRASGEGSAVHNKAGGDITLISDQTPQGSGGIEVYPLKWYTHTFYAMMASDYGDVVNDEGATIHLQGAGVYGVTASRGKALNEGDIYLDGLVPTLDDENNITSTSYWQPSSLYLTSSGMVAGSTDADGDATAINTGNITVNNAGFGMMALNGGTAINQGVITLTADDGVTGQADELVGMAALNGGVVINDTSGVINIDADYGQAFLSDSSSYIINNGSINLNGSPMDDTDSHMGGTPTDKIWIQSLPGSGDSDTRTSDTGFFTAGTLANYGTETLNGDVDVNGGWLYNEAGASLTVNGTVTINGGANALANYGTLDADAISTWHSLFNEADGSITTDLLTLNGDVTFYNNGDFTGSIAGTSYQQEIVNTGDMTVAEDGKSLVSGSFYFYNEEDATLTNSGSAVEGGENTIINLTRANDSLTQVNSGTITATNGYSAITTANGSNDPKWIWNTATGVINGINPDAPLINLGRGYNFGNQGTINVQGDNAVAISGGTSSYVINLVNSGTINVGTEQGKEDGTNGTGLIGIKGNGNATTINNTADGVINVYADDSYAFGGKTKAIINNGEINLLCDSGCDIYAPGTTGTQNDHNGTADIVIPDATTAPTEGSIPTPPADPNAPQQLSNYIVGTNADGSSGTLKANNLVIGDNVKVDTGFTSGTADTTVVVDNAFTGSNIQGADNITSTSVVWNAQGSQDADGNVDVTMTKNAYADVATDSSVSDVASALDAGYTNNELYTSLNVGTTAELNSALKQVSGAQATTVFREARVLSNRFTMLADAAPQIKDGLAFNVVAKGDPRAELGNDTQYDMLALRQTLDLTASQNLTLEYGIARLDGDGSKTAGDNGLTGGYSQFFGLKHSMAFDEGLAWNNSLRYDVHNLDSSRSVAYGDVNKIADSDMRQQYLEFRSEGAKTFTMMSDTLKVTPYAGVKFRHTMEDGYKERSAGDFNLSMNSGNETAVDSIVGLKLDYAGKDGWSATATLEGGPNLSYSKSQRTASLQGAAGQSFGVDDGQKGGGINGLATIGVKYSSNDTALHLDAYQWKEDGISDKGFMLNVKKTFR

SEQ ID NO: 7917 - protein, 567 aa, Pseudomonas putida
MKYNNYILLGIAFTALPVSIQAQTQPKDTTVNRTVIVEQQYNPDIMDAAKVNVLPKVEEPSVSKKEVEYATFTTPATSIPAGTIGAYTGKEIQPGFIPGYVRLGYGNYGNLDVLANYLFRLSDRDKLNVNFKMDGMDGTLDMPFGDTRKWNAFYYRTRANVDYVHQFAKLDLNVAGNFGLSNFNYEPYGFKKQKFTSGDVHFGVKSTDETLPLQYRAETNLMLYGRQQCQLFGGVNETMVRTLATVSGSVSDEQTVAIGFAMNNLIYGNELKENKDRIKDIFKNRTTLDLNPYYELNNDSWRVHVGANVDLSFGNGKAVRVSPDVKAQYVFSDSYVLYAKATGGRQLNDFRRLETYNPYLDPGQEVKDTYEQLNAGLGFKASPTPGLWFDIFGGYQNLKDDLYQSADAWEGGDGANYIGLGQTHTDNFYAGIKASYEYKDLFAISAGGTYYHWNADAQTTGSKSSDYNEALLMKPEFDLGIHTEIHPIAALWLNAGYQYTRRAERYTGLYAKSIPAVSNLSLGATYRIFKGISAYVKADNLLNKKYQYYLYYPVEGINFVGGLSFRF

SEQ ID NO: 7918 - protein, 808 aa, Pseudomonas putida
MLKPLHRRRGPFHHALMSCSAMALLLGPLHAGAATTAEQTQMQARQVQLDLPAQPLDQALTTFADQAGLHLLYTTGDVAGQVSPALQGNYSVEQALQQLLAGSGMSWQFSEARTVTLRKAEAAPQAVNLKPIEVSVASRTSTAISEIPGTVWVVDQQQLREQIDSGVSLKEAIGKLVPGLDLAPEGRTNYGQNMRGRNVLVMIDGVSQNSSRGLSRQFDSISPFNVERVEVLSGASAIYGGGATGGIINIVTKKGEPGPARFETQLGASSGFNNSDDLATRFAQSVSGGNERVNARLGVSGEQNEAFYDGAGDQIFIDNTQTDLQYNRTIDVLGTLGLQLNDQQSLDLLAQYYDSGNHGSTGIYFPNLNYNAPSDLEDAELRSGYSSDLEPRTRRLLLNANYHHTDVLGQDFYLQASYRKEDDNFYPFPYYNRATPTGSRGVYFAASQQNFEVTSLKGLFAKQWDTLKLTYGVDLDRERFNAEQTTFNAQTSSESGGLELEKDSKAARYPSYRVDGVSVYAQLDWHATDNLTLSGGARRQQMDVDVSDFKGVPGGSNDYQVNLFNIGAIYDFKNGHQVWSNYGEGFDLPDPAKYYGKPGLSVADNPLAGIKSRQVEVGWRYADLDWDAQAALYYIWSDKIINVDSQTLTIDVEEQKSRDFGFEGALTRHFQTGWEAGGTLHMTRSEEEAEDGGWIKRDARYASLSKATAFVGWKGDGRSARLQANHAFSLKDDADHEIDGYTTFDLLGSQDTGFGTVSAGIQNLLDKQYSTVWGQRATLFYSPTYGPAYLYDYQGRGRTYTLTWSMAY

SEQ ID NO: 7919 - protein, 887 aa, Pseudomonas putida
MLVPSQHASVARRAITYRPLGVCIGLVLSCNAAAQQAAPNPDPAAPATSTLEAVQVKGVRSSVESAIAIKQSTAEISDSIVAEDIGKLPDNSVAAALQRVTGVQVARAGGEVGQVLVRGLPNVITTLDGRNVFTTVGRDMELADVPAELLRSVDVYKTTGAQFQEGGIAGVVDVHLRRPFDFDQDSTIAGSISALRGDQSGKTVPNGSLTLSQRRDTGLGRMGWMGSVSYQRRPYQESNTLYGTYDRKANPLDPAQQIYVPYSAGGLMARGDRKRKSANFSFQWAPSENSEVYFDTLYIGYDNRPQVNYWLPFPGLATPENTEAVSLRPGSDVLAGLVAREVRTLSSTQAHKNASDTYQAALGGRWAGERMRASSELAYTHSTARNRSFTLDMTTQAPRLNMRSSGGAADVWITQADGSAYDVTAPGNWELSQYYDSWNTQRGEEWAWRADATFDLELGPLRSVDVGARTSRRTATNHSGDTGARNNLTGAPIYLSEVSGLASVTPGNMLDGARAFTSDRWASANQDVLLQQSTRLRTVMGQPPGRPDENPALFFDDREDSYAIYAQVNYGFSLGSIPVDGRVGARATRLDSQLQGSQSVDGVLSPVSIDRRIDKVLPNYSANLTLHDNLMLRLAGSTTITRPEFADLNPQLALYQSTESLPARGNGGNPQLRPVESRNADVSLEWYFRPGSLLSVAGFHRKIDGYIQNYAADESIGGIVYSISRPRNTGEGSLKGVEVGYTQFYDFLPGVWSGFGSQLNYTYISAKAESPEGISQPLTNVSKNSYNAILMYEYARFSARVAYNWRGDYAVSFNSSGDQPEQINQGREQWLDAAFNYELNRHVTLFAEATNLLGTTTNNYFGQRHGDFPREIASPERTYTLGFRFRL

SEQ ID NO: 7920 - protein, 693 aa, Pseudomonas putida
MTRQPRSCAPASSPALCSPSFRLRSTLTHALLLAGLAASTQAQAQVEAPSGTPAAPASQTFQLGTVDVHGARDEAQAISGDEQRLDAAEMRQRNADTVADAVRLLPGATLSRNNRNEEMIYLRGFDPRQVPVFVDGVPLYVPYDGYVDFGRFTTFDLSEIRVAKAGASLMYGPNTLGGAINLVTRKPVKAFEGDARIGAGAGGERKAAVNLGGNLGTWYYQLGASYLDADSFPLPKGFKDFKKQPTDTGNYRDNAYRTDKRLSFKLGLTPNATDEYALGYVRQEGEKGNPVYSGSATGKNVIRYWRWPYWDKDSVYFLSTTRINADNLLKTRIYHDTYQNGLDMYTDASYSRHDPTSSYKDVSQGASIEWANYSFKGHALRLGAHYKIDEHTDAASAKDPSKHYRDVTRSLVVEDTISLAERWSLNLALSHDQRDAREVYQWPTGSASATNGVAKLGYALGGGSEAYFIASHKTRFPTIKDRYSARMGTALANPDLQPETANHLELGVSGSPWQGGQGQAALFYSRVRNQIQTVVVASAECGGTTCNQAQNVGRTRNIGMELSLAQQLSAQWGVNAGYTYLNRRNTSDSSITLTNTPRHRLLAGVQWRPLAQWEFNAEVETEKGRYVPLSGSGQLQTLKLPGYGIANLRARYKPRSDITVDFGVANIGDKWYQFDDGLPMPGRSWYVNLGYRF

SEQ ID NO: 7921 - protein, 685 aa, Pseudomonas putida
MLAVIGFSVFQESNAQELPAETPSSATVPLREFQFETIVVTADAIDDEQQEIESGELRTHKVVDLAEILSDELVEVQMIRKSGYGNEVSVRGFGQENIKVLLDGGILEGACGSRKDPSLSHINMLTVQKLTVQQGPFDVTKPGCLGGYIDVVTRKPEEGFHGELLGKVGSYGFHSGGFTTTGGSDKVQWLFGYNYSESGQYEDGDGSRLWSVREGLGASYSEEGREAQSFQKHDVWGKLQFTPNENSTILLEHSYGKANDILTPRVVFDTEEELTNLSKASWEIRNLGKLSETLTLSVYRNEVDHAPFQEYRNVAVPKNNEVESVISGGAVQNVTETDFATLTYGIDWYHREWWGDVYYSLTGQKINDVLIPSVRSLNLGGYVKMDKTFDRLSLGLGLRYDRFRQEADEELKFTSAVTDNNRNVDHLFGGHLSFRYVLGDEAMLFGGVGRSYRTPTSSERYIQGNPGFFGNPDLKPTANTEFDVGVLYEFGGVKFQTKGFYSSLDDYIYQENNVAGYKSYTNIDAHIWGGDIKAIVDLSDGFSLEGGIAYQKGVKESFPDNNSDDDLGQMAPLKGMLALNYNSHETLREHDRGLFGSIEWVHSSASKHVDADAGEKPLEAWDIINLRMGYRYKSYSLNVGMDNLFDTQYTVANSYEWDVIGGTGANPAIVSEPGRFIYATVGYAW

SEQ ID NO: 7922 - protein, 305 aa, Pseudomonas putida
MPLLKLWAGSLVMLAAVSLPLQAASPVKVGSKIDTEGALLGNIILQVLESHGVPTVNKVQLGTTPVVRGAITSGELDIYPEYTGNGAFFFKDENDAAWKNAQQGYEKVKKLDSEHNKLIWLTPAPANNTWTIAVRQDVAEKNKLTSLADLSRYLQEGGTFKLAASAEFIERADALPAFEKAYGFKLGQDQLLSLAGGDTAVTIKAAAQQTSGVNAAMAYGTDGPVAALGLQTLSDPQGVQPIYAPAPVVRESVLREYPQMAQWLQPVFASLDAKTLQQLNASIAVEGLDAKKVAADYLKQKGWTK

SEQ ID NO: 7923 - protein, 720 aa, Pseudomonas putida
MPRVTHPGRWVPLVIVSLVLPLAHAEVGEEEQGSEVELGTLQVEDWQEESEGSAESGYRHEAARVGPLGKVPLRDTPYSLNVTSGELFENRGAHTVSQALKTNPTVATLMESNTYSGLSRVMVRGFTAGDQGDFRDGVVDRSFTFVPLENVERIEVLNGLSSFLYGFSSLGGSLNYVSKQPTATRQASLALGRYGGGMDYQHADLGGPVDPEGRLAYRVNLYDESGSTYVEGSHQERSLMSAVLTYRLTPDTRLFADGWYQDLDMRGLQTYINVNPASGVNVPSARHFDAETQYGQDWTYNKSHKSQVGVGFESSLNDVFTLRSSFRYGNMWRSYQYTTATLTDNEGNYSESARGSTRQTERTYSGFALLDANFATGAIRHKLTMGFTGHKYRYTRGNDVTTLLGTSNIDSPTDYARPSQTIGQTNVYYHQFYRNWVIGDRIEFNDAWSAVIGFNRAEIRQNVSGGGTSLGTASYTQRKTTPSYSLIYKPAREVTTYLTYMEGLTNGGSAPATAANAYEILSPSVSRQWELGAKATLGRMDLALALFHIDKVNEYTDPSDNTYKQDGREVHKGVELTATGKLTDNLTLVGGYTFMTAEVTESRNNKSLEGNIPVNVPERQGRLYMEYNLSRLRLPDVTLSGAANYSGRRPVDAANTDYLHGATTYDLGLRYEPELAGHKLTLNLFVNNLFDKDYWSYYRSGDGLLLGAPRMTSLTAKLDW

SEQ ID NO: 7924 - protein, 839 aa, Pseudomonas putida
MSSTKRTLLFAAASVIALTGAQAAAQDSRSVDVITVTAQKREQGIQDVPVAVTAYNAELLQNAGVRDLKDLAVIAPGINVTSTSNEFVTTARIRGIGTVGDNPGLESSVGIVIDGVPRARNGVGFNDLGELERIEVLRGPQGTLFGANTSAGIINVVTKRPEYEFSSHAELEYVAGSEEGYGVAGGFTGGVSDNLAMRVFGAYRERDGFQTVETFGGPRTEDRDGDQDYFTLRTQFLLDFSENVSLLLSADYTKREEFCCGAPSLVSGPTAAAINALVPGARPLAGSEDPFSRVIQANRDTGQNIIDHGYSGELNWEFDNFDMTAIVSDRSYSLRSGQDTDFTGADIVFRDASNNTFDFDNTTLELRFSGEGESVDWMFGMYYSDENLVRGDAIQMGNVFEPYLGLLGGSPTLVTDLANGLGFTFIPGFGGLAPGSGAPLGGGNPLGDTFTQQGESLSFFTHNTWHVLENTDITFGLRHTSTDKEATFDFADSSVPACDVWEAVFGDALDFSTPLSQAILNGFSAGSGVAVADLVTFGTFTCLPFSRDVYAQIDNTQSLEENQLSGLLSVSHRINDDFLVYGTFSRGYKAGGFNLDRFTQAGSSAVDFQSVLADPSSYPARFDPEVVDSVEIGFKTEWFNDTLLANLYLFSSDFETYQLNTFNGIGYFVTSIDGASTQGAEAEILWLPESMPGLTVQGGVTYADARYDNFAPTGTADVDRLSGQNFSLAPEWYTSASVSYTGELEGGMNWLAHLDGRWMSEQNTGSDLDPEKVQDGYMVFNGRVGLSAEDEAWSLELWGRNLLDEEYVQVGFDGPFQPGSFNAFLGQPRTYGLTLRVRN

SEQ ID NO: 7925 - protein, 810 aa, Pseudomonas putida
MSRAVDRILRPSLMALAIALAAPLASTALFAAEQSAQRAYDLPSAPLATTLNQIASQSGIALAIDPALVSGRNSAPVNGQYDGLGALQAALLGTGLQLQQSTVGSYSLVAVPDGSLALPETAINADASYESAWGPVDGYLAKRSAAGTKTDTALVEIPRSISVATRQQMSDRGVHSLDDAVRYMPGIVSASFGSDTRYDWMRVRGFEPTQFLDGLPLPRGVYANPKAETWNLDRLALLRGPASSLYGQTPPGGLLDMVSRRPQAESANEIEVQYGSDNHRQINFASTGKIDDQGQFLYGVSGVIRDGGTQIDHIDDKRYNIAPSLTWNIDDDTSLTLLTQFTRDDTGATSQFRPIQGTKIDMPFGKISHHKNLGDPDYEFYDRTYYALGYAFEHRINDVWQFRQNLRYTKTDLSFQTITPGSYNTTTPPVQDDGTVSRMSTNTDEDISQFAVDNNFQADFTTGDISHTLLVGLDHQRVNTNYLSIFGFNVPDSNVINPVYGLPITRPDRSTAFYDYNQKTRQTGLYVQDQMALGNWRLTLGGREDWVHTSTRFLNQGDATNTQRDKKFSGNAAISYVFDSGFVPYLSYAESFQPVSNAAASATESFKPTEGKQWELGIKYQPPGSNTLLSAAVYDLTQKNVSVTNNEGGVTVTSQTGEVKVRGLELEAVSDVTENLKVTAAYTLAKSEVQDGIYKGNRLQLMPNQQASLWADYTWHTGVLDGFGIGAGARYTGNTYGDQGNTWLGKADAYTVFDASVHYDLGRLSSSLKGASVAVNATNVFNKDYISTCDSYYCYYGDERSVVASASYKF

SEQ ID NO: 7926 - protein, 592 aa, Pseudomonas putida
MRKAPLLRFTLASLALACSQAFAAPSPYSGMIVFGDSLSDAGQFGGVRFTNLDANGNYAPVSPMILGGQLGVNPTELGPSTSPLNPVLGLPDGNNWAVGGYTTQQILDSITSTSETVIPPGRPGAGQVLREKPGYLANGLRADPNALYYLTGGGNDFLQGLVNSPADAAAAGARLAASAQALQQGGARYIMVWLLPDLGQTPNFSGTPQQTPLSLLSGVFNQSLLSQLGQIDAEIIPLNVPMLLSEALASPSQFGLATGQNLVGTCSSGEGCVENPVYGINGTTPDPTKLLFNDLVHPTIAGQQLIADYAYSILSAPWELTLLPEMAHTSLRAHQDELRNQWQTPWQAVGSGKPLSPAAPRTWISTARAGASGDGRGYNLTVGGSYRLNDAWRLGLAGGVYRQKLEAGGHDSDYTLNSYLASAFAQYRQDRWWADAALTAGHLDYSDLKRTFALGVNDRSEKGDTDGEAWAISGRLGYNLAADSSNWQLAPFISADYARVKVDGYDEKSGRSTALGFDDQARTSRRLGLGLQGSVQVLPSTRLFAEVAQEHEFEDDRQDVTMHLTSLPANDFTLTGYTPHTAPDPGEPGGKP

SEQ ID NO: 7927 - protein, 228 aa, Pseudomonas putida
MQCDNLCKRYQEGSVQTDVLHNVSFSVGEGEMMAIVGSSGSGKSTLLHLLGGLDTPTSGDVIFNGQPMSKLSSAAKAELRNQKLGFIYQFHHLLPDFTALENVAMPLLIGKKKPAEINSRALEMLKAVGLDHRANHRPSELSGGERQRVAIARALVNNPRLVLADEPTGNLDARNADSIFQLLGELNRLQGTAFLVVTHDLQLAKRMSRQLEMRDGRLTAELSLMGAE

SEQ ID NO: 7928 - protein, 769 aa, Pseudomonas putida
MHQPLLARRPLRAALFGAFGLYAAAARAAGPASEPAAAAPPAAASAASTSQVRHAAIAAARKDAPALDPITVTATRTASAASRTAASVSVITDSDLEEQQADNIKDALRYEPGVTVRRTAYRPANAALGGGRDGDSSINIRGLEGNRVLLMEDGIRLPSAFSFGPLEAGRGDYADLDTLARIEILRGPASALYGSDGLTGAVNFITKDPSDLLSIHRKKTYFSFRPSYDSVDRSIGATVTAAGGNDRVQAMLIASGRRGHELDTHGDDNSASTRRTRANPQDVYTESLLGKLTITPTARDTIKLAAETVRRRIDTNVLSAINPPTTLGLTANDRLERNRFSIDYDLRDATARGFQTAHVQFYYQESTQDQDAFETRGGRLQSRSRSNHYSERALGGSAFAESGFATGPLAHKLLYGVDGSIDRIKSLREGTVASPGESFPNKAFPDTDYSLFGAFVQDQIGFGKLLVTPGLRFDAYRLSPSSGDPLFTGKTVSSSDHELSPRVAMLYEVSPALIPYAQYAHGFRTPTPDQVNNSFSNPIYGYTSIGNPNLKPETSDTLEAGLRGTLGTGYGPLRYSVAAFAGRYRNFISQRTVGGSGRPNDPLVFQYVNFANARIHGFEGRAEWVMPNGFTLKTAMAFTKGTTQDNGAASEPLDTVNPFSAVFGVRYEPSERWFAQADLLWQAGKRGRDVSSAACQKKTCFTPPSSFVVDLRGGYRFNKHVSAYLGIHNLFDRKYWNWSDVRGIAADSNVLDAYTAPGRSVAVSMKVDF

SEQ ID NO: 7929 - protein, 230 aa, Pseudomonas putida
MPHHIVIVEDEPVTQARLQSYFTQEGYTVSVTASGAGLREIMQNQSVDLILLDINLPDENGLMLTRALRERSTVGIILVTGRSDRIDRIVGLEMGADDYVTKPLELRELVVRVKNLLWRIDLARQAQPHTQDNCYRFAGYCLNVSRHTLERDGEPIKLTRAEYEMLVAFVTNPGEILSRERLLRMLSARRVENPDLRTVDVLIRRLRHKLSADLLVTQHGEGYFLAADVC

SEQ ID NO: 7930 - protein, 348 aa, Pseudomonas putida
MPVAMAGMVAGMACGVTGPVRAQPAASVSVYGLIDTMVRYSDNNRGDERLAELSEGYFSGSRWGMRGTEALGGGWAALFTLESGFDLASGNSLQGTAISNYGQVGTQGAGRLFGRQSYLGVEHQAWGKLTFGRQFTTAYDATFRFQPYGHPNLDAVAILNGYTGPRQDNMVKYAGRLGALSAAAHYTFGEAPGDARAGSSRGLALAWTTARIDVGALLQRTDALPTAEARTIWGIGGSSQLGRVKLALGYLDHRYRLAPTRNHVLTGGATLQATPALALSLAAGYDRQTAASGHRLMLTGVAEYALSRRTSVYAEADFNRISGAYALPAFMGVRGNKFGGGVGLRHRL

SEQ ID NO: 7931 - protein, 688 aa, Pseudomonas putida
MSGCTPVFALSLRGTIAVLCGSLLAPLAFAAETGHEGHVHDPAELSPTVITAIAPSSPLTVVTNPKDPRQPVPASDGGDYLKTIPGFSVIRAGGTNGDPVLRGMFGSRLNILTNGGMMLGACPGRMDAPTSYISPETYDRLTVIKGPQSVIWGPGGSAGTILFEREPEKFGELGSRVNGSVLAGSNGRFDKVLDAAAGNQLGYVRFIGNQSHSDDFEDGNGDTVPSRWDKWNGDVSLGWTPDADTLLELTAGKGDGEARSAGRGMDGSQFKRESLGLRFEKSNLGEVLDKVEAQVYYNYADHVMDNYTLRTPSGTGMMGMPMVSNVDRRTMGARIKATWRWADVQLISGIDAQTNEHRQRGGMGVNAHKGKPWTKDADFHNYGAFGELTWYATGEDRLVTGARLDRASARDFRKGSATEGDTRADTLPSGFVRYEHDLAAIPATTYIGLGHTQRFPDYWELFSPKRAPAGSVNAFDGIKPEKTTQLDFGIQYHDERLEAWASGYVGQVRDYILFDYQRNMMGSLTSQAQNIDARIMGGELGAAYKLTENWKADATLAYAWGKNSSDGKALPQMPPLESRLGLSYSRDTWSVGALWRLVAEQNRIAKNQGNVVGKDYDTSSGFGVFSLNGAYKINNNLKLSAGVDNLFDKAYAEHLNLAGNAGFGYPANATEPVNEPGRTFWTKVDFSF

SEQ ID NO: 7932 - protein, 370 aa, Pseudomonas putida
MSANKINKTAAAAIASAAFLSLGTSAHAQSSVTMYGELDTGLAYISNVGGHSQWKSTTGLVDGSYWGLQGIEDLGGGYRAIFRLERGFSVTSGEMLNDHPYYVGIGNEKAGTLTLGHQYDLVHDYLAPFTLTGGTGGTAFAHPFDNDNANNTYLAANSVKYASPSFGGLTFGGMYAFSNTAGQFANNRAYSFGMSYQAGALNAGAAYLHANGRGNSSAGAYEAVVLPTSTNDVFDASVQTQNTYGVGVSYAIGDFTMAAAWSRSTFTGVTVLDTGGIAPSAGFSNYEVNGIYQLTPSVALAGSYTYTKGSGAHWHNGGVQADYQFSKRTDTYLEAIYQRASSGAPAVINSADPSSGHNQVLIGAGLRHRF

SEQ ID NO: 7933 - protein, 227 aa, Pseudomonas putida
MNKSLLGASLVALALAAPAAHAYQAGDMILRAGAITTAPNESSGDLKFDGNKVSGTKATLDSDTQLGLTFAYMLTDHVGLELLAATPFQHTVGVKGLGGGLDGKLADIKQLPPTLSLQYYPMAPNSRFQPYAGIGINYTLFFDEDLSSARKQQGFSNLKLQDSVGIAGQLGMDYMLTDNLLVNASVWYVDIDTKATVDGPSALGYSKTKVNVEVDPWVYMVGLGYKF

SEQ ID NO: 7934 - protein, 290 aa, Pseudomonas putida
MVLNMKKTFAAGALLALSCSMPALADDNKAEYLSDWWHQSINVVGSAHTRFGPQLSSTTYLEYEAFARKDWFDFYGYADVPKFFGGDPDSRGIWDKGSPLFVEIEPRFSIDKLTGADLSFGPFKEWYIANNVIYDQGRNSGSRQSTWYMGLGTDIDTGTDLSLSLNGYAKYQWQNYGAANENEWDGYRVKVKYSYPLGSLMGGNVSYISFTNFDFGSELRDKSNSSRTNNSIASSHILALGYDHWHYSFVARYFHNGGQWADGAELNFGKGPFEVKSTGWGYYLVVGYNF

SEQ ID NO: 7935 - protein, 889 aa, Pseudomonas putida
MNGFARTALTGSAAFMCVATASSAWAQSKIFNIPAQSATTGIAAFGQQADVQIAASRTVTQGKRTKAVKGEMSVGQALSQLLDGTGLQVWQTGVQTWTVVAARPTSRVVTHGRGTAYAALGDAVGASDPDNDAAARPAGSSSPASVAPSQHAEPPETGDIVVTANRRETSINKVPISVSAMTQESLDRQGIKRIDDLARTTPGISFQRSSFAGIGNRSQISIRGIESNVGASTTGIYIDDTPIQTRNAGYTSTSVFPAIFDLERTEVLRGPQGTLFGSGSEGGTVRFITPDPGLSRFSTYDRAELSFTKNGEPSYEVGSAVGAPIVEDRLGVRLSAFFRRDGGWIDRVDRSTGKVLSSNQNSNESIVLRAALTWAPTSSLKITPSFYYQDLDSQGGDGYWESLSDAGAGRFLTGNAIGAPSSDKFKLPALKVEYDFGGATLVSNSSYLSRDAIANPDYTQFVRAVTTGSAFPLIPGEFSRGYFIDEQKGFTQEVRLQSNEHGSRLHWVLGLFYNRTRQVDTEIISSPFFPQIVLDTYGVDYITIFGNPLGARDSVYTDEQRTKDKQIAGFGQVDYDITDKLKATVGLRYAKVDFSFTSRNEGPFAGVATNTGSQSEKPLTPKFGISYQADGANLYYASAAKGFRPGGAQRRPPSSCASDLAALGITSAPETYDADSVWSYEVGTKNRLFGRSVNLATSAFWINWNNIQQNVPLNACGQSFVGNLGKAVSRGFDIAIDARIGDFTLGLSGGYTDAHYTQSIISGTAVVALKGEEISTISPWVAHISGQYDFALADHDGYVRLDYDYRSKGAKPNIAVFGVDPLLFRRPETHFFTARAGVDVGGLDVSLFVDNLFNAHPLLSRTRDIVSSTLIYGSTFRPRRIGVTLSYRK

SEQ ID NO: 7936 - protein, 863 aa, Pseudomonas putida
MLRNRFRIVFVSCIVASSLQAQEETHTLGKVTTLGERTFEYNNKMYIERKELQQRQSNQVRDIFRTRADVNVASGGLMAQKIYVRGIESRLLRVTIDGVAQNGNIFHHDANTVIDPNMIKEVEVIKGAANASAGPGAVAGKLSFTTIDANDFLRKNQTYGAKMEAGFYTNFGYRMNATAAYRGKNWDILAYYNHQDIFYYRDGNNAFRSLFHPNFDLQDPSNSDIGVGTPSEVNSVLGKVNGYINDTDTISLSYNMTRENSTRLLRPNTTSALSKANDPGSQPAPFVIDFGKELAHTINFNHNLSLKYKHDGGTRFGQPRIESTAFLGVRGGDYNPVVNPFAYNSNEPANPDYIPEVKDWCNNPDNISQCTQGAIRPSDGGYQIGYGKPGAIDWQNTSMISTGSNIYHGLVPKNPDYDMTPPNAENTASNDWTLGNADAEGTLARRIFLINSGVNFKVTHPISEDYGNVFEYGMIYQNLSVFSGLDKGKNGYYKNNINPNDPNGLGLPYRHYYTDQSSQYPQNLNTPNPLYRNMPQNSHAIGNIIGGFMQANYNLLENLIVGAGTRYDIYTLLDKNGRTHVTSGFSPSATVLYNPIESIGLKVSYAYVTKGALPGDGVLMRDPTVIYQRNLRPAIGQNVEFNVDYNSKYFNVRGAAFYQVINNFINSYGQDTSKNGGGNATAKNMSGNLPETINIYGYEVSGNVQYKNFVGTFSVARSWPTARGHLLADTYALAATTGNVFILKADYNIHKWGLTLTWLSRFVTNMFYEGYSIYYPQYGLMKIHKPGYGVHNVFVNWTPTSKKWQGLRISAVFNNILNKQYISQASVWQASADAPASDMIPKDKRMALPAPGFNARFEVSYQF

SEQ ID NO: 7937 - protein, 664 aa, Pseudomonas putida
MNRLLFFVFSITLITNVSAEDLTDIQISSPVMDKATISNEAIEEVDTRNAVDGGDLLKNINGVNAIRRGGHGLDPVIRGQSDQRLNTFLDGAMVYGACSSKMDPASTYANVNNYDSVTVIKGTQSVLFGAGGPGGAVSFKRVTNPVAKPEFKIGQNFDSNAGAYTTSGNMIFPLSSSAYLRVNGSASNAGNYETGSGIKPLTEYSTTDYTAILGTLLSDGSKLEFNYTNNRQDKVGYPGLTMDIVYSYTDMYTLKYHRVTPFGMFSTMNVELFNTDIDHLMNNVVLRGNTGNGVMSWPTASDTYGGRIIGTIGSDIRAGIDFEHNTKDAEQNMVMSGMNVFMTYLWPGVETEKLGLFFEKDLNNISYGLRYDQVELDPTRAADDPGSGMMQKTANEVYTADYDGTIVATKRDFDNISGFLRINKDYNHGESYINFSINERSPDTNELFHAKNNSTAMMRHVGNPNLSSERHMTLEVGYEGMLMGNHITGSLYYNDVDDYITTHRKDDSAMKARLYKNVDATLYGYELTAHRIIAGIDTTLNLNYTHGEDDTQNRPLPQIMPLAGDITFELKSAKTNYGLRINFADTQDRFDSKVLDVGETAGYTVYDIFTGFEPTPNLRFTVGMANITDKRYATHLNATNRLDGAADRTDEPGRSLFGSINYEF

SEQ ID NO: 7938 - protein, 728 aa, Pseudomonas putida
MSRLYWMKALLAASVAAAAMMPPMAAFAQSVQSSTQLEPVVVEGEAGDSATGPVQGIVAKKTKTGSKTAADIKEIPQSVSVVGRQEIDDQGAQKVDEALRYTAGVFAQPFGPDSDTNWLFIRGFQATATGTYMDGLQLFSYGFGGFYVDSFGLERIEVLKGPASVLYGGSNPGGLVNYVSKRPEFERKRYIETGINDAGNVYLGFDIGDVANNDTVSYRINGKVAGGDTYSDLQNGWRGFISPSITWKPDEATTLTILANYSHIDENHNGGSFLPYEGTVTDRIIGGVNYGRIDPDANFTEPSVDLYKREQGSIGYEFEHTFDNDWTVRSNTRYSAANIQEVSVYPNGWVSPASTQLNRINFGHDTDAKTFLSDLQIEGKVQTGAVEHTLLAGIDYKYYNIDQVQSSALFGTTPPIDAFTPVYGSTLTPRVSYLSQNLTQQQLGFYAQDQLRFGDGWLVTLNGRYDRGWLGADNRPTFYSASPSAQSQTVGDFSGRAGLAYEFADGVTPYASFATFFNPVIGTDANGNLFNPETGQQYEVGVKYVPTFIDGLFTVSLFDLTRQNVATATAANPFAQYQTGEMRSRGVELEGKVNITEDFKVTGAFTAYDLKITKDKEPTYVGKTPFIAPEVMASASVDYTFRGDWYDGISVGGGLRYLGSSWADNANTAKVPAVTLADLKLGYEKENWGVDLNVTNLFNKTYVASCQTTLTCSYGEGRSFKLKVHTTW

SEQ ID NO: 7939 - protein, 924 aa, Pseudomonas putida
MYNNSKVAKAIRVAMMFGAGAAAAISAPTFAAEEGVEEVEKIEVTGSRIKRTDMEAASPVSIFSAADIAASGVTSLEGFIKQIPAINGAQLGSNVNNASAGFATASLRGLGSGRTLILINGRRFNSGDLNSIPTSFIERVEVVRDGASTVYGSDAIAGVINFITKKDFEGLEVTAQYDVTGEGDGDTAKFSIVTGASNDKGNVVFSVDYTDREEVTQADRKYSECPLWDDGVGSTTYCGGSSHSEFGRVNLPKGYIINGEAVGSKRPDDSTVGGRYVTIDGAGVPFSTADHGYNYAATSYLVTPVKIFSVNAASTYEISDSITAFAEGGYSNRQSSQQMAPAATFWSAPVPAAHPDNIYGVDVSINRRITEGGGRGFEQDTNDYRVVGGLEGEFDNGWGWDVSYNYSRFVDTRVNTGELNRPNTETLLDPALCAADEDCPGVWNPFAKGTMTPEQSDFSTVTFSPVRKGTTTQFMANLSGDLGELELPGGAIQWAAGYERRTEYYLNEPDGAEALGQVYGQAGIRTEGDYSVEEVYAEFNFPILSGVPFAERLTFTAAVRASDYSNLDDNATNTKFGFEWEPVDGLLTRATFAEGFRAPSITELFDPQEQSALSYTDPCWDYGLSSNETLKANCAADGIPADFDSDSQSNAIVGGNPDLQAEESESLTVGIVYSGIENFSVAFDYFNIKIEQGIGTSGVDNIANACYNSVGFSDELCDDIKGSKFGPLDTPPHPTSPRRNVSEVLSGVLVINDNLSTFETSGIDFDFSYNMDLAGGTFTTTLNGTYLMAYDYTLTAGSETIEAAGMVAADQWEGNPAVFAEWRTNLGFNFATDDYSANVTFRYQSEGDDISATDTTLDTVADSVVYTDIQGTYYINDTYTISAGARNLFDVKPPYMSNYDDSNTVNYSYDLAGQYLYVKATARF

SEQ ID NO: 7940 - protein, 494 aa, Pseudomonas putida
MQGECKMRRGGHGMERGSARPGRMAWAAGTLLGALAFGLPVSVSAQQPSPVGQFNDQTQPRTDPRIAEKPSDPVRVGPLAPWATHMAERGLTFDINIYNFYQANPSAGLRTGEQSNSTYFVLSMTADMQRIANISGGTIKFTQTFFGNVRNLNMAADIGDTTVGYQPPFNPNNNRLSLLTYQQKLLDDRLVIEVGRTHPDRYYGLPPCNSINSCFQDLFYINAGFTSPLYAVWGANAAYQLSPTSYVQAGAFSVNPGTNALSGYDFGYERLSGALVMAEIGTKTDYTMTAYPGRASLTGFFNTADHDDNFKTVFGTSKGLNPGAPVLQKSGTSGIVLTGTQTVWRADGGLVANPHPTAISLYTGTGYSFDPTVPIRFNSFVGVRLDAPDQSRPNDSYGLKMNWQRLSENYTQFLSDANFISGGSGAPYSRDKFVFEANAHFDVGAGVIIEPVVQYVVNPNSFWNPFTARRAKDGFYAGATLVVPLGTLLGLAPG

SEQ ID NO: 7941 - protein, 778 aa, Pseudomonas putida
MPHRRPGHRARALTLILAASLLAIAAAQAQSGGKAVALDEISVTSEGNGTPGGTQGGAAGVARSGLPPVSAPTPLDKPTGEVVTSVGREGVIDNRAATTVADILRNSPGVTVRQGNGPRDVVVSIRGNNARATGVSRNFVVLEDGFPVTQADGSSRFDLVDPRAYSRIDVFRGPQSPFFGNFATGGALNFVTRRGSEINGVEYGVDAGSFGYLNNYGTFGGVSGPFEYSLFTSDTRGNGFLSHNSFDTQTINFLGTYAPTPDDRFTLKIINNEVSTDLPGRGSLNQFRLNPFQRGCATAAAAAPGCVTYNLLLNGRNGATVPVTADEGAFFRGDRRTIIGGRWEHDFDAFTTWRTQLVFDDRQINQPFYTSSGRGDFPGFNFLTDLTRRGDLFGLPATGYVALAYNTLDSHSLTYNRAPYGGARLGALTADLEATQANLGGRARVELQLSEQWIAVAGISAENTTINGRNITYGFPAAGGVTTTLANIDRSFLNVAPELSLLYRPNTDWQFRGRVATGYATPSASNLTVTSAGVPGNNGQLQTQENLGFDVGADWTPVPGVRFSVTGFYEFFRNEFVTQSPGAGLLSYTFNAPASEHRGVEVGADWAFAPGWRATAAYTFDDQIYTKYVEQLSAGSLTRRFDRTGNHIPSVPANQLLARVGYEQATGPLAGLGGYVETVFQDDFFIDNANLLKAPGYAIVNLNVHYTTELVGYAKRLNLFFEARNVLDKTYVASAQNLANSISATSGLQNGASVLANTTGSVFAAAPRNFVGGMRLSF

SEQ ID NO: 7942 - protein, 320 aa, Pseudomonas putida
MPYLIPIHFFHVSDSYSISIYLYFFTINRLKKLYWYSPFPCINNMPLLINLLLSNQLITIGIGNYAMKKHLFTLTLSSVLAIPAVSHAEFKGGFADIGIHYLDWTSRTTEKSSTKSHKDDFGYLELEGGANFSWGEMYGFFDWENFYNDRHDKPGSEQRYTFKNTNRIYLGDTGFNLYLHAYGTYGSANRVNFHDDMFLYGIGYNFTGSGWWFKPFFAKRYTDQTYYTGDNGYVAGWVAGYSFMLGSEKFTLTNWNEYEFDRDATYAAGNGGKEGLNGAVALWWNATSHITTGIQYRYADDKLGEDFYQDAIIYSIKFNF

SEQ ID NO: 7943 - protein, 755 aa, Pseudomonas putida
MTSFRWKAAFCAGTAMVCLPAIVSAQTSPQAEPVSPTGLEEVIVTAQRREERLQDVPVAVTAFGARELERRQINDVRGLTENAPSITFTATPYGNNDLILAIRGVAPGGVLPNVDQAVGTYVDGIYYARPEGSNLAMVDIASAEVLRGPQGTLFGRNTIGGALNITTNKPTYALDGSLKLGYGNYNAITATGIVNLPIVADKLAARLVYSHVGHDGYGYNPSLGSDVADQNDDFIRASVRADLSPDLRVDVSFDHYAGSNHQPLWVLNAYQAGLTAAQYAPYVAGPKSRVSYAGYNPTNKSKVFDWTGTITADLGFATLKTISGYRNIDFEGAADLDGTPLPTADVRAFELDGDQVSQEIQLYGTALANRLNWTAGAYYFREKLRNSPITRVPATIQDNTIRPTNESVSVFGQVSFEVLPRLRLTAGVRAVKDTRGMVYTPARFAVAAASSSNPEPPASAVTPAACPFTAIGLNQAPGGCLYAPDDIKFNTVPFTVGLDYRLSGDGLLFAKFSKGYRSGGFQQASGTTAAFFTPFDEESVGSYEAGAKLSFFERRLRVGLSGYFSTFSGIQQNAILSASPIVIAVLNSGKAEIYGGEFEATALLGALRLNAAIGLIHPEFTEGPYKGSEVPTVAKTTFSLSADYPVELSAGRLDLHVDYNYRSEVFFLNTVTITGAGPVPLTAFQRRSVSQDGYGLLNAQASFTLAKSPVTVSVYGKNLANEYFGARSGSFAAANFNTMVIGAPRTYGVNVSYAF

SEQ ID NO: 7944 - protein, 116 aa, Pseudomonas putida
MFSRLTYLGAKKAKDAQYTVYENKGRGTPLQKKVKDYPWLNKSAYVFDMYGFYKPAKNLTLRAGVYNVFNRKYTTWDSLRGLYSYSTTNAVDRDGKGLDRYRASGRNYAVSLEWKF

SEQ ID NO: 7945 - protein, 1083 aa, Pseudomonas putida
MMHPSCNSLVRCSLPLASLALALLASQSAQAATCPELLGREIPAQAIGLPTSGARVTAATPVAGGGSAPQTFGAYCDVSAEIRPVDPATPAIRMRLVLPEQWNRKAMMFGGGGYNGTVPNVAGNVPAGPLDQPTPLGRGYAVFGSDSGHVADPASPGSFAWNDEALANYAHDALKKTRDTAVYLIEQRYGATPERSYFAGGSTGGREALAVVQQWPTDFHGAIVLYPAYNALALDLQFGRITRALAQPGAFPSLEKRAALLEAAMQACDGLDGVRDGVISHQAACNAQFDPARAKLNGKPLRCPGGADTSQRCLSDAQIHALRVFNSPIRFNFPLASGETHYPGFNTWGTDLGRPGEGVQLVVNRLGLNTLQPSYPMPVHGTGFAEGAPYHSGFWDEWVRFFVTRNPTFNSLTLDPQNPRPVAGAHQRAVAAPGRQPDRPVRIRPQRRQDPHGPRYFRPTGEHPRHRRVLRACAPRHGPGQDAALPALLRDPRLRPRRQHRVQRRLGFAERTGRLGRTGPCAAAAGRCRQRRRARPHPPAVRIPRLAEVRRQGRRQCRHELRLRAEPQGRPLASEPAPAPRPAPSSNRPPRWTPPRQSWPRAIHVQPAGRFPCRSRAKAMRRASALARAIQPNRPATSATGTPFALCPVAARERPKTTTRGNTMRLHHKSLCHILCGGAVVIATHPASAAFVEDSKASIDLRNFYMNRDFRSGTGQSKAEEWAQGFMLKMESGYTDGPIGFGVDAIGLLGVKLDSSPDRVGTGILQSDRDAPNRAQDDYGSAGVTAKAKLSATTLHVGTLQPILPVVMRNDSRLLPQTYRGAWLQSKEIDSLTLDLGKLDRVNQRNSSDNEEMTAFNGGRRNIQFGSQTSSDEFLFAGARYAWSPELSTSYFYGGLDGIYKEHNFGLVHVLPLGDKQSFKTDLRYVHQTDDGGSNVDADAFGAMFTYKLGGHAFGAGYQQLNGDTGFAYIAGSDNSLVNLVQINDFGNEDERSWQVRYDYDFAAMGIPGLSLMTRYLSGDNVDRGPGASEGKTWERNTDIAYVFQSGPLKNFGLRLRNATTRSNFGSDLDENRFIVSYSLPLW

SEQ ID NO: 7946 - protein, 376 aa, Pseudomonas putida
MKSTNIAGVLSLAALAALASPGALAQGQDSGWYGGANAGRSAATIDDARINSGLIGSGFSSSTIVDDDRSTGYKIFGGYQINNNFAVEGGYFDLGNFGYTATTVPAGTLDGRIKLRGLNLDLVGTLPLSEKFSVFGRAGLNYAQARDSFSGTGAVQVANPNPRKNDTNYKLGLGLQYALTESLAVRAEAERYRVNDAIGNRGHVDLVSVGLIYRFGGKTQAPAPRMAAIEPAPQVVAIAPPQPPPPPAPRFEKYTLSATELFAFDSTGLRMPQPRLDEIAAALGSHGEVNEVVITGYTDRIGSSQYNQKLSERRALAVKTYLTGKGIDANRLKAQGKGEADPVVACTDKKLPALIKCLEPNRRVEVENITIERRLP

SEQ ID NO: 7947 - protein, 473 aa, Pseudomonas putida
MASSLLAEDDGVFLSVGYQIGEAAQMVKNTGEIQKVSNAYENLNNLLTRYNELKQTASNTDSSTAQAIDNLKESANRLKTTPNSANQAVSSALSSAVAMWQVIASNLANNSLPTNEYEKINTISQSLQNTLEKKNDLTIGNDYEQLLTQASTIISTLQSQCPGIDGGNGKPWGINASGNACNIFGNTFNAINSMINSAKEAAKQSRRTDPNQPNQPNAFTNADFNKNLNQVSSVINDTISYLKGDNLATIYNTIQKTPGSKGFQSLVSRSSYSYSLNETQYSEFQTTTKEFGHNPFRSVGLINSQINNGAMNGVGVQLGYKQFFGKNKFFGIRYYAFFDYNHAYIKSNFFNSASNVFTYGAGSDLLLNFINGGSNQNRKISFGIFGGIALAGTTWLNSQFVNLKTTTSIYNAKINNTNFQFLFNTGLRLQGIHHGVELGVKIPTINTNYYSFMGAKLAYRRLYSVYFNYVLAY

SEQ ID NO: 7948 - protein, 804 aa, Pseudomonas putida
MFKPSLLTLAMSGALSSAFLLPNTAFAQEQEAAKDKSLEVIEVTATRRSGSVQNAPLNITALDADIMKDQNISELADVARWVPGLTITDQGGRSGSPIIVRGLNTNSSGPSSDGGTVATYINEIPVAIDMRLVDVERVEVLIGPQGTLYGAGTLGGAIRYMLKEPELDFTSLEVFGNVSQTQESDSIGGEGGFIFNLPLIEDTLAVRASLNIYEDPGFIDYGYVVREPGVSLPDPNWTDSAAVNNNLKNVEDANGESTTTGRISVRFKPSETFEGTLNYFYQNQDSEGRSIVHYNTLSADNGLSDLIGEYESGYRYEEPREKENQLLSLELKADLGFAELVSATGISNFDADGQRDQTDLLIRLDYGYEEFPAFSSFTREIEEQDTFTQEIRLVSQNDSDINWIVGGFYNKIESDASSQEYTPGFGDFAVENFGADQSRPDQLEYYSVDRVEITESALFGEIGYQVTDKLDITVGARFYKYDVESESAVDFPLFNTLFGGAGPDDVTLNFEQNEASDNGSLFKFNAKYQFTNSVMGYATISEGFRIGGSNGLAPCPDPLPANQAGCGNPSEMLYDADTTTNYELGFKSTWLRSRLHFNAALFNIDWDDAQVAGATEVGQLPYLSNAGSANAKGIEISSRAILSDSFSVYSTYAYTKAELTSDAPFLFNSDGTDGAEDGDRLPGSSEHQFSMGVNYQTDVFNDKTLDINYGITAQSDVISRVGLRDNGETLPGYSLSNISAKLTADEWSATVYVDNVFNKYAVTSVRRSDADITSANRTDIQRNYGYFINRPLTVGIKFNYKFEI

SEQ ID NO: 7949 - protein, 446 aa, Pseudomonas putida
MTCPALDVPMPPRRALRCLASAAAPSLALAAVPILASILTCSAGPAAAGETSRKKAEAKPPVTLDEKGITVRLDDGSTFRIGGRLQGDFGTGHVQQRGFGTVFEEPAAIRRAWIETYYSLKDFEFAFQYDFNERRVPVSDAIVAYKGFQDVIITQGNFKEPFSLDQLISDNVSQFTERSQADAFAPARNFGSAIGTHGANWTAVTGVFGGNINTGLQNNGIASTTRVTYTPWLSENKNDVLHLGLAGSYRTLGGDDSSLSLSSRSEAFLFARPLVNTRTIRDATAIGRLGVEAAWQQGPFRLQGEYILTDIERRDGRPPLLFQGGYIQASVVLNDKGRPYRVVPTYGSEYGVFTGVTVEERQRVSRGGTGLFELGVRYSAIDLESREVRGGVEHDFTAGANWYPEPNIRFVFDYIRSHAEPSAESLNFGRHTVDADLFIGRAQLTW

SEQ ID NO: 7950 - protein, 558 aa, Pseudomonas putida
MPVSSRKTGLIACLSLIGYTASAFSASLNPAERSEIQQRQSEVIEQSRQQREALQQLNDIAQAPLKADNAPQGPCFTLRDIRFNHSTLLRPSDQATLVAGYLNRCNNLEQINQLVHDVSNWYIQRGYITSRAFLSEQDLSGGVLQLEILEGRLEKITINNQTERMTRTAFPAHEGEILNLRDIEQGMEQMNRMPSQQVTIEIQPGSQPGYSVVNLTREAHLPFSGGLTFDNSGQKSTGEEQLNGSLALDNVFGLADQWFISAGHSSRFATSHDAESLQAGFSMPYGYWNLGYNYSQSRYRNTFINRDFPWHSTGDSDTHRFSLSRVVFRDGTMKTAIAGTFSQRTGNNYLNGSLLPSSSRKLSSVSLGVNHSQKLWGGLATFNPTYNRGVRWLGSETDTDKSADEPRAEFNKWTLSASYYHPVTDSITYLGSLYGQYSARALYGSEQLTLGGESSIRGFREQYTSGNRGAYWRNELNWQAWQLPVLGNVTFMAAVDGGHLYNHKQDNSTAASLWGGAVGMTVASRWLSQQVTVGWPISYPAWLQPDTMVVGYRVGLSF

SEQ ID NO: 7951 - protein, 858 aa, Pseudomonas putida
MPRVTLLHPKFQPSALALAILATSTPMAFAEDTQLQTVTVQAEQTDDDALPTRPPASIYGGLEAKVLDTPRSVTQINAEQLANDPIRSSDDLVKYAPGITRGGGQNAGIAPQMRGQNTEVFQDGQRAYGVRHPANFNAYEGADIVAGPSSVTYGSVSGSGGYVNYLSKKPDFNRFRTKLSGEIGSWIPDGESRDATKFSIDNTGPLSDNLAYRVSITRQRQEDFYDNVENNFDAFYGALAWRNDNLRVDWNAAYDDYYDYNITHGWNRASQGLVDHGKYYAGRATPIIQNGNTLWSPVLSSGAADAQVLGWVQRQRNAQGQYAVVNGSFQGASPNTQANPGSLRGWVYDPSLAGNGLTSLSSQTGQRAQDENRSRRFTTQLRVEGDLTSSITLANSTFYQHSTDTTDAVGAFQVQGKDDIFDNRFEFRARGQWQLGDLTLIDDSNTGLIYRRERNESIAANNSFGSTINAYDLTLDPTLKNPGDLLGLSGRNPAGGNAAWIGQPGVPQFSSYYGWLNLPAMYPAGHGLYAESVAPYTADSTWTTKTLFSQHNLRLGERVGLNVGASRSWIDARIENPFVLPGGNPRKDANNYRLFSVQVSPYFKPTDNSTLYYTFDRSLAVNTGFFTNGLGWGSGSGANQLNPLAFESLSVLHEVGLKVEAVPDQLFLTLAAYRQARDQSPDSNNNIARLIVKGWEATLRYQDQHLRGGLNLSRISAYNEFTSQAGFASAGFIPDNGTVFGDNNSLNQRPSGKFDAVQIPEYNAGGYVDYRFDSGFGVELSGWWTSSWYLNLSKTVKVPDEYNLDLAVYYRQPQWGVTVRMLNVTDELNFVSGLAGSTNTFLQPMPGRTLLAQVDYQF

SEQ ID NO: 7952 - protein, 617 aa, Pseudomonas putida
MRRFLTTLMILLVVLVAGLSALVLLVNPNDFRDYMVKQVAARSGYQLQLDGPLRWHVWPQLSILSGRMSLTAQGASQPLVRADNMRLDVALLPLLSHQLSVKQVMLKGAVIQLTPQTEAVRSEDAPVAPRDNTLPDLSDDRGWSFDISSLKVADSVLVFQHEDDEQVTIRNIRLQMEQDPQHRGSFEFSGRVNRDQRDLTISLNGTVDASDYPHDLTAAIEQINWQLQGADLPKQGIQGQGSFQAQWQESHKRLSFNQISLTANDSTLSGQAQVTLTEKPEWQLRLQFPQLNLDNLIPLNETANGENGAAQQGQSQSTLPRPVISSRIDEPAYQGLQGFTADILLQASNVRWRGMNFTDVATQMTNKSGLLEITQLQGKLNGGQVSLPGTLDATSINPRINFQPRLENVEIGTILKAFNYPISLTGKMSLAGDFSGADIDADAFRHNWQGQAHVEMTDTRMEGMNFQQMIQQAVERNGGDVKAAENFDNVTRLDRFTTDLTLKDGVVTLNDMQGQSPVLALTGEGMLNLADQTCDTQFDIRVVGGWNGESKLIDFLKETPVPLRVYGNWQQLNYSLQVDQLLRKHLQDEAKRRLNDWAERNKDSRNGKDVKKLLEKM

SEQ ID NO: 7953 - protein, 435 aa, Pseudomonas putida
MIRSSNMREKLLAAAIIGTFSSQAFSGTVTTDGADIVLKTKGGLEVSTSDKEFSFKLGGRVQADYGRFDGVFTKNGDTADAGYFRRAYLELGGVLYRDWKYQLNYDLSRNTGNDSDGYFDEASLTYTGFKPVQLRFGRFYTDFGLEKATSSKWTTAMERNLSYDLADWINDNAGMGVQATSTIADMAYVSGSVFSETNNNSDGDSTKRYNVRGVFAPLHSDGNVLHVGAQYAYRDLKNSAVDTRIRSRLGVRGVDTNGGGDAGTNGNRMLFGGAAAQDGLWKDDSVWGLEGAWATGPFSVQAEYLRRKLKADQANNDMKASGYYAQMAYTLTGEPRIYKLDGAKFDTIKPENKELGAWEVFYRFDDIKVEDGNLVTAADQSNERKAKSHTVGVNWYVNEAVKVSANYINVRTDNNENTVGDDSGNAIVTRLQYVF

SEQ ID NO: 7954 - protein, 763 aa, Pseudomonas putida
MRQYVPSAVSSPRLIVSAIGVALSASSAYAADPAASSAITLDATSVNGKAEQASTDYKVDKAASQKYTAPLVDTPRSITVIPQQVIKDTNALTLQDALRTVPGITFGAGEGGNPQGDRPFIRGFDAQGDTYLDGVRDTGAQTREIFAIESVEVAKGPNSAIGGRGAAGGTINLVSKRAHLGNSLDGAWTWGSDQTQRYTFDGNYQFSDTVAGRLNLMTHESNVAGRDKVNYDRWGIAPSLAFGLGTPTRVNLDYYHLESDDLPDSGIPYTIPTNGSAGRTSAHPSKPNDGGDSDNFYGLTGRDFRKTRVDIATFAVEHDLTDSLTIKNTLRHGNSMQDYILTQPDDSKGNVNNGSVWRRANTRVGNTATTTNQTDLFGEFYVGGMKNSFSTGIELSREESERSSYTVDTDTVPGGSANSNCTPGMIGATSGYNCTSLSNPNPDDPWNGAISRNYAGTTTNSKTRAIYVFDTLELTPEWLVNMGLRYDHFDTDYKTYNAAGTTTAKGKDVSEFVTGQLGLVWKPAENGSIYVSYATSATPPGAMLGEGTEGNPLGGTPDRNGNLLGSDMEPEETTNYEIGTKWDLLDQRLSLAAALFRTEKENARVQVNTNTYENIGETRVQGIELSASGKLTDKWQVFAGYTYMQARQIDGGPVGKANDGNQLPNTPNNSASLWTTYSITPKLTVGGGAFYVDDVYGSVANTTMVDSYVRYDAMAAYKLTKNVDLQLNVQNLTNEVYYDKAFSTHFANQAAGRTALLTTSVHF

SEQ ID NO: 7955 - protein, 710 aa, Pseudomonas putida
MAKRSVAPASISMLGLLVVPAVHAAAQTDTQSSLALPATAVSSVYEQQSYKASESRSAMKIDAPLRDIPQTVNVVPESVIKDQGAQSMEDVLKNVPGIGLSNGDGQRDQVTIRGFSAIGDMYIDGVRDDALYFRDLSNIERVEVIKGPAAVLYGRGSSGGLINSISKKPSFTPKREVGMNVDSEGKRRTQFDTGWADPQSNQAYRVTGAFEDSDTFRDDGYIDRKAIAPSAYFRLSDDLELNLGATYLYDKRLIDFGIPALGNRPVDVDRDKRFGSGDADQDYARSEVFSLTASLDYRINDNFTLTNTSRYYRYDLDRNNTLADSSPTRFVTAPDGELLIKLNRGNVARDEYGVFNQTELKQQAQLAGMQHNLLYGVEAGFQDKYQRVLSQTNVAQVPVYRDALVPVPEHAANLSSKGTNFQQTTGLYVQDMIELNAHWKALVGVRYDIFGQEYDDDRVQNIDLDRTDKTWSPRAGLVYQPDAIQSYYVSVSRSYQPSGEVFAVSPSNQHLEPEETTNYEIGAKWDLLDSRLSLTAAVFRLERTNMKTADPANPNLTVLAGEQRTDGFEATVSGHLTDKWQIYAGYAYLDAEITKSNSKTNGVANEGQTPTLTPRNSANVWLVRTLTPEWRVAAGANYVDERYTALDNVVVMPGYTTFDAALLYSVPQWDAALRLKNVFDRDYYASAHGSVDLITPGAPRTLEASFNYRF

SEQ ID NO: 7956 - protein, 801 aa, Pseudomonas putida
MPAVKSCRLRPLARAAHPLFAMSLLLCAPAWADEPARRTFQVAPASLGAALTHFADQAGVSLSLDPALVEGRQSNGLSGRYSVDEGFNQLLRSSGLQALPVGEGAFTLMPAPQASGALEIAPTRIVGGLAAGNEAQPYAGGQVARQGAQGLLGSRDFMETPFSITSYTSDLVKNQQARTLGELIASDPSVRATNPAGGRFEQFTIRGFSLFNSDVAYNGLYGILPTYSIDMEMADRVDIIKGPSQLINGISPRGSVGGGINVQPKRAADKPITEFTGSYASAGQAGGAVDIGRRFGEGQQFGVRFNGVKQAGDTEWDHQRVDREMAVLGLDFRGERLRLSADLGHTERDTDAPQERVLVGANAKVPNANDVRHNYAQAWSKARTNDTFGALNAEYDISESLLAYGAVGARKSNHDFLRHNVSITNDAGDFTVQPRDFTRDESVRTAMAGLRHWFHTGPVSHELNLAATYYYMDFTNGGARYASAPSNLYDPVAAPTPGTPTRLDPEVYTENRFSGVALADTLGFFDDRLLLTLGARWQRVQVDDWSDGIKGDTGYDEEKVSPSGGVLLKVTDQLSLYANYMEGLSQGKIAPSTSINEDQIFPPFTSRQIEVGAKYDLGQVAFTASAFRIRQPAYETNPTSRVFGPNGKRDNRGIELSVFGEPVQGVRVLGGVMYIDSELTDTVGGAYDGNRAPATPEYNVNLGAEWDVPGVNGLTFTARGIHSSSQYLDQNNSKRIDGWERYDLGARYAFKVDATEVTLRASVENVLDDRYWSSAGASDDSEPGLTLSTPRTYLLSATLGF

SEQ ID NO: 7957 - protein, 415 aa, Pseudomonas putida
MPSAIRCIGAATLFVVLGAPLKAGPFQTLLGLPNWVDFSIQFTAEPIGGIQGGLDPSASSWFQNTVVGLSVGSGFHKPETTWKELDHWQVNLELTNQAGNPNLNTELGSEFTLQTLVNPVGTWITAASVERNRGQSWWSASAGLLSMDPDFLVTPAMNAYINSTLNNTLNLLVVGLPINPLVTPGVKVAAHSESMGSFTYGYFYLDPETSIASSLGVNPEQPQVRGSVQAMQWSTNPLRSRQDLLEPIPLGNSRITVERTLPAPEAQLGGYIASTQLPTNRTGDVGSGRNRGIYGSLTWPLQLPLGMDNRLWAAGRISLDPGNNPFPSYLGGGWLSQGILSHRPRDVLALGVSRTSFSPNLSPGTTYEGVIELNYSIYLSETVQLQPVLQWVINPGGEGKVQGIWAGGVQLNLNL

SEQ ID NO: 7958 - protein, 179 aa, Pseudomonas putida
MGRPFIRNTFSRLLISSLLSFITSASYAANYVEGSFGIAWLASDNSELDSNTYAPYRIHYGHQISRTRFLETGYLGGDNYEDAAKDDLEMDMIYIKLKHFYKINDSYAIYAKVGTAAYRYHLENDDSSISKKNGLGLSVSAGYEFTLENNFSVGIEYEHFNTARFRSNTLNANVKYHFM

SEQ ID NO: 7959 - protein, 260 aa, Pseudomonas putida
MRTINSLILAGGLLACGTTFGGDLLQWQNNSLTYLWGKNFKVNPAIQQTVTFEHADGWKYGDNFIFVDKIFYQGQKDAGNGPNTYYGEISPRLSFGKIFDQKIEFGPVKDVLLAMTYEFGEGDTESYLIGPGFDLAIPGFDYFQLNFYNRTTDGSRAGDNVWQITPVWSYTIPVGDSDVLIDGFMDWVVDNDENRRGTYQANLHFNPQIKYDLGKALHLGEKQLYVGVEYDYWKNKYGIKDSDAFTTDQNTMSFLVKVHF

SEQ ID NO: 7960 - protein, 809 aa, Pseudomonas putida
MNNNKPFPRFRALALALAVSTVAVDSQAAEAGNTLQIQAQPLDSALNQLGQQTSLQLFFSPELVAGKQAPAVSGNLAPVQALQQLLQGSGLTFEMTGDTVVVKPLPTTLDLGSGSLELAPTDIKVVGDWLGDAQQSVVQNHPGARTVVRREAMVEKGAMNVRDVLRGIPGVQVQDSNGTGGSDLSLNVGVRGLTSRLSPRSTVLIDGIPAAFAPYGQPQLSMAPISSGNLDSIDVVRGAGSVRYGPQNVGGVINFVTRAIPEKASAELSTTLETSQHGGWKHTESAFVGGTADNGMGVALLYTGVNGNGYRESNNGNDIDDVILKTHWAPTDVDEFWLNFHYYDGRADMPGGLTQAQYDSNPYQSLRDYDYFAGRRKDVSFKWQRQLDDATQFEVLTYYTDSFRGSTIASRDMKTLSSYPRNYHTFAIEPRVSRIFFAGPTTQEVSVGYRYLKEAMREQSTRLALIDNVPTVTPTSDGHVFQDRSGGTEASAYYIDDKIDVGNWTITPGVRFEHINTDWRDRPVLDANNRPVAEKKRSITSNEPLPALSVMYHVSDAWKVFANYETSFGSLQYFQLGQGGSGNSTANGLEPEKAKTYEIGTRYDNGGFAGELTAFYIDFDDELQYISNDVGWTNLGATKHQGIEASVRYDLAGLDPRLDGLSVSGGYTYTRATYEGDIPGFKGRDLPFYSRQVATAGVRYAVNRWTWNLDAYAQSKQRAPGTGINADGSFNGDYITEPSADGQYGDIPGYVTWHARGGYEFGPDMSNLKLAAGVKNLFDKQYFTRSSDNNAGLYVGEPRTFYVQASVGF

SEQ ID NO: 7961 - protein, 886 aa, Pseudomonas putida
MRIFLVTPPSAILTSGHPHRIGYHLAFGITALFATSAWADCDSTAPTSGTTVTCTASVGTATSVIAVPGSTGVTVNSSGAISFTRMGIQVVGGSNVTNNGTITTAAGSGSGLKAAISALTNNNTIINNGVIAVTGPSIYGISVGTSAAGGGGVGNTIVNSAGSQITTLNSGSDAIHVVGGNNTITNDGTISTSGSSSTAAYAQGNANSFTNNGTINVAGNGSDGVFMNTVSSTFTSSITNNGSITSANSYAIRGLNGSDTVINSGYLEGHGGAAGDTAIILGNSVNNSLILRTGSQIVGASEGGRGNSNVYLEGSGLVDSAFRNFNTLTMRGAAWNWTTDATFNNTTIQTGTLTLDSVLTSPVYIDTAGTLATTGGTTTVAGSAAGAAPGTVVGVLSGTGSVAGNLVNGGTVHPGAGDGTGALTINGNYTNLSSGTLAIDLTPTSAGKLNVTGNVNLQGGQVTANFKPGNYDAFQQQEIIHCTGNCVTGSFTAYTPSAFVDTTVFNGAGNNSVFIGYQRNDVDFADVATTENDKALAASLDANANAGGMTNIVNQLVTMSAAQAQSAFNSLGGGDVHATLAGLNMRQSGMFARALTQRLSGPLPRDMTRDSGLWVRPYYSDGRVRSDVVADADYRISGVAAGMDGWVNPEWLLGAGIDVSQLHGNFSSYDAHAKTDAYQLGVYSSYQRDDFYVDGILSAGRQKNTVDRNISFAGTDARANAAYTGRHVNLYMETGYKLPLSGQLVLKPLASLSYVRQREPGFSENGAGEIGLNGQSATTQSVRSGLGAALMKDFAVSGGVLTVEGKARWLHEFADRTPQFQAAFAGDITGQTFTIKGAEAWRDAALLGLNLIYANSANMHVYLSYDATVAKRDTAHTVTAGLRYAW

SEQ ID NO: 7962 - protein, 862 aa, Pseudomonas putida
MSTGPTRSSNLPRRTGQLSLLTLALLASGACSLPALAAEPAQASSPRMGDYRFSIGQQPLVSAINAFSQVTGWQVGFSAELADGVASPGVQGSLPPDAALKRLLRGTGLSFRKISNGNVVLERQTASNVIALQQVTVSATRSAQDVSQVPSTVSVQTREQLDRQNVNNIQDLVRYEPGVSVSGTGQRSGLNGYNIRGIDGERILTQVDGVSIPDSFFYGPYAQTQRNYVDPEIVKRVEILRGPASVLYGSNAIGGAVSYFTLDPDDIIKPGKDVGARLKTGYSSADESWLTSATVAGRQGDFDGLLHLSQRNGHETETHGSHSGDGLSRTEANPMDVRTTNVLAKLGWNYADDARLGFTYERYKDDRDQNILSAVGGPFIPGFGGMGYYKARNGNDTITRERFGINHEFGLDSLVADHVKWSLNYQIAKTDQHTEEVYVPPGRQVLRTRDTTYKDRQWVFDAQLDKAFSIGATDHLLTYGTTLKHEKVTGSRSGTGTCLTVGSGCSAAGAERPADGQVLVSDFPDPTVNTYSLFAQDEIRWNNWTFMPGARYDYTRMEPKFTEAFLRGLESSGTAPTSQDDSDKKWHRVSPKFGLTYAFNDNYTWYGQYAEGFRTPTAKAMYGRFQNLDQGYRVEGNPNLEPEKSKSYETGLRGNFDAGNFDVAVFYNKYRDFIDEDAVQSANLEQTFQANNIKHATIKGAEFKGRLNLDHFGAPQGLYTQTSIAYTYGRNDDTGQPLNSVNPLKGVFGLGYEQQNYGGLLSWTLVKRKTRVDDSTFYSPDGSTSKFRTPGYGVLDLTGYYKVTDDVTINAGLYNLTDKKYWQWDSVRSYDGQGEAAVTQPANIDRLTMPGRNFGINVVWDI

SEQ ID NO: 7963 - protein, 447 aa, Pseudomonas putida
MEQRKRIKTLGSLALLALVGSSGTQAAEAFSSESKWMTGDWGGTRTELLDKGYDFTLDYVGEVAGNLHGGYNDDKTARYSDQFALGAHLDLQKILGWHDAEFKLAITERSGRNLSNDRISDPRAGQFSSVQEVWGRGQTWRLTQMWIKQKYFDGALDVKFGRFGEGEDFNSFPCDFQNLAFCGSQVGNWVGGIWYNWPVSQWALRVKYNITPEFFVQVGAFEQNPSNLETGNGFKLSGSGTKGAILPVEAVWSPKVNGLPGEYRLGYYYSTAKADDVYDDVNGNPQALTGEAFKSHSSKHGWWVVAQQQVTAHGGDVNRGLSLFANFTVHDKATNVVDNYQQVGLVYKGAFDARPKDDIGFGVARIHVNDDVKKRAELLNAQSGINDYDNPGFVPLQRTEYNAELYYGFHVTNWLTVRPNLQYIKSPGGVDEVDNALVAGLKIQSSF

SEQ ID NO: 7964 - protein, 685 aa, Pseudomonas putida
MPRRVLLSAASLLAFALVAPLAQAAETPAPADAAAPDGPDGPTAVDKVVVTAAPYAVSLDTVTSSVNVVTRDQLDVAAPAGIGDMLNGLPGLRSTFYGPGASRPVIRGLSGPRVMVLQNGVGQVDASALSPDHAVASDPGEASRIEVLRGPSTLAYGGSGIGGVVNMIDDRVPSTPAANGPEGRLSASASSVDKGYAYSGALKAGSGPIVFALDFSSRRTDDYDVPVAPVSDRLAARDGLTVDPDKTVKNTDVEVDAYGAGVSWVHDRGFVGASVKKMDTTYGVPYEQILAPIDPNAEGPVSIHLQQTRYDVRGEQALDTPWFEKVRVSLGYADYEHAEVSVEDGQVGTRFLSHGTEGRVELVHREHDGHQGAIGFQALDRHFSAIGDEAFVPSTDIKEYGIFTLQRLDRGTWGIDAGLRFDTRSLQTPTEKRDFDNVSGSIGVFLKPSDSLFYALTLSRNGRAPTEFELFANGPHPGTGGFEVGDNKLDNETVTSLEATVRWKSDRLRAEGHLWAAKYGSFIEEAPTGAVEDNLPVYQYFQTKADFHGAELEASYDAWRGATQSLRLETTFDWVHGDTDAGVPARIPPWSLGGSVVWNVPRVETTLEVRRVAGQDRVAQFELPTDGYTVVNLKATFKPSETSPLRLFIDGRNLTNAEIREHASFLKDIAPSPGRSVRAGVAWKF

SEQ ID NO: 7965 - protein, 656 aa, Pseudomonas putida
MSKSKICICIFVSIGLYGADNNTTKLDEVVITATGFESFLRDEVRNVTVITSEDLQGRGYRDINEALEKAPGVSYIYNGSGRNIDIRGQGQKANTSAKVLVNGIAINMIDTTPTKIHTDLIPIEDVERIEIIPGGGSVLYGSGTTGGVINIITKQKPKDFFVTASTKIASYSYKDFNVGIGGKVSEDLYLKAAIKNFNGDGYRYGEWLRGYYANLGIRYQINDMQSISINPSYFKVKEKGAGALTKKQLEQNRRQADDYSEVVSKRVAVDIDYNAKFSDAFELTLTPYYQKETDDMDSDTKFEDKKLGSNFKGRYTYSSGEVIAGYEYLKNDGLRILNVSAATPMGIMRNYTKFDMQKQTHSFYIMPKYNFTDYFELNVGYRYEKALYDTDRLQRTTMMGRTTGGTFSEDKSMSNYAFEVTPNFKYSKTGNVYLKFERGYTSPGPNQLVDKLNRTTYAMNNLRPETFKTYEIGMKDMFLGGYFSAAAFYTDTKDEIRNFSNTANISDGWRFINLDKTRRYGFELYAEQDILRKLRLSETYSFVDAKIKAGANSGKRIPWVQRSKFVLGVDYEPIKNLNLLTDVKWYSSIVDSYYDKISDKTIVDFGAKYKFQNGISVVAGVKNLFNKKYNIVEMKRADSYSPARARNYYVEFKYAY

SEQ ID NO: 7966 - protein, 410 aa, Pseudomonas putida
MNRTHFLSAAWLATFALPMPALADFIGDSHARLELRNHYINRDFRQSNAPQAKAEEWGQGFTAKLESGFTEGPVGFGVDALGQLGIKLDSSRDRRNTGLLPFGPNSHEPVDDYSELGLTGKVRVSKSTLRLGTLQPILPVVVYNDTRLLASTFQGGLLTSQDLDGLTFNAGRLTKANLRDSSGRDDIGYGAASSDHLDFGGGSYAITPQTTVSYYYAKLQDIYRQQFVGLIDTRPLAEGLSLRSDLRYFDSRNDGAERAGNIDNRNFNAMFTLGVRAHKFTATWQQMSGDSAFPFVNGGDPFTVNLVTYNTFTRAGLDAWQVRYDYDFVAMGIPGLSFMTRYTDGRHAETATVTNGRERERDTDITYVIQSGPFKDVSLRWRNVTFRSGNGLTNAVDENRLIIGYTLALW

SEQ ID NO: 7967 - protein, 488 aa, Pseudomonas putida
MKSVFIALMVVCGGAQAAMGPFDVYEQALRNDPVFLGAIKERDAGLENRTIGRAGLLPKLSYNYNKGRNNSEAHLPDGRGGTYRDDRNYNSYGSTFSLQQPLFDYEAYANYRKGVAQSLFADESFRDKSQALLVRVLSYYTQALFAQDQIDIARAKKKAYEQQFQQNQHLFQQGEGTRTDILEAESRYELATAEEIQALDEQDASLRELGALIGVQSVNIHDLAPLNQNFAAFALTPAKYDTWHELAVSNNPTLASQRQAVEVARYEVEGNRSGHLPKVTAYATSRKQESDSGNTYNQRYDTNTIGIEVSLPLYAGGGVSASTRQASRAMEQAEYEWKARPAKPDRLRRQFSACLSGVSKLRAYQKALTSAEALVVSTKQSILGGERVNPRCAECRAAAVQHPSRPGPGALRLFDGLDQIALLRGQLARHRPGQGGRGLWPGEMSTHKNNKDGLNDHRLIPLQTLYRRLVAAVVRCGTGGLHRDRPTG

SEQ ID NO: 7968 - protein, 426 aa, Pseudomonas putida
MKKVMLKTSLGVAVALASSQLLAAGFALNEQSISGMGTGFAGRSSSADDASTVYGNPAGMSRLKREQFTVGGAAVIAKTDISGPGSNFGGETDGDMVPLVGVPMGYYVKPIDDHWSVGFGVYVPYGLITDYGSDDAARYWGKKSKVEVVTFQPTVSYAFNDKVSIGFGPTINRIKGELGSNLSSKALLGPNGPDGETKIKGDDTAIGYNIGVLVQATDRTRLGLTYHSMVDYKLEGNTRVSYPIPQLGLNGKFDASLKIKTPESVDFSVTHELDDHWTLYAGSTWTRWSRLESIVVENEAPAGYPLKTITEEQNWHDTWAHAIGASYKVNKEWTLRAGFSVDQSPTNNHDRSPRIPTGDRKAVSFGAGWSPNDDMTIDVAYSYLWEEDTKVNNLPSSQQQGLLKGSYQAKYENSAHGIGASLTYRF

SEQ ID NO: 7969 - protein, 416 aa, Pseudomonas putida
MNHTPCVALGLTLLSQPLLAAEGGFFEDSKATLSARNYYFSRDFSDIVGANKQSKAEEWAQGFILDFKSGYTPGPVGFGVDALGLLGIKLDSSPDRTNTGLLPVHGDGRAADEYSRLAPTFKARLSKTELRAGELQPNLPVLTFSDIRLLPPTYQGVSLSSSEIDGLTMQAGHLKSTHLRNEGGDGKMNAMLGHVPMRQAESDAFNYVGGDYAFNANQSSVSLWYGQLEDIYQQGFVGLKHSKPVGDWVLSANLGYFTAREQGDALLGNIDNQAFFSLFTARHGGHSFHAGYQGIYGDSPFPRVFANISPLGNEVPTYEFAYTDERSYQVRYDYNFAAMGVPGLTATVRYITGNNVDTGLGYEGRDRERDLDIGYAVQSGALKGLGIRVRNAMARSNYRSDIDENRLTLVYTWQLF

SEQ ID NO: 7970 - protein, 514 aa, Pseudomonas putida
MDVIKKKHWWQSDALKWSVLGLLGLLVGYLVVLMYAQGEYLFAITTLILSSAGLYIFANRKAYAWRYVYPGMAGMGLFVLFPLVCTIAIAFTNYSSTNQLTFERAQEVLLDRSWQAGKTYNFGLYPAGDEWQLALSDGETGKNYLSDAFKFGREQKLQLKETTAQPEGERANLRVITQNRQALSDITAILPDGNKVMMSSLRQFSGTQPLYTLDGDGTLTNNQSGVKYRPNNQIGFYQSITADGNWGDEKLSPGYTVTTGWKNFTRVFTDEGIQKPFLAIFVWTVVFSLITVFLTVAVGMVLACLVQWEALRGKAVYRVLLILPYAVPSFISILIFKGLFNQSFGEINMMLSALFGVKPAWFSDPTTARTMLIIVNTWLGYPYMMILCMGLLKAIPDDLYEASAMDGAGPFQNFFKITLPLLIKPLTPLMIASFAFNFNNFVLIQLLTNGGPDRLGTTTPAGYTDLLVNYTYRIAFEGGGGQDFGLAAAIATLIFLLVGALAIVNLKATRMKFD

SEQ ID NO: 7971 - protein, 165 aa, Pseudomonas putida
MRVMKWSMIALAVAAGTSQLALASSQDESKGFIEDSKLNVKTRMLYFSRDFRNNPAGTQSRREETGLGFLGTFESGFTQGTVGVGVDAIGMLGLKLDSGKGRAGTGLFPTGSDGRSQDDYSKAGGAVKFRISDTVLKVGDQFTALPVFATDDSRLLPEIAQGTLI

SEQ ID NO: 7972 - protein, 795 aa, Pseudomonas putida
MRVAKTIGISFLCPRTIAVKANAALRRNRRKPTDSTVCAVFAVRNDPMIRQAIHIIFLSACILLHAMSVCAAPALPEDSTPALADSVIQVEDIQVTAIKQGLNLRNQPVTASVIGRTDLERRHVAALKEVSQVVPNFHIPDYGSRMTSSIYIRGLGARIDQPVMGLNIDNIPYLNKDAYDFDLTDIERIEVLRGPQSTLFGRNTMGGVINVYTLSPFTFEGVRLGMEYGSGNTQKYRISTYYKTSERVGFSVGAYYSKTDGFFKNLYTGEKCDWERSGGGRFKVQYRNLHGLRIDNTFSFVKLEQGGYPYAYVETGQIAYNDPSDYRRTNFNDGLTIRYEGEKFSVASITSYQYLDDRMNLDQDFLPLSYFTLTQARREHAVTEDLVFRSPDDKAYRWLLGAFGFYRHTSMHAPVLFKEDGIRNLILDRFEPQGIHAEWGEDTFLLDSRFRTPDYGAALYHESTYDAGRWRFTAGLRVDFEASKLHYRSYAEATYTTQTPDGTSYPHAILVDQPGTLKQSFTEILPKISVLYRMGSSRRNTLYATVSKGYKAGGFNTQMFSDVLQQQVMKQMGFGSLYDVADVVTYKPEKSWNYEVGAHLSTPSHKVQADLALFYIDCRDQQLTVFPEGQVTGRLMTNAGRTRSFGGEASLLATLWRNLDLQVAYGYTRATFVKFDTGKADYAGNFIPYAPQHTLYAGASYTLRTGWNWLEYVIFRVAANGAGRIYWNEANTFSQPFYALLEASIRFEHRHWAVDVWGRNLTDTRYDTFYFMSIGNSFLQRGRPRTFGVSLSITL

SEQ ID NO: 7973 - protein, 714 aa, Pseudomonas putida
MTPRPEATARPRSLPRCLKALLLGCSALVTLPGAALAQDASPQDADTYRLSPIIVDAGAAADDDANSIVAQELWVGGKVATSLLDTPASVSVVTQKEIRQRNATTTEEVLQYSAGIVSDYYGSDDRNDYFLVRGFQASTYRDGLTLGSMRGVREEPYAYERVEVLKGANSTLFGVSDPGGSVNFVTKAPQFARFGEIYGQIGTQDHKEIGVDFGDVLNPDATLAYRFTAKVRDSALDYDTSRDDETFLMGGLSWAPSDATTLSLIFDHLDRDGTPNSGGYPLDREYDRSNFFGEADFNDHDVERDTLTAMLRHEFGGGLSLSANLRYSDLTDDFGYIYLSDFADRTGTELSRFYFGTDSTSEELIGNAILQYDTRFGSTDSSTLLGIEYRDASTSQSSYYGAAGTIDLATGIATGVPSALAPYEERESDYKTKSVFLQQNLSFADRIVATVGLRHDWLDLATRGQSFGVAFDDADDYSETSIRGALTYKITDEISTYVSYVESVAPPAIGVEPERGEQYELGVKYQPTGMNALLSAAIFDLTKNDITIPVVLDDGTIERQLIGETRVRGVEIEGKAEIAENWDVIAAYSYLDAEATRAVVRGTDVSGNRFANVPEHMASLWVNRTLPATDARGEMTFGVGARYVGSYHYALQNNTGKSESTTLFDAAFSYEIAENTGMVINVSNLFDNQHVVGRGTADYYNPGRSITATLRRTW

SEQ ID NO: 7974 - protein, 314 aa, Pseudomonas putida
MRCFRLSRHFIVYLFSLCAILLLAGCVQSRGGFVSKNHVVLAEQNPNTHFEQEVMIVRLSQVLLVGKMSNEERASLHFERGVLYDSLGLWGLARYDLTQALALQPKMASVYNYLGLYLLLEEDYDGALDAFNTVFELDSGYDYTHLNRGLNFYYVGRYHLAQQDFLQFYQADKKDPYRVLWLYLNEQKLKPQEAQTNLVERAKGLSEDFWGTHIVQYYLGHISVEELQQRASEFAENSQQYAEILTETYFYLAKQKLNVGLVDEAAALFKLAMANQVYNFVEYRFAAFELMKLKPVQTEDEKEEKSAVTKAIVF

SEQ ID NO: 7975 - protein, 741 aa, Pseudomonas putida
MLYSLTKKRQSLELSFPNITFTRKNNTMKHFYHYLLTVFLAGQVPGWGQNATEKKHIFVNDSITVDLPEVFVKAERPLVKVSEGKLQYDIPNLVKDKPVDNAFDVIGELPGIQKDGDKVSIIGTPSTSILINGRKSSMTAEQLAGLLKSTSSSKVKQIDVMYSTPPRFGVKGASINVVIENDKSLKDVLKGEISLTGKQGYFFSPSGQANLSYIGKNYSADISYSAAYDHGRQEEEMIARPTVNDRPYDIRQDDWYNNVSLSHNIRGAFDFDLKSKDRLSLSYTGRFYDPDKVSRRGALTEFVDIRRVETELELSGASNLHNARMDYIGHKGFRAGMDYTFYKNDDKQHLVNDFEKEEEQTISTLSSQQVQRVDLYMNDSRKLKKEWMLDYGVDASFSDTRNESGQSINGGNAPEGTFRLKQKDYSMGAFASFTKQFGKKVSLNASLSLQYYKASVDSAGKKKTLWNRAGLFPQLNFTYKVAPSGMLMFSFSSDKTYPSYWMTTPTTYYMNVYSSIIGNPDLKPQLSYSMQLNYVLKSKYVFGLFTNIQPDKIQQMTYQRHDELRSVFQTVNMDIYNMYGAVAVIPFRPFDFMSSRLTLMGCAIHNKGTLYDVFFDRKKLFGRAELNNTFYLTEDRNLLLELRGYCISPVIQGLYDVDLIYNVSAGLTWTFAKKKMRLTVRGNDLFEGGNPVTRVDEQGQKSRMKLWQDSRNVTLTLRYSFGGYKEKKAKEVDTSRLGTGI

SEQ ID NO: 7976 - protein, 401 aa, Pseudomonas putida
MFQKKLSVVALALGAVASSSSIAAEAQDGFKVDLGLRTFYMNRDFDQGANDTHAAGQAFKLNVASPYFGGLVGFDATVTEVVELLDDKTIRSSDVLTADGDGYTAVENLYVKLKPLDNVNLRAGRMVMMTPLLNDLQSRLSAPSTQAIYGDVALDNLNLYAFYSDEASKNNSQDFSNYTASGEDYGIASLGGSYKFANGVNAQVQYAVADDYLKQSFFNVTYPTKLADYDVTFDAIHMRGEDDGALYGSDYDSNLTSLTAKFAKGNWAYTVNYQTVGGDDAYNLQWGGQDDTQYFTYGAIQLLDFNADDEQSLQFRVDYDVPSVPGLHLMARHTQAWDIDSGSITDGKRHETNLDAKYTVQSGKAKDLSLHLRVAHVDGDAAIIPRISDIRLILDYPVNLL

SEQ ID NO: 7977 - protein, 708 aa, Pseudomonas putida
MPSRGQEGRLLTHYSKTSMNKRCLLTILLGGCAAMGAFAQQHATGKKTEMSVDLNPVVVTGTGTHQRLKNTPAPVEVVTANEIKKAGITDFQQAMTMLVPSLSFSTNSMGSYLMMNGLSNKYVLILINGRKLTGDTSNNIDLSRIDMSRVKRIEVLDGAGSSLYGSDAIAGVINIITNEPKELMQVTSTTRYEDHRQLTQMVNADIATEKFGSYTSYKHEQSAGWQNSDLAYVTDKKGNVSTVPTVSATSNGFHSNLVNQKFTFEPTEKLSFYANGGYYWKLTDRPVYTADIDGGSKYDLHYESYNFGLGGRYKINKRSSIQLDLMNDNYMQNYKYTVADDKNKIAIGDYAKTKEQHFYDAELKGIFNFAKNNMTVLGVDYRSESLDRPSARVDKSVYTASAYAQHEIKLWNCLTGIAGVRYDYHELAGGRFTPKLAVMYSVGAFNIRGTYSTGYRAPGLDELYYYMNKGKTITQGNKDLKAEHSNYYSVNLEYNTNRLNVSVTGYLNYIDDMINSTTYRLVDLPNGEELRAQAQKEFNLTDSETKALANYKLYGNLDKGVVRGFEVNAATNLGAGFSLNGNYAYAYARGKSVDGVWGNIDRSVRHTGTVAGNYTHAWNDYMLNVNINGRFQSKRFHPGHSYGDAPGYGVWNLNVKHSLTGFQHLGLDFGMGLDNIFNKRDTRPNGVNYALLSPGRMAYVSLTFRFKK

SEQ ID NO: 7978 - protein, 209 aa, Pseudomonas putida
MIKRQALLLAALAATLGMSSAMAETAGTWTVGVGAAYVDPESNNGTLLNGALKTEVDTDVRPTITGEYFVADNVGVELLAAIPFHHDIDLKAADGSVIKAKTQQLPPTLSLQYHFDNLNSNVKPFIGVGANYTTFFKERISMPNADLEIKDSWGVAGHVGVDFKLNPTDAVRIDARYIDLEPDVKLNNDDIGKVKINPWVYGISYVQRF

SEQ ID NO: 7979 - protein, 1125 aa, Pseudomonas putida
MHFSNSILRYAVLLICFLPMALYAHGAQGKRIILKGQSITMQQAIQLIEENSQYTFFFKSGVIANDEKKDYDCEGDINEILRKVFSNSGIDYVIKNNEIILKSAKAEAVQQKSQGPKKSEIVGVVVDANTGESIIGASVQIKGAATGVITNIDGKFTIMAAPSDVILISYVGYTPKEIKIGSRKVLSIDLNEDAKQLEEVVITAYGTGQKKASMVGSVESIKPAELKVPSTNLSTAFAGRLAGVIAVQKSGQPGADGANFWIRGVSTMNGVTDPLIILDGVQVSSSDLNNLDPEIIDSFSILKDATATAMYGTRGANGVMIVTTKSGMNLDKPIINFRMEAQMSQPTSTPKFVDGATYMELFNEAVNNDNSGDVLYSQDRIDGTRAGLNPYIYPNVNWYDELFKDASYSEKFNFNIRGGGKRVDYFSSISVNHESGMLKNRSKDFFSYNNNIEIMRYNFQNNINAKLSNSSKLSLRLNVQLRDMTTPNQGVGAIFNNAMNTSPVEFPVYFPDDGETPYIKWGATERVNADYQTNPVAQAATGYNKGFQSTVIAALEFNQKLDFITEGLSFKALASFKNWSSSENKREGKWNKFALTGYEDDGNGGYTYTTSRIGDEYTTNLTAKNTNSGDRRFYLEGMVNYSRTFGEHDVNAMLIYSQDELVNNTPGDGNFIGSLPQRKQGLAARASYAYAGKYMAEVNVGYNGSENFAKGHRFGLFPSIAAGYNISEESFFKPLKNVVSKLKLRGSWGLVGNDQINGSRFIYMSQIDLGGKGFTTGVNQNVTYNGPVYQRYANEDITWEVGEKINFGVDLQLFHSLDLTFDIFRENRRDIFQEKGTTPTYMGTATTKVYGNLAAMRNQGFELAASYNKQFNKNWFVSFKGTFTYAHNEITQYDESPKYPWQSKIGVSANKNAIYIADGLFIDAADIANHQQQLGAAVIPGDIKYINISRDWYGYDDNLTDTDDWVWAKHPGVPEIVYGFGPSIKWKNLDFSFFFQGIARTSFMVKDFHPFGDSMLRNVLSWVADERWSPDNQNTNATYPRLSRKTNNNNNKLSSYWERNGAFLKLKNAEIGYTYKNMRLYISGSNLMTFAPFDLWDPEQGGGSGLSYPTQRVFNIGFQMTINNK

SEQ ID NO: 7980 - protein, 745 aa, Pseudomonas putida
MLSSLRRMRASAAPSPARPSGAPFRPLALTARMAFAGLLTSGLGLPAFAQSAAKTSADTAEHAIQLPETVATGRAGDDPVRPYTGGQTARGARAGLLGNKDTMDTPFSVSTYTAKRMEEQQATTLADVLNKDASVRFTGQTGGVTDSFYIRGFPVGEGNLSEVAFDGVYGVAPNYHVFPEYVERVEVIKGPAALLYGMSPNSGVGGVVNIVPKRALPQDLTRFTATYASDSQLGGHVDLSRRFGEGRAFGIRFNGVARQGNTPLDHQRSRTDIGALSLDYQGDRLRASLDVITQHEAVDAPTRPFLLTSGVAMPSAAEGRRNVSQPWGWWKSDGQSALAHAEYDVSDRVTVFADAGGSQTSIGRLSDQTPTILDAAGSTRSTPGYYKFQVNRLTADAGARARFDTGTVKHALTLQASTYHDRVATANNMGTAILSNLYAPVTAPEQFIAAPAAVPKTSSSQLSGVAVADTMGVLDDRLQLTLGLRQQKVSSDNFSASTGAVTSSYDKSAVTPMAGIVIKPWRDVSLYANYIEGLSKGDIAPTTASNAGQVFAPYKTKQYEAGVKVDRNGLLATLAVFQISKPSGQLTGTVYGVDGEQRNRGVELNLSGEPVKGVRLLGGVTVLDAVLTKTNSAATVGNRPVGVPGLMANAGAEWDLPWMPGLALNGNVTYTAKEYINQANTQSVPSWTTVDVGARYTTRLQGKSTTFRATVLNVFDRKYWAGVASFGTISLGAPRTVLLSASVDF

SEQ ID NO: 7981 - protein, 228 aa, Pseudomonas putida
MSTLNKVTVALVSVFATAAVSAASLDIRTEYKHTTEQHATRIKMGDSIGNFYYSGELKFKGEDGAFLKDLQNNGWELDLGYRFKINDNWTIQPGMPIEARSAGMTYKPQLRVTYALDSVEGLSLSGRYRYDIRQNNGEDAQNERRHRLTANINYSVNEWRFGLEGNYYKAATDGYILYNGKDTNYELNATARRSFGQWAPYVEFGDVNVDSVTDRRELRSRLGVTYSF

SEQ ID NO: 7982 - protein, 342 aa, Rickettsia sp. IG-1
AIAIPALFASAANAAVVYGKDGTTFDVYGRVQANYYGDHNTADSTAASGYRDVDGELVGSSRLGWSGKIALNNTWSGIAKTEWQVSAENSANKFDSRHIYVGFDGTKYGKIIFGQTDTAFYDVLEPTDIFNEWGDAGNFYDGRQEGQVIYSNTYGGFKGKLSYQTNDDKAVKVTDVGQGIKETAVYGADVERNYGYAAAAGYDFDFGLGLNAGYSYSDLENTKTNNTGDKKEWALGAHYAINGFYFAGVYTQGDLSYDNTTGGDKDKGRGYELAASYNVDAWTFLAGYNFKEAKVKSNTAGAEYKDLLDETLLGVQYAFTSKLKAYTEYKIQGIDKMDDEWT

SEQ ID NO: 7983 - protein, 1616 aa, Rickettsia sp. TwKM01
MGAATQQNRTTNGAATTVDGAGFDQTVALANVAVALNAVITANANNGINLNTPAGSFNGLFLDTANNVAVTVSADTTLGFITNAANNGNSFDLTLGAGKTLTITGQGITNAQAAATKNAQNVVAPFNGGAAIANNDLSGVGTIDWGAADSTLVFNLANPTTQKAPLVLGNNAVIANGVNGTLNVTNGFIQVSDKSFATVKAINIGDGQGFIFNTDATVGNALNLQAGGATINFNGTDGTGRLVLLSKNGAATDFNVTGSLGGNLKGVIAFNTVAVAGQLIANAGPANAVIGTNNGAGRAAGFVVSVDNGNAATIAGQVYAKDMVIQSANAGGQVNFGHIVNVGTDGTTAFKTAASKVAITQNSNFGTTDFGNLAAQITVPNTMTLTGNFTGDASNPGNTAGVITFAANGTLASASADANVAVTNNITAIEASGVGVVQLSGTHTAELRLGNAGSVFQLADGTVINGKVNQTAVVGGALAAGAITLDGSATITGDIGNGGGAAALQGITLANDATKTLTLGGANIIGSNVGGTIDFQANGGTIKLTSTQNNILVDFDLDITTDQTGVVDASSLTNAQTLTISGTIGTIGANNKTLGQFNIGSSKTALNGGNVAINELVIGNNGSVQFAHNTYLITSTTNAADQGKIIFNPVVNNNTTLAAGTNLGSAANPLAEINFGSKGAHADTILNVGEGVNLYATNITTTDANVGSFVFNAGGTNIVSGTVGGQQGNKFNTVALDNGTTVKFLGNATFNGETTIEANSTLQIGSNYTADFVASADGTGIVEFVNTGPITVTLNKQAAPVGYLKQITVSGTGNVVVNGIGNAGNPGAATDTIAFENSSLGAALFLPSGIPFNDAGNTMPLTIKSTVGNRTATGFDVPKVIVLGVDSVIADGQVIGDQNNIVGLGLGSDNGIIVNATTLYAGIGTINNNQGTVTLSGGVPNTPGTVYGLGTGIGASQLKQVTFTTDYNNLGNIIAANATINDGVTVTTGGIAGTDFDGKITLGSVNGNANVRFADGIFSNSTSMIVTTKANNGTVTYLGNACVGNIGDSDTPVASVRFTGSDDSAGLQGNIYSQVIDFGTYDLNILNSNVILGGGTTAINGAINLLTNTLTFASGTSTWGNNTSIKTTLTVANGNIGHIVIAEGAQVNATTTGTTTINVQDNANANFSGTQTYTLIQGGARFNGTLGGPNFAVTGSNRFVNYGLIRAANQDYVITRTNNAENVVTNDIANSSFGGAPGVGQNVTTFVNATNTAAYNNLLLAKNSADSANFVGAIVTDTSAAVTNAQLDVAKDIQAQLGNRLGTLRYLGTPETAEMAGPEAGAIPAAVAAGDEAVDNVAYGIWTKPFYTDAHQSKKGGLAGYKAKTTGVVIGLDTLANDNLMIGAAIGITKTDIKHQDYKKGDKTNVNGFSFSLYGAQQLVENFFAQGSAIFSLNQVKNKSQRYCFDANGNMSKQIAAGNYDNMTFGGNLTVGYDYNAMQGVLVTPMAGLSYLKSSDENYKETGTTVANKQVHSKFSDRTDLIVGAKVVGGTINITDLAVYPEAHAFVVHKVNGRLSKTQSVLDGQVTPCISQPDRTAKTSYNLGLSASIRPDAKMEYGIGYDAQIASKYTAHQGTL

SEQ ID NO: 7984 - protein, 1058 aa, Rickettsia sp. IG-1
ITLQAGGSLAANNIDFGAGSTLDFNGPLGGGNAIPYYFKGAIANGNNAILNVNTKLTAYHSTIGTVAEINIGAGNLLEIDASAGDVTILNAQDINFRALDSALVLSNLTGVGVNNILLAADLVAPGADEGTVVFNGGVNGLNIGSNVAGTARNIGDGGGNKFNTLSIYNAVTITDDVNLEGIQNVLINDNADFTSSTAFNAGTIQIKDATYTIDANNGNLNIPAGNIQFAHADAQLILQNSSGNDRTITLGANIDPDNDDEGIVILNSVTAGKKLTIAGGKMFGGAHKLQTIVFKGAGNCGAAGTTFNTTNIVLDITGQLELGATTASVVLFNDAVQLTQTGNIGGFLDFNAKNGTVTLNNNVNVAGTVQNTGGTNNGTLIVLGASNLNRVNGIAMLKVGAGNVTIAKGGNVKIGEIQGTGTNTLTLPAHFNLTGSINKTGGQALKLNFMNSGSVSGVVGTAANSVGDITTAGATSFASSVNAKGTATLGGTTSFANTFTNTGAVTLAKGSITSFAKNVTATSFVANSATINFGNSLAFNSNITGSGTTLTLGANQVTYTGTGSFTDTLTLNTTFDGAAKSGGNILIKSGSTLDLSGVSTLALVVTATNFDMNNISPDTKYTVISAETAGGLKPTPKENVKITINNDNRFVDFTFDASTLTLFAEDIAADVIDEDFAPGGPLANIPNAANIKKSLELMEDAPNGSDARQAFNNFGLMTPLQEADATTHLMQDVVKPSDTIAAVNNQVVASNISSNITALNARMDKVQAGNKGPVSSGDEDMDAKFGAWISPFVSNATQKMCNSISGYKSDTTGGTIGFDGFVSDDLALGLAYTRADTDIKLKNNKTGDKNKVESNIYSVYGLYNVPYENLFVEAIASYSDNKIRSKSRRVIATTLETVGYQTANGKYKSESYTGQLMAGYTYMMPENINLTPLAGLRYSTIKDKGYKETGTTYQNLTVKGKNYNNFDGLLGAKVSSNINVNEIVLTPELYAMVDYAFKNKVSAIDARLQGMTAPLPTNSFKQSKTSFDVGVGVTAKHKMMEYGINYDTNIGSKYFAQQ

SEQ ID NO: 7985 - protein, 1062 aa, Rickettsia sp. TwKM01
ITLQAGGSLAANNIDFGVGSTLEFNGPLDGGGNTIPYYFKGAIANGNNAILNVNTKSLTAYHSTIGTVAEINIGAGNFFAIDASAGDVTILNAQAINFGVPDSALVLSNLTGVGVKNILLAADLVAPGANGGDVVFNGGVNGLNIGSNVAGTARNIGDGGGDKFNTLLIYNAVTITDDVNLEGIQNVHINNNAAFTSSTAFNAGAIQINDATYTIDANNGNLNVPAGNIQFAHANAQLILQNTSGNDRTITLGANIDPDNDDEGIVTLNSVTAGKKLTIAGGKTLGGAHKLHTIVFKGAGDFGAAGTTFNTTNIVLDTTGRLELGATTANVVLLNDAIQLTQTGGNIGGFLDFNAKNGTVTLNNNVNVAGAVQNTGGTNNGTLIVLGASNLNSVNGIAMLKVGAGNVTIAKGGDVKIGEIQGTGTNTLTLPANFNLTGSINKTGGQALKLNFTNGGSVSGVVGTAANLVGDITTAGATSFASSVNAKGTVTLGGTTSFADTFTNTGAVTLAKGSITNFAKNVTATSFVANSATINFGNSLAFNSNITGSGTTLTLGANQVTYTAGTGSFTDTLTLNTTFDGAAKSGGNILIKSGSTLDLSGVSTLALVVTATNFDINNISPDTKYTVISAETVGGLKPTPEENVKITINNDNRFVDFTFDASTLTLFAEDIAADVIDEAFGPGGLLANIPNAANIKKSLELMEDAPNGSDARQAFNNFGLMTPLQEADATTHLMQDVVKPSDTIAAVNNQVVASNISSNITALNARMDKVQAVNKGPVSSGDEDMDAKFGAWISPFVGNATQKMCNNISGYKSDTTGGTIGFDCLVSDDLALGLAYTRADTDIKLKNNKMGDKNKVESNIYSLYGLYNVPYENLSVEAIASYSDNKISSKSRRVIATALETVGYQTANGKYKSESYTGQLMAGYTYMMPENINLTPLAGLRYSTIKDKGYKETGTTYQNLTVKGKNYNTFDGLLGAKVSSNINVNEIVLTPELYAMVDYAFKNKVPAIDARLQGMTAPLPTNSFKQSKTSFDVGVGVTAKHKMMEYGINYDTNIGSKYFAQQ

SEQ ID NO: 7986 - protein, 1645 aa, Rickettsia monacensis
MAQKPNFLKKIISAGLVTASTATIVAGFSGVAMGAVMQYNRTTNAAATTVDGAGFDQTGAGVNLPVATNSVITANSNNAITFNTPNGNLNSLFLDTANTLAVTINENTTLGFVTNVTKQGNFFNFTIGAGKSLTITGHGITAQQAATTKSAQNVVSKVNAGAAINDNDLSGVGSIDFTAAPSVLEFNLINPTTQEAPLTLGDNAKIVNGANGILNITNGFVKVSDKTFAGIKTINIGDNQGLMFNTTPDAANALNLQGGGNTINFNGRDGTGKLVLVSKNGNATEFNVTGSLGGNLKGVIEFDTTAAAGKLIANGGAANAVIGTDNGAGRAAGFIVSVDNGNAATISGQVYAKDIVIQSANAGGQVTFEHLVDVGLGGKTNFKTADSKVIITENASFGSTDFGNLAVQIVVPNNKILTGNFIGDAKNNGNTAGVITFNANGTLVSGNTDPNIVVTNIKAIEVEGAGIVQLSGIHGAELRLGNAGSIFKLADGTVINGPVNQNPLVNNNALAAGSIQLDGSAIITGDIGNGAVNAALQDITLANDASKILTLSGANIIGANAGGAIHFQANGGTIQLTSTQNNILVDFDLDVTTDQTGVVDASSLTNNQTLTINGSIGTIGANTKTLGRFNVGSSKTILNAGDVAINELVMENDGSVHLTHNTYLITKTINAANQGKIIVAADPINTDTALADGTNLGSAESPLSNIHFATKAANGDSILHIGKGVNLYANNITTTDANVGSLHFRSGGTSIVSGTVGGQQGLKLNNLILDNGTTVKFLGDITFNGGTKIEGKSILQISSNYITDHIESADNTGTLEFVNTDPITVTLNKQGAYFGVLKQVMVSGPGNIAFNEIGNGVAHAIAVDSISFENASLGASLFLLSGTPLDVLTIKSTVGNGTVDNFNAPILVVSGIDSMINNGQVIGDQKNIIALSLGSDNSITVNSNTLYAGIRTTKTNQGTVTLSGGIPNNPGTIYGLGLENGDPKLKQVTFTTDYNNLGSIIATNVTINDDVTLTTGGIAGTDFDGKITLGSINGNANVKFVDRTFSHPTSMIVSTKANQGTVTYLGNALVGNIGSSDIPVASVRFTGNDSGVGLQGNIHSQNIDFGTYNLTILNSDVILGGGTTAINGEIDLLTNNLIFANGTSTWGNNTSLSTTLNVSNGNVGQIVIAEGAQVNATTTGTTTIKIQDNANANFSGTQTYTLIQGGARFNGTLGAPNFDVTGNNIFVKYELIRDANQDYVLTRTNDVLNVVTTAVGNSAIANAPGVHQNIAICLESTDTAAYNNMLLAKDSSDVATFIGAIATDTGAAVATVNLNDTQKTQDLLGNRLGALRYLSNSETADVGGSETGAVSSGDEAIDQVSYGVWAKPFYNIAEQDKKGGLAGYKAKTAGVVVGLDTLANDNLMIGAAIGITKTDIKHQDYKKGDKTDIKGLSFSLYGAQQLVKNFFAQGSAIFTLNKVKSKSQRYFFDANGKMNKQIAAGNYDNITFGGNLMFGYDYNALQGVLVTPMAGLSYLKSSNENYKETGTTVANKRIHSKFSDRIDLIVGAKVTGSAMNINDIVIYPEIHSFVVHKVNGKLSKAQSMLDGQTAPFISQPDRTAKTSYNIGLSANIRSDAKMEYGIGYDFNAASKYTAHQGTLKVRINF

SEQ ID NO: 7987 - protein, 515 aa, Wolbachia endosymbiont of Setaria digitata
NRLSAADIAADPTLVATETGALTLAEGGALSSLGDSVLSGNLISAGGILLSNTYTGGNGAATDDRLTVTGTYLGENNGSGEGAWLALDTVLGDDDSATDRLVINGDATGTTSVRVNNAGGLGDKTLNGINLITVDGLAQDDTFLLAGDYVTTDGYQAVVAGAYAYTLQADGEAATAGRNWYLSSELMLTEGVRYQVGVPLYEQYPQVLAALNTLPTLQQRVGNRYGAPGALADLNFDDNQWAWGRIEGSHQVTDPARSTSGSQREIDVWKLQTGIDVPLYQSQGGSLLTGGVNFTYGKAKADIHSFFGDGRINSAGYGLGTSLTWYGNNGVYVDGQLQTMWFDSDLSSRTAGHAVASGNNGRGYTSAIEAGKGYALGNGLSLTPQMQVTYSRVDFDTFRDPFDSEVSLQEGDSLRGRLGVSLDKETTWSAKDGTTRRSHIYSHLDLHNEFLNGSKVQVSGVEFATRDERQSVGLGAGGTYEWQNGRYAVYGNVNLLGATRNVSDNYAVGGTIGAR

SEQ ID NO: 7988 - protein, 207 aa, Wolbachia endosymbiont of Pentastiridius leporinus
SDEETSYYVRLQYNGEFLPLFTKVDGITYKKDKSDYSPLKPSFIAGGGAFGYKMDDIRVDVEGVYSYLNKNDVKDVTFDPANTIADSVTAISGLVNVYYDIAIEDMPITPYIGVGVGAAYISTPLEPAVNDQKSKFGFAGQVKAGVSYDVTPEVKLYAGARYFGSYGANFDGKKTDPKNSTGQAADAGAYKVLYSTVGAEAGVAFNF

SEQ ID NO: 7989 - protein, 370 aa, Escherichia coli
MKVKVLSLLVPALLVAGAANAAEVYNKDGNKLDLYGKVDGLHYFSDNDKVDGDKTYMRLGFKGETQVTDQLTGYGQWEYQIQGNAPESENNSWTRVAFAGLKFQDVGSFDYGRNYGVVYDVTSWTDVLPEFGGDTYGSDNFMQQRGNGFATYRNTDFFGLVDGLNFAVQYQGKNGSVSGEGMTNNGRDALEQNGDGVGGSITYDIGEGFSFGGAISSSKRTAEQNNSARFIGNGDRAETYTGGLKYDANNIYLAAQYTQTYNATLAGDLGWANKAQNFEVVAQYQFDFGLRPSVAYLQSKGKNLNANIAGRTYDDEDLVKYVDVGATYYFNKNMSTYVDYKINLLDDNNFTRAAGINTDDIVALGLVYQF

SEQ ID NO: 7990 - protein, 123 aa, Escherichia coli
MKVKVLSLLVPALLVAGAANAAEVYNKDGNKLDLYGKVDGLHYFSDNKSEDGDQTYMRLGFKGETQVTDQLTGYGQWEYQIQGNSAENENNSWTRVAFAGLKFQDVGSFDYGRNYGVVYDVTS

SEQ ID NO: 7991 - protein, 375 aa, Escherichia coli
MKVKVLSLLVPALLVAGAANAAEVYNKDGNKLDLYGKVDGLHYFSDNKSEDGDQTYMRLGFKGETQVTDQLTGYGQWEYQIQGNAPESENNSWTRVAFAGLKFQDIGSIDYGRNYGVVYDVTSWTDVLPEFGGDTYGSDNFMQQRGNGFATYRNTDFFGLVDGLNFAVQYQGQNGSVSGEGSEDYTGHGITNNGRNALRQNGDGVGGSITYDYEGFGIGAAVSSSKRTWDQNNTGLIGTGDRAETYTGGLKYDANNIYLAAQYTQTYNATRVGSLGWANKAQNFEAVAQYQFDFGLRPSVAYLQSKGKNLGTIGTRNYDDEDILKYVDVGATYYFNKNMSTYVDYKINLLDDNQFTRAVGINTDDIVALGLVYQF

SEQ ID NO: 7992 - protein, 364 aa, Escherichia coli
MKVKVLSLLVPALLVAGAANAAEIYNKDGNKLDLYGKVDGLHYFSDNDSKDGDKTYMRLGFKGETQVTDQLTGYGQWEYQIQGNEPESDNSSWTRVAFAGLKFQDVGSFDYGRNYGVVYDVTSWTDVLPEFGGDTYDSDNFMQQRGNGFATYRNTDFFGLVDGLDFAVQYQGKNGSAHGEGMTTNGRDDVFEQNGDGVGGSITYNYEGFGIGAAVSSSKRTWDQNNTGLIGTGDRAETYTGGLKYDANNIYLAAQYTQTYNATRVGSLGWANKAQNFEAVAQYQFDFGLRPSLAYLQSKGKNLGRGYDDEDILKYVDVGATYYFNKNMSTYVDYKTNLLDDNRFTRDAGINTDDIVALGLVYQF

SEQ ID NO: 7993 - protein, 364 aa, Escherichia coli
MKVKVLSLLVPALLVAGAANAAEIYNKDGNKLDLYGKVDGLHYFSDNDSKDGDKTYMRLGFKGETQVTDQLTGYGQWEYQIQGNEPESDNSSWTRVAFAGLKFQDVGSFDYGRNYGVVYDVTSWTDVLPEFGGDTYDSDNFMQQRGNGFATYRNTDFFGLVDGLDFAVQYQGKNGSAHGEGMTTNGRDDVFEQNGDGVGGSITYNYEGFGIGAAVSSSKRTWDQNNTGLIGTGDRAETYTGGLKYDANNIYLAAQYTQTYNATRVGSLGWANKAQNFEAVAQYQFDFGLRPSLAYLQSKGKNLGRGYDDEDILKYVDVGATYYFNKNMSTYVDYKINLLDDNRFTRDAGINTDDIVALGLVYQF

SEQ ID NO: 7994 - protein, 362 aa, Escherichia coli
MKVKVLSLLVPALLVAGAANAAEIYNKDGNKLDLYGKVDGLHYFSDDKSADGDQTYMRLGFKGETQVNDQLTGYGQWEYQIQGNSGENENNSWTRVAFAGLKFADAGSFDYGRNYGVVYDVTSWTDVLPEFGGDTYGSDNFMQQRGNGFATYRNQDFFGLVDGLNFALQYQGKNGSVSGEDQTNNGRSALRQNGDGYGGSITYDLGEGFGIGTAVTSSKRTNSQNDMGFGTGDRAETYTGGLKYDANNLYLAAQYTQTYNATRAGDLGWANKAQNFEVVAQYQFDFGLRPSVAYLQSKGKDIEGYGDQDLLKYVDVGATYYFNKNMSTYVDYKINLVDENEFTRQAGIGTDDIVALGLVYQF

SEQ ID NO: 7995 - protein, 373 aa, Escherichia coli
MKVKVLSLLVPALLVAGAANAAEVYNKDGNKLDLYGKVDGLHYFSDDKSVDGDQTYMRLGFKGETQVTDQLTGYGQWEYQIQGNSAENENNSWTRVAFAGLKFQDVGSFDYGRNYGVVYDVTSWTDVLPEFGGDTYGSDNFMQQRGNGFATYRSTDFFGLVDGLNFAVQYQGKNGSPEGEGMTNNGREALRQNGDGVGGSITYDYEGFGIGAAVSSSKRTDDQNFGLNRYDERYIGNGDRAETYTGGLKYDANNIYLAAQYTQTYNATRVGNLGWANKAQNFEAVAQYQFDFGLRPSLAYLQSKGKNLGVINGRNYDDEDILKYVDVGATYYFNKNMSTYVDYKINLLDDNQFTRDAGINTDNIVALGLVYQF

SEQ ID NO: 7996 - protein, 87 aa, Escherichia coli
MKVKVLSLLVPALLVAGAANAAEIYNKDGNKLDLYGKVDGLHYFSDNDSKDGDKTYMRLGFKGETQVTDQLTGYGQWEYQIQGNEPG

SEQ ID NO: 7997 - protein, 343 aa, Escherichia coli
MKVKVLSLLVPALLVAGAANAAEIYNKDGNKLDLYGKVDGLHYFSDNDSKDGDKTYMRLGFKGETQVTDQLTGYGQWEYQIQGNEPESDNSSWTRVAFAGLKFQDVGSFDYGRNYGVVYDVTSWTDVLPEFGGDTYDSDNFMQQRGNGFATYRNTDFFGLVDGLDFAVQYQGKNGSAHGEGMTTNGRDDVFEQNGDGVGGSITYNYEGFGIGAAVSSSKRTWDQNNTGLIGTGDRAETYTGGLKYDANNIYLAAQYTQTYNATRVGSLGWANKAQNFEAVAQYQFDFGLRPSLAYLQSKGKNLGRGYDDEDILKYVDVGATYYFNKNMSTYVDYNAGRQPLHP

SEQ ID NO: 7998 - protein, 339 aa, Vibrio anguillarum
MNKTLIALAVSAAAVVTGVNAGELYNQDGTSLEMGGRAEARLSLKDGKADDASRVRLNFLGKVAINDSLYGVGFYEGEFTTNDQGENKSNNNLDNRYTYAGIGGNFGEVTYGKNDGALGVITDFTDIMAYHGNSAAYKIAVADRVDNMVAYKGQFADLGVKASYRFADRSADKDSNGVWNAEYTDNNADGYSLSAIYAIGDTGVVLGAGYADQDTAANASSDQYMLAASYAISDFYFAGTFVDGQDKAASKTDKTGYELAAKYTMGQAVFTTTYNYLESKTSGNKADEADNFAVDATYFFKPNFRSYISYNFNLLDSDKVGKAKAKSEDELALGLRYDF

SEQ ID NO: 7999 - protein, 212 aa, Escherichia coli
MKKLTVAALAVTTLLSGSAFAHEAGEFFMRAGSATVRPTEGAGGTLGSLGGFSVTNNTQLGLTFTYMATDNIGVELLAATPFRHKIGTRATGDIATVHHLPPTLMAQWYFGDASSKFRPYVGAGINYTTFFDNGFNDHGKEAGLSDLSLKDSWGAAGQVGVDYLINRDWLVNMSVWYMDIDTTAKYKSGVNTVKDSVRLDPWVFMFSAGYRF

SEQ ID NO: 8000 - protein, 454 aa, Alistipes putredinis DSM 17216
MERQQDQSRNVFRHPARFRRWLSLLGCCLALYINPLLAQEPGADALPPPLTDSLPTDTTFVSPFPACDEELIPCVTGLDEHGDYPTGELSGFIQIDSAAFEQSPASMAAFGDINNRTAVRRARLALTGDLATDVGYKMDVEFATSPPAARDVYLDFRDRPYADRLIVGTTKVPFQMEALTSSKNFTFAERAPFFTFSPFRQVGIWADGTLEEERGTWSLAGFLVGKGGFDLNHNADGQGFAARTTYLHWYEDDGRDLLHTGLNYSVLQPFDKMVRYDSKLSFFTNQEPGINSSGPPQLVDTGNVPAESVNLFNFELAGSHGRFNYQAELTYALVNQMGGPPLVFYGGYAQAGWFFTGESKPYNRKAGVFDSVKPLHSFFDGGWGAWELAARGTFLNLNDKNVTGGRMNSAELVLNWYLSDQLSVKFDYVHGFINNATTDDLPIDVIGGRLQYIY

SEQ ID NO: 8001 - protein, 726 aa, Alistipes putredinis DSM 17216
MNRFKRTTITSAVLIMMGHGGFALAQSNALPGVEVSGNSILPSNIENLPGSSNVLTREDLDKREPFSILELVREVPGLHVVSEDAAGTHLNIGLRGLNPRRSSRTLLLEDGAPTVFFAPYGDPSAHYSTPLERLERVEVLKGSGQILYGPQTLGGMINFVTKPVPREGFEGSAKLSLGNEGYRGTHLNLGTGSERGGIMIDLLKRQGDGIRAQHEFDVQDVTIKGQLNINSAHTLTAKYTRFEEDSLFSETGLTAQEYLRDPYSVPGTEGERYVMDRDTIQLIHGWQLDERARLTTQVYHTKTDRTSLRSREFESAFDPMNPATIGLGELETEFATRPRQYDVFGIEPKLEFTHSAFGVPSETIIGMRYHTEDIDRKKFEFDNFADTTPEADERLLADVEATAFFAQNTFLMGNWTLTPGVRVEQIDQTKVLFSGVAGTANFQQVDMLNTKETETLPGIGFTWNGLNNSTVFGGVHRGFSPPRPDRDIENDMLQRVTPELATVAELGIRGNVRAGSYEATFFNLDIEDIVVNSGGFFRNEGKAQHTGFELAGRLNLGELFNAKANPFFVGMAYTNLFTAEFKNSGVVGGEGEDGYGTYQAGNRLPYAPKHTLALNLSYETEQWNARVGATHVSKQFANTENFGGTEPLGFCPNGEDPANDLFCGLFGEIEAVTLLNASVSFKPAGSNVSYFLNAENLTDKQYIAARTNGIQPGRQRQVVAGINVRF

SEQ ID NO: 8002 - protein, 705 aa, Alistipes putredinis DSM 17216
MEYSLLAFAVTAACTSAHVYANTSEFIDSASTEVITVIGSSLNDDVKEIEREAVTAATNIDADFGDQLALLPGVSISRNGPVTGLIQYRGLFGNRVGVSIDGVDITGAGPNSMDSPLSHILPEPGLTATLYRGIVPVSAGVQTLGGKLRINADAASLFALDNDITGSVNASVIAPGSGQQYQGNVLYKTDQAFFSGAFMHQQRDERESGNNIVIPNSYYQRNGGKFRLGYEWGKHQFDASYQRLNTNESGTPALAMDIGFIDAAWYRVGYRYNAGESEYFAINWFGNSNQHAMDNFSQRMVMSESMVRENNADAIAQGLDAKYVTPLNSGELEFGAYLHHSRNNSVITNPNNGMFFVDNFTNAKRDTASVYAQWTVNTEAYSSTYGARYTFTTMDAGEAGSNMVMMNPAIATLVSNFNAAERDENYNMLDMAATTRYHASESLDIVIGISQKNRAPTYFERYTWLPLGISGGMADGFNYIGNLELENETARKIEVGIDYNYESWTISPRLFYQDIEDYITGSPSTNMAANMVSSMMAFTEPFQWTNTDAVIKGADMTIQGQLTDSLSVQAVATVQHGNRDDIDDALFRIAPEHLTTTVQWNTQVFDAPLQMQLTSELVGAQNHVSALQNEASTAGYGLFHISGLLALFDNAHTNLQLTASIHNLFDKQYAPHTAGINRVMNAGAEVGERVPGAGREWHLSLSYRF

SEQ ID NO: 8003 - protein, 172 aa, Alistipes putredinis DSM 17216
MMKFKKCLLPVAMLASFTLAGCQSNADDHAADVYQTDQLNTKQETKTVNIISILPAKVAVDNSQNKRNAQAFGALIGAVAGGVIGHNVGSGSNSGTTAGAVGGGAVGAAAGSMVNDKTLVEGVSLTYKEGTKVYTSTQVGKECQFTTGLAVVITTTYNETRIQPNTKCPEKS

SEQ ID NO: 8004 - protein, 982 aa, Alistipes putredinis DSM 17216
MKHLFLLLTLLSFSLTALAQQKVTGKVKDSSGEPVIGASVVVKGNNTMGTITDFDGNFMLDVPTKSVLVISYIGYVTQEVPTVEKKSLEIILKEDTKTLDEVVVIGYGTQRKGDVTSSVASVKADNFVKGAVKDVGQLIQGKVAGLAITNPNGDPTGSTQIRLRGTNTIGGANTAPLVLIDGIPGELGTVAPEDVESVDVLKDGSAAAIYGTRGTNGVILITTKQAKGVDINQVEYNGYVSTSLIAKKLDMLNADEFRTLYPDQDHGADTDWIDEISRTPISHVHNLSLMGGNSKTNYIANLNYASRQGIMKKSDFESFQGRIEVTHRMFDDKLKLKFGLFGKKNQMESTTSGGSFRGWVYGQATRRNPTDPVRNEDGTWNENVSKFEYENPLALLYEAEGNVKKTQLRYNGNIVYNPIKDLTLSAVFSYIRDNMNRGYGETLSHISALRDGLAGWSSVGAYTKMEKLMELTAQYNKEIGAHKFSVLGGYSYNETDFEELWIDNYGFQDDYFGGWHNIGIGSALKDGKANIGSKKTPTNLIGFFGRATYSFKNRYLLMGALRYEGASQLWGTDNAWGLFPSVSVGWRITEEAFMKNQKIFDDLKLRVGYGVTGSQPKDPFLGVAMLKYGSYAFVNGNWIQTIVPASNPNPDLKWEEKKETNIGLDFVSWGGRLSGSIDYYNRDVDGLIYEYGVPTPPNLYNKTMANGGTMRNRGVEVLVTVVPVQNKDFEWSTTGTFSLNSNKLISLSGSIFKSDYDYFNTGTVEYSGQVADSHRVQVGESIGNFYGFKVVDVDSEGRWIYEDRNGELVNYKDFTHAPEDKHVIGNGLPKWYAGWNNTLRYKNFDLNVTMRGAFGFQIINGGRMNYENVKNSRFENRLKSVNDLVFGKHTLSPEVEPEFNSYYVEDGDYWKIDNITLGYSFGQVGKYIKSLRIYGSVLNALTITGYKGIDPEVSTDGLTPGYDTRDRYPSVRSFTFGVNVKF

SEQ ID NO: 8005 - protein, 557 aa, Alistipes putredinis DSM 17216
MIKKITALTLLVSTALSAETLPDSHMMQDMSMGESRRALQDSTREVNQLIEQRRYQQLKQQRLLAEPAAPALPQSAQCLPIAGVYLQGVTLLSPADLSALSGLPEQCISSNDINRLTRELTRLYVQKGYITARVQIVRPNSQGELGLSVTEGFIEKIEGGDRWVNSRLLFPGLEGKPLKLTELDQGLDQANRLQSNTTKLDILPGRQVGGSVIRLRNQHAKPWLITAGTDNYGQKSTGRWLARATATLDSPFGLSDFVSLNANSTLENPAHRYNRAYTLLYSLPYGAFTFSGFASFSSYENHQQLPHNVVKLHGQTQQYGLRSDYVFYRDHDQIDSLSGQLTYKRIDNYFESVRLEVSSPTLTLAELSASHLQILPNGVFSANLSVEQGMPWLGAGRHPSSVHLDSQFTKGKLFANLSQRLRLGDATYQLNNLFYGQYSRDPLPGVEWLSLTDRSAVRGFSRSTQSGDNGWYLQNTLSRSFNLGATTLTPRLGADVGRILPRQDNSGWRSSAGISTGATLRYQRALVDLEVSRGWILSNHATPEDPVQVLARFSYTF

SEQ ID NO: 8006 - protein, 771 aa, Alistipes putredinis DSM 17216
MRIALSDQGIFQVGTQMHTTRGDGVKYTLLAQAIDQAHVARGRRYGWLLMGLAALPWVPAMADNAATQSTETVALESVTVTATRREESLQKVPVAVSVIQGEQLERDNRNGVASIVQQVPSLNFRTGASNKDTSLFIRGVGTISTSPGVEPTVATVIDGVVYARPGQATLDLLDLERIEVLRGPQGTLFGKNASAGVLNVTTKAPTEETHGYIDQSYYSGNESRTRFGISGSLIPQTLKGSITTLFGSYDGNVDNKLNGQEVNGYNRKGARGKLEFTPNDDITFTLAADYMQSHDDAPNGVVSKALTPAFASALSPVRADSDNRDVLSDYRSHVEDVNKGLSGQLDWQLGDYTLTSITAWRGWDNIQYQDGDRLGTVTAAFPGTEDKGDLEFNQYSQELRLASPKGQFVEYVGGLFYMHGKSDETYQRTLITPTRQDRGIADYSTTTDSYSVFGETTFNFTPDFRAIAGARWTHDDLEYDHRRVSTSATTVSGIQPATSSSGSVDEDGKSGRLGLQYDLNDSVMTYFTYSRGYKGPAYNVFFNMQPRDTDALKPETSNTWEVGVKATTWNNRLTTNLAVFHSDYDNYQANFFDSVAGQVVTRLINAGSVSTEGVELDYALQATRNLKFSGALSYTKARIDSFACPAGAAASCNVDGKTLPYSPDWKSYVRADYTIPLDNGLDIELGTDYSWQSEVQYDISQNPDTKQGAYGIWNASVALADYNSGWRVALLGKNLADKSYSPMLATGGSYVYRSVPRDDERYFGVQLRKDF

SEQ ID NO: 8007 - protein, 990 aa, Alistipes putredinis DSM 17216
MRVAGEILGTSLAGDPAFFDDIIREVTVNRQFHLLGAGVAALMTAIPAMASAQETAGASNDVVVVTGSKIPREDLEGPSPVAVFGEQQIDRSGAVSIGRLLREIPSVAGAGETRAINNSGAGSQEVSLRGLGSQRTLVLINGRRVPDSSAGLEGQVDLNTIPVSLIERVEVLKDGASTVYGADAVAGVVNVILRRDFEGIALDYQKGISEQGDAEQDSVSLTLGDTFDKGNFVINFSLTEEGEVSAGDREFSKQARDIELGELIPGGSSAPPWGRYFVTGGPEPSVTLGPDYSGGPFFGYQGFQFAEDAYNFAPINHQAQPLDRWSATFIANYDVDVLSDGPFFLDTELFTEVSYVDRQSQQQLAEVPLAPLAFFGFDAPYSADNGYNPFGQEISDWRRRIVETGGRTDDVQVKTFRTVLGARGELPRDWSWEFSYSYGDVDRTSSFFPIIDLNKTALAVGPTAMDGDGVLRCDTDSDGDFTDADDQTCVPLDVFGENSITPEMIDYIAITQNESTEATSEIFALDLVNPSIFTLPAGDVGIAVGYVHRSEEGTFTPDSQVAALGGAATGTPSQATVGGYELDEFFGEVRVPILADRPLADELTVEAGIRWSDYDTFGDTTNYKVGLTYRPVSDVLLRGSVNTAFRAPQIEDLFGGAEFSFPSTTDPCASNPSQFCIDDGVPPGGFDQLSSQVRTIEGGNVDLQPEEADIFTVGAVYTPSQIPGLALGLDYYDYEITDAITTIGASVILQECAATGEFCELIDRLDNPGEVTDGAPILVDNRTTNVGQIETQGVDFFIEYVDIPAGPGEITARLQGTYTDTFDLTQANGTVVPHAGYFRDDNEGHFAKLRLNSELAYTVGGFTGSITGRFIDSVEEFGEDLFGSCVNDGGFVITPGVNAGLTCVGERSSLAASPVDVGKFHRRIEAVTYWDVYAEYLMPIEQVETILYMGIDNLLDEQPPLSVDGFNDNTDVRTYDTIGRFLYGGIRTKF

SEQ ID NO: 8008 - protein, 468 aa, Alistipes putredinis DSM 17216
MRKNKVLPGSVIRIATASALVAPAAALAGGFSLNEQSASAMGVANAGTAANPENATTVFFNPAGMSQLSGTNMSFGAAVLDIDAELKEGTGSAVRDDSRPVAGGNGGDIAAPAALPNFYMTHEINDWLDVGFGLHAPYGLAADYDDDFKGRFFADKTELTAIAFSPSIAVNDGNGFSMGAGVNVIYAEGRLTKFQDYSGTEARFGLPPGTLEDGYADIEGDDVALTFAFGMLWEMSERTQFGISAQTGTELELDGDAEVRNFPQGSLSGGGLVFNQSTVTEKVTVPLDIPESITFGARHQLTDTVTLLAGATWAKWSRFEALDVVSREDNGPISSQAGPGLGDERLVTHVSENWKDTWQANVGAIWQATPEWAFKAGYAWDESPVNDDFRTARIPSGDRDWITLGAQYADARSGWTVDVAAGVLLFDDQDVNEQNYDVNDEPMPGAARYRGTYELDAWSAGVQVSKQF

SEQ ID NO: 8009 - protein, 1028 aa, Alistipes putredinis DSM 17216
MRAYRQSLLALSCLTLATGWVNPALAATDTAALEARQADTPIGPKINPAVDPLVEVRLAEGPLGAALFALGRQTGAQILFTSEMVAGRSGPAVIGRMNTAQALDRLLAGLDLDVQRMSGKVFVLKARAQLISTTGALRARDTEGDALRASMLLQVTPEDPTLLSEIVVGSHIRGAKDSASPVIILDRESLSRAGRTSVADALSALPQAFGGLGAEDASSTGADPTGTNSNKATGVNLRGLGTDATLVLVNGRRLAGTGLRGDFADVSSIPMAAVERIEVLLDGASALYGSDAVGGVVNIVLRERFEGVETRAMVGATTQGGASQWSFGQTVGKAWNGGNLVISYEHSARDRLRGRDRDYTGQADLRVLGGTDRRRFYGMPGTILRANPSGVLAPAFAIPTGQSGVGLTPESFQAGTINLENQLGAYDVLPRQRRDSVYVALTQEVSSAVSLSADLRATRRRFTNRSVASSPTLTVNRNNPYFVSPTGQASERIAYSFLNELGGQRVNGLAETLGLSFGGQARLPGAWRLDAYGAYGLEQGRSRTDNLVNTSYLSEALGTTANNAATAFNTATDGFFNPFIGQGSNPSAILDFIRGGYLTRKTRGETASVNLKLDGELFTLPAGAVGLAIGGQVRREALKTSGVSLTSGFSPTPVARRDVQRRIGAVFAELRAPIFGGDFVRPGLQRLELSAAVRREDYGDIASTDPKVGLIWSPASGLTLKASYGASFRAPALIELNEPQIYAPTTLTRNGKDTIVMILYGGNQDLRPETATSKTLTVALAPARWPRFKASVTGFDTRFSDRIGQPGLDHLSKVLTAPEFAPFVSLVSPGSNAADLARIQALIDDPRSLAQGIFPAQSYAAIIDGRWVNTGQLRVRGLDVSARYTARIGDDPLTFSADLTWLADYQRKITPQAKAVQQAGVAGQPADLRLRAAASWTHGDLTTTAALNHVGDLRTEIGGRIRPWTTADLNLAYGFKAGPMAGLTLALNVQNLLDDDPSFYDSPLAVGYDPANADPLGRSVILQLTKTW

SEQ ID NO: 8010 - protein, 174 aa, Alistipes putredinis DSM 17216
MKRRYSFLVFLGLLLASPLALANDQHTVSFGYAQTHLSSLKNSDSKDLRGFNFKYRYEFNETWGMLGSFTATRNEMENYTWKEGKLHKNGSDSVDYGSLMFGPTYRFNDYVSLYGNAGIATMKFNKHSKEESFAYGAGVIFNPVKSISIDASWEASRFFAVDTNTFGVSVGYRF

SEQ ID NO: 8011 - protein, 379 aa, Alistipes putredinis DSM 17216
MKIKSLLFGSAAALVATTGAYAADTVVAPEPESVEYVRVCDAYGAGYFYIPGTETCLRVSGYVRYDAAGGDNVYGRGFVDRDGSVDTRRNSWDNKARFTLRLSTASETDLGTLKTFAETRYDWGNGVEGASGSLRFAYIQLGGLRVGLDESAFVTFPGYLGDVINDDVILAGGYRTGLISYTFTGGNGFSAILSLEQGNNDDTDSAYGYNGVIKDYTPHVVGGLKYEGGWGKIAGVAAYDARNEEWAGKVRADVNITDRFSVWAMGGYKSNKDQYIMQTDGNGHDIGQVRAISSFYGTWGGDWAVWGGAAFKATDKAVFNAQLAYDGTNTFAATANVAYEMVPGFTVTPEVSYTKWSDSKSYLNGKDAVQGMIRFQRSF

SEQ ID NO: 8012 - protein, 796 aa, Alistipes putredinis DSM 17216
MIKNGILILIAVIYSASLFAQPRTLLSGKVVSTDKSVIDFATVYLKGTQYGCTTNEQGIYHLHAPAGKYTLIISAVGFETYEKAIEIVPNERNKQTVVLKPSVTELDEVVVTSTGVNRVKKSAFNAVAVDTKELHNSTKSLSEALSQLPGMKLRESGGVGSDMQLMLDGFSGKHVKVFIDGVPQEGAGTAFDLNNIPVNFAERIEVYKGVVPVGFGTDALGGVINIVTNKKRRNWFFDASYSYGSFNTHKSYVNFGQTFKNGLMYEINAFQNYSDNDYYIDNYITEFGEDGITESTDKNKIYHVKRFNDTFHNEAVIGKIGVMDKTWADRLVFSFNYSHFYKEIQTGVYQYVVFGQKHRKGYSFVPSVEYRKRNLLIEGLDISATANYNHNITHNIDTAAYKYNWLGDKKYTGTPGEQSHQNNESKNTNWNGTFTANYRIGEAHTFTLNHVISTFHRTTRSYISGSSKLSDFSIPKKTRKNITGLSYRYMPSDKWNISAFTKYYNQYNEGPVSQNSDGIGNYTTLKKHLSSLGYGVAGTYFIIKDLQAKLSYEKAYRLPTTEELFGDEDLEAGKADLKPERSDNFNLNLSYAYHIGKHAIYVEGSLIYRDTKDYIKRGLSQVSNMSFGYYENHGRVKTKGYNISLRYNYSRWFNIGGTFNSMNARDEEKYRAGGTQQESLTYGQRIPNQPYLYANFDASFTWHDLFDKGNVLTLGYDGYYQHEFPLYWENLGDPTTKIRVPEQISHNLSIGYSLKGGRYNLSFECRNLTNAKLYDNFSLQKAGRAFYGKIRVNFGK

SEQ ID NO: 8013 - protein, 535 aa, Alistipes putredinis DSM 17216
MHPAARQEETSWFSLEISRLLGGNFATGTPSANRHPRPRCNALPVAIPAACQQRAFDALGQRRRLVISHVQIDKETPVKGNYVRAATAICVAICGTHARATDVFNLEGFGPVSRAMGGTGAAFDIGPAAMMENPATLGLMGEGRHFSLGLDVVSTDIKVTNTATGETASSGNHGNNNGPYFAPQTAFVYRQGRYAFGAGIFAEGGLGTQYGGSSFLSRTSNGVDTGLDQFSRLLVLRVPFSAAYHVTDKLTVGASVDAVWTSLNLGTLLDVSQIGTLAGQGRVSGTLVPTLLGVPGLSGGSIDFSRNAPVGGGAQAWGIGGRLGLTYQVTPDTRIGAAYQAKTHVGDLTGQATLSAVSSVAGNIPLKGDVTVRNFQMPAQLTVGISHQFNDQLSVSADYQRVFWSSVMKDMTVGFVQSGSGANLDLSLPQNYRDISVFGIGAEYRYNAKWTFRGGFHYAQEAIPGNMLLAVVPATPTTSLTGGVSYAIGKNDVIDFALSVALRKTLDNASQPNTAVPISVTHSQVNAVIAYQKRF

SEQ ID NO: 8014 - protein, 108 aa, Alistipes putredinis DSM 17216
MKKLILIAIMASGLVACAQSTAPQEDSRLKEAYSACINTAQGSPEKIEACQSVLNVLKKEKQHQQFADQESVRVLDYQQCLRATQTGNDQAVKADCDKVWQEIRSNNK

SEQ ID NO: 8015 - protein, 365 aa, Alistipes putredinis DSM 17216
MKKLIFGASVALMCSGAYAQSSVTLYGLIDEAIRFQTSGSGNTLGMNEGAINGNRFGLKGKEDLGGGSYAIFQLESGFNVANGKFDQQSQLFGRFAWVGLQNDTYGTLKAGRQYGGIYNFYAFNFDPIGGGNINATDWSLFLTGIRFDNTVEYDNRFGPVALQVQHSFGGQAGSASSGSTTTASLIYNFNGGKVGVDGAESKDGTGHKLLVGSAGGTYAWGPVGLYLYGINARRDAGFSVAATNSGLPLSNTNLISNATTAFGPQTKARDDMFVRAGVTYQAAPQWKLTASYAYDHANNVAPGQNGTIQTVYGIVDYLLSKRTDVYLEVDHSHLAGASIDDPNGPLTFGGKANNFGAGLSLRTLF

SEQ ID NO: 8016 - protein, 3822 aa, Bacteroides stercoris ATCC 43183
MSSAGGTLGTSIGGTLLGNAVNIDTGVTLGLNGSANLGLSGTIAGNGGLAQTGAGTTTLLGANTFSGGTALSGGGLIAGTGAALGTGALHVTGAGGSLATNVGGTLLGNAVNLDAGATLGLNGAAGLSLGGTIAGNGGLAQSGTGTTTLLGVNTFSGGTALSGGGLIAGNGAALGTGALNVSGAGGTLATSVGGTLLGNAVNLGAGATLGLNGAADLSLGGVIGGSGHLAQSGAGTTTLLGANTFTGGTALSGGGLIAGNGAALGTGALNVSGTGGTLATNVAGTVLGNAVNLGAGATLGLNGAADLGLNGAISGAGGLALGGTGATTLSGANTFTGGASLTGGGSLIVGGNTALGVGGALNVSGLGGSLSADLAAGAALANDVNLNGASLTLNGANDLGLSGAIGGSGGLVLSGTGTTTLSGANTFGGGTTLSAGTLLAGSNTALGSGALNVAGAGGALGASVNGIALGNAMNLGAGATLALTGANDLGLNGVIGGSGGLAQIGSGITTLTGANTFSGGTTLSGGGILAGNGAALGTGALNVTGAGGSLGTTVGGTVLGNAIQLGAGAALTVGGANDLGLGGIISGSGGLSVNGPGRTTLTAAETFTGGTTIGSGTLAIGAGGSLAASSPVNLTGAGAQFNISGATTPQSIGTLSGVAGSTIDLGANHLTLAGSGSGVFAGNIGGAGGLTLAGTGSQALTGNNTYAGGTALTGGSLVVGSGAALGLGALDVNGSASLGASVPGVTLGNAVNLGAGVTLGLNGANDLGLSGTIAGNGGLAQTGSGTTTLLGANTFSGGTTLSGGGLIAGNGAALGTGALNVSGAGGTLATNVAGTLLGNAVNLGAGATLGLNGAADLSLGGVIAGNGGLAQTGSGTTTLLGANTFSGGTTLSGGGLIAGNGSALGTGALNVAGAGGSLGTNVGGTVLGNAVNLGAGATLTVGGANNLGLGGAISGGGNLSVSGPSITTLTGVGSYTGNTTIGNGSTLAVGAGGSLSGGSLFDLTGAGATFDLSAATSPQTTGGLVGTAGAAVNLGGNTLTLGGSGNGTFGGTIGGAGGLTLAGTGTETLTGTNTYTGGTLINSGTLAIGAGGSLAAGGAVNLGGAGATFDLSGAALPQVIGTLSGVAGSTVNLGGNGLTLGGAGSGTFGGTIAGAGGSLTLSGTGTETLNGANTYTGGTNLAGGGTLVAGNGAALGTGALNVAGAGGTLAASIAGTTLNNAVNLGAGSSLTLGGTNDLGLGGIIAGGGSLAQTGSGTTALTGANTYTGGTTLGAGGLSVGSNTALGTGALTVTGSGGALSASTANLLLANAVDLGIGSTLHLGGAFDFGLNGTISGAGGVVQSGAGTTTLGGANTYGGGTTLNSGGLSVGSNTALGSGALNVTGNGTLNASVSGTTLGNAVTLGAGATLGLNGANDLGLSGTISGSGGLAQTGAGTTTLTGTNTYDGGTTLSGGGLIAGNGSALGSGALNVTGAGGSLGTSVAGTTLGNAVNLGAGSTLTVGGANDLGLGGGISGSGGLSVSGPSTTTLTGVNTYTGNTTIGGGSTLAVGAGGGLSAGSALDLAGAGATLDISAATTPQTSGMLSGVAGTNVNLGGNTLTLAGAGNGSYAGTIGGTGGLTMAGTGTETLTGTNTYTGATTINSGTLAIGAGGSLSASSPVNLAGAGATFDVSGATTPQTTGTLSGVAGSTVNLGGNNLTLGGTGSGTYGGTIAGAGGSLTLSGTGTETLTGNNTYTGGTNLTGGGTLIAGSGSALGTGALNTSGAGGTLGTSVAGTTLTNAINLGSGSTLTVGGANNLGLGGAISGSGNLAVNGPSTTTLTGAGTYTGNTTIGNGSTLAVGAGGSLSSGSAIDLAGAGATLDVSAATSPQTTGTLSGAAGSAVNLGGNTLTLGGSGNGTFGGTVGGTGGLTLSGTGTETLTGTNTYTGATTINSGTLAIGAGGSLSGSSPVNLAGAGATFDVSGATTPQTTGTLSGVVGSTVNLGGNNLTLGGTGNGTYGGTIAGAGGSLTLSGTGTETLTGNNTYTGGTTLSGGGTLVAGNGSALGTGALNTSGAGGTLAASTPGTTLGNAVNLGAGSTLTVGGANNLGLGGAIGGSGNLAVNGPSTTTLSGANTYTGSTTIGGGSTLAVGAGGSLSSGSAIDLSGTGATLDLSAATSAQTTGALSGGAGTNVNLGGNTLTLGGAGSGTYGGVIGGTGGLTLSGTGTETLTGTNTYTGATTINSGTLAIGGNGSLSSSSPVSLTAAGATLDLSGAASPQSTGAISGVAGSTVNLGNNNLTLGGSASGTYAGNIAGTGGVTMSGTGTETLTGSNTYTGATTINSGTLAIGAGGSLSGTTPVSLTGAGATFDLSGATTPQTTGTLSGVAGSTVNLGGNNLTLGGSGSGTYDGTIAGAGGSLTLGGTGTETLTGVNTYTGGTSLTGGGTLIAGNGSALGTGALNTSGAGGTLGTSVAGTTLGNAVNLGAGSTLTVGGANNLGLGGTISGSGNLAVNGPSTTTLTGVGTYTGNTTIGNGSTLAVGAGGSLSGGSAVDLAGAGATLDLSAATSPQSTGALSGVSGSTVNLGGNALTLGGSGSGTYGGTIAGTGGSLTLAGTGTETLNGTNTYTGGTTLSGGGTLLAGSGSALGTGALNTSGAGGALGTSVAGTTLGNAVNLGAGSTLTVGGANNLGLGGAIGGSGNLAVNGPSTTTLTGAGTYTGNTTIGNGSTLAVGAGGSLSAGSAVDLSGTGATLDLSAATTPQTTGAVSGVSGSTVNLGSNTLTLAGAGNGTYGGTVAGTGGLTLSGSGTQTLTGNNSYTGATTINSGTLAIGAGGSLSGSSPLSLTGAGATFDVSGATTPQTTTALSGVAGSTVNLGGNNLTLGGSGSGTFGGTIAGAGGSLTLSGTGTETLTGPNTYSGGTNLTGGGTLVAGSNTALGTGTLNASGAGGTLAAGTPGTTLANAVNLGTGATLTVSGPNSLGLTGAISGSGTLAVNGPATTTLSGANTYTGGTSVTGGGTLLAGTPTALGSGTLSVGGTGGTLGASVAGTTLGNAVNLGAGSTLTVGGVNNLGLSGPISGGGNLAVSGPSTTTLGGANVYTGNTTIGNGSTLAIGGNGSLSAGSALTLAGNGATLDVGAATTPQTASALSGAAGSTVNLGGNTLTVAGPAGGSFGGTIAGTGGFAVQGGGTQTLTGANTYTGGTTIGSGSMLALAGAGSLAPTSPVILAGSGATLNLAASAAPQSIGTLSGTTGSTVNLGATPLTVNTAGTSSFAGTLSGTGPLTLAGTGAQVLSGTNTLSGPTNVTGGTLAVTGSLASSPVTVGSGATVTGTGTVGGLVVSGGGTASVLQLGQPLKVAGNATFQPGSTLQVGATPQQSGGLDVTGSATLNGGSVQVVAATGQYQPGKLYTIVNAGAGVQGQFSAVNSTYAFLTPTLTYNPAQVLMSLAPNGTPFASVATTPDGQAVAGAVGTLGAGNPLFDTVLTSDATTANRAFTQLAGDLYPSTRSVLLSDSRYVRDAVLDRARLGSQPGGALCGCEAPVSADDHAAALDRRMAAENGCTPAKSYKPAVWGRLYGSHSRFNGDGVASIDRNLYGFIVGTDAEVSSHWRVGIAGGASRSQLNTDQNESAKVNGGTIALYASGRYDAWNVRGGVSQSWYRVHSERNPSFGSFADHDTASYDANATQVFTEIGYSTAIRNVSLEPFVGLAFASLHTGGFRENGGAAALQGDSDTTGLGFSTLGVRASTDVAVTTKGKVTAFGTVGWRHAFGNTQPASTLSFASGGSPFSVTGVPVARDAAVLEVGVDAAVTKNLSLGLSYSGQLGGHISDHALYGNLLWKF

SEQ ID NO: 8017 - protein, 827 aa, Bacteroides stercoris ATCC 43183
MQTPFTPTPARAALTCLLAAAVAWAAPGHAAEPLAQTRQAARAYEIGAGPLASVLGQFAAAAGVALSYDPASTRQRQSGGLRGSYTVGAGFAAILAGSGLEAVEGGAGEFIVRKAAMPATAGAAAADATELPAVRVVARAAPAPVDADERYQPTPDASSLRTTAPVLEIPQVVNVVPAQVIRDQRPRNLDEALANVSGVTQGNTLASTQDTIMKRGFGTNRDGSVMHNGMPLVQGRGMNAAAESVEVIKGPSSLLYGLMDPGGVINVVSKKPQLRQRTALSLQGSGYAGGRNGTGATLDTTGPIGENGLAYRLVVDHVDEDYWRNFGQHRETLVAPSLAWYGDDTQAVLWYEYRKYLTPFDRGTALDPVTRRPLDLPATRRLDEPFNQMTGETHLAQLSVDHRLGSGWAAHLNLSYNREIYDANQLRVNGVNTARGTLQRSNDATHGALSTDSYGSAYVDGSVQLAGLRHDLQFGADAESRLIYRSDLLRQAVTSTFSYTNPVYGLEQPSATVSASDSDQRDQLHNQSLFLQDAIHLGDRWVLTTGLRYQTWRQTAGRGRPFKANTQADGTAWLPRAGLVYQLASGLSLYGNYSQSLRPTSTIAPLASGTVIDSGVAPEEARSWEAGAKLDLPGQLTGTLALFDIRKKNVLVSQFNDATKLTDWRTSGAARSRGLEVDVAGELGRHWSAIAAFAYVDAKTTQDPLYQGNQLWNVARQTASLSAVYDFGQVLGGVLGGVLGEGRLRVGGGLQYVGKRPGDSANAFWLPGYTVAHAFATYDTRINGYRTRFQLNVKNLFDRTYYPSSANTYFISMGDARQVLLRATVEF

SEQ ID NO: 8018 - protein, 219 aa, Bacteroides stercoris ATCC 43183
MKKYAITSIAAAMLSAPAITATADPLYISLSGGLNLMSNSDAKVSDTETSIKNAVEYKRGYALEGAFGEKTGVFRGEIAVGYQSSDVDKVLGSDIVEQLGEIDNYEDLTVTASALTVMYNVYADYDMKGILSPYLMGGLGAAFVDMGTSFKVDGVEYDSSYDKTVFAWQLGAGLGIKITNNVALDLGYRYFKTGDLDLENKTKLSFGGSKILLGMRYNL

SEQ ID NO: 8019 - protein, 777 aa, Bacteroides stercoris ATCC 43183
MKQYILLLVLMVMSAGINAYAEDVNPVKEGNVISGHVVEKGTENSLPYAAILIVETGQGTVSNEDGEFRFKKVPAGKYTLRVQLLGYETQEKKVTVSNDFTVDVHFLMSDESIMTDEVVVSANRNETSRKVAPVVVNVMNAKLFESVNSTDLAKSLNYQSGLRVENNCQNCGFPQVRINGLEGPYSQILINSRPVVSALSGVYGLEQIPVNMIERVEVVRGGGSALFGANAVGGTINIITKDPINNSFQVSSTMSNMNGKVWEQYMGANASLVSKDNTYGIALYQSYRNRNPYDADGDGFSELGKLNMNTFGLRTYYRPTQFSRISLEYHTTNEFRRGGNKFDLQPHETDITEQTKHVINSGGLSYDLFWKEYKHKLSFYSSIQHTDRNSYYGAQQDANAYGKTKDLTWVAGGMYVGNFEKVLFSPATFTAGLEYQNNSLHDVMTGYHRDMKQDVRIASAFVQNEWKMNQFVFLAGFRLDDHNLIDNPIFSPRLNLLYKPSDKLQARITWSTGFRAPQAYDEDLHVTAVGGEGVLIKLAEGLKPEHSNSISGSIDWTANIGHFQTNLLLEGFYTGLDDVFVLEDMGHDENGNKVKERRNGNGARVYGVNLDGKIAHGRDAALQVGFTVQRSEYTELEAWSENPEVAPVKRMPRTPDYYGYFTLTSAPFKNFDCSLSGVYTGRMHVPHFAPTELPEEYIGQYIAKDEMVHTPDFFDLNVKLNYTFVLNDHIKLQLNGGVQNIFNAFQKDLDKGGYRDSGYFYGPTQPRTYFVGIKITN

SEQ ID NO: 8020 - protein, 218 aa, Bacteroides stercoris ATCC 43183
MRKISLIGLATMSMLAFNTSAFALGTASSNSGASGKHWSVVGGAALVQPKNGKNAAQNTVKFGGDVAPTLSVTYYINDNVGFELWGITKKLSYTAKTDASGKIGNVTQKTPLALSAQYHFGQAQNVFRPFVGVGYSQAKSRFTALGSTDRVNLGNFRGAIGTIGLDMNVDSNWFARLDARYTRFSNSNSKAALSSSLGLDQNRRLDPWSVGFGIGARF

SEQ ID NO: 8021 - protein, 392 aa, Bacteroides stercoris ATCC 43183
MISFRKCNIAASVASLVLMATTAFAGPTWTFGPDDEGLLKLDYKGQFQLDYRDTGSGSGGDDDTMEFNFRRNRIALMGAYGNLGIYAQTEYTEDVNVGPFTVSDGSSNTFQMLDAQIRYKFNDAFRVRAGKFKYNLTRENLEACEKPLTLDRSVLIRAPYVSTRDKGVAVWGNLFNDIFQYRLDVMNGRTDSVSAPDSNFRYSGRAHVTFLDGEKGYGYKGTYMGKKKVITLGAAYSVEQDVAYADCTNETGAVDYKAWTVDLFAEYPIEGIGTFTLSTAYVDYDLDDAYQGADPDSGVIGVNGEKNGGYTKVAYMLPELPLQFFFRAENWSLVELDGVYDQEIDWYGGGFNYYFRGQNLKLTVEYSAVEFDTESSNYEDFDSLTAQLQVVF

SEQ ID NO: 8022 - protein, 329 aa, Bacteroides stercoris ATCC 43183
MYHSRWKNSHREAGLTYGDRLYKNNIIINFKSYLTKEKINYVEQVFDIYNEYYPEIIEEIKGFAEGQHTDFKIVFAFLVTMYVFTYDNYCSMLALTNKNCLVFARNSDFLVDIKKVSDSTFYKLNSNFSFIGNTTAMIQMEDGINEKGLACGLTFVYPTVKNYGFNAGFLIRYILEKCETTEQAVDFLNKVPIGSSQNIIIIDRFRNLAVAELNSSHKTIRINEANVVYRTNHFIEQTMLKYKYLGDDDVFSHLRYKTLNSQNYTEFNLSGIFELLKGKNGFICQYDKTKKFDTIWSSVFDIKNKVIYRCEGNPKQKKFIIDKRLKFSF

SEQ ID NO: 8023 - protein, 86 aa, Bacteroides stercoris ATCC 43183
MLLLFQSLLRRGLLVAINFSPKVGEILECNFGNYPVSQNGPFSTTYYDGRIPPEMIKNRLVVVLNGKINGNACIVVPLSTTRDQTS

SEQ ID NO: 8024 - protein, 992 aa, Bacteroides stercoris ATCC 43183
MSSAKTLQISFVGMQTQDVAIRPNVRVILKSDAEQLDEVVVTAMGIKRDRKALGYAAQDLNSEQLNKAGTTSLASAIQGKLTGVDIRQSSGAPGASSQIVIRGARSFDGNNQPLYVIDGMPVNATADFDTGKSVTGANYADRSIDINPEDIESVNILKGQAASALYGIRASNGVIVITTKRGSKNNMNKPSVTISTNLSAQRVSRKFERQNIYSQGNSIAAGYDPSSSMTWGPKISELANDPKYGGNMNNQYTAADGMREGQYYNPKRAQAGLDGWTTPQIYDNVGDFLGTGFTENTNVNLSQSINGINYSFGVNNSHQNGIIPSTGMDRWGARGLVDWKINPQWNTGFSMNYSSTKITSAPGANDGIMNVVYSAPAEYDLKGIPNHEPGNPTNQILFRSTSFTNPYWWAEHNEYLQHTNRAFGNTYLEYQPDLGLGENFSLKIREQAGLDIWTSDYATVREMGSTSSLKGGDIENYGSQHNVFNNLFTVNFDGKFGKSDEWRLNVILGNEFNHESIRNWDYYGSNFNFPGFTNIGNATSLTSSEYKRQERTVGFFGSLSMSWQDQVYLTVTGRNDYVSTMPRGSRSFFYPSVSLGWEFTKLPFLQNNKILNYGKLRASFAQVGQAGNYYANYYYTPTYGGGMYSYYPVTYPLPSGVSTFTPYYRVYDEELKPQNTTNYEVGADLHFFGSRLKVEYTYSLQNVEDQIFYVPVDGATGYQEMLTNAGKMRTHAHELSINAAILQAKDFDLNLGINFTKVNNKVIELAPGVESIMLGGFVEPQIRAQAGCTYPNIYGLGFKRDEAGNLLLLNGLPQSSGNSQDLGNCSPDFTTGFTLGGRYKRLSLSTTWSWQQGGKMYHGTNMTLNYFGATKESLPYHEGSMVAEGIDEATGQPNTVEVYKADYYQAYYNITESGVYDTSFVKLRDLTLTYQLPKLGIFDISIYGFARNVLVWANLPNFDPESSQGNNNMSGYFERFSVPNTSSFGGGLTINF

SEQ ID NO: 8025 - protein, 1068 aa, Bacteroides stercoris ATCC 43183
MKRKLMFFMTFLFIGIGLATAQTSKVTGLVTSEEDGQPVVGASVLVNGTTLGTITDIDGKFTISNVPSSSKTLRVSYVGMLPQEVTIKEGILKIVLRSDAKALDEVVVTALGIKRSEKILGYAASTVKNDDLVAAKSGSVMSGLSGKIAGVNISSSGTAGSSQKVIVRGYSSFSSNQPLYVIDGVPMSNNTSLSNDQGNGVIAASDAIDFGNGANDINPDDVESVTVLKGASATALYGSRAANGVVMITTKRAKQEKLTVSYDGSFMASNVLRVPQEQDKFGQGWGTWNRGENGSWGPALDGRLNEWGSSKLTTPMKKHYSFVKDNLRNFYTTGFEMNNNISVRTGNEKMGLMLSYGNTSSNGVLPNNADKYERNTLSFRGNMKFGKFAADASITYIRKDMTKAAAGQGNAGATMQQELIQHPVDIDYSVMKDFNDERFNGDNYYTWYAQNPYWVLANNKNNYQDDRIYGKLELSYEVIPGLKAVGRLGGDFTNARQKLRTAKLTYADNSYSSIGGKSEEKGTYTERTDNYDQIDATLFLSANYNIGTDITLGGTAGWNLNQRKSSYLKSFLEGLFMEGWYNLQNGTDKPVSTNYSDLRRTIGAFAQVEFGYKNFWFVNLSGRNDWSSTLPIHHNSFFYGGINTSVILTDMFPSLKNNVIDFLKVRAAWGQTGNDADVYRTLAYYIPDHISSGYGYLDTPLNGALGLTEYNRQPNNNLKPEKTSEWELGLTANFLSNRIGIDFAYYDKLTKNQIIAADVAPETRYTSAVRNVGEISNKGIEIALNLTPIRTKEVEWDLGVTFSKNWSKVNKLWNEGDKPVTEYVLKTAYSANFVAKVGEPLGIFQVPALATVQDENSPYYGKVIVDANGIPTTSNSEMKTIGSSAPDFNMGFNTRVSYKGFTLSAVADWRKGGYMYSYTAQLMHFVGNTTRSLFNNREPFVVPNSVIALKDGGYAENNRPVTSDNMSSYYSDSYSDSQFENFIIPKGYVKLRELVLSYSFPKAWISKLGIQQLDLSLIGRNLFMWTPKANNYVDPETTTFGNDIASELGEFAALPSTRNIGGGIKVVF

SEQ ID NO: 8026 - protein, 350 aa, Bacteroides stercoris ATCC 43183
MRKAILASAVLAAMVSGSALAAEVYSKDGTTLNIGGRAEFRGDFIGDKGKEIEGSMANKSRFRLNVGGETQITDGLTGFGFYEAEQSVHSSGDNTATNTLKQRYMFAGIGTQFGDISFGRQDTAGVQISQMSDDGQIWTGGQKTFINAGNEQINNTIAYSNVFSDVLSIKASAIAAEEKNENGYGLSGIYATPFGLDIGLGYAMNDVSEDEFRGNNDNGSANQFIGGLSYSIASLTLGGTYTQGTYDFDNAADVDYNGVELSGTYKFDNGFRIMAAYAKAQYEGKGAGESKYDKDDFFELTGQYHFNKSLRTYLSYKIDNRSKGDSSDIANNKIAYDVENTLRLGLRYDF

SEQ ID NO: 8027 - protein, 1002 aa, Bacteroides stercoris ATCC 43183
MKTNTPAISLTPRTLRILGGIGILLLTASFTANAQTDENSEEGIFELDPVIVTGSSITRFEEESGLPVTTFEGEELLTEGFVSPGEIFTDMVFTGSPEFEEASDGPNDARGDVTSINLRGAGPGQTLILLNGRRLASHPLNQTVGQVPSTLVNANTIPAGLIKNIDVLRDGASAIYGTDASAGVVNTKLNEKLNGQSISFRYGAEEGSDFDENIISYTGGFNFNESRTKLSIFLSQYERDPIFATARDYAVNGDKRPLVPEKFRDDISIINVSSGGVYANLETDLRSSRDELSQNGTPITDGTGRFHINAPHQTGGTATLANGLEMEDGTIPREERYDFAPFRTLTSEAERTNAFVALNHEISDDITFFADYGFYTSDTYQQRAAVVIGTSDAIVIPAQNYWNPFGPVTFADGRENPNRLSGITQQNGDPLPDEGIDIQLDGWRSEDLGLRLVEVSSDSHLFTVGLKGVAKEKWFWETGIRYNINEATDVTHNRLSKSGLEAALADDTPSALNVFAGPGVNDPANFEDMLISISRTAETELTSYDLRANTPDLFSLFGNPAGFALGFEAREETYMDDRDPRIDGTIRFDDTTQGESDVVGVSPTGDSDSKRSVLGVYSELLLPLVGEANRAPLVHRLEVQIAGRWEDYDDFGDITKPKVGAVWYPTPDLFFRGSFAEGFTAPDLSVLTDPIQRFSTGNEDRYRLQWDEDNSENDGSSQIADLRGGNSGLGPEESTTKTAGVVWRAPFAKDLTFTADYYEIEVTDRIGTIGTNDLALADREILNQLSTNPADYSPGQVIIGDPRVERGPITQELIDFATSEGFAPAGPITRFVNPFVNEAGRLIKGYDFGMEYEIDAEALGRFRLSGNASYLDTFDDTEIVDGPTISEIKDEINPRLRGNVNLRWNKGAWSAGIKTNYISETIDNDVDATDDTEWLIEEYWRTSIRFGYRFDDGVLDGLRLTLGVRNLFDAEPSLNPDESIGYESSLHSNRKRMFYTNLKYVF

SEQ ID NO: 8028 - protein, 1180 aa, Bacteroides stercoris ATCC 43183
MKHKTTFEKLPQTNVGRSKNWKTLRAICLLLFLSVSFTAYSQITVNVKDISLRASLKKIEQVSNYKFFYNESLPELNQKVSLNVKDATIEQTMQQLLGKMELTYKKEQENVIVLIRKPQEKQRNIKVSGTVVDSNGEPIIGASVVVKGTSNGTITDLDGNFSINDVSETSQLTVSYIGYKPVQLRATDKNMAKVVLQEDSKMIEEVVVVGYTPMRKSDFTGSLASVKASELSLSAATAGQALVGKVAGVQVMQTSGAPGEGVKIKVRGTNSLSASTTPLYVIDGYPASEDVYINPEDIETIDVLKDAASAAIYGSRGASGVVLITTKRGNSGKARIDYDYQFSMQQVERKIKLLDAYQYRDLVIEARNNSYRDKAEAAGKSWNPLDDNAIRASKGFNLNEVGISDLFFDFTTGKPVDPTYNTDWQDAIYGNAPMHRHNLSVTGGQDFLKYRFSLGYLDQDGIIAPSGHKRLNVRANVDAEVTKRLKVGVNFSFVDVSERQVQADGRYINDGVVQSALLMFPQFPVYNSDGTYAVGNQIAMKADGYQMVENPVALAHEIDIRNKSSRMNFNANITYDILKQLQFKANLGTQYYTSRYNYYRPRTVGQDGDMPNSDAVQARVKARDITNRDIDRLGEFTLNYNGEFGKHRLNALVGYTLQKKTYDRVAVEATGFPDDRIHEVTAHGPNASDIGLYSSDTRKAAWTMMSYLARVNYSFDNRYVVTGTVRTDGSSRFGKENRWGWFPSISLGWTISNEKFYQDLLGNNSSLKLRASWGLSGNNNIGNYEHTATMSQGGYVYGNTVETAYWQGTFKDAAIGWEKTSQYNVGFDLGLFNGRVNLIGNYYNSLSYDLLYDQPISSISGSSSVKTNLKNAKVRNSGVDFQIDGRILTGDFKWNVSANISVNRNKVVDLGGINDLYLVSERNVVSHVTRSGLPIGSFYGYIADGIISEKDYTNIMIDKSNLVNGKFPDGYQLIGPAVPNYNNIHPGDVKWRDVDKNGLITENDREILGNAYPDFTYGISTDFSYKNFDLRATFTGSQGAEVINFQKYYLYNMEGSGNQLASVLNRWHSDENPGSGGVFRAARSSTPNTSQRLSSYMVDDASYFRCANITLGYNFPVKWMQKVSVQALRLYVSVDNLFTLTDYEGYNPEVDYKGNNLLPGFDWGVYPLARTYSIGAKITF

SEQ ID NO: 8029 - protein, 179 aa, Bacteroides stercoris ATCC 43183
MKKLLIVTMLSTLALSAQAQWYVQGDLGASKIDITHVNSSDSPSFTQRISVGYAFDKNFRLAVDYTNYGKVTANYADIVDVSLKGKSLGFTSFYDFDLADFKPYVGVRVSANKGEGDVTANARYYRIDFATETSIGIGALAGVQYKLTDNVALNTNIEYNRLASDVSDVGVKAGLRFSF

SEQ ID NO: 8030 - protein, 994 aa, Bacteroides stercoris ATCC 43183
MQRHQQKQHVFLIILVLLHTMVCFNLKFTYNFALLINMMLLMKKGILGCNIIYLFILICIGIALPIKSQNNYKVKLTGTVYEYDHNNKRLPLEFAAVSIPEIALGTTSDENGRYILENVPTGKIRMQIQYLGKVSIDTLINVNKDLVLNFTMRNEDFKLKEVTVTATNSRSGKSTSSHISRSAMDHMQATSLYDVMSLMPGGISQNQDMSSAQQINIRQVSSSSGPEAPMNAMGTAIIRDGAPISNNANLSAMSPTVLSGTETPASLAGGASPAGGTDVRSISTENIESIQIVRGIPSVEYGDLTSGAVIINTKAGREPLRVKAKANPNIYQVSMGTGFELGKKKGALNVSADYAYNTNNPISSYQHYQRATTKLLYSNTFFNNKLRTNSSFDFIYGKDQRERNPDDEQTKTASEGRDIGFTLNTNGTWNINKGWLKTLRYVLSGTYMDKDSYYETVYSSATSPYSMTTTNGAVLSNFAGQHIYDANGNQITNFGPEDINHYAVYLPSSYLGHYEIDSREVNLFAKVTSSLFKASGHVNNRILIGADFRSDGNVGKGKTYDPSTPPYRSQYGHNSSFRPRNYKDIPFINQFGAYVEDNFKWSISGTHDLNIQAGVRYDHTSVVGGIFSPRVNASIDLIPNLLSLQGGYGIAAKMPSLLYLYPENAYFEYININELTNENIPESQRLFMTTTEVRQVDNSDLKIAQNHKAEVGFNLRVGKTNLNVIAYKERLKDGYVMSQTFNTFNTFIYNEYQRTENGIELSSSLPVLSTYAKPTNNLNIETKGLEFDLNIGRIDAIRTAFQINGSWMRTKSWRQGYSFYDNSEDAASARKPVAIYSQEGNASYKQQFVTTLRATHNIPRIGFVVTMTAQAIWQQSNWNTFGNDSIPVGYLALEDASVNMFPKGKYTTTQQVKDAGYGYMLNNVSHNNAIKESYSPYFCFNLNVTKEISNMLRVSFFANNMFRSYPRRESKRNPGSYIQLNNRFFFGLELSLTL

SEQ ID NO: 8031 - protein, 350 aa, Bacteroides stercoris ATCC 43183
MARRTIQRLGTALALGTALAAQAQSSVTLYGRVVAGVDYQSNVYDPATGGSGNLWRAVGNQWGTSMLGFKGEEDLGGGLHALFTLESGFSIDDAKFNGAGFFNRRTFVGLRSGWGTLKLGKDLSISDAHWALDPTGQQFIGSATLVRGRNWGGHDNMISYETPSWGGLGVLALTGLGEQPQGASRLRKDALSVSYTAPTFELRAIYDVARDANGRFSDLYTTSRNLTLGGTVTLSAFKLFAGYEQLSAPDSAAGVPNKARQYWMGARYKVSGPLTLIGAGYRTTVNNGGGSANLFMAGADYALSKRTLLYASVGNVRNGGNANFSVETTNNNPAPGGSQTGFYVGMAHSF

SEQ ID NO: 8032 - protein, 976 aa, Bacteroides stercoris ATCC 43183
MRKHICGLAVGLLLCAVTGTAQEIGGATINGSVTDPSGALIAGARVTATQTATGAQRTTQTSSAGLYTLSALPAGAYDVTIEGTGFKQAKFAAVPVSVGAVVTLDAHLEVGATQEIVDVTADAPVVETSRSQTSTVVDQKAIANLPINGRNFLDFAVLTPGVVRDPSRGGDLSFGGQRGTSNSLTVDGSDANNVFFGQSAGRAGTGRSPYSFSQDSVQEFQVSANGYAAEVGRAGGGVINVITKSGTNDWHGTAFEFFRDKSMNANSWENNRARLPKRNYHFNQFGGNLGGPIVKNKAFFFFDYDGQRNNEPITVIPGAAAPADDLSQQAFQSLQKYFAAYPRSLNNNVYLAKVDLVLSSAQRLSVRYNANRFTGVNYENSGSTSAAGHTGNSSVTTDSVSANHTLVLSSASVLDSRVTYSRDNEPGAANSTDPEAVIRQGGATVINIGRNNFSPRYTNARTIQWAESLSVLRGRHTFKAGLDMNFQHIDNFFPGNFSGSYTFNSYADFASNKPFSFTQAFAGAGTDGPLSTPNVNEYAFYVQDSWRVSEQLTLNYGLRYDLFDLANPQVTNPDPGLAAANLNTSLIPIDKNNIGGRLGFAYRLTKSGDTVVRGGVGNYYARTPSIMTGTAFTQNGIQVQTYTLTANLPSYPNVLSAPPPLNRTPDIYVFAKDYVQPLTWQWSLNLEHQLGRDYAVTLGYLGVRGEHLSRTRDINFLPAVPQQGTFADGTPVVYLRHPGRANPAFGRISLFDSGADSIYHGGFVQLSKRFSHNFQVQTSYTFSKVIDSRPDFTSVVVGTDDSKNAQDTLAPNQERGRGNADISHRFIFSGVWDINYGKSLQNAIARNLLRGYQLSLIGTLQSGRPLTATVGGDPNGDTNTATDRPPFVGRNTYTGPNFDNVDIRFTRDIPLYRDRAALRLMFEAFNLTNRANFNSITTAQYNFNAATRVFTPNATFLFPTTTYDPRILQLAAKVTF

SEQ ID NO: 8033 - protein, 283 aa, Bacteroides stercoris ATCC 43183
MLKTVLARSAAAFVSTAAVAADLPQREQTPVFAQIPAFTWSGFYAGIAAGYAFSGRQTVRTTDFTPIGQAVLAASGFGAVRSEQEGATVAGGFGYNYQFTPGTGFVAGIETDIQYTDLDSSRATSASVGGTTFFLSGRQSLNFLGTVRGRLGYAFNRVLVYGTGGFAYGNVNYEINANVTSALGTIPFDAGRFNNVETGYVYGGGVEYAMPTESFLNFFSANAVIIKAEYLHYDLGSRSVFNSGVGPVFGPGGSLAVGLTSVSRFRTEGNIVRAGVNYKFGTY

SEQ ID NO: 8034 - protein, 1010 aa, Bacteroides stercoris ATCC 43183
MKRFTPNLITAALLASGTAFIACSAVAQQSVDEPITAGTVSENDEQKQGQELERIEVRGFATSLIQSLNQKRFSDTVSEQISADDLGGLPDVSMADALTRLPGISAVRTGGQAAEINIRGMSGDFVFSTLNGREQVSTSGSRSIEFDQYPSELISSAAVYKSPKASLIEGGVAGSVELQTASPLSNDQQHTFNVNARGMFNDRAGEVSDAEEFGHRLSLSYQGKYLDDTLGVALGYARLFQPSVSTQFVGLAYNATKDVDNDGDEEFLGEGFELQHKGGEETRDGYMGAIEWTPVDTFTLKADAFFSKFDSEEFARGFRVKLGGASAAVANPVLNGNAVIGGTFNRTSQSFTRVELVNDDNQDYDQVSSYGINADWQATDNLTLAFDVSQSVAKSDFRNGLLWALVGEDANAELPVFDNDISISYLLHGLDLPDVGFSQAEAFTDLDRVMVTKYGIYPYENEDELNAYRFDLTYEIDDNAFFSSVEFGARYSDREYSNDRSVFEYGSDSSFSASQPPLRLTDDMVDVVDWEGDFGYLPSYLSIDLNSALNAWFPSGIPQPVKTWGAGSPGVINGPGEGPNTSWTMLESGKVFEKVTAAYIMANIDTELFGLPVTGNVGVRMVETEQSSTVLQDVSEDIIDPDTGEVIDTRGNPANGAQFITDDAGLVNDFYRPALLTDKYRDYLPSINLNVKLTDSEQLRFAAAKVLGRAPINRLFANATLRVEDVQAFRDQDTGEIVLSKPTAVISGSATNSPYLRPFYADQYDISYEKYFEDTDGAFIAALFYKDIKSFINTFKEDPFDFTGNGFTIPADITVLVTDEEGEPLFNDDGSRLSVQVPTENGGYETAVNNDKGGYIRGAELSYTQIYSFLPDMWSGLGMSASYSYTESEIQTQTTLGGASVEQTLPGLSENVVAATVFWEYEDFETRLSVRWRDAFVSKQVAVNEQVVNFDSETVIDYQASYNINENLGMLFQVNNLTDEPTKSYFGSEAQTGTIQYFGRQIFLGVTYSL

SEQ ID NO: 8035 - protein, 480 aa, Bacteroides stercoris ATCC 43183
MRIVPPMRRSSGLRGWRAGLPLPTSPVRRSAQPGSWTSATLCTRRPVPDGRTICDVTPFCPHAAAHRVVRPAGHTYNSSNIRRAFGLPGPRLRRSVMKHPVIFAAALAAFAAPAFAETSVTLYGVIDEGFNYTNNVNVNGVGKTNYQLASGYAQGSRWGLKGSEDLGGGLKAVFTLENGFDVNNGRLGQGGRMFGRQAFVGLSESRFGTLTFGRQYDAVVDYLAPLTANGNWGGTLFSHPFDNDNTDNSFRVNNTVKYASADWNGLTFGGTYSFSNSTGFSNNRQYSIGAQYSLAGLQVAAAYLQANNPGIGSAGAIAADDANFVADRLRIFGGGVNYTFGPATVGVVYTKTDVKNPVSTVYLPASTFAGLGLTATKFQNFEINGKYQLTPDFYLGAQYVYTDGKYDAAAGSFKPKYHTVGLMADYSLSKRTDVYLQGAWQKVGGDKTGTAADGGYVVGTDGPSASSNQFSVRAAIRHKF

SEQ ID NO: 8036 - protein, 377 aa, Bacteroides stercoris ATCC 43183
MRKIHLALASGTAVALATQAFGGGVERSTQSVGILFEEGTYAELSFGQVDPDASGDFVLDRSVSTGDMLASENIFTLSFKTDLSDRLVAALVLDQPVGARIRYPEGTGHPFAGSKADLDARALTAMLRYKFDGGFSVYGGLRAQQVEGFVALPTIPGYELTTNNDREFGYMVGAAYERPEIGLRVALTYNSAIDHNFESSESFLTPGGPAVLDDGFKTTIPQSVHLEAQTGIAANTLLFGSIRWVDWSEFEIDPPVYAAGIASLGQDYALAAYESDTITYRIGVGRRFNENWAGAITYIHEPDSGDIFGNLGPIDGRDAISLGVTYSRDNIKITGGVEYGWLGDALSQAPNGPPGTPVSDFRDNTSVSYGFRIGYYF

SEQ ID NO: 8037 - protein, 1040 aa, Bacteroides stercoris ATCC 43183
MKQIIFRGFLFASIFLLYGMANAQQTVSGTVIDESGPLPGVTVAIKGTSTGTSTDFDGNYTLNNVPDDATLLFSFIGFVTQEVAVDGRSTIDINLTTDASELEEVVLIGYGQTTIKDATGSVSSVTSENFNKGVISSPEQLIQGKSAGVQISQGSGEPGSGVAIRIRGTSSVRSNNNPLFVVDGVPLPSGDTSSEGTNIGVGSSAAKNPLSFLNPNDIESISILKDASATAIYGSRGANGVVIITTKSGRSGGREGIFEFSTEVSFSSPAEEYDLLNRNQFLNAVDAFGGIALDEGNDTNWQDLVTRNAVSYNSNLAYSRNYGSGNLRATFNYGNQDGIIEKSSQERITGRFNLNQRLFDDKLRLTLQSTLSRVNDEAPPLSGSAGSTGDVLGAAYSANPTWPADPDFNPGDRINPLNLLENWQSLTETDRFLINFSADYDLFEGLNAKVTFGYDLAESTREASLSANSFNVARGAGGNGRGALNDITNENRLFEVTLNYEKEFDNSRFEALAGYSYQDFNTRGKNVEGWGYGNTGLDQMANDLSSSVGTLESMITGSYQQYGYSFDVSGNDNGLFVNRLFPGVQTDFLGETSIPVRAVFADTFDNTDELQSFFTRLNYTIADKYLFTATLRADGSSRFGSDNQYGYFPSAAFAWKINEEDFSGDLFSTLKLRLSYGITGNQDGLGYGRFVRRERYSGSGVNDGGSINIPGISTVDFANPGLKWEETSQLTVGLDYGFFGDRLNGSIDFYRKETTDLLLNIEAAQPSPQPFFFENLDAVVLNQGIEFDINYGIIEREDLNWDAGFNIAYNKNEIQDFEGSIAAGTIRGAGLTNAFAQRLEEGQPLYSFYLREFTGFDENGNPVHEGGTDNQKFVGKSALPDITAGLSTSLVYKNWDASLYFNGQFGNYIYNNTANAYFTAGAIGSGNNVIQDVVSLAGVESRFAEASVSTRFLEKGDFIRLQTASIGYTVPLGENSFLKSLRFTVVGQNLFVITDYTGLDPEVSVIPGASDLLNGLPIAGIDYSSFPRPRTYSLGLNITF

SEQ ID NO: 8038 - protein, 423 aa, Bacteroides stercoris ATCC 43183
MKKVLSVIVLLLVCAVTYAGGYRVSLQGQRGLAMGHTGVAYVNSAEIAFFNPGGLVHLESKLSISVGGFGVFSDVKYQNTEFGTSSQTDSPTGTPLYLYAAYKLSEKSSVALAVYTPYGSTVEYPTDWSGSHLVNSIELSAIFIQPIFSTKLTENVSFGGGPILAIGGVNFNRNLTRSLTDENGNRSNVEVDASGVKGYGFSVGGYAKFSDKWSFGVNYRSRIDIEVEQGEGTATFSNVPNSPLAPTVNGDFDFTATLPLPAEWTVGVTYKPTDKWVLNADVNYAEWDIYNSLDLNFLNPDGSVALESINPRNYQNAWTLRLGAEYAVSDKFALRGGAYFDESPVQEGFFSPETPRNDSFGFTGGFSYNVTQKLAIDASFLYLAFREVDASYDAYTESGVEAPFAGTYRSSAFAPGLGLSYKL

SEQ ID NO: 8039 - protein, 1000 aa, Bacteroides stercoris ATCC 43183
MKQVNLRICQTILTLILGLFLSVGAYAQNITVKGHVKDALGGVIGANVVEKGNSTNGIITDLDGNFTLTVPQGATLVVSFIGYKTQEVAAAPSVIITLQDDAELLGEVVVIGYGTAKKNDLTGSVTAISADKMVKGAVTSATDMLVGKAAGVSVITDGGAPGAGATIRVRGGSSMSASNNPLIVIDGVPVDDGGINGMSNPLATVHPNDIETFTILKDASATAIYGSRASNGVIIINTKKGKSGRVQVGYSGTFSINTRPNKVDVMSANEFREFVTSKFGESSAQFKALGQANTDWQDEIFKTSFSTDHNVNVSGAIPHMPYRVSVSYTNENGILKTSNMERLTGAISLNPNFFDKKLNIQLNVKGIYNTNRFADTGAIGMATQYDPTQPIYMDGNPYGNGYFMYMKSGNNPTPVDIGLANPVSILDSKHDESTVYRSIGNAQIDYKFHFLPELRANLNLGYDVSKSEGDVIIEDNAPMTWCQGNYKTGFGENSSYYQLKRNTLLDFYLNYAKEFGAHHVDVMGGYSWQHFYNSTWTKYPYSTVKAEETGKEFYKDMEDYSTENYLVSFFGRLNYTLLNRYLVTFTLRNDGSSRFNKDNRWGLFPSVALAWKMKEENFLKGVDWLSDLKLRLGYGITGQQNLNNGDYPYMARYMYSKAGANYYFGNNKYSLIAPQAYDENLKWEETTTYNIGLDFGVLNNKLTGTLDLYYRKTDDLLNTVTAPAGTNFSNQLLTNVGTLENKGIELTLTAHPITTKDWDWTLSYNISYNKNEITKLTFNDDPAYKGVIHTGIDGATGYNIMINAVDHPYNSFYVWEQLYDKAGNPIEGAYVDQNGDNKIDEEDLVAYKKSAPDVFMGLTSQLSYKNWDLSFALRASIGNYAYNNVQSNREAWDGSQMYDQTGFLKNRLTSAWKTNFKTGQYRSSYYVQNASFVRMDNISLGYTFNKLFNDKQSARVYVTVQNPFVITKYDGLDPEISGSGVDNNIYPRPRVFMLGLNLNF

SEQ ID NO: 8040 - protein, 453 aa, Bacteroides stercoris ATCC 43183
MKRILLGVLLASTAMSAQAADLAPRPYTKAPPMAPVYDWTGLYLGVNAGLGVGRNRAVHDFGPLAISTHLQPLGAVGGGQIGYNWQTNSFFGPIVFGVEADLQGADMTDNRTNFIGALQYNQRLNWFGTARGRVGLVNGPMMTYLTGGWAYGNVGTTVIQGGVPSAFGGGRSGWTWGSGVEAALGGNWTGKIEYLYLDLGNRTDFIGGQALHSELRENIFRAGLNYRIGGHSPYVPMVTANWNGLYLGGNFGGGVGRNRTTISNPAGNLAQFNLAPNGFVGGGQIGYNWQAGNIVFGLETDFQGSTLEDNKACFFCVPGASVDFNSKLQWFGTVRGRLGYAVGNSMFYATGGFAYGNVQTALNTPLNNFSFSNTRTGYAVGGGIETPLPLVNLFGGPLFGPNWTSTTEYLYVDLGRSSFNIGGGPNVLTTGAQEHIFRTGLNYHFNMPTVAHY

SEQ ID NO: 8041 - protein, 1019 aa, Bacteroides stercoris ATCC 43183
MRQRDLKFTFVVGEGKLAFDVVEFELEEALCEPFRLNLKLASDKNAIDFKQVLDQPGTFTLWQDGRPARYVHGIVSHFTQGSSGFRRTRYELLLEPQLARLELCCNWRIFQEKSVPEILQALLKEHRVLDYEQRIYHEHLPREYCVQAGDSDHYLHDRLAFEEGLVYYFRFDEHRHTLVCSDRLYVQERIAGGPVLFSAQPEGDNPQPVLHSFRYSENVRTARQTQRDYSFKRPTYDQEHHLAGEALEHQGSSYERYDYPGRYKRSGAGRPFTESRLRGHRRDARVASVSGDDPRLIPGHAFALEGHPRADFNAWWRPVRVVHRGTQYAGQEEESADAPLGVSYDLRAELVPEDVEWRPAPLPRPRIDGPQIATVVGPAGEEIHCDEWGRVKVQFPWDREGRHDEFSTCWIRVAQNWAGADWGHMAIPRIGQEVIVDYLDGDCDQPIVTGRTYRATNRPPYALPDHKILSTIKSKEYKGSRANELRIDDTTAQISAALMSDHGASALHLGYLTHPRPEGGKPRGEGFELRTDEHGAVRAAKGLLLSTEEQLRAGAGHLDRGVVVQVLEAALELARELGDYAGEHQGVGHDAAPQQTLQEAVRDLGHGANDESGKSNGGKPAIALSGPAGIAAATPASLTLAAGEHVDSVARQNQQVTAGQKVVINAGSDIGLFAQGGELRQITHQGPMLLQAQKNDIRLEAKQSVEVSASQQHVLVTAKEHITLMCGGAYLTLKGGNIELGMPGNFVVKAAKHSHVGAASLEAELPQFEVGETQRRFVLKQLDGQTAMPNVPYTITMANGEVIEGVTDAEGATQLLQKDAMNIAKVDMKHTKSPASAVAGIAAAVGAAVAVGKLLGGPDAEAGRALSEGEISLAKGVFGDSIDYSTVRLRDEDYVPWQGKDYVMAPNGHIYFGEELRGVADWSLESLQRQGLFIHEMTHVWQHQHGVNVLLVGAYQQARQFLLGDQYAYRLEPGKTLKDYNIEQQGDIVRDYFLEKNEFGEASANSRFAGVLKNFPTGY

SEQ ID NO: 8042 - protein, 247 aa, Bacteroides stercoris ATCC 43183
MNNLLKVCLCIPVIYSVSGWAGTTWVDVRGAHNIRADTNETRIKFMHQATNGFYFSAEATQSHNESFFGDEDSRDGKEDGVTGVSQEIETRWQFPLGNGYSIAPGLTTVFTKTNTHYRPFIQGWKAFDNGINLAARYRYNTVNDAHSDRKLDSDEYTRRKSHQFDIWIAYNIGRFGMSWNPRFRYQDGVDQGTGRDTYWEHTLAFSYKMDDDWTPYIELGSLDKTYVDDHGTHKNEFVGRLGITKKL

SEQ ID NO: 8043 - protein, 250 aa, Bacteroides stercoris ATCC 43183
MSVPTGKTLSVSNGKVTGFSGDFTVQSRYPDGGSSYMSSAVYTDYRQDITPKSTLNSGIRLTNTVLKAKWIDQTFITLPQTEITLKNSAITATLGYAYRPTENWQLNSVLSSGFRSPNIDDVGKVREKNGKVTLPNIALKPEFAYNAEVGVLKFFNKKRFSLGFNTYYTLLDNYITREADGTQVQYDGETGNVVKNVNKGQAYITGYTISYQGRINENWKTLGFLTYTKGEAYDTEERLSSIPPLFGRFE

SEQ ID NO: 8044 - protein, 244 aa, Bacteroides stercoris ATCC 43183
MKVKTSLSTLILILFLTGCKVDLYTGISQKEGNEMLALLRQEGLSADKEPDKDGKIKLLVEESDVAQAIDILKRKGYPHESFSTLQDVFPKDGLISSPIEELARLNYAKAQEISRTLSEIDGVLVARVHVVLPEEQNNKGKKGVAASASVFIKHAADIQFDTYIPQIKQLVNNSIEGLAYDRISVILVPSVDVRQSSHLPRNTSILSIQVSEESKGRLIGLLSLLILLLPVTNLAQYFWLQRKK

SEQ ID NO: 8045 - protein, 1136 aa, Bacteroides stercoris ATCC 43183
MRKISLLLSCAVAMLLCVGVCNAQVLYGSLTGNVTDPSSAAIPAAKVQAVNNETGVTRQAETDARGSYLFSNLPFGSYKVTVDAKGFKTSIVDKVQVNVNEVRRVDIAAQIAQATESVEVAANSAVLQTDKSDVHSEISAQQVVELPYNGGEGKNFQSLLYLVPGAGIPATREANSEAGNPQRAQTIFMNGVSSTGNSTKLDGATVSYPWLPVNIAYVPPSEAIETVSITTNSFDAEQGAAGGAAVNVAIKSGTNSLHGVLFERNQNNDMTAVNYFSHTSPLNKNVFNQYGFAVGGPVWIPKLFNGKNKLFFFADYQGTKRRQYAATTNKTLPTSAMRSGDFSATGVTIYDPLTGNADGTGRTPFANNTIPTGRIDPASVTLTSLLPALTRPSALTSNYDAYGNTQYNRSNWDFKVNYNPTEKTMVWGRYSISPMDIVALLDLGPAGGDAFGGGNPGHAGGRVQTTAAGFTYAVSPTMVVDGNVGYTRQNIGANGDPQDGLYGLDVLKIPGTNGVGPNYFGIPGFQVTGVANIGNTSTGSPFQFRDNQYTTGINLSKTKGAHNLRFGFEYDKYALNHFQPQGGTFGTARGTFGFDGTLTALKGGAAVNFNGVPANSWAEFLLGFPSRIGKITQFQNPNALRFSDWAFYARDQWQVSRNLTVNYGMRWEYYPIFSHDHYGATRYDPSTYTVLIGGQGGVPWDTGASASKKGFAPRVGLAYRLGSKTVIRSGYGITIDPDNMRNQRNAFPSVVNQDFTPANSYMFVTTPGVAQASLRTGIPAATAPDLSTGKFTPSTVASTTTYLPSTNIAASFPKFMNRGYIQSWNFFIQREFAPTLTAEAGYVGTHAVHQMMGVNINGSAPNTGNAGRQLAPYLTTDLNVYEPFGNLTYHGLQSTVKKRFGSSIVGVAYTFSKAINNYNGDNGDGTIFRAYPVSYTLNKQLAGFDRTHTFQLYHVYQLPFGKGQKFLNHGVIGYIVGGFQIGGTLSRFSGLPFTLGSSSSVNAGGQGQTASQINPVVQILGGHDPNTPYFDGTAFTNPPAGTLGSTGRNLLRGPGFFNVDENVSRIFSFKDGKVKLQLVGEAFNLTNTPSFSTPNATFAAPTLNSDGTVKSYGNYSVISGTVSTARQLQVGAYVRF

SEQ ID NO: 8046 - protein, 1254 aa, Bacteroides stercoris ATCC 43183
MNMRIISLRKEYLSLLPSMIASLFSANGAAAVIDSCQGYDIKANCQASRQSLSGNMQDWSIADGQWLIFSGMANNASGGAVFLQHSAEFTISPQNETGMTLFADNSVSGEYNNGGAIFAKENSTINLANVIFDSNVAGGYGGAIYSAGTNDTGAADLRVTNAVFHNNIANDGKGGAIYTINNDVYLSDDAFNNNQAYTSTSYSDGDGGAIDVTDNSTDNTHLSGKTIINNTSFTNNYAEGYGGAIYTSSTTSPYLIDISVDDNYDQNNGVMIDENNSASGYDHSATAAAGGFMYIGHSVAEFNIAADKTLVIGNTSNDGAIDSLAGTGVIVKEGAGELVLNADNNAFTGEMSIQNGEVTLGRSDELMNVGDTHCQSDPQDCFGLMVGSTVHSEYQAELNVGNTQQTFVHSLTGFANGILNIDAGGNVTVNQGGFSGSIQGEGQLTVAQDGSYLLTGAQSMALTGDIVVEDNAVLSLAGNQADLRAMQSDPQSIVLNGGVLDLSDFTTWDGDSSYNDGLQISGSGGTVIGSNDVVDISSGDDLHIGGSDASQNGVYVVINAGDQRVTLANNNGYLGNTQIASGTLEVSDNSQLGDTSYNRSVIFTDPQQHSEMDVTTDVDTRSATTGQGRNIEMRADGEIHVEDGVDTQWGGLMADSTGQQLDSVSTLTKSGGGTLELTASGTATSAVRVEDGTLKGEAENIIPYVSSLWVGEDGVFETGQNQDIRSIDATSGGDIDITDGTVLRLTQQDTNQALDASLFSGDGTLVNATDGVTLAGELNTNLETDSLTYLSDVTVNGNLTNTSGAISLQNGVAGDTLTVNGDYTGGGTLLLDSELNGDDSASDQLVLNGNTAGNTAVVINPITGIGEPTSTGIKVVDFAADPAQFQNNAQFSLTGSGYVNMGAYDYTLVEDNNDWYLRSQEVNPTPPPDPDPTPDPDPTPDPDPTPDPEPTPAYQPVLNAKVGGYFNNLRAANQAFVMERRDHAGGDGQTLNLRVIGGRYHYTAVGQLAQHEDTSTVQLSGNLFSGHWGDDGEWMLGIVGGYSDNQGDSRSNMTGTRADNQNHGYAVGLTSSWYQHGNQKQGAWLDSWLQYAWFNNDVSEQDDGVDHYHSSGIIASLEAGYQWLPGRGVVIEPQAQVIYQGVQQDDFTAANHARVSQSQGDDIQTRLGLHSEWRTAVSVTPTLDLNYYHDPHATEIEEDGSTISDDAAKQRGEIKVGITGNISQRVSLRGSVAWQKGSDDFAQTAGFLSMTVKW

SEQ ID NO: 8047 - protein, 354 aa, Bacteroides stercoris ATCC 43183
MKSIHTPALGVALACLASLPGAAFAQSKVELFGVVDVGVAHLGGSGASKTGLSTGGANISRLGFRGTEDLGGGLKAGFWLEAGLDVDSGAGKATGGGLNFNRRSTVSLMGNWGEVRLGRDDSATFLNTLIFDPFLTNGVGGTGAFTMLGVPGVPSTGGAPIQISNAVSYFLPQNLGGFYGQVQLAFGEQPSGAPNKREGDYRGLRLGYRQGAFNGALATGRLYGNTSDTNLTANNVGLSYDFGVAKPMLLWASEKRGGTKITAVQLGVTAPLGNGEARASFGHYNLSGSNADWNKISVGYGYNLSKRTQVYGTYAFLKNKGSAAKSIGVQGLSAPGTTPGGNASGLELGIRHFF

SEQ ID NO: 8048 - protein, 790 aa, Bacteroides stercoris ATCC 43183
MRPIVRPSQDPTASLVPRRNAGPISHAVAMLLLGLTSLSAHSQTGSSPGTPTDGSVETREVKPPAEPTARPPATAPALERVEIIGTASDTDVRRESSAAKIVIGREELDRMGDSSVSEVLKRLPGVTLGGRPGRGGAVRMRGLGSGYTQILINGERMSAGLSLDDLTPEQLERIEVLRAPTAETGAQAIAGTINIVLREEVRKRLNNVHLILTHDDRHWQPSATLNRANQDGAFSYNLNGQISHGDRESESLRRTLETSTPDAGGAETTTLDQTDTSFSRDRRNSVHLGGRLQWRLSPTDTLALTPFAIVSNNQGHASSLRTQAVPGSAPDFDRSSGASTSQYRLARLNGQWQGRFEGGARLELRAGSSAWMFDSDSERREFSAGSQNRLQQDRSEIREQWWSTGGKYTRNLAGEHQLATGWEADWGRRDDTRVSLQTLPGTATTSLLADFGDNLRAHTVRTAVWAQDEWDLSGQWALHGGLRWEGIGTRSDAPDAPVRNHSQVLSPLLHAIYRIEEGGRDQIRASLTRSYRAPTLQNLAARPSINSTFPATGANQPTSPDRAGNPDLKPELATGLDVAYEHYLGGGGVLSAGVFHRRINQLIRNQTALETVSWSSVPRHVSRPQNIGRASTSGIELEAKLRLDEWRDGAAPVDLRGNLALFQSRVDGIVGPDNRLDQQPGWTANLGADYRLRSWPLTLGGNLALTPGYAVQQSNAQRFEQDAKRVLDAYLLWRMSPATQLRFTASNLVARDFHNISTVVGSDGSNTLRQTALSTDPSLTVWGLRLEMKL

SEQ ID NO: 8049 - protein, 221 aa, Bacteroides stercoris ATCC 43183
MKQITRMATLGVLLLAGATGTAFANGTSAPEPEPIRYMPPPPPPPAPAPAPAPVVDTCEPGAYISISAGLGIPENAETQYSGEDEMDNGIALNGALGYDFGDARLEAAVGYQKHDFKYGDDDLSLLTVMANAYYDIDTGSDITPYLMAGAGWAHIGMPSDESDDVFAWQVGAGLGFKIADCTTLDLGYRYLRPNKFETNERNIGDVKWAVHNIMLGLRFNF

SEQ ID NO: 8050 - protein, 706 aa, Bacteroides stercoris ATCC 43183
MKGKILLSSMVALNLLPIAQILASETKNLETVEITSEERRDDLNYNAKELVKSTTRLNLTSRETPQSLTVITEAKLKDLNINDYQVLLRNVPGVTLNKWDERVYPTARGFAIDYYLLDSMPSFGGFSLGANDMSLLPYERIEVVKGANGLLAGAGNPAASLNFIRKRTNSKELKGSFKLSAGSYDRYGVSGDVQTPVNSDGTVRARLSFMHEDARSYMDYYDRKNSAIYGVVDADIGESSWLSLGSFYKNLKRHGVRWGGMPAFYTNGSRTSFGKNEIFSQPWTRWDIKTLDFYADFRHYFANEASLNLSYSYRKAKTDSNLLYYGGTVNANGTGNIADLSVYANKREENIHNVDAYANLPYEAFSLQHEFVFGAMYNNYKKSADDVSSYWNSRNTPAGQAFANRTTINFNNLHIEDPRLPYVNQNNADKTIQKAVYFANKLSLSEPLKFLVGARMSYYKYRITGGDGNRNFTQELTPYFGITYDINDNHTLYASYTSIFKPQDVKDINGKYLDPIEGKDYEAGIKGEYFDGALQASFGVFKIIQDKLGANTGVKIPGTNTDAYEAKKGVTSKGFEFDLNGEVNQNLILSFGLTHFNAKDADGKKYNTDASRTTADIFAKYTISNFRTGVGVQYKSKIYTGSGAKEIEQKAYALANVMFGYKIGKNFDIQLNIDNVFDKQYYEGIGSDEMIYGDPRIFNLSFTYSF

SEQ ID NO: 8051 - protein, 384 aa, Bacteroides stercoris ATCC 43183
MKLKLLASVAVAGLFAAGAASAEPNGWYGAIDAGYHMIDDINAESSTTGANWNYEVNDGWAAFARLGYRFNPNWRVELEGGYRSGDIGTVRAVSGTQGLCNLTPATGGCFSPEGDIESTTLMANVIYDFGYEAWGIRPFVGLGAGVNHVNTDTVGNLRANRGASFGADDSSTEFAAQAIAGLAWAVGDRTNIDLTYRYLTGDASFASTTVGTGVGATSFGEWDGDYDQSHTVTLGLRYSFGAEDAPPPPPPPPPPPPPPPPPPPPPAPVAQAPVARQFVVYFDWDRSDLTTEARSVVSQAATYAKSGRPTRVLIVGYTDTSGSAAYNLGLSNRRSRTVADALVAQGVNGGVIALDAKGETALAKPTADGVREPLNRRATIDINF

SEQ ID NO: 8052 - protein, 977 aa, Bacteroides stercoris ATCC 43183
MRKSILLFVLLTLFGIPYLLAQGGFRITGQILSAEDNLPVIGVSVVEKGTTNGVITDIDGNYSITVSKSPATLQFSYVGMKTVEKLFTAATRYNVIMQPNTEMVDEVVVVAYGVRKKGTIAGSVSTVKAEKMENVPAAGFDQALQGQTPGLSVISNSGEPSKAAVFQIRGTNSINSGTSPLFILDGVPIASSDFNTISPGDIESISVLKDASSTSIYGARAANGVVVITTKRGLSMDKAKVTLRAQYGFSQLASDGKWTMMNTPERIQFEKEIGLDTGQDYDLLSRTNVNWLKEIFNDRAPLQNYEISVNRATDRLNYYVSGGFYDQDGIAQNSSFRRYNMRANAEVKASNWLKIGTSTMSAYEEVQQAEEGEMAIYTPIAGSRFMLPYWSPYNADGSIASENNGTWTGTGQNPIEWMANNPVSYKKYKVLSTVFADITPIQNLTVRIQFGADYSHATTFMQSFPSYVINNEQGTAGRNSSDVLKLSETATANYRWALNDDHSFNFMLGQEAMDYQSSGFQVVTKGQSSDFLTNISSGTRASSWDDTTSAYSYLSFFLRGEYNYKDLYYGEMALRTDASSRFGKDHRWGMFWSLGFMWNIKNESFLKDTEWLTSAQIALSTGTSGNSEIPYYDHLALVSGGPKYNDEAGIYPKQSGNEELSWEQTWSNNIGLRLGFFNRVNLDIDFYHKKTTDMLMSVPESYAITGEGYRWDNIGAMVNRGVEVSVNGDIIRTKDFTWNLNANVSYNKNKLVELYNGVQEYVNSTTGLKFVVGHPVHEYFLNRYAGVNPANGDALWYTKDGELTTEFNESDKVMTGKTFDSPWAGGFGTTFAWKGLSLSAQFSWMADRWVMNNDRFFEESNGLYSTYNQSRRLLYDRWKKPGDITDIPRYGVTAQLDDRFLENSSFLRLKNLTLAYALPQPLLKKTNFFTSARVYLQGQNLLTFTGFTGLDPEMSSNIYRAQYPASRQFTQGIEVSF

SEQ ID NO: 8053 - protein, 634 aa, Bacteroides stercoris ATCC 43183
MRKKNLIWLFSLPFSLSTLCAAEVPKHYVMDETVVTATLTETSLKSIPAAVEVIDREEVQESGAMTLHQVLTEAQSVNLEAVSGRQSTARLRGLNSSNTLVLIDGMRLPSGFQDKVDLAEIPAGWIEKIEIVRGPSSALYGSDAIGGVINIITRKPTGEPEAWLNTRYGSNTEGEAEATSFDAGISATSGDFGYAVSGSFSDKGRVDEDLTDGFTDADDKKVKAGAATLTWQLGKDAELVAGVTYADVEREGLRFKNKKEQEWMNGSERSTGRVEFRSALGEDSSILLRAYRSVYDWGVTLTPISTGNPEAHAVDQTTDQFEARWAGRVFGSHKVTTGIEYRTEDREEDGLRSEIENLGVFLQDEVSITGRLSAILGLRFDDHSSFGSVYSPRVSARYQLNDELRLRGTYAEGFRAPSAFELYTGSDYTKRRILRPNPDLDPETSRTWEVGADFENDLFLLSVTAFRNDVDNMISEVFSGQFEGTIPIHESCNIAEAMTQGVEVTARVSLGSGFSIHDELTVLDGENKTSGKALAYVPDVSNVLKLSYRDSAHGFSGNVRLVTLGGQYTDAESSVKADAYTLVNFSLSKSLTSHAKLYAGVDNIFDELVEDGYGNVYGPGSTGMFMYGGIGLNL

SEQ ID NO: 8054 - protein, 379 aa, Bacteroides stercoris ATCC 43183
MKQKNVAVAAALACAACIPAIGHAQSSVTLYGILDAGITYVNNTGGSHVVKFDDGVSYGNRFGLKGTEDLGGGLKAVFALESGFHLGNGQLGFGGSEFGRQAYVGLQNDWGTLSFGNQLDITNELVSIYNISAWGSGYAIHQGDFDRFNGDRLPNSVKFLSNDLSGFKFGAMYSFGNVAGNFHRNSAWSAGASYTKGDFSIGAAYTRLNNPNGIYAFDPYAMIGTHTFLGQQTVTVDPATGARTDLFANTAMDVDSQGTFGVGTSYTIGKLTLDANYSYTTIKGFGQSSHMQVYEGGGLYQFTPALSFIAGYQHTRFEGHHWNQGTAGLHYLLSKRTDVYISGDYLRASQGVDAVIGYSFTPSTTQTQADVRIGMRHSF

SEQ ID NO: 8055 - protein, 223 aa, Bacteroides stercoris ATCC 43183
MKKICAILAAGTAIAAAPAYAQDATPAEAFSGFHAEALVGYDHNRSGSSEDVDNTRDLKQSIDGVEYGGAIGYDIPLGTNLVAGAEAEITDSSASWDNNNDQPNVFNLGRVEAGRQYYVGARLGYAMSPSTMVYVKGGYSNARYNLQGTDGTTNLRQRLDADGYRVGAGVEQKVGENAFVKLEYKYANYSKGEFDFNGDTPDSSRFNLDTDRHSITAGVGVRF

SEQ ID NO: 8056 - protein, 1062 aa, Bacteroides stercoris ATCC 43183
MLCLFKSNQKKAILMKRKEHKSKSLLWRILLVLLSFSFGTIVHAQNITVTGSVEDQNGEPLIGVTVAELNTTNGAITDIDGNFSIKCVKGATLKFSYIGYKDVTKVVTESNLKIVLVEDSQALDEVVVVGYGTQKKGSVTGSVTSVDAKAIEDFPSANLSSALAGRLSGVYITQGTGKPGTSASFSVRAKGTPNNSDPLYVIDGVVRDKMAFDALDASEVANISVLKDGASAAVYGARAANGVVLITTKKGGNAKPTINYTGTVGIDVAAMIPETLSAYEHAVYLNDRAIQGYLNNAIWNPNVEQQDPTTKSSWYTDDELAHFKTTDYSFLDDAWKTPWSTRHAINITGGTEKVRYFIGGSYFYNVGSFDNLKYSKYNFRASIDADISKNFTVGLNISTDNRKDTKPNWKSDGDRDRMNDLYKGLLLRTKMIPSMIDGMPVGNFIEWHPLMLISEESGLHTKKWQNVNVNATAEYRVPFVKGLKLKVQYNRTLDNRLIKKVNFPYEMYNFQTAGTNNHYIDPSNVVVSTKTRDDGNYVFKENQLAEEYQLNLFVTYDRKFGNHDLSALFVYEQSEGDSEKFDAQRNKLITWEMPEFFGASGDASESIVGAGSVSESGRLSYVGRLNYAYADKYLLEAAFRVDGSTKFAPDQRWGFFPSVSAGWRISSEPFFSENIKFIDYMKLRGSIATLGNDAIGGWQWMARYGITTGAVFNGLSYGLEPKEVPNPKLTWEKSTSYNIGFDSRWFRNKFDFSFEYFYRRTYDILDNLNVSVPTTFGASLPKENYSEVKSRGFEVELGYNDRIGKLDYYLRGNFSFANSWWSKKDEAENIRAYKSEIGQSLSREWGFECIGMIRTEEQLQQYMEENPNMTIKGQKPGLGMLIYKDVRGPESDEPDGIITDDDKVVIIENKVAPITYGFTIGGKWKGFMLDIFFQGMAGHKKLMDFRGNGINAHTSTFKYYNDHWTPENTNASMPGATQYKNNEASSFWVRNASFLRCKNISISYDLPKTFVQRIGIDKARLFLNGTNLFLLQDKVKWMDPEATSISDYPVMRNFSFGLNITI

SEQ ID NO: 8057 - protein, 802 aa, Bacteroides stercoris ATCC 43183
MLLASTALRRLAAPATIGETAIQVAQQGRTVSFAIAAGPLPGVLAAYGQATGFQVLYPSDIAQGVFSPGVTGTLAPQDALIRLLAGTGLIARFVDPDTVTLEKLPAQAGNAAVLDPVTVQGGLSRDPGRSEGTGSYTTGSTDSATKLNLTPRETPQSVSVMTRQRMDDQGLNEIRDVLDQTVGVSRMQRGPLGSDGDDVFARGFPVTNYQVNGIPRSTVYGFDDSISDTAVFDRIEVVRGATGLLNGVGEPSASVNLVRKRPTPILQGYAEGQIGSWNRYRGEADLSGPLTGNGRLRGRVVGAYQDNDSFIDRLHERKKVLYGVLEADITEDTTWTVGVEYQKHRSDDASRAGFPLFYADGTKTDFSRSHNSGARWAYFMHDNLTVFSELKHRFGDGWTATLNVERNNREYDGLLGYGARGSLNRDGTGMGIWPGRWNSDLEQTSVSADLNGGFDLFGRRHDLMAGISGYYAKREGLDYPLWTIPGYDPSIPNYFTWNGSIAQPTLNPTGRSQTDERQVVAYAATRLRPTDALSVILGSRISRWEQIEKSSPNAGAGSYSKRSENGVFTPFAGVVLDLTDIWSVYASYTSIFKPQNLQRDVSGQSLDPLDGNAYEAGVKAEFFGGALNASAAVFLIQQDNLGEADPGRFAPDGTQAYRAVKGAESKGFELEVAGEVMTGWQVGGGYSHTSIKNADGQRMMTYVPRDTFKLFTTYRLPGAWDRVMVGGNVKWEGDVYTGTGARPYDRDGYAVVDLMTRYQITDKVSATLNLNNLFDKKYLSSVQNYGYYGEPRNVLLSLRATW

SEQ ID NO: 8058 - protein, 774 aa, Bacteroides stercoris ATCC 43183
MKKKNLFTILLLLAVVTLYCQEKNSIAGNVKTSDGIPARQIKLVIDDFKIETQSDEKGYYKFDDITLKQELKISLYANGIVVHTETIKVISGHNVVNFTLASKVTELNEVIIKGVGFNRFIAKESQDVAKIPLKNTENPQVYSVIPKEIIKAQLIIDNKDIINNAAGVVAFNNPTGAVTAWIRGFETRNAVRNGMATQFRAETDPINIERVEVIKGPSGTLYGANAVSFGGLINKVTKTPNDVPKSEATVFAGSYGLLRFTLDANKPLNDNKTALFRINASHSDQETFQDIGYAKNTTIAPSFLYKVSDRFQILAEAELATISRTQQPYPFFTSGVTFTNFKDIPISYKKYVGGNDVDSKTNITNLFLKGTYKISDSWTSTTNVNSSKGYVDYSYQLYPRWVDDHTIIRNVGLYSGRKLSYFQLQQNFNGDFKLGSIRNRVLAGTDYTQNSTQLNFTWAQYDQIDINTDFAPIIKAKIDGILATKNAGHWDNTQSSISAYFSDVINFTPRLSAMLSARVDHFINSPSIENNVKVKDDFEQTFLSPKIGMVYEIVKNNVFVFGNYMNGFINQGPVDQPDGSQFRLAPKEANQKELGVKTEFSDKRVSTTLSAYEIKIDNATWVDALGFTQQKGEQKSKGFEFEVTSQLTNNFNVIAGIGYNENKFISGEASLIDKRVAGAPKNIYNLWVDYKIKEGFVKNIRVGFGGNHVGDVFWNASNTMTIPSYTIVNSAITYEKGLWSLGLKLNNLTNQKFWNSDAQPQALRNVVCTMSFKF

SEQ ID NO: 8059 - protein, 1131 aa, Bacteroides stercoris ATCC 43183
MNEDHKKRGLTHSKLLTAVAISSLLLSSGNVMAAQANPDNSLGVTEQLQAITISGLVIDAAGEPIIGASVVEKGTTNGGITDLDGKFTLTITPGATLKISFVGYQTQEVKAAKTMRITLKEDTEMLDEVVVVGYGVQKKANLTGAVSTVDLNKTMAGRPQQDVAKALQGAVPGLSILTTSGAIDETASMRIRGLGTLSNGEVSNPLIVVDGVPMDDISFLDTQDIENISVLKDASASSIYGTRAAFGVILINTKSAKPSEKVTINYSNNFAWDQATYLPDYPDVPTQLKMGIEASMNGGAGMPELFGMYFDKLLPYAEKWQQQNGGKTGYRPMNLYQSDSNVGDYIVLDGTPFYYADWDVQDIYFNKAAPSMSHNVSIQGTSGKTNYYLSFGYNEKQGQMKIHPDELKKYNASVNVTTNVYDWLQVGARINYSRKNYKRPDTWANTYQYLWRWGSYFIPSGTIDGYDTRVMAMQKQAADREVTTDLTRMNTFLKAEIVKGLTLNADFTYAIQNMNSGSQDNSVYGINWSGKPVPSYIVTKGNSGIWRDFSKQNTWTANAYVNYTKTFAKKHNLNVMAGVNAEEEEYKYLYGTRNVMYDQEGYPELNMAGKDGQDLSWNHTSRASAGYFGRINYDYKGIYLLELNGRYDGSSRFPHTDQWAFFPSASIGYRFSEEAYFAPLKHIVSNGKLRASFGEIGNEAVGDYMFEQLISQRLNNKSTGYIYWIENNNANANLLTMYNMPDLVSSTLTWERIRTLNIGLDLGLLNDELTIGFDWFQRENRDMLAPAQVLPNTLGASAPYENAGTLRTRGWELNLNWRHTFGDFDVYANFNIGDSKTKVTKWDNDSKLLSTYYTGKTYGDIFGFETDRYFEEKDFTSQNADGSWNYANGIASQAGLESGNFHYGPGDVKFKDLDGNGKIDGGKGTADDHGDLKVIGNSMPRYEYSFHLGGAWKGIDLDLYFQGVGKREDWTTSSLNLPAMVHADVAIYSHQTSYNKVLWNSDYTAITGYEVNQGNRYPRLYRGTNNSGGTVSGIANGCNNYYPQSRYLTDMSYLRLKNVTVGYTLPKEWTRKAYIEKARIYFSGSNLFLLHKGNDLPVDPEISTGNGLTAGGWGRIAPITRTFSFGVQVTL

SEQ ID NO: 8060 - protein, 790 aa, Bacteroides stercoris ATCC 43183
MNDYFRIKSPSFLALGTLTFFSFYSFVNAKEHHHTLQKVTTTEQKFSSSAPLSWQSEEVRDSTSSRTVISNKQLKKTGNLNIENALQNVPGLQIRDATGTGVLPKISVRGFGGGGNGHSNTNMILVNGIPIYGAPYSNIELAIFPVTFQSVDRIDVIKGGTSVQYGPNTFGGVVNIITKEIPKEWEDQAAERITFWGRSSNGSFVDPEEKGKPLAQTLGNQMLFNTYVRTAGMLGKHVGISAQANWINGQGFRQNSPTGVQNYLFDAIYKINPSNTFKAYYQYYKYNSYHPGTLSAQDYAYNRFMNERPNNQDGGRAKRFGIVYQNYFGNPDSGVGGDFKFTYFTHDMSRDFGYSNQYQSVYMSSQNKILPFNGKGKISAKNPNCGLYSYSDTSSPCWLFFDNIRRFVLNAFEPKLNLVVNTGKVKQTFNMGMRFLTEDLYRRFTTRKNPSVPNNGFDPGTSLNNFNNYTSVYASDEINFNDGMLTITPGLRYTFLNYEKKDVPPFKEGQTPKTIKDRYNQWNPAVSVGYKPIKDWLFYFNYQRSYIPPQFSNIGSFVGTSTDYFQIFNVMEGGSRYYFNNQVSFNANYFVIFANHYFTGRYGDNREPVNARSQGVELELYYTPIRGLNFHAAYTFIDATITSHTMVTNPAAPKGPKKDIFGKKLPFVSPHQFILDASYTYAKTTIGLSSFFYSRTYTDVLNTVPFTEYAPTIKNGAITTKTAGMTPWYWVWNLQISSTLWERKNQSVSASLQVNNIFNMKYWFSGIGTSPNGKEAAPPRSITAYVSYNF

SEQ ID NO: 8061 - protein, 86 aa, Bacteroides stercoris ATCC 43183
MKTINTVVAAMALSTLSFGVFAAEPVTASQAQNMNKIGVVSADGASTLDALEAKLAEKAAAAGASGYSITSATNNNKLSGTAVIYK

SEQ ID NO: 8062 - protein, 1026 aa, Bacteroides stercoris ATCC 43183
MKKYIIILLWVCGCFCQVFGQNDAVPVTVRGRVVDKNNEPIPGVSVVVKDQPGLGVPTDTEGKYTIKTNKYRWLVFSFVGFETREVLIKDDLVINVVMKESKSSALNEIVVTATGPQKKVTVTGAVSTIDVSTLKTPSSSITNALAGNVAGVLALQRSGQPGSNSSEFWVRGISTFGAGTAALVLVDGFERSLNEINIEDIQSFSVLKDASATAIYGSRGANGVILINTKRGKDGRVAINGKVETSYNTRTFTPEFVGGPKYAQLMNEARSTRNQTSFYSDDDLALIRDGLDPDLFPDINWMKMFLKDGATTKRGSLNFDGGGATARYFVSGSYIDEGGMYNVDDALNGYNSNANYKRWNYRTNVDMNLTKSTVVRVGVAGSLGKQNLPGGTYDEIWYSLMGQNPISIPIKYSDGKVASRGGAGRNNPWTLITQQGYIENWENKIQTNVTLEQNLDFVAKGLRFLGRYGYDTNNRNNIRRMKWPEGWEAERLRDSNGNLIFQRRITEQLLTQTSSADGERLEFLQGEMHYATNIGNHNLGGVLQYTQEKRVNTTNFGGDLIQGIDRRNQRFAGRATYGYKSRYFVDFSFGYNGSENFARGHQFDFFPAVSGAWNIGEESFIKENLSWMNMFKLRYSYGKVGNDYMPTRFPYLASFKTYNATGDPNKGYNWGDIESNFGFPGLTYENIASNTVTWEVATKHNLGLDISFFNDKIGGALDYFHEQRDGIYMTRNFVPASVGLQAANPRANVGSVLSKGFDGQIKLAQKVGNVNFTMRGTLTYSKNEILEADEQFSNYQYNTQAGFRVNQNRGLIALGLFRDYEDIRDSPIQTYGAVMPGDIKYKDINGDGKIDDNDILPIGATAYPNLVYGFALVTQWKGFDFNVHFQGAGKSSFFIDGYTVYPFSQGDWGNILTDFDQSNRWVLGQNEDVNAAYPRLSYGGNTNNYRPSSYWLRESTYLRLKTIEAGYTLPKSLINKFHINNFRLFFMGTNLLTFSKFKLWDPEMNSSNGQAYPLAKTFTLGLTATL

SEQ ID NO: 8063 - protein, 895 aa, Bacteroides stercoris ATCC 43183
MKQKIHYTFLILPILLLLPLGLIAQTIEGKVTDKSGITLPYMNIVEKGTKNGTTTNNSGEFSIKVKSLPTILVVSSLGFMSKEIKVSSKKYLTVVVEVDNVSLDEIVLVGSRGKPRTAFDSPVPIDNIKISELAQTGKGVLDQQLMFKVPSYNSTQQPVSDAGAHFSPADLRGLFPSRTLVLVNGKRKNASALVYSYVTPGRGEVGVDMKSIPAAALERVEILRDGAAAQYGSDAVAGVINLVMKKSVAPFINTSYSVTSEGDGAQYQLETGFGVDIADKGYANFTFSYFDQERTQRAGKITSVEDEANYWKASDQTTQEFITDNKLEAFLQRNPSAGFQVGIPDMTITNFSYNMGYTLDEETQTEVYSFGALANRTGSAAQFARVPYWVPGFEQIYPGADFFRAEMSPQIKDNTFSLGIKTVYNGWNFDLSTTTGKNRIDYYITNSFNQSYGASSPSDFYNGAHQFSHVVNNLDLFKVYEGADDKAISVAFGVEHRTERFVTEAGELASYEGSGSQSFGGFSPENVADDYRSNIGMYTDISIDLSKAFLIGGALRYENYSDFGSNVSWKLNSRWKTADDKLAIRGSVSSGFRAPSLHQMFYTARTTTLTTDGIQQNGILNNSDPALRALGIPELNPETSQSIGAGVSYRITRKIGFTADVYQVKVDDRIGLSGQVTATDDASSPIDQTLSAANVGAVGFFLNAIDTRTRGVDLVLSYDYINLGSGQLSGSIAANFNKTEVTGFNFPKFIQDNNLQDAVFSREDISRVETWRPQQKIIAAVNYKIEKFSAGVSFMNYGKVTYRHASDASNDATYGGKTLTDINFAYNLTEKLNLSLGVNNLFNIYPDTFADAYSDTGGVPGDRNLDFVGRFKYPWQTTQFGIDGTRVFTKLAFTF

SEQ ID NO: 8064 - protein, 771 aa, Bacteroides stercoris ATCC 43183
MRRVDGDHARQLQFVAKMQEKTMNKKIHSLALLVNLGIYGVALPVLAEETSDNAVSHDDTIVVTAAEQNLQAPGVSTITADEIRKNPVARDVSEIIRTMPGVNLTGNSTSGQRGNNRQIDIRGMGPENTLILIDGKPVSSRNSVRQGWRGERDTRGDTSWVPPEMIERIEVLRGPAAARYGNGAAGGVVNIITKKGSGEWHGSWDAYFNAPEHKEEGATKRTNFSLTGPLGDEFSFRLYGNLDKTQADAWDINQGHQSARAGTYATTLPAGREGVINKDINGVVRWDFAPLQSLELEAGYSRQGNLYAGDTQNTNSDAYTRSKYGDETNRLYRQNYSLTWNGGWDNGVTTSNWVQYEHTRNSRIPEGLAGGTEGKFNEKAAQDFVDIDLDDVMLHSEVNLPIDFLVNQTLTLGTEWNQQRMKDLSSNTQALTGTNTGGAIDGVSATDRSPYSKAEIFSLFAENNMELTDSTIVTPGLRFDHHSIVGNNWSPALNISQSLGDDFTLKMGIARAYKAPSLYQTNPNYILYSKGQGCYASAGGCYLQGNDDLKAETSINKEIGLEFKRDGWLAGVTWFRNDYRNKIEAGYVAVGQNAVGTDLYQWDNVPKAVVEGLEGSLNVPVSETVMWTNNITYMLKSENKTTGDRLSIIPEYTLNSTLSWQAREDLSMQTTFTWYGKQQPKKYNYKGQPAVGPETKEISPYSIVGLSATWDVTKNVSLTGGVDNLFDKRLWRAGNAQTTGDLAGANYIAGAGAYTYNEPGRTWYMSINTHF

SEQ ID NO: 8065 - protein, 997 aa, Bacteroides stercoris ATCC 43183
MNSKIASSRVLKIALLSATVIAGLPAVSQAQDAKSPAAGDTLEAVVVTGFKQSYANAVRAKKNAIEITDGISSDGLGRFPDLNVGEALQRVPGVQINREAEGRDATINLRGMPGEYARMTPNGQAFAEPPLLRDNQGSPLGAFNSDIFSAFVIQKSPMANAQTGGLSGNVDLQIAPALSRREGGSMKAAYEYNTLGDLGAPAVTVSYNKVFSSSLAAFGTLAYRKENFRRDSILINNYAVLTPAYTGLSAANFVAKYGEYYSSTPCTTGSSAFCSYVAGATGTKGTSGLYFNSQTRQYARMNKGETWSASGGLEWKPNDQTKMGLIGYYTDRDLPKTRQDLMINGLNAGSIITPVGTPFKVSDGRYVYDQISFTNPDALMSSRLNSQHQASRGVMANIDWSNENWRLAGVLTASGGKNSSVETQVDANTLITAGGNGISGTLSTGRDDIGDYSYTITPSPVTGIPAGTSWSWLGASDPTSLYNSPTRAAATRRLQLTGTQSYAENSLYTAQFDAERFVELGPIKSIQGGARLERASYTSAGYRVYAFGLQTQNITSAMVKQAPYVDDFFGGKGGAYTKNWQVIDLDAFLDAVRPVTEYTASGGGLSPTGFNIRYQDDNYALRNYTSDDDNTQAYVMAKYDTELAGHRVRGNVGVRYENTDNTLEALDQKTPPADGIGTRNSFSWVTYKNKYDFFLPSAIFAADVTDDIVLRGAYYKTYVKPHPRQFSAITKIGSRTLDTTLTSAAVAVNYVPITIGNNKLKPYMATSMDLSLEWYNRPNGLISLAVFEKSITGRIVTTSDPAILCPSDGSTWGLGTLAWDGTYCTSSQSTSSNVLQVRATGSYNLDKATKVRGLEFNIQQNLDFLPGFWKNFGGSFNYAYTTSKSAAIAPFPGISKHNVNMIGYYETPKYGVRLVYNYRSAYDLNSNGTFTGGSRSVRPRGQLDLAASYNVSDRFSLGLDVYNLTDAIRFEYENDEDVVRTANYDGRTITLTARAAF

SEQ ID NO: 8066 - protein, 1054 aa, Bacteroides stercoris ATCC 43183
MKNIRQKFLENSSSNQKLFLTRSRIFFLLLFFCSVSLMAQNGVVVKGKVLDANDEPLIGAAIVLKGNTNVGTVADFDGNFTLEVPNRNSVLTVSYLGMTPQDVKVNGRTMIVVVLREDTEVLDEVVVVGYGQQKKASVVGAITQTSSKVLERAGGVSDLGSALTGNLPGVVTTASTGMPGEEDPQIVIRGASSWNNSAPLILVDGIERPMSGIDVNSVESISVLKDASATAVYGVKGANGVILITTKRGKEGKATINAGGSMALKMPSKLPNKLDSYDAFQLRNDAVEYELGLTPDSWMYMMSQEQMNKYRNPANQAEAERYPNIDWADWMFKDYAFSENANVSVSGGTRFVKYYAAIDYQHEGDLFKEYDNGRGYQTTYGYNRVNMRSNLDFQLTKTTLLKTNLSGSHGVKQGPRTDYEYNIWGSAYSTPPNVFYPQYSDGTWGYDPINNANNSVAQLALAGQNTRTTTRLTTDFTLEQKLDFIVKGLSAKASISWDNVFYEQNRGVNSTDQALYKYINPETGAVSYNPSQGSHNFDFHEQVNWIAEGGSIDNNATERHLYYSAQIDYNNTFGNHTVGAMGLFSRQERAKGSIVPNYREDWAFRVTYNYANKYFLEYNGAYNGSDKFSADNRFVFFNSGAIGWMLSEEKFMKKIKFLDMLKLRASYGEIGNDVIGDEWDTTRRWLYMDQWETGGNIATGLYNVASPYTFYRQKTVGNTDIHWEVVRKFNFGIDYSFLDGLFAGNIEIFRDKRSDILISGSDRAMPSYFGGIVSAPWVNMGKVKNRGYELELRINKTLRNSLHLWANMNMTHAVNEIIEADDPELLPDYQKDAGKSIGQTHTYVDHGYTQTMDDIYGSTAFESNDDQKLPGTYYILDYNGDGVINSYDQIPYGYSSSPQNTYSASLGFDYKGWSFFVQFYGVNNVTRQVVFSTFSQKQLIAYDEGSRWSKYNPNPDVPMARFGSTTNSYYDAARYFYDGSYIRLKNIELSYTFTSGWIKSLGLSNLKLYVNGNNLWVWTRMPDDRESNFAGTGWASQGAYPTVKRINFGLKFTL

SEQ ID NO: 8067 - protein, 388 aa, Bacteroides stercoris ATCC 43183
MKNKKINISVIAVAAFAASSAAMAQSSVTLYGMLDAGIGYTSNINGHSRFGLDGGAAGSNKWGLRGQEDLGGGLQAVFKIENGFNIGTGGIGGQGPIGTTRSLFNRQAYVGLASEQYGALRMGRQLDAVTEMVQALTGDVISASTFSTPGDVDNNDNTTNQNNAVKYISPIIHGFQAEGAYSFGGVAGATGSGQSWSAAATYAQGGLTVAGGYFRAVNQGENGWLNATAQPSFGGALGYPSSGYNGGNAFKSAGIAQIAAQYQVGPYTAGLRYSNAQYHGNDGQPSIHFNVLGALLQYRVTPALSLATGYTYVYGSAATPKQAAEGRTMASINQVSLGATYSLSKSTALYAMGAYVHAKGAQASAADFGNTSSGGNQVQVNIGMFHGF

SEQ ID NO: 8068 - protein, 904 aa, Bacteroides stercoris ATCC 43183
MYKLCTLTKKSVTILLFIGFLIWSPIYGIAQQKSALDKIVTIELAEMSLADALSALGDQSGLKFSYSSTQLDVQRKVKLSATQKSVRQVLTELLGKQLKSLSLKADVVTIQTSAGKGNIKGSVKTSDGKPAPFVTVSIKDVKSTQADEKGDFMLRDVEAGNYRLDASYVGMTTQSSQIKVLAGVTITENFRLAANSQELTEIEVNGKMVNKFVVRKTETVAKLPLKNLENPQVYTTITRSLLNEQITTDLTDVLKNTPGILKMQGSIGRSGDGAVYYNLRGFPTRISMVDGIAGQTNGDIDPANIEKIEILKGPSGTLFGGALTTFGGLINVITKKPLDTLGGEIGYTTGNFNLNRLTADIYGPLNDDKSLQFRVNAAYHKRSSFQDAGFRKSTFVAPVISYRINEKMEAILNAEFYDYEGTNPSIVFLHRTRSYIATTPKALNYDWNRSFTSNDITLKAPASNIHGQLNYQISGNWKSQTSVSRNTRKTDGMYQYQFIRGASSDELVERNVQLQNYEGNYTALQQNFNGDFKIGGMRHRMVVGLDYLNQTTYNNNSAIVKFDTVSAVNGDLPAKYGTLTRAKAEAKIAALTGVGTAGAVVKNYNSSNIYSAYASDAIDLTDQLLVLLSLRVDRFQSLGTMNLATNTLLVNTKYSQTALSPKFGLVYQLIKDKVSVFGNYMNSFSNVPPVAQPLGDISGTFKPQQANQFEGGLKMDLFGNRMSFTASYYDIEVKDITRDEVLNREGIDYNIVVQNGTQRSKGFEFELIANPVTGMNVIAGYSYNHSKLTRSSKALEGRRPASAGPDELINIWVSYVQPDGSLKGLGAGFGANHSGKYLSGNSATTGVFTFPSYTLLNGTLFYEMRRCRIGIKGDNLTDVLYFTGQGVLSAQMRRSLSANVTFKF

SEQ ID NO: 8069 - protein, 246 aa, Bacteroides stercoris ATCC 43183
MYNPSWLEGAELTLDYYNIKVKDAIGRYGHTTIARECAKGTNPDSCNYIDRDSLGNITDLRNFLQNAGEYNVEGVDFFTAYRFPETSFGSFKASLDVAYVISNEFNGTDRVGVQTGDGGFPEFKGNLMVDWSMGDWDAHWKVRYVGPLNNDYYTGLTPDDIDYYNDLKDSGYRETMDAYMVHNVSVGYNIDGYNTKISLGINNLFAKKPQAEGPTNNEAISTNNFSVTEYDVNMDRFIYLRATTKF

SEQ ID NO: 8070 - protein, 374 aa, Bacteroides stercoris ATCC 43183
MNLKQNLVFVSSFLLLSSPFSVKADIGEQAQLHYHGGLNLIGQTTPLLNSGLTASADFWTHYQAKNYSVKLHIEGATAPEPNTVASELKYSNADSGTALNKYGDGRIQISELFGEYYMSQKNQLILGLMDASSWLDISQISNDENHHFIAAAFTGNLTIDFPDYAPAVGVILKPRTNVKGTFYISSAQGLADNQQKSYEALLDTPDDKDGAFIATEGRLGKESAFISIGVWAHTGPHKSLKDPTEDNLTNYGIYSVLSKQFNQSTLESRIGYTNPEISTITEFYSLTYQLKTYSIYPGSRYGLSVSHAITSPYLPAEKKPSNRTTLETYWAFPIHKHIEITPSLQLFKPPFTDNPTLQSESDVWVANLRIYSHF

SEQ ID NO: 8071 - protein, 181 aa, Bacteroides stercoris ATCC 43183
MKNKLFNIIIFSFLLNSVNIFSLDSDIKEIEPIESIHSDQNASSFADDNIKTFSENSFEENYSPNKSKISNIVSTNKDLKTNKKEENNGEDKFEEITDRTNRITALGSAMGAVDLSKTPADKFRVGAGVGHSAKNQAVAVGIGYAPTERLRLNTKISTTTNSTKSSRSNGISIGASYDLDW

SEQ ID NO: 8072 - protein, 874 aa, Bacteroides stercoris ATCC 43183
MRSPVSGTAGSYRFALLAGAGALALTAPGVAMAQQVDSNDADELALELEDRNSSNVIIVTASKREQTLQETPISVSVTSGETLEQAQIRDVLDLQTVTPSLRVSQLQTSSASTFIIRGFGNGDNNFGIEPSVGVFIDGVFRSRSAAALGDLPNVQRIEVLNGPQSTLFGKNASAGVISVVTREPQFEFGGAVEAVYGNFNTVVLKGDITGPISENIAFSLDGSYQRRDGYADIVNLNEEINDRDRWSARGQLLIEPTPDFSIRAIVDYSRIDEVCCQVGTLAVGPTAAGIAAVGGQIGGPDTFFDYDSFLNFVPTNEVDNYGGSIQMDYETDSGLSFTSITAYRELENFFLSDIDFTSADIATETREQKVETFTQEFRVASDFDGPINFLLGAFYFDETITQDSAIQNGSQIRNFFEILAGADPVAVLTGQPTLFNGLEQSFGFPQETIFNTPLLTSETFAMENEAWSVFGTIDFEPVDGLVFTIGGNYTDDSKTFALSQTSFDPLAQVNFVDAFITGATAADPNLPTVTSRDQFQALPAAVQQGLLAAATNPAINQLLPLAGFQFQPPFLAIPNAVEDGRTDDDEFTYLLRASYQISPEINLYASYATGFKASSVNLSRDSRPINSDFVAGPGGSTFAAPSSPIINAGLAVPNLVSGSRFAGPEETEVYEIGMKAQWEGFGFNLALFDQTIEGFQSFAFTGTGFALRNAGEQSVKGFEFDATINPTDGLVFTFAMTHLDPLFDSFPGSVLGDLTGVRPAGIPSFAIATSATYTHEWDSGTRLISRIDYNHESNEPINNGLPTFGPNNFRREVNLVNTSVTLALNSGLEIGAFARNLFDDQYILTVFDAVAQAGTVSGYPSQPRTYGGVVRFKF

SEQ ID NO: 8073 - protein, 994 aa, Bacteroides stercoris ATCC 43183
MQRHQQKQHVFLIILVLLHTMVCFNLKFTYNFALLINMMLLMKKGILGCNIIYLFILICIGIALPIKSQNNYKVKLTGTVYEYDHNNKRLPLQFAAVSIPEIALGTTSDENGRYILENVPTGKIRMQIQYLGKVSIDTLINVNKDLVLNFTMRNEDFKLKEVTVTATNSRSGKSTSSHISRSAMDHMQATSLYDVMSLMPGGISQNQDMSSAQQINIRQVSSSSGPEAPMNAMGTAIIRDGAPISNNANLSAMSPTVLSGTETPASLAGGASPAGGTDVRSISTENIESIQIVRGIPSVEYGDLTSGAVIINTKAGREPLRVKAKANPNIYQVSMGTGFELGKKKGALNVSADYAYNTNNPISSYQHYQRATTKLLYSNTFFNNKLRTNSSFDFIYGKDQRERNPDDEQTKTASEGRDIGFTLNTNGTWNINKGWLKTLRYVLSGTYMDKDSYYETVYSSATSPYSMTTTNGAVLSNFAGQHIYDANGNQITNFGPEDINHYAVYLPSSYLGHYEIDSREVNLFAKVTSSLFKASGHVNNRILIGADFRSDGNVGKGKTYAPSTPPYRSQYGHNSSFRPRNYKDIPFINQFGAYVEDNFKWSISGTHDLNIQAGVRYDHTSVVGGIFSPRVNASIDLIPNLLSLQGGYGIAAKMPSLLYLYPENAYFEYININELTNENIPESQRLFMTTTEVRQVDNSDLKIAQNHKAEVGFNLRVGKTNLNVIAYKERLKDGYVMSQTFNTFNTFIYNEYQRTENGIELSSSLPVLSTYAKPTNNLNIETKGLEFDLNIGRIDAIRTAFQINGSWMRTKSWRQGYSFYDNSEDAASARKPVAIYSQEGNASYKQQFVTTLRATHNIPRIGFVVTMTAQAIWQQSNWNTFGNDSIPVGYLALEDASVNMFPKGKYTTTQQVKDAGYGYMLNNVSHNNAIKESYSPYFCFNLNVTKEISNMLRVSFFANNMFRSYPRRESKRNPGSYIQLNNRFFFGLELSLTL

SEQ ID NO: 8074 - protein, 1011 aa, Bacteroides stercoris ATCC 43183
MKRKLMLLLACLFVGIGLVTAQTQKVTGVVISEEDGQPVIGASVLVKGTQIGAITNVDGDFTLLNVPSSAKTLQISYIGMQTQEVAIKPNLKVVLKPDTEVLDEVVVTGYGTFKKSSFTGSASNVTTEKLQDLPSISVQDRLAGSVAGVQITSTSGQPGSVASVRIRGMGSINASNEPLYVIDGVPMLNGNVSEFTYADSGNSLMATLNSNDIESMTVIKDAAAASLYGSRAANGVIVITTKKGSAGKTKIGVRADWGMSNMAIDYRPILDGKQRREILHLGFENYAKYTLGYDAEQAAALANKNIDEYAAEPWSGYTDWKDVLFRNGSHQNYEINAQGGNEKTRFYTSFAYTKQEGITNVSGYERFTGRANVTHQTDKVLLEANAMYTNSTQNVNNEGTSFASPIMCYAMTASPSTYPYNEDGSFSSNFPALNGANPIQTETYNYNRATINRFLGSMAATWTIWDNLKLKEAISYDFNQNNERIWWDPRSNDGRSSNGVYQRVMGNRGQLNTQTQLSYNKSFGLHNLDALVGFETEDYKYDYLYANGNQYPSYLPEIENAGDSRASSHVERYRMTSFLGRINYDYNNKYYFSASYRRDGSSRLSRESRWGDFWSISGSWRLSEEAFMQDIKHVLTDAKLRVSYGVNGTQPTDLYGYLGVYEFGYNYAGNGGSAEARFDNPNMKWEKNYATNVGLDVTLWNRLSITAEWYNRDTKDLLMSKNISAVPGVINSSGGATMLMNVGSMRNRGVEFEIKSTNIQNKDWYWSTSLNFGHNKNTLLKLDGEQNEMIDGIAIHRIGEAYQSFYAYEYAGVDPETGSEMFYINGEDGSRETTIHSNEANKVIIGSPDPKLTGGLTNFVSWKFIDLNFTLTYSLGGHAYDAATWLQSNGGTYNYVGNVPAYYKIEDTWKQPGDNAKLPLFAYGNKNTVSSRWMMPTDHLRLKNLTIGFTLPSNLSKKAGISKLRAYISGNNLLTWKSKDLYVDPETPVDGLCYFETPALRTITFGIELGF

SEQ ID NO: 8075 - protein, 724 aa, Bacteroides stercoris ATCC 43183
MMFKTLCNLTLCVSFGYSMQSYTLNKSIITGNALATDVEKIPGNVSVIDNKQIQHMPNAKITDTIKKIAGVRVDNDVGFNPRPKIKIRGINYGTLLMLDGVILSDLEGENRILNQISLYDVERVEVARGAFSSLYGAGAIGGVVNFITSMPTQFQSQFLISYGNEFINNTADKNLIRAFASVGDVFIDKRLRLKLSAGYTHSNGYSSFPTILPSSETNTSNINNMVIDKAGNRIIGDGGKRNYTIYDIRLKAEYDISDSDILSSMISFSNHNYTFGHFKSYISDKNTGESTNLVNGKDYFVGSGLGGMGTYSHLLGNLTYQHDFEESYFKISFSTMNLFSLWQDAKQGEGDRYGGAGSTQDIDSTSNYLDMLYRINLNAIHSLNTAMQFRYYTFTQLNANMTNWKDYKSRTDVYRSYGGKAFVTSAYLSVDSEWLPNLSSTLGMRYDYWKNFNGYLLDNNNPTTNRNNQGAIASVLSPKASINYAPNFLQGIMLKSSIGSGFRMPTMRDMYQFTHSNTYWEINPDLKQESALSFDIGMEYQHKGFEGKIYYYDTELWDMIYRSGTGKQDKPYQNVNAGRGRIHGIEISAQVPIFRDLYIESNYTLTLATILKNNAKKDTEGKQLAATPKHITNLALNYFPQYGLYASIWAYYAPAFYADDLNTPALNNTYGNYESQFTLNAKCGYNFKNGIDLSASFMNITNNRFYDFYQVAGANYSLQLRYKL

SEQ ID NO: 8076 - protein, 682 aa, Bacteroides stercoris ATCC 43183
MKNKYIIAPGIAVMCSAVISSGYASSDKKEDTLVVTASGFTQQLRNAPASVSVITSEQLQKKPVSDLVDAVKDVEGISITGGNEKPDISIRGLSGDYTLILVDGRRQSGRESRPNGSGGFEAGFIPPVEAIERIEVIRGPMSSLYGSDAIGGVINIITKPVNNQTWDGVLGLGGIIQEHGKFGNSTTNDFYLSGPLIKDKLGLQLYGGMNYRKEDSISQGTPAKDNKNITATLQFTPTESQKFVFEYGKNNQVHTLTPGESLDAWTMRGNLKQPNSKRETHNSRSHWVAAWNAQGEILHPEIAVYQEKVIREVKSGKKDKYNHWDLNYESRKPEITNTIIDAKVTAFLPENVLTIGGQFQHAELRDDSATGKKTTETQSVSIKQKAVFIENEYAATDSLALTGGLRLDNHEIYGSYWNPRLYAVYNLTDNLTLKGGIAKAFRAPSIREVSPGFGTLTQGGASIMYGNRDLKPETSVTEEIGIIYSNDSGFSASATLFNTDFKNKLTSYDIGTKDPVTGLNTFIYDNVGEANIRGVELATQIPVYDKWHVSANYTFTDSRRKSDDESLNGKSLKGEPLERTPRHAANAKLEWDYTQDITFYSSLNYTGKQIWAAQRNGAKVPRVRNGFTSMDIGLNYQILPDTLINFAVLNVTDRKSEDIDTIDGNWQVDEGRRYWANVRVSF

SEQ ID NO: 8077 - protein, 867 aa, Bacteroides stercoris ATCC 43183
MKQVMSKLVLGAAVAATSIGTWAAELEEVLVTAQKRTQSLQDVPISVTAISGEQIQDASIRGLGDLGAYVPNFSVTENAVNTIITMRGISVGAQQSFEQSVGMFVDGVHYGKSRQARLGLFDLEQVEVLRGPQGTLFGKNTLAGAINVRTAAPKVGEGLSGRVAASFESDNGKYFEGYVSGSLSDNFAMRLAIMDREIDGYLDNTSPNAWGDDMPSTDETIARIGAQWEPSDQTTLALRYTYSDFVRQGGTATVTTFQPLPNAPASNQAMYATMALAFPNFQASSNDTFRDGYSIGGAAFSGRDGAERKEGTDTQNHEFSVNFEHEFDNGMTFASVTGVSSYEFEDGIDADFLPVEFIGRSDDSEYEQFSQEIRLSSDPSKRFSWVAGANYIDSKQEIDRLVDVRGSLGQPDLMRLITCPVPQILGACGFPTFLAYSPAQLAGIEAGLGFPPGSLPPGVEGLTMYTDVARLSRWVQDTESWAVFLQGTFDLTDTLSITAGLRYTEETKEVSARTDITQGATGITNPVPPAVNPLLHGLMGASFDSYAHEFNEERDTDQLMPAGSINWRPADDHLLYVSYAEGFKSGGFNSVDDQNPIFLPDGTILRDQPGVGFEYDDETAWSVEVGGKHTFLDGSLRVNWNYFNSEYDDQQVSTFVGLGFVVANAASTEISGFEVDAAWQATEKLRLNLAFGYIDGEYGSFPGAGCTALQQDALRGLGITDSSAPVTSVTVDGRTCEQKFLGNGAPSGASQDLSGADLGSAEYSGSFGAEFVQPIGAMAWFTQLDVNFTDDYFMTGDLDPIDVQAGFETVNIRTGLRGDSWMLMFYGRNIGDERFATGAFDIPLASGSHGQYQARGEVWGVQAAWEF

SEQ ID NO: 8078 - protein, 356 aa, Bacteroides stercoris ATCC 43183
MKDLGTLGGTSSTAKTVSPDGKVIMGRSQIADGSWHAFMCHTDFSSNNVLFDLDNTYKTLRENGRQLNSIFNLQNMMLQRASDHEFTEFGRSNIALGAGLYVNALQNLPSNLAAQYFGIAYKIRPKYRLVVFLDHNFSSHVPNNFNVSHNRLWMGAFIGWQDSDALGSSVKVSFGYGKQKATITREQLENTEAGSGESHFEGVAAQIEGRYGKSLGGHVRVQPFLGLQFVHITRKEYTENAVQFPVHYDPIDYSTGVVYLGIGSHIALVDSLHVGTRMGMEQNFAAHTDRFSGSIASIGNFVFEKLDVTHTRAFAEMRVNYELPYLQSLNLILRVNQQPLQGVMGFSSDLRYALGF

SEQ ID NO: 8079 - protein, 353 aa, Bacteroides stercoris ATCC 43183
MKMKKSTLALVVMGIVASVSVQAAEIYNKDGNKLDVYGKVKAMHYMSDNDSKDGDQSYIRFGFKGETQINVQLTGYGRWEAEFAGNKAESDTAQQKTRLAFAGLKYKDLGSFDYGRNLGALYDVEAWTDMFPEFGGDSSAQTDNFMTKRASGLATYRNTDFFGVIDGLNLTLQYQGKNENRDVKKQNGDGFGTSLTYDFGGSDFAISGAYTNSDRTNEQNLQSRGTGKRAEAWATGLKYDANNIYLATFYSETRKMTPISGGFANKTQNFEAVAQYQFDFGLRPSLGYVLSKGKDIEGIGDEDLVNYVDVGATYYFNKNMSAFVDYKINQLDSDNKLNINNDDIVAVGMTYQF

SEQ ID NO: 8080 - protein, 977 aa, Bacteroides stercoris ATCC 43183
MRKSILLFVLFTLTSIPLLLFAQGGYQVTGHIISAEDNQPMIGVSVLEKGTTNGVITDMNGNYSITVTKSPATLQFSYVGMKTIDKQVTASTRINLTMENDAQMVEEVVVVAYGVRKKGTIAGSVSTVKAEKMEDVPAPSFDQALQGQAPGLMVLSDSGEPSKAATFRIRGTNSINSGKDPLFILDGVAISSSDFNTISPNDIESISVLKDASSTSIYGARASNGVVVITSKRGRMGEAAKVTFRTQLGFSQLASKDWDQMNTDERIQFEKEVGLDKGQDYEKLSKTNINWLDKVYNDTAPLQNYELSVNGGTEKLNYYVSGSYYDQDGIAVGSTFERVGFRANVEAKANKWLKIGTNSMFAYQEVEQSDDGEYALWAPISASFFMLPYWNPYKEDGSLALQDDGSWKGTTENPLAWMANNPLSNKKYKLLSTFYAEVTPVKNLTIRSQLSADYGHTTSFYQSFPSYKPNNNYGGAQRSSFDMLNLMITNTANYRFMLNDVHSFNFMVGQEGENYHYEGFQLTTRGQTNDILTNLASGSTASSWSDPVTEYSFLSFFARGEYNYDDRYYADFSIRGDGSSRFGTDNHWGAFWSVGFMWNLRKEKFMQKYDWLTNAQIAVNTGTSGNSSINNYEHLALVSGGYKYDNESGIAISQLGNEELSWESTWATNVALHLGFIDRINLDVEFYNKKTTNMLMAVPISYTSTGFGTRWDNVGAMRNRGVEINVGADVLRIKDFKWNVNANVSYNKNEITELYNGVTEYVASDTGRMVAVGHPLGEFYLNRYAGVNPINGDALWYTKDGEITMEYNESDKVMLGKTHEAPWQGGFGTTLSWKGFSLSAQFTWVADRWMLNNDRVFQESNGLFSAYNQSKRMLYDRWKKPGDVTDIPRYGVTPQLDSRFLEDASFLRLKNLMLSYTFPQKWLKRTSFLNSARIYAQGQNLLTFTNFTGMDPESTSNVYKAQYPMSRQFTFGLEVSF

SEQ ID NO: 8081 - protein, 1056 aa, Bacteroides stercoris ATCC 43183
MKNFSKMRQGLSCMVMALLLMLIPADIFAQNSISVSGIVMDDTNEPVIGAAVMVKGTTTGVITDIDGRYTISAPANGILSFSYVGLKDKEEKVNGRTTINIIMETDSKMIDEVVVIGYGTQRRGSVTGAVSAVKGQDMIKTKNENPQNMLTGRIPGLRVWQKSSEPGTFNNSFDVRGMGAPLIIIDGIPRSTEEFQRLNAMDIDDISVLKDASAAIYGVRAANGVVLVTTKKGGAGKTEFSYNGSYTFQQPSRMPELCDPYESMTLFNEMSMNNINGGSWVFSEESFEAFRNGTRRTTDWNDLIISNVAPQTQHDISISGGTEKTKFYISMGYFYQEGIFRSGDLNYNKFNLRSNISTEIAKGIKFELGVSGISDERNTPYTSSQDIIRNYWRQGVLYPAYADPEGTMLNYNGLDMEQNTVAMMTADISGYKKYKQKYFQSSATLTADFGEYTPVLKGLTAKAMFSYDYRADNNEAFRKEYYQYAYDEQTGTYKQKVYNESSPSNMRREFYDKSQMLGQFTVNYDRTFNDVHHVGGVIGWEVQKRNGDNFYAVRDLAFSMPYLLAGVTEGQIGAMQTGNNDLYEQANEALIGRINYSFADRYLLEAQFRYDGSSKFAKGHQWGFFPSVSAGWRISEEPFFKSIDVLKFVNQLKLRASYGVLGDDGDLNYDWAMGYTYPSTSGNMANGDYNGYSPGYIFGGKFISAASPMALPNENITWFKSKTFDIGFDFEGWDGLLGVSFDYFNRLRTGRFARRTGALPTVVGATAPRENLDSDRQFGMELELTHRNKIGEVGYNLKGIATVTRQKYLTASEKGPWANSYDRWRNDNLTNRYQGVQFGYTSAGRYTSWNDIWNYYGFKERDVLPGDYKYEDWNGDGEINGQDEHPFAFDQTPWLQFSLNAGLQWKNFDFNMLLQGSALGSMEYKEPLHEIWGKNGGGALTQFLDRWHPVDPKADPYDPSTVWTSGHYAYTGRWAKNNSAFNRVSTAYLRLKSIELGYTFPKLKQIPNASLRVYANAYNLLTFTGVKFVDPEHPDDDLGRMYPLNKTYTLGVSLSF

SEQ ID NO: 8082 - protein, 767 aa, Bacteroides stercoris ATCC 43183
MPEIVVYGDNNKSLSSVKTLSSDEISKTPTSNGNITDYLRSNPHIRYENSDQNGFQRGEIKPENISINGADPNQTAYFVDNVNINNDLAIDNSIFDGSMQVVPGISHTQAYFFDATMLSKVEVQDSNISASLGGFMGGAVIAKTKQYSGTDSIKLKYRTTNSSWAKMEAGDSVQKILKQVRPDDSGAAELQPKYNKQTFNILAEKRLNDNLGMVLGYSRRTSSIEQNRLIGFDKDASNKAQLDKQNHQRLSDNLLLNFNWTPQEKERIEFGLRYSNYKELKYFKENIGNNVSDYHQALGATLAWVHSFDSGVWTNTLAYDRFKDKRKSSSNNVETTSVSNEDYEQLYNFEKGGHGNSRLTQDNLHFSTEYVMDPFYLASTEHSISIGGIYQATKYQFYRPQDVHSKIILSTLQSDGTMDSSDPIESTTSKGRVKTSYQNIAIYAEDLIKWRKFEFRPGIRIERDDYLKNNNIAPRFVASYRPWDNTGFTLGLNRYYGRSFASLKLANRILKINDDSTRKHQNFSSLKSPYADELSLSFDQNMGNLALKLGYIHRDNKNRIILKRETVRRIMKSSYINGRPFGVDIYTFQLNNIEPWKLGKTYWTTSLGFDWLNTKRADGEEFDLNKLVSLDGKLMTYREMLRQVNSNTEDWIARLGIDMTIPDYDITWSNKVYMKAPIRRYEELDGDNDDGISRFRSYHYGRHTQWDSSIRWQPTILGKHSVYLQVDILNVLNKTRKNKVATAISTSDEYGVYTPGREFWLEVGYQF

SEQ ID NO: 8083 - protein, 903 aa, Haemophilus parasuis 29755
MKNKLNLISLALLSLFAAQSYAEQAVQLNDVYVTGTKKKVHKKENEVTGLGKVVKTPDSLSKDQVLGMRDLTRYDPGISVVEQGRGATTGYSIRGVDRNRVGLALDGLPQIQSYVSQYSRSSSGAINEIEYENLRSIQISKGASSSEFGSGSLGGSVQFRTKEVSDIIKPGQSWGLDSKSAYSSKNQQWLNSLAFAGSHNGFDALVIYTHRDGKETKAHKDAESRSKSIQRVDLADNKPQDSNWFIVKNDCPSLNCEPRQKVGVSYDGQKYITEQLSAKEYTGEERALPDPLKYKSDSWLVKLGYTFSPKHYVAGTYEHSKQRYDTRDMTYTAYWQPSDLRITSETWYSMDNAKGLYRDNALDGVAINYYTDGVVKSSKGLRWAKARFIDEWHTRDRLGALYRYTNQDENRLIDSLSLSFDQQKIDLSTRLRENNCSEYPTVDKNCRATLDKLWSSTKNEQSSYEEKHDTIQLSLDKTVQTGLGKHQLNMLLGSDRFNSTLKRHQILSEYSVGTWDLVRDIDHRNGAYNKPYVYELKNQAIYSKNVCDYTGTIAGRADCATSKIKGHNHYIALRDNFAITKYLDIGLGYRFDKHKFRSTHRWANQGDYKNSAWNIGIVAKPTSFLSLSYRASSGFRVPSFQELFGLRYDGAMEGSSDAYQKTEKLSPEKSLNQEVAATFKGDFGIVEVSYFKNDYKQLIAPAERMHQTQSMINYFNVQDIKLDGINLIGKLDWNGIFDKIPEGIYTTLAYSKMRVKEVKNYQGYMNIRSPLLDTIQPARYVVGVGYDQPDEKWGVNLTMTHSSGKNPDELRGNEQVGFANYERTATKKRTRSWHTFDLTGYITPWKHTTVRAGVYNLMNYRYTTWESVRQSSLNAIHQHTNVKDYARYAAPGRNYVVSFEMKF

SEQ ID NO: 8084 - protein, 331 aa, Haemophilus parasuis 29755
MRLRTGIACSTCLTLLSAALPAAAQSSSVSIGGLIDGGIYRGFDGTAQAGTIQRSNLAIAGWEDLGGGLKATFRLSARFDIDTGRLEDQGSKPFWHDESTVGLQGGFGHLRLGRALSAMWSQDWKFDPWANFNRISSPAWYQWHYLTPTDRYSNNGTAEYGRMANGVFYDSPTVGGFTLHLSASPERTEVPLTLRREGRGYSASLNYDSDSLSGMLAFERNGSGDKDTFVAGKYRFGAAAVMAAWDYSRVAQTALSAKALTLGATYQMGQTTLKAGYGRQRMQEQTNHFYSLGADYALSKRTTLYASLGRKSYEYGADSGTSFGVGMAHAF

SEQ ID NO: 8085 - protein, 686 aa, Haemophilus parasuis 29755
MHLSSRSLSQLALATLCGLAAPRSRADDVVALARVVVTASPSEHPLVVFVDPKAPAQPIPAHDGAEALRSVPGFVQIRKAGTDGDPVFRGMAGSRLGILLDGETILGGCGNRMDPPTAYVFPSAYDKITVLKGPQTVLYGPGNSAGVVLFERTPVRYPEPGATLTGALTFGSFARNDQFVDVRAGAPLGYVQAAATRTTADDYRDGSGRAVPSHYERWSTHLAAGWTPDAQTTVELSGVVSDGEAAYADRAMDGTSFDRRNLGLRVRRSEISPWLVLLEASAFVNAVDHVMDNFSLRRFTPTAMMPGRAVSNPDRFTIGGRAAATLALGVDTRVVTGLDYQENRHRLRSTRDDPTDPFATKRRMRDASFDVTGLFAEVTHLLTPADRLVAGGRLDSWRAHDERTAVAVGMGTMPNPTAQLHRDASLTSGFLRYEHDLRAMTTAYVGVGHAERFPDYWELVSKESAGSVSAFRAAPEHTTQLDVGVTHRAGSLTASLALFASRIDDYILIQSNVAKPAAMGATRMATITRNVDAVTRGGEASVSYTLGGWRADASIAGVYGRNRTDDRPLAQQPPLETRLGLSYSTPRWSLGTLARWVDAQDRFARNQGNIVGQDLGPTAGFTVFSINAGWKLHEHAQLTAGVDNLTDKTYAEHLSRGGAMVAGFPPPTLRINEPGRTFWAKLQVSF

SEQ ID NO: 8086 - protein, 758 aa, Haemophilus parasuis 29755
MKRRLRAICLAPLGAALVLPAAAHAQSAQAGDAADSSAPSTAEIIVTATKQNTALSRVAAAVTAVTAADIGPGGVQNVGDLQVVVPNVSIGDQFGVNRTFIRGVGLNNFDVGGEGAVAFLQNGAILARPAQQLSGFFDLSQIEVLRGPQSILYGRGATAGAINLVTAAPTDEMDGYLRATYGNYDNRVLEGAIGGPLAGDRLMVRLAGKYEKRDGYGVNLFTGNPVDDRDAYSLRATVVAKLSDTFKATIVGDHFKEDDNNYAFHYFGPSVIPEAGLFHKFIGGKSIFDYYAARNEKPNLRNIYSDEEAINNRKGYGVTGTLDWDLGAASVKSITAYRTFDRFQRDDLDVSDVNLAGQNNYVEKSRAFSQEVTVNYEGDGFTLLGGAMYLHEKLTGQVLVPTVNLGVLFGLPADTFDDGAYEQNGLVKIDAVGVYLQGAVDLSPTIKLTAGARYNYEHRKGDGYFRFDALGVNIPTDKSKGWSSVTPKVLLEFKPTDRTLLYASVTKGFKSGVINIGSVDAAIDPETVWSYEAGFKQKLADNRVLLSGAVFYYDYKNLQVSFVNANSIVQTINAANARNYGGELELEGKITPQFSVNLNASYLNAQFTKFCNAYYGAAFPARSGISYPVCPTDSGLVDLSGKRLPNAPRFTVGGGFNWDIPLGNDSRLAVNGEIKWQSKVYFTEFNNRDAEQGSYAMANAGLTWHAPGDRFSIGGWVKNITNEFVIANNIITAATFAYVRVGSVMPPRTYGVTASVNF

SEQ ID NO: 8087 - protein, 1092 aa, Haemophilus parasuis 29755
MDLINPKRGKLILINTYIVMLLIVISSLPLYAQAGAGVERRVTLKYAKISAAALLNDLARQSGFDISFNSSEFEKLEVNHIEYKDVPLNSVLKDLERNTRLVFLVSSNHISASIDHKKVIQRQQTGRIAGKVVDDRGESLPGASVRILPLNKTMQSSVDGSYQFNVAEGTYSIEVSYISFQTKRVTDVVVKAGQLSKLDVVLKAAANALQQVTVTGSFKKESVAGLYAQQKNAASMTDGISSEQIARTPDNNVGAVLKRVSGVNTIDNKYVVVRGMAERYNQAMVDGIAVPSTDLNRRNFSFDVVPAELVSSVVVNKTATPDVSAQFSGGQVTVNTLAIPESNFMSVTAGTGGNTRSTGKDFLQVGGRGKYDYLAFDDGDRKQPKDIKYWVFPVRGIGNDNPEAYEPTALEQSKRFNPNGFRLYNETARPNQNYRFALGRLYDLNEHTKIGFVTGLTYRNAQETNDYRTTRGYGHVNVIDTDTAGVGKVSKFSSSLGGTINAGVQGEKYKISVRNLYTRMFTDDAYGVYKRQDDDLGSKQYSIIVDPVFTNILQNKLEGEHKLTEDGLLLDWNVARTSVGQDHKDLRRFTYGLTSVVDGQEIYQTPLLANSNNLGTGFDFDYRVWTHVKQTDYNWGLNLSRPFSFLKDKSLVKIGYAGWHKSREQNTLLVNLYSAYTGQFFDLYSPYEVVLAPENQGWAQNKGYYFANAENSGDQYKGSSKYHAAYLMLDQRFFQKLRIVYGVRAEHFDSRNDQLSELEKRRRFGEQFPGQPYTGTGLTETSERNWKYLPSANLTYSLTEKMNFRAAYSITMIRPDLRETATMAFVDPLLRGEISGSNLISTRIRNYDLRYEWYPKSGEIVSISGFYKDFDDPVELMKTNNLNKYYFTNQKSAYNLGVEMEFRKSLDFLGDQEWLNNLSLFGNATIMKSKVTIVGENVIQGEPGTAPTIEAFDLEIKRPLFGQSPYIVNAGISYNAKTFGVNASFNRSGYRTYTVEDEPNNIEYENGRNLVDLQLSKKLFKQKAELRLNISNLLDDASAFYINADGYDISEDRKQAIAKPGKSDKYDRSEGDIVTHRIKYGRTASLSFTYNF

SEQ ID NO: 8088 - protein, 363 aa, Haemophilus parasuis 29755
MKKTLVALAVAAAAVASTANAAVVYEQDGAKVELSGSFRTFLGKTGEGRSDLVNDGSRIIVKASQDLGNGLSAFAGYQIRFTEDGNATNVNKGSDSDFDNPSTRELYAGLAHQDVGRLAFGRQQTTADDVLQDATYYRSGAYNILTTRSDKSVKFKSAEWNGFSFGADYLFGHSNTDVDRYVGEYVEYKNGYGVTAFYHYDFAENHGLEFAAGYTQDNYDDIAYSNDSVGKNKAWLLHGSYTYGPFYLALNYGQYKNEVSDAYTEVVTGRRTDAGTKGRYAMVDARYQFSEPSAVFAQWERLDVRSEATGNTEEIANRYQVGVDYKLHKNVITYAMYERVNTKYDNAETDKDNIYGVGLRVFF

SEQ ID NO: 8089 - protein, 403 aa, Haemophilus parasuis 29755
MINNKLATLLSISILAAPAVSAVEVYKDDKNAVSIGGYIDVRAINTQNQTEIVNGASRINFAFKRQLKNDWEALALIEWGVNPVGNSDIVYNNRFESIQDEFLYNRLGYAGLSHDKYGQITIGKQWGSWFDVVYATNYSYVWDGNAAGVYTYNKDDGAVNGTGRGDKTLQYRNTYNDFEFSVQTQLKNSEFYTCDVSNITEAQCQTKWEAGDATAQKVEFNYTFGGAVTYNVTNMLTLTAGINRGEFDLHFGDGTTRSVEDIIYGAGIIWGNINAPGLYAAANINKNENHDTDNLGRLIKEAVGIETFVSYRFDNDFRPFIAYNLFDAGDDYVIQPNFNADPNDVFKRQFAVIGVHYLLDDNTQLYIEARKDFGDFESANKEQQALMEQSEDDGIAIGFRYIL

SEQ ID NO: 8090 - protein, 704 aa, Haemophilus parasuis 29755
MNPSKRVLKLSLLVFLLSTGINAQELNDKAIQMQKVVVSATGFEQDADNNLRNVIVIDGKDLEKRGFNTLEQALERISGISFVNFGLGRNIDMRGQGSKSNIAVKVMVNGNAINVLDNSHGVTPLESVNLNNIERIEIIPGGGSVLYGSGTRGGVINIITKKEKSDAFALSLKGSSYDHGNLGGNLGVYGAKKINDYLTFGFDIQGFNRDGYQEGYNEKGYFVNTKAYLNTSDNSDLSLNYNYFESKNTSSGYLTKAQIQSDPTQKGSGDNITQINRPEIALDYHHYFSDLYEIQLGAFWQNQKIRYLKDEIPMMGTIAYQTGSGFEDTLTGINLKNKINYKDDSYFIFGYEFANHDAKRTSIVHYNVNTPTFQMSHTMTTLMDMNKQSHSVFALDSHQFNDIFSISGGARYEYSLYDTHRSYTSKMIMGGTQRPSNPELFDADDTSNNFAFEITPNFKYSDTGNIYAKYERGFISPTPAQLVNKDQATQKYYTANLDPEIFDTFELGINDFWWDFYGFNLTLFYTLSKDEISYLGNPHSTGGAFWKYYNIDQTRRLGAELNLHQFLFNDSLILKESLSYLDAQISKGVNDGLRIPYVSKIKATAGVEYAWNKNLSSYIDLSYFSRAKDGGVVDENTGKMSRNSWIKDYFLTDIGVNYNYRNLQILAGIRNLFDKQYYTYQDSTNDQYLAGNGRNYYVEFKYAF

SEQ ID NO: 8091 - protein, 916 aa, Haemophilus parasuis 29755
MKKFLFIIFIIFSQIAISQDKGILKGLLTDKEANNETLPFANVFVKGTNIGATTDFDGNYSFQVPEGTHIVSFSFLGYKTVEKTFTIASGQTIILNQIMSAEEGVALDEIVIKTSIGKESANALLLEQKKASVIIESIGAQTLAKVGVSNAANATTKIAGVTKSEGSGSIYIRGLGDRYLATTMNGLPIPSDDVENKNINLNLFSTNIIENVGISKTYSTGGYADQASGKVNINSKEYSKKGVSISMSGGANTNVAGLSDDFRTTITNQDVTIGFHQKQFALQNLITLQGWDTETLATPINFNGSFSAAKKFEFFGKEVAVFFAGSHAKTFEYQKGVFRAYRSNVLDREFTDVEQYASNANTTGYINVRLKLNDSNNIKYNTLFVNTGVDNLYEQGRNGLGYVFDQDPQETGAFVRDQNFRQTTLFVNQLLGEHKWSENNTANWAGGFNFVLAEEPNRIRNEVNILEVATAPEIQYAHVGDFQQRKSSQKIQDTEYNATFENKWALGAKNENDEKPFSLNYGVNYRHKERTFKSLFVGVKSKDYRAASVDELSSTFTATNFNNGLTLRLREADRYEATLDIMASFINFDFQIKDKFSGTLGFRFERDEINVVWDVANFVGRLGTLNRTYESLYPSVNLKYELAQNNYLRFAASITQTLPEFKELAPFEYVSPTGRVTKGNPDLQKSEIYNFDLKYELFPQRGQLFSLAGFYKQINDPINLSQTRGSSGYFIYSNTGEKANVYGVEFEAKTDLLKNSEDESIFNITGNITKMWLEQDLLADFQYKDITKSSLQGASDFIANTSLSYSNQKQKELTATVTGNYSSDKIFALGSPEDFANSAALYNDEIIEKGFVSLDFVVRKKLSENILLKFVGRNLLNPEIRQTQKVRNLITNIETNETVSAYHKGSQLTFSIKYTF

SEQ ID NO: 8092 - protein, 767 aa, Haemophilus parasuis 29755
MNKFQLLPMTLAVSAAFTTTAFAAVSQPKVVLAGDTVVSDRQGAKIKTNVVTLREKDESTATDLRGLLQDEPAIGFGGGNGTSQFVSIRGMGHNAIDLKIDNAYQDGQLHYHQGRFMLDPQMVKVVSVQKGAGFASAGIGATNGAIVTKTLDADELLRNSDKDYGFKVGAGLSTNKGHSYHGSAFGKAQTGFGQVDALVSYNQVNDSDYKGGKGYTNLLGNDVVTRSALDKSSYLVKAGLTAGDHRFVVSHLNEVHKGIRGVREEFDFANRALTIDIEKKGKIRTEAELLAELNKDYPGQGYKLGKKINDKDNKVVGYHVVDANGRQVPNLNRNNPTQRETYQKLTNLEWTAKNLGFANEVTANVYKLEHGRNSSSDQGNTYITKDVPKEIIDNVDTPSNMHVVATGANINFDKEFNHSPLKGFGVDHTLLKYGINYRHQKAVPPRSLKPGVVHQEKTDAGIYLEAVNQINDFTINTGVRVDRFDFKALGGKKVGKTDINPSFGVIYDVNPNLSVSGNLIYATRSPRFVDAILSRGYRGGVISIDDNAKAEKARNTEIGFNYNNGPYTAFGSYFWQRVDNARATADITRHGTTDANGKSIKVPALGNQGHQTNQGYELGVGYTEGAWRARAGVAYSKPTMHNVTLDGNPEYAVRTGRTWTADVAYRLPNPSVELGVRHTLVEGVDAKDTSILSGKFDDKDGAILNREGYNVSDIYANWKPYGNDKVNVNFAVNNVFNKNYRPHTQRASIDTLPGAGRDFRVGVNFTY

SEQ ID NO: 8093 - protein, 551 aa, Haemophilus parasuis 29755
MKKVQYIFGALALIAFPNWAQAQTQAKDTTLSRTVVVEQEYNPDIMDASKVNVLPQVAPPTVSKKAVEYDARLVPEGNIPASTMQVYTGAESQDKAQRGYARLGYGNYGNLDARANYLFILPNSDKLNLNFHMNGMDGKLKVPDFAEKWDARYYRTRVGMDYVHAFRKVDLNVAGNFGLSNFNFMPYSINNKQKFLSGDVHFGVKSTSEDLPFQFHAETNLMFYERQYDLSQKDGQEAMVRTKAGAVGSISEEQSVGVDLAMDNVFYKNNLFDDYTSVELNPYYLYQNDDWKIRLGAHVDFAFGFGKKFRVSPDVTAQYIFSDSYILYAQATGGRRTNDFRRLETVSPYGQSEMQLDATYEQLNAALGFKTSPVTGLWFNLYGGYQDLKNNLASVGVSSYFVDTNNQSYLQLFQRNMHNIYAGAEVSYSYKDILSFSASGVYRDWKVAKVEEDNGDWLLAYMPSFEANIHADIRPISSVLISLGYQHITRETIENERVDPVGNLYLGGSYEVFKGISIYARVNNLLNKDYQYYWGYPTEGINFVGGVSFRF

SEQ ID NO: 8094 - protein, 390 aa, Haemophilus parasuis 29755
MKKSLIALAVLGAIAGAAQAQSSVTIYGIVDTGIVYTSKALTSTGGTGSKFSINSGIIQGSRLGFKGVEDLGGGLKALFQLEAGFNNDTGGLQGDKGTTTLFRRKSVVGLGGNFGSVLLGRQTDILDDVSQWTSVQDFGGVTGSVGHNLDRLEGTRTNNSIRYNTPDVSGFTGSLIYGFGETAGQTSAGQSFGAGAQYANGPLGLFAAYYQSKLGSPTASDTSLINGSQVANFSGKSGDTALKTFSIGASYQAGPARLYGNWSRTKQPLATSSNSATTGILQPGSFTVGSFNNTKADIFELGVNYAVTAPLHLLASVQYNKLTFADAGADKGKLTQFNLGTDYFLSKRTDLYAFVSNLRAKDAVNPGVYGDSLGDTGNQTAVAVGIRHKF

SEQ ID NO: 8095 - protein, 161 aa, Haemophilus parasuis 29755
NGEVLPFKTKIDGVTYKSGKDNNSPLKASFLAGGGAFGYKMDDIRVDVEGLYSRLSKDADVVGTSPAVVESLTAFSGLVNVYYDIAIEDMPITPYVGVGVGAACVSNPLVTEVTGDKKFGFGFAYQAKAGVSYDVTPEIKLYAGARYFGSYGANFDQSAKD

SEQ ID NO: 8096 - protein, 386 aa, Herbaspirillum seropedicae
MKKSLLALALLGAFTVSAHAQSSVTLYGLIDTGLVYTNNQMGHSNWQLLSSSTQNTVFGLKGTEDLGGGLHAVFKIEQGFLLNNGAQAFAGDAFGSQAWVGLQSDPYGTLTFGRQFDVMNDLVGPLTAEFNTWGGSMAAHPFENDNLAANSVVVNNTVKYTSPTYRGVTFATMYGFSNKAGDFANNRSYGFGLSYAMGPLNLAAGYLQFNNAGNSSGAITSSDASANFIAERQRIWSLGGNYTFGPATVGLVWSHTQIDNASGVFSFGTGTYLGANDSSAGTLAGSLRLDNYEVNAKYALTPALSVSGAYTYTHGAYNGSAPGWNTAMLQTDYAVSKRTDFYLEGVYQNVHGAPADSVLSHAMINTLSPSSTDSQVAVTVGMRHTF

SEQ ID NO: 8097 - protein, 434 aa, Herbaspirillum seropedicae
MKKIVSSMLTCAAVLTMATTAVAGEREGAFSISPFVGGYTFDGEQHLETAPVFGLRLGYDLTKNWEVEAVADYLATEGTRNDRSVNALSYRLDVLYNFLPDGPLVPYLAVGGGGITYGHGRDGLEVSDRTTDATINAGGGIKYFVTDSVALRADARQLFVLESPDKPKYNWEYTAGLTFLFGDKAAPAPVKAPAPAPAPKPVVEPVPVQKPVPAPVVAPVPPPAPPAPSADMTVTPGSITKGEAAILTWKSSNATNCEIQPEVGSVKPQGTVKVVPADNTEYTITCNGAGGTANSAAKVAVIAPAPVVVAPPAPAPKLCSPAVINIQFDTNKADLKPQYRPELKALADFLNEFPNATGVIEGHTDNVGPKALNMKLSQSRADTIRNSLIKEFGIAPERIKAVGYGPTKPVASNKDKAGKAKNRRIESNFNCNNK

SEQ ID NO: 8098 - protein, 359 aa, Yersinia enterocolitica
MEGGWKVSRKGAAIAVAGSLMGGVAHAQSNITLYGIVDAGLLYTSKTAGANGQNLGHQFSAVDSGSLPSQFGLTGTEDLGGGMKASFKLESGINMRNGGFDDSNGNLFGRQAYVALENQFGKVAIGLQFSPFFLSLLDTDPRGFSQLGSGLIIYADTVTGTGAFNSNAVSYTSPTIAGLQGKAMLALGGAAGNFQAGRQYSASLKYTVGNLLISGGIYSGNSGGTVSTPIPTTVAFWGRAIGATYNFGVVTAKAQFVNYKVAQSYDSNVYSAGLDSYVTPQLNLNGGIYFTSDRNHTANHSIMGAAGATYNLSKSTALYAQVAVVNNHGTMNTGISADGALYGAQGTTVGADIGIRHFF

SEQ ID NO: 8099 - protein, 700 aa, Xanthomonas campestris pv. campestris
MPAKRPPARTRSASRRSAPPPPSRADRAPEASSPGVAPAFAGGQVALGGRVGLLGNVPTMKSPFNVASYTDNLIRDRQAATAADALILDPSVRSTHPGGGVLDSFNIRGFPIGEGNSGEFAFEGLYGIAPTYRLFTDYIERIEVLKGPSAALSGAAPNGGVGGVINVVPKRAGEDLTRFTLDYGSTARFGGQWDVARRYGAGREWGVRASGSLRGGDTPIDRQSETTGVGSLALDYQGQRYRSWLYLLAQTDRFDAPVRPFLMAPGVQVPKAPDGKLNVTQPWEWSRIDDKSVLWRNEYDLSNQVTLFGDIGGSRTDVSRFFGLPTIINARGDTTSTPQFFGLNIDRYTYDGGFRARFDTGIVHHALTVQASVYHDELYRRLTNGTLVTSNIYSPSLGATQFVNDMPGRPRLSDSTLTGVSVADTLSVLDERVLLTLGVRRQGIEANNYLSNVGTLTSSYDKSATTPVVGLVIRPLEHLSLYANYIEGLSRGDVAPQQASNFGEVLAPYVARQYEAGIKVDFGRLATTLSGFEISKASGELFAGRFAATAEQRVRGIELNVAGELTQSVRVLGGLAILDGTLTKSAVASNVGHTPIGVPNLQANLGLEWDLPWVAGLTLNGAVIYTGKQFIDAGNSQSIPDWARLDLGARYTTMINGKKTVLRANIQNVTGESYWSSVASFGTFFLGAPRTYLLSMSVDM

SEQ ID NO: 8100 - protein, 446 aa, Xanthomonas campestris pv. campestris
MSTASTLSRATLLAVGIAGVLAVGQAHGAAFQLKENSAKGLGRAFAGSGSAPDDASIIANNPAGMRQLDGRLFQADVSAISFSAKYQGEGGSYANGAPISGGNGGDAGMIAPVPAAYFHVPFGENNNMHLGTSLTVPFGFKTEYDRDWTGRYHGTKTELQAIDFNVAFSYDVNPYVSFGASVFAERLDIDLGNAVDFGSILAARRAPGFAPGSADGYSRIKGDSTEVGFTLGGLFSIDENTHIGFSYRSEVEHKITDGDADFTVPGNAAAALGFAAPGTFIDTKGRATVTLPASATASFTHNVNEQWSIMADVTRTAWSKFDQVTVDFASNQPNSVLDFSYRDTTFASIGADYRMSETLTLRGGVAYDQTPTTAEHRDVRVPDASRKWVSLGLSWRPSQQAEYNFGYTHLFTSDPTSDTTTATGNALAGSYKVHGDVLAASINYKF

SEQ ID NO: 8101 - protein, 676 aa, Xanthomonas campestris pv. campestris
MLRSTSDRFRWSSLSLAIACTLPLATQAADTTTTQTSSKKHSTDTMVVTATGNERSSFEAPMMVTVIEGNAPTSQTAATAADMLRQVPGLTVTGSGRTNGQDVVMRGYGKQGVLTLVDGVRQGTDTGHLNSTFLDPALVKRIEIVRGPAALLYGSGALGGVIAYETVDAADMLQPGQNSGYRVYSSAATGDHSFGLGASAFGRTDDLDGILSFGTRDIGNIRQSNGFNAPNDETISNVLAKGTWQIDSIQSLSANLRYYNNSAIEPKNPQTSAPSSTNVMTNRSTIQRDAQLRYNIKPLDQEWLNATAQVYYSEVEINARPQGSAEEGREQTTEGVKLENRTRLFIESPASHLLTYGTETYKQEQTPGGATESFPQAKIRFSSGWLQDEITLRDLPVSILAGTRYDNYSGSSDGYADVDADKWSSRGAISITPTDWLMLFGSYAQAFRAPTMGEMYNDSKHFAIPIRPGLTLTNYWVPNPNLKPETNETQEYGFGLRFSDLLMAEDDLQFKVSYFDTKAKDYISTRVDMQAMTTTSVNIDQAKIWGWDASMSYKTALFNWDLAYNRTRGKNQNTDEWLDTINPDTVTSIVDVPVANSGFSVGWIGTFANRSSRVSSSTPQAGYGVNDFYVSYKGQEAFKGMTTTMLLGNVFEKEYYTPQGIPQDGRNVKFFVSYQW

SEQ ID NO: 8102 - protein, 922 aa, Xanthomonas campestris pv. campestris
MQFRTTNRKTPVTLLALSIGLALSGHAAAQDAAQTPAEPAVDLDTVTVTGYRASVEKALDIKRGEAGVVDAIVAEDIGKFPDLNLAESLQRIPGVVITREAGEGRAISVRGLGPEFTRVRINGMEALTTVGAGDQSGGTNRGRGFDFNVFASDLFSQLIARKTASADVEEGSLGATVDLRTARPFDYSGFTFAASGQAGYNAMAEKANPRVAALISNTWADNTFGALLSVAYTEREVLEEGSNTGRWANGPSNGGFSATSPFAAARSADVYHPRFPRYTQQIHDQQRLGVTGSLQWKPSDRTTLSLDMLYSKIDAKRDEHYIEAISFSRGGNARPVLVGKPATVVRNGEIRNNALVYGEFDNVDIRTENRHDEWNTEFKQISFDVEHRFSDDFSMNARIGTSRSAHENPVQTTIIMDKYDVDGYSYDYRGNNRAPVLNYGINPTDPTGWELAEIRLRPQTVDNDFDTGQIDFNWNISPGFRLKGGVLAKNYTFSTVELRRANELSVPTFANGTRIVPADLTEQAGLKGINGSPAAWVVPNLDAVADQFGIYSNSGTFAVAPRVNNSRSVEEKDRGVWLMGEFSTDLGSIPFSGNFGVRYVRTEQESTGYALINNAPALTTVGRKYNNTLPSFNLVAELAPDLLLRLGAAKVMSRPGLGSLTPGVTVAVAGGARTVAGGNPDLDPIEATNVDLGLEWYFNEGAMVGVGLFYKDIESFIQTAREVRPYSSSGLPASLLEGTGASVNDDFAFSIPLNTPGGELKGVEANYVQPFTFLPGKWANLGVQLNYTWVDSQIQYLASSGAPVMKNDLLGLSRSSWNATLFYEGDTFAGRISATNRDDYLTQAPGAEAGFNVDGVHGMTGTTILDASLRYKISKQLELSLEGINLTNEASDEWVSSPRTGQLPLQYGETGRQYLLGLRYKF

SEQ ID NO: 8103 - protein, 1066 aa, Xanthomonas campestris pv. campestris
MQARSCRPAQEAGARLSAARLSVAIVLALHGVGAAAQTVGPPATPADAVDLDRVQVKATYRESLQQSLDAKRYSVEQVDAIYAEDIGKFPDLNLAESMQRIAGVSIDREGGEGKQISVRGLGSDFTRVRINGLEALATAGSGSDGVNRSRGFDFNTFASELFSRVTISKTQSAQTDEGSLGATVDLRGSRPFDFDGFEAAASTQYGYNDLSREQDPRFSGLISNIWADGRFGALMSVSYSERHLREEGYNPVRWEHGNYRNSNQSTATNNGTYGFCSPVGYNPQTPRNPLSNETRAGVGSQANQDRNNGWGSYGISATTCGTGIARPANTPENIQAYETATDAWIPRYPRYIRTDHEIKRLGVTGALQFKVSDDTLLNFDMLYSKLDKDQREDSVGANLHRTANFGGKTQIAVREAQVDEQNRLVYGVFDNVDYRTESSSIEESTEFKQFSLDLQHRFNDQVRMTALVGHSTSDYERPVFSLVSFDNTNLDGFVLDRRGGGDYPSMTFPFNAADANNWQWLGYGAVPVNSNGTARGTNISEVRLNPQSVSNTFDTAKVDLEFNISPTFTFRTGLAYKDYDMETSESRHVSYGRLAQGLPAGVGVGDLSTTLDGFGRSLNGNFPTSWVIPDFQKVADLLNINCNCDTGVPGGDYRLADVGHFGSSNNNFQVNEKSLGTYLQLDFNTDLWGRALRGNLGVRYVQTQIAASGYAPCTATASGAISPACESFFGVASATAAAGERLLVPTTVNHNYRDILPSLNLSWDVSDEVVLRFGAAKTMARPTLAYLSPSVSGGPTQFFDDGRFFSINLGNPKLDPFRSTNYDLSAEWYFREGSLLSAAVFYKDIDSYVQRTRVLTTWEAMGYSLDLLPAGFTPDTIFNVQSYFNTPGGPLKGFELTYQQAFDFLPGFWRNFGIQLNYTQVDSKINYLFSTAGNSNTSITTTTTERDLLNLSPQSYNATVYYDDGRFSARVSTSYRDGYINNILAQEDVYNLDGQRLATADVTGKYSVENVDFNMSYKISDHLSLTFEAINLLDTPDRRYVDSALELPDKYTVTGRQYYVGARYKF

SEQ ID NO: 8104 - protein, 729 aa, Xanthomonas campestris pv. campestris
MGLPAKGPVQVSRIQEPHRMPPHHPRLPLSLLSLGLALQCPSVLAEDSVMLAPLQVSDTYANDGYQARQAAVGGFQPAPLLDTPASVSVFSQQLLEDRQVRKLSEVLQSDASVGESYAPIGYYENFNVRGFELNAASSYRINGQTIAGEQNVALENKQQVELLKGLSGLQTGVSEPGGLINYVTKRAEDIRSVTVSTNEQGERYLATDLGGWFGSEKQFGLRANLAHEDIRTYVDHADGKRDFASLAFDWQINPDATLQLDAEYQHREQASVPGYQLLGGTDVPHGIDPEDRLAYQHWAKPVQNDSLNLGGRFEYRFNDTWTGTVSASRSKVVIDDYSAFAWGSSEGAFFGSNGDYDIYDFRSPDDTRRTDEAQAMLNGHFDALGVGHELTVGTSAQRRTLDQRPYYNEWLGTGNIHTGAPDLEPSDKPVGASERRLDSRQYGLFVSDRISLNEQWQTVLGAREVRLDEKTWDENGVAGRHTRQYELLPNAALIYKPQPNTTVYASYAKGLSAGGTAPWFASNAAEILAPTTSRQLELGVKHDWQGLSLSAALFQIRQAYQYARPDGTGNFTYVQQGQQKNTGLELGASGRVTPNLQVQASAAAIRARVQNSGTEAYEGHQAINVPKFRAALHAEYTLPVPGLALLGGARYSASKYASQAGNVEVGGYTVFDLGSRYSTRVAGYDTVLRLTVDNVLDKRYWRDVGDYLGDNYLFQGAPRTARLSASISF

SEQ ID NO: 8105 - protein, 548 aa, Xanthomonas campestris pv. campestris
MPAMPTTDIRIASGLRRAPLCLCLSLALASTLAGPALAQQTTASPPARAADDGIFSLDRMIVTGAGQAQSQFEASYAITSMTAEQIDKLAPLNLTSLIGSMPGIYAESTGGEVQNVYRIRGIPDEGSFAVIQEDGISPYPDNNGYFYKTEGLVRPDVMVESVETVRGGPSPIFASNAAAIVNFVTRQGGDTPEGAVRTTVGDTGLYRLDGYWSGKLAQDWYLAAGGFVRRNDGYRDVGFPADEGGQFRMNLTHTLDHGKITFTAKHLDDKNAFYMPIPLYDPRDTTRSLDPLIDRFTGTLSAPQLQHATLISSDANGQPQREARDLSDGRHMKFNHLGANLDLAFDNGWSLSNKAVVNRLDMTFDALYSSNAPQDATAYANSRRAAASAAFPGLSRLGYVYTDDGSRFDPASTDGLVIQGQYRAMDVRADSIADDLRLHRSFDWGGDTHDITLGLYGAYYARSYNSRYQSYLFEMRQNPRSIDLLGYDANGAVVGGVTQDGVVIYGADRTQGKAYTSMLAPYIADTWQVTDKLRLEGGVRHERYRYRA

SEQ ID NO: 8106 - protein, 292 aa, Xanthomonas campestris pv. campestris
MKKRNLATALCALSGSGSTLAAELELYVDRKTKQIFAEPAPGRDKLGTFVQVDENGKLPASAMPAAPARPLPPAPGAATPADTAIAQATPAAAAPVAAPAPAKSGDTANKWYDKLCLRGYTQIRYNQGIGGDAQDLRAPGDRFIGDDQSLGIRRARLVLSGDLNEHVSLYFQPDFASTPTGSTTSNFAQLRDAYADIFFNKKREYRVRVGQSKMPYGWENLQSSQNRLSLDRADALNSGLRDERDIGAVFFTGPPWPRAGSRTWSSGIEGFGRLRRDRCRCVQWPGRQPRRA

SEQ ID NO: 8107 - protein, 699 aa, Xanthomonas campestris pv. campestris
MSALRRIAPQKSPMTPLPTRRHLLFVSLFAAMPAAAQEASLLDAIVVSEKRALYRPEKAAGATRTQTPVERIPQAIQVVPRSVIDEQQLTRLVDVVANVSNVQPGGTQGNRSETFVIRGFEASSYAVDGILLNPTQNFTETVRDLANVAQVEVLKGPAAVLYGRGEPGGVINLVTLRPDAVFGGNASVQVAEHGLRRVQSSVTGPLSPTLSARLSAAVQQTGSFRDAQADGDRVFVSPSLAWRPNERLRADLDIEYTRQTSPGDRGLVAIDGVVRGPAQRSFGEPWSRNRGISRTARGRIEVDATDWLTLRQIVNHQDGDSGRGVADFTGFSADRAFLQRRAVRQDQQVRATTSQTEALARFDTGPLRHQVLAGAEYVDAHRHTDEARAPLARISVRTPVQGALPGTYVPAREIAVDARYAALYVQDQISLGERWDVLAGVRWDDVQQTTLDNGSRTREDGRRASPRLGVVWKAAPQLSLYANTSTSFRPRSASVFAGGSAPPETGRQYELGMKSALLDNRVLATVAAFQITKDNVATADPNNDGFVLVTGQQRVRGLELDVTGELTPNWRLILGAGYLDAQVTRDTVIASGNRLRGVPRVSASLWSTYHVASGPLYGLTLGAGAVHVGEREGDLANSYRIPGYTRFDASAAYRFGGRYQLALLLRNLGNRFYIEQPVTQTTNYPGAPRTLSATLSMEF

SEQ ID NO: 8108 - protein, 774 aa, Xanthomonas campestris pv. campestris
MNKQRFTQSLIAGAVASVLCYQPALMAQEADNATQAEKKGLERIEVTARKTVESLQEVPISVTSLGAVELDEKGISVITEIQQFSPNTTLQNSRGTNSTLTAFIRGVGQQDPLWGYEPGVGIYIDDVYVARPQGAVLDLLDVERIEVLRGPQGTLYGKNTIGGAIKYVTKPMSGDPTLNIQGTVGSYSQRDIKLTGQFPVIEDKLYVGFGIADLTRDGYGEYLESALEGQDLENYNKDLTAARVTVEFTPSDDLFFRFAWDKTEDDSNAKGGYRLLPSRLTDAPVPNSVFDSYTSLPTENNVELEGYSLTANWDVNDDISLKYIGAHRESYSPTNIDFDNTAIDIFDVPAIYEDENDTHELQLAYAGDGFNAVGGIYYYDGESCGQFEAILGFLGRAAFGVPGLTREVSGCNNSESIAAYVQSSIDVTEQLSLTLGARYTDEEKQATVRNGLIFDNVYPESNWIPGYVRPEGEIVPQVLGSDSDGDGILDAPAKESWSRFTPRVGVEYQVDNDLMFFASYSQGFKSGTYNPRATINEPAVDPEVVDSFELGMKSDWNDNLRANVTLFALEHNDRQYISVLPVTSPEDLQQILGNVGKSKAKGVEAEITYAATDELTFDVSLGYIDAEFEEVFQETLEGRVDVADTFAISNTPEYTANFAANYLLSTDMGDFVFNANYYYRDDYTITETSNSLITQDGYGLVNLSVSWQSEDGNWYGGIHAKNLTDEEYVVGGYQFVVENPDDPTGYTAGTGGDNTLIGYYGDPRTISLTVGYRF

SEQ ID NO: 8109 - protein, 976 aa, Xanthomonas campestris pv. campestris
MTDSRCHRPRVLSQALLLAMLSPFPALAQQADPQQLDAVTVTGSRIKRVQAEGPAPVQIIGSEEIRAQGFTTVYDMLGTLNQAIGTVEADVSWGSHTPNASPLNLRNLGPNRSLLLVNGRRVADYPLPYNGQSNVSNYSNIPAAAVDRVEVLTGGASAIYGSDAIAGVVNVILKQNYSGDQFRMRGGTSTEGGRDTADVSWAGGRTGDNWSVTYALQYTSRDPLFGRDRPQMDDASDAPYSAWTTEQRRVGFRPSSGIALIDNATGTRQAPPPGACEQFGGAYYRADRLLYNRNTDTTTNTGQLCGLSADYGDWLLRSGSKDLSGYLYGTWEFGNGVQAWTNLAVFDSEAQWGTSPPYVQLPAGLDYPAFHDVTSGQQLIGVRQFTANEVGSQAGLRNRNRERSWDISAGLRGTLADGRFDWDASLGRSYYRVQERISTVDWQRANDYFLGPQLGTVDGLPAYALDRARWWTPLTPGQYAQIGAHSVNRAASWVNQGALSLSGTLFDGWAGPIEFAAVVEAAQQGYRLNPDPRANLDYEVQNVDRGGGERTRYSGGLEFSVPLTTTLTATLAGRYDRYGDYEAFNDDANLLDIGTQKESTWSAGLQWRPIDSLLLRGSYATSFRAPDMHYLLGQPSSAQVRTLDQYRCIASGAYQTNNCTGDNTAVTYPFAINRRGTPDLESELGDSWTVGFVWDAFENFSFTADYWRIHLDEEIRDIDETTILRDEAGCRTGLTITPGQAWSNPGGADYCASILARVQRDGSGAITAIERGPINLAQRDVSGIDLSARYQLKTGFGDFQMGLDYTNLRSMREQTYRTDPNPERRDRDIRSKLRGSVSWLYGNWNATVYGDRVGAVPSVRSHWGLDRLDNPGGCVPFADGGVPDDRANCTDTDPNSPTFGQSTRKYFGRVGPAITWNVNVGYRITPAMKLNLYINNVFNSTGYNHKDPYKLDYEFYNSRLFSPVGREIAAEYVFDF

SEQ ID NO: 8110 - protein, 783 aa, Xanthomonas campestris pv. campestris
MPPSFDSSPTPLMPKTHLLSAAVLTALVLSPAVRAADTPAEAGADASAATGTVQQLDAVSVIGQGETRQVQRITQQDIPVLPPGTSIQKLLNRMPGVNVQSNDAFGANEESQTISLRGFNGTRLGYTLDGLPLGDNAYGNYNGLNISRALIAENFGGVELASGIGALGTASTSNLGGTIQYYSADPSSVFGGQLSQTVGSDANRRTFLRIDTGDYNGFSAYVSGINAEADMWARPESPTTTRQFNAKGVYQFDGGKLTAFADTSRTSQADYSYLSKSGMARGLGWDWNLYAPDWNRALAAAYCAPATRNAARCSFSGGVDNVDDAYYQSRALRDDDLFYVAGDFQPNDAISLHTQVYHHENKGQGHWWSPGQASNPGTPQALPISIRSTNYWINRTGGIASLGWDLGPHHLEAGLWYERNHHDVERNFYWIDGPVSDDKFLQDPDRRLFSQNYIITTRQFYVQGNFKFLDDRLSVDLGIKSPSTEMTARETPGIAVEAPVATGSIKASESVLPQIGLGYRLAEGQEVFASYAENIAAFQGGGAGGPLLVTQASFDASVGALEPEKSRTLEAGYRFVRDRFEASLVGYDVTFDNRLLSLNPCASIQQGTTPACTTRFFNVGSVSSRGGELTVIWKPTSYLQWYNSASINRSTYDDNYVQNGVTIATAGKTTVDTPKRMLASEIAFNYAGWNVNLRGKYTGERFYTYTNDQGFGGYTSFDAGAGYEFGQVSMLQSLKLSLNVTNLTDKRYASNLTAFANSDPNGRQLAFHASAPRQVFLTLDAKF

SEQ ID NO: 8111 - protein, 245 aa, Xanthomonas campestris pv. campestris
MLCQGLQGNQGTHWAHIFNVQCFQTMTTTLSPRRKTLVSSICMALTAATIGALSAPAVAADEQQSNWMIRLRGTFLNMDNKSDPVGGVGASDRISVNNKWIPELDVTYFIVPNIAAELVLTIPQKQDVRLDGAKIGTFSHLPPSLLLQYHFIPNGTFRPYVGAGVNVTRIWGADIAGNTLGLDRWSVGPALQVGMDYKVTKNWFLNVDVKKIWISSNVYANGTGQKVSNVQLNPWLFSAGVGYRF

SEQ ID NO: 8112 - protein, 418 aa, Xanthomonas campestris pv. campestris
MHSFMKPSLVALLVLSSQAQGAGFQLAEQSATGMGRAFAGEAAIADNASVLSRNAAAMTRFDTVAFSGGFIYVRPDVNIEGTTRVPTAMGPVNLDAAAHDIAGDAWVPNAYLIVPLNEQWRLGLAATSYYGLGVEMPDNYNAGHFGNISDIKTLDLSASLAYRINQMWSVGGGLSAIQGEGEVGGTFPSNNKIAKHLKGDGWAMGWHLGTLLELSETTRLGLSYRHDVTLTLSGDAIGIEQNGQAFTDTGSLDLPLPATAELALFHQLTPTLALHSSINWTNWSKFVQLESELDNHGIMHIKDEHWEDSWRYALGLTYQLAPQWQLRSGIAYDRSPVPADRRTISIPDSDRVWYSAGVGYQVDRNLSLDLGLTLIDGKKVDVSETMELKPGIPQTTSTFQGTSEGDAWLAGLQLNYLF

SEQ ID NO: 8113 - protein, 937 aa, Xanthomonas campestris pv. campestris
MLRSNLLANSVRLALVGGAAAVALTAPMAFAAEDGAKVERIEVTGSRIKRTDMETTVPITVLSREDIAQTGAINVADILNSSPVTIAGSDQSNSAFTTSTVGLNTTSLRNLGDSRTLVLVNGRRFVSGVDPSSGYAVDLNAIPTSMIERIEILKSASSAIYGSDAVAGVVNIITRKDFEGVELSAQTGISGESDRNTKTISLTSGKTWSGGNAWISLGYDDDEGIKATDRDFSKQDLAVFLDENGNEYAGPLNSSFAPQGKIGKYNGDGSLYSGATGSFNRASYRQLVTPLERKYAAAGLNMELSDNVSMFTELNWNTTKTKDSTIEPTPLDVVNDVWLKNRNGKGGMDINSPLIPDALRNALIADGITNLNQTTFTRRLVEFGARSTDLERNTVRVATGIDWAIDDTWASQTYFTWGRTDQLQDNGGQVNKERAALALDVIRDANGDLVCANELARLQGCVPLDLFGAGTVSDEAVKYVISPAKATGQAEQFVLGSSVTGALPIALPGGDVGVAMGLEYREERGVYSPGDLAQTGASSTNQSDPTDGTLYSKDVYVEAILPVLENLEFDLAARFADHSVTGGDWTWNAGLEYTPFDSFKVRASAATAIRTPNISDLYGGRGETFATVSDPCNGVTATTTGDAAANCRSIQAISDRIAADGAFNLTQAERQGTGGTQGGNPNVKAETADTWSAGIVWQVIDNLAFTLDYYDISVKDAISTTSRTTVLNRCFDVNPSNFSQNCNGNAIRDLNGALIEVHSGTSNENNIDTSGIDAEINYTRDIGPGSFKAQLIWNYTNEYVVTGILSGESIDYVGEVLYPEHRANLNLSYALNEMSFAWRMRYWDSVVDSIDGSNGNFTDGEVLTKFNQIDAVLYHDINASYAFSNGWEAMIGVRNLFDKQPPLLPQGSNSGSTGINTASEAYDVTGRYFYAGITAKF

SEQ ID NO: 8114 - protein, 792 aa, Xanthomonas campestris pv. campestris
MNCRLLLFVSLFFLSTITVFAQSGSIQGVVTTSDLQPLEFVNVGLKGFAKGNTTDRKGFYTIKNIEPGTYTVFASFVGVEKQERTIQISAGETIDLDFTLPESSTELSEVIVTDLSSNRFYADSNFTVAKLPLTDLENPQVYNSISRKLLKEQVVTNMNDALKNATGITRLWESTGRGGDGAEYYSMRGFSVQPTMVNGMPSLNNGGLDPANIETVDVIKGPSGTLFGSSVISYGGLINITTKRPSDLFKGEVGFITGNNGLNRISGDVNVPLNENASMRVNTAYQQNNTFQDAGGKTSFFVAPSFKLQASERLSFLINTEFLNSNSVNAPMIFLNRSNPLTFDSIEPFERNYERSFTSDELSINNDSYAIQAQAFYKISNAWTSQTVVSRSSTKTAGYYHYLFDGSDGDSFYRYISDRNGQTLTTDIQQNFIGDFSIGSMKNKMIVGLDFYDQDIKNSSTGWVGNGVVTLSDGNDTGVLTQAGVDELLKDTFEGNTTAATRVLSAYVSDVLELTSQLSLMASVRVDNFKNESWGTDTEENTQTAVSPKFGIVYQPIKDKVSVFGNYMNGFTNIAPTTVSDADGTNSRFKVFDPERANQYEFGVKTNLLSDKITATASYYNIRVSNRVMTDPTNVNNSIQGGEVVSKGFELSVIASPVEGLNLVAGFSHNDAEVTKDYPESGYLGVRPEEAGPEDLFNFWASYNFYAGPLKGFGLGFGGNAASEYLTLNRDNIGSFALPSYQVFNASLSYTGSQYFLALKVNNLTDQKYYSGWSTVTPQNLRNVSLSLNYRF

SEQ ID NO: 8115 - protein, 774 aa, Xanthomonas campestris pv. campestris
MSIRVFARCFAACATSSVAISFMVNSASSQEQPAPRGQSATLPPITVETSQAPKRKPKRAAARPLVRATTTSSQPAPTNAPAAPVIERGTGFGTRTADSAGKGYAMPDATTATRMNGRVFETPYSIQTVPSDVIRDQAVTTINDALKNVSGVQIDREGIYDGIMLRGFAQNSGNRWIYRDGSPFQNSKFDFANIDRIEVLKGTAGGIYGRIDPGGLVNVVTKKPLATPHYSIEQWVNSNNLGYRTVGDATGSLTKDGSVRYRAIGAFEDRDSFRDFVDSRNVLLSPSISWDITPTTELYLNYEYRRMEQVFDLGIPVYNNVIPDVPRNRFIGLKNQPPSVVESHLIDAILTQQLAEGWTAKVRGTYSKSKTHSFDSEPGGSMVAPGFTNIYYGEFIGTYESHFVEASITGDTQITQDIRNRLFASAESYHSAQNYGFNGTTDPTIVRPLSIENPVYQSWREVAGLPLTMGGRPFTEWRAVSFQDQVTLFDRLDLIAGGRWDGSNAGSASCALSGGATSCPPSTPIDAKAFNVFKPRAGINFRVTPELALFTSYSESFGPIVGFGRLLDGSLPDPSEAKQYEVGAKFQTSDGRLNATVAAYDLTRTNLVTPIPGNPNVVNQIGEARSRGVEVDVSGNLTDRLQVMANYAYTDARITVDTTDAGGVGNTGHRLYNVPLHQGGIWLQYSLPSGWRFGGGAFAGSNRWGNNENTFRIGDYVRVDANASYSWDTGFGKATASFNVQNLFDERYYVSATYVPAVLPAPGRTFIARLRFER

SEQ ID NO: 8116 - protein, 418 aa, Xanthomonas campestris pv. campestris
MRVNSPCKLLCGLSAAVAASLAPISGHSAGFVEDAKVNLNLRNFYINRNFVDPANAQNYAEEWTQNFILDARSGFTQGTVGFGVDALGLYSLKLDGGKGTGGTQLLPIHGDGRPADDFGRLAVAGKARFSKTELKVGEWMPVLPILRSDDGRSLPQTFQGGQITSKEIDGLTLYGGQFRGNSPRNDASMEDMSLNGRTAFTSDRFNFGGGEYVFNQNRTQVGVWYAELEDIYHQQYFNLLHSQPLGSWTLGANLGYFQGKDDGQSLAGDLDNKTWSALLSARHGGNTFYLGLQKVSGDSAWMRVNGTSGGTLANDSYNSSFDNAREKSWQLRHDYDFAALGVPGLTLMNRYISGDNVHTGAITDGEEWARETELAYVFQNGAFKSLSVKWRNSTMRRDYSTNQFDENRLIVSYPLSLL

SEQ ID NO: 8117 - protein, 794 aa, Xanthomonas campestris pv. campestris
MAAGKRRAAGVQRKTLAGACAMALLAGPAMGIAAEAPQVTWLDRIEVTATPIPGTTIDAAQLPYMVQSANRAELSRGRSNNLGDLLQRRFVGVDGNDVQGSAFQNDLTFHGFRASALPGASQGVSVYLDGVRFNEPFADIVSWDMLPEAAINAVTLMPGSNPLFGPNTLGGAVVLTTASGLTAPGAQGELSIGSGARKRLDASYGIAGNDGWHGFVAVTGFDENGWRDASEGRLGTVFGKVGKQGEQTDWSLSVLHGRSRLIGNGLLPDTSYTDDGSRPGLYRADRRAVYTSPDLTRNRNTLFTAQLDHRSDADTALHALAYSRVGRRDTVNGDIGEDYEEFVEECASGYAADGTALDADCDVARADADTLPTGALNTTQMRQEAQGVAVNVSKQWGAHALSTGATFDRGHVRYQQFAREGWVQPDRSVAADPDAERAFFSGVRGSTKTLGVFVADTWALDAATHLTAAVRWNHVTVDNILSTAEDGDRPRERFVYAKANPSLGLTHRLHEGLTVYGSVAQNSRAPTAIELGCADPTQPCRLPTGLQADPRLEQIISRTYELGARWAPSQDSDVTLSVYRADNRDDILFLRAPDTQLGYFDNVGRTRYQGADAAMRFQAGAWQWSAGYSYLDATYRSDGELLSGERVITLRPGLRIAALPRHNLKLGVEWQGDALTLGAGLRAVSGRVASGNEDGQVDNAEDGEPAPERIDIGTAGYALVDLQARWQLSERLSLFARIDNVFDRQYATYAAVAEDVFPDGELARPQDAPVETGPARFLAPGVPRQYLIGVRWAL

SEQ ID NO: 8118 - protein, 884 aa, Xanthomonas campestris pv. campestris
MRTFAVARLSRTGLSLSISALLASGAAMAQSTTTDAAGGTSSSSAAAIAPKQLDQVVVRGEYIPEPMLQTSEVASFVTREDMERTGDSSAAVALTRVTGLSLSRGKYVYVRGLGERYSSALFNGSPLPSPEPMQRVVPLDLFPSDVLQSVTVQKTYSADYPGEFGGGVIDLQSMAVPEKPFFSLTVGGGANSVSTGEKGLTYYGSGDDEWGFDDGARKQPGALRDAIATGRRVDLGSFSREDIRRIGRSMNNANLYVLQEKDSIDPDVNVGASAGYSMDIGEAKLGILAVASYDNEWRTRTGKQQDGIFTGDTVEFNSNYDFATTRNNVRSNGMLGLGWEYGRHTIGWTTLYVHDTLKVARSRAGRDELAGFDVRDDNTEWYARQLINNQLRGTHAFGEYDDLKIEWRAALANASRDVPYETGIRYELLDGYWAHDASRVQNYTRFSKVDDKVASGGVDVTWRLPIEHDLTVKGGLAYLDNDRTAWNREFRFLALDGPLPFYNQYQRVDYLISDYNLSNDFLRLRETTGSFGAAAYDATLKVKAAYLQMEGEIVPTLRATVGLRYEDATQAVHPYDIFSGTRQDSVAPLENSYALPSATVTWNFAENQQLRFGASKTIARPQFREMAPQQYLDPDIDRQFFGNPFLVDSELVNLDARYEWFFEPGEYVTAGLFYKQIDKPIEAIVNDAPGGGIVQSFINAPEATLYGIELEAKKYLDLPIAANWWGDNRMFVSGNYTRTKSEVSASDGDTVQPFGFAAPVQATLFVRDGSTLQGQSDDIANLQIGVESESTNSQATLIANYVGERISARGRPGQPDYIDKPGTQLDLVIKKGLVWSGNKLSLNFAARNLLKTKYQEYQSRGGNRVDLYEYQPGITYDISVTARF

SEQ ID NO: 8119 - protein, 1685 aa, Xanthomonas campestris pv. campestris
MLFPLAGWSATDGADGTGHDGTTGGQGENGGNGSLFSDGGDGGDGMSLLFTGHPSYSVGGLPAGFDWATDMTTLAGIQNGDQFSVTVDGVTSIITINTGVRISELRNQINAVLAPYGMTSIAFNRGGGNFTLDLEGSTNFLSMELANVTGTPLSSTGIDFGALPVVVGSSPPPFEHGGDGGDGGIGTSPFPGDFYFTYATSGGNGGAGGSSDYFYGNGGNGGDGGVGLHITSPGDTFTLFSDAAFHGGNGGNGGAGGAGGIGGDGGDGAVGIQADASAEIHIKAGNLVQGGDAGLGGGGGTAGADGIGGYGISGSDLAIRLAGTVNAGANQPTAIHFAGGDNRLTLESGYNLGGDVLANGSNDTLVLGGANGDFDTATVGTHASDIFRGFEAFEKEGAGTWTLTSANGLDWWVRKGTLVGNERNLSGSIQNNASVVVRHAGDFTYSGVISGSGDVVWDISPSGLMVEHQQHYTGLTHITRGRLIANSLNPFAGDIRIDGGSELLLNGSGPTVPYEGTISGAGDVAVGTYNTAIWNADHTFSGRTGIGREGTLTLGTGGNTGSIVGDVRFDAPFGGFSGTLEINRANDYLYDGAISGEGNLIKNGAGHYILSADHAMTGTATVNAGGMVVNGAMNGVAFTVNNGGLLGGSGSLGNTTVQSGGTLAPGDGLGTLSINGNLTLAQGSLLDFEFGAPGSDFSTLGQSDSVAVDGDLAINGSTLTLNDTGSFGPGLYRLFDYTGTLSETNGGLQLANPDSSLTLQYLSGPRQINLLNTGDMTLNFWNANGLASGSTQGGGSGTWTASNSVWTDATGVVTGPMIPSPGFAIFAGDAGTVTVSDVDGAVEAQGMQFASDGYHVSGDGFTLAGTDGEIRVGDGSAASSGYEASISSVISGSNGLMKTGEGTLLLDSRNDYVGDTVIAAGTLRAVTNEALGDASNRLVLDGGTFHVEGAVMAALFNRYQLALGSQGGTLLMRDSVTVRSDLTGTGGLTVRGSHALDLKGNNDFSGGLMIAGGIVQGEVSALGSGFIENNDELVLLDAGQAELSNDLSGSGLISMSGGGEVRLTGNNALFGGDFGLFNGALIGDVDAFGGATIENQSRLVLDQAADGIFDNTLSGSGDLEKTGSGAVSLDQDAVAFSGNTVIQQGRVNANSNWSNSAFTVVNSGVLGGTGQVGDTTIESGGTLAAGNSIGTLNINGDLTFNSGSQLALEVDPASTSSDRIEVSGQANLAGSVLHVGNDGTYQPFSTYTFLNAAGGINGQFDDVTSSYAFLNPVLSYGSNTASLALLRNDLSFVSAALTENQRAVASNVDGMAMTHSLYRQVLQMSKTQAADAFQAFSGDSLLAGLTAGQQLQQRFATGMRQRGRNAGGQSGGGMDARVSQQLQALAAPSDPYAQAAAASPVAQAAGGGAGGKRNGVWVQAQSSRFEEDSQGDIGNAAYAFRGDQLALGVDHQWDHWLLGVAAGSADGALDYDNRQADGDVSSWFAGLYGRWSSAGPWFLRGDLSYGSSDVSQQRIVMGAPAESDSSVDALRVALESGWDLAWGENGLHPYAMVSMAHIERDGFSETGGGIAGLTVDDSELNIGEAWLGADLSRAFVVGGDWLVAEGGLAVVQPFGDTQAEQTARFAGAQQGFTVYGADQNDTQLAANAGAEWFMTDDFSLWLGYRGRFGGDTESHGGLLSANLTW

SEQ ID NO: 8120 - protein, 959 aa, Xanthomonas campestris pv. campestris
MKRLSGSRRSCLAVQLSLCLIPSLAWAQQPEPAPSTRTLDSVQVTGTRIKTAELQGQVPIQTLNRADIERTGLTSIGEVLQELTASGSALNAKFNSSGNFGFPPDDSGVGAGSAQVDLRHLGSKRVLVLVDGIRWVNESSASGVGSSTDLNTIPLAIVERIEVLEDGASSLYGSDAIAGVVNIITRRTFDGAQVTLNYGQYGKGDGTNQGMDLAWGTSGEDFSLFLGASYVKQDPIYARDRAQARFPIPGTGLTFASSATPDGRFQFVDPNTGVRQNLTPNAGVGTPQYDGSGGCTRSDDYHCFGTADRYNFAEQNLLLTPSERKGVFAQFRYYFNDDVQWYVKALGNRRESTNQAAPEPIFLGPDAGTGNPLADNIVISALNPFNPFGFDLNSATNLIQIGRRPVEGGPRRYEQQVDTQYFGTGLVGTFEGASRTWFWDVNGMYSKNKAEQTNYGSYNLFNINLGLGDPAACAAVAGCVPLDIFSGAGSITPEMLRWIQPVVRDRSQNELSLFTANLSSELFQLPGGAVSFATGYEYRKYEGSYQPDPLTVAGRYNGVPSLPTSGSYDVNEAYLELNIPIFANSTLGDKLDLNIAGRYSDYSTFGGEFTPKYGLRWQVSDEFVLRTSYAEGFRAPTIGELFGSAARADLQLSDPCSIGLGGTAPRGSAANCATLGVPVNYQQANQQISVTTGGNEQLEPERSRSFSAGFVFSPGFGSNASWSDRLDLEVTFYRHHVDGAIQAINAQTQLDLCVDTLDALYCDGIGRASTGGINAFNNRLTNLGSIKTDGWDVDLFWTLPESALGRFKLSWQNTFVGRYEALGAAGQRQPQGPGIEVVDSAIPEWTSNAVLDWSLGNWTASWTARHISKLTEQCGDAVEFAVCSTPAEGTNQLDAITYHDAQVGYRFDWLKGLQLTAGLNNVFDKDPPICLSCSLNGYDASTYDIPGGRSWYVRADLKF

SEQ ID NO: 8121 - protein, 417 aa, Xanthomonas campestris pv. campestris
MSTLHPARQLLPGLLALSCAVPTLAAEGGFVDDAKASFNLRNFYINRNFVDPANPQGKAEEWTQSFILDARSGFTQGTIGFGVDMLGLYSLKLDGGKGTAGTHLLPVHDDGRPADDFGRLGVALKARLSQTELKVGEWMPVLPILRSDDGRSLPQTFRGGQLTSRELDGLTLYAGQFRGNSPRNDASMEDMFMQGRTGITSDRFNFAGGEYTFNDKRTMLGLWNAQLKDIYRQQYVNLVHSQPLGEWTLGANLGYFLGKEDGSARAGDLDNRTASAMLSARYKGHTFYIGLQKVSGDDAWMRVNGTSGGTLANDSYNASFDNAKERSWQLRHDFNFVTVGLPGLTLMNRYIKGDNVHTSAVDDGKEWARETELAYVVQSGVFKDLSVKWRNSTMRRDFSSNAFDENRVIVSYPLNLL

SEQ ID NO: 8122 - protein, 397 aa, Xanthomonas campestris pv. campestris
MINDTLRLRAITACAAICLAPAAHAADDEGPVTAEVGGRVHWDFTVFDNDERGTPERNDTQFRRVWLDVAGKFYGFNYKAEAEFAGLQYEPGSRGILARDVYIAKKFSAGTLTVGQFKQYFSLDDRTGSNYGPFLERGYASTTLAPIYRKAISWQTSRPDATWSTAAYSLESIDNSATKGGALGTRLTFAPEMGDARLRHLGVSLAHERYSHPGSGGASPLLIRPRPENDLANNSRITLARFADGRDTDFDKWSLEYAEVVGPWSWQTEFSGGLLDDGAQHAKVLASYGLVSWFVTGESRGYDRKTGRFSRIKTPNRPSGAFELALRYDYMRGDQHLDGQPDFINASTQSWTLGGNWYFKPNLRVMLNVIDSRNRDRTMNAVVDHTLAVTGRFQYDF

SEQ ID NO: 8123 - protein, 390 aa, Xanthomonas campestris pv. campestris
MRLNLLVLALAAAIVPAAANAATSIENWPTKYTFGDGTELGLTGNYAYDDNNFSGDDRLEDRNDFRRKEFGATIKKKGVYDAMVYYDFESKLWLDVFYRFETKALFGQDYGRVRLGYMKVPVGLEAVQSSRAGSFMELGLPIQAVFQGRRTGAEWTLERQQYLLQAGAYGGKDLQGDNPGTTQAVHAAWTPMKAEGDVLHLGIAGSIENPRGYSDGRGVSFSPRVRLRARPEAGLTDVRLIDTGTILDVDHVIRTGLEAVWIHGPFSLQSEALRAEVARNANQPHFIAQGQYVYGTWTLTGESRSYAGGVPGNIKPSHDYGAVELTARYSRLNLEDNNVHGGRQHDTTIGANWYLTSHFKFQANYSWVDSSRNGVHETPHVMELRAQVQF

SEQ ID NO: 8124 - protein, 378 aa, Xanthomonas campestris pv. campestris
MNLRSLLLGSAIALGANALLVVPESEGVTVTPQGELISILPLEASAAQQQLVELTCKECPFREVREDGEVSWTDGFETSLALNFAMDAGALLVNGHQIFPPPPQTVISAVQRRIPDGQESDPISLGYAVEFMPLGVPDDAPMELSALRFTILDLDGHPVPLDTVAITMINDLRGNIYMAKTEIEDTTPNRGSWKQCRGKPKCLRKLLVERIRALFTAAKARVLGMKSKLPGCGGKRPHSAMPHPHHHPEGDFDDAFVPGHYPSTEDEEHFGMAGRPHHHHPHHMHHSGWERTVSRIIRYVVVPAVLGVLAGLTASALGMLIGQAVVFLWQRYRRTPVRENEEAGTVLEKEGLMTESSESHPPAYSDEDSREQASDMKH

SEQ ID NO: 8125 - protein, 801 aa, Xanthomonas campestris pv. campestris
MRKRIVLAAVAPFIPAVAMAQGTMKNAASQGNQAAASSTAENNTPNFTLPSLQVVGTTPLQGSGLNREEVPAATQVYTGLDTQKTGPADLLRSLEQQGTGISFNQAVGNSLQPNLIYRGFSASPLAGDPQGLAVYVNGTRFNQSFGDTVNWDLIPSIAIDETQLVGANPAFGLNALGGALSVRMKDGFNYQGGQVEVSGGSFGNITLSGQYGVKSKDGTMSAYIAASGMNEDGWRQHSPSQARQVYGDIGWRSDRAEAHVNVTYANNILVGNGTTPVELLAADRSAVFTYPDQTRNKYVRVVGSTTVTVTDEWSVQGNVYYSNLSQRTFNGDAAEVEPCDNDPTLVCSEDGPPLQSRRGGYVPNFVQNSPYNQHGFDYDEGGPYAYLNRTATDTNGFGASAQGVNTATVFGHKNHFVAGVSYDGGRSTFTANTLIGPLTLDRGFGGPSIEVDDSTANVLPVRVNTSNDYYGVFFTDTFDITEKLAATVSGRFNSAQIALNDQIGTSLNGQHSYNRFNPAAGLTWKITRSVSAYAGYAESNRAPTPAELSCADPTAPCSLTNFFVGDPPLKQVVAHTWEAGFRGHHKVETATVNWHTGYFHTGSDDDLAFVSSETSGRAYFRNVGPTTRQGVEASVNLIAGAWSVFANYSFTDARYGSNFTLNSEDNPYADDGLVNVRKGNYITGIPAHVFKVGVQWAVTPKWVVGLIGRAASGQYLIGDEGNQNQRTGNYFVMDFNTAYQITKNVQLFGMVRNLTNQNYATFGTFSPVGEVPMLQAPNATNTRSLSPGAPIAGYGGVRVSF

SEQ ID NO: 8126 - protein, 611 aa, Xanthomonas campestris pv. campestris
MLLSKRPIRTLMAAAIALAALPAMAGESPYSKAVFFGDSLTDAGYFRPLLPADVRPVTGQFTTNPGWVWSQQVANYYGLNGAANGNGQNGDNYAVGGARVGVDVPSAMGTIPSLKSQAARYLAANGGKADGNVLYTVWGGANDLFAAAAAPAQAQAIIGAAVTDQIALVGALKQAGAQYVLVPNLPNVGLTPAFRGPNAATATALSAGYNKALYGGLKQAGIEFIPLDTFTVLGEVAANPAMYGFTNVTSTACKIDPANSTQSILTCNPTSYVSPDAANTYLFADGVHPTTAGHQLLGQYAVSVLEAPRLQQVLSHSAQTIGRSRADQVSMHLGGRPADGLSWWGGVRGDLQRYDHADLYDGLAPAGLFGIDWARDGMVVGGFAGFGRLNADFGNSRGDFTQKDTTAGLFAGWYGDRIWVNGQVSYTWLSYDVNRKVQLGPATREHGGSPDGSNLTAALNAGYEFGTEGGFRHGPIASVIWQKVKIDGYTESAAAGTLATALGYDRQNVDSTVGRIGWQARFDGGTLKPYAQLTYDHEFEDTKQGSAWLQTLPELGSYRVPGLKFDKDYATVVLGARTELFGLQSNFGLSASAGQKRAQDATLFANFSGTF

SEQ ID NO: 8127 - protein, 423 aa, Xanthomonas campestris pv. campestris
MKHVLALGSAALLAVGAAGRARAQAPDDGFWDGAGVDVTALNFYYNRDFRSGEGQGKRAEWAQGFVVDAKSGYTRGPVGAGLDLLGIGDFKLDGVRAEGGTGLLPNNDDGTAQHALMRVAPTLKLRASQTELKWGSFIPNEPLVRASITRIMPETFQGVTLESKDVPKLDLLLARFTSAWYRDGDSRVPITLTNKNRRFLGTPDADALNLVSATYSVAPGTQLRYQGALMEDIYRQQLYNLIQTHAFGKDQLRVDLRYFRTDDVGQSRAGPIDNRMFSSMVSWRTGGHEFGAGYQRLSGPGAMPWPGGTDGNVFNWTFINDFLERGERSWQLRYSIDGKSIGIPGLSVMARYIHGDDARPATYAGEGREWARDVLTTYRFQSPRLKHFSVIWFNGTFRSNYQRNVDENRLILQYKRQFDTPGQ

SEQ ID NO: 8128 - protein, 957 aa, Xanthomonas campestris pv. campestris
MHCKNQTTIKLVMNTLRFPKWLSLSAVFLLLSFTAPFTSLAQTGSLKGTLIDSTANELIFGAIISSPEFPNIGAQSDFDGNFLIQNIKPGTYNFKISYIGYKEVLLNGIVVNAGQTTDLGTINIKIDEEVPVIEIVGEVATNTEQAVVQEVRAQDQVVSGISAEQISKSQDRDAAAVISRIPGVTLIDGRFIMIRGLSERYNNVLLNGAIAPSSESETRAFSFDILPSNVIDRILVFKSGAAEMPGDFAGGIIKVYTKANVDKNITSLGISLGYRTATTFKSFTRQSGYNADWTTFGNNARELPADFPKDLKNLGFDYNKSVEYSKQLDYNWNTKETTAMPDLRMNLLVGRNFYAGSVKISSINNLSYSNVYQSYKNDRFRYWNYDSEGKSETKLAFKDQYSVNSYRLGLMSNWSANFTKSVNKKILTFRNFYTRSAFNETQFRSGYDNEKTQELLFQSLRYGTNAIFSSQLEGEHGMRSNKDNLTWVVGFSQITRSEPDWKRASQTRQLGSSDPFRTVVQPGPTAQDGASFFTKLTEGVVMNSVDYARNMLNHTDSSRVRLTLKVGYYAEYKKRTYYARWMSLTDAGIDPSLKFLSPDELFQSQYLGYPNGLLLQEGTRTQDRYDASNTLIAGYAGANFVISKVTIDGGLRMENNRQQIESAVDGTPVIIDNKILTPLPFLNLSYRFHEKWVLRGSAMKTINRPEFRELSPFPFYDFNIPADKTGNPNLKVCDIINLDTRLEFYPTEAEMVAVGVFYKHFKNPIEAYLLQGASNLVYIYDNAPEAQSYGVEFELRKSLESFTNVEFMQRFSLLFNGSLIYSQINFGNDLTSYSNLIQKRAMQGQSPYVVNAGIYYSYRKTKLSGLYNVYGPRIFSVGDSQIRTIYEMPRASLDVTYSYELNKKTELRIGISNLLNSSIRLQEDGNNNRKLNEKDIDKNISQYRIGQNINVGFVYNF

SEQ ID NO: 8129 - protein, 1483 aa, Xanthomonas campestris pv. campestris
MSTLIEQSQLQKSRFLKYSLLASISVGTIITLPFEGMASSEPINLDIIERGDNGLLQPVINNKFERAKSFATAGNKRKRPPTRRKILVGNETTEQNQNIDTSEPIEQTAQKPEIIITVSSPTVSPTSGSFVTAPNTLNTTPIFSTPSTSPEHIYTTAPGTPYDEPIPHATPNNQYAVARRLSFSEPQQIEQPTTLIKPTMSPKPTTLEITAGIVNRISTHNENAKRKLGMITAAIEQTSGKKAKKSAQKKAPVAEVSTAGPFLNQQRQLDVLTQKQKVNAVRQAAVNKKKRRENEVKRNSTDVEKLITQMNQVQLEQNQRRIAAELQRKAETSTKHVTIKNKNKSKADKVRQEKTFLQKIHLTKTEQEKKIAEDKNARAAAEKVRKEKNKQAQKAEEISNIKLKVSEQLIQMLDYKAKLQEKLQEVERIEAKHEVSVIKKELKNIEKLVSKAAKVVNNAETETSRTTLQVMQDKMNGYSEQLDKIEENLKLLTPIVYSSNDSTYKQPPKAKPIMPLTSGVQGILGKQLQLEEKYGYLVPNQTQPQTYTTVLPNQEVADPKRMDSGFVSLDKETDADVGFNTSCGKGTDCTQVGQELSFELPTLKVLGYQDNINQTLDTIARANSIERPILFQNLLKDLERRKQEAKMVEEQAIMHVINNPNDDQAKEQVALVDKLLEKYNTDIKLVRKTLEDNKENNSRNNVKKPLERLVFEAKLPPIREYDALCEESQKVIASKRATEELRNQREDDPELEKLAIIEYMEVQKKQSQLEQDIKAIDPLFQAAIYSDSELSRELSRSYSVGDILSNTESNLSHSSSVSSLNNLSSSNVMKLEELKSKYEKISNDYKAKELELDALNQNDPKFKELMLEVFAMSKDKIWLEGEIKHLETQFEPNIHSAEGKPVFSPDSINSVFSGVDYINTNDPTKLIENKIAALRIYQMAVIVKRQELEQLPSTSSGADQTAQQIKKLQEKEVIMHDAINACIADPSKLNNVSFEEIKEALKKLSAGIPESVINVLESKAQEDPEDILNGLTLQEMLSSNNDTTIDSLPSGKEQSSEDEEVTKAGIQEVEDKQLLALPVSSNEYALALSDDSEKECLVLSDGSEDEDDDNDSGIDSESEEGVVDQLLDSREDNLKTTEVNTVISLKQEVIEETKKSIAAIAPTLNQGVQVVKNISKSILGARLDSSEALTAVAAGDEEESRIKRGLWMRGMYGTNNHGRVNNMTGYRGINKGTTIGFDFEIDNNIVGIAYSNVYSVFKFKNSKNNDKEFINSHVVSIYGQKELPKNFVAQALVSASKNFIKDKTTYSYGDTNIRSNVKHRNHSYNAEALLNYNYLVKNNLVITPNIGLRYGKSRDGVYNEIGINVQEIALTMKENNILSGIIGTKVKVPLKDVLKFNNLGLIFQGAVEHNFKEKTQRINRVIKILDNTFKQYYLIPKQPKISYNLGVGIMGSIKNTTISLDYNYYLNKHYRSHQGSVKLKVNL

SEQ ID NO: 8130 - protein, 207 aa, Xanthomonas campestris pv. campestris
MRKRSTLLFAALAAASVSAPALAQSKGDWLLGVGAHQVAPKSDNGSLAGGTLDVDVGTDIRPTITAEYFIADNWGIEVLAALPFEHDINIRGLGRVGSTKHLPPVVSLQYHFNSQGKVSPFVGAGINYTRFFSTETSGALAGNDLHLDASWGLAAHAGLDVKISDRGALRVDLRWIDIDSDASLNGNRIGTVNIDPLVYGVAYVHRF

SEQ ID NO: 8131 - protein, 1141 aa, Xanthomonas campestris pv. campestris
MRVVSLTIALLCGAGLYGQEYRGSIQGRVSDPSGAAVPAAAVAVKNLETGVLVDATTNDEGNFQVPFLLPGNYSVAVTRAGFKKAERSDVRVNTNSRVELAFALEIGAASETVTVDTRAPLLETTESDLGVVMNNNVVSNVAVSIYRNAINFARLAPGVSGAPAGTYTSDNQTQISISGGGATQGNNEIILDGVPDTVPLSSGSVVMVPSVDSIEEVKVNTTMFDASYGHSNGGAINIVTRGGTNQPHGDIYLFKRWAALNANSWANNRLGLPAPPLDYHQYGYFLSGPVYIPHVYNGRNRTFFSTSLEKDADVRDLFEQARVPTDLERRGDFSQTRNRTGGTLTIYNPFSTQVVGGKATRQAFAGNLIPANLISPTGAAVLAAFPMPNIAGPAQVGAFNWSDDKTYTVGQQQESFRIDHNASGRQRLFGRFSRLTRNQAPEVLIPGVQQYNGSGANIDHYQQWRNAFTFDDTFTFSPTLVGSFRYGFARRFNYETWGGVGMDPAQFKTPDVIVSNQPQKGIPEFNIGEAVPSLGSRQNRLANDLHSLFTTFTKIAGNHNLKFGSDYRLIRYNSANQGTSASGSFTFSPTFTQGDPFTASSANTTGTALASVLLGTPSSGSFGYTSPLSLQSHYIAGFVQDSWKISRTLVLNIGLRYELETPYTERYNRVAYGFDPGAALPVQGTGLNLRGGVLFPAMGGHPRREGNLDTNNFGPRFGFAWQPLRKTVIRGGYGLFFSSILGNTGSLGNLGVFDAVTPYLGTADSGATPFTTIANPFPSGLRGPLGSSAGLMAQVGDSLTYINQNRVAPYNQQWQVSLQRELPGNLVLEAAYVGMLSLKQLETYNLNDLPDVYLSQGTAQNTAVTNPFLGAFPATSALGQAATVSQKQLWLQFPQFTSVNMNGANTGTTTYHALQAKVEKRLSHGLTVLGTYSFSKLIHNNMTSLVNERHYRSIASLDQPNLFRLAFTYQLPGHFARHGAGRLLEGVAGGWAVTGFLSMESGLPLSISQSNGRPIVIADPRIDGPVNQHLGDVKNAAGVVLNPYFNTAAFQALPSQFAVSAQVPYISQLRAPGQTSLNASAFKNFRIVERLKAELRLEAINASNHPYFNAPGTNMSSTATFGVISGASNSRAMQAGLKLVF

SEQ ID NO: 8132 - protein, 978 aa, Xanthomonas campestris pv. campestris
MNKLLSNTRHTPLAAALAAALTLLAGGAQAQDASAGAGVTELDKVMVKGVRGAQAEAIENKRTAAQIIDSISAEDIGKLPDVTITDSLQRVPGVQIRRSAGEGSQLNIRGMPQVQTTMNGELYLSAGGGDQFGQPNIGRAQPDFVDIPPTLFSGVDVIKSPTAADLDGGISGTVSLKTRRPFDLPEGWTFSGQAEGSYGDRVEELNELYSGLASFRTERWGALLAVSYSDATLENKHPSVYSNGAQKSTEQNVGFDFNGDGRIGSNTDPSNLPRDYFYNWVATELDNRSTDRQRTGVNGSFQFNINDSWTVLADAAYTKLEDQDTSVAAQLHTGWATNQLQPGSVVDSNGVLEYGQFRYNRFQAHSMAGVADSDSLNTNLELRFDDGGPFRASFRWVHGDAQRTYDEARADAVVTRGDQITRAGGVTQWANANGLPTVDASVDFRGTYPAVNLGTDVSNPDNWQLMSTWAQGNKIEATMDAFRADGTFEFDEGVVRGFQFGIRYGEREVKLDTYRYLSPVSTTCADPNRSLYYFKDPLISDTCSGVSEARLLPFNSIPGYWAYFNDFDPLKVTGLGSQGLPAINPQVMKDPVGYINSLYPGNVAYQQAADSYKVTEKSTAAYFLANLEGGTGSAVPWTANIGARIVQTKLAIDQYLSSGNVFIGNVEWNGVSPAIGTNRLNRQYTDVLPTANLSLDITDAQKLRFAYNKAVARQDLPDLGRGLVSFYAVNGTPPRNPALPPDAVLFLNGRSGNPDLDPYRATNYNASWEWYFSDASLVSVGAFLIDVKSFPTTVTNIEPQPDADGVVRLGGPVESIVNGGGGKIKGFEIGYQQAFDFLPGWLSGFGTNINYTFSDADTDNTDIEGNTLPIGDNSKHQANAVLWYQKDKLQARVAYNWRSKRFSQVNSGAWGDELAIWNDDVGYLDASFSYDVNDHLTLYAQATNLTGESERRYAQWTNHYYDQNIFERRYYAGLRLRF

SEQ ID NO: 8133 - protein, 605 aa, Xanthomonas campestris pv. campestris
MASTLRPIRSLMAVAIALAASPAMADSAFDQTVFFGDSLTDSGYYNPLLPAASRAVTGKFTTNPGWVWAEYVGDHFGTNAAPNGNGQTGDNYAAGGARIQASSVSALGAAPSVTSQVNTYLAANGGQANPNALYTVWGGANDLLAAATAPAQAQTIIGSAVTAQVGAVGALQAAGARYVMVPTIPDVGITPRFRAGGAAAMAQGTAAATAYNTALFNGLQSAGLRVIPVDTFHILQEVVADPGIYGFSNVTGTACNPALALPACNPTSLVAANAPNTYVFADGIHPTTATHQILGQYAISLLEAPRLQQVLTRSAQAGGRARADQVAWHLDGKPEADGLRWWGSVRGDIQRYDDADLYDGMAPAGLFGVDWTAGDLVFGGFAGFGRMDADFGNRNGSFKQDDTTLGGFVGWYTGPVWVNAQVSYSWLSYDVDREVQLGPATRVHSGAPDGSNLTAAVNAGYSLGEGNVKYGPVVGLTWQKLKLDGYTESNASSTALGYADQDIDSLVGRIGFQVRLDGAPVKPYLQATYDHEFKDGTEASAWLQSMPEVGMYTVPGQNFDRNYATVVLGARTGIWGLQSNIGLSTTTAQRSARDATVFVNFSGNF

SEQ ID NO: 8134 - protein, 811 aa, Xanthomonas campestris pv. campestris
MTRPTLSVIGLAVAAVLSANAQAQQAAPGATTLDTVIVTGTRASDRTVLESTVPVDVLTAEDIRKAGVVNGELGSALQALLPSFNFPRQSNSGGADHIRAAQLRGLSPDQVLVLVNGKRRHTSALVNTDSKIGKGTTPVDFNSIPINAIKRIEVLRDGAGAQYGSDAIAGVINVILDDNPERGELEASFGAYNTDVEPINRRVTDGQTSYASAKVGTLLGDDGGFFKVGLELKNREATNRAGFDQIPPFEEQTPANLALAGQRNYVLGDGATKGLNAWLNTKIPFSATGEFYAFGTYNQRDTEGANYFRYPDSSANWREIYPNGYRPISEGENRDLQIVAGARGQWGDWDYDASLDYGRNDFTYRLRNSLNASLGPGSTTRFKTGDFAFAQTVGNFDLTRVFDAADATHTFGTGAEFRREQYRTHAGDPASYAAGPFTDRPTGSQAGGGLTPQDEADLSRNVASVYANVSSQFGDKFSTDLAGRYEHYQDFGSQWTGKLAARYAFAPAFALRGAVSNNVRAPSLSQIGYEATSTGYDAAGRLTQGRLLSVNNPIARALGATDLKPEKSINASLGFTSKLGDHFDLSLDFFQIDIDDRIALSEDITGSSLTDFVQQNFGVTGVQSASYFLNAADTRTRGAELVANWRQYAFGGDLLLTGTYSYAKTELKNVIATPSQLLALDPDYVLFGVEESNTLTDAAPRTRASLAANWSNEHWNLQSRINRYGSATRVFDFGAGFVPRQTYGAEWQLDLEAEYRLGTQWTLAIGGQNILDNYSDRSIDDIAYFGNLPYDVLSPIGSNGAYWYGRVRYSF

SEQ ID NO: 8135 - protein, 626 aa, Xanthomonas campestris pv. campestris
MMSLSSVSPCRAVLAVCLSMCVAALAQAEAAVDLDQVVVTATRTAQTQDQTLAPVTVIDRAQIERRQINSLQDLLRGEAGVSLANNGGPGKQTSLFLRGTEADHLVVLVDGVRVGSATAGGAALQDIPFEQIERIEIVRGPFSSLYGSEALGGVIQLFTRRPEGRFVPTFGAAAGSDNARRYSAGVAGRSDGDLGERGGWYSVNAVHDETDGINAYLDTRSSSYDPDRDGYRNDSLNVQGGWRFNRQWDADVHALRAQSRNEYDGSAFGGNLSKGVQQAVGGRVRYAPTDAFKLTASLGSSVDFSDAYFDGTYVSTYDTRRKQGSLQADVDAGPGLLTVGFDWQRDAIASSDTYDADSRIDRAAFAQWQQSFGTQSLQASLRRNDNSQFGGKTTGSLLWGWDIAAHLRVTASYGTAFKAPTFNELYYPDYGNPLLGPETSRSAELGLRGNYDWGTWTLSAFQTRIDDLIAYDAGLVDATHPFGQPNNIDQARIRGVEAGYDTELAGWTVRSALTWLDPRADGDVNHGNWLPRRARQSGRIDADRSFGAYGVGASLFGAGKRYDDLANSDRLAGYGLLDLRVSYAVNADWKVSLSANNVFDRQYETARWYNQPGRAYLLTLRYHPAQ

SEQ ID NO: 8136 - protein, 707 aa, Xanthomonas campestris pv. campestris
MPTFHRLRPEVAAVRFAVLALSSLSLTSVLAQQLTPGTAENTLPAVEVTSSQDFGFTAQKAVSSTKSDKPLFETPQSISVLTREYLDSRQVTSLNEAIQSTAGVSSGGFGRRGWDDFSIRGQRASESIYVDGLKLGQSNWIAQEVYGVESIEIVKGPASINFGQMQPGGIVNMVSKRPRSDAFNQVGFTVGSYGYRQATFDFGRPLQSENGKAAFRINGMASDADDPTDYVWSKNRYIAPSISLDLGPRTDFTILAAINERQYIRQQGLPVLGSILAAPGRAVRNSLFTSDPNLGPYDSSQRTLGYALTHRFDSGWTLRQNFRFLDMDLTGALGNLNGPLQANGNVVRNVLLQDVSERTLALDTNVERSFAFGGAQHTVMVGLDLNQDKLKEYSQRCAIDTLNVYNPVYGKAYRSCSTTTRTQTDLSYTALYVRDQIKFNDKLSLNMALRHDRATTETLQLATGNRKTEDSDATTGSVGLMYQVTRNVAPYVSYATSFLPVAGTDAFQNQFKPEEGKQTELGVKFQSDDKRLNASLAYYDLTRKNVTTTDVNNPGFSTQVGEQSSKGYEAELVADLRNGWTLSAAASVVDAKITQDTTLANIGKRVQNVPERSGSLWANYRFAGNLSAWAYGVGLRHESSKTSPSVSYQVPGYTVADASVSYQGKGYRVMLNVKNIFDKDYYAGVLSANAVPVGDPRIVMLKTVFDF

SEQ ID NO: 8137 - protein, 728 aa, Xanthomonas campestris pv. campestris
MHTSSIPMRLTLLAFCCSMGSPAWAATAAASQQDGPMVLGETDISADKADPHALSPVYAGGQVARGGQLGVLGNADIMDVPFTMTSYTEQLIEDQQAEDVGDVLLNDASVRQSSGYANASKIFVIRGLKLTTDDISYNGLYGVLPRQIISTDALERVEVFKGPNAFINGVTPTGSGIGGGVNLQPKRAQDTPTRRFTTDISSDGRIGEHLDLGQRFGEGNRFGARLNLSQREGETGVEDEEHRSKLFALGLDYRGDNFRLSGDFAYQKQRINQSRNTVFVGSGLTRVPHAPDADTNYAPNWTWTETEDTFGMSRAEYDLNDDWTLYAAAGAKHTRENGIYGSPTINDAAGNITASPSSIPHDEDNKTAMAGINGKLQTGAVSHKVNVGLSGIWTEQRSAFLFGGPASSNLYDPVETTRPALDSFSGGDLSDPGIIGKSRMRSVAFSDTLGFFDDRLLLTAGLRRQQLRVEGYDYGSGPRNALYDEAITTPVYGLVFKPWRYVSFYANRIEGLAQGPTAPSTVTINPGEVFAPARSKQVEAGVKLDMGTFGASLGAYRIEQPTDGYQIQDGSGTRYVREGEQRNRGVEMNVFGEPVSGLRLLAGLTLMDTEVSGTSGGSNDGNRAIGVPTFQFNAGADWDVPGIAGAAINARMLRTGGQYIDAANTLSIPTWNRFDLGARYTFNVAQKDVTLRANVENLMNKDYWESAYGGYLTQGEPRTLKLSGTLDF

SEQ ID NO: 8138 - protein, 795 aa, Xanthomonas campestris pv. campestris
MNCKTSPLAVAVVLALSFSASTAAAQSQAPTQKTLDTLIVTGTRVADRTVAESASPIDIISPQALESTGTTELATALSRAIPSLNFPRPAISDGSDAVRPAQLRGLSPDQVLVLVNGKRYHSTALINLNDTQGRGSSPADLNTIPIAAVERIEVLRDGASAQYGSDAIAGVINIVLKGSGEGGSVNGRYGKYSAGDGEQYQVSGDAGFSFAGTGKVHLAAQAGHSDQTNRALPYQGRVEQRYGDPEIDQGAVSFNGEYSPTDYLTFYSFGMVSRREVLSNGYFRSAGDNRNRPEIYPDGFLPQIYNVSKDVSWVGGLKTSTEGGLNIDLSYNYGQNNLTFDVRNSLNNSLGVTSPTDFHAGTLEVTQNVLNADFTKTLDWGLAYPVTLAFGAEWRGEKFNESPGDAASSANGGIPSANGSLIPGAQVFPGFKLSDSGYYNRNSHSAYVDLEADLTAKFSAGLAGRYEKYSDFGDTATGKLSLRYAFTDKVALRATASTGFRAPSLQQQNFQSIATQFLNVAQPDGSVTAIPFEIGTFRTDNPAAIALGAEPLKAEESRNYGLGVVLQPVENLYITVDAYRIDIDDRIVLSENLTSDAARNYLQTNGFPGIGGGRYFTNAVDTKTQGVDAVGTYRWNLDGGSAELTSGYNYNKTEVKRIADNPAALMAIDPNAVRIGRAELGRITEGTPRDKFFLGGTWSPGNWSFTGTATRWGEFSTFGTNAGSDQTYAAKWTLDLAASYTLGAWSFTVGGDNVLNEYPDRQQAGLGTRTYLPYSSTSPFGFNGALVYANVNYKW

SEQ ID NO: 8139 - protein, 793 aa, Xanthomonas campestris pv. campestris
MNTPLSTLATAIVAALLASPALAQNAPAATANTLDTVIVTGTRVSDRTVAESQSPIDIISAESLQATGTSELATALARALPSLNFPRPALSDGTSAIRPAQLRGLSPDQVLVLVNGKRRHTSSLLNLNGTIGRGAAAVDLNTIPVAAIARVEVLRDGASAQYGSDAIAGVVNIVLKGAEKGGSLQAGFGQYSAGDGSNYELSGDTGVAYGGDRGWLHVAAQLNQQDPTDRARAYAGAPSASQPAVGQKAFKIGDPDVNAQALSANTEFNFSDSITGYAFATASNRDITSFAFYRAPGSTAQNILSIYPQGFLPEIQTYAKDRSVVAGVRGSTASGWDWDASYNYGYNKIDFHTRNTLNVSLGPTSPTSFYDGALETTQNIVNLDVKRGFDWGLAYPVTVAFGAEYRNEKWNQSPGEVGSYFQSGTLAGGAQGFGGFAPSVSGQYSRDSYALYADIEADFTDKFSAGLAGRYEDYSDFGSQASGKLSARYAFTDKVALRGTVSSGFRAPSLAQQYFQSTSTTFLAGNPNPFEIRTFPADSTVARALGAEPLDAETSLSYSLGLVLQPTDALYVTVDAYQIDVDDRIVLSSNLTGTGVRSLLESQGIFGINGGRYFTNAVDTRTRGVDVVGSYRWQLAASSIDLTAGYNYSETEVRSVAANPAALSANGLSLERIDRTERGRIEEGFPRDKFLINGSWNLDHWTLALGATRYGEYTTRPAAAINDQTFGAKWVVDASASYKIDRWTLTLGADNLLDEYPDENNFANSTSGQFPYSNLSPFGFNGAYVYGRINYRW

SEQ ID NO: 8140 - protein, 802 aa, Xanthomonas campestris pv. campestris
MDSTSSSRVRHPATLALLLVPLALPAYAQQTPDGAASTPAAAEPDGGAQVSTLDQVQVVGQAMTYSKTTVSKEMLDRQFVLGSVNDALNELPGVVVTEADAFGSSDWGTQISMRGFVSNRDTQQIGTTIDGVPNGGSAYGGGSKANRFIDMPDLETVEVSQGTADIASRSNEALGGTLNYLTGEPLAEQRVRVIGGIGDNQARKYYARYDTGLLGGHTRAWVSGSSARNDDWIDGSGHTRRDHLAGKFVSSLDKWTLSGYLSYDDADESEYTSVTPAQFARDPEHDLLTGTLTGIPYLDQNYRSGSRALRENTFGYLRGAFDGGNGFKTTLTGYAHRMQGRGDWIPPYLVDVTNDGAGAPESEARGGNTVYAGSDLGKLYYLTPGGAAATQLAGCTGSDAVPAESNPACYPAGSVPVQSYRHSHYDNHRAGAMADVEWRHDLGPIDNTVRAGAWLERYDRSVTRDWHRLLNVGTNISFDHQPYWVQFKDNYQTDEQMYYVEDVMRYGAFAWRVGVKQFFVDQTRDRRIGDAQHVESDAHSDALLSAGLTWTTPVQGLEAFAGYSQNFAAIPSGVLGETDPVALSRVQPETADNIELGLRISRWPLTGSVTLYDIRFDNRIVYVPANFVSGIDYLGETDGVYENFGGVHARGVEAALGYGWDNGWRLNGAYTYNKADYLGSGDAARDTAVEITPGAQVIGQPRNTLVVSADWRGDAWRFGVSGRYLGKRYLDASNRAALNGVTTFDANLGLELSQLSAQLKGMQVALNVSNLTDKRYLEGVDGSDSAFIAAPRTLGLTLTLDL

SEQ ID NO: 8141 - protein, 278 aa, Xanthomonas campestris pv. campestris
MKYRSSIVAIALLSSMSFAGGDIGGVTTFQNDDYQEAERAAQDEIIPETTPTVVEMGGGESDGGYIVESNPEPTTAVAPTPTKAVATPTPNPNSSNGSSSSIFSGLGFGDGKFYMGVALSNMAIRADDCAASSLFSEEDYQDRQLGITFIAGYDFMRYLGAELRAALSISEENRGQDNLSEFGLYLKPKYPLMDDKVNVYGLIGYSSVNMSDPVKGELHHGTASSPFDGTNSGFSFGGGVDYSVTPNISVFTDVVNYLRNFGGTNSTWGANIGVKYSF

SEQ ID NO: 8142 - protein, 853 aa, Xanthomonas campestris pv. campestris
MHSRTTAAVWLAGAAICGLAAPAFAQGAEQSVGDAAEQGVGEIVVTAQKRSESLQRTPIAISAIPAAQLDLQGIAEAKDLSAIAPNLSVVGATTNATAAVISIRGIPTSADETQGYDSSIGVYVDGIYMARSSAATFEVADIERVEVLRGPQGTLFGRNTTGGAVNFITRAPSSEAGLSLRAGIGNYDMRTARAVFNTGTLADSLRMSFSYLYKQRDGIVDNLLAAENRDPGSSLIHSARWSAQLDLGDRVKITNIFDWTRVEGVAGYQQLSAVGNGNTTDFPSTLSLGGNVFPVVQPANVLGYLNEATSLDARCGTPVSQISTERRTRVCNNSAQPSVDKLWGNMTRVEADLDWLTIRSTTAARWWRNHIAGSDLDGMGAISGPAFSQASLLNGMPLQVLDLIPTLSPAARTALAAAPVPTTTQDLFSTRNDRRQKQFSQELEFVSNSGGAFEWVLGAFYFKESGAEFNPQSYAFVIDTNAAVFNAGNFGALAPLLQAGNPARYRALAVQSALGYTSDSESFAVYGQGTLRPGGPDGRLGITLGLRYSWDSKDFQVYQNGATPFTDAQLPNNTSSKKFSAPTGNLTVDYRASDDVNLYARVARGYRSGGFNARQNTSSIPLTPFNKETIWSYELGIKTQFNNRVRLNAAVFYNEYKDQLVTLPVPVGEGQSFGNITVNAGKTRYYGAEIEGRFVVDDHLSLDAAAGYVKTDPRDFPAGDVNNVIRNVASIQHLGYAPEFTGNVGATYRRPIGSQDLTARVGYNYTSSFWMFGNPLTAPFGRQTKGDARGLLDAQIRLDRIAMGSAEASLTLWGKNITNKSYVVRAVDFGQLGFATTIYGDPRTYGLTLDVKF

SEQ ID NO: 8143 - protein, 518 aa, Xanthomonas campestris pv. campestris
MERCWKAVLFQCSMKLRGNSKVIKKPMMGMAVLILTMPAFAAEQANQKNAASNANEESIVADKVKVTSILPDRLEAVPGSFNVVDEKELKARQPFSVREALNQTPGINIVGEDAFVLAPNIGIRGLNPRRTSRTLLMEDGVPLFLAPYGDPSAHYTTPLDRVNRIEVVKGSGQTLYGPQTVGGMINFVTKPVPKEFQASVMAIIGNNNFSGGHVNIGTGGDWGGIMLDAVNRKGDGIRDNHDFEVNELTLKGQLNLDERNTLITKLGWYEENSSISETGLGLVEYNEDKYQAPTGKQDYFNHERKSMQLKHIFQVSDKAKLSTQFYYVKSEAQLKTGYTGSFSTILICNTRLAYVPSPRYMGRTINNKKGAVNMSFKHFNNFSLSNENTPEAIDWLLEVGWHYTTMQENEAMQIARVNRTTWGRWRKGQIKIPPATLELLRLHAFGHTMCNLHRQWDDFRFRRDALITPDGREMRPADLKAVFVWKQMCLYNRTSAERQDIYNRLRLVYGDNYQHAIA

SEQ ID NO: 8144 - protein, 694 aa, Xanthomonas campestris pv. campestris
MHRQSPRVWLPALLLPLAAQAENASYQAEPLVVTGSRYQASGWRLPFSVNRIDAEQATLGKPGVNLSEALGSVPGLVVQNRQNYAQDLQVSSRGFGARSAFGIRGIKLLADGVPLSNPDGQGQAATFDLDSLERIEVLRGPFASVYGSNSGGVIQLFSRDGEGAPRVSLDTSQAAFGTSRTRVAAEGGNDQAGFILNRSHFETDGYRDHSGAILDKTFAKLTLYLDDASKLSLSFSQLDQNDTQDPQGLTWQQVQDDRRAAAPSAVAFDTRKTVDHQQLALNYERSFAAGTWQSTVYSGTRRVIQYQSIPVAVQANPSHSGGVIDFERRFHGIGNRWIQPFDLGASLLTLTAGLDYDQSRDDRQGYENFVGSTLGVKGNLRRDERNEVSSLSPYLQAAWQLGKLDLQAGLRHNQVKFEVDDRFLSNGDDSGSVTYRELTPTLGASYALLPELNLYASWGKGLETPTLNELSYSGAGGGFGFDLQPATSKQLEIGLKARLAEATSLQLALFQIDTDDELVVASASGGRTRFQNAAQTRRRGVELAMESQLSETLRATLAYTRIDAAYRQDFTSGGRLIEAGNRLPGIPASTLYGELAWQPREGFSTALEGLYRSKLYVEDSNAAKAAPSYALFNWQARFEQTLGALTFNQVLRIDNLLDREYIGSVIVGESNGRYYEPGPERAWYVGAGVQYRFD

SEQ ID NO: 8145 - protein, 632 aa, Xanthomonas campestris pv. campestris
MTPRIAAGSLLICSLVISAAKAETPVPRLFATPSFVETRFMQRHAGEDVPRPILLPSILTATPFISPRHPPPPEVIHQGGPATGMMAGLESAGDVAFSGIAARQAIGDTVLWAGLRADRANPYRDGTGQRVNYGYERVSPQAVLTHPLGPRTGLTVFGLLDNFEESRTPHSATDAPQFQHGLGTIRIDHAPMGSVFDRLEIAASVDSITYAADNFTLRAPGALGLRYEGDWITWRGHVRGEFKAAEWKGALILDASLLKYLTVLDTSRVTQGRSSYRLPDTEIATTAIALEGTRPVGQADRLAAGLRLDVVHNSVGMAHEVPAASGASAASYNRAAQELYDTYYGAGTRNDPVDINLSGKLRYTHAIADGDVYGEVRRLVRTPDPGERFFASSGPTALIQVGNPGLAPEAHHAIELGGERRAQGWKGYLSPAAVSGTWQISGKLWHDRIADFITPDRARGQSGILKSDGGIIYRNVDVAMTGVAAEGRWNAMPGLGLRLRLDWTHGDNLTDSRPLYQVAPLHGEAAIERRLAFADHPITLGAATRFADGQHRVDDSTTTGSGQDTGGPTGGYAVFDLFARTSVTERFHLSMGVTNLLDKRYQQHVNPLPQGVTTQPIAAPGRSLFLAGRLEF

SEQ ID NO: 8146 - protein, 792 aa, Xanthomonas campestris pv. campestris
MTSSMPRYALSLAIGALLAPLAHAQTASPDAGKQDATTLDAVIVSGTARFKGLAKRDASFSITTASPEQIQQAVPQSTADLLKIVPGVWAEPSGGGTGANIFVRGMPSEGDAPFVTMQLDGSPLFPPPTLSFLENSTLFRVDDTVERMEVLRGGSSPIFSNGQPGLTVNFIQKKGQDEPEGSVRLTGGNNALRRIDVFNSGPMGNGWYYSIGGFFRETDGVRDPQFSADKGGQFSATLSKRWDSGELSFYARHTDDNNAFYTAIPLLSRNNGNDLSSFPGLNAQTGTLLGRDFRNVDLLVGPNGETIQRDLGDGRGVNIDVFGGELNWDVGGWTVADRFNVMAGTAPTYALFTGDAPQRLGDFIAGYGTTGSGRFTNGGGAVDPNQQVLEAGWWSVDKRLNSFTNDLRLSRELFAGNTLTVGAYYAKYSSADTWYLGNTMLLTAQNNARRIDADLADGRQATRQGFTSTAFLNLRANYDGENIAAFVADEWELSERLRLDLGARYERQSVTGDVHDTATVDLDGNPATVYDNATSLALASTRRIDQDDEAFSWTAGLNFRLNDNNSLFARANSGVKFPGFDNLRDGQTRVQDVDQYELGLKSGASNYDLYLTAFYNTFKNSPFQAFLANGENFTAVGDSRARGLEVEGAIRPFGGFELAGTGVWLDAKYRNYREFTGNQVMRQPKRQFRVTPSYYWMLPFGDLKVFATYSYIGDRFADLANSQRLPSYDMVDIGANLHVGDHWEVTASGSNVTDTLGLTEGNVRVPGAATGGVFMGRPIAGRQYQMSVAYRW

SEQ ID NO: 8147 - protein, 688 aa, Xanthomonas campestris pv. campestris
MSPSLSSPLRRSTLTLALASVLIPALAMADDTPVPADPQTPPSSDTRHDATPSSGRHIKDLDKVVVTASPLRDAAGELSRPVEVLAGERLDEVRASSLGETVASLPGVQSSNFGPGVGRPIIRGLDGPRVAVLRDGLSTQDVSTVSQDHSPAIEPFLANQIEVLKGPSTLLYGSGAIGGVVNVVDGRIAETPVDGFSGRAEVRFDGGDKDGNTDMFRVDAGNGSGLSIHADGVYRNQNDYDTPQGRQANSFLDSKVGSIGASLAGDWGFVGLSASRFRDNYGNPGEPGDLSIGERGVSLKLQQDRYDLKGGLTDPWGDGSALRYSFGHTDYAHTEFEGAEVGTVFTKRANEGRVEASFTFGGGWQTAFGLQGSDTTFQAVGEESFVPKTDTRSLGLFGVARNSWDRVTAEVGARVDKVKYSTDIGVDRDFTPTSFSASAGFRFNEQWRLTANLDHAERAPAEEELFANGPHIATLAFEIGDANLKTEKANQAELGLNFQNDWVDAKIAAYYNRYNDFVYIVDTGGQWFNEEDNDFLPIRQWTQADAIFHGFEGEATFHLANNDTGAWDLRVFGDTVQARLKDGGNLPRIAPGRVGAEMRWNADAWRASLGAIRTMKQDKVAVNETATDGYTMVDAHLAYHMDRGANAWEVFLDGNNLTNQDARVHTSFLKDDVMLPGRNASFGVRLFF

SEQ ID NO: 8148 - protein, 1129 aa, Xanthomonas campestris pv. campestris
MTRHKKRKTMKRSGAKLLAPVVVAAAAAVAARPGWAQAAPYPDPGRRGDPASWRTPEFTNAWGLGAMHAEYAYAAGYTGANVAIGVLDSGYYAQHPELPDSRFVPVTAAGVSGVLNPNNNNHGTLVSGVVGGARDGVGMHGVAPDATVYEGNTNATDGFRFGVSDPKFPASDAKYFAEAYDALAAKGVRIISNSWGSQPANENYSTLNKLTDAYKLHEAVRTATGRGTWLDAAAKVSRDGVINNFSSGNTGYDNASLRGAYAYFHPELEGHWMTTTGYDQLSGQVYNQCGIAKWWCVMAPTGVPSTSYSGGAAAPTGATYANFNGTSAAAPHASAALALIMERFPYMTSEQALSVLFTTAQNMEPDPSRPDYTNNGLFSTVHPAKPGASGVPNAFGGWGLVDLRRAMNGPGQLLGTFNAALPAGTADVWSNDISDVALAARKREDDAEHRAWLDTLRTKGWEHGLPAGASDGDRIDYALGVARETAYQAREYQGSLVKSGGGTLTLAGANTYRGPTTVDGGELRIDGSIAARAVVNPAGRLTVNGRAADIAVNGGVATIAGTSANLSIDRQGRAAVTGTTADVRVASGFASLGGTSGNVAVGALGVAAITGRTADVAVDGGRASLDGASGNVAVGNGGVVSGSGTVRTLTAAANGTVAPGHSVGTLTVSGDVRFAPGSIYAVEVSPGGAGDRIVAGGRAQIDGGALALALENTPPPLTPEQSRSVLGRRFEILNAAGGVAGRFDAPSGYLFVNPVLAYGPTTVSLTIDRNATPFASVARTANERGVADALETADPGSAVYNSVLFAASAQAPQATLAQLTGEIYPAAYAALVNESRQVREAALERLWTARGAPGRAGAWARLLGAWGSARGGDVNGYTSSTGGFLAGADAALLDSVRAGGFAGYSHTGVNLRNQPSSASFDSFHLGAYAGWQPGALGVRIGAAHAWHRGGVDRAVQYGAVAENETTALHAETTQVFGEAGYRFALDGAATLEPFFGVAYVHLKNQGTTETGGAAALRVRQGNHDVTFSTLGVRGETRLGLTSRLQLTLQGSAGWQHALTDGQPSGTLAFATGSDTFTVSSVPVAKDAAVLNVGAGLELGKNGWLRVGYSGSLASRQSEHAVQGSLHWKF

SEQ ID NO: 8149 - protein, 242 aa, Xanthomonas campestris pv. campestris
MKTTLKFVAASMLLATTSHAVANDYKTTVEYRHEYKDGNNKHSDRVKAFIDTGKNIGFELDARYNNDEEDKMYDSMTMNGSELSIFYYTKLKPNLTGVFGSSLDFNPDGLVYVPYARLNYSFDNGFRIQGRYKWKLWDYSQEGTDGNSYHSKIQQFDTWLGYKTGDWDFQYEFQFWKEMEGNGKALFDNGSTDYLHNVRLMYAFNMKDGEKWRPFIELGQVKLNRTTDERQLRYRVGIKYTW

SEQ ID NO: 8150 - protein, 101 aa, Xanthomonas campestris pv. campestris
MSNQFGDTRIDDDLTLLSETLEEVLRSSGDPADQKYVELKARAEKALDDVKKRVSQASDSYYYRAKQAVYRADDYVHEKPWQGIGVGAAVGLVLGLLLARR

SEQ ID NO: 8151 - protein, 996 aa, Xanthomonas campestris pv. campestris
MSSRSLHRTRRHRLSAALLAVLVAPAGHALAQSENGVAPDTTDLDKVTVTGSRIARTGFVTPSPVTAITAEEIRATGATTISDLMARMPALAPSYTLGNSTRFIGTAGLGLLDLRGMGVDRTLVLVNGRRHVGSSPGSTAVDVNTIPVEWVERVEVITGGASAVYGADAVAGVVNFILKKSFTGFETRAQTGLADEGNYNRSFASFSAGTDFAGGRGNIAVSGEYSKQDRFGRGNRAIGREYLVTVPNPAYDPTRPPSERNPQNVLSGPGGNHSTSYGGTFNLGTFDFRNPASYGNRYLFNEDGTFRRNRYDGTVVSNTSCVDCDFADLNAVADLQPGFDRKSVNTMVNFELSENHRLFFEGKYSETDSEFFGQPAFDSSLRVRRQNPYVSPELGALMDSRGATQILMNRFNVDAGRRGENIERKTYRAVLGAEGNFTDNWTYDVSANYGKTTVDRQNLNNRINERWQAGIDAARDASGNIVCRTTLDPNAINPNTNRVYSALAREGCVPFSVFGNGAVSPEAAAWFNTTARSQAKIQQTVFSASVANSNLLSLPAGDIGIAGGVEYRKEQSEEITDPLAASGVTFLNAIPNSGGEYTVREVFVESTIPLLAGLPGVDRLALDLAGRYSDYSSIGSTKTWNIGLDWTIIPSLRLRGTLAQAVRAPSIGELYDSQSENFATINDPCNYLSSNSNRPGTAGDVALRQANCSALGVPVGWIDTYTANRPGVSGGNPELKPERARSLSYGLVWQPEFFEGFGMSVDYWRIDLQDAIGSVTAETNSTRCVDNPGGINNSFCGFVQRAPLGGFTDPQGRIYPEHSIIGWQALNENLARSRRVGVDLEMDYRFQLGEGNTVLRLVGTRLIQSREWVFQDFPEEYDEYVTYVTDPRWRAQFQTKYNWNEWRASWDMNYVDGNLRVTPESYNSNPGSASPIKNGSYTYHNFQFGYQFPGSKIDVYLGIDNAFDKDPPRNYFGSDFTSALYDNVGRFFYLGTTVKF

SEQ ID NO: 8152 - protein, 1064 aa, Xanthomonas campestris pv. campestris
MTHPRCLRMSKLTLGLVAALAAAPVFAQSTSAGVAGLVTSSGGQPVPNAEVTITHVESGTVSRATTDASGRYNARGLRVGGPYTITITASGAGNTTREGVYLNLDKVNQVDAALGSDLATLGTVQAIAGNYGSDIFSANKMGTGTNVTREEIESLPSINRNLQDYVRLDPRVAQTDKARNEISIAGQNPRYNAIRVDGISTNDAFGLESNSLPTPRQPFSMDVIDEISVDVANYDVTINGGTGGVINAVTKSGTNEFHGSVYGTYRDNDWSGKNQNGIRPQLFDNEATYGLTLGGPIVKDKLFFFANYEKYKGKGVFNGNSGFGPTGSGASNTVNISQAQVDEIVDISRNVYGFDPGTLALPALDSDSEEKGFKLDWNISDKHRGSFRYGKSEQSTANLNGFSTSSLALNSYHYVRDFELETYTAQLFSDWTEDFSTEAKVSYRDYSAIRTAASQLPAINVRVGANSVNLGTEANTQANELRTKTWNAFFAGNLFLNDHTVKFGFDYEDNDIFNLYGPRVFGSYSFESIAAYRANRPVSYRYSSSNTRNIDDIAANWGLRNLGLFVQDTWAVNSNLTLTFGLRYEKQLVPNSPQFNQTAFDAFGVRNDATIDGNDLWQPRFGFNYTFDADRPTQLRGGVGLFQGAAASVWLSNPFSNTGLAYTDYNFRNASQITRGNIRFTPDVNNQPTGTGGATQSVDFVDKDLGQPSVWKANLAFDAELPWHGIIGSLEGVVTRVNEAIYYQQLNLGAPTAVGQDGRQIYWNAVGRNRANWDNQGRVSGNALARANSDQRFNDAIIARPTSEGATQSFTVGLNKPFNDSDWSWSLAYTYSNAKEVSGLTSSTSGSQLLNTAAFQANEEVNATSAYEIKDSFLGTLQWKHNFFGDYATKLGLVYQGRSGRPYSYTFDNDANGDGRANDLLYIPKGRGDVLFGSAAEENAFWNYVNNDQYLSTHQGQLAGRNAVRNSWVNQFDLHIEQELPGFFDGNKAQIWLDVMNVGNFLNKNWGRVDEYAFPGFKRVVEYGGIDAATGKYVYRFNEPAQSTVYDDKGISRWALQLGFRYQF

SEQ ID NO: 8153 - protein, 918 aa, Xanthomonas campestris pv. campestris
MLNHKRSALSIALAVVLAPTLASAQSTQSTTTPAATAATNLDTVQVTGIRRGIENAIAIKQDATSVVEAISAEDIGKLPDVSIAESISRLPGLAAQRVAGRAQVISVRGLSPDFATTLLNGREVVSTGDNRGVEFDQYPSELVNGVTVYKTPDAALVGQGLSGTIDMQTARPLSFGERVIAVSGRYQKSSLGRAANVDPYGNRFSASYIDQFLDKTLGIAIGYAHSDMPIQENQVGLYEPWTTEHTDKGNRPGVAAGTYFSDGIKALRRTGNNKRDGVMATIQFRPNNSWTSTFDAFHTEAEQIDTANQFELNLSNYNGNYTPGLLVSNPQVNGNGSFTGGTASGVYPLVRGMYNKRKDKIDAFGWNNEFNFSGVKLVADLNYSKATRDELNLENNLQLTPMPQLDTVGVQFRQNGFSHISPGLNYSNPDALFLTNTIYGSGYGKVPKVEDRLKGGKLAATIALPDAIASWAPDLDIGVNYADRRKVKTQSEGNILLGAQGDANIASDLQYRPVNLGFAGIGYIPAWNVPAAVGRYMTFNPVDNLDYLIPKSWTVQEKITTAWARLNINTDIGVVGVRGNIGVQMQHTDQSSDSRYWDSSQAAGNNVQPYSNGRTYNDWLPSLNLAFMFPHQQTLRFAAAKQVARPRVDQMRAGLEFGVDTGTGRPGGSGGNPLLDPWRATALDLSYEKYFGEKAYVAAAIFYKDLKSYVYTQSVDNYDFTALLGSYVPPPGMTTPVLTTGTFSAPQNGKGGTLKGLELTASFPLEMLTDSLRGFGVQASATFNKSDITILDPESASSVGNDPISLPGLSKRVYNFTAYYERSGFEARVSQRRRSDFIGEIGNFNGNRSLRYVVGENVTDAQLSYTFSDSSTLRGLTLLLQGSNLTNEPYRTYAGSKDRPLEYIEWGRTYMLGVNYKF

SEQ ID NO: 8154 - protein, 945 aa, Xanthomonas campestris pv. campestris
MKSQGTPMSHSRSAGLLPPFSCKTPLRRAILLVLAAAALPAAAQQQGSDASASPETAQTLEQVNVTGTHLRRVDAETASPVVVIDRQRIEDSGKSTLGQLLQQLPVMAGFMAGPALNSGFSHGRALVSLRNLGPERTLVLVNGHRMAGPASSVASAPGVDVNAIPAAMVERVEVLTDGASSVYGSDAIGGVVNIILKDKYDGFAATVDYAQSTHGDANSRTLGVEWGKSWDRGGVIVGLSRNSMNPVFNRDRSYAAKAVEYFEGQVSEVRGANTRAFLTDGRRLTPAEGVAPGPVGQDAFRPYQRATDSYNVYDAQYLITPIERTNASLHGSFDFTPSIQGYMDVFWTRSKTTSRLDAFGLEMLGASDNYYNPFGDLLERYDLRSTQANTRVYTATMFQTNIVAGLRGRVQGTSWQWDAAAGYARYKDTLVRTGFSITSALNNAVGASFLDSDGVVKCGAPGAVIAGCTPINIFNPNDPATIAALRGTQRPVDLIDESEMRFVDISANGDLFAMPAGAVQAAVGLVYRTNKFAQGTTSDVAAADADGNCDYNDGCILQQGRDESVREAYAELLVPLLKGAPFADTLNLNLGSRYSKYDAWGATTNSKVAIEWRPVANLLVRATGSQVFRAPALGDLYGSPFTAVIDNTGDFQDPCEGYTGAPNPACTNVPNDGSFTNTARFNVVTSGANNIGFQLKPERGRSYNLGVVYDPLQNLSVNVDSWRVVLDDMLSGVGDQQVVSDCFEGREAAFCGLIQRDANGQLTRVAVPFAYNSGKVDIRGYDAGIHYRLADTAWGDFSTGLDATYFSSFRFAGETHNYVGENSSWGNMPRWRAVANLAWDKGPWHASWNTRYLGPTVNGSQYEDFCADTNADGSCRYFRIGSVVYHDASLSRKIAALHGTLALGVDNLGNRKPPRFYSYSNAANTEASTYDTLGRYFWSRLRVEF

SEQ ID NO: 8155 - protein, 612 aa, Xanthomonas campestris pv. campestris
MNDAVKSGLRRGTIAGSISSFAIAAMALAPFEAASAQTAPGAQLPPVTTPPARNQLTPPELRREDRSVTLTIDGDLERSPCVLDREEYSEITLTLSGVQFSGLEKVPGLSLQDAYDGYLGRELPLAVLCDIRAQANSILRSQGYLATVEIPEQNLSDGVADFGVVFGRLTGVRVRGDAGPSEGLVAAYLEKLTDEPVFNTQEAERYLLLADDLPGVAVRLSLRPAAGGAPGDLLGEIAVVRQRGVIDLNVQNFGSKAIGRFGGLVRGEVYDITGLGDRTSVAAYSTLEFTEQQTYQFGHDFAVGGEGLRLGMNLTYSVTNPDVGLPNFDVDSETFLAGIFATYPLQRSRRSSIFAAGGFDLVNQEVDVNNFALSTDRVRTLFARISGERTDERSVRRIDGYSPFEPRWRYRWGFEVRKGLDVFETSPDCRANPLACTTGGSIPPSRIEADPEPLLFRYDGALEFRPDPMVTFSLETFAQYSDDPLPAFEEFAAGSFSIGRGYDPGAVLGDSGVAASFEVSYGTLAPAGPEEVAYQPYVFTDVAYAWNEDPSRRPLNPDRLWSAGGGVRAAWGSKIQADAFVAVPLERPDLAIQRGDVRFMFSVTARLFPWRY

SEQ ID NO: 8156 - protein, 852 aa, Xanthomonas campestris pv. campestris
MLNKTPLCLAITLTLAAATWSPLAHAAQGAATGGAASAAAIDLERLEVRPQLEAQERAVDLKRASDAIQDAVASDAMGRYPDKNVAESLQRLPGVSVTRDQGEGRFVVIRGLDSSLNSVTIDGMTMGTPEDGTRSAPLDVIPSDSTERLKVVKSPTPDMPGDSIGGAIQVESTSAFDRDGRTLRGSIEASHQSLSGKTSPKGAFNYSDIFNGTFGVAVGVNYQDREFESDNTEVAYDTFDGGADDDLFAGEVQRRKYFIERTRMGANLNLDWRPDADNRYYLRTLYSRFDDAETRQRTIFGLSDGEVSANGDGTYRVDDLPADSISKRVRYRTKKEDTMALSVGGENRLSAATVDYKLGYTKTRERVNDEKEARFNYDGDDLAATVDQRSGIPKLGFSDNGWQSNDDFVFDRFVIAPTQVDDSERSAQINVRFDGEHSSLKMGVLGRWRERGVNVDENELRRGPAIDLSDWTTPAPEHRGGTLGQSIGSDGMRRYWNTSGDLYSARPQDVGGNLQTSLQDDYTATEDVFATYAMGTWDIGALRMIAGVRVENTQFDATGNQVDVAANGRTATVTPREASSSYTNVLPGLHLRYDSGNDWVLRFAANKTLSRPAFGDVSPRVSINRGDNEVSLGNPDLDPYRSQNLDLSFEKYLGSTGVISLGVFHKSIDDYIVQTINTNDAEFPGLQVTRSINGDTAKVRGAEFNWQQTLDFLPEGWNGFLVGASATLLDSDFNPGLENRAGDDFTLPRSSKRIYSGHLGYEKYGFSARVAAVYRSQYLDTIGQSRAYDIYVAPHTQLDFSMNYQFNSHVSLYLEAQNLLDEPLELYQGIRSRTLQNEEYGRTYALGLKVAL

SEQ ID NO: 8157 - protein, 534 aa, Xanthomonas campestris pv. campestris
MTALGVLAGMNANSKATVVPDIDVAVDGPPVVTVPENIEVNPAAGSNTAIVSFTAPTATDAVDGTITPVLVSSSPTEGLDSGSSFPIGETLLTYTATDDVGNVGTASFTVTVSDVTPPKKATGIIITTNSDGSINVEGMAGLGTMVEVTFPDGTTVTTSIAPKPGELIKARLSRNKQSTTTEASDNSGAFSLTSASMQPSGGVKVVVIDAAGNKSEASETGYVAGPTPEQTREQIAGYMQNRASQTIAAQPDLIGLLSGASMGGFNAYVTQGNGNFDFATSGDQPVWATLQGSWSEFGTTESSYFFGAVGAHTKLSPDVLVGIMFEFDKLTQTDGASSTEGDGYLAGPYFVAKLPNQPLFIEGRLLTGQTENQVSVVGVGGTATETFDTQRTLASIKVAGQLNYGELVLTPSLTATHLRDAQDTFVNTQGNIVAAQGIEVNSVATGLNFAQPVSLSNGELMLTGGISGIWSSSEGTGFASSVAPTTDGRRARITLGANYTLPNGIVLSAESFYDGIGMNDNESYGLNFGVQMQF

SEQ ID NO: 8158 - protein, 1120 aa, Xanthomonas campestris pv. campestris
MSHGSTVIRLFLAGYFLSGSLALQGQTLGSIAGQVRDSSGAAIPEAKVTATNAGTNAQRSALSNEAGDYAFPSLPPGIYTVTAERPGFKTLVRSRVEIQVQQNARIDFELQVGLVSESVEVVANAVMVTENSTVGTVIENRRIVELPLNGRNYLQLVSLAPNVSTGFSTQGQAGARQGGIRAAQTISVSGQRTNFNHYTLDGVENTDPNFNTFVVMPSVDALQEFKVQTGIYPAEFGRQTTQINVLTKSGTNQYHGTAYEFLRNDKLDATSYAFTSLRPVKDPFKWNQYGFTLAGPVWLPKIYKGKDKLFFMGNYESFRKRGSSTGLFSLAPAAFQGGDFSTLANRIYDPLSRARAADGTLTGTPFAGNVIPANRISPTSKKLLEFYQTPTLPGVTNNYVQALSRPQNRDQFILRMDYIESSKSSWAGRYSWGDENELTPGLNQNGGKLVTNLEQYMGSNTRTISPSAVTETRFGYTRFYNSVGTLLAFQRNVVDELGIPGLKGGDPVSWGIPAVGIPNYTGIGDSTDGPFENNNSSLQFLNNTSITRGKHSFRFGGEVRKDQFNQVGNQFGRGSFTFAITPTQDPRALTAGSGLAAQGDGFASFLLGNVTLTEVAAQIAAAQFRATSFAFYVDDVWKISPRLTLSLGLRYENTPPWEDISGNLTTVFYNAFDNTPNVADQNRYPVFLRQGKSSGDPYAGLRVRWPNIPLVQDGRLGDRLVNRDNNDFAPRIGIAWSPTPKWVVRTGAGMFYNQDQGNPRFDVARNAAGRTRNDDNPDFPSETWANGAAALSGSVANILTPQAFSNKFDRRTPYSMQWIFNLQRELARNLSFEAGYLGSISRHLESYRGVSAAVPGPGTVASRSPYPNWGLLVLVEDGGRGNYNSLGTKLTKRYSNGLTALVSYTFSKSIDTTSGIRTSDSDSLFSQDGRCMLCDRGLSAFDNRHRLAVSGLYDLPFGKGRRMAINNPLLDAVIGGWQVGGITTWRSGFHINPGAGVNRANTNINVDRPDATGQAVSLDTPTTDRWFNTAAFALQPIYQFGNAARNSIPGPAGFMLDSNVQKSFRIVEGHELQFRWESYNLLNHPVWGFPNSNLSSPSFGRIISTAVNMRQMQFAMKYVF

SEQ ID NO: 8159 - protein, 1033 aa, Xanthomonas campestris pv. campestris
MNCMPFARNHSTLSAGIAIALFASAASTSVSAQQANGTPAPTGQAEVQATDLDAVTVTGYRYAIEKSLEQKRNANAVVDVITAEDVGKFPDKNVANALQRVPGVVISRVAGEGKNVSVRGLSSELVLTELNGNYIATAESNGDPTRSFNYTLLPSNLLGSAELYKTPEARIDEGGIGGTVILQTRRPLELEPNSGFVSAEGTWSDTSKKTDGQFSGSYSWHDQDNRFGVFVGYTQQKRTARTLNASTESWQWYGRDEGGPAVDVNGNPSDFNANWWGGTGFWNQDGNYSTGFMMPTAVSLDAKREERERKGGQLTLQFKPTDDLTLTANYFRFDLSQDSQTNTIKIPEWNIARYNGDGNWRGGRLLDGLQFDPSGTIVTGAAYSLRPGKTYYCSEAQAAAAGLPPGGWGSDDCTVPTPQITGSYNIEKSQSQTVDLGGEWRGEQVDVAFKAGRTWAKGGPELQFSLPIKPRLQNADGSWTNGNFASAWDLTGTPSMTFSPQLMQNLRDGILQVDLGSTGSSWTRNTNQQQYAQIDTTWHFDGEVFDSLQFGIKRRDGGIHRSTGNNYWVCPGTDPSDYDNRYWNGRCNAIATQFSPGLLVAQDNLAGGVNASAFPAINFPGYIGYLNQTYGAMQTRSEDNFVYNVDEEIYSSYLQLNFHTERLRGNVGVRVARTGQRADSTDKVTAYNDYFFDAADGNPLACQQGAAMPSGAPADTYCGTEGYWRLSDSVQRTESFVISGLDRNYTDVLPSFNLAYDLTENLLLRAAAAKVIARPSYNDIAAPGSLEFYSPEYVADRRLTGGASEQGWYGSGSNKNLEPYKANQFDLGLEWYFHPGSVAGLGLFRKNVENFAVDVISDVNMMVDGQPVTVQNYSTQAGGQDAVSQGVELYAQHTLPFGLGVQFNYTYNDASKAAVRLEDGTEAGKTSMPGSARNQTNLTVFYEADSLLLRASYNRRGELVQGLVNGLNVFEEPYYQIDLNAAYNITPALSLTASVLNLTKQESRSHLGDDTRARFYTGGYAGRLAYLGLTYKF

SEQ ID NO: 8160 - protein, 697 aa, Xanthomonas campestris pv. campestris
MTPKTPFKPLAYLSASALLLSLLHSPFALSDDTVVLAPVKVEADLRQSEAEDMPVSITVIDSAELQDAGATHTDDVLLSAPNVNVSNQNARIKHIQVRGMGERDEYTGAPNASVGLAVDDIDFSGLGGIGSLFDVQQVEILRGPQNTRYGQSAIGGLINIKSNDPTPFHESLIETSIGQYGHKELGLMTSGPMSDKKDATQYRIAVFKHQSDGFYNNATLNRKDTNAKDELTLRGKLRIFATDNTTVDLTLLHADFNDGYDAWSRDNTFTTRSNQPGKDDQLSNAAAMKVTYEGNTAYNVISTTSLSNTDALYNYDGDWLAKPEQFYENQKHRRHISQDVRFQSKESARIFNDSTDWLVGAYYSNMDESNYTDNYYAGWTELIDSDFNHQKLAAYSQLDQHVSSKQTMTYGLRLEHNQQTFKQTKKTYSDQTLTDDFSPDETLWGGSIHYKYRYNPNHMAFAGVTRGYKAGGFNAGSGSSTNVTYDAETLLDYEIGLKSNYLNNRLQTATTLFYMDRSNPQFDGYSYDSAGEWIFYKENLDAAQNYGLETSFDWQATYAWQFFGSLGLLFTEVEGIPQNSSFTMSGRDQAHAPNYQFHLGTQYRAANGFFARTEVRGMDSYYFDNVNNGKTGAYQIINARIGYEAKDWEVYAWGNNLTDERYATRGFKFDHYDGDGVQEYIRLGDPRQFGATLRVHF

SEQ ID NO: 8161 - protein, 488 aa, Xanthomonas campestris pv. campestris
MRARRIATVAAAGMIAAAPALAAAPKDPSTAELLAEIRRLANRVEELERKKPIAASTEQRLEKLENHNAAVEKALDQDTISETEPQVAARLKAAESEVLSYKKGSKVIDVLGGIKVGAGMSVVGQNLLGQSQEKDGQLNWRGDVTLTIPGGSVGDSKGTIFTHLRMGQGRGLGNVSNSMASVNSTAFQRSGADNTDAAIGLVEAWYQLDMPLGGDAKTAKQHLEITAGKMDPFGFFDKNAVANDETLYFMNSALVHNALLDAGGDVGVDPFGFSPGLRLAYVSDADKWKVQAGVFESGTGASFQGSNEFPFRIVQAETTERFFGGLEGTYRVYAWSNDRATDFDNKRGRHAGLGLSLDQKVDDYVTLFGRYGYQLKGKTRFDQSASIGGEVNGSYWGRGADGFGVGLVANHLSKTYRDKSETLDADQDGAPDVGYKATSFEQTAEIYYRYRVMPRFDLTPDLQIIRHPGGNPSGEVAYAVGLRGQLTY

SEQ ID NO: 8162 - protein, 405 aa, Xanthomonas campestris pv. campestris
MTGILFMKKAAAAWLVAGSMCAGAHAQGTVTLYGIVDAGLGYTSEQRVAQTKGALGSPVGYRNESSYGFASGTWSGSRWGLKGKEELGGGLAAVFQLENGFNIGTGQAGQGGRMFGRQAWMGLSSERYGTLTMGRQYDPIVDFVGTIGAGAFLTGMGAHPGDLDNIDNQARENNSIKYVSPKFGGLALGALYGFGNQAGSVKNQNTWSVGGQYVNGPFSLGAAYLYATNAYGANGGAWTGSYDGTFASSINEGFASAKSMQIVAAASTYQIGAVTLGLSYSNTRYKSGAFSTFNGTATYNSIGGTVSWQATPELRVAAGYDFTRGSSIDGQSAPKYHQVNFASYYYLSKRTALYGLVGYQKASGKTLDAYGNVVAATASVGDVGNGISSAGDTQTLVRIGVRHTF

SEQ ID NO: 8163 - protein, 682 aa, Xanthomonas campestris pv. campestris
MRIKVLVPAMLAAAFANDARAESGDSAVTMGSVDVRQGGRGQLAANRVLTSVDVLGGDQVENKNVMNSWELLGQMPGIQLTETRQGTESGKATFRAFNGEGYINGIKILIDGVPSNVNSGNQRFIDMVFPLEIDYIEVVRGTNDPRYGLHNIGGNINFGTRQGGNYTDGRLTYGSFDTREAQLAVGREADGFAQNYFVGVQDSNGYRDHDTSQKYSLGGKWFVGSDADTAKLGLVARVYHHEADEPGFMTAEELATDRTASAAKNANDGADRDMRHLGVHLDLRLSDTLHFNNKLYYNSYEETRRVTFTSFPTGNAPRQQREWDEKQTGMLSTITWRQSELLTLEGGANVEHQDNGYRRLRFAYSVPTDFNAPPARAQNDDRYTLENVGAYVQAVLTPTAALKIVPAFRVDRFSGDTRLPGGVTAPLQHTGWIEQPKLSVVYSFNPGLHVYANWGKTFQVLTGSTAPAYLTAGQETFRPSINTGQEVGIKFTPAAGTEARLAVWQQDATDEVANMPATGTTVGLGETRRRGVDLQVSSHLGEHWVLWASHAYQEAKVISAFTTAGDALAGNEVIATPRYISNIGADYRPNAQWTFGVQGRMQGDYYIEERNTQGKFGGFALVDMSARYQLSERISLDLQVRNLFGREYAYTWYDNFFWGGNDQPMFSPAPGRTAFLSFNVKL

SEQ ID NO: 8164 - protein, 1049 aa, Xanthomonas campestris pv. campestris
MSVPYSVVAADNALSSQSTQQAKTITGKVVDVAGEPIIGASVLVKGSSTGSVTDIDGKFSVEAPVGSTLVVSFVGYATEEVKVGTASDYTVTLKDDTQSLSEVVVTAMGIKKEKKALGYSVSDINSKELMKNKQTNVVNSLAGKIPGVNITQAGGAAGAGSNIVIRGGNSASESRDNQPLFVVDGIIYDNSTVNTGNSGTDGMTKTATTFSNRVMDINPEDIESMSVLKGAAAAALYGSRAANGVIIITTKKGEEGAVRVNVSSKYTYSWANKLPEAQKQYGRGEYNTSGAFIDKTMDSWGDRIDGMAYDNIDDFFQGSSVWDNSVSVSGGSKNGSFYLSGSNYHQSGIIPTTGYDKTTFRFNGEQKYGILTVGANVSYSQASTDKTLTSAGLYGQGGNGAMTAVYGWPVDDQMSRYLNDDGSKYRILEGLQDLEDDVENPYWILNKNTLTDETSRFTGAVNASLKLTDWWDVSARAGIDKYTTSSNTLRRPGGAVKQIYQNGYMSKGDVNYQYITTNVMSNFHKTFGDFDLNLLVGTTTEATKTTNNTRWGYNFVTEGLYSFNNIIKANQYFKESTVRKRMVGLYGEFRASYKNLVYLTVTGRNDWSSTLPVNNRSYFYPSVSGSFVFTELLPKNNVLSFGKIRGSWARVGKDADAYSLGYYMWPVATLNGGKYGMGNSWTGGSVGLKPEIQDSYELGLEMRFFNGRLGFDYTYYQSKTKDQICAPRLAQSTGYIFLTLNGGSVENKGMELSITGKPIVTKDFQWETTLNLSGNRGRLGDFIDGVDIFYVTDAQVGAAKAGSIPNGGYFLGLTGNKYETAQGPDGKMYNVIDPSTGLYKDTQVETNIVGNREPKLIGGFNNSFSYKNFNLSFLFDIRLGGDIYNGTEYYLVTKGLSTKTINRESVSFTGVVNTGTAAKPSYETKTITYNANETYQVGNSTRSGKYMIQEYYKNYAKNAYNFITDTNWLRLRSISLSYDFKDLLKKQNIIKGLTATITGTNLFVWTNYKGMDPETCVSGSGTGGSGSAGIDYCGVPATAGMSFGINLTF

SEQ ID NO: 8165 - protein, 418 aa, Xanthomonas campestris pv. campestris
MYSYQIGRRASARAAAPHAVRRHHRTVALPATAIAACVAGLIPCIAHAQSSVTLYGLIDTSITYATNQRTQDAGSPGSGSVALTSGALNASRWGLRGREDLGGGTAAVFALENGFSGTTGKLSQKGVDMFGRQAWVGVSSRTAGTLTFGRQYDPILDFVTPLGASGPGWGGNLAVHPYDNDDSNRNLRINHAVKYTSATYRGLTFGALYGFSNTAGAFSNNAVWSAGLGYANGPLKLGAGYLKISRDRNAPNPDGALSTVDGSATITGGNQQIWAMAGRYAFGLHSVGAAWSHSATDGVSGVLQGGGITPLKGKSLVFDNFTVDGRLFVTPAFSLSAAYTYTMGRFDTRTGQTRPKWNHVVTQAGYAFSPRTDAYLEAVYQSVSGGNGNPAFNATVWTMTPSANSNQLVVALGLRHKF

SEQ ID NO: 8166 - protein, 743 aa, Xanthomonas campestris pv. campestris
MMQSQLRSLSQASGKALAAALMLTGVHGAALAQDGGATAEAEAPAYGDIVVTAQKREQNIQKVGVAISALGKQGLADLGRQDISALATKLPSVQVLAYSPTLTVFNIRGVSQNDFADSQEAPIAFYNDEVYVSALGAISGQMFDLERVEMLRGPQGTLFGRNATGGLIQVVSAKPTRDLTGFGTVTVGSYGQVATEGAISGPLSDTLRARLSFSTNHHGGYIDNSIGKDLGNSKFYGGRFQLAGDVGEGGEFTLKLQGLRNDKERTGGLYSHRTAIANADGLGEYVGRNDNPFGTCAGCDMFGYVQAGNDPFKVAFNGPNNFSRSYWSASLRYVQDLGGVTLTSISDYQYLRKRYGEDADMSPASTFAYSTSQNLDQYSQELRLSNSSDRATWVVGGYAIKIVSKNGYNTDLTGSLGLSEIYGGTLKTTSFAGFGQLEYNLTDQVALIGGLRYSADRKTIDFTHAENGVTDFTFDRASVGKLARQKFNDWSGKAGINFKPNEDTLIYASVNRGIKGGGFGTPAFNPGDLTTIPFKEEVLTDYEGGVKLTLFDRTTHLNLSAFYYDYKDYQAFELVDLALAVRNKDATIKGVEAEFNTRPVDGLYLQTFATYLDSKVKGVILPGGRVANTRMPQAPKWSIGWLVRYELDAGPGRLALQTDWKYDSAQYLSTFNAPVDRQPGRVVGNARVTYGFGDGKWEVAGFVNNLTDKKYRLYNLDLSGPFGFTQQAYARPRWFGASVTRSL

SEQ ID NO: 8167 - protein, 757 aa, Xanthomonas campestris pv. campestris
MTSAIRTCCTCLCSLLATAMLQAQSLDGDLVAANWDSPIVLTALDVSGRQLTYEDSTAFKLPVTLHETPRSVTVLDRVRIREQNFVRLEDTFRYVPGVFSRSQDGDSYHFLSRGFDMGPDQTMVDGFSGLLAGGTFSPSLFSVDRVVYLRGPAGLQYGAATVPGGVINLITKRPTERPFARAEVRAASYAGHGLDLGSNRSLEVSIDTGGPLTPDGKVTYRAAALVQNLGSYKDGINDRNRGLLAALTWKFGEDDRFELTPIFLWQRQPFGAGRAVSISPATSLSTADGLTGPIHTADLTPLSQNYSEGERVLENTIAGFDFRAALSDAWHAHVAYRFIQSDSDSNQFLVQTASLRQLEGRWVVSRRQAISEIGRQNHAFDLNTSYEFTPLAGAKNLTLLGFNGRFYQLTYSRAAATQPDQSPIDLYTGVPVSPLVDHRPALVNAFLNDDFYWNAYLQNQTSFADGRWTLTLGLGYGEQQFERDYSAVSAPPPQNLEALTATRKGDVTPNASLVFNVSPAVAVYASYSTSYSPADSSFENAAGQTGGFGPTTGTNLEVGAKLDLPASESTLTLSVFRTELDNVLVQSSPAELNPNGNRFYTQTGGGRLTKGIELGAETRPLPGWRVNATASYLDSVYRGEGRLRGSRTERTPPWAFSLYNRYDFAAGVLKNLGVSVGLIWQDQRWSAARTSAAPDPLLLPSYWRVDAGLFYRMGTHWDLALNLENVLDETYFVNGTTGAALELGAPRSLSLRVGYRF

SEQ ID NO: 8168 - protein, 713 aa, Xanthomonas campestris pv. campestris
MKLSPLSAAVLSVLAANLVHAESEVYHFEEVVVTANKIEQPLSEVAGSVAVITGKDLEQKGATELYDAIKSEPGVSVTGGAGRPQNITIRGMTGNRILIVKDGIKSADGFGANDINDKIGRNSFDMSNLESIEVIKGASSSVYGSGAIGGVVVVKSKQPGDYLVDKDFYSDVSATYAGISNKYKGATNLAFRAGKFESLLNLSYWEGEETRNFDEDLYQRDVDGVGGGYTLNYWSTDALMLKGNVEYYKENLSRKEGSSKIQKDGKWDTEDFDQQGYTEAFSAYVGLEYLPTNTWFEELDTKIYWRDMTNEDTTNRLMSRTNNNVSELRRTIDFRGFTDQLLGASADFISAFQHKNMSHTLSYGMSMETNLHERPSQSSVLDWNGLSLNADVPFAPARSYNFAAFVRDAIEIDHWTVTAGARFDVNQMKPESQNSISGYELKEQTSSELSPSLSVSYQLTESLNTYLSYNHGFRAPGYDKIYGYQNHDFVPLTPFVIVPNMGLEAETSDSFELGSKFDNGQTQLYTAVFYQKFDNFIDVKQITFTPDPNTGNYYKQYQNVSGVETYGIEASIAHRLNDVWSVSTKVGFVDGKDDEGEKVRTLTPWEGNAEIAYDDNAFSAYAQVNWAQAMDEVPQCEDDLGMVTDCATTSGWASVDLGVSYAWNFGLDVSANVVNLFDKEYIRYQDVAGIADSNKIYSTEPGRYFTVNAKYEF

SEQ ID NO: 8169 - protein, 704 aa, Xanthomonas campestris pv. campestris
MPSPSDAVQRHPSALSRALLSSTILASSLLATAAPALAQNNALPTINVTASRLYQGIVGASTTVITADDIAHSPAQTVQDVIAQTSGVQSTSLYGGVNGTGSSVDLRGFGATATSNTLFLVNGRRLNDLDLQGVDLSSIPLQSIERIEITRGGSGAVLYGDNAVGGVINIVTKTGAGGPPATFRVEGGFGSFNQRLAAVSAAYNYGPWSTSAFANGVRSDGYRANNALEQNNALGELRYSTPDLSAFLNISGDNQHLGLPGSRIVDPSIGVNQLQTDRRGTNTPFNYADKQGVNVTAGFTKSLWDGAELIVDGGVRDKRQQAGYFGDVPLSSFNASSFDAHLRTWSITPRLSIKNSIFGLPSKILTGLDYYDATYDSDRGQYRSTPPVHVYNLSQKTMAGYWQQTVGLLPTTDFSYGGRLQGVKIEATDRLNPAAPGYFGDAQALPLSSTETQHALHVGLEHRFNDVFSVFARAARAFRTPNVDERVASGPSYDPFFNAIPGTFNLKTQTSVDFEGGFRVKSGPFEMQTSAYNMNLTNEIRYDPVNFYNTNLDPTRRYGGETSASLRISDTLLLRGGGAYTRATFREGPFEGNDVPLVSRYTANAGVTWNVWQKYVVFDATARAWSNRFMDSDNSNRQTKIPANATVDIKLSGELDHFFWSLSVINLFNAQYYDYAVASSFTPGRYGAYPLPGRTYLVKAGVTF

SEQ ID NO: 8170 - protein, 686 aa, Xanthomonas campestris pv. campestris
MAGQPDERTAEDGRPAGAPNGAEVELPAVTITASKRDQSLASINGAAAVVQQPALDDAQVASTQDLQRVLPGVEIAGGGSLLFPVISVRGVSSAQDFYNPALTLYVDGVPQLPTFTSQTLLSVDRVELLKGPQGTLYGKSAEGGVLNIVTLPPDDMLRVRLRTGLSSRGGNVEQAEVAGPLVKDLLYGSVSLAQVDAPGDLRNPVSGASHQGGSRALAGNVKLRLAPAGAPWEAGLSAGRDCTKATQDIYVPFDNIASRTANIDPRMPAQYAEPYLRRCGNSYALSGRYDFGQWRLSAVSAWQTVDIARRFPYLQYFLQQPEQWRQNVQELRLATRAPKRRWDAVFGLYRQDVHQSRFSTYDMVIPSVVNLTTTTSGNQSKSLAAYGDVTWHATDALDLSAGLRASRDQAWTAFAGTTMTSSGAYSTFSGANASAGNRVLGKVSAGYRLDPAWRVYANVSQGYKPGGFNLAPSSAADARGYGPERAISREIGARYEGRSLRGNVALYRIDIHDAQLFSGNALGYQTLSNVGDTRSTGAEFGLEWDVARGWTAGLDGFVNHATFRSYTDLYGCTACVGNDVPFAPRYGLTLNLAGKVPTAIGVVRPRVAVRWLGAQYFDTANRLRQGGYALVDASLGWRPRHDIEIALYVQNLTNRDYRTYAFAAPTGNLAMVGLGRTVGMTVSFDY

SEQ ID NO: 8171 - protein, 789 aa, Xanthomonas campestris pv. campestris
MYALKNKSLLSMAIAMAVSTSVYANDKTIEEITVVAKPTSYANNVIEPAMLEQQSSVASILSVIDNLPGISINEGDAFGGDDWSTTITMRGFSIDGNQQQLGMTVDGIPNGGSNYGGGAKANRYLDSENLATVEVGQGTSDIKSASLEALGGTFNFVSKDPSLEKGTTFAYTSGSHDASRYYIKHETGTVFDNTQAYVSYSQTDTSRWIGSGSNGGKDNQHAELKFVSNFNDLTLTGRLSYDDVSETNYNSVSIEQFEQTPNWDQLTWNWTGVPHFDQMFAEGWGTLRENTLGYLKFEYAISPTSLLTISPYYHKNSGRGDWIPPYLTTPVDENGEPTTQGGTNAGSYGFADSEGNPLAPNSGCTASLSWPWESGPDLNPACYDDTATPVMSYRHTHYKKDRLGVTANYQATFGDHDIEAGFWYEQSEREESRDWHKVIDARIFHHFENTPYWTQYKNTFDTDTFKWYIQDSINLGDLTLNIGAKQYLVELQKYDHFANESSDKVDSDSDVLFSGGALYQLNNDTELFASYSENFAAIKDGVLERDSSTLTEIEPETAKNIDFGVRYQADRLTLSATAYSVKFDNRITFIAPGSDSGGIDYTIGTNGSYINVGGIDSKGLELSASYMLTPSWSVYSSYTNSSSEYSSDDPNAYDSQGVLLQDKDGNTAAPSFKKGDSLIDTSEDLLVVSTDYFSDGFRVGLSAKYTGERLGAWQDEGTRARNKVDGYTVLDFNAGYSTDVDAGPFKAIDLSFVVYNITDKSYLAGGTGNGTTYFIGAPRTAAVTFTADF

SEQ ID NO: 8172 - protein, 713 aa, Xanthomonas campestris pv. campestris
MRPTLLVTALAVALALPAPSAFAQQTSTSPAVTELDGVNVVGRAQTLYKSEDAAVATRTDTPLALVPQSVQVLPRELIDDQAARQITDLYRSISGISFFSYAGVTLRGFRQENVLYDGLRGDPYAGFSVPQLFNIERVEVLKGPAGALYGGGEPGGVINYVTRKPSHQALRRVELQLGNQSFGAASFEATGPAREDGRIRYRIGAYADGEDGFRWNTDSESQIGDASVAFDIGETGELTLQYTDITQNLGGNRLRGVPVDDDGNFLTNRRWNHNESTDFLDMRAKVAFAQYKFAPSSAWDVDMALRWFKNDEHQIYHEPMGLIDRDGNGIAEWMTRQLRNQYRDNDALSSNVNAVFRTSTGAIGHKLLMGADYYRLDADFRAQTANTADTGRTRGPVPGIDLFNPVYGRSGFYDYGLDTLPWRATSTRSQRYGAYLQDELTLTERWFAMAGLRWDGFNDDNRLDGSRITGNDLSWRVGSTVVLREGINAYASYASGFLPQDAANQDSSVGGPFDPERSTQWEVGLKTALNDGGLTLNTALYRIERSNIVQANGSIVDGVNQLSALGLVRSEGLEVDLLADLTERWVLNLTYAYNDARVLDAGTNGITNASGDRFANAPRNTFGLWTRYELPAWNSAVAFGADYVGERLSLEGQRVKPYAIFDISWQTQWDAWKLQVNVKNLFDKVYAASGFTERTGHFPGEPRRIYAQLAYSF

SEQ ID NO: 8173 - protein, 414 aa, Xanthomonas campestris pv. campestris
MTHHTKIFLEDGESMKKRTAVAMTAAGLAAVATAHAQSSVTLYGIVDNGIAYQSSSTSLGSTTGGRSAVKMSTGVWAGSRFGLKGSEDLGGGSKAIFQLESGFSTANGTSQFAGGIFTRQAWVGLTNPTYGTLTAGRQYTAYYTLLSPYSPTTWLTGYFGAHPGDIDSLDTSYRTNNSLVYLSPKFYGFTFGGSYAFGGQPGSVNAGSTWSAGIQYMNGPLGIAAAFQRVNNSTSGGGDWGANSTTSNGGAQTAVSAINNGYKTAQAQQRVAVTAGYQFSSAWDISVSYSNVQYIPGVNSAFRNTAIFNTAGAVLHFKPSAQWDFAGGYAYTRATQSNGITSAAQYHQFTLSQYYSLSKRTGLYAVEAYQRANGKTLAGGKIIDATASIGDGFNTSPSSSRSQVGVGVGLIHRF

SEQ ID NO: 8174 - protein, 228 aa, Xanthomonas campestris pv. campestris
MRSISILSLAAVSALAIAPSAFAQDTTYTGDTSSTSSSTMSTSGDTASGKHWAVVGGVALLNPKNNAAPGLDVDGGPAPTLSASYYINDNWAVELWGAADKFNHRVNADGVGKVGTVEQQPIAISGQYHFGEADNVFRPFVGVGYYESNFSNEKIDAASTTGDHVGLSTAKGVIGTVGVDMNINSTWFARADARYMRSRPELRVGGQGTGSELELDPWTVGFGIGARF

SEQ ID NO: 8175 - protein, 224 aa, Xanthomonas campestris pv. campestris
MACARPAIVAAAASLVAAAVCPTAYAEGIDLPPATGNWMVRLRAVNLTAANKSDAIPALAVPDDAIHINNKAFPELDISYFFTPNLAAELILTYPQQQDVTVMQSALGGPTKIGSFRHLPPILTLQYHFRPESRFKPYLGAGLNYTRISGVDLQVPGVGPLDLSRNSFGPALQAGFDYRLTDRIYLNVDIKKTWISADVKLAGQTISKVRVDPWLVGVGLGYRF

SEQ ID NO: 8176 - protein, 547 aa, Xanthomonas campestris pv. campestris
MSSLINNAMSGLNAAQAALNTASNNISSYNVAGYTRQTTIMAQANSTLGAGGWVGNGVYVSGVQREYDAFITNQLRAAQTQSSGLTARYEQMSKIDNMLSTSTSSLATQMQDFFTSLQTLVSNAEDPAARQALIGKSEGLVNQFKTTDQYLRDQDKQVNIAIGASVDQINNYAKQIASLNDQISRLTGVGAGASPNNLLDQRDQLVSELNQIVGVEVSVQDGGTYNITMANGYSLVQGSTARQLAAVPSSADPSRTTVAYVDGTAGNIEIPEKLLNTGSLGGILTFRSQDLDQTRNTLGQLALAFAEAFNTQHKAGFDANGDAGEDFFAIGKPAVLQNTKNKGDVAIGATVTDASAVLATDYKISFDNNQWQVTRLASNTTFTVTPDANGKVAFDGLELTFTGTPAVNDSFTLKPVSDAIVNMDVLITDEAKIAMASEEDAGDSDNRNGQALLDLQSNSKTVGGAKSFNDAYASLVSDIGNKTATLKTSSATQGNVVTQLSNQQQSISGVNLDEEYGNLQRFQQYYLANAQVLQTANAIFDALINIR

SEQ ID NO: 8177 - protein, 250 aa, Xanthomonas campestris pv. campestris
MKKTCLCLALMLSPQAFAGDLVQWWDFSATALYGEDYDLAPSDKQTTVTLETAGAWKYGDWFAFQDFIYFKGDHTGMDSTTYGEISPRFSASKILGEKIAFGPITDLSLALTYEEGEGPVHSLLYGLGVDVAVPYFTYLNFNTYRRDAMSSGNISDGWQFTPVFRIDIPVGSANIVLDGFIDWVFATDNSGYEENFHFNPQLKYDLGKSLFGDHKANKLLVGIEYDLWTNKYGVKGVDQDTYSVIAQYHF

SEQ ID NO: 8178 - protein, 682 aa, Xanthomonas campestris pv. campestris
MPVGSATIPGLTPSGVASASSDDAVGGVDLGAVPYEERVVTASRRAQSSLDAPNATTVITAEDIRLSGATSLPELLRRVPGADVMALGVGSANVSLRGFNQRIANKVLVLVDGRTEYQDFLGLTIWSSIPISLEEIERIEVIRGPGSALYGANAMLGVVNIITRAPGTGPRAQFNVTGGTGNTAAGSFVSHGGSGTMRYRAAAGYSQTDKWSRDYASGLPDVTLRGPDPDLGARGARASLSAVYTFAEGRQVGLSGGVNRFTTEIYPPGLLRNYFIDGVNAFAKGDVELGPLKLKTFWNHISSDAGPQYEATGQRSLVTSLNSNLFNAELLFARDFELAGTHQLNIGVEGRLKRVDWGDYLGPLREQVHAAFFVQDEWRIVEPLALVASYRVDRHPLLNLGSPGLAHSPRISALFKPFENHAFRASAASAFREPTFLESYTQLTVPVPGINGVSTLTTGNQQLRPERLTAFELGWRGEAPELGIDLDVAVYQNTVRDLIGLSGVSRLPPGQSYDPGTGSYLLGSSSFQNEDAIYTARGAEAGVTLAPVDGLGLKLSASLQDVTSDRESAAECGPCNQAPQFRLYGGLTYRSRADLEFGVDAAYTSASTWIEREPAAADPTRIELVSNPLRAYTVVNARVGYMAVKDTVTVALVGSHLGGAHSQHPFGNRIERRVYATLTVTP

SEQ ID NO: 8179 - protein, 710 aa, Xanthomonas campestris pv. campestris
MSLYRQAVVAYLGLLLGTSCNSMAEEAASDPLELGETRIVDDQLADGSAELGYRVESIQLGPLGNGKLQDTPFSINTVSGELIRNTQATNTTEALKYVPTVYSNTGASQITPYFTLRGFTASTWTYNMAVDGMRNFDVYQPMEDKERIEVLNGANGFLYGITSPAGIINYTLKRPTKRTLREFTLGTYDQQVYGHLDLGGSLTDDLRYRLNLLQSDEGDTNGIDDQSQERHLYSGALDWQVSPDTLLMLDASRSRRDLEHAQALFMTSAAIGIPSAPNMAKNWGAPYTGAMDATNRFGIGLETRLNDVFSLRAKARYSRIERSYFLNRLSFVNKDLDYRWRVDSQEEFDTLVKQYNLFLDANFSTGPLQHLFTVGLTRDSYDSADTGYRGTTYATVYPGNLHGNTGYPAWTEPPRGTSTSQETHYTTLIFAERISIGDKWTIMIGGTRARVDDRSTSRSATGVETTTRYDEQEFSPAYSIAFKPIPAVTAYASYVESLQQGMVAGATQANAGEVFSPYVSKQKEVGLKATLGNMDLSLAWFHIEDANQNVDTATNVATQDGKAIHKGWEFSATGRLTERLTLTGGYTKLDARIDRASANEGKTPQGVPESMAKLYAEYDLPGSTSHSGLTLTGGVTYTEEVPWDASNTLYVHSVTLWDAGLRYRARIRDKDTTWRLSVSNLTDKDYWTTRSGILYLGAPRTVSLSSTVAF

SEQ ID NO: 8180 - protein, 151 aa, Xanthomonas campestris pv. campestris
MRENSIRINALELKNVDILNSEAPKEMTIVLDERSLNFDFDKSNVKPQYYDLLNNIKEFVEQNNYEITIVGHTDSIGSNAYNFKLSRRRAESVKAKLLEFGLSEDRIVGIEAMGEEQPIATNATKEGRAQNRRVEFKLVQRETIPMPTESK

SEQ ID NO: 8181 - protein, 406 aa, Xanthomonas campestris pv. campestris
MQRRYPEVKVAVTAAAMMLTGTCAFAQSSVTLYGIVDAGLGYQSSSTSLGSTSGGHSAFKMINGVWAGSRFGLKGAEELGGGTKAIFTLEEGFNSATGAMATNNLMFSRQAFVGLSNPTFGSFTAGRQYASYYQLLSAYSPTTWLTGYFGAHPGDLDGLDTGYRTNNTLLYMSPVIYGFKFSGSYSFAGVPGSVNQGSSWAAAIQYAQGPVGLAVGFSRINNSTPGGGAFGADSATSNAGAQAGVSAVTNGYQTAQAQQRFAVGAGYTFNSQFDVTATYTNVQYIPGINSLFRSEQIWNTGGIVLHWKPSPTWDFAGGYSYTRATTANGISSSAQYQQFNLSQYYSLSKRTGVYVLEAYTRANGQTLATNGKSIINATATIGDGFNTTPSSSRSMVAVGAGVVHRF

SEQ ID NO: 8182 - protein, 738 aa, Xanthomonas campestris pv. campestris
MSASRSLQVSALAVAVASLLPFYAAAQQAPSDDGIARLDAVKVTVERRSEDSKDVPVSASVLRPEFLDAISTSGSDIRVLAGKAPSLNIESSNGRVFPRVYIRGYGNTDFNTYASQPVSLVYDDVVQENAFLKGFPIFDLEGLEVLRGPQGTLFGRNTPAGVVKFNSVKPTIGANDGYASLSYGTYGTMTLESGLSIAMGEHWAARLSTLGQRRDDWVENRDGRDLEGYTDSAVRLQLLYQGSDTFSALFNAHARHLDGTARLFRANIFQPGTNQLVDGFDPERASIDGANNQELQTYGGSANLSWDLGDIALHSITAYEGIGKYYSRGDIDGGFGAVFAPPSGPGPIPFPVETAGGIKSLDQYSQELRAESQYAGPLNWQAGLYYFHDDVEGENYTYNTFSGGDLASYQLTRQRNTSWAAFGSLNYAATDRLNLRAGIRYTYDKKTFDVLALDRVTLVEPSSGETDNSKVTGDVAATFAINDAVNVYARAARGFRGASFGVPSGTAPLTVAEPETVDSFEIGIKSDLFDNRARISFDVYDFRVKNQQLTAVGGASNDVRLLNADKTKARGAEFDFEALITQNLRVTAGGAYNWTRIEDPTLSVGVCRTCTVTDPLNAAGNAIIDGNALPQASKWMANATLRYGIPMGDDGELFFYTDWSYRSEVNFFLYDSREFVGQPLVEGGAKIGYNWGAGAYELSVFCRNCTNQIRATGAIDFNNLTGFINDPRIVGAQFRANF

SEQ ID NO: 8183 - protein, 1028 aa, Xanthomonas campestris pv. campestris
MSRFSSLLCSLLFCMITYAQEITVTGKVTAGGEEMPGVTVAVKGQTRGTITSIDGSYQIQVNGNESLIFSFVGYETVTIPVNRRKVINVELKETTQMVDEVVITVPYGTAKKSTFTGSASYIAAGTIEKAQVSSVSKALQGTVAGLQSFSSSGQPGSDATILIRGVGSVNASTNPLYVVDGVPYDGALSSIASSDIASITVLKDAASAALYGSRAANGVIMITTKQGNKDSAPTVELSAKYGFSSRARADYDQLNTNQYYELYWEAMRNYRMDNGYSAEEAAVWASSNVTGNLGINPYGSAYPEPIGHDGKLVAGAKPLWDDSWDDALSQDAHYTDLNVRVSGGSKTSKYFVSAGYMDDQGAYICSGFKRYTLRANVTSDIRKWLQIGLNVSGTHSVQDYPKQDDSTISNVVMFARSVPSFYPVYQRDLATGAYLLDENGNRMFDYGEYRPNSYAKYNLLASMPHDKSEIKRDAASLRGFIQITPIKELAYKMSLNIDYNNKTNHNYTNPTYGTGSISGGSVSKYNYRTTGMTFNNVINYQHTFNDVHDIRVMAGQEYYEYNTSNFGGSRSKVIMDGFYEPDAASSLGDFGGNSDQYKLLSFFGSAEYSYNQKYFLSASVRSDGSSRFHPDHRWGTFWSVGASWKIMQEEFMKDTSDWLSNLSLRASYGAQGNDQVGYYAYQALYSIRNNLGESGLHAYRLATPNLSWETNLNTNIGLDFGFWNNRLNGTIEYFERRSKDLLFSKDLVPSSGFSSMDENIGAIKNYGWEFQISGYPIMTKDWKWKLSFNATTYKNKITSLPAEEMWSGNKKWVKGGSLYDFYLVEWAGVNPENGNPTWYRYNTNGEKITTEDYSSTTPDDKVKCGNSLPDWTGGLQSDLSFKDFTLSFLFSYSIGGKIYNGDKVSLMSQGPTGTGWSVDMLDRWTPENPYTDVPRLTTSPKSSWTNSSNRFLVDRSYLRLKNITFSYNLPKSLLNTLTLKDASIFFQAENMLTLAKQQGLDPEQTFGGSTYYRYPAMKTISFGINVKL

SEQ ID NO: 8184 - protein, 977 aa, Xanthomonas campestris pv. campestris
MKNSYARTALSCALGSILLGMSSTAAWAQSADAQSTAQTPPATAGNNDAVTQLDTVTVSGYRRSIQFSTDAKRDSVGFADTVFAEDIGKFPDMNIAESLNRIPGVQLARDVNGEGLNIAIRGLGTSFTKTTLNGASIATASIGLNAQNQNREVDLNLFPTEFFTQLTVSKTPTASMLEGGVSGVVDMRSARPFDRPGVHFTYQAQADWNSTSEKTTPRGAFMGSWTNEAGTFGALFGVASVRSKLGVRGFESVGWTNPGLTYTQCGLAPPAGTPATNQPAACNVNGGGNWRIPDTVPATAGSGLTTGETIDAAWLLARNPGLSIDQISDALIPRLGRSVYMSGDRDRDASVMSLEWRPSDSMHFYLDTLYSEAERTTERISMNLIGRNGNMIPLGMQLDQNNVVTSATFANAQYFLEARPYHENVKFWSVNPGAELLFGAEQDIKLNVQANATRSWLARESPSILVTSPFTTVDYRNEGGDRPSITSPLDLNDPNLGWGWTGGRVNIQNEKRQTETRGARADLQFGEDKRNVKIGASYDMAERTIRGFDNSTAWEQVVCRGNGGNVCNGGAGSAIPNAALASYLKPGPGGFITADFSRFLADTNYYALRDAAPESNSANTGASTGGIREKNLGFYIETNAEADVWNRTMRFNAGVRYVTTDQTITGPVTINGVRSVQVLDSDYKETLPSFNVAWDVADKVVMRLSSSRTLTRPDPSAMLPNTNFSDPSAQTATQGNPNLKPYLSTNVDFGGEWYTGGEGYVGLTLFNKRITGFTVNGIRRIPFNDLGVNYDTLLPIQQAGLAQRGGPNAATVDVQTQVNADGVLNIRGTEAIWVQPLDKLFDGLGFSLNYTHVNQQSEGEGVPAVAVGVAPNLWNGTVYWEKDAASIRLSYTWNDDMVISGANQNGIPYARLNADARGQLDMSASYALDWLPSKPQITLNVTNITNEPLRTTFAWPNATYDLYEPGRTVMLGIRGTF

SEQ ID NO: 8185 - protein, 1012 aa, Xanthomonas campestris pv. campestris
MKTYRTVSTLPARSLLCCALAASLLAASPAMAQSSNATLLGQVAASQAGTTVTATNVATGTTRRVATGPDGSYALVGLPPGTYKVDAGPGTEKTVTLSVASSVSLNLGSGGEATTPADGTATTLDTVKVTATSLQEVKTSEVGTNVSLKQINTVPQLTRNFLEFADTVPGMQFETDPNGNSRIRGGAQASSAVNVYIDGVGQKSYLFGGVSGQEQSAGNPFPQLAIGEYKVITSNYKAEFDQVGSAAIVASTKSGGNEFHGEIFGRTTNTDFRARQADERAGAPNADGSKRQTHQDEYGMAFSGPIVKDKAHFFVSYEGKGFEVSANPVSVPDSFSALSDDLPAGVQGRLGSVTRPFKEDLYFGKIDWDVGENDRLELTAKYRDEKSRDDVGDRNTAIAGKNNLNTEERYDLRWQHFGERYVNEARISYEDVLFNPNAFTLGNQNIYTRGVAEDDVLIRDNATSGLAIQRKGQKGPSFQNDLTFNSIDWHGSHVIKMGVKYKEVELTQSENSAVNPSFYYAVADGLGTSAIPYQVKFNLPFAGAAPSVTTKSKQLGLYIQDDWDVNDKLQLNLGVRWDGEKIPSYLDNVTPPEVVAALNGPGTDPTVSATYAEQLAKGGVNINDYISTGNNRKQDNNNFAPRLGFSYDFRGDESLVLFGGAGRSYDRNLFDILGLEQVKSALAQYTLRFAEAAPGCTPAPGTCVNWNPAYLSDPASLGGLVNSGVRNGEIDLLNNDLKTPYSDQYSLGLRTRLGEWNTSATVSYIHSKDGLILTLGNRYPNGDFFQNGGQPWNENPPGFGSLLIGNNGVETKTGQLLLSADKPYTQESGWGLTAAYTFSRARGNRGNDERYGFDAATIADYPFLDLNAVPRHRLVLTGIYDLFWGISASAKLTLATVPPRNEAVSYDQYGGQPSENIRIVSVDAPGGKFIAGGDIFGTRQLDLSLSKDMHVTEALTVQVRGDLINALNFRNYDQYAIDWGQDGVYNPRASINQYGALSTSPRTLFLSARIIW

SEQ ID NO: 8186 - protein, 1051 aa, Xanthomonas campestris pv. campestris
MKTHRISRITGALILALGLSTAAMANVTTSAIKGRVAGPSGNPAAGSIITIVHVPSGTTKTATVNEAGLFVAKGLRVGGPYRVVVDSNKFEDTTVKDIYLTLGETYPLSVALNSESALETIVVTGRSISMQSGGTGPAAHFNSDDLKYAPSINRDLKDIVRIDPRIYIDESRSDAIQCGGGNPRFNSLTVDGVRMNDSFGLNDNGYPTTRIPFSYDSIDQVSVELAPFDVKYGGFTSCNINAVTKSGTNEVHGSVFYDYSNDSLKGDSIEGEDQDNGDYDDKRYGFNVGLPLIEDTLFLYTSYEKLDGVQLFEYSPMTGSDPQVTQADIDRVNQISIDKYGYNAGGTPASKAVDDEKILVKLDWNINEDHRASFVYNYNDGFKLDQSDEWGMTLDNHFYESGAELNSFVGSLNSDWTDNFSTEVRVGHTELENRQESLDADSGFGEVQIRHNGTTIFLGPDDSRQSNEMNWETTTFKLAGSYYLDEHTITAGYEYESLTAFNLFMQHTVGEYRFGSIDEYENGLADRVYYNNSAGTNVPSDASQEFTYGLHTFYIQDEYTLPDIDMTLTVGLRYDRYTSSDNPRYNAQFEERYGIRNDKNMDGIDLIQPRVGFNWAVQDNLEVRGGFGLYSGGNPNVWLSNSYSNDGLVNISERAKYHKDSIAMVGEQFDLFNTPSSDPRGPGFGVPQVMVDSIQDLDELSGNASVNATDPNFEIPSEWKYALGATYTTDNDYIVSADILHNRKQDSATILDYNLEYGDKTFDGRPTYKEVTHPDGVKNVSNEYVLTNTKSDGSSTIISLALSKSFDFGLDASFGYSYTKSEDANPMTSAVAGSNYGNLATTDALNPPITTSNYEIPHRFTMNISYGVELIGGLETRFSLFGQASEGQAYSFTYDDSDGAFGDNNWSGDRQLVYIPTVDDANVVYGPDFDKAAFDAFVSAEGLARGQTTGRNAQNADWYVSFDIKINQEIPGLIEGHRGNAFFIIKNVGNMINDDWGVMKQGEFVGNRMVEMSVQDDGKYLYEGFNSGNEDQNFYKDASVWEMRVGVSYDF

SEQ ID NO: 8187 - protein, 966 aa, Leptospira biflexa serovar Patoc
MLQPQKEDQSKQHPTFTQADLNVRMLPLVETYMEVGGLIKNLQKTPSFSQQKLIDTSLASIKKEQKNLENIIQELNILRLKLVNKPQNETSYNRRIEEKLAEAKQIESRINGYQDKIKTNVGFITANKEDTHIVPKNNLALLGHQNIEYSLHRINSANSNKRPVLFDRLLKDLNKKKDEAKAVWEQFVIYKENKERKDLNGDENRQIKAAEALLKQYDNDIKLVEEAFENYKEDSRKSNDIQSPASSNLEYLALEEKFASLRKHDELDIETKYHELRRKRLDHEKSQLLQDLAQESQLRQHIEDLGSTPSSSNSSDSDVEIKAQGYSATPLKKYASVHSISDLVGSKEDLSVEFEKLVEAESLNNESKTDRENIDPKLKTEFKEIMDGFDRVAADINSELETLTAAKGLNDQPNANIGTKTEDASDQLLLSTNEHSSLGVSNGREDKPSSSGLIDGGKSEHRLLGVSDGKEEEDRFLGLSDGREDKPSSSGSSDGGKSEYSLLGVSDGKEEEDRFLGLSDGGKSEHSLLGVSDGKEEEDRFLGLSDGSDDKHGLLALSDGRENKNDSLKLKDGDDKRSFLRLKSGEKDEDSFLKLIDSDDDYDSGIEEDLEYSKPLKKIDAITTIPLPQAVEEVKKSVAAIAPTTNQQIQTVQKVTKDSIFTRLDSIAVVKINEDNNAAIAAGDEESPVKRGLWMRTMYGVNNQGRVNNINGYRGINKGGTVGFDVEIDNNIIGIAYSNVHSVFKFKNNNNNDKEIIKSHIVSIYGQKELPKNFVLQGLVSASKNFIKNKTTYLFNNTKFKSNVKHRNHSYNAEALLNYNYLATNNIVITPNIGLRYGKSRDGVYNETGISIQEIALATKENNILSGIIGAKTKIPLKNNNLGLTLHSSIEHNFNEKTQRVNRTIQIQGNKFTQNHIIPKQAKTAYNLGGGIIGSVKNTIISLDYNYYLNKRYHSHQGSIKLKVNL

SEQ ID NO: 8188 - protein, 374 aa, Leptospira biflexa serovar Patoc
MKMKLFAAAVAALAAGGAYAQSSVTLYGVVDAGLTYANKVPNGNGGGSSRVGLDSGGLSGSRWGLRGVEDLGGGLKGIFNLESGFTIDDGKSAQGGRLFGRNAYVGLQGQWGQLTLGRQQNLLYDFSLIYDPMAIASRYGLANQDAFFSGRADNAVKYIGTFGGLSVSALYSFNRDGNEQPGLPKLGREWSLGANYAGGPFSVGAVYDQSNQTTIATADNKEQRATIAGTYAFGPAKLYAGYRWYHANFATVAGNGNLRSNLYWLGAGYQATPALTLTGTAYYQQFKNSNAGNPWLFVVGTDYALSKRTDAYFNLAYAKNSSGSGLGVLNLNKTDSYAGTTLGSTNFGNQNVYSSPAAGNANQFGATVGIRHKF

SEQ ID NO: 8189 - protein, 891 aa, Leptospira biflexa serovar Patoc
MISSLYKKHSITFFYLMLLLVFSHSFISAQTPDMPFNIYLKQASLKEFTAKIEQLSEYSFIYGEEVVLKHPITLDLKETPLTTILQTAFIKQDISFEITKHHIILKKTTSLPIKQHFTLNGYVLDEISKETLIGANIYDQQNKQGTITNPFGFFSITLPEGNTELNFSYIGYGSKQIALYLCKDTLLTVQLKNDNTLEEIVVLSDKMETGFQSSRMGANNIPLTHIKNTPALLSEADVLKSIQLLPGIQGGITGTSGLYVRGGSPDQNLYLLDGVPLYNVDHTLGILSIFTPESVKKVDLYKSSFPARYGGRLSSVIDVRTNDGDMRNYHGSLTIGLLTSRMHFEGPLWKDRTSFIISARRSYADLIIKPFMDKDTKGGYYLYDINTKLNHRFSDRDRLFFSFYHGKDHASFTNTSSYYFEEEKETDTRERQVMAWGSTLGALRWNHIVSNRLFHNITLSYNRFRFNIKNNFTSANKHLDSQYYSGIEDWGLTSDFDFHPSPSHFIKFGGNYLYHTFRPETQHTFVHSPNEQEQPDKTYTIGGNEATHSHEISLYVEDDFKWNEQWKTNIGAHFSLFQVQKHTYASLEPRITVSFKTSPNLTFKAAYTHMTQYVHLLSSSNLSLPTDLWVPVTQKILPMQACQFSIGGYYTGIQGWEFSVEGYSKMTKNVLEYKDGNTLVGNSIHWEEKVEMGKGRNFGIEFMLEKKTGRTTGWINYTLAKADRIFSKGNVNGGKRFPYKYDRRHSVNITINRRLNKKVYMSASWIYASGNTATLPKEKATIILPEGSYGWGHMGNTGNGVVFPFEYSSSRNNYRLPASHQLNLGFNFHKKTKHGERIWNVSIMNAYNSLNPNHVFIDYYTDEQSEGKKIPVIQKVTLLPFLPSFSYTYKF

SEQ ID NO: 8190 - protein, 167 aa, Leptospira biflexa serovar Patoc
MVSIAGGAVTVTQNRGFVNGRVFTGYNFNKNIAVELGYLQTGDTTANIAGVSGTLVAYTGELKASVSGIDYSILIRPISNNEWNGLFIKAGGHYLEMDQKGSLTFAGIGTNTIKESVNGSGFLIGIGYDTPITDNIDLRSAYTYYGKIAGDSDSEANFFTIGLLAKF

SEQ ID NO: 8191 - protein, 748 aa, Leptospira biflexa serovar Patoc
MHHTRAILAIGTALGSSLICFSAAQAQSAAPAAQSTTAEGELAEIVVIARGRAESLQTVPIAVSSFDAKTIEDAGIERPADFISFTPNVSVAETQQPGTAFITIRGISQVRNGESPVAVVVDGVLQTVSNQFNTELFDLQQIEVLKGPQGALYGRNSIGGAIVVTTRAPSDEFFGRVTVGAGNGDQHKAQIGVSGPIIEGRLFGSIAGSFRSREGFLENVYLNKKVDFLRDTAVRGRLIFDATDALKIDYRASYNRTHSGALYFKRNNVLASGFYQFYPTVRSTASNPGSPDDYGPPLNSNIDGDALRKIYSTSLKVDLETSLGTLTSTSSYDEVSELTLADASPYTSAAAGTQTSNFMWFARSTELRLTSPSDQRLRYIVGGYYLDLARKSRRANGVDTGPGIVLPGYNPANSVNPSTNNTADNNDQTSYALFGQLNFDITEQLELAGAIRYDHDKRDTLNVSHPKDAGSLPTYTPVGTPGAYREASFDAWQPKVTLRYKIDSGTSVYASYSKGFRSGGFNQDGVRAIALRLNPNSAVTDDYKKEISTSWEAGFKARFLDRRLTLNGAVFHTRFNNAQYFVFIPEASAQIITNIDKATMKGAELDVSFRPMTGWEIYGNVGYTDAEIDKYVQLPASEGKTMPYVPKLGYSLGTQYTYALTGDLDLIGRVDLHHKGRQYWETLNTAGARSAFNLVDARVSIADADRRWKLSAWTKNAFDKKYLSEFVGGGFAYPGEPRSYGIELDYEF

SEQ ID NO: 8192 - protein, 198 aa, Leptospira biflexa serovar Patoc
MKSVIRHILSVAVLFCLISGVQAQSVKVNIPFWLTGSPNVGFEYTLTRQLTVNGEVLWMPYLFKKHEEVFRALQSSVELRYYVNPRNFYTNDSWDGFYIGPYAMYGNFNIGLLKHNDPLQSYRRKGWGVSGGISTGYKFAFNSRWGLDLNIGLGYAHLQYNKYYLGGEYVNFPLERKKTKRWIGPTKFGINLTYNIFR

SEQ ID NO: 8193 - protein, 878 aa, Leptospira biflexa serovar Patoc
MKLILLIILIIFGFQSSAWGQAPTLSIEAKQEPIQEIMKKIEHQTGMTFSYDPSILKGISRITFKSDNQSISECLTRLFQKLPLSYQINGTHIILKKLPRSVTISGFVRDKATTEYLIGASVYDSRTQRGTATNNHGFFSLTLPVGVVRLETSYIGYGRFSHTFQPLERDTVMEILLESGEALAEVVVTGSNDTQNPIQAPQMGTIKITRKMIKTIPTLFGEADVIKALQTQPGVSAGTEGLAGMYVRGGNGDENLYMIDGIQLYQVNHLGGLFSAFNAEALKDVDFYKSAFPARYGGRLSSVVDVHTKDGNMKEYHGSAMLGLTSGNLNFEGPIIKDRTSFNASFRRSWLDALSAPGLAIYNKIQKKKGEKFSARYAFTDLNLKVNHHINDRSQAYVNFYFGQDFLKGGSSEFSVGDNITPFENKDFGKMRWGNIALSSGWSYVFNNKMFGTVTLAYSHYQSKLKQETSQYYGTEGDKDYSSRFIETSTRNGINDFGVHANFDYIPTLAHHIRYGTDYLYHRFSPEYIEEKTSENLSPTKRTTGDERLSANELAVFAEDDWAISPIVRANAGLRLNMYNIQKKTYVSLDPRLSVRFLLTRDLSLKASYARMNQYVHQISESYMSLPTDMWMPVSKKLKPLVSDQVSVGAYYNLHKNYSFSVEGYYKWMNHLLDYKDGYNFLPSFVGWEEKLAAGKGWAYGAEFIARKETGRITGWIGYGLMWSDRQFDEINNGKRFPAKYDNRHKLNIVANWKINEKLELTGSWTFMTGNRVTVAFENYEDLGLTPVPPLLPEGGLDYFTERNNVRLPAYHRLDLGINIYRPKKNGHLGIWNISVYNAYCQMNPITIHKRSWINYSHYFETLSLLPIIPSISYTYKF

SEQ ID NO: 8194 - protein, 516 aa, Leptospira biflexa serovar Patoc
MKNLKALLAVPAAFGAVLAVSGNAVAAESLVESAAVESFDVEATDTEVVVAEPIQLAQVTSVSELSDVRAGDWAFTALQRLVEEYGCLEGYPDRTFRGNRAMTRYEFAAGLNACLDVVIQLIGGGDIDGVQRLQEEFAAELATLRGRTDLLEADVAELEANQFSTTTKLRGQLDANLVVPFGDTTEIADGTALDGGPSEALEAGDGNVGGEEADATFDYRARLNFDTSFTGEDRLRIRLQASDDAGALANTEGGLASQSGPIAGVDDNLGLDDVFYSFPIGNRFSGIVAANSIVTDDFVTSTIVPFDGPAVADASGPEFYDLYQGGDAFGAGVNIAFTDNLVLDLGYSTDTGNVNRGFDEAGDLIDPDDTGLFNNYSYIAQLNFLTDGFIDAAVAYIDGDQDGEGSPEYTVAGLVNLDFGRVQVAGHYAYTPAEGDGDLDSYGGGINFPELFGGNLGAYAAISPNVDRDPLLVEAYYELALNEYFTLTPAVIYADNDSDIGDDDNFYGALRATFRF

SEQ ID NO: 8195 - protein, 229 aa, Leptospira biflexa serovar Patoc
MTLNKTDRIVITLGKQIVHGKYVPGSPLPAEAELCEEFATSRNIIREVFRSLMAKRLIEMKRYRGAFVAPRNQWNYLDTDVLQWVLENDYDPRLISAMSEVRNLVEPAIARWAAERATSSDLAQIESALNEMIANNQDREAFNEADIRYHEAVLQSVHNPVLQQLSIAISSLQRAVFERTWMGDEANMPQTLQEHKALFDAIRHQDGDAAEQAALTMIASSTRRLKEIT

SEQ ID NO: 8196 - protein, 846 aa, Leptospira biflexa serovar Patoc
MMKQRALSTTFLTAATLSLAGAGLAAAQVDVITVTATKREQSTQDIPLAVNAMNEETLEELGVDVFTDYLQQLPGVTAGGSGPGQATIYIRGLASTTPNLTTAGVAGLAPNVALYLDEQPVSQPGRNLDVYAADLARVEVLPGPQGTLYGASSQAGTVRLITNRPDPSAFYASSNFAVSFTEGGEMSNKVEAMVNVPVADNFALRGVVYVDQQGGYIDNVPGTRSARESARFRAAGTMRDNGVPVSATRAGFQSTADLTNVTFLDANNSDLLEKDFNDTTYSGFRLSALYDFNADWSLTVMHMQQQLDSEGVFFMDPSLDDLEVQRFEEDELDDYFHNTSWTLEGRLGALEMVYTGAYTDRNTDQRVDYSDYLFVGQYLPYYICDGSVSYPGAGGPTGTCQAPNLFVQSDTRTKVFTQELRFNTPADRRVRATFGGFYSDMEVAERNDFTYPGSVNAISFDGVTTGFAPNYPLTNTAVTGEIGNASPGYFSDPGPFPAGVIFRNDVLRTDQQYGIFGETTFDLTEQFSITLGARYYDIEVDLVGSANGSFFNFGQTDDAQVFGTNISALYGPNNAFGNPDVAATDGFIFKGTLEWRPTDGALFYATVSEGFRPGVLNRPGGASGPGGYTVPFALDTDEVVNYEFGWKTDLFDNQVRFNGNAFMVEIENLQTTIFDPSITNLFFSDNAANAEIRGIEGEVTWAPADIEGLTVVGAFSLLDTEITEVLVPTNDVLAGSELAFAPSYQANLRARYEWPMENGMMAHVMPQITITDDSVSDVIEINKADVEGYTSLNFTTGLTGESWSVELFANNLTDERGEIANNFVFDRERVTVIRPRTIGVRVGVQY

SEQ ID NO: 8197 - protein, 1821 aa, Leptospira biflexa serovar Patoc
MTSSFLSTSARAASFKDLVSKTPAWAKHNSTQQQNIWKDLTPTEKIKKWQEAALVPSFTQAQNDLGIKYKETDLSSFLDNTRHKARQARAEILLYIERIKQQDFDTKKQAYINQGVVPTDIEAATNLGISYDPSKIDHNVEHDQKVRRAEKDKKAVIELYISSINRDIKYKHYVDNDIIPEMQEVRTALNMNKDDAQSFVASIRTEIMENAKGQYIADSHIPTEKELKKKFGISRDDNRDGYIKSIRLKVMENAKGQYIADSHIPTEKELEQKFGADKGEATNYIASIATQMMLGKKSYYIDNNIIPNTDELMNEFNIGPVKATSYINQIRAGIEAKQFLNNNDTTKPSTGHSQKKSGSKNDHWYMSNQSINDTGTSSRIFTGREKKQRYFFDPISTFKTHFNTKASKGNLTQSQHTIKRIIQQEENIAEFKNLIKTDPIAALTLQVGSSYKQEAVTTILSDFNDNTIQRVLFSNDKGQLDFKTNIDVKNRPILQELLENSSSEEKTKFAERIQDYATRNISHSQFEEKARLDLIKLAASKDKRSVENFLTLQLELKNRMQPYIVNSAYILTPEIVKEINIELKNKGLIRDSLTKDYMIKLAKEVNNHTLNSVIKVILSDSNILSNETNKILGLAVGNNANNLEQTQSGIPNPPPLPLNGDIPNPPPLPLNGSMPPPPPLHSQGFSSNSKHFDLNQLQTEYPHIHSLYIQFTHNTTVQSKAPLQPTASSATSTGRSTPETAYAKLYAEYRTETGGTKANDLQDQLIKRQADLTNVIRQILTESYANQGADEKTLVNLFSISTPEIAEKAKEAFNTLAQDQYIKDITVNGKKTITSEEIIKNLFNEDTDDAVKRILLSSCKISEELKRPIKLEFNKSALIRELQGKQNPFEQLEFAYINAKNFDQDIFSNRVDELINNPNILTIVQQANFLITEDTNLRKTINSDQAQAKLDDLRTAILNTIKFEELITTNLPQHDFIAIVKEKDPALLQEFLKATTLKLTGNNNLDQLRLALPSFADMSNEQIRILANKLKMPIILKAIQECSQEKAKQHIHTENMPPPPPPPPLPNAHDLELAYLTSLGITKFNANTSTFKTTPKTYHFSSDIALRYKEFTLSGQKSAGYKAKYSDADLLQKAIVESVAFEHSKNLSKAYQNNKYFEQIQEAVDTMHPRFIGPRTEIGQNIHNIYTSKLLELTKDKEFIKYVEDIILSKKLTEAFTSADSDFIGPRTEIGQKIHDIYIQQLTKYPEEAVKEAFNTAHPDFIGPRTEIGQEVHNIYKSQLLELAKDKELFLFVQQVLVDSAELEQKYGSDIQSENSNDEKKVGRLDKTKLRLFQQENEATNDESSTKDDTQPEDSNKKSEQSDSKTALSPRLLSSNDSKNDKSSDYKKSLLELRSSDEDDQGYATGYTTDEEELEESNSTTGEELKKDISDYKKSLLALRSSDEDDQGYATDEEELEEGNSTTGEELKKDIVLESEDEAIDVSFKTEAITEQDKVTQRQQVSDDTSGKVAILVQATSTLHKPVHYNINDRLTVAAIGAGDEETSINRGVWISGLYGINKQSIWKNIPKYQNRTTGITIGADAEFINSHDVIGIAYSRLASQIKYNKKLGKTAVNGHLLSIYSLKELIKGFSLQTITSYGHNYIKNRSKNINNIIGKYQNNNLSVQTLLNYKYRTKYDLHFIPNIGFQYDYSRASNYKEYNVDIENLMIQKKSNQLFESSLGGKIVFKPIVTTNNIVLTPSLYGNIEHHFNNKNTKVNAKATFKGQTLQETIITLKQPKLGYNIGSNILMSRKNINVLLEYNYYTHRKYQSHQGLMKLKVNL

SEQ ID NO: 8198 - protein, 499 aa, Leptospira biflexa serovar Patoc
MTLATNAYADDSVTEPTSRTPKAQTLSQTLSSPAQHAADSSAVQSNPSGKRRADQGGQVRNDQPDTTNAIVNAEADQTVLPPVPLSSQAASKGFIADSHLNLQFRNYADYFQAPDTIYRHAWVQGMQVNYESGYTQGPVGFGVDASLFGALKLDGGNGAGNMVHVGKGGGGSEQLAWAYPGMYDIKGRISETVVKYGLQIVTNPFLEPHDNRALPPTFLGVSMVSNDLAHTELQAGSFTRVDARGHTNLSNLTTSYGGTRIDRLTYVGGTWHYAKNGEMALYVDQADDVWRQYYGSVAQSFGDPATIKWSGLANIYSTHDTGASRQGYINSNAYSVSVSAQHGAHALLLGYQQVLGDQFFDYVNETNGIYLTNSMDVDYNAPHEQSLQLRYTFDGKYAGVPGLKAMFWGQYGWGADASAGAAENASPSAPLHDLYWKNGEPVHGHHHEFGFIPSYTLQSGRFKDTKVTFIAMWHNSQYHYSDGNNMEYRLVVNVPVKVF

SEQ ID NO: 8199 - protein, 746 aa, Leptospira biflexa serovar Patoc
MEKTKPFIVFSLLKNNIIFYFFLSFLSLETFFFPVRVFSQEHSKQFKKESSETKDLKTEELNKDEKQSEGIFVKGYTGKGLTGMKQNVRLKDIPATVKIIDYKELKARAADQWLSAISYVPGIFVIQNYGGFNTLTIRGLDSRNTLLLKDGARDDTFLIQNSSPMSNLTNVERIEILKGPNSVLYGQGAMAGVIHIITKKPQKKAGYEFSFTKGNFGSKRAYVGATGPIGTESLRYRIDAATSEYQGFRKNSYNLNNISTSFEWDISVKHTLSILSGKNFDFIKPDAGLPKSKKPNIDLIAPGVYLNNNYNTKEDYLKNESGNFKIQLDSKFSNKLSMKSFISYLPQTYYYFSAEDLTISSRDENTIERDHFHFETKRSPLQGTVELQCIFQTGFKHKLLSGYEYHWMVSRHRQRYFPIGSTNINVLYPQIDLTQSLPVNFKDRKILYQQMHSLYFQDLMELSKIIKFVLGGRYDSWVRENVTEKLSDWNDRYVSKPEDRTIHRFDAKVFTYRLGLVYQPLHYYTAYVGYSTAFIPVTFINIKGNQLKPEMGEQIELGQRLEFAKGKIQLTSALFAAKKYDVAVRINSKPALYNQAGELRTNGYEFDIDLRLTQRWSLKSGYAHTIAEWESFRFVNSKGNEIDYKGNRPINVPRNTANLWTTYTFASGLGFGLGGRYIDSIAGDNANSFSIPPYGLYDASLYYQYKHFRFQINCNNISNKKYFISSTPNPTPGPPRQFLFTASAKF

SEQ ID NO: 8200 - protein, 207 aa, Caulobacter sp.
MKLIAAATLLALVSTTALAADAVPVISDAPVAAAPAFTWSGPYLGIDGGAGWLNGDFSAGGASASEDFNGGIFGGFVGYNFQFDNIVVGIEGNLEHNWNEEEALGADVGTDWTGAVRGRVGYAFDKALIYGAAGWTATRGYVDLPGLDKETETFNGYTVGAGLDFAITNNIFARGEYRYNDFGEKDVLGVDVDLDQHELKFGIGVKF

SEQ ID NO: 8201 - protein, 284 aa, Caulobacter sp.
MTDKMQSLALAPVGNLDSYIRAANAWPMLSADEERALAEKLHYHGDLEAAKTLILSHLRFVVHIARNYAGYGLPQADLIQEGNIGLMKAVRRFNPEVGVRLVSFAVHWIKAEIHEYVLRNWRIVKVATTKAQRKLFFNLRKTKQRLGWFNQDEVEMVARELGVTSKDVREMESRMAAQDMTFDLSSDDDSDSQPMAPVLYLQDKSSNFADGIEDDNWEEQAANRLTDAMQGLDERSQDIIRARWLDEDNKSTLQELADRYGVSAERVRQLEKNAMKKLRAAIEA

SEQ ID NO: 8202 - protein, 381 aa, Caulobacter sp.
MKIRLFIALASWAVVTPAFSQGSVTLYGVLDEGLNYTNNVGGHSQVALASGFPHGSRWGLKGAEAIGGGIKTIFQLENGFDVDSGRAFQGGLLFGRQAYVGVSSDTLGALTAGRQYDAVVDFLAQNTAGGTWGGYMFAHPYDSDNLINTFRTNNAVKYTSPALGGLKFGATYGFSNDVKASNNRLFSVGGQYTVGGWLLSAAYLQADHPSATSYGAINNGGDQNLLGSRLRIVGAGATYTLGKATLGLAYSNTDVGDPQSSGYVGPIVPPVGRLSSLRFQSFEVNVKYPFGASYWVGAMYTYTRASFNATSGRPHPTYHSIGLMADHLLSKRTDVYLQGVYQHAGGDTTGTVLDVAYVPGAAGVSSNRNQVLLRAGVRHFF

SEQ ID NO: 8203 - protein, 352 aa, Caulobacter sp.
MTYIITRCIAPAVIAAALALPAHAQSSVTLYGRVVGGVEYIDKVAVPATGKTGSLLQAAGNQWGTSMFGMKGSESLGGGLQALFTLESGFSLPNSALNGPGLFNRRSYVGLSSPSWGTLIVGKNLSISNDIWDIDPTGQQFMSTATLVKGRNWPGADNMIEYRSPDLGGFSFGAQASLSEQPAGRRVSAQGLSATYQTSDLMLRGIYTERRDSAGAFSDVYNASKDGILGGTYRIGPAKLFAGYERILASQTGADTAPSALSQAWLGIRYDLTQAVTLIGAVYHVKSNQSGGNATLAMLGVDYYLSKRTFLYASLGGVSNGANADYAADVTAAGPGVGKSQRVVYVGMGHSF

SEQ ID NO: 8204 - protein, 723 aa, Caulobacter sp.
MFSTGIHSFLQQWKDMSRFFKLHPLAACLAVALPALADDHDNPAVALPSTAITDTRAEQKVDLATPTQAGSRLNLSTLETPASTTSITAEQIQQRNNLTVQEAVTRSPGITFIGSPGDGGTGLSARGFTGHGSVMTLFDGARLYTGAGTQTFPVDPWMVERIDVIRGPASVLYGEGATGAVINVIPKKPFTGDIHNHLRLGYGSWDRQQLSLDSGGSLSKRLSYRLTLDQQAGNGWVDRTNSRSLALSAALQFDATDDLSFTLAHERGDAEPANYYGTPLIDGHYRSSLRKKNYNIQNDVQRYHDEWTRFTTDWAISDQLSASNQLYYIKSRRHWRNAEDYSWDADRQQLLRQSYLQIKHDQEQIGDRQTFTFDHALFGLASRTMVGAEYNKVRFNVDSNSPYNDVGGDYIDPWQPAPGWFHSASPLRPQTLSTTHTFALFAENRLQLTDRLSLVTGVRRDQNHIDRNNLTDGTRSDRSLQGGNWRAGLVFAVSDDLSLYGQYSTSEDGVNDLISLNPAQLNYDLTESKQTELGLKQRFWEGRGEWTLAAYHIVKKKLLVDDPITHEKQQAGQQTSDGLEASLELALPQQWQVSANASLVRAKYDEFDEMVAGVTQDRAGNRPSNVPRRTANLWLTKGFGQQVEAGIGARYVDDRYANTANTQRAPGYTVVDANIGWQLLPDVRLGLQINNLFDREYVASAFSGTQWIMGTPRSYFATVDHSF

SEQ ID NO: 8205 - protein, 338 aa, Caulobacter sp.
MKTVNVALLALIISATSSPVVLAGDTIEAAATELSAINSGMSQSEIEQKITRFLERTDNSPAAYTYLTEHHYIPSETPDTTQTPTVQTDPDAGQKTVAATGDVQTTARYQSMINARQSAVTDAQQTQITEQQAQIVATQKTLAATGDTQNTAHYQEMINARLAAQNEANQRTATEQGQKMNALTTDVAVQQQNERTQYDKQMQSLAQESAQAHEQIDSLSQDVTQTHQQLTNTQKRVADNSQQINTLNNHFSSLKNEVDDNRKEANAGTASAIAIASQPQVKTGDVMMVSAGAGTFNGESAVSVGTSFNAGTHTVLKAGISADTQSDFGAGVGVGYSF

SEQ ID NO: 8206 - protein, 787 aa, Caulobacter sp.
MRADAHPDTRSLIGKTLAAGQRRPLRTITLAALLTSSSQLCFAQSATPGATITLDTIVVEQRREAVRAPARQRSVVRRAAPAATPNAAPAASTVQTVDLVRERFNVLAGGVALVSQKDMPNAGNPTLANTLSGVPGLIIQNFLGANDQPRIQMRGSAQQNPAERGVLVLYNGLPINRADGSYIVGFANPRQAEAIEVYRGYMANRLGATVLSGAINFISPTGSSQPGVQMSVSGGSFGQINSSAQIGTKKDNVDAFLQFDTTRRDGFRDYNSSDRTSLNANVGIALSENVKTRFFLGYTDLGFDVAGPINKDALFANPRQTATGPTVVNGVAINPGPNAVRDKPRRDASQFMIGNRTTATFDAHLIDIALGYTYTDDTFRFPISSGVRSTKGGDFTGLVRYAYNPADALLPLFETTAQYSVGSADRDYYLNQSGMTGAQFGSNRLDAQTLSLFAGANVPVWQQWTVSPAISYAYATRDNDDRYTAAARPTIAYNPAKPTVLLPNGSVPTQDNGYARSYSGWNPSLALSYRPDATQTFFIAGSHSFEPPTHDDLIATINGTPNSSPGRPTPPSPNLKAAAFATPNLSAQTAVTVEGGWRGRADRFSWDVVTYYSWIDNELLNLRDVTGASIGAINADRTTHFGIELGAGVRFTDKLSGRLAYTYQDFRFVNDPLRGNNKLGGAVPHLIYAQLQLQATDAWMVQGAVRWSPASVPVDNMNTLYADPYAVVDLRSEYRINKTFRVFGEITNLFNKTYAATSLVVDQARPDQAAFLPGDGRGFYAGIKASF

SEQ ID NO: 8207 - protein, 442 aa, Caulobacter sp.
MKKLLFISAATLCISFPTFAGDYLTNTNQNAAFLRMIARGASIDIDGVYSNPAGLSFLSHEGFYLSLTGQSAYQTREIDATFPLFQQADGTNGSRLYKGTASAPFIPSFQGLYKKDNWVISASFAITGGGGKASFSNGLPMFDALAMGMIHQQTGGQVTPQMYDINTSMDGKQYIYGVQLGLSYKINDWLSVFAGGRMNYVKSGYEGYLKAYMKENLGGAQLANLELDCDQSGWGLTPIIGVDAKLGRWNLAAKYEFKTNLNIENQTHTLEVPTGTPEAVIKPYADGEQTPSDIPAYLSVAAGYEILPNLRASVEYHFYDDKHAGMLNDRQKTLKHGTHEYLAGMEWDITKRLTVSGGFQKTNYGLSDDFQTDTSFSCDSYSLGFGARVNLTQAWSIDVAYFWTHYNKYTKETDNYNGTGLKGTDIYNRTNKVFGLSLNYKF

SEQ ID NO: 8208 - protein, 923 aa, Caulobacter sp.
MRLQICRTGSGEKTAGQTRRAVLLATTAIAISFAPPVLAQTGADAANSRQPGGEQGATRPFNIPAQSLSSVVSAFGRQSDLQVTLATPAAGNVRTNAVAGSFTVREALSRLLAGTGVNFRIAGNGRTVIIGTGESTVDFSEAAGTTVLETITVTGKSGRNSLAGAGYQGTPDWVYDTPASVSVVSREAIQSAGVRNTRDVFNRVSGVYAGEGNGSFPTVSPNVRGLQESGRVVVSIDGARQNAQRGYSTGGASIYSANNGQAYVDAAFIRAVEVEKMTSATSGNAGSLGGKVEFRTVSAADLIPEGANKGAEVNVSRGSNGYDFQGSVLAAVREPDGPLSFVAGYSRTIMDEYKIGTKGEALSTALTMKDLLGRDGWSTFFKSEGDFGDVQTSLSWMHQQNDFVQGASTVVDREGVRNDSIVAKLDWDPESELIDFKSSLWLNDNMTHELRAARTYAVETNLDMGLRSFGGSLENTSRFDTRAGALSLNYGAEAFRDIATSVATSATIAQNPSFASSYTSFSPAGRRDVASLFLNGELEPADWITLSGGVRYDWSRLKGSATYYSFKESIVTTSVPCDLVRNHYTALEYFNQVFLPANLPVWASRYNVFLASIWPRTSANCMPGTGITTKTPVTEYPSHEVDIDRTYSAWLPSATIEFKPVDWFRPYVSYSQSLRPPTILETFFAGARPGDSAGYEYAPNQSLRAEKATTYEIGANMSFDGVLLDDDTLRIKMAAFRREVKDYIALGYLVTDQVFDRTYTSFVNLDGTTYMRGLELEGNYDARSFWIGGSATVLKTEWPEKTQVFSNSTTTTSGEIVAWPGDVAPKMKLTLDGGMRFFDEKFSLGARLNHVTPTQSRTLDTEGNLREITDPYTTVDLYGSYAFNDKATLRFAVNNLTDRKYIPAASAYTAPGRTFIATMNVKF

SEQ ID NO: 8209 - protein, 343 aa, Caulobacter sp.
MVSTHKVLSLAIVVSLSFNVLADETSADSDAFSSHWYLGGKLGAMKYQNACEEWAVDCDGTDVALGGFIGYQVWQHWGLELGYLDFGEAKALYPEGGRVNQYSGSMSGIEMSVVGRISVTDNLDAFAKAGTLYWQGKNSGPTRSLTDDGWAPTAGVGLEYHFSNHWAGRVEYQYVNALGSDKLGGSNGHLATLGIVYRFSSAEDSKPETQTEPKPVTPIITTRLPEVHSSVLFAFDSEKIENVEALNPIVYRLTRYPETRATVYGYTDSTGPNEYNQSLSERRANAVYEYLKHAGVSTEQLRVAGYGEDSPVVPNDTTEHRHMNRRVTVHIEEMTTPSSTNQN

SEQ ID NO: 8210 - protein, 330 aa, Caulobacter sp.
MQNPLLAQEQTPLNQVVNTLKERISLSGYAQLGYTYDDAANPDNTFDIKRIIFMAHGKITKRWTCDFMYDFYNGGMLLEVYTDYQFLPGLTARIGEFKVPYTIENELSPTTVELINCYSQSVCYLAGVSGSDKCYGMTSGRDIGMMLHGKLFRDFLQYKVAVMNGQGLNTKDKNSQKDVVGNLMVNPLKWLSVGGSFIRGTGHAIADSEYTGIKAGENYAKRRWSAGGVVTTSTFNLRTEYLAGKDRSVKSEGFYATGSVRFARNFDFIASYDYFNPNKSADFKQNNYIAGVQYWFYPRCRLQAQYTFCNKKGDGQKDSNLIQAQVQVRF

SEQ ID NO: 8211 - protein, 412 aa, Caulobacter sp.
MALQILHCPQYDKNQRPIDKALRWLPLKLYIMKNLVSLGVFLLILLSVQVNAQEQSVLQIRPTGRILMDGGLFHSDNKNFVDGVAIPDARIGVKATYGKYKAKVDIGYAYGKVSLKDIFVERQFSSHALLRVGNFVHQFGLQSSTSSSMKVTMEEPASNEAFFNSRLMGAMFVYDKNDFFGTASVHVESEALKKKSNELGKMGYGAMSRLVYRPLHDTGRLFQLGISGAYETPRYNSEPTLNHTSFDLGANFPTRIAKVRAVNALIPDAKNLIKFTPEMIAGYGPVALEAQYYYLQVNRKKDFKNYKASGMYGILRGLLIGGNYRYSHTDCGIATPDSGSLECVFGYNYTDMSDTRSHIYGGRLNDVSFTVNYYINKYMIWRFRYSYTKITDRVGFENQSLSAFQTRFQVIF

SEQ ID NO: 8212 - protein, 452 aa, Caulobacter sp.
MHFHHKSFLAAALTLGLATPALAAPAFEVTHDGVIDGSQSFGSSYYMDELELRITNPSSFLAQISAMNIQSTNNIALFLYNEGEFTPADYWQNNLAVTSGYLPGLSGAGAYPEGNYILAVVGNLPGNTGTYTLGLIGAILGWGPTQQQLLEEMQSAGITLGRLALRQSAGNTSQGARGSFVARDLQSPLSFGDFEDGEAPVISTKNGQLMGNVYAWVNFNGFIARGSANDYSGSGVQLGADISVSPNMVLGLSLGHDDLNANTATTSTSGDFTYVQPYLGYRSGAWSGELALLYGQADYKQTSAGGVGRADSDVWALSIAAQRDIALSDMLTFTPMASARYGEEKITGKSGTLAGTGSTTVDYSELSLGARWTRSVRDTLVYTGLHLDYVTTDAPAALAGGGYDPDGLSGRVELGGAFPITANGDLMIGAEMGGIGSELTNYSGQMRFVFSF

SEQ ID NO: 8213 - protein, 626 aa, Caulobacter sp.
MTNTRPFNVRLSALSVHARVAVLPLALAAAFPAVSQTLLAQAATEPQLRETVITATRVARPLADIVSDVSVIDRETIEASGAVGVIDVISRLPGVQITRNGGQGSNGSVYLRGAESRFTAVYLDGVRLDSQSTGGVVWEQIPLSQIDRIEVVRGPAAAVYGSDAMGGVIQLFTKKGEGAPAPYVGVGMGNQGTRTVQAGVSGGTEQVDYALGLSHERADGFSARVGSAYNPDKDGYRRTSANARLGVQFDTTHRLEGTLLASNLNSQYDGSKTADDRNHHQLRTASLAWLAKWSDVYSTRLQVTQGQSEYSTRPNFYMTETTLHNYLLQNEWRLGAHLFTAALERREDELHNPATEFVGDLQRDRSQNALALGYGLNQGAHTLQANLRYDDDSEFGGKSTGSLSYGYAITPQWRVTAAAGTSFRAPTLYHRFSEYGAPDLQPEKGRNVELGARWTQGESSVGVVAYRNRVSNLINFGAAGRCDSSFGCYENVGRAEYKGVTLSAAHRIAGVSLHGSIDWQNPRDLDSGKLLARRAKRYATLGADTLVAGWTLGAELYASARRYDNAANTNVLGGYTTLNLYTSKRVARDVTLLARVDNLADKDYQLARTYATGGRTFYVGLKWAPQ

SEQ ID NO: 8214 - protein, 290 aa, Caulobacter sp.
MNIKSLVTTSVIAMAAASAAQAADVIIPHEVAPVITAPSFSWTGFYIGGQIGGFSSKIDLKDKDKDTSVFKDLSPKLSGLIGGFYAGSNFDLGNGIILGVETDVIWSGKKDVRLATKTKTPETPETPETPETPETPETPPTGSETTQTGNETTGTKKLSAKNARDSEVVDVSEGVGFKQKWAGATRVRVGFAAADRIMPYVAGGVAYTQLEAAHGQVKVADKTFSAGSSDETATMVGFTIGGGIDFAMTDNVLLRAEYRYSDYGKKKFFAKEKEYNFKTNDFRVGVAYKF

SEQ ID NO: 8215 - protein, 671 aa, Caulobacter sp.
MAGGFVTPDGNDYIATIWSWNNLKDTINLGASFARSKVKALSADGSIAGGYQYIRIHESTSSANLEKKASNRKFLANDGVSAIFIPVIWSGDSWENEVKLELGILESGVVNALSGDGKTIGGYGFSTHLVPIIWSGSHWKDIKQLDVPKEYYDAEVRALSTDGKVAGGYISSKNITRGILEGKSGNDTKNFTHAFIWSGDGFGIKTDLGTLNNNESEGAEVRALSTDGKVAGGYFSMENGSVSYGVIWSGDQWTTKTQLGTLKSDNSGNSLVYALSADGKIATGFAESDSSIGRATIWLGDHWQTKIDLGTLKSDNSGYSIATALSADGTVAAGYSEVDSGKDHATVWKIIYPTQSQSESQPQSQSTVVKVDTVNTIGALSVLAAETFSVMDLQRQGLILLQQGCEIDDSQVCWSVRTGVVSTGSNRDSVVGFRFGYAMFETLSAGFSLDRSLSRSLQDSYLKNNHNLGAGFYAQWNAPFRGGEWYVRPAVAFNQYSVVVQRPLLTNTEAGTGYSCMKGRDASLEAGQRFNADHSVLLGWHLGVRHSSVLRTAYSEQNAAFPFSYSAINNRRTSAYVGADVAVPLTARLKWMAGLEIDRRLYGDDPVYGGHADYIGGFAHQMVMKRVIGTISSGVEYRLSPTMFLGATFDVSRRALGDRTWSGTLSLGGRF

SEQ ID NO: 8216 - protein, 1004 aa, Caulobacter sp.
MKIGKQLLLICLLLTFFGARAQQGINVTGTVSDAMGPLPGASVVVKGTTKGTQTDFDGNYELSGVQPDAILIFSYIGFSTQEISVDGRTDISLTLQEDTQALDEVVVIGYGTQKKSDLTGSIATVKAEEIEKTPAANVMQSLQGKVSGVQIVSAGSPGDSPTVRIRGVGTYGDATNVLYVVDGMFYSNIDFLNPKDIKTVNVLKDASSSAIYGVRAANGVIIIETKDGALNQKPVIEYDGYTGVQVAQNVVKMANAEQFVTMANESGSAADVQFVLNAMQRYGRSRVNPNIPDVNTDWYDEIMRQGIIQNHSLSATGGGENVSYSLGTNYFSQEGLLDMKNEYERFNIRAKVDANLSDNIKVGVNNIFSNATQYRPENSAWFKAYFAVPIIPVIDPLNTAADPTPYSNAQLLGYRGTQNPFPDMEFNNNRLKIRKILTSVYLQMFFFDGKVNYKSTYNHDFSSLEERYVNLPYLLGNNVERISQITRVQNNFSNQIWDNTITYTDSYGDHDLTVLLGSSYRDESRNTFRATGQDITGIDLETSWFLDFANGESFINNVGESGNRFYGLSFFGRVSYDFKDRYLLYATMRADGSSKFTLDPWGYFPSVGAGWVISQEPFMENNSVFDFLKLRASWGKLGNDNVSASAGSNTIQVIQAALDDQPAEGVVSTNVFSNNTWEVIEEMNFGLNAVFFDNQLSLDADYYIRDTENAILPVFVPIVNLFVDTNAGVIRNQGLELNLNWTKQVSDDFNYTIGANFTTLKNKATQLPDPGYIDGGTAEFRQRTQLGGPLFAFYGYETTGVYQNQAQIEADPAVTSADVVPGDLIYKDQNGDNIIDDDDRVIIGSILPDFTFGGNVGVDYRNWGFSMNFYGQIGNQILNRKRGEVIFTNDTNMDADLAINRWHGEGTSNTYPSSAGLRKGWNQRLSNFWVEDGDFFRIQNIQLSYTILGDKLGGNMPDTKLTLTAERPFTFFDYNGFNPEVPDGVDRQTYPVPAVYTLGVNVKF

SEQ ID NO: 8217 - protein, 820 aa, Caulobacter sp.
MTATAVVLRNAPSSLDFPRASRLSRSVRAALLSLAMAAGAAPLCASAAEAAAEQARPYAIPAGQLGDVLNRFAREAGITLSATPAQTGGYSSQGLRGSFTVQQGLARLLADTPLEAEDQGDGSFVLREAPAKDGDVLNMQAVEVFALGNNLGSTDGYLATHSQIATKTSKPLLETSQTVSVITREQIDDTASKTVQQAMRYTPGIFTGQVGASNRYDYVVMRGFADNSVDNIYLDGLKAMGDSGTFSSMQVDPYFLERIDVLKGPSSVLYGRSLPGGLVALTSKKPLYEDYRQITGSIGNMGQKEMGFDFSGPLDEEKRIAYRLVGLGKGSDTQFDHVKEERYAIAPTLAIDFSDDTTLTLQGYLQHDPNGGYHGGVPADGTLSHHNGRHISREFFDGEPSKDDFDRTQRMFGYQLEHRIDDVWSARQNFRYLDSDVDLSQVYAYGWSASEPNKLNRYFSGAREHLQAYIVDNMLQAEFATGAARHTLLTGLDYQRRRTVVDWRSGSASALDAFNPVYGDDAISYFPDDNHTRRLEQTGVYLQDLIDIDQWRFSLGLRQDWVSVTDKNRSTGSKADDDWEKFTGRIGALYLFDNGLAPYVSYSESFNPNAYSDASGTPLAPTEGKQWELGLKFQAPGSNSFYTASLFHITQENVASKEPQDNFYTSVGEVRSQGLELEAHTQLSDNLKLLGSYTYTDITYTKSLDGNQGHTPNQAPKHMASLWADYAFDAGPLSGLSIGGGARYVGETWADKENTLRVPDYTLVDARIGYDLGKLGLKGLDVSLNANNLLDKDYVASCYSLDFCYFGEKRNVTATVNYQF

SEQ ID NO: 8218 - protein, 1206 aa, Caulobacter sp.
MMSGFSPKPKTIILSLAGAFGALAFADTPNNTEQQKELNTIVVHGKRSADQKGADDVYYKNVSNAYVGKEYLERYRVQSAGDVLKGLNGVYNMNTRTAGGAITPNIRGITGKGRIPVTIDGTEQTIDVWMNNYGVGDRNYLDPALFRSIAVEKSPALTRGVKSGVGGAMSIRTIEPSDIIPEGRNWGIEVKTEFSGNTVAQKNDLRQFLGRDYRTLSPIGATADGVSGMPDVLTGYTGKPSPTALLLDEGIADTKFSGGKSHTNFKDDRQLMLSAAFKTDITDGLAAYSHRQKGNYYAGKRGYQSYLNNPIYGADACYDQYPDKSWREKDILCKSSASLVPNMAVLFRPGEEIMNSHTDTKILLLKNNWYLPDNQKISLQYMDNKIGFGEINPLITAWILGFAEQSLNEPVQQAPGIGTKIDSKTYKIGYEWKPQNNKWIDLQADMWRVKTDSNRHQSGGPVVGVITSDFDYDLWYWCNIRKKPSPNLRGESCESAMTWNAYGSARTHEEVLRMIEDTPDKIARKLAEYDENNRAITDRWMGHTGGYYTITPADKNVLTDQTNQIGKMMNLAELKQKLNQERYYIEHPDRIIVPGARQRTDVVRNGFNLSNRLRLSDKLSLTLAADYQRETLEERTDTADSNDLMNTFGVLTRMAALGGPQSAKKREWGANLVFDWKPTSRLNIQAGVRYQNYKGNNIELARQRAARNPWYQYGLGSDSYVTGLMMPYYELADEEDIANQKRMLQLYDPDRADGQVAEYQDLNRRFKEKNGYDFDPHDTLVGQDTRFYAKSDGNFVQYADGNKNTDVLYVLRRKQIIPMNAGKFDPGKVQITPEMYRERVNNPQGKSGSYRRYIPGSHIYITPGSVREEMERMANENQIPSKEDNNQALEFNSDLNRTAWIRHQFGEADRWRMPQEQRAHSWSPMLAVSYDLADNHRLFARYARMSRFPSLYELTAATGSGGLYGSETVAEYSLKPEKSTNWEVGYNFNFAPHFAKLRQGDLRLTYYSNKIKNQIDTSNEDGGMIQYDKAVSKGVELQSRLDSGRFFASFGGTYRLKHMVCDKGIAFKFDYYLQRVPECLEGGFGLSRFFQSLQPKYSLTLDVGTRFFNEKLELGMRAIHHSKAERRNYDKLIADGAGQVYARNGKPYGWHAATLLDAYARYRIGKHIDLNFSVTNLANRYYLDPMSSTPVPGPGRTITFGIKGRF

SEQ ID NO: 8219 - protein, 324 aa, Caulobacter sp.
MSQSLPLSFATLAALALPAAAQSQVTISGYLDTGVFRDYDKTRKLGTIQRSHLAVAGTEDLGGGLKANFRLSTRFELDTGQSEGAGSKPFWHDESTVGLQGGWGQLRLGRALSAMWSQEWKFDAFSNFNRIASTAWHMAHYYTPTDRASNNGAAEYGRMTNGVYYDSPTWDGFSFNASASTERTQAPGRDGRGGSVALNYDQGPVAAMVGYERNGSGDKDLFLGGLYRLGAATLMMAYDHSRAGSSPATSRMVSVGGSYALGVTTLRASYGRQRLNDGVTHHMASLGTEYHLSKRTMLYASLGHQRYEHNPSRTAFGVGVAHAF

SEQ ID NO: 8220 - protein, 984 aa, Caulobacter sp.
MSRSITFKRRLLPICISAVAFSGITSSTIAQEENYEEVIVTGIRGALTRAIDVKRDAGSVVDAISAEDIGKLPDATIADSLQRVTGIQIRRSAGEGSTVNVRGMPQVNTLLNGEQFLSAGSITTLQPNFTDIPAELLSRVDVIKSSEASTLSGGVAGTIDLRTQRPLDLAEGWTFVGAGELSDGSYTDDNGTKLSGFAGYHSDDFGALLSVSTSSATLANFRYGMYNDWWFRGYQEDGNWPGWSTPTDVTGDGDTNDAIFGTIDYGVTNRTSERDRTGISATVQYRVNDKVEVLGDVFYTSMDQYEHTNGLVADNAWAQYDWVYPQNPVNRGPSADGNTDKDFYTASVFDLHALRVTAKAESFVDKRESTNINLQTNIDFTDSFRASVRYIHGSAENKHTGNFADAFITTGEQHGLQTRVDNVTETVNPNGEGPDRIVIRGDMSGTHPSFTYPEGFGDSIEKYGLVSSFSHQNRDEESKLDVLRFDGILDLNDNNSLEFGYRYGKREVTRYQYDYVAPFTRRGMDDEQITVYSKWKDSGLPVNGDPGAGVFGDTIARTIPFTELDAMGWITEVSDFGPAPSDGRSFYFIDPKAMDDALGFHNTLYPGNVAIKDPGRSYELDDKTHTLYAQANFEGEFGVPYQANFGVQYIRTFLDVTTNVPGVEPIVEVDGVEYPTLSGTPPQDLGDSTVERSFTDFLPRFNIGFDTSENTKLRLAYTKTMTQLDANDLGLGLVYTVNNNADLGVFQAVSASQDGNPYMEPWRAENYDATFEWYFAESSMASIGLYRLDVATSITTTGTTTAAVPDSDGVIRDEDGEIGLTIRDNTDGGVVQGIELGYQQAFDFLPGAFSGLGTTLNYTWADGEGGDKDFYGATMPMGDNSEHQFNAILWYEMDGWQARVAMNYRSERYIGRAWNDGHPAAWWSAPTTYVDASVSYDITDGITVFLQGTNITEEYEETYMQWQDVVVNQNVFEARYNLGVRARF

SEQ ID NO: 8221 - protein, 433 aa, Caulobacter sp.
MKMGRVKIAGFVAALLGSTVMAHAGGFERGSQDFDILFENGNAVEAGGTFVAPQRKLKNIRGSAMEKTPQRTGGQNFVPAGINPTTGRPYETEVDEAKSYYVPKVSAKFDITSDLACAAQYRQPWGIQTDVGTDTVRMFTAIEQKISSHDYGVNCSYRFVAGEKGYFRILGGVSYQELKGEQTRLIPGISPNMNPTKFPFPGPVRVASLDAEDQSVGWRLGAAYEIPEYAMRATLVYQSEVKYDLEGTIDNLVLNPITGRGMPLNVESDVATPQSVEFKFQTGIAPDWLAFGSVKWTDWSSITSVDFVSSDNKIAPKGTKITSLNLYYQDGWTVSGGVGHKFNDQWSAAATVTWDRGTSTGLTSQTDVWLFGLGTNYKPTDQFEVRLAGAAGWLSAGDLDDTMIAGVSNPTGSKGEFGNDFVGALSLTAKVKF

SEQ ID NO: 8222 - protein, 674 aa, Caulobacter sp.
MRLPRRPGLVAPVLALTMMSSPALADEQVTKSEENGDVFTLGRVEVIGTSESIKHPAVEVVSSEDMLQFDTETISEAANLVPGVTLSRKGGRNESTVYVRGFDLRRTPLYLDGIPIYFPYDGYPDLGRFFTYDLSELVISKGFASVLYGPNTMGGAINMVSRRPTREFEGDAGAGYSSVDQYHTFANFGTRQKNWYFQGGGSWFGSNGFEMSEHFHNRTYENGGKRNNAFQEDWKVSGKLGLTPNSTDEYALTYIYQNGEKGQPLYTGDNPDEKIKFWRWPYWRKQSLYFTSHTAIGDKSYLKTRTYYDKFKNSLEYFTDSTYSALDKNMGYRSRYDDSTVGCSLEVGTSLIANNELKMAFHFKDDVHREETLTTPRQRFEDRVYSFALEDTIRFTEKLSAIIGVSYDILDGVQAHKYDSKSTAYFDAPLADEDALNPQGTLMYSYSDTGKAHASVAMKTRFASMKERTTMGLDGTTIPNPDLKPETTINYELGVQDVIAGLVKVKSSFFFNDIRDYIEGVVIGSVLVNGKPKDQKQIRNIGRVQRYGYELEAVAPISDRIEAGFNYTLMYNKNRSGDEPITDLPKHKFFVYGTYSPVKALTLLASLEYDTKRYGDAGYNAGEFVVINTKASYEPLKGVMVEVGVNNLLDRDYELAEGYPEPGRTFFVQARYKW

SEQ ID NO: 8223 - protein, 191 aa, Caulobacter sp.
MRLFYQRISLLISLCGFFSAAWASDVQPASSTGLWQRFTQNVAETWHHSPHQDLYVPAITWHNRFTYDDEHIRRYNERPWGAGYGISRYDEKGNWHAIYLIAFKDSFNKWEPFGGYAWEKQWRPFDRYQDIHFGAGFTAGVTARDNWKYIPVPALLPLASVGYKQLTFQATYIPGTYNNGNVFFAWLRYRF

SEQ ID NO: 8224 - protein, 72 aa, Caulobacter sp.
MTNPIGINNLSQSSNIANATGDEVVSLDKHINTSATDTDQIQAFIVSTWMAPFQNDMYSEDNPISPYYKIEW

SEQ ID NO: 8225 - protein, 502 aa, Caulobacter sp.
MSQRPAPLLPTASRRARVPWTARAIVAAGCLALGAFSVTRAHAVPPTINLGNAAEAEDDASSGVFGFLSNWRRSANFLGNMWGLRPELGKYGAVLAVQETSEVFGNATGGNRRGVDYDGLTQAVLQINTQRAFGWYGGTFNVSMEQIHGRSLSQDNLQALQTISGIEADRSTRLWELWFDQKFLDQQQLDIKIGQQSLDQEYMISSNALIFANTMFGWPMVPSADLPGGGPAYPLSALGVRGKYWLATPLYVLGGVYSGSPTRALSGDPQQTNASGTSFPLDRGVMAIAEIQYVYPALGAMVSPDDEQPLSHVYRLGGWYDSEPFADQYYDNTGTPLASPASNGTPVNHRGAFSFYAVMDQMLWRSHVDPNRTINMFGRAMGTPQADRVPVDFSLNYGVTMKDPFPYRTDDTFGLAMGYTHVSSALARYDRAVHQYTGVYSPPQGGETYVEATYQYQFTGWMQWQPDFQYIFNPGGGIPNPSHPDHHIHNELVLGFRTNIAL

SEQ ID NO: 8226 - protein, 656 aa, Caulobacter sp.
MSRHILSARVAACLLLCSSAPPALAGEATTLVLRPVVVTAPGTSSPLRVETDPKQPRLPVPPNDGAGYLKSIPGFSMIRKGGTGGDPVFRGQSGSRLGLLIDGAPLLGGCNMRMDPPTAYVFPESFDSITVLKGPQSVRYGGGLSGAAVLIERTTDRFTEPGVRGDASLLGGSFGRNDQMLDVTAGAPEGYLRAIGTRAHSDDYEDGEGNDVHSRYNRYSGTLVAGWTPDADTLLEASSEISRAEAAYADRMMDGAEFDRTSHRLRFVRDGLTPLVDRVEASAFYDYIDHVMDRFSLRRWTGGMMAALSNPDREGYGGRAAVDLKPAEGLTVSVGVDGNHDRHTVRSLSAAEYAAGVDYRDKPRLADLVFETWGGFVEAGYQIDADRRLAAGYRLNRTRAEQRGRAAAAADTDWLHTGFARVEQAAGAAWTLYAGLGHTERAPDYWERTRLFSLAPEKTTQIDTGALYRAGRWEGSVSLFANRIDDYILLSASTGKNIDARTWGGEAELGYAITGDWRAAATLAYVRGENRTEDTALAQMPPLEATLALDYDDGTFLGSLLTRLVASQDRVDIGWGNIAGIDVGPSGGFAVVSVSAGWRPTDGVTLTAGIDNLFDRTYAEFLSRAGTPSLAGDGYVQTTRVNEPGRSFWLKGSFTF

SEQ ID NO: 8227 - protein, 701 aa, Caulobacter sp.
MSRRLSLLAVSLLGGTAFATPAFGQNAKPLIVPSPGEIAIHKIVVSATRTREASFNVPVSIYSISGRQVSFANAEENLSETLNRVPGIDVQNRQDYAQGLRITSRGFGAQTPFGVRNIRILVDGMPLTGPDGTTDSEVIDLGDISRIEVLTGPFSVLYGNASGGVIQVFSKNGPTRPTVGGSVIATSYGGWRVGATYGGTARWGSDGSFNYMMNASDFYTGGYRQHSAARRQQFYGKFRVQVSPNTSYTLLIDGLNEPYSEDPGGLTAAQYHANPRQAGTGADAFGTRKVLRHLQFGLVFKHRFNAQNSIRVVVYEATHSVLQFLPFTGSYAASGGGVVDLARKSGGIDASWTHRDEVAGVPVTLITGVDFGYEQQHRKGYVNEFGSIGALRRNEQDVARNVAEYAQVNAHVAKRTTLVVGLRHSNDYYSVTDNYVTSTLTNDSGSVSYGNTSFVAGATYHLTPTTNLYADYGEGFETPTLDQLAYLPNGLAGFNSALRPTTSQNFEAGIKSLIGADTYLQLAVFHIHTNNEIEVSSSKDGRTAYSNQGQTARNGVDVSLDTYLPHHVELYGSYSLLKAHFLANQFAGRSLPGVPDQRIYGELDWHDPSTGFYAQANAQWQSRMYVDSQNSAYAAGYFTAGIAGGFRQNLGPIRFNEFARINNLFNRTYVGAVVIAASNAAYYEPAPGRNFVIGMRARYRF

SEQ ID NO: 8228 - protein, 228 aa, Caulobacter sp.
MRKLQLASLTFALISTMGSAFASTNQEGYYGSARLSKVWQKADSMDTSLRPGIGQFVSGDDKDDFYNASLAAGYQYGNGWRTEGEYSFNKKAEYTSGSTAFSTSFNHHKTESQRLMLNVYRDYDIYQGISVYGTVGLGVAKVKSSGWQGNAARQYGSNTDTNLAYSIGAGVSYEPIDKLNFDLGYRYIDLGKIESGMNRFANARGIQDEQMKAHLKSQELVLGVRYLF

SEQ ID NO: 8229 - protein, 836 aa, Caulobacter sp.
MRAFHTTLLMTAVSGLALSAGLAHAADVAAPGAVPEVEQVEELVVTAQKREQKTIDVPIALTAYSGAMLDKLGVQEFDKLSAFVPGFQVQNQSPNNPGFVMRGITSDSGEATVEPRVSVFQDGVSISKSRGSYIELFDNQRIEVAKGPQSTLFGRGAMIGAVNVIQNKADPRALDWRVAAELGDHGYGLFEGMANVPLSDTFAIRFAGRYKERDGAIENVLGGANLGSTDTGAMRLSAHWSPTAKLDADLIVNYEADHPTGTSFKSNTFNPTNITTGQALGDRDPNSPAGLSSGYGFEGGAPLGLKRFVQGATALVDYRFNDAWTLSSITAARHFASDEVFDPDGFSLPMFVFAEDARGTQYSQELRLNYDNGGKFSWFGGVSYFDEDAQTRVPLQFDERYALALLTGQLSKPNPQPTAVLTNTTYLAALVTGLTGGAATGATALGIANNLGVHTEQFTNYGMTKSWDVYGDATWHVTDRFELSAGLRYTNDDKSSGIASQVSQRSILGGTIGALSQPAATRQAILGALAAPGAANIPTSAGYPIPMFGLFAQPTTGNGQISTQDFTDDGLTWRLVGRYAVTPEASLYASYARGRRPKVLSSAAPSAPMSPGKFTPVSAETVDSYEAGAKSRLLDGRLYVEGAVYFYSYDNFQTSVQDGAQIITTNAGKAESYGFEGQATWQAASFAEVFATYGYNHGRFKAGIRDGNRFRLSPDNKFSIGTTLHADALGGRFSLTPIYAWQSKTFFDDDNDLPALQKKNLIPDLVQDEFQKSYGLLDLRLEYQPSFAHWKVGAFVTNATDKKYVKDAGNTGDAFGIPTFIAGNPRYYGVTFSLKR

SEQ ID NO: 8230 - protein, 313 aa, Caulobacter sp.
MISDSKLLASAAWDAQSLNELKAKAGEDPAANIRPVARQVEGMFVQMMLKSMRDALPKDGLFSSEHTRLYTSMYDQQIAQQMTAGKGLGLAEMMVKQMTPEQPLPEESTPAAPMKFPLETVVRYQNQALSQLVQKAVPRNYDDSLPGDSKAFLAQLSLPAQLASQQSGVPHHLILAQAALESGWGQRQIRRENGEPSYNLFGVKASGNWKGPVTEITTTEYENGEAKKVKAKFRVYSSYLEALSDYVGLLTRNPRYAAVTTAASAEQGAQALQDAGYATDPHYARKLTNMIQQMKSISDKVSKTYSMNIDNLF

SEQ ID NO: 8231 - protein, 225 aa, Caulobacter sp.
MRSISILSLAAVSALAIAPSAFAQEATYTGDTSSTAMSSSSDTASGKHWAVVGGVALIKPKNDPAPGLDVDGGPAPTLSASYYINDNWAVELWGAADKFNHRVNADGVGKVGTVEQQPIAISGQYHFGQADNVFRPFVGVGYYESNFSNEKIDAASTTGQHVGVDTAKGVIGTVGVDMNINSTWFARADARYMRSRPELRVGGAGTGSELELDPWTVGFGVGARF

SEQ ID NO: 8232 - protein, 783 aa, Caulobacter sp.
MALDKLNVEGKGNAHDSDWIYDEPRSVSEITREQLDNRPARHAADILEQTPGVYSSVSQQDPGLSINIRGIQDYGRVNMNIDGMRQNFMKSGHGQRNGSMYIDPEILSNVVIERGIFNGIGGAGAIGGIATFNTINASDFLAPEKELGGHIRAMTGDNGTRFIGSGALALGNPNGDILLAVSERNLKDYWPGNKGVLAGLRLYSPTRNVGDDLKNTKTLFTGYKMRSQLAKVGWNFEAGQRLEFSYLQTQIASPNASMLSEVLALSPSGKEITKIGWRNTSFTNVENRNIALDYRLNPEHISWLDATAKIYYVDTNDETDNANSLFKEYFWTQTRLKTRGLQLQNTNTFTPSDAHQIRLKYGLEWFSDKSEGYSTRKLIERTTPPGKRAITSTFAQLNYEYDDWLRLEGGLRYDQFRLKGNTWLHTRSFLQPYTFENPCDRRIHEQSEKPGSRCSSRRPATMRWDVDRREQQLSPTLAMGVKPGLEWLEFFGSYGKSWRPPAMTEVLATGTAHGYSWVLPNPFVAAERARTWEAGFNIQQSNLFIEDDHFAAKVAYFDTRIANYINLELGKAKPKFGGDSFTDVAYVNNLLKTRFRGLEYQLSYDAGTFYTNINYTRMIGVNNVCSPYAWLGGLQSVKYKYVGKVEQIYAVENEVANNYVTCMNANVLFGSSAYLPGDRGSLTLGSRIFDRRLDFGTVIRYNKGYQDRSAQDENGNPLTAYVADWPKYIVYDLYASYKVTNNLILRSSIENITNRAYLVNYGDTLSFAPSRGRTIQGGFEYKF

SEQ ID NO: 8233 - protein, 779 aa, Caulobacter sp.
MSLHLQRVSISRHRQRTRPDADRLRSKKVPACRRGPAYRGEARVFKDSIGAFRSAACGFALAVAGLSMPAFAQDRAAPAADDAVDEIVVTATRRAANVQDIGIAVTALGGDRLTELGLRNSTDLAAMTPGLQFTAPGGPPVAGLISIRGVSQNDFAGHIEPANAFYVDEVYQPSNATSVQELFDVSRVEVLKGPQGTLFGRNATGGLIHVITNQPTDELSGFVDATYGSYDQFRVEAAVGGPLGEGVSARIAVLKNKADGYIKNDIGSDILANDTLAARGQVKIEPNDRLTVNLFADWYKIRPVATGGAMITGAAQDADGLGVLLPPGSPTGFGYVDADGDPYTGSFNFAGRFTRETWTVGGKINLDLGGGYSLATVTSYQSLDSEYAADNDFSPIDIGIFGQNAKAKHFTQEIRLIEDEGAFRWTAGLYYLNIKGDYFQGFNLPAFGTYPRADYSVDTQSYSAFGQAEYDLTEQLKLTAGIRVTRDEKKYYYSEVCTGPLCPAFIAPGSLASAGVTTDKHGETGVSGRLALDYKPNSDTLLYASINRGYKAFNYNAGFVGQAPLTGFRFKGENLMAYEVGGKFEFFDRRLRLNGATYYYDYSDYQAFDQRGFNFTLFNTSAKMYGADFELSARPGMGFQFDAGLALLHTNVKGIPIGTRLVDRKAPQSPDYTINLAATKRFDLGFGQLSGTMNAIYTDDFYAQLTNAQATLIKGSWLANARVSLKFADSGFELAGFVNNLFDKARKTFAFDVSAPPLGGSYGTYATPRWFGVQARYSF

SEQ ID NO: 8234 - protein, 687 aa, Caulobacter sp.
MKMTSRPAGACARLPVALGLAVTASLAHAAPAEEARTLDTMVVTAAAPSSPLHWVTDPRLPRQPVPASDGADYLKTVPGFSAIRNGGTNGDPVLRGMFGSRLNILSNDGNLIGACPSRMDNPLSYIAPESFDRLTIIKGPQSVRWGAGASAGTVRFERDTPRFEEPGLRADASALVGSRNRNDQVLDLTLGNPTGYVRASGNRSEADDYKDGNGDVVPSKWRKWNGDVAIGWTPDADTLLEISAGAGDAIARYAGRGMDGAAFERTSYAARFEKRNLPGAWDTLQANVYYNEADHVMDNYTLRTPNPHSMMPMPMASNVDRRTQGGRVSSEWRWQDVQLVAGVDGEGSRHRGRMGMGRDTYRQAAWETDANFRRYGAFTELTLGAGTDQRWISGLRIDRASVRDERQSVRGMMGNRPNPTAGLQRKEWLGSGFLRYEQDLADGLTWYAGLGHSERMPDYWELFSPNQGPAGAVNAFSGVQPERTTQLDVGMQYKGPRVHAWVSAYAGQIQDYILFTYHGSGMMGMSQARNVDARIAGAEAGVEVALAEQWKLGGTLAYAWGENRDQQRPLPQMPPLEARLSANWEGQRWSAGALLRAVTHQHRVADGQGNVVAQDLGPSAGFATFALNTAYRFSSQLQLSAGVDNLFDRAYSEHLNLAGSADFGFPADPVRINEPGRSVWMKVNYRY

SEQ ID NO: 8235 - protein, 838 aa, Caulobacter sp.
MRFTQVLCGTASAAVLAGLSVASVAQAQQTETMTVDSIVVTAQKREQNLQDVPVVVTAVGAKLLQDTGVKDIKDLTILTPGLTVTSTTSEASTTARVRGVGTVGDNPGLESSVGVVIDGVYRPRNGVSFGDLGEMDRIEVLKGPQGTLFGKNTSAGVINIVTKEPEFGFGAAAEATLGNFNAHGLSASVTGPLFGTETLAGRLYVAARERDGYNDVLTGKGPSKRDQDQDQGFYTIRGQLLFVPNDEATFKLIGDYTKRDENCCGAVQIRTGPTAPILNALAGGVALAPTAKPYDRVAYSNRGAPSSIEDKGISLEGNIELPIGELTSITAIRNWRTDNGQDSDFSTADLAYRNKDGTNYSEFTTYTQELRLAGKTGNLDWLVGTFLADERLDNKANFLYGNDYEQYLGRLLSRSAANPAGIGNFISLLTGRAPNTTFTPGQGLYDKYNQRAKTIALFTSNTYQFTDAFSITAGLRYSIDKKDLDTYQTTSDGGVGCGIGLSTAGQARIAGIVGAAATPTVVGNLCLPWANPLFNGRGTHQKRTDKEWSGTIKAAYRFSPEVFSYASYARGYKGGGFNLDRTQSSNGLQSGGLGVVPIYDTSFEGEFVDSYEIGLKNTLFNRSVLLNLTGFYQKFTDFQLNTFLGTSFAVASIPEVTSQGVDADFLWFTPVRGLTVQSGFTYAKTEYGNQKIPNDSTNALALLPGQRLSLAPEYSASGSLTYERPVGDSYKARFNVGAKYSSEYNSGSDLFPPKLQESYTVVNARIGVGTADDAWTVELWGQNLFDEEYTQVGFNAFLQGSSGLSATQATYVPANDTITYDAFLGAPRTYGVTLRAKF

SEQ ID NO: 8236 - protein, 722 aa, Caulobacter sp.
MPGQQSQSRFLFTPALLTMGIWIATSQAAYGAETQATEASSATTMELGATQISSDQLGSTTEDSQSYTTGPMQTATKLPLTIRETPQAVTVVTRQRMDDQAMTSINDVGKYTPGLFLDQSSGPGRQTYTSRGFDIDNIMYDGLPASYSGYTAGVQPNLAMFDHVEVIRGATGLATGSGNPSAAINMVRKRPTAVPQVTLTGTVGSWDDYRGVFDASGPLNDSRTVRGRIVGSYQDANSFRDKEKSDHGVFYGVVEADLNDATTATLGLSRQEDQTNYFWGGLPLGTDGHHLNLPRSTYSGSDWENKKIRIDTVFGELEHRFDNDWKLRVAGSSSSLDGLFSGTYLSRYNGPLETTAYQSKPEEQQTAFDVYASGPVEAFGRTHEVVVGTSRRVYDKTSKEYSPYDTGLPIGAPKPDFVRDGKTHSIATQDAIYLTTRLSLADPLTLILGGRLDWYDYDDRSGDEDYKVTRNLTRYAGLIYKLDEHHSLYTSYTDVFQPQSAQSLSGKVLDPVVGENYEVGIKGEYFNGALNASLAVFRIDQKNLKTESPTQAGCAVLTCYDAAGLVRSQGIEIELQGALTENWQVGAGYTYARTHYLKDTDPANKNQQFNTDTPEHLFKVSTVYRLQGALEKMRVGGNVYWQSRMYNDIALTDGSYRLEQGSYAVADLMAGYQVSKNLDLQLNANNIFDRTYYTAIGASSVWGSTDVYGNPRSYALTAKYSF

SEQ ID NO: 8237 - protein, 768 aa, Caulobacter sp.
MNNRSIPRASRFPITRLALLVSLNSLCLISPFIQADDDVPTSVTAPASDDTAAVTLGTVSVIGQGETRQVQRVTQKDVSAYSAGTSPLKVLQRLPGVNFQSGDPLGREEGSQRISLRGFDMHHLGYTLDGVTLGNMSFGNFNGLSITRAIIAENIAASEVAPGIGSLGTASNSDLGGTIQFTSSNPDKEFGARLSQTLGSYDTSRTFMRVDTGEYNGLSAYVSGEKYDADAWKGHDNPQKSDAVNAKVNYNFGENRVSFFHSTSSHDEANLPSLSKSIIQRLGYNNWSYYTPDWTRAVNAANGIYTGGVTSAGDATYNASSLRDDELDILNGNFSLTDDLVLDATVYHHHDSGRGNSYYPFIFTSGSTTVPSNSIRSTVYGIDRTGFQSSLTYFLGQHEIQGGFWIQSNKNDIARYLFDTTNATPQNHIVKTNGLRQAATVLDQSYNDLTRQFFLRDTYTLLDDRLKLEFGAKNTVTTSTAEGKGGGYASGSLEARDRFLPQVGATYTLNDSDEVFTSYSENMAAFPSGGYSPFFTTQTAVDAQNGFKDLKPKTSKTAELGVRRSTKLYSASAAVYNTKFDNRLVAITNCTGIVICQNGVANVGSVTSRGLELSFGLTPDEHWRWSNSMSYNHSTYDDYASGGSTVHVKGKTVVDTPKLMYSSNLDWNWEHWNAGMQGNYISKRYYTYTNDSSVSGYWVANANLGYDFGKLGAVKDTTVSLNMVNLFDKRYISTLNTDASAATDPAGNLQILQVGTPRSAFVTLGVKL

SEQ ID NO: 8238 - protein, 260 aa, Caulobacter sp.
MRTIKSLILAGGLLACGTTFGGDLLQWQNNSLTYLWGKNFKVNPAIQQTVTFEHADGWKYGDNFIFVDKIFYQGQKDAGNGPNTYYGEISPRLSFGKIFDQKIEFGPVKDVLLAMTYEFGEGDTESYLIGPGFDLAIPGFDYFQLNFYNRTTDGSRAGDNVWQITPVWSYTIPVGDSDVLIDGFMDWVVDNDENRRGTYQANLHFNPQIKYDLGKALHLGEKQLYVGVEYDYWKNKYGIKDSDAFTTDQNTMSFLVKVHF

SEQ ID NO: 8239 - protein, 216 aa, Caulobacter sp.
MSITKRKIVFVIVSTLMARGASAADLADHSVPSAPSYDAPGTFSWAGAYAGLHGGVAAPKFNPFNNDRAPAVGAQVGYNFQAGPGVFGAELEGSYLNNEVRVPGGKVESRFRGAAKAKAGLGLDRTFIYGTAGVTTTEFEGRRPVFGSDKWKSGPESWKQGYLFGGGVEHAFPGGVSAKIEYNYVINNAVPTPSGGVNSGSDLNDSVIKAGINFRF

SEQ ID NO: 8240 - protein, 865 aa, Caulobacter sp.
MKTLLIPRNFEAKEYLFSPCLVQKKLCSLFISLFFCLSAIGYTDSNSSLPLNSGNINTEDPSEPNETTSGSNRQKNNDPSATLPEVTVTAVGPTENILPTAHSNTSVYAIPLDVIDIPRSVTPISHGLAQSAGIGQFGYLDPLSTAFLVPAALTQINYGIASAPTIRGRNGLTLINGIEETLNNNSEQNIPWNYNMVESMDIVEGPSNAVFGATQVSGGYINYITKQPYFDNFRGYMWDTLGMYEEYMWGADIGGPIDKDKKLAYRFSYMGQENGSYYQYQRNDQQNFYLALGYHPTESYSIDLYTDLGTYDFTPMWGMINRPTQELIDEGLYLPGALSPTLANTGIINNPPASSYLGSPVGISRRNVLLNPTDGGYGTTGLTQVIQKFFINEDFQVINNTFFWYHDDQWILHPLFYDESCRGDYEIDNRTECRLYFDTIPQGKEKKEKEPSYPVLGQVLFSHSLDGGVEMHYQKNLDYNSDSFIVLNSYSLINQNPLLWNAELSKYFQARIGNPKASFGGEWPIPGAPQGYYFEPANLAAGSTDCHYGAISPFILDNINITERLSVIIGARATGYFVSAQTPPGTPPILFEQLSTTQLTPLVDGGTVYKVFPWLSAYFDFNWGYVVNAADMGGFSPFFGPSQFHLLNELYEGGFKFDLLKHSLFAALDAFSQFTYLNNRAGPATPSTVNGFEASINYQPGRHFWAKLGYAYMHGTEDWTSVGHGPPMYQTYSTAFALQQNLPLNNNQMYPVGIYNFLGFPEQIFSGLVTYRLDSGIGITMGGLVMSEQYLGYNYITHIPTQFILNATLFYTAPRWEARLYFYNFTNEPYWLAFGMGANGTRTFNFEDIVAGMPFWIQATLVYKF

SEQ ID NO: 8241 - protein, 740 aa, Caulobacter sp.
MKSIYQRTLTLTALAVMLAHSAHAAENQESTQPSYMAPELIISGQKGDVLQHVVGKESVVLNPSQMSVYKAINLMPSLSQQSVDPYGLADIVNYHESFRFRGIEATSGGVPATTVNVEGLPVTGRPGGGATIYDLENFSSLNINTGVMPAHVGLGLADVGGKISMEIRKPEEQFGVQLKQGIGSDSFKRSYLRIDSGDLGDGLKSFASVSNSNADKWKGEGDSERNNVMMGLAKPLGKNVTLETYLTWSKGNIHTYKPLSYTQLSDLDGSYKSDYGTNPNSYDYFDYNRNEFEDWMLMANLSIKTGEQSTLTIKPYYWSDKGYYLETITLANGQNRIRRWDIDHDLSGILSEFSTNVADVDLRLGYLYHTQERPGPPNSWKTYKVVNGALVFDTWSILSNPSRHELHSPYMDATWRFGSYQLEAGAKFINYTLPSIVTYQTTGIGDVAHADALALQPTLDTFASASDTKSFSRVFPNLTLTHFVSDNLTLHAAYGENYVTHVDIYPYFISQRALFAAKNISFQKLWNAREMETSRNVEFGMHVNGSNWSMTPTLYYAKHINKQAVLYDPALNATYPMNNAEATGYGFELEADYKPSNAFKWYGSFAWNRFYYAQDIYSEGGSLIDVKGEQVPDAPEFLAKSMVSWKVGDVTLSPIVRYSSTRYGDVLHKEKIDANTLCDFDITWSKALAGLKQVDCSLSFMNIFDERYVSMISTSDYKTLKTSYQPGAPFTVVASVALHY

SEQ ID NO: 8242 - protein, 864 aa, Caulobacter sp.
MSKRYKKLAQQAMLPELLAYGLSSVIATLGLLAPLPVRAEQAAGVPETPDIDLAKLSTPPSAQPATSVKEWQAQIEASIVEITAVRVEPSPEGLNIILESETGQLSIPTPTTEGNRLSAVIPNAVLALPEDPSFEQANPTPEITQISITNQADDQVQVVITGANSAPTATVSNADSGLTFSIASESAPDTLAEDEDVEITVTANPEEGYAPPNASIGTRTDSPIRDVPQSIQVIPKQIIEDQQAIGVEEVVENVGGVTFLGNNDGRGLNFSIRGFDNVPVLQNGFRLFGDNSVEPEIANLERVEVLKGPASVLFGQSEPGGLINLVRKKPLSEPFYKLQIQGGNRGFVSPSVDLSGPLDKDGNLLYRLNALYRREDSFRDYTTSFDRFFVGPSLTWNISDQTDVTFSLEYIKEDNPADFGTLAFGNGIANIPPSRVTNNPEDTIDKTYLKVGYGLEHRFNGKWKLRNEFSYIYDKNDYGILALPFALDEPTGTLTRVFAAQFNENNFFNLNTSLQGEFETGSIRHNIVAGIDLSRADNNGATRFSPTPEFFSFLDIFNPVYDPKPAFDTVPIAFGNDNSVNRLGVYLQDQIYLLDNLILVGGIRYDIVDRSNISIVTGVEDTQVDEAFSPRVGLVFQPTDYLALYANYSKSFNPTFETDDLGELLDAERGEGFEVGIKAELIKDRLSATLAFFDITKSNVATADPVVPFAVITTGEQNSRGIDFDISGEILPGWNVIASYAYIDAKITQDNTFPIGNDLIGVPEHSASLWTTYEVQSGDAQGLGFGVGFNFVGDRAGDLEDSFRADSYFLTNAAIFYRRDKWDFRINIDNLFDVNFIRSVNGGRARGIYPGEPFTIRGSISVEL

SEQ ID NO: 8243 - protein, 369 aa, Caulobacter sp.
MQRKVLALMIPALLMAGAAHAAEIYNKDGNKLDLYGKVDGLHYFSDDQGADGDQTYMRLGFKGETQINDLLTGYAQWEYNIQANNTEGSDNQSWTRLAFAGVKAGDYGSFDYGRNYGVLYDVEGWTDMLPEFGGDSYSKADNFMTNRANGVATYRNTDFYGLVQGLNFALQYQGNNEDASNNQEGTNNGRDTRHENGDGFGISTTYDFGMGFSAGAAYASSDRTNDQVTKTTAGGDKADAWTAGLKYDANNIYLAAMYSETRNMTPYGDNDAAVANKTQNFEVTAQYQFDFGLRPAISYLQSKGKDLGNGQDDQDLVKYADVGATYYFNKNMSTYVDYKINLLDEDDQFYKNNGIGTDDVVALGLVYQF

SEQ ID NO: 8244 - protein, 2961 aa, Caulobacter sp.
MTKANESFSTFRAIIGEKDNKKVYSQTQPDGTTKDFTAASNVSGKEEKWVDNAVGIYNKIAPTGKLEIKVPELTIKKYSKDGVGVYAESGKISIEEGNISIEGGEGNIGLYSVGGPIEYKGNITMGPSGDSGNINGNEGNQDGKSNIGLFSKKEITMTGDLVTENTHGKAKDSTVLYADNGGKITIDDEYDGAVPTPNKVRESKVDIKLVYGKTGENTAIFSKGENSLITLKSKTRKINIDGTKSDGTASNKGVGLFAQDGGKIQVNGTALTNGTEITIKNGASALVSMGKDSNNIASQIDAKYSKIEYDGNGYAVYSDGIGKVDLSGAELTLKGKSTAFDVDLTPSATLPITLDSSTRIHANSDDVIAFNLKQTGGVTLTTVGGIENDIITKIQGKLTGVNLTNLFDGSTSNKYKVAAVDGGTLTVGNLDKSGKKGDTDQDKIDGYQYFNKFLGQRLKATASGKTIKAVLTTEDATERFNGQVVGFEMNSSKNATNETDTAINLQNNSKIIADRNGAGTGAVGAYINYGLVNIDATSKIEVEKDTSTGNTANKGAVGVYAVNGSKVDNKGTIEAGGKESVGVLAMAYGESGGVTQKNQFGGKTGEGTFSVTNSGNITMSDDDAIGIYAKNNNTSAASNDYKVTNTGTIEVKKSVSKTAIGIYADKSTILPKGGTIKIGEKAVGIYAKNSIVGVAGDNLGNIDFNGANGVGIYLKDNSTLLGNKVTLKQSATGTLAGKVGILADTITNKTLNTEVVADTGVNDVIAYYSKNNGTLTVQADISLNENSTGITGADSENLVYSGSKTMKLGQKSTGIFGQKNIDFSNGSNIELNGNSSVGVFAKGTSGVINSNGNIKFTKENSIGLYGANGATVNDNTASMDFTNANAKNNIGAYLAGAKWVDNRTAAYTFNSDHSKNNIYLFAQGSRNNGTDIGSTATLKNEFKVNPSGSASSTAKTIGMYFNTAVKGESTFVDNTLDMTGSNAKVSVTNSGIGVYAKNTTGSGKNNIINKIKVSSTGTGSVGVFTDGDLKLSGTNGLIEAKTNGIGLYGNSGKVTVENEHKVEVTSAGTGMYMTNGSYLSGGTLELENKTTGTTAAGIYYTKGTSSDEVTHNTKLKIDHGSDLLALYVDGGIKLNNTETIKIGDGTNNVGAFVTGGSIFKNKGGITLTDSIKNAIGVYVEDGQAANESGKNIGVYDYNTSGSGTPSIGMIAKAASGKTAKVINMGNIVADGEAIGMDIENDSIGENSGNITAKNREVSGVEFKSIGAYINGANAKFTNSGIISADNIGLALKDTTANKILNSGTLKLTKTGAVGVYANNSVVDFNIAPTVESTVDKTVALYATGNTKIKSQITTAAGKSHVGVYAEGNAEFQSGSKVTVSDGIEDSGTTYYGIGIYTKSGYNKAANVDLKLNGLKTIGFYLGATGTTGSTVTHTGTIDVGSGIGTFIPKYSKFVAQNTTFNVGNGGTAVYLKGGEADLGSTGTANINFTGSGRAVYQDGGTLTTGAGLHITGTGSFLTLKNANSIINSIVNVGENGIGINGIYDSNAQDYTLKLDSPTGHIKLSGNKATGIAAVAKNTVALKKVDIINKGTIETISGEKTTGIYGKGANIENATGAKINIGAKGVGIYTTNYYDNSTLSLTNTTLKNNGEINLTGDEATGIVAVKAHTTQDFIGGKITGTKDKLVGMFFDNSAAQTKVKDFNISLGTNAKGLIFKDGQDFTITSSSTNKVTIGNTTNVASRGIGISALGVNGTVSNTEVKVGKNSLGLYAKDKKLTFDLATGKLESSDTSRSSILAYADGNNSEVALNGGGTLKVGADGIALGTKGGKITANATTTVEVDGVKGLGAYVENGGSISNNFDIKVKSAEGIGMYAKGGALASVAKVSELKGNKSIGYVFENITNAINMPNSVQLTDTNATGQVGVAVKGTGAGLTVAGVSVVGSKNIGIYNETTGAVTNNGALNVADSTGDSSIGIYSQGGTVTSTGNATIGKNSIAIYGKNTAATLNGNLNIGEKGVGLYVDNTATSKGDTTVNGNITVGANGAIGIQTTNSKVNLTGDLSVASGDSKGIFSMGAGNVETTGNITVESNSVGIYKNGSGEVKTAIGKTLTVADSAYGIFSKGAKLINNMNVTVGVDAIGAYVDGNDLTSTGTVTVADKGVGLLVKGTGKTLTSTGNITVGSNNSVGLYAGDNANIAQFGNITVANNNGIGVYSKGSGNVSTIGAITVGKDSIGVYKDGKGTMNINASSPIQTMTIAEKGYGLYYKGNSRADNIINSNMNMTLGKEAVGIYAKNTTVNHTGDITVGETTIGSSGFTTPSDNKNSIGIFGDNSNINFKGNMLVDKPLSVGIYGANGGSITVKSGSTITVKNGATGIMTGSKVENITLESGSTLNVDGKVDTNVYTNATKSNVSFGIAAYSGLIDNQGTINVKNGATGIYLAGTASLKNGATGTINIDATSKSTAKPDTKASAELGGIKVTDKGVVTINNKVINGGTLNVKGALNMEGLGLDISTGKTVVDAKSISGVAEVLPSFSKGNSEQKVTIKDVFRTGVVGAFSGDVKSKSVSWIAKISKEPGSSTTTSDITMVRIPYNSLISGERYKNLASGLEDIRSKIGKDSSSPIFKSLDNISSHRDFARAIANIRGDVYSNIQERMKTVENSFDKSYNELLSSYNKTRNVDKFSVIYTGGEHKDSTLGVSGYEYKSTGVLYLNDREAFTYGGKYGWSAGIVGSNFEFKGDTNKGSKERVVSGKLGLHYQAPLNKDDDNARLRWLTRGEITVNNHRTKRYSQVGADTYQNKASFYSTELSWKNVISYDYDINTNWTVKPYTGIDISYGHIFNIKEKNEGLPLEVKGKDYFVITPNVGVETKYVLPLGATHQVFAKVDTEFNYDVTKLYHGVNQAKMKNASTGYYDLSKPERRRARVAVGAELGLEKENAYGVTFRAEYQGYKKSQLNYEVRLNYKF

SEQ ID NO: 8245 - protein, 182 aa, Caulobacter sp.
MQKLLLSCGVIFSVSAITLPAQAEQHTASIGYAYVKPQDVSALNGATLSYRYELDDQWGLLSSFTFAKGDEKETKYYTGEDLKYYSVMIGPTYRINDYISLYGQLGLSRINDKSTAHYSGGYIEKESTSKNTLGWGAGFIINPTTNTSITAGYEGSRFSIKDGNEKDHLSTNGFNITVGYRF

SEQ ID NO: 8246 - protein, 776 aa, Caulobacter sp.
MAAMRWRGASVGVLLAALAQQAAAHPERVPAELPTVDVDAPKRTTRSKPKPQIRRDAQRAQPGVSRMPVTQPSAATAASAPSGAPNVGSGAPQVQGMASETVITGDEINARPATRPGEVLEAVPGLIVTQHSGEGKANQYFLRGYNLDHGTDLALFVDDVPVNMRTHAHGQGYADLNWLMPETIGRVDVRKGPYFADEGDFASVGSVHIGLVDSVPKAIAQMTAGSFGYRRFFGMDSVHAGDGHLLIAGEAGRYDGPWTTPDDAKKLNGLMRYSQGTATDGFSITGMAYANRWTSTDQVPERAITSGLLGRYDAIDPTDGGKTNRFALSGRIAGSDDAGSWKANAYVVKSQLDLYNNFTYWLRDQDNGDQFHQHDDRLMLGANASRTLNGSFAGQPMETTFGIQTRYDDIALALSYTAQRAYLSSVRNDKVGEGSVGVYVENTVRWTDWLRTTIGYRGDYYQTHVYSYFNGNNTGDASASLGSPKFRMVLGPFNQTEFFLGAGYGMHSNDARGATTTDDPNAPGNRIDSSPLLVRTKGAEVGVRTRVIPGLDSSLSLFMLNQDSEILFSGDAGDTEASRPSRRYGFEFTNHYRPASWVDIDADLAMTHARFVGEDADQATTYAQLVGSGAPSEVLRGNAPGNYIPNAPSMIASAGITLGEKTGWFGGVRWRYLGSTPLTEDNYFRSTATSIFNGRIGFRDANGWRIQLDVLNLFNTKANQISYGYGSLLPSDQLYADCYGSAPKGLPAQVCQTGVMDRVLHPIEPLTFRVTVAGTF

SEQ ID NO: 8247 - protein, 986 aa, Caulobacter sp.
MAKVTTTGQVVDAKGEPLIGVSILEVGTTNGTITDIDGNFTLSVNEGATLEISYIGYKTQTMTVRPQLGQIVMKEDTEVLDEVVVTALGIKRSQKALSYNVQEVKGDALTAVKDANFMNSLAGKVAGVQISSGATGAGGAARVVMRGMKSLTKDNNALYVIDGVPIFNTGSSGGEGQYGDMGGSDAVADLNPDDIASVSMMTGPSAAALYGSAAANGVVLITTKKGQTEKTNITVSNSTTFSKAYIMPEMQNRYGTSSGLFSWGAATANRYDPSDFFNVGTNIINSIALSTGNSKNQTYLSASTTNSDGILPNNSYNRYNFTARNTTNFLNDRLTLDIGAQYIIQNNKNMVSQGQYYNPLPALYLFPRGDNFDEIRLYERYDTDYGYMRQYWPYGDGGMSLQNPYWIQNKILRTSEKKRYMLSASLKWKVTDWFNITGRVNLDNSDYRNRNEKSASTLTTFCGVNGGLEDAMRQERSLYADVLGNIDKTFGEFRLNANFGASIYHTSMDELFLAGDLIIPNFFQINNINFSANYKPDPQGYQDEIQSVFASAELSWRNQLYLTLTGRNDWDSKLAFSDQASFFYPSVGLSAVLSEMFELPEVITYAKVRGSYTVVASSFDRYLTNPGYEYNAQTHNWENPTVYPMDNMKPEKTKSWEIGLNLKFWENRFNLDATYYRSNTLNQTFKVDIPSSSGYNKAIVQAGNVQNQGLELALGFQDEWAGFGWSSNATFTLNRNKVVRLASGSINPVTGEEIQMDNMPVGWLGKENVAPRVILTEGGSMTDIYVYNQLTRDNNGNIKVDQNGNLSMTSSSTPTKVGDLDADFNLGWTNHFTYKGIDLGVVLSARVGGLAYSATQGILDYYGVSEASATARDNGGIPINNGMVDAQKYYQTIGTGEGGYARYYLYSATNVRLQELSLNYTLPKKWFKNVANVTLGVVGRNLWMIYCKAPFDPELSAATSSNYYMNVDYFMQPSLRNIGFNVKVQF

SEQ ID NO: 8248 - protein, 294 aa, Caulobacter sp.
MKKTLLAASAVVALSASFTAGAAETEKPQYLSDWWHQSVNVVGSYHTRFGPQIRNDTYLEYEAFAKKDWFDFYGYIDAPVFFGGNSTAKGIWNKGSPLFMEIEPRFSIDKLTNTDLSFGPFKEWYFANNYIYDMGRNDSQEQSTWYMGLGTDIDTGLPMSLSLNIYAKYQWQNYGASNENEWDAYRFKVKYFVPLTDLWGGSLSYIGFTNFDWGSDLGDDNFYDMNGKHARTSNSIASSHILALNYAHWHYSIVARYFHNGGQWADDAKLNFGDGDFSVRSTGWGGYFVVGYNF

SEQ ID NO: 8249 - protein, 809 aa, Caulobacter sp.
MRRSASRAAVKISSLSFSRGVSSIVFNPSVSSRSRWHRQNARWEFHALLCSKCYANGKPLLLVDGGWVAVIWHLVGAWGLRICTMAFPGCRGGHFLVHCGAMTVQCVARTLLFWCMYQGLLNRKGMPLLQAAARQGLLTWGCVSLCTGAVWARTVQEGDKTLPEVQVSAMVKGQALDEAQRAFSVTEFRRDEIREQPRQEVESLWSLVPGMHVNHYQLSGVANGLVMRGFGGGGHGGDVAATLDGIPLNEAMSHADGYFDLNVVVPLELDQLNVYRGPVSVMQGNYNRAGLLELRTRRSGSYTELEVSAGSYGMFDAQAALGRGLEGGDQLNLAAQHSRGDGNRPSSGFERSTISGTWKHQVHEKLDISLSGRWHEARGDSPGYLTEAQWRQNPQGKDSRVAGDGADKHFGTVRLDAQYALDAETRLLGFVYGTQQDFVRWFTRPRSATWMQREERYDRSVLGAGLNVSGKSRLAARELNWMLGLEQVRESTDYGYWDGLLDRRRTGPALNDRNTRLDNTAIYGQAGWQPTAWLQTTAALRWDHFDGRCRLLGEEAGGDECNRMLGRSHASPKLGALAQLNARTAVRASWSQGFALPSDFAKYALRNSDLHANIFRQSELGVEWKPSGHWLIDASLYRISSSHEIRNTAPGEYENLGATVRRGAELQLHWLPSRNWHVEWAYGHNRSEVTQNANGALLGRRVVAVPEYTSTLHARWMPRSDVTVHGLLRHVGRAPINTGNTEWAGSYRWLDLGLQYRLPASLARNASLSLWLRNAANTRYASTTTMIAGQRLVAPGAPRSVQLGLQFSL

SEQ ID NO: 8250 - protein, 103 aa, Caulobacter sp.
MGKLTLLLLAILVWLQYSLWFGKNGIHDYTRVNDDVAAQQATNAKLKARNDQLFAEIDDLNGGQEALEERARNELSMTRPGETFYRLVPDASKRAQSAGQNNR

SEQ ID NO: 8251 - protein, 578 aa, Caulobacter sp.
MRKFFNYQRQVLRACFGICVCLGLMPELWAQEASDRILITAKEIAAMNVMKIQDVLNRVPGLKATDSYISIRGSSNVMVFMDDRPINDPTSSAGGVKWDMISLGAVESIEIHKSKGGAIYGDNTSGGVILITSKKISRFNGNLESFYGRFEHKNVELNLQGQYEEMGAALTASYEAEDGFVENSDKTQWQLGAKTAFHPKESLSFGLAADFIDQANGSRGLPESRTPNSRNDYQSASGLFSADISELKSRTYISWSETENRDSDRDLYNQLRSTQIGQKFMLPANLPKLGLFTFGAGVEWEEASGTQFDKQAETRTWAFFSKSIRFENFPLQLSLGARANFYTAFPNAFNPELKAIYQFSKMFSLDGSVNQTNNMPTFKQRYNETSVTKPNPNLKLEKATNLSVSFQVKPAKTFSYSISGFYSKITDRITYVWQSDDWGMYENFGKVTYQGVETSVFWQPLAQVSLSPAYMYLHAQNDETGYWLPAKPFHRITADVMLYPIERLSMTVSLKYDSKTYTRSDNSKSLDAYWIANFRADYRLGAVRLFIDVDNLFDKSYRYGDGYDAPPLEWVFGMNYQF

SEQ ID NO: 8252 - protein, 658 aa, Caulobacter sp.
MKKSFSPLVFSASLGSKLFVASLIFPLSALAAEVMAQADRAKQEGGAERIELAPMTVTGQALERGYIAPNASTATKTDTPLMETPISIQVVPEAVAEDQQAIRLDGITQNVSGVQTMRQLGILFDNFIIRGFTSSNFNVYRDGLRLGTQSFETANLERVEILKGPPSALFGRSNPGGLVNMVTKKPLTQPYYALSQQFGSYDLYRTTLDATGAITDDGALAYRLNFVYLDSNSFRDFVDRERVFMAPQFTWKPTEALEVNFGYEYKNDDVTGDRGIPAIGNRPAKVSISRFIGEPDFSLQEAESHLAHLNWAYRFNENWKIQQRFAANILDTFNRNIVPLSLQADNRTINRGLFGGLTKRETYATDIHVNGQFDLFGARHNILVGFDYLRFTQSRGATFLASAPFLSPIDVFEPVYGTTQIPDLDTLPKNNFTDLKTEWFGVYFQDQMDLTEQLHLLFSGRYDWAKTESGFSTTSAPEVSTLWTDKFSPRVGLVYQPLAWLSLYANWTQALGANNGRSADGSPFKPEWAEQFEGGFKMAFFQERLNASVAVYELTKENVLTADISTPDPSDQVAIGEARSQGVEVDFSGQITEQWDLIGNYAYTATEVLKDNNGNQGNRLPNVPKHSGSVWTTYELLESFISKFINIETFVLYSFILL

SEQ ID NO: 8253 - protein, 494 aa, Caulobacter sp.
MKLQKSLIALSILVGVPTTFAQDDTLSSDNHSPAISQQDFVQQAIAEDQKLSDSEFNSTQSSQLNSLGYRSISTNSSFEELRIANESDNPTNFYDSPYRVSLFNPQNGEDSERLWSQTKSIFAYGVGVAGVLALMPESITNWEKDDVQLMNKWWDNVRSGPVWDRDDHIINYIGHPYFGGVYYQAARKSGYRQWDAFMYSTLMSTFYWEYGIEAFAEIPSIQDLVVTPTLGWVYGEWAFNKEKEIRLRGGTVWGSDALGSTALFFLDPVDSLGRGVNNIAGREVIKAGTGFVGVHSNVMRNGEVETKYQMQVNYAFGAGETDDSLKRRQKKNYHQYTDDPVTYGIVGVSAGFAYPQLDNERNLKNDFAPAFTLGLYFTEQFSTRLGYMQGNYDSTVSNEKHIYENYSLDVQYYFMPGSAFKPYLNAGVGEAMLDKDRDTKKLQWNIGTGVHYSLNANWSLQADWKYAYHRNSGARDQLWGTRLIYRFGEGNKYI

SEQ ID NO: 8254 - protein, 702 aa, Caulobacter sp.
MSKSEVSKSLRRHRLSVAIAMLPVSLLAIGSAPVLAQEQADAPVQLPGINVTADWLGPPTEESERTYTGARTVVEEEQLQATGALNLDDALRPVPGLTVLDETGTGILPNIGVRGLNPLRSERLQILLDGYPIAIGPYSNVGVSLFPVTLPSLEVVDIVRGGASVHYGPNNVGGVVNFVTKPIPAETSQTLRERVTIAEETGNVFTDTYYRVGGRATDKLDLQFQANVQRGDGFRDHSDTEVDNLILDARYYLNDQHELATQLQYYRVEAELPGALTPQAYEQDRSQSQRPHDGYEADMSRATFTWTYTPVDNVEFQWRNFVHDADRTFFFGQNLSGTGHWADPGLDSTHVADSPRLFTVLGTEPRLAIRHGRHDITLGARFVSEDVEFDVNRLEFSSGNRSVARDWHLDTRAMAFYISDTVSFLDDRLTVTPGLRYEDVDMDFRDNLTGNTEENNADELLPGLTVGYQASDDLFVFANSQRSLVPVQIAQTTREGAVANETSWNHELGARLQVTPDLLSSATLFRIDYEDQIQFNRSTSRFENLGETRHQGVELTNRWNLNSQWELGLGYTFLDTEQLTGDNEGNELPNAPTHKVSADAVYSYQAWDASLNWVYVSSSYSDADNTEEETSNGSAGELPDYHLVTTRVGRDFAIGGDRVLNLGLAVNNLLDEDYYFRGVDVSPVGRVPQPGRSFILEAQLDF

SEQ ID NO: 8255 - protein, 340 aa, Caulobacter sp.
MTKTFKIAALASAAAFLPVVAQAQTPEGAYVALHGGVNFNVDQELSIPGAKGDAKTDTGYAAGGAAGYAFGGGPRLELEGTWRSNDLYKIGNLGTKGNLDSASLMVNAIYDIPTGTDFYPYLGVGAGASWVFAEAKNSGAGFKAYDDDIAFAYQGIAGVGYNVDQNIGVTLDYRFLGTTGLDFKTSAGKADYDAYYNHTVLVGLRYSFSKPSAPPPPAPVQEVVQQSVVEVPESYLVFFDFDSTSITPEAGGIINTAATNAKSTGSSTIEVTGHADRSGGDAYNLALSKRRAEAVVGELERNGISRSQIAVYAKGEADPLVPTPDGVREPQNRRVVVVLK

SEQ ID NO: 8256 - protein, 741 aa, Caulobacter sp.
MPRRSGLTLLESFRAARKPGDKVGRAAASGLSREQARSCTVALATFLAVGLDPVVASAQLAADATQEVRLDELTVQGTAGPRLVADGYLAKQSVSATRTDTPLREVPQTVVVVPNQVFEDAAATRIDTALDLAGVGRANNFAGLGLSEFTIRGFATGEYYRNGFPINRGYPNSPDIASIERVEVLKGPSAFLYGRGDPGGTFNIVSKQPLAERTFAVGTQYGSFNTKRSTFDATGAVSEDGTVLARITGAVEDNGSFRDFVSSDRYYVAPAIAWRPTADTTITLEGELISAGQIFDRGIVPFRGNVLAVPRSRYIGEPGLAPFRNDNALGQLRIEHRFDPDWVLTAGTQVLGGNIAGDAVQTVGVLGDGRTLRRTLDHRELTWSDLDVQVNLAGKFETGPFRHTLLLGLEYDSYRYREVITRSNSTTNPFFLDLLNPRYGQALPPLTVPGSNLLENTESYAGYVQDQIDITPRLHALVGVRVEDIGLTSTSYINNSTTRLQGTAATPRFGLVYDLLDWVSVYGNYSRSFRPNSGTDRNFRPFAFQEGEGYEVGTKFDLFDGRLSATAALFDITRTNVLTADPVDQNFSVAAGEIRSRGFDLSVAGYLAPGWRVIGTYTYVDAAVTRDNTIPVGSRVANIPENAFAFQSVYEFQGGALRGLGLGGGVNFVGRRAAGTAVSTFDLPEYATFNLISYYRITPDVRVYLNVDNLFDEVYYDRGFSNRYATPGTPRLITGGVAARF

SEQ ID NO: 8257 - protein, 230 aa, Caulobacter sp.
MMTKIKLLMLIIFYLIISASAHAAGGIALGATRIIYPADAKQTAVWIRNSHTNERFLVNSWIENSSGVKEKSFIITPPLFVSEPKSENTLRIIYTGPPLAADRESLFWMNVKTIPSVDKNALNGRNVLQLAILSRMKLFLRPIQLQELPAEAPDTLKFSRSGNYINVHNPSPFYVTLVNLQVGSQKLGNAMAAPRVNSQIPLPSGVQGKLKFQTVNDYGSVTPVREVNLN

SEQ ID NO: 8258 - protein, 189 aa, Caulobacter sp.
MNKMKLAALAALIASTGAMAETDNTGFYVGGAINQVKASGDGEGSSDGVGFGAYGGYNFNEWFGLEANLFASGDLGEDGVDVGAGALTFTPKFTYHFNDTFSAFAKVGVASMAVVVDYGPFDADYTGWGLTWGVGVNAALTEKLNLRLSYDETRGDLDEDGFWFDNDYYNGEIDNVKISQISLGLHYQF

SEQ ID NO: 8259 - protein, 861 aa, Caulobacter sp.
MSNQNKSVILSPYYRLLLLTSGLVLGASPAQATQAFSPLNMLADGDNTELLVSPSSELNFPGPTSESEASNYSTLQEAAPSVINALNGENGEISVIPPEIEQIDGDRLGQTMEISAGNLDVGVDDLPPMAPVDSAELAQANELPHGNAVAQVAPRVAQVEQENLIAETKTDNQTDHVEPQSPLMAQAAVEEEVEAVEMEATEETTGVTEETPEETPSFTPDAPPTNTEGTPGPTQTLPSFTPPASPSTTTPAPAEEEPRVLVSEVLVTGTTPELELLVYNAIRTQPGRTTTRTQLQEDVNAIYATGYFSNVRVAPSDTPLGVRVTFEVQANPVFTGLNIRTVPETAEGKERILPQEVVDETFGEQYGKILNLRELQEGIKTINEWYSNQGYDLAQVVGSPQVGADGQVTLVIAEGIVENIQVRFFDSEDEPVQGRTRDFIITREMRLKPGDVFNRNRAQTDLQRVYSLGLFEDVRLSFNPGSDPTEVIVNVDVVEGNTGSIAAGGGISSSSGLFGTISYQERNLGGNNQTIGVEAQVGQRELLFDVSFTDPWIGGDPFRTSYTANLFRRRTISLVFDGADSSIRTFNGFDSPRVVRTGLGLTFFRPIADDVFAPPDWRLSAGFGYQNVRIENAAGALSPFSAPLNGFNSQPLSFSDYGVDELFTLSFGASQDNRNNALQPTSGSLVRFGAEQTIPVGTGNIMMTRLRGSYSYYIPVNWLDLTGFGLVESTQPQTVAFNVQAGTVLGDLPPYEAFILGGSNSVRGYQEGELGNGRSFFQATAEYRFPIIAAVGGALFVDYGSNLGSQGAVPGFPAIVRGLPGSGVGYGLGVRIQSPVGPIRIDLGFTGEGESRINFGIGEKF

SEQ ID NO: 8260 - protein, 247 aa, Caulobacter sp.
MAIALVTGGSRGIGRATALLLAQEGYTVAVNYQQNLHAAQEVMNLITQAGGKAFVLQADISDENQVVAMFTAIDQHDEPLAALVNNAGILFTQCTVENLTAERINRVLSTNVTGYFLCCREAVKRMALKNGGSGGAIVNVSSVASRLGSPGEYVDYAASKGAIDTLTTGLSLEVAAQGIRVNCVRPGFIYTEMHASGGEPGRVDRVKSNIPMQRGGQAEEVAQAIVWLLSDKASYVTGSFIDLAGGK

SEQ ID NO: 8261 - protein, 2906 aa, Caulobacter sp.
MSGRGGASGGGGDGAVVTNTSTLINYGTIAGAAGVGSSQGVSLGFAGSGVRMGADSHVVNAGTISAGARWVSGGASGPSSNAVDIVGNNNTFEIWNGSVINGNVVAAGGTSGNVFVLGGTDASSFDGTQIGVKYQGFEQFIKDGTSTWTMTGAVNDTHNWTIKQGTLALFSDGSLAKADSVTVNGTLDISAISASSTAIQHLTGDTTGQVALGSKTLTLTAGTGDEFKGSISGSGGIDLVSGTQILSGTNSYTGLTTIDSGTTLQIGNGSTSGSLAGNITNNGTLVFNRSDASTFAGKVNGTGKLTKTGAGTLTLSGTNTYSGGTDINGGTLAAGNTSALGTGGLAFDGGALQLTANVSFGGAVALNGSGAIAADSGTSSSFSGVMSGTGGLTKTGDGTLTLSGTNTYSGGTSLNTGTLIASSDSNLGTGALTFDGGALGLGGDLTLAATLNAGGGTIDVATGASHSFSGKLSGTGKLTKTGAGTLTLSGANTYSGGTDINAGTLAVGGMSALGTGPLGFNGGALQLTANVSFGGTVALGAGGGSIETNTSTNSTFSGVMSGAGSLTKTGAGSLKLSGTNTYTGGTFINDGVLKVTSDANLGAATGAVTLNGGTLETDGTFSSARKVHLTGNGKLSAYNGNATFSGVIDGNGALTANGSLVLTGQNTYKGGTFVTDYSSLTVSSDENLGDASGDLTLGLQSTLQLDSQFSTNRKIHLDSNFASWINTGGHDAVLNGTIDGAAILVKDDDGTLTLSGNNTYQGGTAINKGTLIVSKDENLGDKAGYVDFSGGTLQLGGSGFSSGRELRLNAAGIIDTNGFNGTFSGVIDNGDDPNYPGQLIKVGAGTLTLSGDSTYTGGTVINGGVVSVGADANLGATTGALSFNGGTLQLTGSFENSRAVTLGAGGGTIQTSLFHSNEFSGVIGGAGQLTKTGAGTLVLSGVNTYTGGTAVNGGVLSVRVDKNLGATTGALSFDGGTLLLADSFDNNRAVTLDAGGGTIETTAAKSNGFSGVISGAGKLTKTGAGTLALSGVNSYTGGTAVNGGVLSVGADENLGATAGALSFNGGSLLLTDSFDSARAVTLGASGGTIETTAAKSNDFSGVISGAGKLTKTGDGILVLSGANSYSGTTTVSKGTLQIGNGSTTGSITGTVDIASGATLTFKRSDAYTYSDVIKGAGALHQDGSGTLTLTGTNTYTGGTTISAGTLQIGNGSTTGSIAGNVDNNGTLAFNRSNTLDFSGIISGTGIVQQNGAGSVTLSGDSSAFGGSTSVAAGTLLVDGSLGGTVSVASGASFGGAGTIGGNVTVADGASLVGQAGQVLTFDKNLSLANNSTIEASFGGASQTGLFNVKGDLTLGGTINVGTFGDDGPGIYTVFDYSGNLTDNTLSVGTLPSGQDAAKVSVQTNQSGKVNILNTNGGELTFWDGDNPANQDDGAQNGGDGTWTNEASNKSWTDHNYLLNGPWDDSGFAIFASNKGTVTVDNSAGAVKASGMQFQTDGYEVTGGDLTLVSPASNLSGAPIIRVGGGTNDGDMKATISAKLVGTDGMRKTYAGRLVLTADNQYTGGTDILGGTLQLGDGGTSGSVLGDIDTGIDGINRGLLAVDRSGTVTVDNTITGTGVVSITGSGEITLSGNNSYSGGTYVRSGTLVVTQDDNLGPAESVVAVGADPEDVAGGATGNAVLKFGADFTGANTFTHTIELNTAQSQLDTNGHTVIASGVILGSDGLTKTGDGTLILTYNNDYDGGTTISKGTLQIGNGGTSGTIEGDVTNNGILAFNRSDAYAFDDKISGTGSVEQIGTDTLTLTGANDYTGGTSVKSGTLAVASNGVLGDQSGKLTLDGGIFENTAAFSTQSRAIEIGNGGGTFQTDADLTLEGALTGTGTWTKTGTGDLIFGGDESAFVGTGTVQTGTVRVDGTLGGDLAVQTGATLRGTGTIDGNTTIDSGATLVGLDNNTLTMNGNLTLANGSMTNIALGTPTGSALFDVKGDLTLGGTLNVTEDVGGFGAGVYRIFDYGGTLTDNGMTIGTVPQNSDASGMWIQTDYEHQVNLVNQNGVEVTFWNAEGDRSQNNQNSKIVGGSGTWDVSNDNWTEDDKGSQQGQLFNGRWDNGSFAVFGGNAGTVTINNQNGTVTASGLNFATGGYVLTGDALMLDNGAPGTAPIIRVGDGKADSNITATISAELQGTGGLRKTDYGTLVLTGANSYSGGTTVTGGVLQIGDGGNTGSIKGDVAVSSGAYGDGTLAFNRSDDTEFDGNITGDGKGGVVQKGAGTTTFTGDNTFSGGLTVENGGVKAGVAGHAFGTGTLKVKAGATADLGGFDTTVGGLAAFDASGTTGDGDIALGSGKLTVEQSFDSKFSGVISGAGDLTKSGTGTLTLNTAGTYTGATNVDGGTLKQGAAGVFNNASSGYTVGTDGTLDLGGFDTTLAALSNGGLITMGTQQTAGTTLSVTGNYTGTGGTVVINTVLGDDSSKTDRLKVGGDTSGTTNLKVNNRGGLGAQTVNGIEVVEVAGQSNGTFSLVSDYTTKDGQKAVVGGAYAYTLQQGAGSGNKDGNWYLTSQTTQEPPAPDCQQTNTCPVDPDNPRYSAGVPVYQGYAQNMQVLNKLPTLQERVGNRYLTSGNDNDASNTGSSTVDSRGIWARIEGAHNRLEPHSATGMKQDINSFIMQTGVDGQFYEDANGKLIAGITGQYGTAHGNSSSFFGDGYTDTSAWSLGATATWYGNDGFYVDTQGQLTWFDNDLNSDTANSGLADGAKAFGYALSAEVGQRIALDEHWSLTPQAQLMWSSLDADAFHDIWGNRVHMQDGDSLTARIGLAANYQDSWQGDDGRMVNTSVYGIANVYQEFLGGTRINVAGVNVDTDNDKTWAGIGAGGTYAWADSKYAIYGQGSINTSLNHSTDSYAVKGNAGFIVRW

SEQ ID NO: 8262 - protein, 530 aa, Caulobacter sp.
MRRTNSIAMKVAASAAVWFGAAITAQAASFCPATVTQQNVVQTRQVCVTRDSFGNCTEFRTETFVAPATFSGFSAQPVNGQCTNNGQGPDPAAFSGAALASQALSELSQSTTQETARSAENSITNRRDEERERCSAGFSRVNGACEPIAAPAAEQVAPPPPSPAPAKKHAAKKKGKAAVAEVEEAPPPRSAPPRAHPKATFVSKDGFVPPPPPLEAPFRYSVWGQVFGEYEKRNASGFGAISGPDFNGGAPVGVNTTVDSKTGTVGFQAGLDYTAHGLFAPTDGVIVGALVGYISSTLNLDTVSASSNPAIVGTGTTHLHAKLDGPSLGVYGTYFSGPFSADILAKFDLLSLDQNFTDNLAFAGPFGPFSSTFSGQGSASLLNSTVAGNLNYRFDVYPNFWFEPTVGAQFTALGYGGGAAALGLENGNQVMVQGGARVGTASVFDKVIIKTTLTGLAYSDVAVNGGFIPGASFNGNNILADADRGQVRGRGILAFNLDFGQGLTSFVLGDVHGGQGLFGAGGRAGIRYQW

SEQ ID NO: 8263 - protein, 935 aa, Caulobacter sp.
MGNGKNIMSMFKPSILTLALTAAGLSSFATAAAQENTIKKEDVEIIEVKGFRGSLVESINTKRFSTQVVESISAEDIGKLPDSSIAESIARLPGLTAQRLDGRASRVSVRGFSENESATTFNGREQVSIGDNRGVEFDLYPSEIMSGVTVYKTPNASLDAEGIAGVIDMQTVKPLSKGERVIMFNGQLEQTGFDKLNPDGNDSGYRGTISYIDQFADDTIGVAFAYNKMSSPNQEKRWNSWGYPEFEAAGEQYSILGGAKPYVRSSTLERDSAMFVLEAAPTDRLNMTFDALYVDFSDEKILRGIEVPFAWGQGTIDASSAEIDESSGFITSAVTQGQRVVVRNDYEERNAELTQFGFNTKYDINDSWSLEFDASVSEVKRQIWSIESYSGTGRGDANGVADNIGYAFDGGNTGAQFSHELDYSDYDLIQLGGPLSWGASSALNDKYGLTGTAYENTAQDGFINAPEINDELQTLKLAASKALENEYFSKVSFGVSYRDREKSKLSEGYYMTLKDFSLANPGMLAIPEQYREGSASLDFIGMGNMVAYDTNGLVNDGYYDLLQESLTNQKHKTQSWTVQEEVIAVFAQLDINAEIGSIPVTGNIGARYVQTDQSSQGSAANTVNGLVVVTPTDVSHDYSHFLPSINLSFAIDEEQTIRFGAAKTISRARLDEMNASINATYSQTQPDDNGNFWSISGGNPKLEPKEATGFDLSYENYFDAEGYFAAAFFYKDITQWIFDGTYDVDMTGVADPSTGEIPATSTGTGSGKVNGGEGDLWGYELSLSLPFSVFHPSLEGFGLIASHTGVEQDLSDQNGNEYELPGLSDQIDSLTFYYEHSGFQARTSMRKRSDFKGDVYGLGFETTQVDIKGETIWDAQLGYDFSEGGFDSLAGLSVTFQVQNITEEPFVSLQGDNDLQIRDYQDYGRTFLLGFSYKL

SEQ ID NO: 8264 - protein, 130 aa, Caulobacter sp.
MRLDTNPGDLDTIVAGFRRQDAALLGATYDFGVVKLYGQYQHIKNTISTGDTKANGGQLGVSVPVGAGSILASYAYTKTSGAVDVKRNTWAIGYDYALSKRTDLYAAYFRDKVTSLSTADTFGVGMRAKF

SEQ ID NO: 8265 - protein, 176 aa, Caulobacter sp.
MRNKPFYLLCAFLWLAVSHALAADSTITIRGYVRDNGCSVAAESTNFTVDLMENAAKQFNNIGATTPVVPFRILLSPCGNAVSAVKVGFTGVADSHNANLLALENTVSAASGLGIQLLNEQQNQIPLNAPSSALSWTTLTPGKPNTLNFYARLMATQVPVTAGHINATATFTLEYQ

SEQ ID NO: 8266 - protein, 781 aa, Caulobacter sp.
MSQVRNIGDAIARKFLKRRDARYPSGGDLAYRSPNGIAANAWTTTQRRGVSTGYLMHSLNSSLRRALTLSCGAAALVTAMAAAPAAFAQDTKVGEVIITAQKRSENLQDVPVSVAAISGERLQSTFAAGDDILALSAKAPGLYAESSNGRVAPRFYIRGLGNADFDLAASQPVSIIQDEVVLENVVLKSSPLYDLDRVEVLRGPQGTLFGRNTTAGIVKFDTIKPSEEMKGRASASYGSFNTFTFDGGVGGALVEGKLAARASVLFQHRDDWIDNGFTKKKNVMGGFNERAARLQLLFTPTEKLDALFNVHGRDLDGTAAVFRANVLTKGSNKLNANYDRDTVYFDAGANNPQRYKGYGASANIGYDFGFAKLTSITAYENTHGFSRGDIDGGNPTGPGFIPFQSDTQDGIKDLDQWTQEVRLASNTDGALSWQVGGFYFDTTYAIQTNPFFAPATTLQQKNTAWAVFGQASYKVSDQLSLTGGLRYTDDDKDMKVLSGPNMAAPVSVSDSHLSWDLSAFYTVSEDVSVYAKVASGFRGPSIQGRDIAFFSPASAAKSETIMSYELGLKSELFDRRVRLNGAVFAYSIDDPQFSAVGGGSNSNRLINAKKGEAYGLELDSEFVVTPNFVVTAGYSYAHTEIKDRTLAVATCAACTVTDPKTASGAALVDGNPFPNAPKYTFDFTARYAYPVASGELFAFTDWKVQGYTNLFLYESKEFYSKGDFEGGLKLGYANKEGGWEVAAFARNITNEHNIKGAIDFNNLTAFVNEPRVIGVSIDARF

SEQ ID NO: 8267 - protein, 439 aa, Caulobacter sp.
MRHFFKLGLVSAAVLGSQMTLANDFWSQDRQWLLGDWGGERQQLEKQGYKFTASIMSQAATNLDGGYNDSNTLENAGQLTLGANFDLSKIAGWEDTTAAIMITKRDGNSLTLERIKDPRSTTLGNTQEIYGRGKIWRLTQAWVKKGFNDNTVQFKIGRMGMSDDFNSSQCEFQNLLLCGGQLGKSIGSIWYNWPVGLWGTNVKYQFAPEWTLGLGVYEVNPDNVKTQSNSDGFNLDMNNVKGATIPVELAWKPKLAMFNGLPGEYKVGALYSTADANDVGTVSKVHDSKHSFWINTQQQLTQHNDNAKRGLFVSFNGVVNDKATTMVESTQQLALWYKGPFDSRPNDSIGFGLANYVVNKRVRDRQIATNESRGYYEYDDLASNYVPIQHDELNVELNYTYQWSPAVMLRPNIQYIHQPAGVKEVDDAWVAGLSMRLNF

SEQ ID NO: 8268 - protein, 607 aa, Caulobacter sp.
MKTSITVVDKIAAETPANVTVMDATSLEESPGTNLDDRLRDVPGFSLFKRSSSLVANPTTQGISLRGIGSSGASRTLVLWDGIPMNDPFGGWVYWTQFVPDEISRVEISRGAATSVFGDRAMSGAIGMFSRPAEKFHLFGQYEMGNERTHDISTGFSDLWGRVAISGFARAFRSDGYYIVPANIRGSADMQANVEFVTGDLRLDHYTSIGDFFFKTSILAEERQNGTALTHNSTGLGTISLRYAREFTNDSFSVFGFHTRDGFHATFDSVTNNRNTDKLTYSQTVPSDAVGGAGLWQHHEKRWNVVAGADVYRTEGTSTDHLVPTGLRVGGGEQLQHGVYGQADGSLGPVKLFAGVRHSFAGNGSRFLSPNGGFVMGKKRLRARGSVYRSFRAPTLNELYREFRVGNTDTLPNAGLQPEMMWGAEAGVDWIGENSTFRATAYRNSLDGLITNVTLSSTPAAIVRQRQNAAAALSRGFETEFRERMHDFTGELKYLYVESRYVTGFRVAQVPKHQGTAQLTYLHGGTFASASLRSYAYQFDDDLNQFRLPGYASAQLVARQRLVKSLSAEVTLENAFNRQFYTAYTPTPNIGAPRLWRVGLRWDGRIR

SEQ ID NO: 8269 - protein, 834 aa, Caulobacter sp.
MSRRPPTFARCTALVGSALLSFAAGVQAQDAQRLERVEVTGSAIKRSQVEGPVPVQVVTHKDIERTGASTINELMKSIMSLDIFDDGELSSGTPVGSGTAIVFMRGLAETNVLVLLNGRRLPINALYDSSGAGAAVDVNSIPLAAIERVEILKDGGSAIYGADAVAGVVNFITRKSYTGFELRAGYGISSRGDGEERKAGLSAGFGSLAADGYNVFAGLDLFKRDPIQRSDRDMSSSADFRRFGGPDSRSIFAPTGNYVDADFIPIPGAYVRPCPPAQIGADGLCRYDFNASLLSAYNGADRLSGMLLGTVQLTPGLQGFAEVLASRSRDTFVGHPAPDYFLDGNGDFFVGRFMQGGPRLTQRTANLLQLSTGLEGTLGEVEWKVDVGQGRSRVVNDDRNYFTYAGVDQLDASSLNNDPALVESLKVRPRREGESKILFANGKLTGELLQMPAGPLSYAVGTSVWKESIVDTPDALSQAGEIVGSIQQAAVDAERKAYAFFTELNVPVTPQLEGQVALRYDHYPSASKTSPKLAARYLFTPAFSTRASYTESFRMPSLKQLYGARESGAADFTNDTLCAAFGQPAGCTLSGFFANGSNPRLQPEKGRTYNLGFVLSPEGGFNATLDIWQIKIADQINTPTVDQAIAAGKFAQDAQGRIVVDTDLQNFSKARVQGLDLQLEQRLGSAGAGSFTLRNDTAYYLKQERQDGPGQPWQDLKETYAAPKWRNLFSVTWELATWANTLALRSTGGFYDTDEPDPAPGTRKVAAHHEVDWVSGFTGLKNLRLDFGIRNLFDRMPPFSVTNASDGRYSQLGFAELYTNRGRFFFLNASYEFN

SEQ ID NO: 8270 - protein, 906 aa, Caulobacter sp.
MAIRTLSTVSGASLAAMTVALAASPVMAQEAAGDAQAQATEAAPTEGQEQAIVVTGFRAALATAVNVKKTAPVIVESVSAEDIGRLPDASIGESIARLPGLTTQRLFGRANSIAIRGSSADLSSTTLNGRPQTSTGEQRNVEFDQFPSEIVSRVDVYKAPQANLVHQGLVGTVDIKTIRPLEMGKSLLSVGARGTYADLGKVNADSHDKGYRLTGTYVGQFMEDRLGVALSAAYTDEPYQAQEFEAWGYADGPDSTKVIGGMKPFGVSTQLKRLGIQGTVQFKPVDELTLTVDAFYGNFKDKQIKRGVEFPLAWSGAQLSPTGIETTGNLITGGTFTGVEAVVNNHGYERNSDIFSGGFNAAWQGDDGWSASFDFGYSKTDRNELTLETNAGTGPGGGVGATDTLTFVSDGKGTHFTDHTLDYGDFNSIVLTDPLGWGGGAPAGHQEGYYNNRIIDDEIKSFQVEVGKELEDSFLSKLSVGTAYVDRTKAKTPEEYFLNLADGARSLVVPDQYRTGTTDLSFIGAGPIVSYDPFKMLDDGVYVKTLNPSKDVPAKAYAVTERVMSIYLKGDLKAAFGDIEMDGNIGVLAQNTEQKSRGYVNLAAASLVPVTRGARYWDVLPSLNLNFRIPGDWVVRVAAAREIQRPRFEDMKVSLDYSYNTASGIISGNGGNPELRPYRAWAADLNIEKYFGRKGYIGVQMFYKKLDNYIYTDVVPYDYSGLPVTAPVPITNYVGTLKTAVNGSGGKLYGIELAGTLPFEVITPALEGFGFTGGVGYTKTSIKPGVDAKAQDLPDYSRWVASGTLFFEKAGFNARVSARHRSSFQGIFVGFGGERELRRALKETIVDAQIGYDFQESSKLHGLSLFLQGQNLTDEPFVSVDTGTTLQIRNYQTYGRRFMAGFNYRF

SEQ ID NO: 8271 - protein, 986 aa, Caulobacter sp.
MDYNIFKKTQLAAAVSMVVGAATISPVYAQDNAADNTLEEVIVTGIRGSLQRAMDIKRDAQGVVDSISAEDIGKMPDTNLAESLQRITGVSIDRSNGEGQKITARGLGPDFNLVTLNGRQMPTSGLQGTSINSSRSFDFSNLASESVAGVDVYKTSRADIPTGGIGATVNIKTARPLDNAGFKLTAGVKGVYDTSREDASLAPEISALISNTFLDDTVGVSLAISHQEREGASDAATVGSYHTQSVVPGDGWNGGFVGEGADAYPSTAQLSRPQNFEYNFTDFERTRDNAQLVLQFSPSEDITATLDYTYSEQEVLSSSNMVGAWFWEGNGLNATNNEFVEGSAGQYYPELYSSTACCDLTFSAARFGQVNENNSVGLNIEWDATDNLSLELDYHNSKAHSEAASPYGNSSVLTMANQNRVATVVDFRQDFPVWDVALAEGTTDAPSTFTVTGSSLRNSQFTNDISQVQLKGSYTFDEGVVKSVDFGVSSTENDVKAVMMTAQRDTWGGEGTVDDIPDSLFTAESITGRMDSLSGTGTLADGSEFNIYDRYYSFSFEEAAAAVAAFAAPTDESGTSPNIWPCVGEFCVTEDWTTDERVSESMLAGYVQANMEFEVAGMETKVTAGVRYEETDVSASAMVPAYSGVDWVSANEFALVSSGDSAYTDFKGSYSNFLPNIDVSLAPVEDVIVRASFSKTIARPTYNHIKGGVSINEVRATYATASSGDPSLLPHESKNFDLSAEWYFGEASYVSAGAFYKDVENFIGTHTETENFFGLRNPADGARFAEALASEGADNVAIRQYIFDNFPESTTESSGLIHSIDSDNLIEFDVSKPFNEKKANITGMEFAVQHTLDNGFGALLNFTVVDSDAEYDATVFDEQFALPGLSNTRNLVAFYDKDGLQVRVAWNWRGAFLVATDVGHGNPLQNEEYQQVDINASYDINDNFTVFAEGINVTNETQRLYGRYKTTMMQAVEGGPRYNIGARYTF

SEQ ID NO: 8272 - protein, 762 aa, Caulobacter sp.
MMRHLLVVFSFFAIATTYAQTNNTEILIVSEDNIPLEDVIAYKSSNVIATSNDKGILSFKNPSTEEFILRLTLKDFKPVSLKISPNTFKYTVVLSKAEEELNTVILASTYQKESKVLIPTTSVTAESIAEGSPIDLVDAINETSGVYIQRGAINTNRITIRGIGSRTLFGTNKIRAYFNGFPITNGIGETAIDIFNTQDIASIEIIKGPKATQYGANLGGTLLLNSKDPKKEGLVLKNTVTIGSFELFKESLSLNLKEDKLSLHLNADHQEHEGYRENNRYNRNALFINTSYTLNKTFTINGLVQHINNFAQIPSSLNLTDFNEDPTQAAFTWAQSQGFEDNRQTLVGLGLSSNISDSWSNATNVYYSYLDHYEPRPFNILAEITNTYGVRTVFANTFNLNMKSANLSFGVEFNQDHYVVTTTENLYEDNNGNGSLEGSLLSDNTEIRSQLQLFGTSTLPITEKLTAEIGLHLNKTSYNLDDNFNEAEANTSADREFDIIVAPNLSLLYKLNNTVTTYLNISRGFNYPSLEETLTPDGIINTDIGPEIGWNYEVGTTLSLLKQRLQINAAAYLLSVNDLLVAERVGNDQFIGRNAGQTDHKGIEISIDYKQNIVEQLQFKTFLNAEFNAHKFIDFVDGDSDFSGNDLTGVPSEKINAGISLQHTSGFFFSSQLQYIGEQPITDANTLYAEDYTTLRLSGGYNQSFNEKLSLEVKGGVNNVTDIAYASSILINASSFGNSLPRYYYPGLPRHYFASLSLNYNF

SEQ ID NO: 8273 - protein, 962 aa, Caulobacter sp.
MMTRFKFGRLALLSGCAFAGIIAPAHAQTATTASPEPQPMEDAGAPTTRDIVVTGTRVVRDGYSQPTPVTVAPTTELEKATPTNLADAINKLPQFANSVSPQSNSQLQGNSGEHGNLLNLRGVGPTRALILLDGIRVPPTTFRGAVDVNTIPQLLIQRVDVVTGGASAVYGSDAVSGAVNFVLDKKFTGVKGVAQRGVSTRGDLGNYRIGIAGGLSFAGDRGHVLASIERFHSDGIKRSARIYGDDAYAAVGSVPGSTAAPGREANPFIFLPNLRFTTNDYNNGIILTSTVPALANNIFLPGGAVRPIQRGTPTGTPGTNVGGDGLYIPGFNQLIAPLTTTQGFGRLAYDLTDGLTAHVQGSYSRSVTSYDTQAQSVLGFRFFSGNAFLDPGVQAQMGPNDSFTVFRFIGEQGPIPTREATNAYLINGGLEWNLGGWNITADYTHGNSVTKFAQTQVEIPKMAAALDAVRGPDGSIICRVTLTNPGLYPGCTPLNVFGAGTPSAADLQTVLGVSRYRAMNTTDDFVVSARGDLFELPAGPVTVAIGGQYRKQKLDLRSNSDPAVPTDFTGLRGIPANRMTRFNNTNVGSAYGKLNVKEAFAEAQVPVFKGQPFAEELSLNGAFRLTDYSTSGSVKTWKVGAVYKPIQDIMFRVTRSRDIRAPSLFELFAGVQTQPVNFNDPHTGQPGSIRQFSGGNPDLDPETGDTFAAGVVLSPSFLPGLDVSVDYYDLKIKGAIATQGLNDVINECETSNGTSPTCALIERPLPFSDRSAANYPISVSLITQNISFLRTSGLDITMSYRTKLGDGELALRAFANYLDRYKSQTNSIAPVIDYAGHGVNSQTGYAYPKFRGTLSANYTNGGLTLFVQESMIGKVTIGNLKNDPTSFYDVPAIKPVFYTDATASYKFDVRGEPELFVTATNLFDRKPPLVAAAAAPGLLYPTLFTLYNVAGRTLTAGVRFKF

SEQ ID NO: 8274 - protein, 187 aa, Caulobacter sp.
MIRSALPRSAKLLAAALGAATLFAALPAQADPSVRAIYGKDNKHGIEKYGVDLDFDSGFHWGNPEGWFVNLDWEVALGQWRSTKGTNRQNITEFGVTPLFRLEKRGGSWVPFIEAGVGPRLLSHVSTSNEHYFSTAFQFSDMIGVGVAFGSKQQFQMGYRFEHLSNASIKRPNPGTDLNELYLRYTF

SEQ ID NO: 8275 - protein, 797 aa, Caulobacter sp.
MPRHDTPTLNRPSPNPAPSAQRPPLRPLALAALTIGTLFGPMTYAPAALAQGAVAARSYNVPAGPLGTALTAFAAQAGVVLSFDPQLAAGRHSAGLSGPYAVDEGFARLLEGSGLHAAAAGDGRYTVRARPQPAGADAAPEATLGTVMVTGEKIERRLQDTVSSVAVATAQDIAAHADRNLNDVMMRTPGVYISSGNELWGIRGVPVSGFDDQGPGTLNGAVSVTVDGAAQAHRVLTMNPLSMWDVEQVEIYRGAQSTVQGRNALAGAVVVQTRNPTYQPELASQISVGSDGQRGAAVVAGGALVPGVVAGRLAVDYQQQDGYIRNETLGEDADRRRSLNARGKLLIHPSDRMEVLLTVAHTDQRTGDNAVAKRADGRPDYYALFYNTDAHDEIRQDAVTARVDYFLDDAWTLTSITSQTRTRYDSLLDFDQGPTSLMEVVRRHDGNFLNQELRLGYRSDTLRGHVGAYWGRSRYEQDDRLDFSGAPFGRIVADTTIVNRALFGELEWDMNARWQLIAGLRHDHERNSTRFEQDDFSAPGRDSLSSDALLPKLGVVYRLSADDMLSAQVQRGYRSGGVNVRAGAAHVAYDPEFTTTYEFGYRGAFLDKRMRAAANVYHTDWRDQQVSIDDGSGFLQVANAGRSRMQGLEVSAEFDATRALRLHAAASYGRTRYDDFVTGAGDDYSGKAFLFAPRYKLTVGGNFRVTEQLNIGGDVVHQPESPSAYITNASGQVVDTRRSDAVTLVNLNLGYRISKSVQVSAYVKNLFDERYITNNQSGPVLDVGAPRTLGVSLRADL

SEQ ID NO: 8276 - protein, 989 aa, Caulobacter sp.
MGHLLPVREGITVKNSYARTALSCALGSILLGMASTAAWAQSTDAASTAQTPPTSAGDNGAVKQLDTVTVSGYRRSIQFSTDAKHDSLGFADTVFAEDIGKFPDMNIAESLNRIPGVQLARDVNGEGLNIAIRGLGTSFTKTTLNGASIATASIGLNAQNQNREVDLNLFPTEFFTQLTVSKTPTASMLEGGVSGVVDMRSARPFDRPGVHFTYQAQADWNSTSEKTTPRGAFMGSWTNEAGTFGALFGVASVRSKLGVRGFESVGWTNPGLTYTQCGLTPPAGTPATNQPAACNVNGGGNWRIPDTVPATAGSGLTTGETIDAAWLLARNPGLSIDQISDALIPRLGRQVYMNGDRDRDASVMSLEWRPSDSMHFYLDTLYSEAKRSTERVSMNLIGRNGNMIPLGMQLDQNNVVTSATFANAQYFLEARPYHENVKFWSVNPGAQLLLGADQDIKLNVQANATRSWLARESPSILVTSPFTTVDYRNQGGDRPSITSPLDLNDPNLGWGWTGGRVNIQNEKRQTETRGARADLQFGEDQRNVKIGASYDMAERTIRGFDNSIAWEQVVCRGNGGNVCNGGAGSAIPNSALASYLKPGPGDFITADFSRFLADTNYYALRDAAPESNSANTGASTGGIREKNLGFYIETNADADVWNRTMRFNAGVRYVTTDQTITGPVTINGVRSVQLLDSDYKATLPSFNVAWDVADKVVMRLSSSRTLTRPDPSAMLPNTNFSDPSAQTATQGNPNLKPYLSTNVDFGGEWYTGDEGYVGLTLFNKRITGFTVNGIRRIPFNDLGVNYDTLLPIQQAGLAQRGGPDAATVDVQTQVNADGVLNIRGTEAIWVQPLDKLFDGLGFSLNYTHVSQQSEGEGVPAVAVGVAPNLWNGTVYWEKDAASIRLSYTWNDDMVISGANQNGIPYARLNADARGQLDMSASYALDWLPSKPQITLNVTNITNEPLRTTFAWPNATYDLYEPGRTVMLGIRGTF

SEQ ID NO: 8277 - protein, 798 aa, Caulobacter sp.
MIISTSKKFVLSTLAVMVSSSLWAAEADTAETKKDAIGLERITVTGVARGTRVMDSSVSVSSVSPEDLAISSPRSSAEAFRIIPGMKVESTGGEGNANIAVRGLPVASGGAKFLQIQEDGLPILQFGDIAFGNADIFLRIDSTTQTIESIRGGSASTAASNAPGGIINVISKTGTSDAGSISSTVGLDYDTLRTDFEYGTSINDSMRFHIGGFVRTGDGPRDPGYTANKGGQIKANLTKEFDSGYVRLYVKHLNDKSIGYLPMPMYSDGSSIPGFDAQSDTVHSANMLSTLRLDANGNISRGDMRDGMNPIVNSVGLEASFDLGDDWLVENRFRISDVSGNFMSLMPAEVGNSSSIASSIGGAGSTLIYANGAKAGQAFDSDLAMRVHSFDVTMNDFGSIVNDMKLTKTFDDSNVTLGFYTATQNINMTWMWNSYLMEVQGDNAALLDVVAADGTSYSDNGLYAYGVPYWGNCCQRNYDSDYTIKAPYIAASSKFGDLSLDGSVRYDSGDASGYYAGNVQSQVDMNRDGVISQPELSVSSIDNANPQLVNYDWGYLSYSLGANYQVSEDLAAFGRISHGGRANADRLLFGKVNPDGSVSDEDSVDEVDQYEVGVKYRYDNMSVFATAFYSETEEQNFEATSQIFFDRKYEAKGIELEGAYYVGDFDFRGNVTWTDAEIVKDALNPSVIGNTPRRQADFIYSLMGRYNFDKGSVGVNLIGTTDSYAQDNNDLSFDGYTQVNAFASYQLTDVLSVALNVNNLFDTVGITEAEEGSVPDNNIIRARTINGRTTSATIKYEF

SEQ ID NO: 8278 - protein, 418 aa, Caulobacter sp.
MSISLPARQLLPGLLAMSCALPAFAANEGGFIEDAKATLNLRNFYINRNFVDPAHPQGKAEEWTQSFILDARSGFTQGTVGFGVDVLGLYSVKLDGGKGTTNTHLLPVHGDGRPADDFGRLGVALKAKLSETELKVGEWMPVLPILRSDDGRSLPQTFRGGQLTSREIAGLTLYAGQFRGNSPRNDASMEDMSLNGKAAFTSDRFNFGGGEYTFNDKRTMIGLWDAQLKDIYRQQYLNLTHSQPLGDWTLGANLGYFIGKEDGAERAGKLDNRTASALLSARYQGHTFYVGLQKVSGDDAWMRVNGTSGGTLANDSYNSSFDNAKERSWQVRHDFNFATVGVPGLTLMNRYIKGDNVTVGSVDDGKEWARETELAYVVQSGSFKDLSLKWRNSTMRRDFSTNAFDENRLIVSYPLNLL

SEQ ID NO: 8279 - protein, 919 aa, Caulobacter sp.
MKRHLLVNAVCAALALPSLAIAQSQDDVTQLDKVTVTGSLIPRSQIETATSVFSITAQDIQRRGFKDVYDVLRSQPMATGSVQDGQFTGGFTPGAQSLSLLGLDPGFTLVLIDGRPMADYPLLYNGQSNFVDLASVPVGMVERIDVAPGNQSSIYGSSAIAGVVNIILKKRMDGMQMNYRMGTYDGGGGNNQRFQLTGGNAIGGANIVWGLQLNNQDPIYGFQRRNFDSTNDNPDPTLRYGSQVALHSIPGPPDSYIDPGADNCAALGALFNHSVTLDNRSKRGNYCGSRSALGYSSILNKERSASGYANLSYAFNDNAELYATLLLNRTKVEVNGGSRSWLTSADTGGLFYNQNTQQLETYKRIFAPEETGNLDFNNDRQTADSYNIALGMKGGLGGSNWTYDAYYARSEYRIESRQQWPLADRIEDFFRQQFLGPQLSEQYGYPIYSPNDANFYRALTPAQYRSFNDEIHTKSRTWTQNLNLQLTNTELFTLPAGAVGVAGVLQAGNQYWNNPTDPRVIAGDFYQLTGTQGSGKRDNWAAALEMHVPILSTLTANLSGRYDDYKNQGGGSDSRLTYKVGLEFRPVDALLLRGDYATAFKAPDMAYTFAGDSGFYESVNDYYRCAIEEPNKPIADCSYSDTTIAGRRAGNPELKSITAKSWGYGLVWSPSAHLSASADYYHINITNEVSDMSADQLLQTESACRLGNLDIASPTCVDALSRIDRTGPDATVPNRLNSIRVNPINISTEQVSGVLAKASYDWSTASWGTFLVDAQYNLTLKHESQQFPQDPIIDLLSNPFYSQEFHSIANASLTWKKNAWTTTLFGQRYGRTPNSAAQLSDAGYATKDAGKVAAWTTFNATLDYAISDDISLTATVNNLANTRPPRDRTDTYYPYYNIFNYTGYGRDYMLELNWRFGAH

SEQ ID NO: 8280 - protein, 476 aa, Caulobacter sp.
MRAFGRFAHLHITEVSMNQNHFSLKILTVMLLSAYGGSFADGVVPVSDGNTVSLDTVNVRGSHALSGKTEKTRSYTIDRMSTATGMRIAGKDTPQSVSVITRSRLDDKAVHTLEEAMKNTTGVNVVRDSGLQTRFLSRGFYIDQIGEDGITVNVAGRSGYTAKIDVSPSTDLAVYDHIEVVRGATGLTQSNSEPGGTVNLIRKRPTASFKHTGELTADHRGSRRAVLDVSGSLNKANTLRGRLVGAEEYKKSFKDRVWGRKHMVYGIAEADAGDSSVLTLGGMYQKSREVPDFSGIILSCENQKTAPFSSTPACNRPLQLPRNTYLGEDWSRLSADKYNLFSGFKHVFDNGWQLNAEVSYTKNESDAKVGQFFLKNEHAAGLSGEDAVGFLTEKNEVIPFEPKDKALEKLKAYRDETAKEYRERKDDFVKNRFDNTAFEQYRSRRAAERKAGFDECMSAPFALDFICQGSWGGSGR

SEQ ID NO: 8281 - protein, 618 aa, Caulobacter sp.
MRHRFLFIVVVLCALTTAAQIDTLQVLPEVILSDSKLKNHSVGIALEKISDSTIQRSRTALTEVLRANSTIYFRENGPGGVASASFRGTNAAQTAVVWNGININSQLTGQSDFNTLSSKNYDQVDVRAGGGSIIYGSGAVGGSVHLGNDIRFNKGLSTTVTAGYGSFDTQIATAKTQFSNTNFYIDAGLDYQRSENDFDYLDTDNQFNENGQYDNLNAIFNMGYLLKNKGDRTHLLKLHHNTYVGNRNFSGTLTAPSNDGYEDRNTRTLAIWENLGTRFNGKLRAAHIFEEFRYFANNQTDDNDLGKSIRYLANYEATYKLDRKKELTVIGEVNHISAAGSSIVSTTRNQGSVVALWKQQLTNQFTYEIQARQELVEGFDSPFLLGAGFDYAFAKAYTLTFNASKNYRIPTFNDASWSGPGAVGNPDLKPETSIQAEIGLKRTRKNLTLGLRGFYINTDDLIQWQPNLSGIWSPINIADSEHYGIEGALDYTAIMGSHKVTTTAQYAYTQAEDVARGKQLIYVPAHKAILGIAHNYGRLSSYVQTTFVDRVFTTTDNTAQVDGYAIAHIGTSYDILHKQGTKLQVMARVNNLFNTNYQTVAFRPNPGRNFLLQTTITF

SEQ ID NO: 8282 - protein, 386 aa, Caulobacter sp.
MTSFRKTTLLPTAAFALLSAVAVNAYAQSSVTLYGLVEDGLIYTNNQQGHANIQATTGQTNTSRFGVRGMEDLGGGYRAVFTLENGFDASTGKLGQGGLEFGRTASVGLATPYGTVTAGRQYEPVSEYLGGLSSALQWAGWTGAHPGDIDNMQSTIRFNNSVEYTSLTYGGFSFKAMFAPGGVAGDFSRARAMSFGAGWQGAYGGVSAAYLNMNDPSESAYAGSILPGQAGYTSPATSPIYRGYASADTLQIVGAGANLQFSGVRLDAIYTNTRYQNVVPTATTPYRGGTAQFNTVELNGSYRIVPSVLAGAAFIYTKGETANYLQWNLGADYALSKRTDIGLVGVWQRASGTDSTGKPAVASIASLTASSTNSQVAVRLNLRHRF

SEQ ID NO: 8283 - protein, 429 aa, Caulobacter sp.
MLSMQPQAFAPTRSFAARPSALASAFALAGVAPLSQAAFFEDSTATFETRNMYFNRDFRDGTSAQQSKRDEWAQGFMLNFESGYTEGTVGFGLDALGMVGVKLDSSKDRTGTGLLPTHDDGKAADEYSKLGLTGKVKVSKTELKIGTLIPELPTLQPNDGRILPQTFEGGLLTSNEIKGLTFTGGRVDKAKDRDDTNWEDLALNNKNGRFGGTFSADNLDLGGVDYKFTDRITGSYHFAQLEDIYRQHFIGMVATQPWGPGTFGADLRLAVSDDAGSAKAGRIDNTTFNGMLSYGLGGHKVSAAWQQLTGDSAFPYVDGADPYLVNFVQINDFAGADERSWQVRYDYNFAALGIPGLTFMTRYINGDNVSRADGSEGKEWERNTEFKYVVQSGPLKNVAVRLRNATFRSNFTRDADEVRLLVSYSVALW

SEQ ID NO: 8284 - protein, 273 aa, Caulobacter sp.
MLESGFDIDTGRSAQGNRLFGRQAYVGLQGDFGAITMGRQQNALFDLFGAYDPMSVAGVYSLNAVDNQFNGRADNALKYTGKFGGLTATGFYSFGRDANVGLGGEVPGSFKVGTNFGGGLAYANGALSVGAAYDQYQGSTLAASGLSAKRAAIGASYTLGEAKVFAGYRWLRDEVSTSTARHDNLYWLGAQYKLTPAFTLNGAAYYTNARTDSNSSWMFVLNGNYALSKRTDAYVLVGYVTNKGNATFGVTGTANTLPGQNQTGAMIGMRHRF

SEQ ID NO: 8285 - protein, 226 aa, Caulobacter sp.
MRFVWCSIHLRDTISLLLLSVLLINRNLFIMKKTTLAVAIGILAISSTASANWYVQGDVGYSKIKASGMDDLDFKDNVFDQRISAGYDFGDIRLAVDYSHIGKAKDHYTLFRGEQWETSGSTSVETNSFGISAIYDFNLNTSLMPYVGVRLSENSLKFEDHWRDNSASESYSETKTKFGYGALAGVQYHLTDNLLLNVGVEYNRLGKVEEVKIHQYSAKAGLRYNF

SEQ ID NO: 8286 - protein, 933 aa, Caulobacter sp.
MQSQEVKVKPVVKVVLKSDAEVLDEVVVTGYGNFKKASFTGAASTVNTGKLEDVPVLSVEEKLSGSVPGVSFSSSSSNPGAVSSIRIRGMGSINAGNDPLYVIDGTPVTSGNVSEFSYSDAGTNILSTLNTNDIESITVIKDAAAASLYGSRAANGVIVITTKSGSQGKTKVNFRSDWGFSNMAINYRPQLSGDERRELLWTGLKNYGLYGQGVSEAEATAFADANIDAFAAKPSTGWTDWKDELFKTGGHQNYQVSVSGGGQNTQFYTSLSYTKQDGIVQNQGLERFTGNANLTHTFKRLTVQVTSQFSKMIQSKTNEGTSYDGAVANYAFFQSPSSTPYNEDGSLNNGCGMFGVNPLYEFNHSSDRATIIKAFNTIKATYNIWDNLNLSEKISYDYMTNTNDVLWDRNSNNGGPGGVMQRIINKNEQLNTQTQLTYNKSFGEHNIDALLGFETEDNVYAYNYMSGQDYPGDLYEFTNAGSTSADSNTQSYRLTSFLGRLNYDFGGKYYLSASYRTDGSSRLARDNRWGSFWSVSGAWRFTHENFMEPTKEVLTDGKVRLSYGVNGTQPSDYYGYMNLYKYGQKYNGISGMGIIGIANPDLKWEKNKTFNVGLDLTFLNRFSLTFDYYQRKTSDLIYDLPVSQVGGYYDSSYGYYMPVNVGALKNSGVEVTIQTTNFQTDDFTWTTSLNIGHNTNELVTLNGEQNEIVSGPLIHRIGEAYYSYYLYEYAGVDPQTGKEMFYKNDGTADARQTTTNVSEANKVIVGKHDAKVEGGLTNNLQWKWFDLGFTFTYSLGGDAFDYATWQHTDGGTYLYNGAVPAYYKLEDMWTGPGDTSAKLPAFQYGNNAQSMSSRWLMSTDYLRLKNLTLGIRIPQNWASKAGMSNARIYFSGSNLLTWKSKDLTVDPEMPVSGVCTFETPALRTFTFGIELTF

SEQ ID NO: 8287 - protein, 660 aa, Caulobacter sp.
MVVLKKNKIALGVVAALASSFVMTASAEDPERLLVTTASGFKQTVEDAPASVSVVTREQLETKSYRDVTDALKDVPGVLVTGGGSSSDISIRGMDPKYTMILVDGKRVASRETRPNSDNSGIEQGWLPPLPAIERIEVVRGPMSSLYGSDAMGGVINIITRKAQKEWNFSLRGDTTLTERKNEGNTGQGSFYAAGPLIDNVLGLKLQGQYSHRGEDRRVDGYNRQITASGGGTLSWTPDEKNTVEFEFKKDNQHRDSRVGYSKSAELVKGKAPQSSFTDYELTHYALTHDGIYDFGTMNTYVQRDESRNPSRKMDYDDTTVRNQTVFMFGDHMLSVGGQYRYEELKDEGNKLKGNNKLDRYSWALFAEDEWTLTNDFALTAGLRMDKDENFGTHWTPRVYGVWHLADEWTLKGGVSTGYRSPDLRQATATWGQATGGGRYDAVIYGNPDLKPEKSVTEEIGIIWDNRDNLNASITIYNTDFKDKIMERRVCDKDSSKPCKASDGFGHVYDFVSTRENVDKANMRGVEVTANWIISPEWNLAANYTFTDTEQKSGDFKGKPLNKQPRHMANATLNWETTPEMETWARINFRGKTSDYLSRTSMAKSTPSYAFVDVGTSYSLTKQLNLIGGVYNVFDRRIERDNYGSTLEGRRYNIGLNYNF

SEQ ID NO: 8288 - protein, 728 aa, Caulobacter sp.
MNARVVPLAAAIAMALSPLAATATPQNADKEKPAKDENLERIKVTGKYTVSQNLDSATGLGLTLRETPQSVSIMTDERMFDQNIDTVLEVVNNAVGVSASEMDNVRNTFYARGFEISNYQIDGVPTSWSIAGDAGETIADVAIYERVEFVRGATGLLTGVGDPSASINLVRKHATSKEFEGYINASVGRWNSKQVTADVGSALNASGSIRGRAVIKVDDSESHVDFLEESKEVFYGVVEADITNSTLLRVGGSYQHHEPKGAMWGFLPAFYSDGTYTDWDVSKTTGADWTNWETTSTNYFVNLNHVFDNGWELLANYNGLKADKTSKLLYINGSDSQNLLDKETGTGLKAQRYNSDGENSQNSFDVQLKGQFSGFGRLHDLVIGALYSEHDKFAHTFNPQPLGGDGTYDQVPVGNFYEWPNIEEPQWSDEPTPGEDTATEEKGFYAATRLALSDSLKLVVGGRVSSWDRDGVSYGTVVDYGDSGVFVPYAGLLYDLTDNHRLYASFTEIFNPQNRKDTNGNFLDPLEGQSNELGLKSTFLNDRLHTSIAVFKIEQDNLAVVDPNHESTPELQTAYIAEQGTESTGFEAEIVGQPVDGWNISAGYSQHEAENANGMLVNTDTPDKLFKLFTTYQFVEFLPELTIGGGANWQGDVYSTGMNPATLEMETFTQDAYWLVNLMARYKLSDNMSLQLNVANLFDEKYYSQAGFAYGYRYGTPRDYTLSFNYKF

SEQ ID NO: 8289 - protein, 402 aa, Caulobacter sp.
MTKAAAVLIGSTLSMNAFAGAYVFSELGMMSISTAGAGAQAIAEGAETAYANPAGMTRLERPMLAFNIEGTISDAMYYDNGSDGVFSRGSESTQAGASLPAGALYYVHPYNDKLAFGIAIASAGGSVIDYGSDFKGSLLLQDVSMITVQVSPSVAYKVTNELSVGVGLVAEYGKLEQTFGGSNLRGIGQMVGKGDSLEFGYTLSALYEINNDNRVGFTYRSENNHDLSGDISTKNFSPDASFNIVMPSIAIMSGYHQVAPKWTMLWSAGWTDFSKVQTTDITLTNTTASIDREWEDTWLFSLGAHYQLTPDWRLEGGVYYETSPQDDPTKQYPDVPTGEIWKYALGATYELNAEWRMQMYYEYLDAGTPSIEYTTDVGPGGTLRGDYDIGIHYFGVLFNKTF

SEQ ID NO: 8290 - protein, 728 aa, Caulobacter sp.
MKLRNLSPLSLAIIAALTTSVNAEETKTTAKQDAFEKIEVTARKRTESLFESPTAITSIGANLIDKANMSNLEDIGKYVPNLNITRYGVGNSAHASVFIRGIGLQDHVITTDPGVGVYLDGVYLGRQMGSNLSLPNVERVEVLRGPQGTLYGRNTLGGAVNVITKQPGDEGILTTTAKVGSRGRVAGDIYFNNALTDDLSMSASASYKQRDGVGTAVNLANPEKEIGEEQEFSGRVAFKYQATSDLAFTFSLDGVDNESGQSPYTIELTAPLDPNDQNNGDFPLLTPDLIPANPDDLGTTVAGIESTSYSGWGTSFAADWAINDTYTSKFISSYRTSEYEGGLDDDASALNLSEFPEQGGADQYSFEVQLNATFDNMDFVSGLYFFNEDGFTRSEDFVFSPYNTPDSFGFFEINQETNSYAAYFNAGYDLTDDLSIGGGLRYSKDKKEANAIFPSFAERKYVSADFDAVTWDINASYQLSNNMNVYGQVQKGYQTGGFPPRPFGGPDQFSSFDETKAINYEIGLKGQVHENVSMMLAVFVTDYTDLALPFSDPTSGGGFVTIVENAGQSKAQGIELETTVAITDDFTIRSAVGYLDSEISEVAAGVQGIGKGDSPALTPRWTVMIAPSYFMDLNNGGTLAFNANYSYRSEMQGQSVFNYSETIDSRELVGFNISYTNPYGDMEVTLYGENVLNEVYDVGRLQQTGFVGVMRSNDRSEFGLKFKKDFEL

SEQ ID NO: 8291 - protein, 824 aa, Caulobacter sp.
MRRRLRGGDRQAEQGPGERLIRNRRFIFHHLMKKGWRPAPVRVMVFAIRCSMNWRSSERASAKDGSGSGGRNTREGKPMTSMWKAALLAGAAWSTIAGAASAQQAPAADNSVSVDEVTVTARRREENLKDVPVAVSAFSAERLERAGGTDITVLSQTTPNITVQTARGSNSTLISYIRGVGQQDPLWGYEPGVGLYVDDVYIYRPQGAVLDIFDIERIEVLRGPQGTLYGRNTIGGAIKYVTKRLGDEAGAKIRGTYGSYNQTDVLVSGQTPVGGGLSVGGSYALYKRDGYGSNLTTGAEHYNKDVEAYRISAEYQPTEDLFFRLAYDKVVDDSNPRHGHRELPALVGGYKVLDIYDTQAGLGDKNHVMTKGVSLTAQWNASDTVTLKSITANRRGHTDTVIDFDGTPLPTLDVPATYDDRSFSQELQAVYSDENVQGVFGLYYMNSQASGEFDTIAGNLGVAIANGGKVNTQSFAAFFDFSANLTDKFKVSLGARATRDAKRANVYRFFYLGATRTPYQGGTPRPILQTRTNYNAEKTFEQFTPRISASYDLNDDLTSYVSFSKGYKSGGWDMRGDAFITPQTVNGYKPEVVKTYEAGLKGYMFERRVSFSSAAFLSKYTDQQVTTQVVVPSGIASSVDNAGASTLYGVEFEANAKLSANLSANVALGYIHAEYDTFSRFVPAGAPNPLNPSTTLATGQIVNVADLYGFQNTPEWTGNVSLTWRGELAGGDLAITPMVSYRDAYQQFEQPLPLLDQKAFTLVDLTAQWTAPSGRYKLALTGKNLTNEKYRIGGYNFGVPTYNNSVIGFYGPPRTVAASIEVAF

SEQ ID NO: 8292 - protein, 804 aa, Caulobacter sp.
MSALAVAISMALTSSLALAQQIQNSSTQQVSLSSQNLDQALIQWANTYNTQLVVDQSIVKGLQAPTVSGKYTARQALNLLLAGSGLQVLESNGNYVLTKPALSSNPNNAPKLSSVVVSASGFEQDLAQAPASISVISREELQTKQFRDLAEALKDVEGIDVRGSTGKTGGLNISIRGLPSDYTLVLIDGRRQNTAGDVTPNGFGDALTSLIPPLSAIERIEVIRGPMSTLYGSDALGGVINIITRKVGKAWGGSVQLETGIPENSDEGGTQKQSFYVSGPLMENTLGLAIRGNLFRRDESTLEPSTPGGTISRRGPSPVESRQHNLGFRLTATPNTRNDLWLDYESYRTTYDNDECQLGTRDFLNCNTGAPSNTASGYSDSLSFNRQQFVLGHTTRMQFGTLESSLTRSITETEGRTVPSSARPAGDVSIGTARRLETTNTILDTKLVTPIGDQHVVTAGAQYWDAELEDGLVPNPYTQTTWALFAEDEWRLRDDLALTLGLRQDQHDAFGGNLSPRAYLVWNTSDTWTLKGGVSRGFRAPRLNQLADGISGITGQGTVISIGNPALQPEISTNTEFGALYDNHAGFTVSSTLFYNRIKDIISGDGGDCTSTAIPTCSFNPTATYPVNRDRADTYGLELATRIPIAKQWSANLNYTFTETELVEDGQNVGELSDTAKHIANAALRWDASDKWNWSLRGEYRGDSRRFDGDPAALTGNSLNEFRALGDLKGYAIFSLAGQYKVSNNVTLNGTLFNLLDKDFREFTPYSDINGNTVFGSPYFRSAQSTKGTLPGGRTLWLSANVTF

SEQ ID NO: 8293 - protein, 1088 aa, Caulobacter sp.
MYNQQRLKKVALMLMMSMLCLISFAQERQVQGIVKDKSGEPMIGVNVLVKGTTNGTITGVDGDFTLSGVKKSDILSFTYIGFKNKELKYEGEKLLNVVLEEDSELLDEVVVIGYGTVNKRDLTGSVASVSSQDIASIPVSSASEALTGKMAGVNITTTEGSPDADIKIRIRGGGSLSQDNSPLYIVDGFPVSSISDIAPSEIQSIDVLKDASSTAIYGARGANGVIIVTTKSGKEGKVQVDFGASFGFKKVTKMTEVMSPYDFVAYQREIGSLDYGNYNDMDIWKSIDGIDYQDEIFGRTGNQQQYNVNVAGGSKQLTYSVSYAHNEEKSIMLGSGFKKDNINAKLKSELNKWLTLDFNARLSYSTIEGLSGGADTNESNAANSTVANAVVFRPVNALSHSSDDDEESNAALQKTPLERLLATNKGRNSFRQNYNFGLNWKPFKNWTFRSEFGYGWRYEDTEQYWGTDAVSNSKYGYNGRPQAYLLRETTKNWRNANTLTYENKKMFDGRDRLNVLVGHEVSSSMEESIENVSVNFPTTMGFEDMKANMGAGTALPNQSTISAEENMLSFFGRVNYTMMDKYLLTVTVRADGSSKFGDGNRWGVFPSAALAWRISDEAFMANTKDWLSALKLRLSFGTAGNNRINSGLLYTTYSLSGNDSRNPFFNGTSTPMLEHGTYLYNPKLKWETTVTRNLGIDYGFWNNRISGSVDVYWNTTRDLLMKAEIPGNSGYSYQYQNFGQTSNKGIEMSMDAVLVDTKNFSLNFTANVAYNRNRIDKLTTDSPWQSSNWAGSTISKYEDFRVEEGGRLGEVWGFRTNGYYTVYDPVTNPTGELVWGDKQWVLKDGMKDNSPTITGGSYYPGGLKIQTDENGNPLKQRLGNTVAPWVGGFGLNGRFGNSRTGELDVNIFFNYSTGNVIINGTKLASSFRSGSRTGYNLNNDFRLGNRYTWIDPETGLNLASSSTAVLNHYGDMQAAGLRLNEINSNANMYNPAAASTMQLIDYAVEDASFLRLNNLTIGYSLPKHLVKKAFLQNVRVYLTGYNLFCWTSYSGADPEVDVSSKRNAMTPGVDYAAYPKSRTFVGGINITF

SEQ ID NO: 8294 - protein, 729 aa, Caulobacter sp.
MSHRNTRSLSLISTALLAALSPQVMAQESDSQPTMEQISIFGKQNPLNTAPGSAHLITQAELDNFKYTDIMRTLASIPGVYIQEEDGYGLRPNIGMRGTGQNRSEKITIMEDGVLAAPAPYASPAAYYFPTPGRMQSVEILKGSSTVKYGPRTTGGVINMLSRQIPEEELAGKLDVAAGQDGFGKLHAYAGGQGERVGAVMEMYRYQADGFKDINGVGGDTGFEKNDALAKVSVRSADDAKYAQVLEFKLKYSDEVSNETYMGLTDSDLETTPYARYSASQKDVMNTEHKQLQINHIIDFSDNLTLGTTAYYNDFARNWYKADKVNGLKLSKGGVEAASEFDKDPSMAPMDVRVKANNRSYISQGVQTELNWYLANHDLAFGARYHEDEMDRFQWADHYTLDSNQVMTLSESGIPGTDSNRIDSAKAIALYVQDKIQFGDFNITAGLRYEDVTTNRTDWGKENPGRDGQPNKDIDNSFSATLPSLSATYQINSELLVLAGVQKGFAPASPGNADKKEEQSWNYEAGARYNSGEFSSEAIFFYSDYSNMHGECTASKGCDDDNIGDQYNGGEVDVKGLELSLGYSFNTQTDFSFPVKLAYTYTDAQFANSFESDFDPWGDVSEGDKLPYIAENMLFASAGVKADSWELTLAARYTDDIRTQAGQGEIAADNLIKAKTIVDLSGRYFIDDAQELYLTAENLFDEKYVTSRVYGSNFVGKPMTVSVGYAYKF

SEQ ID NO: 8295 - protein, 256 aa, Caulobacter sp.
MRKYVKSLLAAGALAVVTALPQTAGAQGFSATEVQLHQGDGYLFGRNGINETSRTTVTLDHITVRDWGDLYFFVDFFSDGDGTGRKSDQYGEIYMHFSGRNAGLSFGDGLIKDVALGASINQGTDFTAALIGPRVSFNVPGFRVLSLGLYAYDTVTDPFGRDLDTTYQATLVWDRPFDIGSQKFLFKGFADFIGERGQGVDNQILFSPQLRWDAGHAMGNKPGVFQIGLEYNYFENKFGVASADEDSLSVFAAFKF

SEQ ID NO: 8296 - protein, 731 aa, Caulobacter sp.
MTAQLNKSIRGKIMLKRTPIFVLVATACAASPLLAQDEEVTLPELEVVGQPVERAGVEAENKPFATPDTADLLRRVPGANVNANGPIAGMVQYRGMFGPRMNVRINGTPIESGGPNWMDPPLSYAPRSLVESIEVTRGVGSVSTGSGIGGYVEAKTKSSHFTGSEQFEFHSDVDIAGHSVDGGYNLGGILSLSNDRHRLHFLGSRDDGGDTEFGDGTIKATEYERNTYGAGYGFKTGDHEFSADYQRLDTENSGTPSLPMDISFIRTNRAGGKYTGFWNDIQLETRFGYSDVDHQMNNFRLRQAANFCALPAPFCQGDDKRLVNAGSEDFNYGLKATFALWGGDLAIGADGHAAQHNATVLDPDFAPFFVTNFNNAQINKYGFFSEWTKEIYSNWELQLGARYDRVEMDADGVNAFPAQLADRGMGGMPAQMIQMLRNRFNGADRGQNNNNVDWVAELSYQMNSALRWTFGAARKMRSPTYIQRYLWIPLEVNAGLGDGNAYVGNVALDPETSHELGFGFDWQTQAAYFSPQAYYRRVDDYIQGTPAADPVVIAVSTNAAGDATPLQFSNVDAEIYGLDADFGYRFHPRWRLDGVASYVRGKRRDINDNLYRIAPPNLRLSLTHERIHWFTTVESVLVYRQENISDTNTLDPGNANNTNEATPGYVLVNLYGQYRLLNQGITFTAGINNLLDKTYTNHLTGFNRVLNSDVSQGRRLPGPGRNFYAALRYEF

SEQ ID NO: 8297 - protein, 1037 aa, Caulobacter sp.
MSFRRSALLLILVALLTFSGRPAWADDLADEADLHFRIATERYSARDYRGALEHFLVSNRLVPNRNVIFNIARTYEALQEYPDAFRYYVQALDLEPNAARRPAIEEALARIRPNVAVINVTTDPPGATVYINRRDLGGRGSTPRLLGFQPGKHKIIVDLEGYEPAEVENVEAKIGEQTNVAVKLKRIVGTVRVVGEMAGTTVRVNDASGPPACTAPCDLTLPPGRHRLYLSQEGYQPSEQDVNVAAASTVTARYRLNPLTGSLVVNADERDALVEVDGKPMGFTPAVLNVQSGQRRVRVSLRGFRPVEQSATVVAGQQTRIDISLRQLEEVEAASRTAEAVEDAPGSVTIISGQELRAMGYPTVAEALRGMRGVYTTYDGTYSWVGIRGISIPGDYSNRVLVLLNGHSINDTWDGLAFADQAARTDLEDVERIEVVRGPGSLLYGTGAFVGVINIVTKGRPTSFGAGVGVGAAQHGFIRGRAQAQVPFGRDSGMWLSVAGGHGQGRDYYLPILPGLDDQWKNRDANSRDADHFNVGTVQGRLWYKSLSAQVFYNERRKALPSGANKTVVGDDRTFYRDRRGFAEVTFAPRISDVFSTVTRVAYDIQFYDDTLWLVNDSTGMRISDVEQYQDMFLLADQRFEITPFPQLKVTVGVEGQMHFVGRQRIEETTCLPNQPCVDTLILPVPVERQDVDNDGTVEEPAAGASSDDDDDLNNDGVINKDDVAIFNARDDGLFDAHPYQILAGYGVVDFVPSDRVRVSAGARIDYYNYGKDDLSFNSGISPRIALVVKPYEGGNLKVTGGRAFRAPPIYELFLQVPASNFAPGFNPAEAEEEQIGPESVLSGEVEFTHRLSSTLSLLGAGYVNYMTDMIAQTGDFTADKPGRYDNTKEPILVLGAEAELRREWRQGWMASLSYSYTRARYLDKGDVDDVLKKVPNSPEHMAAVKGTVPLFGKALMLSTRLTVESPRLDKTLTETDPSVIWDVVLSGQTDVAGLRYNMGVYNVADWEYEAPISPQFTATRMPQAGRTFLLSANLNF

SEQ ID NO: 8298 - protein, 872 aa, Caulobacter sp.
MNQEGITAHGNATITLKAKENNKITVENAAYSSDGISTLINRTGARPGTRDDGNKIILEAGGDNIVTMKSGDADADYVNNSKVLTETPYYKSKRGSNGIFAYGDKSLVKLIGENNIVKSEISEKSKALNGGFRHIGIYSWQNAKVELSAKSDNIVQGGIWGLYSNNSSISLKGKNNVISNPKYNVFAYKKAKVDLTVENKNTLSDAEFGVYALNTSMVNLSSKDNNEVKSTQVGLYSQDGGSINVDRKDNIIEGDAVALVGKGGSQNIRASRTNLISSKSLGIHAEQAAKIAITGASNTIHASNAAIRSLDKSEVKIDGQITIDSNVANLARQDGSIHLNYKDDTRITGATVSDKGLVAIKPLNNTNIVADTIHYKGDVLAVNKGKVELDFTPNILLAGRLDNFSGLTDSKHKNLFENYVANLDSKSAGEINFNLAKDALWTMTGQSWLDKLEGQGTIDFNNDAKTSGRALHIGELAGANKFLMHLNKDGIHSDMLYVKKGTSTPQEVVVKNLSEVLDSMNYGERLRFATVTNSKNEFVNGKKYIDDTHLMEDALTVEYSAHNGDKNNKDDYNKSFNGSEMTAEKAGDDYVNKTYTDNRQNVYLVKQATGNPSRNVKNINDMFDSTAHYAFTLDTYAKREGERAFSTLDKKEGDWIRLTHTRVIQSNAFRFHNNDFEIGYDRFSLNEQEKKRKWGISLDYGHGRTSLWNTFGKDKIRKYELALYNTTQYIDKEGDETGYIDNVLKIGKLRNRVIARNHMGQLWGKGKYSNTLFSISTEYGRRKFLDDDKLWRITPQVQLQYSYLRGTGYRIDNGINVNLSHANSLIGRLGLDVVRKFDGGKKLFYIKGNIFHEFLGSRSFKAFEGKSHYAQK

SEQ ID NO: 8299 - protein, 264 aa, Caulobacter sp.
MSNPIYRSGKVIAEMIEMNKVIAVSALAMAGMFSTQALADESKTGFYVTGKAGASVMSLADQRFLSGNGEETSKYKGGDGHDTVFSGGIAAGYDFYPQFSIPVRTELEFYARGKADSKYNVDKDSWSGGYWRDDLKNEVSVNTLMLNAYYDFRNDSAFTPWVSAGIGYAKEIHQKTTGISTWDYGYGSSGRESLSRSGSADNFAWSLGAGVRYDVTPDIALDLSYRYLDAGDSSVSYKDEWGDKYKSEVDVKSHDIMLGVTYNF

SEQ ID NO: 8300 - protein, 792 aa, Caulobacter sp.
MTSSMPRYALSLTIGALLAPLAHAQTASPDAGKQDATTLDAVIVSGTARFKGLAKRDASFSITTASPEQIQQAVPQSTADLLKIVPGVWAEPSGGGTGANIFVRGMPSEGDAPFVTMQLDGSPLFPPPTLSFLENSTLFRVDDTVERMEVLRGGSSPIFSNGQPGLTVNFIQKKGQDEPEGSVRLTGGNNALRRIDVFNSGPMGNGWYYSIGGFFRETDGVRDPQFSADKGGQFSATLSKRWDSGELSFYARHTDDNNAFYTAIPLLSRNNGNDLSSFPGLNAQTGTLLGRDFRNVDLLVGPNGETIQRDLADGRGVNIDVFGGELNWDVGGWTVADRFNVMAGTAPTYALFTGDAPQRLGDFIAGYGTAGSGRFTNGGGAVDPNQQVLEAGWWSVDKRLNSFTNDLRLSRELFAGNTLTVGAYYAKYSSADTWYLGNTMLLTAQNNARRIDVDLADGRQATRQGFTSTAFLNLRANYDGENIAAFVADEWELSERLRLDLGARYERQSVTGDVHDTATVDLDGNPATVYDNATSLALASTRRIDQDDEAFSWTAGLNFRLNDNNSLFARANSGVKFPGFDNLRDGQTRVQDVDQYELGLKSGASNYDLYLTAFYNTFKNSPFQAFLSNGENFTAVGDSRARGLEVEGAIRPFGGFELAGTGVWLDAKYRNYREFTGNQVMRQPKRQFRVTPSYYWMLPFGDLKVFATYSYIGDRFADLANSQRLPSYDMVDIGANLHVGDHWEVTASGSNVTDTLGLTEGNVRVPGAATGGVFMGRPIAGRQYQMSVAYRW

SEQ ID NO: 8301 - protein, 726 aa, Caulobacter sp.
MKPVIWKTLVTQTAFCALAAAALAQEAPPSDQERVLETVIVTGNGSQVELPDAYAGGQVARGGRAGLLGNLDFLDAPFSGTAYTADLVSAQQSESVGDVLQNDPVVRVAKGFGNFQEVYVIRGFPVYSDDVTLNGVFGILPRQFVAAELLERVEVFRGANAFVNGAAPGGSGVGGSINLVPKRAPQDGIRRVTAGYESEGQAFGALDMGQRFGADEAWGARFNAVLRDGETSVTDQSRSLTALSLGTDYAGDRFRFTADVGYQDNRIDAPRPQVSPLAGVPEAPDADTNFAQPWTYTDEQQLFGVVRGEYDVTDAVTVWAAAGARQGEEANVLANPNAAADGSMTAYRFDNTREDEVFSADAGVRAEFPTGPIGHRVVVSATSTQLESKNAYAFSSFSASFATDLYNPVAAAPPAADFFIGGDLGDPLKTEAARTRSIAVADTLSFLDGRLLATLGLRHQEIETASYDYNSGAALSRYEDSKVTPAVGLVWKASDRMSLFGNYAESLQPGAIAPSTSGGTVILNAGEVLEPFTGEQMEAGIKYDSGSFGMTASVFQLTRPNAIVVDQVFQASGEQENQGVELTVFGEPVESVRLIGGLTLIDAEFSKTQGGVNEGNTVIGVPEVQANINAEWDVPGIEGLAVDGRVTYTGEQYVNETNTVDLDSWARLDFGVRYALQVAQQDVMLRARIENVSDEAYWASTGGFPGANYLILGNPRTFTVSASVDF

SEQ ID NO: 8302 - protein, 348 aa, Caulobacter sp.
MTTSIRSIPLSAVAVSALLACGAAHAQSSVTLYGVMETGLRYSTNNDAEGHGKAEMAGGYYSGSRFGIRGSEDLGNGLKAVFHLVSGFAPDTGVGSTNDMGLGGYKPTTPATSRLFGRQAYVGLEGGFGSLTFGRQENLVFNTAGQYDALSIGNLGATAWHVTATGVRIDNSVKYVGDFNGWRPGVMVGMGEQAGAFSAGNYSALSLNYASGPFAFGGAWEQQKDLQSVGTRTWTTGGSVQVGPAKLMLGYINYRDGTPTKNDLILGGVKYDFSGQYNLVVGGMATRQRDPDGLRYTAYAIMNYVVSKRTWLYVGMDYTHQKDAGTVLAAALPKASQTGVMVGMRHGF

SEQ ID NO: 8303 - protein, 681 aa, Caulobacter sp.
MSIQRHYTQLAAAVIAAISSLPAFAQEDPDKMIVTASGYSQQLRDAPASITVISKEQLQNKPVRDLADAVKDVEGVSIVGSANKQDINIRGLPGEYTLILVDGRRQNSRESRPNGSGGFEAGFMPPVEAIERIEVIRGPMSSLYGSDAMGGVINIITKKVTNEWHGNVALGGILQENRDSGDSTDGNFYLSGPLINDKLGLQLYGGGDYRQEDKITEGHNKRDNRSLTAKLTFTPLENQTFLLEAGRTTQERTSTPGKSFAEYTMRGESKQKNTKTEIHNDRNHFALTYKGDWDLFNTELSVYQEQTKRNTKSEVKDSAGDYHFVYEARVPEITNTVVDGKVVAFLPDNILTVGGQFQHARLKDTSATGKKTTEDTTLRAEQYAFFLEDEFTATDNLILTGGLRLDHHEFYGNHWNPRGYAIYYLTDEITIKGGVSQAFRAPTLREVSPSYGTSTEKGEGIIYGNRDLKPEKSLSEEISIAYDHESGFNASLTLFNTDFKNKLTSYYTGEPDPITGLKLYTFDNVGKANIKGVEVATGIPLAEDWKLSMNYTYVDSERRSDDEKLSNNMSLKGYPLDKTPKHTANAKLDWQYSEDLNLYTRAHYEGKQVWAAQRNGYTAPRYRSGYTTMDVGMTYQLLKNTKLNLAVLNIANEKGPKIDTKGGNWDVEDGRRYWANVNVSF

SEQ ID NO: 8304 - protein, 393 aa, Caulobacter sp.
MLIYNQIGSMGFLFIIPIGFIMKNLTKIVVAGSLLSCAAAQAGGLYLYETSTTDIGLASAGMAARAQDASVMAANPAGLSNVAGQSFSGHLISLYGDATLDTVGGGDAGNIIGYVPLGSAFYSQQVNDKWTLGIGMYGNYGLGLEYDKLFNRIDIPNAITQALTVQPSASYRINDQWSVGAALGIHYGILDMDVKVDGTTIAGGVEDTDTQVNGRVGVLYELNSGTRLGLSYSNETEFEFDDKDFSTSAVAPQQLVFSAYHELNDKLAVMGNLNWQDWSAYQTLMDVETQDTYQIALGTQYKVNSKVMWNAGFAFDSSMFADQSNGDLTIPSGNAYRLGTGIDYKIDEASTVSVAFEAMLIESSEVKMAGIPVASFDDPALYFLSIGYSWKNQ

SEQ ID NO: 8305 - protein, 439 aa, Caulobacter sp.
MSKKAALSLTALSLALGSAPVFAQSETAEGFIEGSTLSLINRNFYFNRDFRDGGSATGNGYSEEWAHGLMAFFESGYTQGSVGIGVDAFAMLGLKLDSGSGRSGAGGTVDLLPYNSAGDAEDDFSRVGGAVKARFLGTEIKAGDVFPATPVVHFGDARLLPESFKGVTVVNNSLDDLTLQGGRLHAMSQPNTSNTNDDFVTFYGGGVDSPWLGYAGGDYSVNENLSLSLYTSRLKDAWDQHYFGVSATYPLSDAVVLLGSFNYYKATDEGRKLLGEFNNSIWSSSLGVAFGAHTVTASYQRNNGNNDFDYLRQADSIYLNNSIQYSDFNSPKEQSWMLRYDLNMAGYGIPGLTFMTRYARGWGADYSNANEVYMRQDDNGAPLSGQKRWERDVEARYVVQTGSFKDLSLRVRQATTRATAFESDLNEVRFIAEYPLSIL

SEQ ID NO: 8306 - protein, 265 aa, Caulobacter sp.
MNTFYASFLAFASVAFSSVAVSPAAVLAESEEQARGPYLRLGAGVQWPETSALKDQRCSSTSPPALFGCGPGDDGRSLGAYGGFDQAPVVDAAIGYRWTSWLRTEALLNWSPQLNVSAQSNFLGAGPNQPVRSSGNGLAGFGVLYVDGPSIATVRPFIGAGLGAARTSLADVTYRFPAISSDAVTVTSGGRSTSFAYLLTAGVSIPVSEKLDLDLAYRWTDLGTVKTNAGSAKIVRPAGRSNLEIAGTEIDLQSQAVLASLRFRF

SEQ ID NO: 8307 - protein, 320 aa, Caulobacter sp.
MIRNISKALLILAVALSSAASLSAKTYAIVGFGLQLDLGQLGGTITKDGLDAASYYGPVRSTDTCTVGPNDPTCVQNPGKPAGEGNYLGVAPRKAIPAENKLITLDRTTGGLINARSTKGAMVGGNLMVGYESDFGKYFFWRVAAEYTQKISGGITKADIAGYSIVDMTWGFSSIVIPATVGIKLNVTEDAAVYMGAGLNYFNGWWSLNGSNNLKGGHDILAAAGAGSVANLIADGTDPITTREHVRFRTSGIAPNFLIGTQARVTDKGHVFLELETIMSAAYAVGKTQSAGGATNLSPFPAYPIVVGGQIYRFGYKHEL

SEQ ID NO: 8308 - protein, 349 aa, Caulobacter sp.
MRKMALACSAALVALGTVTVTPARAEVTLYGILDTYLGYTNAGGKGAQTAMQSGGLSASRVGIRGSEDLGGGLRATFDLENGILTNSGAATDSTLAFSRSAWVGLGTPYGEFRFGRQNSVLLLMHSKFDAFSGGTYGSFLHNASTFVFRYDNMITYWSPNIAGFTFSAGASLGGQTSPHDALNAYVGSIDYQRGPLYLGVSHAEQNGANGKINTKTTFAGGSYQFGSLTGYFGYYRGNNLGSNISTNVEGKYHSVYSLSTTYSVTPALRLAAGVGYAQDSSGQHNNAGEVSVGAFYSFSKRTLVYGTLERLVNRHGATYALIANGPITPNTPTRGEGVTGAQLGILHSF

SEQ ID NO: 8309 - protein, 797 aa, Caulobacter sp.
MRFTITALALAGVSLFATTAAAQTAPAAADSEGVNGLQEIVVTAQRRAESLQKVPVAVTAISAEQIDDLRVTNVKNLAGLAPSLQIQNQGLQSNPSIAIRGVASGVSNNAVDPKVGIYLDGVYIGRTVGSIFDLADIQRVEVLRGPQGTLFGRNATSGAISLVSAEPTGEFGVRATGSYGNGEAIRGKAVINLPAFGPFSVKLAYLHDQIDGDYTNLIGGKTINLALRDPRFGTETFARKLGRRNIDGGQLAIRGEFGNLTADYRFDYTDARTTGRAIQSLGVIPDSSGALLQPIVDLQPFFGGVTNIAPNARLSAVANATSEEHVVTQGHSLTLAVKPNDLVTVKSITAYRKFRQDPNIYDLAASGGLRFTFGQLGALITPGLTPAQIQAALFNPANIPGPNDYFFSLLTARKTSQKQFSQEFQIQLDGEHYELTAGAFYFHERSPATDILGILEPIPGGLVVPSPLDAAFGSGVTDTVSINDSWAGYGQLTVHLGDRVDVTGGLRYTIDDRDLAINAISGGQGGQLGVGKYNVSFKKLNYTGILTWRPTDQATAYAKISSGYVAGGILSGIPYKPETLVSYELGAKTQMFDNRVRLNVAAFYSDYKDLQTQNFINGRQFFDNAGKASIKGFEVEADVIPVRGLVLSGNVGYADLNYKTFILNGIDVADVARTTYNSKWTARVAAQYDAPEFANGSHLQGRIEGRYRSSYYLTSTPFVNLTGQVVLENENRQPGYWLVDGRFGLVDIPIGGTKASLSAFGQNLFDKQYISFGAPVLSLVGSYERGRTYGVELGFAF

SEQ ID NO: 8310 - protein, 477 aa, Caulobacter sp.
MRKNFLIGFVMLIVSIPTFAGDYLTNTNQNAAFLRMIARGASIDIDGVYSNPAGLAFLPQNGLQVALTIQSAYQTRDIAATSPLWTMDGQTSVRNYEGKASAPVIPSVHAVYKNGDWAFSGSFAIVGGGGKASFNTGLPMFDAAAIGLVNSTSDMLKPNMYNINSAMEGRQYIYGLQLGASYKINEHFSVFAGARMNYFTGGYKGFLNIALKEGVAGQIGAAIVQQIMGANPNLSLEQAQQIAQEQSAPMLQKLNDTKLELDCDQTGWGLTPIIGVDAKFGKLNLAAKYEFKANMNIENNTHKLEFPDAAAAYMAPYQHGVNTPSDLPSMLSVAASYEFLPSLRASVEYHFFDDKNAGMADNKQKTLKHGTHEYLAGVEWDINKIFTVSGGYQKTDYGLSDAFQTDTSFSCDSYSVGLGGRINLSKALSLDVAYFWTTYSDYTKENPRGLDGAMASMDKDVYSRTNKVFGVSVNYKF

SEQ ID NO: 8311 - protein, 727 aa, Shewanella halifaxensis
MKPITSRIAVATALSFAVVAAPAWANEADETPEANQSAQQDTGETSSARRAEAQDDVHYRGNIIVAAEGLQELDFIAGQDVLEVEQIQRNFNGQIGEVLAKVPGVSATSFAPGASRPILRGLDGERVRVLIDGLGTADVGNTSADHATTIDPLTVERIEVLRGPAALLYGSQAIGGVVNVIDRRMPTVVPDHTIHLDALTAFDTASNLRSGGASIDVGLNDMFVLHLDGSFRETDNLEIPGFQLTDDLRADLLADAAEEEAEGEFEEADELREAANQQDFLPNSQTEAYTFNGGFGVILGESTFGAAVGYYDTTYGLIGNPEGGHHHGEEGEEEEGEDEGEETVSIGLEQWRFDFSGDVALGEGFIERLKIRAGYSDYTHTEFEGTEVGTVFDTETFEARAELIQSTGGVIGVQFLNRDFSAVGEEAFVAPNETDQFSIFTAQEFDLGGVQLEAAGRYEMVDVQSAPLGLERDFDLFSGALSAIVESEGGVRAGLTLSRSERAPAGEELFADGPHIATQTFEIGNPDLDVESAWGIETFVRGDVGDISFGGSIYYQQFDDFIFLSPTGEEEDELPVFVFLQEDARFFGFEADIAMPIIERDDFTISTDLRASYVDAELSNNGGNVPRIPPLSLLAAVTGETGPFEARAEVQHFGEQNDTAEFETETDDFTFVNFYLSWRPIETNQNVVVQLAGENLFDVTGRRHTSFTKDFVPLPGRNIRASVRLSF

SEQ ID NO: 8312 - protein, 956 aa, Shewanella halifaxensis
MSGRTVKGRVADRLTNEGLPLVRVIIKGTTQGVETELDGTFTLPNVPTRSVTLLFSSQDYGEREVLIGANQRTVEVAMENIFAEEMVVVGRASEVARKNLANSVASVNSEEINRAPAQTVDQALQGKVAGANIQSNGGAPGGGLQLRLRGVSTINGSSAPLYVIDGVLVSDVAIASGVFAITESVAGANANPTQDNQVNRIADINPNDIESIEVLKGASAAAIYGSKAANGVVIINTKRGRSSEPQFEVTQRLGMYTLANKLGTRRFNSVEEVRDTFGEAAVQYYEQGRRFDHEATLAGRRDLSSETLASVSGVTGNTKYFASAMIKNDEGIIANTGYEKQSFRLNLGQKLGDAVEVNVATNLVHSLGQRGLTNNDNASISNYMVLPRAPEFLPLEANSDGVYPQNPFLSNRANPLQTAALVKNDENVWRFIGSGDLTWHLWKTEAHHLRVLANAGVDRFQQENSLFFPPELNFEPIDDGLPGSSLFGTSQVRNLNSGLNLVHTYKPTSGGIVATTSGGLQFEERNIDSIYIVSKNLNAGQQNVDSGTVVNLRQNRSLVRDRGYYVQEEVLLLDERLTLVGALRGEQSSANGNPNALFLYPKLASAYRIPSFHPKVNEFKVRAAYGETGNLPLYGMKFNGLRATGNIAGSPGLVGTGIAGDRNIKPERQREVEAGVDALLFGGDVVAEVSIYQRNISDLLLQRALAPSGGFATQIFNGGSLRNRGVEAMVQVTPVRGGFEWTSGATFALNRSRVTDLPVPAFLAGGFGTALGAFRIQEGATATQIVGNDGVDENGRPIVRKLGDTEPTFRMSFTNSLKYRDFSLSFLFDWQQGSDIINLTRYIYDDAGTSPDFTTGGRERLVRQRTHASTYIEDASFLKLREVTFMYQLPKDWVSMVPAVKSARLSLSGRNLITLTGYSGLDPEVSNFGNQAISRNVDVAPFPPSRSFWTSLDVGF

SEQ ID NO: 8313 - protein, 367 aa, Shewanella halifaxensis
MMNNTLKAVLLTSMLPFAANAAQELTPWYVGGGVGVNDYEPSCDLKTMKVCGKDDPYAWDVFGGYLFNDYFGVELGYRDLGRGEWTDYANKRNDVGAKGMTLGLVGFMPLSQRWSLSAEAGAMNYLLSNNKQYGTEYYSDSGVAPYFGVGVGYNITENLKLQAKYRRYENLEDDKWNTLDMESNYWGLELSYRFGRTAPAAVVAPVVAAPVDSDNDGVTDDMDQCPNTPSTHQVDGNGCTIYKETTEQRDVGSIQFANNSSVVKNESYQQIEKLANYMNQHPKSTVLISGHASDVGKAEYNMMLSDKRANAVAKILVEKYGIAQDRVEAKGFGITQPIIEGSSPAANKANRRIEAHVTGVKKEALIK

SEQ ID NO: 8314 - protein, 874 aa, Shewanella halifaxensis
MRPSTFKKSVLATNIALLLSGAVSVSALAAEADAEAVNTDNIEKIEVRGLRASMKASINAKRFSDAVVDAVTAEDIGKFPDGDVGESLGRIPGVTVNRQFGQGQQVSIRGASAQLTRTLLNGHSVASTGWFDQQAIDRSFNYSLLPPEMISGIEVYKSSQADITEGGIGGTVVVKTRKPLDLDANTLFLSAKGDYGTVSEATDPAVSGLYSWANEAETFGVLVSAAGSQTDYQRNGIETLLGWGEIVPTTFQQDRERTAYNIAAQYRPTDNLEFGLTVTSLDLKANNANTSIFLFPTQQGVSTCNKTNAAGVCTDITHTGEGGFAWAQTWAREAEMSSDTYDLDFKYEGEGFTLEGRVGNTKADGGTSLTSNYGNSIGQPGDFAGHYDATGEKIIIDIANKSFDAGDFNGQLETAGWALKKQPNTDEETYAQFDLTFLVDFGAITSIKAGVRYADHDVTQQTDAAIVGDIVAKDASEYYSGTISSGAGFTLPKPNFDAMIRDAKASVDGFTRDKSGYGTLNEKNLAAYAMANFEAEGIRGNFGLRFISTDIESDYYALSSSGQFADELSTDKSSYSDVLPSINVTFDLAPDLLLRTTAAQVMSRPNYADLFATSTLPGLNDGTPGNEKLNRGSVALEPFKATQADVSLEWYFGGEGLASLTYFIKDVSSFITTRQKLNQQIGIEDDNLRDQGYSACGVGVYDCWTVSEKYNANGGHIEGIELQLQDSFENGLGYSVNYTFADAGSPAENYPDKVGVFSDSSKHTVNLVGYYEMESFSARLAYNWRSEYMMRELPGFYGNRQHQDYGSLDLSMNYSVTDWMDLTFEAVNLTEEDSIQIGVSPVDNPDVIAEFKDNYPVWSFEGEARYKVGVALRF

SEQ ID NO: 8315 - protein, 716 aa, Shewanella halifaxensis
MLNLIKKSKKLIIKGALKLKVFLVLFSLFFSSLALAEPTFIANLDISDDEGSATGITFKPDGTKMYITGIGADKILQYNLTTAFDITSAALEKSVLIRTVEGAPEDVKFNSDGTVIFILGTEGNGIDRWSLSTPYDIGSITAADTTFTSIGGDPRGLAFNNNGTKMFVLNQTNTRVEEYNLSTPYNPDTKTLTNTLTNATSSNFHQGLGFNADGSKMFVVKSRGGSNTDNKIDEYALSTAFDISSSSATLTGTFSPTHSSDEYLSGMAFNGSGTKMYHINWSGDEVREYSLSCPFKVTSSSTCDAPQKNKDVRGVVDAQINTAKNFAKDSSQSALKRLSILRANKYYNASAQNIELNFQNELLKKVSNNVLSSAQAKLNPLQKLDQILPNDWEVWSEGSISFGKIGESSLSSAQDIDSLGITVGVDTKMDDDQILGVALRVGNTDVDVGTFGSKVDTNALSLSLYGINSLENSNFLKHVFGVSYLDSDIVRKYEGNTDINTGDREGKQVFGSLNFGREYENGDLIITPTGRIDGSYTALNGYTESGSAAALSYNDQDIKSLMASLGVLIDQDVDLENSTVRSRINLEYSKEFASSSKVVTSYVSNSESFEYQADNKNRDIYTAGLGLDFKHDQGLIISTDYERQQIKGHGYINKFTLSAGFLYRKETEFALGLDEEMTSSFKISKALGVFDLEFDLENNFSNQENHNANLSILSKF

SEQ ID NO: 8316 - protein, 1071 aa, Shewanella halifaxensis
MMNKIIISIFILLWVAVGAMAQTATVTGMVTDDMGPVIGATVTVQGTSIGATTDLDGKFTLTSVPNVAKAVLIVRYVGMEEAKEPLKGRTSNINIHMKEAVGMLDDVVVIGYGTQKRGNLTGSIASVSGKILEKVQTTSAAEAIVGKLPGVQVTAVDGSPDAEIKILVRGGGSITQDNSPLIILDGFEVSSLNDVPPTDIESIEVLKDAASTAIYGARGANGVILVTTKRPVEGRVVISLNTYVQTKELSNKLDVMDPYEFVLMQYENARQKSSNPTAFNNKYGHAYEHYIYQGNAGTDWQDEVFGSNPVAKYVDLSVNGGTEKAKYKLSFIHQDQPSVMVGNGLKQNNMNASFNFKPFKFLTLEYRTRLLHKEVDGSGTEGVSLLTALREKPTKGLDEYMKLPEDDTYFDPDQLEEETLFDPKEESKRNYKKRINKSLNTMGAVTWDIMKGMTFRSEFGFENNSEEQRRFWGMETSKARSNNNQPVAEWSMKQGTKWQLTNVWNYNFMLKEAHDIRLMLGQEIKHNQTTTKTYSTRFFPENITAEKVFDNLSLGTPYENSSSAASPSRISSFFGRINYGYNDKYLATVTLRADGSSKFAKGNRWGFFPAGALAWRISNEDFLKDNQVVSNLKLRLSYGSSGNDRIDADLYQKLYGVSSSRPAGWGEVSHYYYNFYNSKYVYNPDVKWETTITRNIGIDFGFFKERLSGTIDVYWNTVKDLLVPSDIPGYTGYTKLMTNVGQTSNRGIELQLNAWLIETKDFSLNATFNIGHNKNKIDKLASGEKEWILTSAWRNDVVNSDDYRAYVGGTSGLIYGYVNDGFYTVADFESFDSKSRTWKLKEGVVDSSPLSDTPRPGNAKFKKLTPVDPNSTNPYQLTEADRTVIGNTTPKFSGGFGLNATYKGFDMSMFFNFMYDFDVLNANKIMLTTWADNKENNFLMDIASDKRWRNFDDMGNEIRYSPEVLAEFNKNATMWNPTSIGRPICMSYAVEDGSFLRLNSATLGYTLPSVWTKKVGLSKVRFYVSGNNLFTLTGYSGYDPEVNIATGLTPNIDYNRYPRSRTYTFGAQLTF

SEQ ID NO: 8317 - protein, 1051 aa, Shewanella halifaxensis
MLKITRQVTLLLLAGALSFPAYSYATQATEVLVPEVTQEKVTGTVKDALGPVIGASVMVKGTTNGVITDLEGKFSLNDVKKGDIIVISYIGYVTQEIPYTGKPIQVKLAEDSKALEEVVVVGYATVKKANLTGAVSAVDGKVLEDRPIVNLGQGLQGAIPNLNVTTSGRPGQGSSFNIRGTTAMSGSSPLVLVDGVEMDPNLINPQDVKSVSVLKDAASASIYGARAAYGVVLITTKGGRKDQPTQVSFDASVSFNGPTTRPTYMNSMQYATWMNTAQQNTVGRDYFDAEWMQHIEAYYKDPVNNSPVFIHSDPGISKNGTKYTYAGNTNWMKELYKKNYPVQKYNVNISGGGKKATYYTSLGYTDQGSLIRFGNEQFKKFNVMNNINYDVNDWLHLSMKTSFNRTKLRGLNQDNVHGDNFMGGDTRPIMPVKHPDGNWAGQGDFTNFPAILEDGGSRLTNKNDLWNTITMKLTPIKGMSINMDYTFNYYSENNKVHMKSFDEYGANGQFLQTFAWTNPNSVSQSQANDTYNAFNFFGDYEKTLGRHYLKGMIGYNQESKHTTGFNAGREQLISNDLGSLSYATGDRWVGSSDNSWATRSGFFRINYGYDERYLLEVNGRYDLSSKFPKHDRAVFNPSFSAAWRLSNESWFKSWTNSFFDELKIRGSYGSLGNQALNNGWYAYLSNYSTGQISWIMGSNQPQYVVPGGLVSSSITWETVTQWDLGLDFNFLNSRLKGAFDYYQRRTSDILAAGKILPGVLGANEPQENAAESLTKGWEFEISWNDQLANGFHYTVGFNLSDYQSEVTKFDNESKELGNWYVGQKQGEIWGYETYGLFQSEQEIAGAANQDKVSGGIKLMPGDIRFVDRNNDGVIDWGDNTVDNPGDKKIIGNSTPRYHYGINLGADWKGFDLGIFFQGVGKRDLYLPGTSFRSHYGSEWQVPSAYNNDYWTEENTGAYFPRARFNGGSAINQAQTRYMVDASYCRLKSVSIGYTLPKVLTQKASIEKIRIYFTGENLFTISDTPDGLDPELDNPYTYPMQRSLSVGLSLTF

SEQ ID NO: 8318 - protein, 242 aa, Shewanella halifaxensis
  misc_feature (29)..(29): Xaa can be any naturally occurring amino acid
MHYKKFFSATALVTLLSLSNAAFSDPVGXIADEETSYYIRLQYNGEVLPFKTKVDAIQYQDNADKVFDPFKASFMAGGAAFGYKMDNIRVDIDGLYSQLNKNEISGTAKAGNTKIADNLSVMSGLVNVYYDVAIEDMPITPYVGVGIGAAYLSNPTTEKIVADQKHRFGFAYQAKAGVSYDVTPEIKLFAGARYFGSYGAKFNKSEEARKIDSTKEKTEVTKDTYKVLYSTIGAEAGLMFNF

SEQ ID NO: 8319 - protein, 989 aa, Shewanella halifaxensis
MQLNQPTNQPTNQPTNQPTNQPTNQPTNQPTNQPTNQPTNQNSNASEQLEQINVSGSTENTDTKAPPKIAETVKTAKTLEREQANNIKDIVKYETGVTVVEAGRFGQSGFAIRGVDENRVAINIDGLRQAETLSSQGFKELFEGYGNFNNTRNGAEIETLKEVNITKGANSIKSGSGSLGGSVIYKTKDARDYLLNKDYYVSYKKGYATENNQSFNTLTLAGRYKKFDALVVTTRRNGHELENYDYKNADSLTQGKKREKADPYKIEQDSTLLKLSFNPTENHRFTLAADLYEHRSRGQDLSYTLKYLKTLDLPEDDSRHTNDKTKRRNISFSYENFSQTPFWDTLKITFSKQKIKTRARTDEYCDAGVRYCAGTDNPAGLKLTDGEITRRDGSPLQFKEKETKTKTKTKENEKIYDFDKFIDTDNKVIEGKLTLGNADDTWYDCSIFNCKNGTKINVFEGEQSYGYYGKWKKSELEIENLNGKKLARIKDRKNGSGYSNRKIKSILPYSPGYLERLWQERDLDTNTQQLNLDLTKDFKTWRVEHNLQYGSSYNTTMKRMVNRAGNDATDVQWWATPTLGKNIFDNPRTCEDSWKAHLCPRVDPEFSFLLPIKTKEKSVYLFDNVVITDYLSFDLGYRYDNIHYQPKYKHGVTPKLPDDIVKGLFIPLEKNKNADVKKNVQQNIDYIAKQNKKYKAHSYSFASTIDPTSFLRLQLKYSKGFRAPTSDEMYFTFKHPDFTILPNTNLKPEIAKTKEIAFTLHNDDWGFISTSLFKTNYKNFIDLIFKETRNFAVGDRGGNTLPFSLYQNINRDSAVVKGIEINSKVFLGKMAKFMDGFNLSYKYTYQKGRMDGNIPMNAIQPKTMVYGLGYDHPSQKFGFNFYTTHVATKNPEDTYDIYAKDKNQTNTSIKWRSKSYTILDLIGYVQPIKNLTIRAGVYNLTNRKYITWDSARSIRSFGTSNVIDQSTGQGINRFYAPGRNYKMSVQFEF

SEQ ID NO: 8320 - protein, 939 aa, Shewanella halifaxensis
MKTLIYSFFLLVTAISLQAQTGTIAGTVNDGQLNDILPFANILVQGTTKGTTSDFDGKYTLDVEPGTYVIEFSFVGYTTQQISEVVVKEGKTTVLDVTLSGASLDEVVITTTARKNTEQSVLNLQRKSVQLLDGLSLESIKKSGASNVASAVRNVPGVSVQGGKYVYVRGLGDRYTKTILNGVDVPGLDPDRNTLQLDIFPSSLLENIIVVKSSTADQPADFTGGVVDIVTKDIPNGKQSSASIGLGYNPDFHFNSNYITNESSGTDFLGFDDGLRSNPFNENQEFNFPTTTPNTAEFLAGRLNPTLAAARENSGADMSLSFTTGNSYDVGDNKLGFLASVSYKNETTYYDNYVDGQRFRKDTDPSIFELNTDRTQQGERGENNVLISALGGLSYKTDRSKYRFNVLHIQNGESGASLLTQTNRIDNSNTVKKDVLIYTERALTNLFFSGKHTNEDASWTTEWKLSPTFSNVDDKDFRSTPFLINEDSGDFIISPSESGDASRFFRELDEINVASKLDLTRKHQLFEKDAKLKFGGAFTYKQRDFATIRFSTPFRNFDSTLLNGDPNAILGQYAYSATDDSGFFVRKDSNENDSFDSNMNIAALYASEEFRPSSWFTAIVGLRAEKFDLIYSGQNQNGQIFDGEKILDKFDFYPSANLIFDMNEEGAQKLRASFARTTARPSFKEASNAQIFDPINSLLFIGNINLQPSYINNFDLRYEIYGEEEKKFGLGDFVALSGFYKEFKDPIELTFIKEATGQITPRNLGDAEVYGIELEVRKSLDIIGLDNFSLNVNTSIIESNETYNADELIFRENLLREGESLGDGRVLQGQSPYLLNAGIAFESKETGWKSGLFYNVQGKTLQIVASEEVPDVYTLPFNDLKFNLSKSFGEDQNQTITFKAGNLLNDDRESVFQSFGAEDQLFSKWSPGQDFSLSYSFKF

SEQ ID NO: 8321 - protein, 197 aa, Shewanella halifaxensis
MVNAGGVVVAPPVGMGRHHATGGTVGGHIGYRWQIANSVFGLETQGNWADFKGSNANLAFAGVRDDSTLDAFGLFTGQVGYAWNNVLLYVRGGAAVVRDKYRVSDFATGLTIDNGSETRWGGTVGAGLEFGFAPNWSIGVEYDHLFMGRRDVDFFFSPGLVGVPVGTFAGTARIGQDVDIGLVRVNYRWGGVIATTY

SEQ ID NO: 8322 - protein, 575 aa, Shewanella halifaxensis
MRNKNIIMLLMSSLILSGCGPQPENKESQQQQPSTPTEQQVLAAQQAAIKEAEQSAAAAKALAQQEVQQYSDKQALQGRLQEAPTFARAAKAKATHIANPGTARYQQFDDNPVKQVAQNPLATFSLDVDTGSYANVRRFLNQGLLPPPDAVRVEEIVNYFPSDWDIKDKQSIPASKPIPFAMRYELAPAPWNEQRTLLKVDILAKDRKSEELPASNLVFLIDTSGSMISDERLPLIQSSLKLLVKELREQDNIAIVTYAGDSRIALPSISGSHKAEINAAIDSLDAEGSTNGGAGLELAYQQATKGFIKGGINRILLATDGDFNVGIDDPKSIESMVKKQRESGVTLSTFGVGNSNYNEAMMVRIADVGNGNYSYIDTLSEAQKVLNSEMRQMLITVAKDVKAQIEFNPAWVTEYRQIGYEKRQLRVEHFNNDNVDAGDIGAGKHITLLFELTLNGQKASIDKLRYAPDNKLAKSDKTKELAWLKIRWKYPQGKESQLVEFPLGPTINAPSEDMRFRAAVAAYGQKLRGSEYLNNTSWQQIKQWAQQAKGEDPQGYRAEFIRLIELADGVTDISQ

SEQ ID NO: 8323 - protein, 883 aa, Shewanella halifaxensis
MHWSDGIGINANVKTLKNTGTIQGFSAPIKSSDGTIETLINEGTMKGESIGIYMSGGLVKTLINSGTINQNNSATWAAGIKLQNNSTIENIINTGSIRSNAFGISVTGGKFGTLTIKDGGQVYGKYSAIGVGRSQTLGDLYIDGRSNNGTVSGIYSEENGIALDANSRTQKIELKNGGIIKGKIHGIRLDNGASLSGEMILSGEGSRVEGGSGAGILNRSGKIEGSITIKDGATVTATSNLAIANYRSGSITAGITVSGKNTKLEGNIINLGNASIGSDIKIEDGAKVEGGLVNQGNGSISGSVQVSGGGSIDSITNEGNGVISGSITVDKNSKLDSITNTSTSSTGISGSITNNSDNKLEISNSGNIGGKIESTGSADMVISNSNGGTISGGISSSGSGSTSISNSQGSTINNGITVSGSAQVEISNQGSVGKDKNGNTVTNNGSGSVGIKDWLVSTDKNTGKLDTVVIGGRGAFNVKVENITVDQSNVDLEELNDINNIISGVNQNNIGNIGTNGSGEISLSFDPITGKLTTDFNLNASISGATFRSLISTTSRRSTFIDNVMGNSMQSFALASSSKSQSIAMSEKGNLYADASDYIKSDLNNGSYGSNKEHSLFILPYTSSQNVELSLNEESKGHTKGTIIGYSTLKDSGIYGVYAGYEDTKMGSTYFDINNRTYYAGLKYFNTLFTTEKDQEVYIKAQGKAALIKNDLTKKIGNNEAKAEPNSYAYGVNTALGMNFISNKDIFSPEIGLAYEGGYTEAFSMKDTIGQATVKGGERTYANYLNLFSTKTSLTWFRDWLPNLKTSVELGAKFNINPKVEAEARFGNIKVSDEFDLPRVQKFVSTSFIVPVNEAFYFSLNYNGMFDKDGNTHTGFAQFNYLW

SEQ ID NO: 8324 - protein, 948 aa, Shewanella halifaxensis
MYKNNFLTNSVRLALVSGAMTAAFTAPAVYAADEEVERIEVTGSRIKRTDMETSSPIHVMDAEQIKMSGFTNVEDILNQLPQLETASNAFQANGASGTASLDLRGLGSNRTLVLINGRRMQAGSITSQSADINQIPASLIKRVEVMTGGAAAVYGADAVAGVVNFIMDSDFDGISINVGASGYQHDNDNGYIQGLMDEKGFEYPSGNTDIDGKTYNIDLAIGSDFADGKGHAVAYAVWRRNDELLQGERDYSSCALNGSQSACGGSANTPLAHFDIYPVVDGEVDYKQNFWGYTDPNGNGFKPDDGYRYNYAPVNHFMRPNERISLGSFMNYEINDHARPYVELSFMQNRTAGQIAESGTFFNEEYLMDYNNPLLTELQKQQLQAEFNQTGDDQFVAYIGKRNVEGGARANNLEHNSYRILTGMEGDINDNWTYDVNFNYSATSSSSVYQNDLLAPKIAPRVGAVDTECVEADGCLYYNVFEPGGVTAEQAAQLAGVGIQTGLVTQTIYSGYVTGDIGVTIPSASDPIAMVFGFERREQDYERISDTVYEEGQLLGQGGPNTSLTGEIDVNELYTEFQIPILDNLAFDLGARYSDYSTSGGNWTYKVGADYTLADAYMFRASFNRAVRAPNVAELFDSQSIGLWSGADGCATDEDGNIAFNEAQCANTGVTMDQYGNIGSSPAGQYNEFAGGNPELDPEEAETITLGLVANPLDNFSFSLDYFNIEMENVISTVGAERILNICAETGDSAFCQNVQRSASGSLWLGQSGYVVNLSDNIGGRSWEGIDAAAQYNIELGSGDLSFDIIGSYAMKKEVQPIKGNDALAYDCAGNISSDCFATPEWRHTFTAKYTAADWVLAAKWRYYGEVSYDGTADTRLAEQGGIDAYNYFDLNGTYVFTDYMSVTAGMNNLFDKEPPMVGNSLSTNANTIAGFYDTLGRFMHVSVNLKF

SEQ ID NO: 8325 - protein, 403 aa, Shewanella halifaxensis
MKKTLVASALAAVIFVPSVSAIEIYKDDKNAVEIGGWMDARIINTQGATEVVNGASRINFGFTREMSDGWKAFTKLEWSVNPFGNSDIEYNNDSAFSSESDEFLHNRLGYVGLGHDTYGSLTIGKQWGAWYDVVYNTNLVNTWDGNASGTYTYNKADGAINGTGRGDNTVQYRNAFGDVSFALQVQLKQDSFDLTESSLDNNSNPFPTADKNFMTGSSTASTSETIATVEYNNTVGGSITYAATDMLTLTAGFNLGEFDGTMASGEGISETDYIYGAGLTWGGFEQPGFYAAININKNEFHDTDNMGRLMHDAVGLESLFSYKFDNGLKPIFAYNYLKAGDAYEAFYNDGEFKRQFIVAGLHFVWDEQTMLYIEARKDMSEFNAGNQTPDESDGVAIGIRYYL

SEQ ID NO: 8326 - protein, 877 aa, Shewanella halifaxensis
MGMSGAQAAEAVDADTSGSAVSSSAAVVPATTQLQRVEVTGSAIRRVDAETAVPITILRADDLKKQGVTTTQEMVQRITGSQSINNSAGSVGAGTGGASFADMRGIGANKTLVLLNGRRLANNALSGVGTPNGSAIDLNMIPFAAIDRVEVLRDGASALYGTDAIGGVINFITKKSLTDGSLTLGGETPTASGGGATKDMSASWGFGDLEQDRFNVMGVFNYNKQQNLDANDRSFAKDYVPGRGLNQTSGTAYPGNYFQGDNSANPLGRNCGGANLIASNGICRFSTREYIDLIPQTEKTSFFGKATGKLADDHNVSLEYFWARNNNHTDIGPAPLTGLSLDSSSPFYPGNGITPAPTDFTLDPTQPISTAWRETAAGPRGSSDQNTSQRFLLNFDGLVGGWDYNVGASYNQNKVLSSLTNGYISDAAMLNGLANGTLNPFGPQTTAGQALIDASEYHGQYSSAVGRVAGLDARISREIGDWFGAGPAGIALGGEYRKEKMHQEYEAYVNDISSLGADAAGSVEGDRSVKAQYAELNVPVLDSLELTAAVRHDKYSDFGSTTNPKYSFRYQPFKQLVVRGAYSEGFRAPSLYELYAPRSTTFTQGYYNDPVLCAGGVVQPGGNAGRDCQQQFLNNGGGNTELAPEKARNMTLGFVYQPVSNLSMGLDFWWIHISNQIQAFPESTVFDDPNTYADRYVRAADGSIANIVTGNANLGIVKTSGVDVTLDYRFPNTPYGQFGLGMTGTYVTRYDFQNIIDGPYTDKVGDFQGDGVISRWKHVLTGTWALGDTRASLTNRFTSGYNDYDRTTNARVASYALWDMSVGHTFDKVLDIDAGVRNMFDRNPPFSNQAYNFQSGYDPRYADPLGRTLFARATYHF

SEQ ID NO: 8327 - protein, 198 aa, Shewanella halifaxensis
MKKQLIAAAVLSTLLSGAAFAQQATEGPWMVRARAVHLDSANGDSTGLGLSVNNKWMPEVDISYFVNKNVAVELVLTVPQKHTMYSNGVEIGTLKHLPPTLLGQYHFDMNGFKPYVGAGVNFTRFSGVNLLGGVATVDKNSWGPALQVGVDIPLSKGLYLNLDVKKVYIRTDVAAAGTKIGEFKVDPLLVGVGLGWRF

SEQ ID NO: 8328 - protein, 215 aa, Shewanella halifaxensis
MNKKITLSLVVASLLTAGFSFGAAAHQAGDIIVRAGVAMVAPNESSPVVANIAEFGVDNDVQLGLNFGYMLTDNLGIELLAASPFSHDVSLGELGKIADSKQLPPTLVAQYYFGDSQSALRPYIGLGINFTNFYDSEFTQEAKDLGLDNLSLSNSWGVAAQVGLDYQIDKKWLVNASVWYAQISTDVSFDMGADHVVVDTDIDPWVYMVSIGYTF

SEQ ID NO: 8329 - protein, 649 aa, Shewanella halifaxensis
MKKQQKVLRVSSLALAMSLAYQVQADEIERDPILDVTDVIVVHGERASVTEAATTHWSVDAEEIKASGAQSLDQVLENVPGVYVRVGGDSTPRVDIRGLKTRHITFLINGVPASSTEDGQFDPSVIPTNLIARVDVSVGPTSVLYGPGGSAGVINIITKQGDESSSLSGKVESAADNTLNADISAAGSGDNWQGIMSVTHQETDGTPMPDDFEDTRNQIGDLRFNSDRKLTNYYAQGSYFINDSTKLMANYTQRDGEWGKAPTVDRKKAPSRIEDFNEQSMQLGAAHEINEKYVVRGFVYYNQTDMVENFYNHRMNNLNSIVESTSKVSGTNLQFISEFDYGAVLTTSVIVEKQDWFSHTDKIRSEKGTGSGGGSGGGQGSSGDIDESLMVYTGAAEYQYQDDGIYGYSLGVAVHNYDLDVNSETDFSAQASAFYQVTDSSRIHTGLARKVRYPSISDLYAPNSGNVNLKAEVANQFELGLQQSLPFDTQLDISSYITDANDYIAKDDNNHEQNIGDYRFMGVDLQMTNQYFDSLGLTFAYSYIDTEDRATNERLQYRPTHNLRLQASYDFSFGLTTRLNAERVIDQVNGKGVQLDNYTLVDLSLSQNIWHDNLELYVRATNLFDELYYQSDFMPQAGRQVFVGINWQL

SEQ ID NO: 8330 - protein, 184 aa, Shewanella halifaxensis
MNKKLMYIFAIFIVAAITCISQPKKTTLRDKAMVNYAFDYLSSPGSLPFTTAATELSAIHGHSTSQYRLGEFYLHGSDGKPLDYTQARYWYEQSAEQENPRAQSKLGWIYLKGLGVKPDTRKAILWYKEAAEQGYAHAQYTLGLIYRNGSGINVNHYESQKWLKLTAKQHYKNAERLLAGLPAH

SEQ ID NO: 8331 - protein, 621 aa, Shewanella halifaxensis
MKLSRLALAVALLPGVQVFAAELTRDEALKLSDTVVSANREPQRRSQTPAATTVFNRDDIERLQIRSVAELLERVPGVSITRTGGAGSQTGLFLRGTSSTQTLVLVDGQRIAATSSGTSSLEFLSPDQIERIEVVRGPRSALYGSDAIGGVVQIFTRQGSGQGLAPAVRFGAGSNGTFERSLNLSGGNGQTRFNLGVAMDETQGIDATRDSFGANGDDDAYRNRSLSLNVAHRFNDRLEAGVSALDQRGELEFDDTFDGFQPTVDFQLSSISGFVDAKLNDVWNSRLEVGHSEDKRDTGNDSPLAPDYVFFSYSTYRDSASWVNTLQLDPAHQLLLGADWHEDQLHSSSDFAQDSRWNQAAFIQHRYTGNAFSTEIGLRHDKNEQYGSENTWNAALTVPLDTRNDVIVSYSEGFRAPTFNELYDSWFGNPDLTPEKSKSYEVQWRNRYSDSGSLELSLYRTDIEDAIVSDAFWIPQNVQTARINGLEATLRQDVFGWQASLAAGLIDPRDRDSGHTLARRAKRTLSLDLDRQFGDFSVGAGWRAVSGRYDNAENTIELGGYGLLGLRGSWQANSEVKLDLKLNNLFDKDYAETTYSTANGRYGYNTEGRTALFAVTWTPSL

SEQ ID NO: 8332 - protein, 894 aa, Shewanella halifaxensis
MSSVTLTAKAVRRSFIAAAATSVALSGFAFAEEAADEKVERIEVTGSRIKQVDMETVSPVTVISAADIAMTGEKTVADVLNNSAVNSFGSWRGMSGYGSGGSATSSVNLRGLGSSATLVLLDGRRMPGTSSSSGAVADTSQIPMAIVERIEILRDGASAVYGSDAVAGVINIITKKDFDGVQLDFSTEQPSIEGGDANRFSLATGFNTDKGNITFTYEYYDTKNVMDRDVWDMNDPTYSDYSSFSSVPNGYYNTGEKNDDGKDIYAFYSNSDMCEQTENVSNGTDGENNGRCYYSYGEVTKLFGDVTRNSFMTNFSYEVAEDIQFRGRGSASFTETHTRYAGTPVSTNYPVMDAENQYNPTGEDMTIYMRSVQIGERDTLTETNNFDILGGLVGFSDVANGVDWEVNLQHSASTTNSFNYNLINDNIIQSEIDTGEYDIFNTQGLAYDEWEQQMGALYGAAAHTGVYQGKFESTQIDALASTLIFENDAVSLAMVGGVEYEMISFEQTSDPESAAGIISGGSGGDDVDATRDRTAGYVEFQMGLPANVELSAAVRYERYEQEGNLTGATGEVTESSTFDAVVPKFGLSWRPVDSLLLRASYGDSFRAPNMGEMFSSQSLSFESGYDPVWCGANGDDADADYCSPTNQYKTWYGGNPDLEAEEGNSLTLGGVWNVTDEWNIELSYYSIVYDNKIESVGIDDLLYDEQINGGSDKIHRGADGKIEYIEAGVENIASVETSGLDFVTAYNLETGFGDFNFKLDVSHVMAFDKQADATSEMVEYAGTQDYPDWRGNFAASWYLNDFSAAWTTVYIGSQSGQDLRDEGYDYIVDIPSYMKHNFQVGYTHDWNGSITVGVNNIFDEEAPSMYDFAGYRDTNTGLYDVLGRTYYLRLNQKF

SEQ ID NO: 8333 - protein, 544 aa, Shewanella halifaxensis
MNKLKLIFALILSSVSFSVFAQTEGEIISTTIITDDKAKLDLNLANRFFEPNLDVQPTREATPQQYDTKDYSINPPRFDAKVKIPTIPPDSLNTILPNYGKIGAGNYGTVLGEIYLTNKRSASYSYGAHFKHLSSAKGSLMNSGNGHDLLEGFGSKYGKTNSWNGHVSYSNDRYRYYGRPQVDSLNNKDSIKQTYQLFHAGIGTVKTKVGDKFTYSTGIDLYYLATKLKAKETELVWNAAGTLQLTDTRSASLDASISNANRSDSSSVNRFLLMLKPTYKLVGDKWDLTVGATVNYSSDTLKGSNGLHLYPAIHGNYNLKPGKVTVFAGIGGGMDKNTYRTFIQQNPYVGSDPVLSHSNRKIDLYVGSNGNIDDKVSYTVKMSYRAYTNQYFFTNSITDSSQFSVLYDKAGVFGLDGGLFYDLSKEWRVSANMVYNAWSTDKLASAWHRPSFQGSMGVQYNLKQKIYFNAEMYYLSGIKGLNMESNSTVKLTDIADLSLKTEYRFSNSFSAFLELNNILSQKYQRYLYYQVKGFNVLAGLTYSF

SEQ ID NO: 8334 - protein, 831 aa, Shewanella halifaxensis
MRHFLILLFAAISLNLQAQRPQGPGEKSITLTGTVLDQDTGRPLEYATLVLQKVGEPSNVTGGITDIDGKFNVTTEPGRYNIRVEYISYLPYTLDNQLLRQSRDLGEIRMAINAQELDAVEVVGERTTVEVRLDKKIYNIGKDLTNSGATISDALNNVPSVTVDVEGAISLRGNENVRILINGKPSALAGFGSTEALQQLPADAIERVEVITSPSARYDAEGTAGILNIVLRKEKTLGFNGSVNTYIGVPVNSGITANGNIRTDAFNLFSTLGYRYRDAPGNGYFDNSYTSGSFDRIIEDRDINRLNRGLNWNIGMEYFLNDQSSLTGSFFYRLGNDDDQTDNNTTRFVGSEIDSRTLRQELESEDDRSYQWSLNYTNNFNDDGHKLTADVQIGRDREDVATVIEERTTFPQDGLVALENVAQEENSNEYLIQADYVLPMGESQFEAGFRFDLEEEITSFRLDSLDRASGQFVVNELLTNTFTYNEDVYAAYTQYGSKIGKFSFLLGLRLENTRLRGELESEFDPTALEEELGVDVDVNFDKNYLGLFPTVNLIYEIGENENISLGYNRRINRPRGWFINPFPSRDSRTNVFQGNPDLNPAFSNTFDLGYLKRWDKLTFNTSVYYQRETDSFERIQESTGQTTTDGIDIIRSIPINLSTNQRYGGEASILFNPSRKFRINSSFNIFRFVNEGFFNGVDYGAENTSWFARLGSKVTLPAAIEWQTNAFYFGPRQNAITDTKGIFSLNLAFSKDIIEDNGTITLNVNDFFNSRKRRSFTETEFFTSDSEFQWRQRSVTFSFIYRFNEQKKRNAGRGGNGNFDDDGEFEGGSGS

SEQ ID NO: 8335 - protein, 747 aa, Shewanella halifaxensis
MMNTRKIAFACIASTIALAHPAFAQDAADQPNDGDIIVTANRTSSLLSKTPIAMTAVAGDDLIQSGITNPTQLEETVPNLSIVRGNGLQITIRGVTSTDGTEKGDPSAAFMVNGVYLARPQAQEVSFFDIERIEVLRGPQGTLYGRNSTAGVVNILTVQPKFEFGARADVSYGNYDALNGTVAINLPASESIAFRVAANIDRRDSYLIDGNSADGIGIGRFKDNKAVRLSALFKPTPDLSLLLVGDYSWQKGSPTNGVETSTFFSDITSGGRPTFERPTYLDPSARAGRTLLATQAQYAFRDSTDRGVMGQLDYTMGNVTLTYVGSYRESDRKEFSNVGTLPISADFYGSYWQTSQEVRLAYGGDGPLQAQVGGYYFKEKSGIAFFINNLLGANTRFGFPQDPTIAENKSVFGQATYEIAQDVKLTGGVRYSHDLKSRVGATVLDSYSSVVDSSNIGEFLDRTTFQVNDAKRNFSKVTWRAGIDYDSPLGLIYASVSTGYKAGGFNDGCEVGKGDNCALAAGDLYYQPEELTAYEAGFKFRISPEFRLNATVFHYDYKGLQLSQVSNACGGPCQVTSNAAKAKVDGVELDATIQPVDNFTVRLALNYLDARYGQFTPSYEDEDAEGGFSYVNFAGRALNRSPKWSWVAGVNYVVPVGEGRIVLDAQTAARSKYELTDLANYAYFYQPGFSKTDASITYNAPQDRFYLAAFVENLENNLVLTGATTGTLGSVTFSDPRTFGVRAGVKF

SEQ ID NO: 8336 - protein, 352 aa, Shewanella halifaxensis
MNTMNTLKSLVAIAVTLCCYNAYADDAQSLEQRIANLENNAAPSQFKNSQVSLYGSIRPTLSYLDDDQDKTWDVRDALSRVGIKASTEFADGWSAIAHGEWSVDIANSGNFGKARLAYAAIASPYGQVGIGKQRPAQYTLVAEYVDIFNHGNSPYAYDHESPFFVDNFVTYKLATGGFTFMAGAQVDGNSGDTGADMVNLGVGYDLGQLHVGLGYVSQNTQTDAGIEGDDQTIGGVVAYTFSNDLYAAVSYQDKQYNLDAFSQDRSGSTLDSALAYPIAKNYKIKLGYFLFKDGIEGNTSADYDGFNTTLEWNPISNVRVHLEYLAKNSDHRADDQALTLGFRYDFNLNWKG

SEQ ID NO: 8337 - protein, 285 aa, Shewanella halifaxensis
MKNVKTLALAATAVAAISGNAFAADRTDLHGTDYKWMQFNAMYSIGEKPESPAAGDQHNYLEMEFGGRSGVFDLYGYVDVFNLANETSSNGDKNPGTGKSKLFMKFAPRVSIDALTGKDLSFGPIQEVYFSTLFNWDGNVGEGVNSTFWGVGADVNVPWLGKTGMNLYGYYDMNAKEWNGYQFSANWFKPFYFFDNKSFLSFQGYIDYQFGADEAYWPVVENGPLVKGKSTNGGNVFFGLYWHSDRYALGYGLKGFKDVYLLTDDGATGLESTGWSHYLSATYKF

SEQ ID NO: 8338 - protein, 776 aa, Shewanella halifaxensis
MSVGSDRSGTRTARRNYLAACATGALLISSAGLDASHAQQSRSSNPDLPPVVVQQDGNVRRSPAAREARSAASRRSPRVARTTAASPPPASARQTDPGISVPGLNGYIAIATSVGSKTNTPVLALPRSTSTVTAQEIFDRDAASVQEALQYTAGVGGFFRQGNLTREYNRVRGFEAFQYLDGLKLHDSNWGFERYGLERVDVLKGPASTLYGQGSPGGIIDLTSKRPTETPFGEALLRMGLRGYLEGAFDVSGPANENKSVLYRFVGVGKMGDGEIDFTKNERVFFAPSVTIRPNEDTSLTLLASYQYDPHLTVLQPLPYVGTVVPGANGQFISRKTFLGEPNYHDTSKESYRIGYEFKHQFNDIFSFQQNFAYQNIDISLREVQSRSTGNVSTQRQMAYQQYNIDIFQIDNRLKADFETGPLRHHVMFGVDYASIPNYQGTGTNRGTSNFLLNYYAPIYGAALPNNPLTTKRYQDLEQIGVYLQDRIELGRLSVLFGVRNDTAHFAQQSQTLVPATGNFTQPPWTRQNDNATTYQAGAIYAFDSGVAPYVNYSQSFAPTIGTDFSGRPFIPVTGDQIEGGMKYLPPGMNLSISTAGFNITQKNVLTADLLHPGYAIQTSSVEASGAEIEVKTTRLYGFNSSAAYTYLAPTVTATNTAGGIGKDPVSMPRHAASLWTTYSFEDTSVLAGLTVGGGVRYVGSSFADTLNTTEIPSFTLVDLSLRYRLGAISASLQNWDVALNVKNLADKRYVGSCDAVSQCYYGLGRTVDGTIRVRF

SEQ ID NO: 8339 - protein, 386 aa, Shewanella halifaxensis
MNKRLFALAAACACGAANAQSSVTLYGVVDVNVEYVNHVGAVPQAGNGYNPGPPQTVFRENSGGYSGSRWGLRGVEDLGGGLKSIFVLENGFNADTGTLQQGGRMFGRQAFVGLDTRFGVFTFGRQYQSIFSTMANFVPARYATQYEPTGVVAGANFRQDNTVKYSGTFGPFTAQADWSFGVGTTLPSTYPTVPTAGGAGEVPGQFRRDSAYGVALSYLAGPVGLGIGYDQWNPTIGTGNGTFKKAVVMASYAFNDTAKLMGGYRWGQNKDPGGTTILRDDFYWIGGQYRFSSALDFTLEYDYQNVKNLGGNNGVANPWQIALIADYAFSKRTDVYLTTAYSRNAGLAMESAASGFATSLALGNSYALANGQKSMFGAALGIRHVF

SEQ ID NO: 8340 - protein, 459 aa, Shewanella halifaxensis
MRIFTLTALALSISALSTVAQADPQSQAYIPLTLKGSSEQAQASGFIDGQSLSGSTRNWYARERAARAPLWKYYKSDGTRHPTHSRENWVQGSILNYSSGFTQGTVGIAVEAAGYNAIALQQSREAVAGPNNRTLTHSDGDPIGQWSKLGLGNIKARVSNTTLTLGRQSVDTPMIAYIGNRALPSSFQGAFLHSAEFDNLSFDLGTFDRVSPRTEQSLSKFRSEYSATGVETDRASTAGINYQPFKSLSTSLYATKVDDFWNQYYFGANHVLGDSAVLSLSTGLNYYKTVDAGSQKMGKIDNDTYSLSFDLTHQAHTLGASWQQVNGNEYFDYLHETNGIYLANSLLSDFNGPNEKSLKISYVLNMAPYGVPGLKFNLYNARGWGIDGTHYRGTAYDVNGLDGETHYEWGIGTSYAVQSGPLKDTSIRATYTTHRASKAQGDGSLDEFRVVTTIPFNIL

SEQ ID NO: 8341 - protein, 346 aa, Shewanella halifaxensis
MMNKTLIALALIGTCGYANAADVDNTWYIGAGAGQSNYESVDAASHLGDGSDLAWNALVGYQLNKYLAFEAGWQDLGATDDTHMWGGLDGSQKIDVDGFTLGVVGTLPLSEKWFLTGEAGAYQYHLAHQMSADKYVSAMDTAPYFGAGVGYNITDSLAISAKYRRFAKIDETAWNTANMDAQTVGLQLTYRFGVKAATTTAVVLPAVIEKQTKPMPRPEPKPEPKYEIHTEKSSVAVLFGFDSSELNSTAKAKLDQVIKLSKSKDQDVILLNGQSDNQGDSQYNLKLSEKRVQHVEAYLVSHGVEVKKIDTQAVGEQDAHANLRKDRALERRVIVTLTSQEKVQAS

SEQ ID NO: 8342 - protein, 751 aa, Shewanella halifaxensis
MNNKLKIVGASLLCAGLHSIAFAEDTQQQQNKGIVQFSKLKISGAEKQTPLVKALEKPGAFSAVGTQNKLEGLDKIIRTMPGTYTQMDASQGTVNVNIRGLSGFGRVNMMVDGISQTYYGISPSNYTHGQQPNNDFGALIDPNFIVKVEVEKGQLNGGESVNALVGSANFRTIGIDDVIFDDNLYGLRSKARWGDNGLGYNGMVAVAGKTPVNTNDGYLGGLIAVSGHNIPANYKNGAGYDSDDFATDHTFKQKPQSQLTKLKYKPDDSHELEFSGRFYQNKLTRRKINSEDYYLKYKYTPLNELIDTELIISHGESKQTFEGDSLGWALRQGESKNNADGINLANTSRFSYGETDYEWKIGSKLLKNKYERKVSSVSDQNTIIYNQFSPSGTLDLMSLYTQFNAKYDIYSATFNLNYAHYKLKGFKPACDDDVKCFPQGDASINLKEGGFNPGVLLSAEIIPEFQPFVSYAHSMRAPNSQEVFFSQNGGNSMNPFLKGEKAQTWQIGFNSMRPDLIVQDDQFTMKALWFHTRIKDYITSKPYLLCRPRTYAEFTWCLMNESVWDKEFPDFMQKSYIYMNDPREVNLRGYELQANYDAGVFYSTLSYTKETGDQPNSIASVADFSAGDFTELPDYYLTLDTGVRLLDEKLTLGSVITVTGPAKRIGVESLVDNNGDALKDKYEKQPTVIDLYADYEINKNVTLMFTVNNVANEVYSDALNRSNSTAIMEVRGNNNATARGRSYMLGGVVRF

SEQ ID NO: 8343 - protein, 656 aa, Shewanella halifaxensis
MGTQPSKIALLLGACLAGSFPALAESSGTPGPVDETITVIGRTENTPINIAANVNVIDAAAIELSGATNLTELLRGQSGIQVSDSNSGAVFAMRGFSASQAVNNTLILIDGRRLNNIDIAAPSISAIGLNQVERIEILSGSAGVLYGDQAVGGVINIITKAPKDNGGSLQLSGGSFDTFEAKAEGSVAINDNWRLYGAANHLKSDNYRDHNASKTSSVLGRLQYDDEVQQFLAEASHYDNHRELAAALNDDQLKQNPRQMGDLKQGDLFIDAYLHEMTTAARTGYQRQLNEAWALGADLNYSDTLTTGLSTWNTSRRDTRSLLEFKPKAVANIKTDIGELKLVTGLDLSRGEATFSNRSNVQKLASAYLQATVPLTESFSYVVGGRYAEVTDELVDASAYPNGIDLDQDAHAFELGLNYRPSQQHRFYLRADDNFRFAKVDEQAYTPESIQGLKPQTGRSYEAGWDLLLERNTLRLSAYRLDLEDEIVFDPSAETPAGGSFPGANVNADASRRYGVSADWDWQATQDLLLGLEYNYIDAEFTEGANEGKALSWVAKNTGRGYVSYDVYEHLQLFAEAVYTGERYMEGDNANQGDKLDAYTLANIAINYSRDAWLASLRVDNLLDKEYVSSGYFSTWGSGYYPGTGRALRLTASYRF

SEQ ID NO: 8344 - protein, 869 aa, Shewanella halifaxensis
MNRPSKLASAIKFGLIASVSTTAFTVSNTAFAEEVGADVERIAVTGSRIQRTDMETASPVTVIDASAIKASGATSIDEVLQKMTATGGAMTNPGVNNGSQGGASINLRGLGSQRTLVLVNNRRMVNSGTGAASTVDLNTIPVSMIKRVEVLKDGASSVYGSDAVAGVVNIILKDDFEGLELNVQSGISGQGDAEETSFDLTTGGNFDGGNVVMGIQYMKRGSASQADRGFSECPLTESGGELVCAGSVYSENGHLYGPDGDYQGNPDGSWDEYNHVEDAYNYSADSFLYTPMERLNFTALANFDLTDDTTLFTETMYSKRWSEQQMAPQPIYTEFKYTEAMGDSLLEHGINYGDDLGYARRLTEVGPREFSQVVDTARVVVGLEGMLDNGWTWDTSVNYGRNDSVDRLANLVNMGSLNKDISEGNFNPLDQTSWSSDNMDGYTYTEQNTGGSEMFIVSGNLSGEVMELPAGYLGFASGIEHRKEKAWFIPDSLTAQGLANDPKVDPTEGEYDVNEAYLELAIPLLADLPLAQQVDLSAAVRYFDYSTFGSDSTWKLGLTWKMTDDLMLRSVASTAFRAPSVDELYSGSATSFDKITHPVTGEKSYQAEVTRGGNENLTPEEAETFTVGFVYSPSYLDGFSVTADYYDISITNSIALVDSNYIAEQCMNSSGEQINTDTALCQSANITYDPLSGKIKFNNQLQNIGAEDTSGIDVNLAYTFEVLGLDWRTGLDTTILLENVSEISGQSIDYAGYITSGMGSFAKVKSNFDLGVQGADWSANYQARYISGMDSYDCQAADASCLAPTVGSVVYHDISGSYYFNNGLQLSLGVNNLFDKEPPYYSGNNDANTDPYTYDTLGRYFYLQASFKI

SEQ ID NO: 8345 - protein, 682 aa, Shewanella halifaxensis
MTKKPLVIAMAIALSSTAISAETFAQQAESVAEFDEVLVTATRISEKASDTSRSLVVIGEEELQQLQPASVAQALKNEANINVSNGPRASSQGIEIRGLGGQRVLQTIDGARQSTTSGHRGTYFMDPELLKSVEVIRGPASSLWGSGAIGGVVALNTKSARDMLDEGDTFGGYLKQGFETNGDKIKTSGAIYGVADKFDWLINGSYNDSNNIKMGNDQTLENSGSERTSGLMKFGWEPSEGQRLQFSGRFSDTDELVPSNPAAEVGRSVPLIQRKTQDKNLTLDYGLNPTQNAYLDLNGTLYWNGTDYDEDRVTKGQIDSTEYETIGFSVNNSSIFGATRLVYGIDGYQDTIKTVRDDSGQAGQRPEDIDGKTTVWGAFAKAEIGLSDTLSLEVAARYDTFENESINLGESSDDNALSPSLGLVWKTTDWLTLSARYDEAFRAPSIEEMYSTGTHYCIPPIPGFLPNGLCNTFEITPDLQAEKAKNKEIKVDMRFSNLAGNDELAITLNVFRNDVDDFIEQSVSNPLMGIPGLEQTTSWDNVDEAKLTGFEFSTRYRYEQTRLMLNYGQTEGKNNSGEYLTNIPAKKLVADLSQAVMQGDVKFGTRITYVADQEQMPESYGEVYDSYKLWDVYMAWEPAMGTFEGLRVDFAIENIGDEEYRQAWQNLYDQGRNFKLSARYNF

SEQ ID NO: 8346 - protein, 385 aa, Shewanella halifaxensis
MNKKLLALLIPSILIAGSAQAVEIYNDQTNSINMMGWLGFAAINDTHDTAVVDNFSRVGFRFDRQEKNGWRSFAHTEWGINMVTSDDSLSYSGGQLGAEKNSDFLFNRLGYVGLANDKWGSLTFGKQWGVYYDVAYTTDVLNVYTGYSVGAYTFGDGGLTGAGRADSAFVYRNSFGNLSIALQYAAKQNGDVALYDKDGIALDDGSHVEFDTSYGASLTYHFTDKFKVLAGINRGDFTGELAGERVDDTNEIIGVGAQYGSFYQYAPNREADGFYVGFNAHKSKQNELVAGELYDSTGSEFLIAYQYENGFVPSFLLSYQDLDTDASTTIQGDWTRQFAVLGLHYRYSNDTVMFAEAKIDFSDMDDKSFENLQDNSYAVGIRYFF

SEQ ID NO: 8347 - protein, 384 aa, Shewanella halifaxensis
MNNKVFAAATLAVFATAAHAQSSVTLYGVIDAGISYVNNSKTATGHDNLFKYDDGVAQGSRWGLRGTEDLGGGLKALFVLESGFNSGNGTLGQGGALFGRQAYVGLSKDGIGSLTFGRQYSFSTDYLGGNYSTGGQTVAGNYAYHINDVDQLTSSRINNAVKFSSANFAGLTFGAMYGFSNQAGAFAGSPTVGTTAGSSRAYSFGVNYANGPFGVGAAYTDIRFPAQSTPAFSTAMANVTTGTVRDLRTFGVGGRYTIAAATLWALYTNTRFEPITGGTTTFAAYEAGAKYAFTPALTAGAGYTYMHLSNANRGHWNQADLSVDYALSKRTDVYALGIYQIASGHNAATGDVQAQIGSSTSYFSTSGTGSDNQLAFRVGIRHKF

SEQ ID NO: 8348 - protein, 381 aa, Shewanella halifaxensis
MKKTLIITALCSGVVTVAHAQSSVTLYGLIDAGVTYTNNQHGHSAWQQSSGADNGGRWGLRGAEDLGDGMKALFVLESGFNINNGSTGQNGRIFGRQAFVGLSHNEYGSLTVGRQYDSVVDYLGPLSLTGGQYGGTQFAHPFDNDNLNDSFRISNAVKYQSVDYNGLKLGALYAFSNSTSFSNNRAYSVGVSYSYQGLHAAAAYLQVNNDVNALSLDATDAGAVAGDWTFAAGRQRVWGTGLNYTYGPATAGFVFTQTSLNDSRAISAGQSGVAGGITGLSGTTRFNNYEVNARYAVTPAISLAGSYTYTDGHLAGQNPSWNQFNVQAAYALSQRTELYVQGEFQKVNANGLDLGADIIGVGSASSSNKQVAVTAGMRHVF

SEQ ID NO: 8349 - protein, 354 aa, Shewanella halifaxensis
MKKTVLSASIISTLAITSFSALADGPNFYGRADLAFTNSDLGVATQNQKSGTIIENNFSWLGVKGTEKINENFEVIYQMEFGVTNFDNSGDTFGARNTYLGLKSVAGTALVGRNDTVFKAAEGGFDLFGNTNSDIDLLAAGQSRSADGISYYSPKIADLVTFNATYLVEDNYVSYDETTNDRIDAGNMYALSATIGDKALKAQNYFVSGAYTDGIDDIKAYRGVAQVKLGDVILGGFYQNSEHLDDKYSNLEGDTYFVNAAYVMGNLKLKAMYGNDNSGLGKYVSRFVGNTEGGAMETVSNVDLQQFSVGADYRVSKSTLFYGHYTKFDGDMVLNSVTQSLNDDIITVGMRYDF

SEQ ID NO: 8350 - protein, 944 aa, Shewanella halifaxensis
MTSISRLSKAVKVALLATTSAALMTSAGAYAEEQEGDGIERIEVTGSKIKRIGELSPTPVTVITGADMMDMGITNVADILNKLPSSTVGISPETSNNTIFANGLNQTNLRGLGTDRTLVLVNGRRFVAGSNGDSAVDLNTIPTAMVSRIEVITGGASAVYGSDAIAGVINIITRTDVQGVELDASYIQPEQSGGEESQFSLTAGGNFLDDKLSTVFNFTYAEQQELRNTDRDFLDNPVTSIYNPDTSEGAPARIPYEGRKPLSWINEAGTFFAGDGGQYTFGSDGAMREFDYGEGLIPGPGTNGNYCGPSCEGYDPVDYGLVRTPLERMVFTLNTDFEINDNHKVFTEITYVDYTSNGESTPVFHTWNPIMADNAFLPQETQDLMADTDMEYFNLYRIDGEFGNRTYNQDRETMRFLVGLEGSISDDWDYSFHAQRGQLKETTLWKGQIWDERYEQAKDAILVDGEIVCRDTDARAAGCVPMNLLGVNQASQESIDWVGTSAGQTAKTTQTSAGLVVSGALFDLPAGYVSAAFSADYRKEESETNPDQALIDGTIFGNSANPMKGEYDVTEFAAEFNVPLLSDMFLAHDLALDLAYRWMDYSTAGQDDAWKVGLNWAPIEDLRLRATRSKSVRAPNIGELFSPAGQTFESFTDVCDKINVELGPNDNRKKNCQASGLPEGWNPSDSWYLSNHPGSNAGNPDLKAETSNDYTVGAVYTPSYLDGFSITVDYWAFEISDAIQYIGVDTAVRYCYDSESLDNVYCDRFTRDPVSGDIVDFVQSPVNSASFDVKGLDIEGQYDIPTDSFGDFRVHVIATYLEQWQTNPTGFAEDLQVDVGEYTDPRWKAMFSLGWKYDALSLEARSNYRHSAVASNDWKPENNNYNDIPSHTVWDFTGSYAFNDDLSLRFGVLNAFDIEPPRNPYVYDGAGYYDTTGRAFFLGANYKL

SEQ ID NO: 8351 - protein, 175 aa, Shewanella halifaxensis
MKKALAALIALALPAAALAEGASGFYVQADAAHAKASSSLGSAKGFSPRISAGYRINDLRFAVDYTRYKNYKQVPSTDFKLYSIGASAIYDFDTQSPVKPYLGARLSLNRASVDFNGSDSFSQTSTGLGVLAGVSYAVTPNVDLDAGYRYNYIGKVNTVKNVRSGELSAGVRVKF

SEQ ID NO: 8352 - protein, 731 aa, Shewanella halifaxensis
MSHRIVPARALTRADIRSPQLPLAYSLLALALACAWPLAAAAQSSTRDPVDLDRLQIEAHRGAATEGSDSYTADVARSSTKLELSLRETPQSVVVVTRQQIVDRNLQSLQDVTDTVAGFNSPTWDTERTYITARGFEVDYYRIDGIPTDYTGDVQQNMAIYDRVEIIRGANGLTTGAGSPAASIDLVRKHADSDVFTGRVDLSAGRWDRYRGTVDLQSPLNAAGNVRGRVVASDEDKQSFRDYYSKQSSLFYGIVDADFSDATRGYIGVNKQRNDGRGTTWGGVPAYFSDGSRTDFARSDSFTPRWARGVADTTNAFAGLTHRFDNGAQLHVEYSHQRFEADWKSVLFGYFDYPDRETGLGLSNTFGGRYPAITAQNSLDAYLSVPLTWWGRNHELVAGATWMNRNVRSWSNGPQPPQVLTAESVYAWTGSMAQPQWTPLVKGEERDVRQVAAYAAGRFSLTDALTAIVGARVTDWKNTDQLVPANTYERRGRTTPYAGLILDVDDHHSLYASYTGIFKPQNNRDRSGRYLAPLEGNSYEVGAKGEYLGGQLNAALALFRIEQDNLAVNDPGQLVPGTTNQAFLAAKGTVSQGVEFQLDGQLSEQWRIAFGFAQFDANDASGVDVNPTSPRREATLFASWQTGPWRVGGGLSWQSAIHELMSGPLGSTQRLTQGSVVLANAMARYDINQAWSAQLNVRNLFDRKYYANIVYQSQLIYGDPRDVELTLSWKF

SEQ ID NO: 8353 - protein, 921 aa, Shewanella halifaxensis
MMKIQMKGISLMIILLMLALTVQAAVLRGTITDKATKEPLIGAAVQLSGTNIGTITDVDGNFELAGLRNGTYKLIISYVSYCTQIVEVTINGMFEIKVELEQDNQQLGEVVVVADAKKNTENAIITQQRTSLVMQTGVSAQQITKTQDKDASEVIRRVSGISIIEEKFVMVRGLSQRYNNVWINNSAVPSSEADARAFSFDIIPSSQLDNMLVVKSPAPEYPADFSGGFILVNTKDVPSSNLFTISVGTSLNDQTHFKKFLYNKGSGTDFLGFDNGFRSLKGGINAVLNPINNGYDLLNNGLNNDWTVKDRRPLADLSMNMNFSRRWVDSSGRTLAMLGTVNYSNSYKTYLDMDNNLFGAYDTTHDCSNYLRKSIDDQYNHNVRIGTMLNFTYVPASGNSRYEFKNIFNQLGKDRYTYRKGTDAQSDYEESAEYYYQSRTTYNGQFTGKHTLGDADKLDWSTGYSYANRNMPDRRRYTTVLNEETNQLEVENLNEINREFSRLDEHILSANINYQHDFSFGIFTPSLKAGAYTEYRAREYNTRFFIYSWKNGLPSAYKVMNVPNELLQEKNYGENGLYLLEQVDWRNNYEGNNLLSAGYVGTNLPLGKLNVYAGVRFEHNRMELVSHTQKNEESPTSVFYTYNDFFPSVNVAYRLNDKQQFRLSYGRTVNRPEFREVSSSVYYDFDLASNVQGNYNLKPAYIDNLDFGYELYPSSGELISVSLFYKRFKNPIEWTYTVSGGTDLIYSYVNAKGADNYGVEVDIRKNLDFIGMRNFSLSLNGALIKSKVKFEPGAKEEDRPMQGQSPYLINAGFFYQHADSGWNAALLYNRIGKRIIGVGRSLGTAGNEVRVPDSYEMPRNAVDLSVSKKIGNLEIKVAVRDLLAEKVSFKQFEETRHGKVEQITRQYKSGRNFNLNINYTF

SEQ ID NO: 8354 - protein, 895 aa, Shewanella halifaxensis
MIKTNKMFLTASAMILSVSAQAFTLKGVVVDNSTKEPLIGATVQVGGTTTGVITDIDGRFEIKDIKGKTCTLIVQYVSYKTQEIVVEKGQKDELVIALAPDNQQLDEVTVVARKNLENERSLMMERQRSSVAIENIGAKEMSTKGISNVEEGVKKITGVSVASAGQIIVRGLGDRYSTTTLNGLPIASPNPDHKLIPLDLFPSSTVKNITVSKVYEANSFADYSGAHIDIGTKEQTGEDFFSLSFNTGGKFNTLGKDTYQMDRDGTLFKTPSLDNKLRDMSLVDFEEYAGKNQLFNTSFDVSRSKSLPEFGGNVGFGKNFDINGNTLSLLASMGVSNEQQTMLDASVRTLEATGTTLNDFSYDSYSSELKIAGLGSLGYSFRKQDQLNYTFFYARNAIDNYMLREGYDYEDHNLIGSNNVTHVYTLQNHQLGGKHFFGDKWSMNWSGSYSKTSSDEPDRRQIMFIREGSEINLFKLNRQETMRYFGVLDEKEWVGNLSGDYKFGNQNKLQAEFTYKDKTRDYSSTRFYYNLNKLNPVIGGEEDIYTPSGFLNQEAIESGLVSISRSQQPKDSYTAGNKIYAGYILADIYPVEALLVNVGIRYESSKQWVNYAEDGGKLQRRDLNSNDLFPAMNLRYQLDKRNSFRFSFSRTVTRPSFIEMAPFLYQESYGSAQIRGNADLKNGYNYNLDLRYEFFGENGDMFSATAYYKYLEDPIEQIQQLSGGATIHSFQNANNGMAAGLEVEFRKELIRDLRLGANASFMYTDVKLPEGGAYTNTQRALQGASPYLVNADITYTPRLDDVKQLSAALVYNLQGPRIQSVGISGLGDVKQQPVHTMNFVSSFKFNEKVSLKLQINDLLNQPVVFKQEVPSTGEKVEVERFKRGSSFEIGVTYNL

SEQ ID NO: 8355 - protein, 412 aa, Shewanella halifaxensis
MVKLPLKALFCASCAIIASAGQVYAGGLERGGYNIDLLFNPDRFATEATTIYVMPNRKLNNVKDSSPWDGPVGGGRTDGVKESEAYWVPRIGLKVGITDSLDCLLDYSQPWGAHTNPGRNWAGANDNTETKMNSDGYSGTCSYKFDVSEKAQLRLIGGVFYQAMDGFKEQLVAPIPTNPFGWNGIGRLTLEADGWGWRSGVAYEIPEYSLRASLVYNSEVKLDEITGTLNLKGLPPGAGGNPLAGGSWDVNGSAKLPQSVELKMQSGIAPGWLAFGSLKWTDWSVLQDIPFYYKGVRATSLDLLYRDGWTVSAGIGHKFNDEWSGAVQISWDRGTSTTIGNQTDTWTLAGGASYTPNERVELRVGGLIGVLTGGEVSNEIVNPATGRPYLDASYDFDDDIVSALTVSLKVKI

SEQ ID NO: 8356 - protein, 314 aa, Francisella philomiragia
MKLKNIVIATSVLFGTATFSFAAGSDNMDMSADTNTPVTQSSSSNSFIAPFANTYSSLTNKNNTWGPQDRTGQWYFGVDANGLAGTPNSPSGAGANMTIGYNVNKYFAVQYNQLVGRVFAGLGEGVINFSNSTMITPYAAGGAGWANLAGQATGAWDVGGGLKFELSRDVQVSADYRYIQTMAPRGMSGAQGRAGTNMIGGGITWFFGGKDDTTNDTGNIQDNGATTAAETTAMPTIDETKYVLPQGIKQCEGNFNLTKEGVACYTVNGDDVTVYLDTKFAYDSANLNSKGKEAIASFVNFVKNSDIKTVTVKG

SEQ ID NO: 8357 - protein, 398 aa, Xylella fastidiosa
MAIRRLRTIFVSLLLGLAASATQAADRSDRNVTAKLEGRFEWDFALFDNDTRGTPNRSNNEIRRFWLDVTGKVFSFDYTIEGNFTNLQDKFKGKSIEMGDVYLRHDFGNTGTLTLGQFKQHFSLDDRTSPDYGQFLERSGGANTLAPEYHKGVSWKATHQNTTWWVSAYSLDSISLSNVNGRGLGGRGTWSPETPEGDVLHLGLSLAHQRYDHPGSDGMTALSIRPLPAGHLSDNSGITLAHFANGRDTKVNRWALEYAQVRGPLSWQSEYIGGVFNDGMQRATVQSAYGFVSWFVTGESRTYDRKTGRFTRIKTLHNPRGALELALRYDRMWGNQHHNNQPNFLNASTASCTLGVNWYIKPNLRLMLNLIDSRNRDRLAGTILDHTRALTGRFHYDF

SEQ ID NO: 8358 - protein, 389 aa, Xylella fastidiosa
MRPIKFLFTLCLTSTASAAVAGDFNHWPLQYTFGNATEASLTGNFAYDYNNFSGDDRLKDRSFMRRKELGISIKKKDVYDAAVAFDFQSKLWLDVFFRFETKALFDQDYGRIRLGYMKTPVGMEALASSRAGSFMETALPVQSIYEGRRTGVEWVLERPQYLLQTGAYGGKDLQGDNPGTTQAIRAIWTPFKTTGDVLHLGVSYSQENPRGYHNGSNVSFSPRTRVRARPESGLTDVRLIDSGTLVDVDKIQRNGLEQLWIHGPLLVQSEALHIKVTRNNGLSTYNGNGQYIYGSWVLTGESRPYTAGTIGNVTPKHDYGAVELLARYSRLNLDNGSILGGRQHDWTIGANWYLTNYFKFQANYVKVNATRLGTRTTPDIVELRAQVHF

SEQ ID NO: 8359 - protein, 964 aa, Xylella fastidiosa
MKNMKTTFFPGSILVLTLVAFLSACGGSGLVRPPTPTPTPTPTPTPTPTPTPTPTPTPLPALDPALAAKFRVHLDGTNTEPAHTLGFTGKGYMVGVVDSGVNRNHVTLHDKVIHNNVYVDYQDPASPDDVSGHGTKVAQLIAGQPVEYWPGGIAPGATIFSARVFSSAAESAKEGPIGGSFFERETTQLKRVNADMIAAGVRIQNNSWGYENQNTGDKQVWIDPAVTDGFVNVYRDLVLNNNGLVVFVSGNEAQPQPGQLARLPSLPTMEGGGSPADLERGWLVVAALDSLDHPDQLAYYSNHCGIAMHYCLAAPGDVVVIHDSVTNSSSVDDEYYKPLQGTSFAAPLVSGAAALVWEAFPYFSNDLVRQTLLGTATDLGAPGVDEVFGYGALNVGKAVLGPAKFDWGDVQVSFDDRRSTWGNDITGSGGLIKRGTGTLVLGGSNNQYTGATQVLGGTLQASSLGASAVSVANTATLIGSGRFGGAVSNAGTLELGKDGLKVQGDYTQLETGRLALYVGDQLSVAGNATLKGGELQVLGKRDYVTFNTSYSVLQADGSLTGTFSQLTWGPAVLLGEGRLTYGTNNAYVTLQRLNVSAAAQALGIVDRVAQASAQRIEQAFRAIDAQQAQGGGALPTSFIGAAAALQQSSSAAVAAASLQSLSGQSHVAAAAASLDAIDLGRRSLATRLDAPRSGERIVTWHQALGGPGHNGAASGTFSLSGWLVGHDAQLASGDIVGVAFGQADSSPSGSASGLRGIDRQVQGRVYLQRTQGPLYVLGQLGFGSFQRRLDRQLQLGDWNDWTSSRYSGQFWSGSVEAGYHWRQGALALTPYLGLDQTQLRTDGFREQSGSGFGLQVQSAQATRSQLLAGVRTEWRWGGVQWRGYGEWQQTLRQSGLNPQASFTATSSWTPLVASSWPGRSGGVLGLSMVLPVGVTAGLWTMGLEHYFGTRSRGESLGLRYQLGF

SEQ ID NO: 8360 - protein, 1083 aa, Xylella fastidiosa
MKTIDIKSNSRILHWAFYIFLFTVLSVGSVYASEDTPSVLSTNQSEKKTVKGNVMDEYGQPLVGVAVQVKGTSLGVVTDLDGNFSFSIPVDSRALLFSYLGMKTQEVSANKSNYKIVMVEDATQMEEVVVIGYGSQSREKITTSVTKLDKEALKNVPYANAASALQGTVSGVRVQSISGQPGAEPRIIVRGGTSINNPNGATPLYIIDGVMRANMVHIASEDIESIQILKDAAATSIYGAQGSNGVVIVTTKKGKAGKTRVEYRYNLTISDIGKKYEFANAEEFLTLMRKGMISPAKFGKATEQRLIGHLGYGTGNDLTNNTAFSTQYLTDENRYKLDQGWKSMPDPVDPSKTLLYSDTDFQDKIYRTGFSHNHHIEVSGGTEKATFNMGLGYMTNEGTVITTSYKRYNFSLNGSLQARDNLKISARTTYSNSFTYGSPLAADATFYRSPAASPTTKFRFEDGSLAPGAAQYLGNAVYHMNKAQREYDYQNLSIGVDADWTILPGLSFKPALSLFEVNSNNYTFWDAFWNGPRDYITTRNANADTYKWRQYQADAVFNYVKSFNEKHNLNVTAGYAYYFRKEARLAAAGRGASTDLIPTLNASSVPVSVSSSITERSMQGIFARIGYDYKDKYLISVSARYDGASNLGTNNKWGFFPGVSLGWHVDKEKFWSFMPENLMRLKLRASYGVNGNISGLGDYTAQGSYSVGSKYLGNAGITMGTMANQDLSWEESKTFDIGTDISFFNNRLNFIFDYFNRTTDNLLTNRTLPHSTGFGSIFTNLGRLQNRGIELEMNARILPVSSSIQWSLGFNASKVTNKILKLPDNGVENNRIGGEYIWDAKLGKHTWQGGLQEGGRIGDLFAYKMIGVYSTDEEAQNANEPIDNVITVPDKTKYGGDAKWQDTDGNGVIDSKDRVYVGNIYPDWTGGINTSLSYKGFDLYCRLDFTLGHTIYNFAKGFLDYNWQGDNNMTKDVVNRSWKEQGDKADMPRFYWHGDRGQQNAIRGSSLYHESGDFLAIREVSLSYTVPANIIQKIRLSGLRFTVTGNNLHYFTKYSGLNPEEGGQDNGRYAMPRNIIFSANVSF

SEQ ID NO: 8361 - protein, 1008 aa, Xylella fastidiosa
MKKSCSSQLLQIRRLLCYAFAVCLYLALPNAFAQSSNATLRGQVSRAQAGAVVLVTNTATGLVRRTTLLSDGTYGMTGLPPGQYTISVGGVSRTVTLSVASSVTVNLDAGVPISGDAKTLDAVQVTGQAIREVKTSEIGNTIALRQIQQLPQATRNFLEFADTVPGMAFNIDPQGRTTLRAGASNSSASNLYIDGVGQKSYVAKGGISGQNDSQGSPFPQLAIGEYKIITSNYKAEYGQIGGAAVTAATKSGTNEFHGETFYRYTNQSLRDRRPDEGETKVDSQTKEYGFALGGPIIRDRMHFFFAYEGKDNVVPRSVQADARAAPYVHFLPSYLSQQYGPVNLPFNEDLFFGKIDFEPTGDDRLELSVQYRDETQIDNIGGQNAADHGLNKINKDKRGSLRWQRSADAWSNELIFTRENARNNPNPMSIGNGFNYVYLDETDPNIGEYTFLSIGPDGGSSMQRRHQDGWSLQNDLTFTSVKWNGDHTIKMGVSYKNITLQSQDAASLNPQFSYAVSSSGVATTPYRVDFYSPYATPGQKALVETRAKQYGLYLQDDWNVNQKLTLNLGLRWDYEDNPAYTNFVTSQAFVAALYADDPENPGHPWANRLLPSGINVADYISNGHNRHNFNKGWAPRFGFSYDIYGDEAAVMHGGAGRSYDRNLFEQMAYETSKAALSPVAVYFQDPATHTCYHSDRLCVPWDPKYLNGIDQLNAIAGVSGSGELFIFNNKLKTPYSDQYSIGISNKIGSWLTDVTFQRVLSNDGLAMSLVNRYPDGRYFDAEGNAPWDQSVPGHKNTILGMNGLKQRSSQVLLSVEKPYSKESGWGVNVAYTHTSARQNRTIDEPFAFDKATIYEYPFVKSDAVAAHRLVVSGSMDGLWGMTFGAKVVLATPTPINTIACYGQIDPDGANCQQVGVIPPSSGKFLVGGNIWGYRTVDFQASKEFTVFNDFKLSARVNLLNAFNFKNYASYVYNSFGSDGRLQPDITINRIGDINYVPRTVTFELGMKF

SEQ ID NO: 8362 - protein, 216 aa, Xylella fastidiosa
MQKIILPTLLLAMSSSAFSADNTGFYIGTGYGSFSYDATEIKIDEVEEYQAMAGISSAPLENLIKSTSGNTLKIYAGYQFNNVFALEATYTDYGTSEGYITHFDKSTTTIEQNPTSLSVAMNIGYTFRYGIRPFVLLGVSSVTLNSSDVFLDSADESFIAIKYGFGLEYSPQYLRGVQLRVAYETDTYFAEIEGKNDSNIYAFPLNSVYAGISYKF

SEQ ID NO: 8363 - protein, 480 aa, Xylella fastidiosa
MNPFVSLTVASVTALFVASPAFSQEATQSATLDTMIVTGTHVTERTVVESQSPIDIISAAHLAATGSSELATALSRMLPSLNFPRPALADGTSGIRPAQMRGLAPDQTLVLINGKRRHLSAQINVNGTIGRGSSAVDLNTIPITAIERIEVLRDGASAQYGSDAIAGVINIVLKGATQDGSLAVEHGQYSAGDGATSKLSGDSGISFANGRGTLHLAMDISQQEQTNRAGPYQGSAPNTGNYPDIGRTAFIYGDPGVNAAAFSANGMFHVGEHVKGYANAMLSNRDITSFAFYRSRNHNGQSMLLAQRYPKGYVPEIEQNSKDRSLVAGLKGSTEHGLNWDMSYNYGSNHIGFHTNNSINYSLGVESPRDFYDGALEYTQHLLNTDFTKVLDWGLTYPVTLSFGTEYRYEQWNQSPGIPASYNGMTGGAQGFAGFSPLNTMHANRNNYALYAGLDGDLSEHLSAGVAGRFEHYSDFGNQT

SEQ ID NO: 8364 - protein, 770 aa, Xylella fastidiosa
MKNRLWAGAGALALAQAIAWQAHAEETAAAPSAVEEIVVLGRGEARQVQTVSGEELSLEAPGASPLKLVDKLPNVNLQAADPFGSYEWAARISIRSFNQSQLGFTLDDVPLGDMTYGNHNGLHISRAIAGENVGGVELAQGAGALDTASANNLGGSLKYVSRAPSAEFGGQVAGTAGSDSTYRGFVRLETGETPTGLRSYVSYSYNTADKWKGDGKQKHQQVNFKAVQPVGEGSLSGWLNWSKRRENDYQDMSLAMLERLGRNWDNISGDWDLIVRIAEIANNRGDTGVTPQRPQLGVTYPAPVISVDDAYYNAAGLRDDLVGAVTLDLPAGEAFKVRATVYGHNDEGQGLWGTPYVPSPNYAAAAATTDNAPISIRTTEYDLQRYGFVGSATLALGAHSVNAGVWYEDNEFNQARRYYGLNLAAPQRSFLDMQSNPFRTDWEYDFSTTTWQFHLQDSWRVTEQLTVNAGFKALSVENEGRTVFARTASLEKNGTIKAEKGFLPQAGVRYELTPDSELFAAYSRNMRAFPSSGTSGPFSSTQAGFEAIREDLKPEISDTFEAGWRFRTAGFQGVLAAYHVKFKDRLFAVPVGSGIVGNPSALSNVGGVTAKGFEAVGSWAFARDWSLFGSYAYNDSTYDDDTVDGNGAVVARTAGKTTVDTPKHLLKGELAYDDGAVFGRVSVSHLSKRYFTYENDQSVPSQTVAELAVGYRFSGSPLLEGLEAQVNVTNLFDEDYISTINSNGFPLRGDSQTLLPGAPRQVFVTLRKTF

SEQ ID NO: 8365 - protein, 902 aa, Xylella fastidiosa
MKFKLSIISSACLAAMLSASAYAEPGNFVGTLSDGNKQVYFEGAQVKIKELNLTTQTRRDGTFRFNNIEPGHYTIEISYLGAAPIVKTIYIEENKTLKDQFTLTESGNTIEDIVVYGQRAGQAGALNMQRSADSIKSIVSSDAIGQFPDQNVAEALQRLPGLSIERDQGEGRFVGIRGLDPNLNNVTVNGINIPSPEAGVRSVALDVFPSELVEGLEVSKSVTSDMDADAIGGSVEIRSLSAFDRAGESASVTLQASHNQLRSDTSPKVSASYSNRYKFGNVDDVFGVAAAVSWSDRDFGSDNIESNGDDEVEQRHYKINRERLGAALNLDYRPDFNNQYYLRTLYSQFSDTEFRQANAFTFAGDDSEVERSSKDRFEEQQILSLTGGAEHQINQWLLTYQAGYSKASEDEPEALNYVFKTDGFTLNSDLLGKIPHVEQQVGVSELANYKLDEIEFANNQSNDKEYSFRFDLAKDLTFLNYPSQIKFGSKYRSREKQQATQVTFFDGDFDNIDSDMFVGGSPDWGLGEFGEGLNKHALRSFFNSNRANLEVAQLDSDIESRGESFINKEDILAAYIMGTIDIEQLRIVAGFRYEKTQFSTSGHKVELIEDEYSDINQLDVNPWQVDRDYDYLLPSLNVRYNVTENLISRFAYTQTLSRPKFEESAAFQIIESNTVKDSDGVLTTEREASVGNPELKPFESDNIDFTIEYYPGGIGVLSAGYFYKNISNFVIYADVANQPQWQGFDEVIQPINGDKATLQGIELAWVKTFENGLLLAANATFSDSEAVTLLDGKRFETSLPNQADRVGNLTVGYEDEKWNLRLTMTHKSENLEEIDGELLRMEDSHQQLDFSSKYYINQKMNLYFNAINITDQPFYNYFSERNRNAQYEEYGRTFELGFTWKM

SEQ ID NO: 8366 - protein, 783 aa, Xylella fastidiosa
MIVMCCHNSTSTDHGSLRPPMPFIKSRKHLITATASSRHLTAAALLSSFSFSFSFVAQAQAIPITTLDKIDVQAEQLKRYSADKPTYGKYTQPLIDTTQTINIIGKTLFNEQGATSLTEALRNSPGVGTFYVGENGTTSRGDSVYMRGFDSSSSIYVDGIRDLGSITRDVFNLEQIEVTKGPSGPDYGRTSPTGAINLITKQPFLHNANTASISYGTASQRRITSDLNLIVSPDSAFRLNIMGQDIGVPGRNNVKNKRWGLAPSAAFGLGTSTRVFVNLQYINQNNIPDGGVLTIGLPGYSTPDSTRTQISAAPRVDSKNFYGTGSDFEHVKSSMTTVRIEHDINDKTKLQNTLRWGRNEQSYLLTSYRGNVENLITPDLADPSTWTINREIPIFKNQTNTILTNQTNLNLTLKTGPIEHNIATGMELTRERMQGYGISSSGRWPAANLYHPDPDVSGLHWAANGAYANGRTDTTAFYLFDTLKLNQHWQLNSGLRWDRYNTDYAALLCDPVRSRIYCNTTPITLNRFNGNTSGTLFGWKTGILFKPTKHSSLYINYAVSQQPPGGSSLDLSAKPQDANNPKYQPQTARTAEAGVKWNSSQEGLQLTAAIYNTQVKNDIVQDPIDLQYYQNGKKRVRGVELSAVGKITNAWSISAGFTTMDAKVKQGPSVSADGSPTLAYTPNQAFTAWSTYTLPFGLTIGGGARYVGEMKRDSKTAIGTPTYIKSYWALDMVLSYRLNEHLDLRLNSYNLLNKDYVAAINKSGYRYAPGIPRAFLLTANFHF

SEQ ID NO: 8367 - protein, 1040 aa, Xylella fastidiosa
MKTFSKYTPALNHLALALASTLLLIATYTANATAAESEHSTNEDSKAAPHDSKTTELDRVVITGSRIPRAGFDTLEPATVVNRQYIDSFGFTNVADALFSQPGFNSSASVRGNQAGFGAGVSFLGRFGLGSNRQLTLVNGRRLVTSNPPTVFGPGDGGTQVDLNVIPTSLIERTETIGVGGAPTYGSDAISGVTNIILKKNYEGAEVNIGYGLTERGDNARYNYSALLGSNFANHRGNVTIALNADDNAGVLGEARRYYRNGYSMQTNPNAAAIAQFQPGRQYATDGRVNPNIPFNTSNTDGIPGSVLIRNRRINNMTWGGLLYQAPAVTSVMPASTHAFWPKSRSIPAIRQTRQPCSPTTLGLTSAIAPPLGAMGWTSIKHTSHLTVDRKSVFMLGNYDITDNISSFFEGSYYTSKALELTDQSIYNAASFGTGNVNGSGDQSGALNFNIDNPFLSEQNRQALRNLGITDFRLSRASRDLVIGNSSTDTRLWRAVAGLDGHFDAGGHPFTWETSLNHGEGNFDYYNTGLIQQHFINAINVTRNSAGEIVCDSSAAGTTVDPNCVPLNLFGESVASAAARNYVTTPTHAKAQMKQTVFNANLSGSFIDLPGGKLGFNVGYERRREEGRFTPDEYQRLGLGRTVPTTGSRGTFTTNEYFGEILAPLVNPDAHLPGLHRLDLTAKLRRVNNTVNGWFTAYTYGLQYEPFQGLQLRGNKTRSFRAPSIVELYTSQQPRYYSIPEPCTPANITAGNRPELRQRNCEAFFAYYNGVNPGTFQEAPTTQLGSVSGNPTLENELAKSWTAGIVFQPEWAHGLRVAADWYNIKISNVITQLDSGDITSGCFDNETFNRNDVPNANRFCSMITRDPSTGVASSVRGEYTNGPYINFRGWTAEINYRFDLKELRWGGSGILDLGFYGYFPKNLKYTAAQDIPAEESVGTIDNSKRQFQWNARYLTGPWNFGVSANYKSAALYSLTNTVETRDYLGIPSYTSYDANIGYTFDKHSSLNLAILNATDKMVAFPYVYDGLGRRYMLTFNYKFH

SEQ ID NO: 8368 - protein, 1013 aa, Xylella fastidiosa
MLVTHARRNGAPQRSTGWLASLTAIAVAILAYPELSLAQGVQWGPSLIGAPTAWALGLTGSGVTVAFGDTGIDVNHPAFAGKIDPRSRNFVPNYPGGPIDPAEINHIEYDSVHHLYAVHGTHVTGDALASSTSLAPGIAYDAHVVVMRDLSFTIDAVDQAIDYFTGLAGVRILNLSYGGVTPSATGLLAWPAEAFNPLQAAAILRATAAGKIVVAAIGNDRTTDPVAARNARGIGLFPFMQPANAHAGVYDDGGHNFDFSALLRQPGLLIAATAVAPDKTLPIYADMCGVAASWCVAAPGGTIPTDPNGIYSTFPTYDVDHPSGYGYNIGTSEAAAFVTGALAVLQQAFPSYNSQDLAHVLFATAENIDGQAAVNATYGYGLIRLDRAIDGPTTLAAGAAVNLGSLHGLPTMTYWSQPLTTGGAFSKTGDGSLIIAGRTNASGDVTVSGGALGVDGTLTLDAGRRLIVQQGGTLAGFGWIVGDTVVNGTLSAGQLPNYQDLIANNGGTLPAGIPTSGTSAGTLTFIGDLALGSAATMRVNVDGDLTIPGGPRTFDKYLVDGAFTANGTLAPILRGIAGGTNSYTPALGSQFHFVTASGGVSGSFSGLSQPQGLASGTRFDALYGSNGITLAVTPVAYADLGSAGFAQTASQIAVGQVLDAIRPQAAARMSAEQAVVFPALYRLSGDTIALTLEQLSPTIYGDALMGWRNAWSQTDAAISEQLETRRGFRSGSRAQVATDPAGRTAWLTGFERSDTVGGGTGGYSDRLGGLAGGFDAPVSDDLTLGAAFGFIDSRTSATTGASVSGDSVQLQLYGGYRLGASFLEAQAGAGRFQGTATRPLPLYGMRPSAETAGTAFGGSLRAGLRFTAADWQIEPSIMLAGVALRQDGLTETGGGLLGLTLDAMSLDSLRSVSAVRTERRIVLANGWTVIPSVQVGWQHEYGDTSVDSRGALALAPSLPFIAGSAPIGRDAAVFGLRTALQTAGRIEAHVGYAATLQTDSYSHTATAGLRALW

SEQ ID NO: 8369 - protein, 927 aa, Xylella fastidiosa
MTHVAIDSHRYIPRNLLCASISGVLLVAAVSVQAQETNAASNLERITVTGSNIPRTDTETASPVQIVTREDIARSGRATVGEYLQTLTSDGQGSIPKNFGNGFAMGGSGISLRGLGAGSTLVLINGRRIASYGLADDGQKLFADLSSIPMDAVERVEVLKDGASSIYGSDAIAGVVNIILRNDFQGALVSASYGLSGYRDGHTPKATMTAGVGNLASDGWNALVSVDVGKSDGIMTSDRKDRKWIGTGDTRPWGYDLANNQQFLRGAITGKGTIADSSPVGAVRNPSNSQFSSLPGCSKFSSISPQDPGGGCLWDAAQFRSLTPDEKYANVFTRGTFTLFDTTELYTELSYSKKKSEFSNLPSPVSGAWGYPGGAVNASSGDGATVLAPGHPDNPYNLPARLRYAAFDVGPRVKENTNDFMRVVLGIKGSVASWDYDVSALHSQSQMDRKFTGYLRYSSVRCVLGNLACPAGVWNIGNGSETNPRSLYDFISPVLSAQAKTKLDVFDARVSRALADLSGGAMGLSMGVEYRRDQASLTPMTYTDIGDIISTGYSAYSGEEKVSAAYAELAAPFTKAFEATVAGRVDHYSSGNTAITPKLGVKWKPFDWFALRGTYAQGFRAPNAAESGKGGLASFASISDPVRCAAAGGGGAECAPRLVSVIVTPNPDLKPEKSNSYTLGMVFQPTSSTSMTVDGWQIKRTKEIAQIGTVDAINAGDVIRDDNLLKGVAGTGQLLGVKAKYVNLNATTARGVDTDVQHRIAMGGLGDLILDLQWSRMLKFQREEANGNISEYAGTHGNCDVSNCIGTPKDRINLGATWKLNNISVSALGHYRGPMENRLFKGGACVSHFADGSDAPNHCRLNAFTSVDLSANWQATEALAVFGSVQNLFDRIAPLDPLTGGAVNYNPLDSAGAVGRFFTVGARYAFK

SEQ ID NO: 8370 - protein, 453 aa, Xylella fastidiosa
MRKISLIGFVMLIVSIPTFAGGLLTNTNQHVAFLRMLARGASIDIDGVYSNPAGLAFLPSDGLYLSLNGQSAYQTRNIDMTFPLFPEDGHRRYYKGTASAPFIPSFQGAYKKGDWTISGSFAVVGGGGKASFDNGLGMFDSMIMGGLAASDKLKGLQQLVGAGAVSDLYTLNSAMDGSQFIYGVQLGLSYKINDWLAVFAGGRMNYFSGGYEGFLTATANSELPSIGGKELAGIELDCDQTGWGITPILGADIKLGKWNIGLKYEFMTNLNLENKTKMAEVRQNGIVMPDKGNPLADFKDGVNTPSDIPALLTAAVGYEILPTLRASVEYHHFFDKDAGMANDKQDHLKHGTHEILLGAEWDVTKQLTISGGFQNTDYGLSDDFQSDISFSCDSYSLGFGAAIKMTKHLTMNVAYFWTNYKDYKKVTESVLGLSATTYSRTNKVFGLGVDYKF

SEQ ID NO: 8371 - protein, 597 aa, Xylella fastidiosa
MTSNFTRSLLAFAITLTTTQGIAKPAFQQTIFFGDSLSDSGYYRPLLPNEIQAITGAFTTNPGWVWSQYVANYYGSNASPNGNGQSGNNYAAGGAHINEPSISILGEAPSLTSQTNAYLSAHGGKADPSALYTLWGGANNLLDTLTTPEQIHTIIGNATAAEISLVSTLKNAGAHYIVVAAIPDLGLAPRARNTGTTAQSTAAATAYNTTLFSGLKSVGLQVVPIDTFHLLQELITSPATYGFSNTTDTACTLQLPLCNPTTLVDANAPNTYAFADDIHPTTAAHHMLGQYAISILEAPRLQQVLTRSAQGIARARAYQVAWHLDGTPQQDGLHWWGSMRSDSQRNDSNDLYKSVAPAGLFGFDWHSGQIVSGGFIGYGRMHADFSNGNGTFKQKDTTLGGFSGWYTGPVWVNAQISYSLLNYDIKREVQLGPATRIHRGSPNGSNLTVALNASYEMGEGRLHYGSVAGLTWQKTKLESYTEQNASSTALGYPDQQLNSLLGRVGLQMRLEGNVVTPYLQVTYDHEFKKQQNQANAWLQTMPEVGIYSVPGLTFNRNYASIVLGARTKIGHLQSNVGLTTSTEKNARDVTLFVNGNF

SEQ ID NO: 8372 - protein, 730 aa, Xylella fastidiosa
MERKNHKKTTLATLISVLLMGGAGATYANSASISEKLDLATQHLDGAASTGEAISSDGKTIATSINNRTRAFLLSGDNWATKTELGSLKSDSSGTSIVRALSADGKIAAGISSVDSSSTQLHATIWSGDNWATKTTLGTLATNNGGDSVVYALSADGKVAAGQTAASTGTLHAVIWSGDNWATKTDLGTIRSDGAGDSMVKALSADGKIAVGSADSDIKTPVNGMYAGGVLTGPNSVRAIAWSGDNWATKTDLGTLRSDNLGAAVANAISADGKVIGGASHHYVTTEYYRSNDDQLATIWSGGNWATKTNLGSLRSDNSGASLVAALSADGSIAGGAALNDANATRAIIWSGRHWATKTDLGTLKSDNSGNSEVAALSPDGSVAVGTAAADSGSSHATVWKITYPAESTSTSDSTTNTPTPSQPSVVTVDADNTKKTLSRLGAETFSVMDLQRQGLTRLQQHCQIDAAGQSCWAVQTAISSIDGNRDKVAGIKLGHGFTETFSAGLSLDRSLSRSLPDSYLKNNGNLGAGLYAQWNTAFHGSQWYVRPAVAFNRYNVTVQRPVLENTEAGIGTSRMKGRGASLETGQTFKSDHSVLLGWHLGGRYNNVSRAEYSEQNAAFPTTYGKASFKRTSAYLGADATIPLTTNLKWMAAAEIDRALKNRDAVYSAQADYIGSFNHRAGIKGTIATLSSGLQYTISEKILLGLTLDVNQTAFGDIARGGTFTVGGHF

SEQ ID NO: 8373 - protein, 868 aa, Xylella fastidiosa
MYNHTIKLAFCISSVLYCSTSATAAPNTDAVTKLDTVTITGYRASLEKTQSIKHAANSIVDAISAEDIGKFPDSNAAESLSHLPGISVDRQFGEGEKISINGTDPALNRVLLNGQTIASGDWGGNPTDTSGRTFNYSLLSPEIIGLMEVYKTPEARIDEGSIGGTVIVHTRQPLDLPKNTIRGSIGYSYNDRSQKSNPRGSILWSWKNDSENFGALISATHDKQDIARAGIEFFGYTTGANIPPEATITGDGSTPTTAKVPAGINSAFFQQTRERNGLQGALQWKPNEQNEFNLTGIYIKGKYNNFSESRYICPACNNDLNKASAANVQNGYITTATVSDGTAGQPYAQLDANYRISTVTTNSLNLHHQWSGDKWVLTTQTGTTKATGGKDPEYLMKFLLQEGGYRFNYDGTHTGVTYDNNNASNWALKSGEQAGGLEYTRTNDQENYFQFDATRDLHWGPFNKLQFGYKYIGHKNGQTSRGNALFANQDILLTAFNPGMTPTGLYNGLGASGDLINWPTADLRSVLSYLNALPEAAFETKYNQQFSVTETTNNLYTQLDFDSGKWRGNLGIRYVDTKDNILYWQSTTVNDTVNYQPVKDSKRYYKPLPSLNIAYDLTNNSVLRFSAARVIARPRYGDLAGSFSLNSTSGDLTASGGNPNLKPYQSSNYDLAAEWYFAPSSMLSAEAFYRDISSYIVTTTTTETLSDPSNNIFNKPYTVTRPMNATGAKVTGLSLNYQHAFAYGFGLATNYTYAQSNSNDGLNLPYLSKNTYNVIPYWEKGPWAVRLNYSYRSKYFTQIGRLDSQVFTDAYKELDLTTSYKFNDWVTLNISATNLLNSTYYWYNEVKYAPIGMYKNGRSYQAQLNFKF

SEQ ID NO: 8374 - protein, 713 aa, Xylella fastidiosa
MPSFPSHPPARLRANRNLRAALLSLTALCAPAMALAQEENADVVVLDNIVITAAGFEQNIKEAPASISVITAEELQKGNFTSLTDALKEVQGVVTTGTANEADIFIRGLPGQYTLILVDGKRQSTRDSRTNGNAGYEQSFIPPIAAIDRIEVVRGPMSSLYGSDAMGGVINIITKPVADSWTGSVSVETVIQDEEGFENSRQTSFYASGPLIANTLGLQVWGRKFDQDASSISGGPGGSDDYDLGARLTWHVDDQNQVLLEAGRTQITAEDYGDLGYRDHDRDHWSLTHKGSFADLDTELSFSQETGERTSYSRTAAGAEFVENLRSPEVRNSVLDGKATRTLSWNGEHRLTVGGQFLRTEIFDQNPGAVAPGEEPRDEKFQGDEWSLYVEDEWRLRDDFALTLGVRYTDNEFYGGHVAPRIYGVWNATPNLTVKGGISTGYKTPELRSIIPGYAYTSGGAGCASNTPPSCAVILGNPDLKPEETLNFELSTVYEADTFTLSATAFHTKFDNKLQQKSVGRDTDGDGVIDEHEYWTDGPQYLGSDGELYYRRIIQNFNVDKAEISGLELAGDWDITSTLSARASYTYTKSEQKTGEFAGFPLARTPEHMASLRFDWMTPVEGLDTWLSANYHGSEIASGLRIGSNGREVEINGQTGRKYSPYTTVDIGANYRINEMATLNAAVYNVFNEEVLETDFNTVQEGRRLWLGLTASF

SEQ ID NO: 8375 - protein, 329 aa, Methylobacterium sp.
MVALPVYAQSGVTLYGILDEALQFNTNSQNVVHGRNVGGRQWNLNSLSGPSGSRWGMRGAEELGSGLSAVFTLESGINLNSGAFGQGGTAFGRQAFVGLRSREAGSVFMGRQYDSINDYVARLSFTLSGYGGIDHPGDLDNMGHQSHINNTIKYVSPNLRGLTFGGTLSAGGVAGSIAQNSGFSVGARYAQGPLKLGVAYEIYRNPSNIGAALNSNANAVSPTSTSIFESLNSGYLTGANPATTWQVGAVGGTYDFGAATLGLVWSNVRYGNIGRYNGATATFNDMEVHGIYRFGPALSAALDYNYLKGNAVSGDIGDQTYHQAIFRGS

SEQ ID NO: 8376 - protein, 409 aa, Methylobacterium sp.
MTIASLLLILPSWALAAPAGTSDYNQWRAQQNDAHYAIQLIASASESRLPNAADIEQVKAVNPSLDVIYQRKHVKGKVWHALLWGSFDSPERALQANRGLPDSLRNDSPWVRKISSLPAREATGSPAPAPAPAKKTRSSGGLQGELAAMLLGNSASSAPKPAPPKPSARRPKAQAAPAPKPRVRRPDDKSPRAPSHRLDTSGLSKNPSVLRDGAPSPSRKYTKPTLLPPGNYTKKGWENSLAGDDHPSEEGLETYIPRQGTYPYARFEAGQISYDATPEPTGTQMHFNLGLDVGYYVATELGYTSASGIKANGGPEIDLSGLEASLLFKLPIDGELYRQWIPYVQVGLFDWETEGAATTSDSDLFIGAGLDYKLNTHWAIGLRTKQYDFSAAEATATTLNLSWRWQGRN

SEQ ID NO: 8377 - protein, 344 aa, Methylobacterium sp.
MTLYGRIDGGVEYLNHIATPNGSATRWSAEGGDWGTSMFGLKGVEDLGGGMSTVFNLETAFQVMNGRTGGGRLWSRRAYVGLKSDTWGQLQAGRNLFIDSDGVWEFDPFVQQAFSSASLVRGRNWQQTSNNIEYHSPVIGGFDVQAQYAFGNQSRGFNYGAADDFGRSDGIMISYHSPVLDVRGIYDELRDNNGKFSNIFTASREYFVGANVKISKFKIQGAYTHYQAPDSPAGVADRADHYWLGATYAATPQWAMTAGGYYVKVGDGGGDASHDPSGHAIMYVLGTTYNLSKRTFLYGTVAYVRNGGNSNFSLLATPRDASPNTSPMTGESQTGAYVGMMHTF

SEQ ID NO: 8378 - protein, 723 aa, Methylobacterium sp.
MIVNKLSIFIYNYTTKVRHYINCIYHTCVSYSQIFRSWLWYRRQLRIGLLFFLYLVSVYGLSFSKSPEENEEEAKGRQRVQAMELSFHNAAISQEVNETVSSMEAELEEESAYATELEILVDETVKTFFETTDIVTDDVVSVMLQGIDETASDLENSEVRARKNLEKLKQLTEHKKFLIGQNKLRLSNHCCRLQEVILENSDITHLEDAVKRNRQRLAHQEVMLKQLEEICSRTQEKQLFQEERNNSIMAEVASLEDLFYTQCSGEEDHDENTASTEGNYTQEGSFDDMPPLEGEEDEDITDQPQPLSLQENQGNQSSTIQEDQEGNSSQGGSVSGPHFMSSSGSNNSQGGASGGTSTLIPGYNVHSQMSSLQGLQCVLLSAVEQVAENLKVLILKAINVSKENKFNVASFNYRTSKKNTSSQKHFSANVPANKQGVDSRIVSSLDKFHVFAVMDSYLMNLESKVRSGQLGIITNIFSDLSIGLAYAHNNSSSKEHIGAMFGSVIGSAKAKMNTNALSAIFIWNTNKTGFSGCISSYYGWGQMKNARQYLHTEEIISSKGSPDIMLGGGLIQLGYNCFISKSVMITPYIEYLFITTGWKEYNEITGTLPSHISSTKEQLISKNIGIRSRINLMGNSQLQTWVTGAFGQRKLGTITAQPLKSTNSIYKAMVQKAKNKYVQGEGGLSYEIIVTNNCKIGLSGDVQFEKNRPLKNGNVRCFFHLTY

SEQ ID NO: 8379 - protein, 832 aa, Methylobacterium sp.
MVTDGKAGMVKRLWFKRRLLMASVSTGLLSGVVVAGPAGAAQDEETNVQNLPPVEVTAPPPATTRRNVPSRPVAQAGASSSSSPKTRIYVYPTAPGTGRGLDVDKVPSAINAVDANQIKRTGSLNVTDALRDNIAGVNITEVTGNPFQPDVEFRGFVASPVTGTPQGLAVYQNGVRINEAFSDAVNWDLIPTAAIRSVTLVTNNPAFGLNALGGALNLQMKDGFTYQGAELDVMGGSFGRIQGSAQWGKQVDKNYGVYAALEGLHDNGFRNFSQSDVRRFYGDVGYKAGDSEFHANMGIAKNDFGASATVPAELLDKYWGATYTTPQTTSNRVGYLNFTGKVDATPTWTLEGTAHLRRYEQKLVDGNPTDVQECGADPTLLCFGNDTTPANGTNGVQLANPFAPGTILGEIDRSSIRSTSFGVSGQATNTDQLFGHDNRFVMGTSYDASVTRYNATAEIGTMGENYVVSGSGIFLGPTGVPDTVAGPVSLRTVNQYNGLYAMDTFNVTDALAITGGGRFNVARITLEDQLGTSLNGDHTFTRFNPVIGGTYKITPELTAYAGYSEANRVPTPLELGCADPVRPCLLAAFLVSDPPLNQVVSKTMEAGLRGTKELNIGTLGWKIGGFRATNYDDIVAVPAVGRTGFGYFTNVGRTRRQGLEAEVNIKSPTLQFQASYAFVDARYLDAFELGSESPFRDPVTETIQVLPGDQIPAIPRHRVKVGIDYNVTDVWKVGGNALFVSSQYFVGDESNQYSKLPSYTVFNLHTSYQVAKNIQLYGKVDNIFDKRYATYGQFFDREALPNFTNGGAEFTDPRSLSPARPRAFYAGMRVTF

SEQ ID NO: 8380 - protein, 225 aa, Methylobacterium sp.
MGRGGAGAAFNWNPNGGPISVRGTYVAANAFSPVKDAFGGGFLGDPYQGTVEVEYANKFGKEGKNNFAVRLQYTNSATFDVAQNAGGLNVEASFGQFGLFGRYGYSGGQVYGSGAFTLAPFVNPDDFPAGKINFTAQTWMAGVGVRDLLREGSLLAAAVGQPFINDLPSSRGNNDATQTNYEAFFRFPVNDNITVTPVIMAITKANNDSTNAAIIQGVLRTTFSF

SEQ ID NO: 8381 - protein, 719 aa, Methylobacterium sp.
MPPRSFAPTRSLLAAAICMTTLPPTFANEQPVSQAPAVMELGATAINDSSLGSTTEGSQSYTTGAMATATKLPLTMRETPQAVTVITRQRMDDQNMTSINDVARYTPGLFLNQASGPGRQSYTARGFDVDSIMYDGIPSAYTGWVVGAQPNLAMFDRVEVVRGSTGLVTGAGTPSAAINLVRKRPLAEQKVTLTGAAGSWDNYRGEIDASSPLNDSGTLRGRVVTSYRDANGFRDGQEENHGLFYAVTEADLSEDTTLTLGFSHQKDKTNFFWGAIPTDLNGHHLDVSRSYNPGTDWEDKDQEINTLFAEVRQRLANDWNLQVNANYSEQNALFRGSYQSRWSAAKTLSRTVYQSQNDENQLGLDAFASGPFELLGRSHELVLGASKRLYDMNERNYSPYDTDYPLNGGKPDFVHTGNSRYVINQEGVYATTRLSLADPLKLILGGRLDWYDYDQRDNDAGDYKVTRNVTRYGGLIYDLDEHHSVYVSYTDIFTPQEGRDGSGKPVTPIVGKNYEVGIKGEYFDGALNASLAVFRIDQQNRQVEVKLPDCPQLSCYQASGEVRSQGIDFELQGALTDHWQLGAGYTYARVHTVKDANNPAKVNKPLNSDTPEHQFKLYTVYRFQGPLEKLRVGGGVTWQSRMYNDIALGDGGNYRLTQGAYAVTDLMAGYQLTPQLDLQLNANNVFDRTYYSSISKSVDYGSDTFGDPRNFMLTAKYSF

SEQ ID NO: 8382 - protein, 653 aa, Methylobacterium sp.
MGCMLKQVAVAVGMACLCVPAWAYDYGDYARETVDTLINDYPGRYRDTANFVGAADWMTQRMAPGYSTVRQDFSWTAGGTTRSSQNVLASNVGLSSEYIITGAHFDTFFGRPTLQGLDDNASGAAILTEVARNFSGIQTEKTLVFAAFGAEEEGLRGSRAMVNDLIAQGNAGDLKAMINMDSMITGDKLYAHAGDNSVANPALASLREQTLRIANELGIDLFTNPGLNASYPAGTGCCSDGDSFNAAFDIPVLYMEATNWDIGDQDGYEQTTNPAVPGGATWHDPTVDNEAFLTSVFGQERIDQHLRDVSRLVTRLLLEISNTDLLHSAYSAAAMQQAMEESLKRQRQSLSDLHNQRWLLLQNTTRSVGTLDTAIGVEGDVIPSNGFDRAPQQRSRQAMAYALVDYQLSDIVTIGGSLSLLRSKDKLERNGHIESDTWQAGVYGLLNQGGPAWLGSEVTAGRAAIESRRSVYLQSAGGPVLLDNALDGNTEAQFIGARVSGGYDFPISGLRTGPVVGLDYARYRINAFDDKGNLRTGVRYEKQDVDSLEASLGWRVRGKVEFSNTMSLQPYATVAWVRELADGLDSSFTVKDHVDGANRRVAVGEQDKNFGKATVGVQWLAAENLNLYSEIGSRFGHQDGDQTRYSVGVQWQF

SEQ ID NO: 8383 - protein, 809 aa, Methylobacterium sp.
MRFLLLQIFAWIPASCLCLHLCQSSAQAVPSDTAPPPVTLQPLDIHASRAWDLMPQPPTGLFHEEPTSATAYAGAFLEEQDITSLAQLAPYTPGVFIAEKSPANTVFNIRGISSEGGDPRGANRIGIFQDGVPLNRVPAGGVALFDMESVAVLRGPQPTLFARGAEAGAISLVQNKPVDANTGSLTVGAGNYDEFTTTGFANVSLIPGQLFARVAFTRTVRDGYTDNVADDSDLNGRDTAALRGSLRWQPGSRTTLDLIANWQHDTPPATGFKSNSIPPTGGETSPFTFAELNRGRDLTVDRTLKGITGIITHQPAPDWKITSTTAWREFDSTDNYDADGSRLNLIELTDNSTGRQFSQEFRLRYDDAGVTPFSGSAGLGYFYEEGKQRLTLHSDERAMWPFLSPGLRDQLTALGVPSALLNAALPPTDPTVPVNNLPASLALFNNPALPPELRQLALLAGAPLNPSNPETSITSNTTNAVDLVLDGTWRASDRLRFTAGLRGTFEHITSGYEVENAATPSTLGFILGATPNAIFPPTNGQLEASDSSFSWAGRVAGEYDFTRAITGYASVSRGRRPSGIVLTADAITPFAEEVVWNYEAGFKGALLRNRVLWSASVFYYDYSHFQSMAPAPGNPFLFVVTDAGNATGRGAEFSLQGRITDHLSVFAVYSFTDVTFDATDSDGNPQPNAGYTTRLTPRNTFSLGATWLIPVDGGSAFFVSPVYQYKSSVYFNDNNALFNYSLHQGGFGLMNLRAGWRSPRGRWVVTLYVDNLFDKDYLLDAGNLGAFYDLPTFVAGPPRLYGAQVTVRF

SEQ ID NO: 8384 - protein, 766 aa, Methylobacterium sp.
MLSSSPAGTRRALLTTSAILSPGFAVLLSSGLLAVTTVPAAAQNAVSMPTIVVEGAKPKPNRQAQRSAAPRRAVVAPEPAPISEGPVVPADTTTISAATATSRSLSTSDSASLIADIPGGAAWGAGGVSSLPAINGVGADRVQVAINSMLISPACPNEMNPPLSFVNPTMIANMRAYLGVAPVSVGGDYIGAKVDVTTAPPLFAKGPGWLTTGQVSGFFRSNGNGYGVDAIATVANADTSVTYTGGWAKASDYKAGDGTRIKSTLYEIQNHALSISKQTFGNLFTVQVGGQFIPYQGYVNQYMDMVYNQSAFINGRYEGVFDWGQFEASAFYHQVQHTMGFIAPDKTGSMPMDTKASDIGYKLKASFAVSGHDLLRVGNEFYHNQLDDWWDPVTKTAGMMGPNTFVNINNGHRSRLGTFVEWERHWDREWTTLVGLRNDVVWSDTGDVQGYNAMAMYGTDAALFNARDHAKTDVNFDGSALLRYEPGLTSQFELGLARKTRSPNLYERYAWSSAAMAMKMIGWFGDGNGYLGNLDLVPEKAHTASFTAAWHDPAQKFWEVRVTPYYSYVQDYIDVDRCAVRGGSSACTAANLTKTNNFVFLQFANHDAYLYGVNLDGKLQVWDGPVYGRGVLRGQLGYVRGERTDGVNLYHVMPINAKLALDHTLGNWNNSIELQLVGAKDDVSQVHNELTTPAYALVNLRTGYQWDAVRLDLGVDNLFNTNYYLPLGGADLVDYKVVSMMGSSTAYGYNVAGPGRSLNARLTVKF

SEQ ID NO: 8385 - protein, 215 aa, Methylobacterium sp.
MIRNVLVAVFGASLLGGAAHAADLAQAPEPAPTVETISSFVWTGGYLGLQGGGGWLNSDLSVPGGSASEKFSGGLFGAFAGYNYQHGDWVVGVEGDVSYNWNDETVTVFGSDTEAGTDVSGSVRARLGYTVNDRTLIYATGGWAVTRGFVDVAGAPKEKETFNGWTIGGGVDYGFTDSVFGRAEYRYNDFGDKDVGGVNVDLDQHQFTVGVGVKF

SEQ ID NO: 8386 - protein, 725 aa, Methylobacterium sp.
MKKILLSMMALAAITATAQQTTVIDTTKVESLDEVLVRSVRVKADSPITHSNLTKAQIAQRNLGQDIATQLNFLPSVVTTSDAGAGIGYTGFRVRGTGNQGINVTINGIPYNDAESATTFFVNLQDFSSSVESLQLQRGVGSSTNGPGAFGASLNILTDAISKEAYGEISNSFGSFATRRHNVKFSTGLLNDHIEISGRLSQIKSDGYIDRASSDLKSYFLQAAYTDDKTLIKLVNFAGSEVTYQSWFGIDAETLAEDRTFNPAGQFTDENGVTRFHGNQVDNYKQDHYQLHWNQRYDNNWSTQLSLNYTYGRGFFEEYKEDEDLAFYSIASVVIGDETVETSDIIRRRWLDNDFYVANATVNYKDTSLDFVGGLYGSVYDGDHFGEVIWARFASDSELGDDYYFGTGKKKEFSAFAKANYRFNSKWSGYLDLQQRFISYTTDGINSDITEFIVDEDYSFFNPKAGLSYKVNDNNQLYASFARANREPNRTDFENGAPRPERLNDWELGWRHNTEKVSLNVNGYYMGYRDQLVLTGALDDVGAPIRANSGESFRAGIEIDAAIAITGKITVQPNVAISTNKNRDFFFERDGVLTNLGNTDISYSPNLVAGNTISYKPAQNFRISLLSKYVGEQYLGNIDSETSKLDSYFTNDLNVTYELKDIPVFKSIVFNALVNNIFDIEYVSNGYFFTYDDDFSVPNEITTIEGAGFYPQAGINFLVGATMKF

SEQ ID NO: 8387 - protein, 389 aa, Methylobacterium sp.
MAWRGGSLKGLSSDHSRLVGETLWRQRRGRDFTVEDLSARLELNGVVATGLGVHTLGFGVKAYQLTYGEKWLRINPTAANPYPIDLFNPVYGAVPSPTPLPFTDNLETREVVTLYAQDLWEVNDRLSLVAGLRWDDYSQTIRNNRTGAVGENKDSPVDYRFAARYRLTDALTAHASYGQSFVLNSGTGRTGAGFTPEEGKGYEIGLSGAWERIDLAATVFDIEKTNILTSDPVDANYLAPVGKLTSRGIELDGSVRVGEAWQVVANYAWTDAKADDKAFATDKVLNVPEHSGSLFVVGRFATTHGTDWSMTAGAAYVGDRAATLTTDGVRLPAYWKAKAAVEYGLTPQVTARVEIDNLFDERYAASSYSALWIFPGAPRSLRASLRIAL

SEQ ID NO: 8388 - protein, 764 aa, Methylobacterium sp.
MARQPLRAALFGAFGLYAAAARAAGPASEPAAAAPPAAASAASTSQVRHAAIAAARKDAPALDPITVTATRTASAASRTAASVSVITDSDLEEQQADNIKDALRYEPGVTVRRTAYRPANAALGGGRDGDSSINIRGLEGNRVLLMEDGIRLPSAFSFGPLEAGRGDYADLDTLARIEILRGPASALYGSDGLTGAVNFITKDPSDLLSIHRKKTYFSFRPSYDSVDRSIGATVTAAGGNDRVQAMLIASGRRGHELDTHGDDNSASTRRTRANPQDVYTESLLGKLTITPTARDTIKLAAETVRRRIDTNVLSAINPPTTLGLTANDRLERNRFSIDYDLRDAAARGFQTAHVQFYYQESTQDQDAFETRGGRLQSRSRSNHYSERALGGSAFAESGFATGPLAHKLLYGVDGSIDRIKSLREGTVASPGESFPNKAFPDTDYSLFGAFVQDQIGFGKLLVTPGLRFDAYRLSPSSGDPLFTGKTVSSSDHELSPRVAMLYEVSPALIPYAQYAHGFRTPTPDQVNNSFSNPIYGYTSIGNPNLKPETSDTLEAGLRGTLGTGYGPLRYSVAAFAGRYRNFISQRTVGGSGRPNDPLVFQYVNFANARIHGFEGRAEWVMPNGFTLKTAMAFTKGTTQDNGAASEPLDTVNPFSAVFGVRYEPSERWFAQADLLWQAGKRGRDVSSAACQKKTCFTPPSSFVVDLRGGYRFNKHVSAYLGIHNLFDRKYWNWSDVRGIAADSNVLDAYTAPGRSVAVSMKVDF

SEQ ID NO: 8389 - protein, 374 aa, Methylobacterium sp.
MRRSRRARCRFNLDLSNSMTKHIETRGIDCRVRPVHAGFRLTVALACVAGSGTASAQDGVTLYGVIDEFAQVVNTGNGYTAAINSGGQWGSRFGLKGGEDIGGGQKIEFALENGFNPNDGSLASAGSLFNRQAWVGIAGQWGKVRAGRQNSPLFNDQGGQDAFGGVTQASGMDNLTVFAFRTSNTLSYQSPEIAGFQGGLYFGFGDAGGVRSAGSSQQFDLTYEHGSFGAFVAGQWLKNAVATTTDRTIMAGASYAIGKATVYGGFSTVKWADLGIDSRVYGLSVKYQFNPASYVALGYAYLHDQSSQGNHADQLGLMYEYDLSKRTSFYGALSYLRNRNQAGYTLAGAANPGLPLAYPGANARGVQLGIVHRF

SEQ ID NO: 8390 - protein, 476 aa, Methylobacterium sp.
MALGDEGMKTVRFLLRCGAAVSVLAWSTAAWSQAAPDQNAKSADPAAAEQAAAEPAAEPAAEPEPAPPPAPPPTISDQIGAGKLILEVRSRYETVDQTRTATLRDKGDSFTVRTKLGWETAEFKGVKGLIEIEDVRQVGNEHFAVNVPGAATPPLNGADKARYPIINDPDVTELNRAQLTWTPNAVLQVTAGRQRITLDDHRFVGNVIWRQDEQTFDAVRADVAYGRFKATYAYVTHVNRILGELRDWDSDSHLFNATWSPAEALRVQGFVYALDFGNSAINSSITKGVKASGKTWVGLFQTAYTATFARQSDYRRNTAAYELDSVSADIAGTFDIYTLKLAYESLEGDGVRGFTMPLATAHAFNGWSDAFVSPGGNKSFVDGIKDLNLSLNVKPRFRATYFFNSDLIVRYHDFNSERTGVDLGHEWNLQYTAAITTRLSVQLKYADFERVKTVPIGTAAPPASRTKTWLTLEYKF

SEQ ID NO: 8391 - protein, 316 aa, Methylobacterium sp.
MGRSKPLTLARIVTFAAAVGLPGLVQAADLLPPPPPLPPPLDVGGGWYLRGDVGASIYTEPKLSTLPQPDPVRYYNSDIGGGGFAGVGIGYQFNPWLRGDVTGEYRFSAGLRTNDSIDAKVPYTVQGPDGLRGVFSDHTDETTNGHLSSGVVLANVYADLGTWYGVTPFIGGGVGVAFNHLSGFSDSSLNLIRYNLIDAAGNVGTDVYSQGGVSGGIYKSRTTTSLAWALHAGLSYAVTPGLKLELAYRYMNLGEARTGVLNCFCGASYAPIKIKDIESHDIKLGMRWMFGVPVVAPVPAPVAAYEPPPGPIVRKY

SEQ ID NO: 8392 - protein, 810 aa, Methylobacterium sp.
MSVIAQAGAKGRQLHKFGGSSLADVKCYLRVAGIMAEYSQPDDMMVVSAAGSTTNQLINWLKLSQTDRLSAHQVQQTLRRYQCDLISGLLPAEEADSLISAFVSDLERLAALLDSGINDAVYAEVVGHGEVWSARLMSAVLNQQGLPAAWLDAREFLRAERAAQPQVDEGLSYPLLQQLLVQHPGKRLVVTGFISRNNAGETVLLGRNGSDYSATQIGALAGVSRVTIWSDVAGVYSADPRKVKDACLLPLLRLDEASELARLAAPVLHARTLQPVSGSEIDLQLRCSYTPDQGSTRIERVLASGTGARIVTSHDDVCLIEFQVPASQDFKLAHKEIDQILKRAQVRPLAVGVHNDRQLLQFCYTSEVADSALKILDEAGLPGELRLRQGLALVAMVGAGVTRNPLHCHRFWQQLKGQPVEFTWQSDDGISLVAVLRTGPTESLIQGLHQSVFRAEKRIGLVLFGKGNIGSRWLELFAREQSTLSARTGFEFVLAGVVDSRRSLLSYDGLDASRALAFFNDEAVEQDEESLFLWMRAHPYDDLVVLDVTASQQLADQYLDFASHGFHVISANKLAGASDSNKYRQIHDAFEKTGRHWLYNATVGAGLPINHTVRDLIDSGDTILSISGIFSGTLSWLFLQFDGSVPFTELVDQAWQQGLTEPDPRDDLSGKDVMRKLVILAREAGYNIEPDQVRVESLVPAHCEGGSIDHFFENGDELNEQMVQRLEAAREMGLVLRYVARFDANGKARVGVEAVREDHPLASLLPCDNVFAIESRWYRDNPLVIRGPGAGRDVTAGAIQSDINRLAQLL

SEQ ID NO: 8393 - protein, 754 aa, Methylobacterium sp.
MSKRIIQSVLSVSVLASMMSMAFAAQNEQEQAEQTLEKPAEPVKLETIFVTAEEQVKQSLGVSVITKEDLEKLPVRNDISDYVRRMPGVNLTGNSATGQRGNNRQIDIRGMGPENTLILVDGKPINSRNSVRYGWKGERDTRGDSNWVPAEAIESIEVLRGPAAARYGSGAAGGVVNIITKKVTNETHGSVEFYTSQPEDSKEGSSNRVGFNVSGPLIKDVLSYRLYGNYNKTEADDVDINKSIGSTAAGREGVKNKDISGRLAWQATDQQTVLLDISSSKQGNIYSGDSQLNANAEADAILSQLIGKETNTMYRDSYALTHEGDWSWGKSKLVAQYDKTHNKRLPEGLAGSVEGKINNLDDKATSRLETLRFNGEANIPFEYYLPQVLTVGTEWVEDRFKDNVSTTQGKDSSGSGYGDQLAKGDRSKMESRIASAYIEDNLKVTDSTDVVLGLRFDDHSKSGSNWSPSLNITQKLNDYFTLKGGVAKAYKAPNMYQNAEGYLLSTNGNGCPANIESRCLLQGNGDLKPETSVNKELGIQFQKDIVNASLTWFRNDYKDKIVAGTHVVGTVDGSSTNANTGAVTNTKWNILRWENTPKALIQGFEGSLGLDFGDIRWTNNFTYMMDSKDKQTGNPLSLVPIYTINSIFDYDITDQLDVNFVFTQYGRQKSRQFAENRLESGIGSGGANSALKPSTVKSYSTAGINVGYKFSDQISTRVGVSNLFDKQILRDSNSISQTYNEPGRAYYASLKYSF

SEQ ID NO: 8394 - protein, 2057 aa, Methylobacterium sp.
MNRTYSIVWSAVRNMYVVASELARGHSKVKAQVCASETHSPNKKSEYGQIIKATRAALACAVAAALGFFSPLAMADNPVSYIDGTEHDLSTETSPISYSGTGQGTALSLEGLPTDKGGWQATSGTGTDVVIETDGGGDILSGSTRAIGTAVSLNKGATLNLTDAQITTTGIYTAGIDLKEQSSMTLTGGIIQIGGNYGVLTLNGESKATLIGTEVKATTENTSDLTSQEGSTLRIEGGSTITLTNGQVRVVGDTTYNSWLEVDGSAVSSTGTDSTVIASNKGVLDITNSTVTHDNAKGAAIEAANASTVNISGDNKSSMFIKSEGIGIKSARSSVNIDGATVEAKGDGILMTTGGSTFYSNISGLTVENADVTSSDAAALHVDKNTVIETPITLTDSTLTGPTAIKLDNAATVEAKNTTLNGNIEAGSTVSALSLAEKSSLQGSVNGLNSSLSLDDTSLWNMTDPSTVGNLTNDGGITLGNASGSTGTLLTVDNTLTLQDGSQINATLDTANSSPIIKAANVTLDGTLNLSSTATFVAPETDEHFGSVTLIDSQTAITTDFDSVTLNADTSAMPDYLTINAGVDANDNTNYELSTGLSWYAGANSARAAHGTFTVDADSTFTVTSELDETTANSNWGGSKLTKQGDGTLILSNTGNDYGDTEIVGGILAAKDAASLGTGDVTIAENATLALSQGTLDNNVTGEGQIVKSGSDELIVTGDNNYSGGTTISGGTLSAKDAASLGSGDVDIAENAKLELSQGTLDNNVTGGGQIVKSGSDELIVTGANDYSGGTTITGGTLTADHADSLGSGDIDNSGVLQVGEGELKNTLFGSGSLVKTGTGELTLSGDNSYSGTTTITDGTLIAASVNALGSGDIDNSGVLQVGEGELKNTLFGSGSLVKTGTGELTLNGDNDYSGGTTIDDGVLIAASVNALGSGDIDNSGVLQVGEGELKNTLFGSGSLVKTGTGELTLSGDNTYSGGTTISDGTLIADHADSLGTGAVANSGVLQVGEGELENTLSGSGSLVKTGTGELTLGGDNSYSGDTTIADGTLIAANVNALGSGNIDNSGTLMLDANGAFELANITTHSGATTALAAGSTLDAGQLTQEDGSTLSIDLGAATDDAVITADSVTLGGTLNVTGIGSVTDSWTPEAYTYTLIDSDSAITSDFDDLTIAGMNREDVDFLTIDGKVDETDNTNYDLTASLSWYADRDNATTDAHGTFTLSDPDGSFNVAATLTDVDDTLDPGSRWDGKSLTKEGAGTLILSGDNDYSGGTTINEGTLVAASTTALGTGLVDNNATLVLDADGEVSAVGGITTHSGATTQLALGTSLDLGDSALIQQDGSTLNVELNSDSVQPLITGGSATLGGNLVVSDASLQARASDAEFQSFKLMDMDSDISGDFTSLTMNLTDQPDYLTVTGTINPEDASEYLLTEGLSWNATATSATPAHGTFTLGAGDSFEVTSVLGDKTGNGDWDGKSLTKLGAGKLTLSGANTYTGDTNVQEGTLWLSGDGSIGEMGSQQAVNVASGATFGGSNGTTVNGKVTNEGTLVFGDSEETGAIFTLNGDLINMGTMTSGSSSSTPGNTLYVDGNYTGNGGSLYLNTVLGDDDSATDKLVITGDASGTTDLYINGIGDGAQTTNGIEVVDVGGVSTSDAFELKNEVNAGLYTYRLYWNESDNDWYLASKAQSDDDDSGGDDTPSDGGDDGGNVTPPDDGGDGGNVTPPDDGGDGGDVTPPDHGGDVAPQYRADIGAYMGNQWMARNLQMQTLYDREGSQYRNADGSVWARFKAGKAESEAVSGNIDMDSNYSQFQLGGDILAWGNGQQSFTVGVMASYINADTDSTGNRGADGSQFTSSANVDGYNLGVYATWFADAQTHSGAYVDSWYQYGFYNNSVESGDAGSESYDSTANAVSLETGYRYDIALSNGNTVSLTPQAQVVWQNYSADSVKDNYGTRIDGQDGDSWTTRLGLRVDGKLYKGSRTVIQPFAEANWLHTSDDVSVSFDDATVKQDLPANRAELKVGLQADIDKQWSVRAQVAGQTGSNDFGDLNGSLNLRYNW

SEQ ID NO: 8395 - protein, 685 aa, Methylobacterium sp.
MRRLSPENAVIPSHPSLFMQRSLLSLAIMLAVSHQALADDVMTLPDMQVTAGKRVQSQDQTDLALSVANQADLERANVYNSGYLERVFPELMIRNTGAGVFPSLSLRGVSSSDPYNAPVGIYVDGVPQYLGTFNQQLLNIEHIELLKGPQGTLYGRNAHAGALNILTRQPDNTPTATLQSRFSNLHQQVSATGSTPLANDTLFIQGTVYHDDTDGELTRSEHHGDSDNGGGNVGLTFKPNEDFSLRLAYARDRLTSYNEQYLADATYEKRRASVPLMESVYVRRVETSSAILDWNLNDALKLTSITSLQNYRHERVYGDLGFQWPESQRTVSQELRLSTQGDDRAWDAVGGLYWQKSRSHSEREPDRSAPLFGVYGAADSRIESTEKAVFGEFTWHLAPRWDLTLGARHSVEKAETDYTQVDAAFTPGFVYSGNDTFTSTTPKVALGFQATPDTRLYASVSKGYKAGGYNRIGAITPDAVAYSPEKSLNTEIGVKSSLLDQHLWLNAALYRIDIDDVQQFIGAAGTGTQSLSNIGKARSEGAELSMDWHADEATLIRLAGTVNRNRMLDSDRQGNRLTYTPGRTLRASAERSFYFDGLVGEVRPSVGISYTGKHYFDVENEVSQGGYSLVDARLAWLPTHDLELALYGNNLGDKDYRTYSYLSGGAQFSQPGQGRELGLSTKITF

SEQ ID NO: 8396 - protein, 287 aa, Methylobacterium sp.
MKSLLKSATALAGVLVAGSALAADLPRRVAPPPVFTPVPVFTWTGFYAGFNAGYGFSTNDNNTPTVLGVGPATGLVFAPTVIAFQNRNNNDGFVGGGQVGYNYQFTPGSGVVIGLEADAQFADFGRNRNRFLATGPIAAQTVFNPAGISGLDWFGTVRGRLGYAFDRTLVYATGGFAYGSGGGRDFGLPNRDDFQTGWTAGGGVEYALPTDSFLNFFKSNAVTVKVEGLYVNLERERNRSGAFAVNNAGTLITTASPGVVVVSGANLRRDTEFAVVRAGLNYKFGTY

SEQ ID NO: 8397 - protein, 1129 aa, Methylobacterium sp.
MRRSFVIQIVTFLAAATLTCWGQDRATILGRVTDPSSAVIAGATVTVTNPDTGAKTTTNTNDAGNYVVRGLAFGRYEVTCEAKGFRKFVSKDNTVDVAQTLTIDIALQLGAVDQTVEVSGAAPLVESSTSDLGTVVDSKQVADLPLSVSGNVRNPESFVFLAPGVTGDTANTEVNGSQDRAKEVLVDGVQSTGPESGGTVGTYPPVEAIGEFKLLASNFSAEYGKTGGGFEIFTTKSGNNQFHGSVFEYLRNDKFDARGFISPITPVNRQNEFGGNIGGPVILPKYNGRNRTFFYFVYDGFRYRAGATNQLLTLPNAAQRSGDFSGLTKGGVPLAIYDPYSSRSDGAGGFTRDLFPGAKIPANRISKVSAATLQLLPAANTSAATANYTAVGATTFTRNVVTIKGDHSFNDRNRFSVFVYISNEANVAASLIDGGLSPALNNQRPARWARFNHDYQFSPTILNNFRVGYTREPQLWFRTTSDQGFLQKTGLTGVNPPGDIAPRVQFADTYQNWSDETKNKGVQVNSTLQFGDTVSVFKGNHNMKFGADMRWQQTNGPDSAGQQGLFSFNSNETALPTAAGRSTSGNAFASFLLGAVDNASYNGLYVVPGLRYQYKALFAQDDWKVSRKLTLNLGLRWDLFMPRHEHNTNISGFDPGLPNPGAGNLLGAIAFLGNGPGRDNTRSSFADTYFHAFGPRVGFAYQLGLKTVVRGGYGLSYGQGNATAGLRDSQKFIYGFNAAPSYASTDAGVTPAFNWDSGFPTNWPHPPFINPTVQNGTNVTMVGKGDGRPPDFQNYQISVQQELAARSSLEVAYVGVKGTHLGNGLINLNQLDPKYLSLGSLLTQSVASAAAVAAKIPIPYVGFTGSVAQALRPYPQYLNIVNNSNPNGNSTYHALQVKYTKRLSHGLTMQGAYTWSKSLTDGSIAAGGGPSGQDFYNRRLEKSLSPNDVPQVAVLAYTWELPFGKGKKLMHEGVGAAILGGWQFSGIQQYQIGKPLQLTANNGLPIFNSTLRPDVISGVAMTLDHPDPLASPWLNKAAFAAPASFQFGSAARSYAGVRAPNAYNESFGLMRHIKLTEKATLMLRGEFFNAFNRTVFGAPVSNISASNFGRVTSQANAPRQGQVAARIDF

SEQ ID NO: 8398 - protein, 356 aa, Haemophilus somnus
MQSKFKRGMAALAVASALGAASAGAQAQSSVTLYGQVDAWAGATKTLGASDRAWGVNSGGMSTSYWGMKGSEDLGNGLKAIFTLEAFFRPDTGKYGRFDGDTFFARNSFVGLQSSTWGSIKLGRLTPPYFVSTILFNPFIDSYTFSPMVFHTYLGNGLRGPGGISGLVGDSGWNNAIMYSTPDFNGLTANFIYGAGEQAGHNGQNKWGGNFLYFHGNFAATAAFQQVRFDSAPGDLNALVAGFSRQTAAQLGATYDFGVAKVYGQYQYIKNAINSGDAKSNGGQLGMSVPVGPGSILASYAYTKTSGAADVKRNTWAVGYDYSLSKRTDVYAAYMRDKVTSLSSADTFGVGIRAKF

SEQ ID NO: 8399 - protein, 205 aa, Haemophilus somnus
MKKMIVTLALIAPLSAVAAQKDPNGFYIGVGAGSTELDDGGFGKAITRKTTTTETESPSYKLIAGYQINRIIGIEGQYTKYGTSTTKVGSSKAFTTDFSSISVAANVGYTFDIGLRPYALLGYSFLNSEIENSGNNKYFATKSSTVSGIKMGVGVEYAIPAAPALALRAGIDWEAADIKVKDEKNKELSNVHTLGSFYLATTYTF

SEQ ID NO: 8400 - protein, 733 aa, Haemophilus somnus
MFPADEFTAKMGLAAAAEQCLIYVDCFYHLYYQAQVEINDSTRNTTNYRASPYCKLRFKDQDAKGHVMGKFRLTQHLLGTVSVLGLTLGSGAMAQQLPEELPLEIQGEEFLGTVELGQGKREVQVGTAVPITVINQEEIDDRQAGTIAELIDSVPGVSLVNGSRPEGSGINIRGFGANGTYGTDQKVAIVIDGATTGSEEIYRIGTQLFTDPALYKSVSVIRGTVGSYEWGSGIVGGVVKLDTKDASDFTGGKVGLRLHQLLGYTSNGEGYHSSSIIAWQPMENLEVLLNYTKRDTDSYKDGDGNLVRNTSTEPYSGLAKIRYTFGDANEHGLTFAYQQTYSDEFDSPYDQFNQVNFGNVNRSTESKVATLKYEYNPVGNDLVDLTVQYSYSDIYIESEPTNPGGFADYLLDGDHDYSIDKLTVKNAMYFQTGAISHDLRFGVELISKDRLESQVSPTSGSVSVPGGKDERVALFLIDEIGLGNNWTITPALRWEDQKITGSDTYAGDRYDNSALMGGISARYEFDTGLALFASAAYTENLPILDDLSVASRMTQPEKSQTFELGASYVAGDVFADGDSLQVKANLFATDLWDITSYSGINTVDSQGAELELTYAMDNGLYVDLNAAYGDYEANGSSPWSNAPANSARLTVGKRINEAWDLSWEQVVAENGNNNYGGYGISNLRATYRPQNGMLAGAELRLGIENAFDRAYQPNLATQLAAGRNIKLSVSKTF

SEQ ID NO: 8401 - protein, 946 aa, Haemophilus somnus
MKKISGLRLCGDNVAALIVRPRVLKKVLEWSASCLQCATSPQSVFAPLSQGGIQKMTNTKTTATAGRRKAFVIALLSGACFAEAALAQSTPAPAADQAAVDEVVVTAFRKSLATALEVKRKDVRVSDGISSEDIGKFPSENIAEAIQRIPGVQISAINGRGSTISIRGLGPQYALTTVNGQAFKSSNFTDGFRYDVIQTELASGIQVYKSPTADMDAGGLAGTVNIDTVHPFDVKGRQIIVAGKLQQQELIGGNPTGKYGLTYVDHFLDGKLGVFLGGGYQELKDRGDYLWMDRWTVSNNVYTPARLRYRRIDRETKRSMINGAVQWKPTEHLQMDLIGTYAEDKTTQNIHQQVFLFTTPSASNVVPITVANGTSTKVQVNNFRLENNQQYENRPQSTSALTTKLHYTGLENWDFNAVAHYSRGNAKHNEEAAVLGINIPSATVDIADPKNVIFTTSTALTNTAQYAPTTLIRNTYPTGAFRTVGSHESAAQFDAKRYLDWGILESVQVGAKTRSEVLKRYVIRKDNQVVPASFSPTMANSGIAVTNFLDGQMTLPNAWVSPNLDAYREALKAQGISVYEGFDPLGSYRVERDLTSVYAMANLRGEVLSKSYRANIGVRNESTDQTIKGYIGSTANPQNTEVRLAAGNYTAKKSYDNLLPSANLSVDLTDNLLLRVAAAKVLVRPIIDSSNQLARTMTSATDTTGRRIFTISSGQGNLNPMTANQLDLTLEWYYGQGNGLSAGYFSKKVKNGVFSQLTCPTSYESVALSRDSSGVCVAANGDNYMITESFNDSRVVDIHGYEVNWQQSLDAWLPIEGFGLIANYTHVTPAKSTTGFRLANLSEHTANGTVYWENQKFSARLSANYRSAYDQTSVESFFAGPLGHTIKARTQLDLNLGYNFNERLSFAFAAMNINNAQEEAYLINASRWQETAVTGPSYFLSFQYKM

SEQ ID NO: 8402 - protein, 974 aa, Haemophilus somnus
MKKMQKFILFLAFLIPIGMLAQTKVTGVVTEQSTGTPLLGVNVVLKGTSTGTTTDFDGKYQITATNGQTIVFTYVGYKTQEIPYTGQATVNVALEEDASTLDEVVVVGYGSAVKKDVTGAVESVTSEDFNGGAIVSPEQLIAGKTAGVQVTPPSGAPGSGSAIKIRGGVSSLSASSAPLIVVDGVPLDQGNSGLNYINANDIESFTVLKDASAASIYGSRATGGVILITTKTGKSGQLNFNVNHYTSVGNNVNEVDVLSSTQFRDLVLANGNANQISDLGNSSTDWQDQIYRGSLTTDTNVTVSGGFDNSNFRASIGYVSQEGTLRNSKVNRWTGSVKFIQRLLDDDLRIEANVLGALIDDTFGNQGAIGAAVSFDPTQSVFDPNSPFGGYTENVNNDGSINTIAVRNPVALLELYSNTADTKRSTGSLKIDYTLPFFRDLKLTAKGGYDYFEVDGNLVIPATAASNSNTDGLIGTNSTLNRSRLLDLYANYKKDIESIKSTIDLTVGHSFQSFYRSNRFLNTPGVGQVTGNVFKTENALESYFGRLNFAYDNKYLVTLNLRNDSSSRLNPDDRSDFFGGVSVGWNIIDENFMKDSKVFSQLKLRAGYGETGQQEFGQDYGYIPRYTTGDGQVQYQFGYNSDGSPRFVTTIRPEEYDENLRWERSKTINLGLDFGFFNDRLTGSVEVYERKVEDLINFIPVPAGTNLSNALFTNVGNLENRGLEINLNAAIVENENFSWNTNFNVSFFDNEITKLFLTDDPTSPGSPTGGIAGGVGNTIQINSVGYEANSFFVYKQIYDANGAPIEGAYVDINGDGVVDTDDRYRYKSPNPDAVLGFNSNMQYGNFDFSFTMRASLGNFAYNNVASNTGNVQSLFGANSINNVNSSILDTGFQNQQLFSDYYVQDASFLKLDNLTIGYSLDNVFKDVRMRVYATGQNLFVITDYDGLDPEINGGIDNNFYPRSRNILMGINLNL

SEQ ID NO: 8403 - protein, 395 aa, Haemophilus somnus
MLQYTQYQPRRYGPLFDSLNEETGELSRFEYFAGGTYKRLFTNAEVVGKFKTGFVKHQVLFGTEYRNYSENPRFQFSQAYPSINIFDPIYTGKPFKIRPEFFRDDTINTYALYLQDQIDLLPNLKLLAGFRYEYVDQFRTTRDLGSPRNEFELRDSAITPRFGIVYQPIEPISLYASYTTSFNPAFGASRNADGSVFEPETGRQYEVGVKADLTERLSLTVAAFDIRKQNVETPDPENPIFSLQTGEVTSRGFEFNLGGEILPGWNLIAAYTYLDAFVSEDNTNIVGNRLANVPENQFSLWSTYQIQRGKLKGLGFGLGFFYVDNREGDLENTFILPSYFRTDAALYYRRNNWRAQLNIENLFDIQYFSSATFGSRLGINPGAPFSIKGTISVDF

SEQ ID NO: 8404 - protein, 744 aa, Haemophilus somnus
MQCRTSSNSLALAFVALASPSMLATAAESEELRAGEVVEAPVADNALVIQDTLITAEREARQALGTSIITAEDIKRHPPANDLSDIIRREPGVNLTGNSASGARGNNRQIDLRGMGPENTLILIDGKPSSARNAVRYGWNGDRDTRGETNWVPAEAVERIEILRGPAAARYGSGAMGGVVNIITKRPSDELKGSVSLYTQLPEDSAEGASRRANFNLGGGLTDNLGVRLYGGLAKTDADDLDINAGHATSALVAGREGVRNKDINGLLSWKLNDEHRLEASAGYSRQGNIFAGDTMNSNGGGDVDFVSSLYGHETNVMQRSTYDLTHLGDFTWGTSKTTLAYEYVRNWRLNEGLAGRTEGAPSDEGGAMSRLRNTRLSSEVNLPFAMGSTEHVLTLGGEYLYETLNDQGSLRPQSSDPTHNDGLVGFDRSSSKMTARSYALFVEDNIIVGDTTLTPGLRFDHHESFGDNFSPSLNLSHKLTEALSVKGGIARAYKVPNLYQSNPNYLLYSRGNGCSVQQANNGGCYLQGNADLKPEISVNKEIGLLYDRGTWRTSATYFRNDYKNKIIGDTDVLYTMGTGSRVTQWDNAGKARVEGVEGNFFIELAPTLDWNTNLTWMLDNDDRETGEPLSVIPEYTVNTSLDWRATEQLSFQVAGTYFGKQKSPTYNYRTQQDYDKTAQQDVDAYGLVDVSAGYKFNANYDVRVGVNNVFDKQILRGGNASSSGANTYNQPGRAVFAALNINF

SEQ ID NO: 8405 - protein, 762 aa, Haemophilus somnus
MSLRTTAAALLLPLASSPCLAQSATPGSSIVLDPIVVEATRRPPQPGTSPRSSASRALPSDAPPAAVTSAAQQDDIVRQRLNALPGGVALVPQQDYSNQGNPTLSNALTGVPGVIVQSLLGGNDQPRIQMRGSPQQSPAERGVLVLQNGLPINRADGSTILGFANPGQAETIEIYRGYMANRLGATVLSGAINFVSPTGSSQPGAQLSVSGGSFGQINTSGQLGGKKDNVDALLQFDTNRRDGFRNYNASERESVSGNVGVALSETIKTRFFMGYTELGFDITGPLTKRQLYADPRQVAPGPTVVNGVAINPGPNSVRDKPRREASQFLVGNRTTMEVDAHLIDIALGYTYTDDTFKFPIASGVRTTKGGDFTSLVRYAYNPASALLPLFETTAQYTVGSADRGYYLNQSGQTGAQFGANELSAQTLSLYAGANLPVWQQFVLSPSISYASATRDNDDVYGLARRPTIAYSPASPTTRLANNSVPAQDTSYSHRYSGWSPSLALSYRPDALQTFFVAGSQSFEPPTHDDLIATANGTSNSSPGRNPANTALVAAFTTSNLKAQTANTVEGGWRGRADRFSWDAVSYYSWVDNELLSLRDAAGAAIGSINADRTTHFGVELGAGVKITEQWSARLAYTYQDFRFVDDPLRGNNHLGGAVPHLVYAQLQLQATDAWMMQGAVRWSVARTPVDNMNTLYADPYAVVDLRSEYKINKTFRVFGEITNLFDKTYAATSVVVDLARADQAVFLPGDGRGFYAGVKATF

SEQ ID NO: 8406 - protein, 650 aa, Haemophilus somnus
MSAVTLAWPVAAATDDGETMVVTASAIEQNLKDAPASISVITQQDLQRRPVQNLKDVLKEVPGVQLTNEGDNRKGVSIRGLDSSYTLILIDGKRVNSRNAVFRHNDFDLNWIPVDAIERIEVVRGPMSSLYGSDALGGVVNIITKKIGQKWHGSVTVDSTIQEHRDRGDTYNGQFFTSGPLINGVLGMKAYGSLAKRGKDEQQRSATTATGETPRIEGFTSRDGNVEFAWTPNENHDVTAGYGFDRQDRDSDSLDKNRLERQNYALSHNGRWDLGNSELKFYGEKVENKNPGNSSPITSESNSIDGKYVLPLAPVNQFLTFGGEWRHDKLSDAVNLTGGSSTKTSASQYALFLEDEWRIFEPLALTTGIRMDDHETYGDHWSPRAYLVYNATNTLTVKGGWATAFKAPSLLQLSPDWATNSCRGGCRIVGSPDLKPETSESWELGLYYRGEEGILEGVEASVTTFRNDVDNRISISRTADVNAAPGYSNFVGFETNSRGQRVPVFRYYNVNKARIQGVETELKVPFNEAWKLSLNYTYNDGRDVSNGGNKPLSDLPFHTANGTLDWKPAQLEDWSFYVSGNYTGRKRADSATAKTPGGYVVWDTGAAWQATKNVKLRAGVLNVGDKDLKRDDYGYTEDGRRYFMAVDYRF

SEQ ID NO: 8407 - protein, 365 aa, Haemophilus somnus
MKKTLVALAVAATTAAMAVPATAATVYEQDGAKVELSGSFRAFLGRVGDDNRGDLKNDGSRVYVKASQDLGNGLSAFAGYQIRFEEEAYKTAQRGSDSDFGDPTTRELYAGIKHVDIGALSFGRQNTNSDDFLDDAAYYTSASLSPLTTRSDKSVKFKSAEWNGFSFGLDYLFGDSDKLDVTNDGNYKNGYAAVLFYHNAIGEHAYNLKALYSQDRYEGFGSETGVKKTQWGLHAGYNYGPFDAALSYVNYRTKFETGYFGTVGQVSLAREAGIIGDAKGNYILLDAGYRIIPESRLYVEWERLDAKADDADYTAAIRNQYTAGIDYRLHKNVVPYIEYAHTRTKFANAETEKDNTFGVGLRVFF

SEQ ID NO: 8408 - protein, 343 aa, Haemophilus somnus
MKKTIIALITSALFFSGGASAVTVYSAEGTKVNLDGRASFELINRTDKRSDLIDRGSRVRIHAYQDIGSGFTALANVEIRFTKDGDIGNQIYTKRLYGGFQHKLGSLTFGKQALLADSIGYSNFTYELGKITMMPKDADKAVRLLTDWFYGFRFGADYVFGTSEKYDDSDRELANKNRAYELAMFYNNKFGEFNVKGAVAYSQQKAGTLAKDEYDKKAMSTSVQLGYGKGAVGFDWTKGKSIEGKKDFKFRVGNNKFEEINLFEVGAKYAVTDKNNVYAEYLWGTGEIQGQDDGKFKGWFLGADHQFNKRVVTYLEGGSFKTKRSGDTLEKEKRIALGLRVYF

SEQ ID NO: 8409 - protein, 125 aa, Haemophilus somnus
MMTMYATLEEAIDAAREEFLADNPGIDAEDANVQQFNAQKYVLQDGDIMWQVEFFADEGEEGECLPMLSGEAAQSVFDGDYDEIEIRQEWQEENTLHEWDEGEFQLEPPLDTEEGRAAADEWDER

SEQ ID NO: 8410 - protein, 396 aa, Haemophilus somnus
MKKKISALALISLMVAANASASGFRIPEQSVDSTAKAGANIASSTRADATYFNPANMSWLEDGTMIQGNLTYIHLTKNEYHGADGYSSNAEDENFVMPTGFIVSPYFGDFRFGISNTSPYGLAKRWKNNAGTGSAREFSMETFELNPTLSYRINDKVSLAGGVRMMYANATIKNVLYDMEGDTIEWGYNLALSVRPVESWNISATYRSKIDLNFSESDVRFNPTASGLLPPSAIISASTSVPAPAVLALSTSFQPLENLTVELTVDRTFWSAYDQLNIVTNPAGYSKSFLKDWDDGNAYRLGLSYDLNDALTLMAGFAYDECPSPNSTVGFELPDAPAWLYSVGFQYAMTENLDVGMAVLYDYKEERDVNHPGIGAVGEFTNGGAFLVSTGLNYRF

SEQ ID NO: 8411 - protein, 277 aa, Haemophilus somnus
MNMKWLITASAFAFVSVSAAQAADVIVPPSPTPVAPVIVAPTFSWTGFYFGGQIGGFSGKTKMDILAKGQKIPVSDDYLPKLSGFMGGLYAGSNIDLGNGLILGVDTDIMWSNKDDTKTGKTYVIAPGHINYINKILKDAAINIGKDALEAGAKRTHSFTFKEKWAGATRVRIGFAAERIMPYVAGGIAYTQLQDTASISITEKDSDKVIASGTLSDETKTLVGYTLGAGVDLAMTNNIIVRAEYRYSDFGKKKFSNDKYETSYKTNDFRVGVAYKF

SEQ ID NO: 8412 - protein, 899 aa, Haemophilus somnus
MNSNKPSKLALSTLNCAVLAALFGWSVNTAAAEADIQEQEIEEVVAVGQRLKGSAGAVLQERQNQAFVADIMGADQISRTGDGDAASALRRVTGLTLVDGKFIYVRGLGERYSSTQLNSMYVPSPDPTRSVVPLDLFPSEIIESLSVQKSFSPDMPAHFGGGNVNIRTKSIPSDFLFKVQVGSSYNTSNSDSGYFYEGGDDDWMGRDDGTRALSNVFTTALTSDAGLEGNINSTLEERKKLIQSLDWNVGISKEDVDPAMSFSVAVGDRLESEIGTFGVLAAVSYDNEWEVVQEQSGSSLGSLGCENKCFAQYYDGTSTEQNVRWSGTLNLGYEFNSNHRFELTNIALHDMSDRVRNRNYYDANETEEGVTELRRVDISYEEREMFSSQLKGTHNFPELNNLFFDWYGGLSRANRNAPGGLDVVFQQNYNDGVFESEQLQDVAATNITREYQVLHDDVETFGWNMGLPFYGDGYELELKIGGDFSEKKRDASNVKFGITHRGISDEFTFGNNISDIFADANTSNDAFYTSATGSGIFDDGTTDGDKYSAAHKLDAYYFMADYFFENTWRITGGVRWEDFKQVSIGYQAHSNLFENTLEEIQDVVINEDTFFPSLAVTYIMDEEMQFRLNVSETTIRPDLRDVSTSFFVDPLTEFLVRGSPSLQSSELTNVDFRFEWYMATGNNLSVALFYKDIENPIEMVELAGVGGASPQLLTANAQSGKLSGIEVDFLTDFGFINKDWSSAFLSGNVTLSDSSVNLGINDSDNVDSLFETQLKEALEADTVSNIVTNNKRRLVGHSEWVANLQMGYDSDDGFHSTSVIYNVFGPRIIVPGTRGNEDAEEKSFHSLDLVYSYFPNFNSKVNFKVKNILGQEKQIEQEGLTLWGQETGTEFSLSYSYEF

SEQ ID NO: 8413 - protein, 868 aa, Haemophilus somnus
MKLYKFRKELFVLTFLVSGSSISAEIIAELDEVVVSDSSSVADFQSLAFQGGRKASDVFIEGKEFKTRSATLGNALAGELGVHSNPFGGGASAPVIRGQEGVRIKLLQNGSDIVDMSNISPDHAVVADTLLAQQVELVRGTSTLMYGMASPAGVVNIVDNRIPTSRPEKGYEGEIVSRFDTASKEKVLTAGVTLAAGDNFLIRAEGLTRKSENYHVPEVFIGQKLNYLPDSHHKSKVGTLGTTWIGDKGYLGASVSYRKDRYGIPGHNHAFDYCSGHLFDTDNLKAITGGDGEAPYLNAYPHLMTDADMISSLHFHCGADIQGHKHSHESIYGHDHDISEAGPVVDMRSKRYDVRGEWKAPLPWISKVKLSLAYADYYHDEKHDGKAHIDKNDSQGIKDRKKYTAAIMSGKPEAFYANRGFNSRLEIYHQPTEHFNGVVGMQYQTQKTKVQRLAPSLNNNGQDLSGERKESERNPLVPHTNKQFSVFALEQFTWRNFIVEVGARWETQRIPIKYDPNKLRLDKAAGSKVRLPDLSPYTENALSYSGTLMWDFHPAYRLSITGSHNERIPSPMELYYHGKHLATNSFQYGNKDLKKERSNNVEIGLMRISDKWDFKVSAYYQRFKNYIHNENLYREGNLFMRRYNQSQARFYGFEGEIGYQITPNHKITFFGDYVNGKLFGFKKFYGNPKFKKICEIPKAQLIDIERCIEDEEWGEEWDYRKIGEQIIERPNRNAARVPPMRLGFRLKSQFNDNWSSSLEYTRMFAQKRISINTVIKEIDREEAEKRRENANGLGYDGHYTELVPEDVTQGYHLLNLSLNYSRKIDGVEYSATLSANNLLNQKIYIHNSYLPYVPQMGRNFILNVGVTF

SEQ ID NO: 8414 - protein, 803 aa, Acinetobacter baumannii
MLNKSKLFLALITLGASKILLAAEGPVTTLNTIVLTAQSDELGSELLGKSLNVSNQFIDTSKLKQRSTTLGDALGTELGIHSNQYGGGASAPIIRGQEGKRIKVLQNNADVLDMSNMSPDHAVTVEPSLAKSIEIIRGASTLLYSSNSAAGVVNVIDYKIPTQMPQDGLEGNTTLRFNTGSNEKLTTAGVTVGLSPRVALRAEGLYRNAGNYKTPHYQSSSYNSLEDLENQNIVYKNLKYLPESWAESRLGTLGLSWIDDNTYLGVSYTHRHDEYGLPAHSHLYEGCGASAISINTRISGLKNYLLYYPQLMEEQDINYVNPRPDCHQHNHIHETTFSHNAPYIDLNTRRYDMRGEFTQPFTGIDKIRTSLSYIDYFHNELEGDKITNFFKNTGKVGRIELSHQPLGELTGILGLQYLEQDNSALSPVHSQEGHTTYLDTQQLLNRNVTKNFSVFGLEKYNWNDFTFELGARIEKQKVSMDYDIEKIKDSMKPWPNKYNSPYVEKNNKIRAQNLKSILEAVQPNKETAFSYAGTVHWRFAPNYILSLTGTHQERLPNAQEMYTHGMHLATNSFEIGNRFLRKEKSNNLEISLAYKDDLLDYQISTYYYDFDNYIYLQTLNEVLGTTKVRDQHTLRINHYSQSAANFYGLEGNIGYQFNSVYHGSLFGDYVKGRLTNLPDAVIAYDIWNREPTLAPQKDRYTPRLPPARLGTRLKADFDESLKGEIEYYRVFKQDNISKFEQVTSGYNMLNMTLAYKNKLSHTEYDLFFKANNLLDQKVYAHETFLPYIPQIGRNFSLGLNLNF

SEQ ID NO: 8415 - protein, 165 aa, Acinetobacter baumannii
MNGLTATGVTVGICAGLWQLVSSHVGLSQGWELLGTIGFVAFCSFYAAGGGKSGFIRSLAVNYSGMVWAFFAALTAGWLASVSGLSAFWASVITTVPFSAVVVWQGRFWLLSFIPGGFLGMTLFFASGMNWTVTLLGFLAGNCVGVISEYGGQKLSEATTKRDGY

SEQ ID NO: 8416 - protein, 762 aa, Acinetobacter baumannii
MSLIRTRKKIVSSAIASSLSMIATTAMAQEAVSQLPTIHTKATQEESLKVDQSANSKFVAPLKDTPKSVSILSQKLIKDTNSNTLLEALRYEPGITLGAGEGGTPFTDMPYIRGYSGQSSIYVDGVRNTTSQNRDMFAIEQVEVIKGSSSALGGGGSVGGSINLIPKVAHEGDVYQGSVQSGTDNYRHIQLDANKDFGNGIAGRVVIMGHENEKAGQSNGAEYKRVGIAPSITFGLDTATRGTLSYYYLRSNDEPDAGIPFNNANPAKPPVGVTVTPGGGKPVDVKAGTYYGWKARDFDKRENHIGTFKLEHDFNENLTLSNIATYNKSKSDYVYTNADDSKGNIYRGTVARRALSRILDTDAYSDQLSLRGKFNTGSLKHSFNVGTEWSFQETDQGVHTFTNAAGETTSTILDSNIQNCTSAAAVANGWCTSLNNPGNGAFTDKRGSITAQSTTRSHNVGIYALDSIEFNPQWLLNLGVRWDKFETEKKYNKDVDGRTPHKAGDKLESDTDYFSYQAGLVFKPTEDGSIYLSYATSANPVGVLAEGDTGSDSISDSGTASASANALKPEEARTFELGTKWDLFNNRANLTAAVFRTEKQNTRIQIDPNTTANAGKSKVDGFEISLNGKITDKWDVSTGYSYLDSEITEAAYNAVAQEGKPLPFVAKNSATLWSTYRVMPQLTLGAGVEYRDQVFVNTTAPKYLPTYTIYNAVAKYDVNKNVNLQLNINNISDKRYFTSAHAAHYAFEGNGRNAVLAINFKY

SEQ ID NO: 8417 - protein, 417 aa, Acinetobacter baumannii
MKTHKSLMVSCLSVLSITLFVQHAQAAAAFDPNGSWMLGDWNGQRTALQAQGYDFSFGYTGEYAGILDSKQTSTHGSAYTGQLALGSHLDLGKILGWQDTEAQITLTYRDGQSLSEHSPALAGHQSSVQEVWGREQTWRLTDLWIKKKFLDQKLDVKVGRFGEGEDFNSFDCDFQNLALCGSQVGNWVGDQWYNWPVSQWAMRVKYNLQPDLYTQVGVYEYNPENLERGKGFNLSTDGSHGAIIPAEVVWSPKLGVQSMPGEYRLGYYYSTADAKEIADSTKTSHKQGVWVTAKQKLFQPADQADRGLTGFVNLTFHDSDTNKVDNMQNIGLVYKGLLNQRPQDELALGVARIHINDDWNDVQAKEYDTEYNTELYYGIHATNWLTIRPNVQYVRHVGALKNGDNTWVGGIKFSTAF

SEQ ID NO: 8418 - protein, 624 aa, Acinetobacter baumannii
MFHKTFPLFLSALPLSVFAMESVDVISTEKAEANVEKITIEGAATANNKPVGTFNSPISNLEYDPRVDLQSRNMAEAQADVTIRGGIFENTGFRVGSATLIDPQTGHYFAEIPIAPEMLTKPSIFTGVDNALYGVNSSVGTVSFGWKLIQEAGSVSVGVGNNNFNLQRVHGAVKQQLKSYPAWSVGVEGEYSRSESDGTIANGDHQFERASGRVQLASECSQTDLFYGYQQKFFGWPNLYTPFDVNETEDIETRLVMLNHNQRYGEKGNESAFEVSTYYRENDDHYVFSRENPESFQAFHETQVKSLALSGTHNLSPRLGINYSAQITADDIESTTLENNFTSRDYYNISVVPEYRTQLNTKESITVRLGGAFDDTNRDEDRLSFVGDINWYTQTGDNASRSLYLSYAEATQVAGYTAVGGSTTSGLFRSNNQLQREVSKNLEFGASFDEQSWKVDTAVFYRWDNELTDWTYSFDSTSARSANPVDIETLGFELIAIKRFDNADVVASYTYLDKSEDYGIDGVDASFYALNYPPHRATLGLVWFATDTVEVRIDNEWRKQEINALRNGSDSAFFSHVTLTYSPAQIEGLNLVLAVDNLWDERFEEIPGTPGRGDQYSATVTYFW

SEQ ID NO: 8419 - protein, 685 aa, Acinetobacter baumannii
MLFYKNILTLSILAAISIPVFAAENENVEKLETIRIKAHPLEQTSKDFAVADTVVDQKHLTEGAATIGDALNSEVGIYANQFGAGSSRPVIRGQDGPRVKVLQNSSENVDVSTLSPDHAVTVDPVLAKQVEVIRGPSTLLFGAGTVGGLVNVIDNKIPTQIPENGYEGQVGLRYNTGSDEKLASAGVTVGLGSQVALRIEGLTRDANNYIAPNYIHEGEKERRVDNTFAQGDSVNVGLSWVYDRGYTGISYSNRRDQYGLPGHSHEYETCHIHDLSLHCGDHDHEGHSDEEAHDHEHEHGGPWIDLKSERYDFKTELNDPFAGFQKLRAQASYTDYQHDEIEEGTIATRFQNKGYDGRIELVHNPIADWEGVIGTQLGQQKLNLTGEEAFMAPTTTKKWSVFALEHKQWKDVHFELSARADQQEIDVDDNSKQDFDGSAFSYAGAANWEFAPNYKLSFVASHQERLPLAQELYANGGHFATNTYELGNDQLSKEKSNNVELGLHFDNDKLDYHLHVYHNWFDDYIYAQTLDRYKDFRLVQYTQDKARFYGAEGEIGYQITPMYKISAFGDYVRGKIDAEGNAPRIPAGRLGTKVDADFGDGFSGSAEYYHVFNQDKIAAYETETEGYNMLNLGVAYSGQYGAKTDYRVYLKANNLLDDTVYQHASFLSNIPQVGRNFTVGVDFSF

SEQ ID NO: 8420 - protein, 420 aa, Acinetobacter baumannii
MELLHRFKPCNLAITTLFGLLTSSSLWAADTTQQSEDEWKFTLKNAYINRDFDNDALKDTGSWSQAASLFYKSKMYDTPLIIADKPITIGADASVQYAVRLSSDKHVADTVLPFNKETQSQASDFLKYGATLKLGYDKTLLSIGELWLDLPVTAVDASRQLLASYWGTNLKSQLSDQLYAEIGRVEKVSPRNEEDFKKFSFTANGMTKESDGLNYIDLRYQFTPSLKGEYYFGNLEDLYNKHYVGLEHTWKQPNFALTSKFKYFNAKDDGNTFDIDAQNIGVLETLKVKNHTFGLGYQQIIGESAYPLPDGFLPETYFINWNATGFFKEDEKSYHVMYGYDFKDYVPGLNAMVKYVYGHDFKAANGEKNHETESNVILNYAFQQPFLKGFALQYIRIDYNVKHGNDFGEDRLFVNYTKKF

SEQ ID NO: 8421 - protein, 439 aa, Acinetobacter baumannii
MPNVMKLSVLTIAVLGSQFALANEPWSQDRQWLLGDWNGKRQQLEQQGYKFTASIMSQSATNLNGGYNDSNTFENAAQLSLGANLDLEKIAGWKDTTASLVVTKRDGNALTLERIKDPRSSQLGNAQEIYGRGKIWRLSQAWVKKGFVDNTVQVKFGRMGMSEDFNSSQCEFQNLLLCGGQLGKSIGSIWYNSPVGVWATNVKYQFAPEWTLGVGVYEVNLDNIKTESNSDGFNLDMNNVKGATIPVELAWKPKLAAFNGLPGEYKVGALYSTAEANDIKTAGKVHDGKQSFWINAQQQLSHAGQDPKRGLYVSFNSVVNDKATTFVQSTQQLALWYKGPFDSRPNDSIGFGIANYVVNDRAKDKQIATNESRGYYSYDPIASDYIPIQDDELNVELNYTYQWSPAVMLRPNIQYIHQPAGVKEVDDAWVAGLSVKVNF

SEQ ID NO: 8422 - protein, 253 aa, Acinetobacter baumannii
MRTTILATALFTTVSVPAYAEYQGGFANISMNYLDWTSHTTHKSGQTSHKDDFAYLELEGGAGFNWGELYGFFDLENAFNNQHAEPGDNQRYTFKTTGRFYLADTGFNLYGHVYGTYSLPGTAHGGNFHEVNTLYGIGYNTDFAGVWFKPFVALHYVDQTFYSGNNGYVVGWVAGYDFQLWEEKFSITNWNEIELNRNERYGNGGRNGTNGAIALWWTPHQSFTTGIQYRYADHKLGEDFWQDGIVYTIKYNF

SEQ ID NO: 8423 - protein, 406 aa, Acinetobacter baumannii
MKRSTSSAKAVVIGAALVGCAPAFAQSSVTLYGIVDNGLAYQSSSTSLGSTSGGHSVVKMTPGVWAGSRFGLKGGEDLGGGTRAIFQLESGLNSATGAAQYTNALFGRLAYVGVTNPAYGTFTAGRQYASYYQLLSPYSPTTWITGFYGAHPGDIDGLDTIYRANNTLEYTSPKLYGLTVSGSYSLAGVAGSVSQGSTWTTAVQYAMGPIGLAVGFSRINNSTSGGGAWGSDSTTSNGGSQIGVSALTNGYQTARAQQRFAVGGGYTFNSAWDVTATYSNVQYIPGINSKFTDTAIFNTGGVVLHWKPVTVWDLAAGYSYTRATQANGIKDSATYQQFNLSQYYALSKRTGLYALEAYQRANGKTLGTNGSSQIIEATATIGDGFNTTPSSTGSQFAFGLGVIHRF

SEQ ID NO: 8424 - protein, 696 aa, Acinetobacter baumannii
MRHKLGLLSSLGLSFISTLTWGEETSTVLETIRVQAESTREDVSQNSSATKFTHDVLDVPFNRAYLSKQIMEQQDVQRIDDALTLVSGVFHQNSFGGGFWDNYSFRGFSTDPNLGAAMIRNGLSVNRGINAPKDVVNIESLEFLKGPMAALYGRGETGGLLNLNSKKPQWESESELNLRANTQEQYRISLEHTAPINDELAYRLAVAHEDNQSFRDHVSSERWFFSPQLTWKISDQTQLDFDSEFTEHKGTFDRGVSTVNHQFVMDPKTFTGEPDDGDLKIKDYFYQLRLSHEFNPDWKLNSAVSYKDAQMVGFATEPRRMQNDGRTLERQRRYRDYTSEDVLAQTELLGKLDTSWARHEILLSTELGQLDYKQNQLRRNHSTDSPNTIDIYQPEYGKYLPNLTPFTDTKERQRYFALNVQDQIFFNDQWSVLLGNRFDQVEQDFKNHIKQTEDNQTLHQNSPRFGVNFKASEQWAFYTNYGRSFAMNSGMNRNGQTFAPEKGESYEVGTKYKINDQSVLSLALFKMKKRNVLTTDPIDSNFQTAAGEVSSKGIEFDLNSQINDRWFVNANYSYTDAQIEKDQDLAKGARLSNVPKHQGAISTNYEFLQDGARKAGVGANLTYVGERSGHNLDNGFNLPSYTLVNLNGYYAPSDRLRYQLNINNLFDKTYYVSSYSDLWVQPGEPLNASISAQWKF

SEQ ID NO: 8425 - protein, 718 aa, Acinetobacter baumannii
MQRTTKHFQINALALAIAMSTISAHAETDQQTSEYGTLPTIKVKAGSGQENEKSYIAGKTDTAVPLGLSVREVPQSVSVITQQRLQDQQLSTLVEVAENVTGVSVNRYETNRGGIYSRGFVVDNYIIDGIPTTYSLPWSSGEIFSSMALYDHIDVVRGATGLTFGAGNPSAAINMVRKRATSTEPTANVEVSAGSWDNYRVMGDIANSLNQSGTVRGRAVAQYEQGDSYTDLLSKEKLSLLLSAEADLSENTLLSGGVTYQEDDPRGPMWGGLPVWFSDGTKTNWSKNITTSADWTRWNVKYTNLFADLTHKFNDNWSAKLSYSHGKRDANSKLLYVSGSVDKNTGLGLSPYASAYDLEVEQDNASLQLNGSFDLWGLEQKVVLGYQYSNQDFTAYARSTDTKMEIGNFFEWNGSMPEPVWNAPTLNEKYNIEQNALFAATYLNPIEPLKFILGGRFTNYEKNIYGRSSSIKYDHEFVPYAGIIYDFNDVYTAYASYTSIFQPQDKKDFDGNYLDPVEGNSTEVGLKSAWFDGRLNGTLALYHIKQDNLAQEAGDVTRNGVKEIYYRAAKGATSEGFEVEVSGQITPDWNITAGYSQFSAKDTNDVDVNTQLPRKMIQTFTTYKLSGKLENITVGGGVNWQSSTYINAENPKEVIEKVEQGDYALVNLMARYQITKDFSAQLNINNVFDKKYYGVFPAYGQITLGAPRNAALTLQYKF

SEQ ID NO: 8426 - protein, 370 aa, Acinetobacter baumannii
MKIKLSKIVIAGSLLIFANMSYAEGVKRFSVSAGWLHVMPQGKANPFNINTSVKNGTVAKVGSISPTSFLNSVDPNATEVDVGGEPFNQKEFLELALNDDFLKGLLLDEEGNIKPEVAGEATIQGLEQWHQNDAGLEVDDTDTLGLMFNYYLNDNVSLQFIGGIPPKVDIKGQGEILAPLSGVALSPNELVKILFPNGITLGQAVPITNLGNKPKAASVRAWTPAIEAQYQFGKSGVNKFRPYLGVGLMYAHFNDIKLNDEIRSDLISAGHMIQNVLDGKAGAALDRKESSGNMVVKVDADDAIAPIFTAGFTYDFNDSWYTVASVSYAKLNNRTQIDVINQNTGARLIHGSTKVDIDPIITYLGVGYRF

SEQ ID NO: 8427 - protein, 932 aa, Acinetobacter baumannii
MGNKCETGNVKRFFLLLLGSFLSLSAWAQTGVICGTVSDAKFKDALIGASVVIEGTTVGAIADVEGNFRIENVKPGKYTIVASYVSYKSETIRDVVVKAHQESVLRIELSDADLQLQNVVVVAQRKLGTETAIINTVRKSLPVVSGISAQQIGKTQDSDAAEVLRRIPGLTIVDDRFVVVRGLAQRYNNVWLNEATTPSSETDSRAFSFDVLPSSLIDNMMVYKSPSAELPADFSGGFVQVMTKNIPDGNTFNVSYQMGFNTNATFRSFQLTDGSWKDYLGFGAGVRSLPSSFPSHLGDYSTEEAAAFTRRINQRWGINRFTAIPDQKISLTSHRSFDAGDWKIGNIANVNWSTGYDYSETVNNNYIAYDVANDLSRPRFEYNDVRYKNTSKLGALFNWSFMKGDHKYEFRNFFSQRGVSALTQREGMNYYSDKAIRKWESLYTGRTTYSGQLDGTHTLQEDINKVDWTAGYAFAAYREPDRKIVNSILDETKTDLPNYYVSDPMRYYQDLKDHGVSLAANYEHKFTVSDKFAPVLDGGVYGEYKSRTFDARRFGYNLLGKGYDRYADWDYTGLFCDENISADRIWMRETTTNSDSYTSENILGAAYVSAKLNYGEALNANIGVRMEYYNLKMDGYSSDGTTPVHLDNRTSDFFPSVNISYNLSAKHLVRAAYGRSVNRPEFREVVPYVYFNFERDANIVGNTELKNAYADNLEVRYEFYPASGEMITVGAFYKRFKDPIEETYNEAGSGLQYTYHNAKNAETFGIELDMKKSLDFIGLRGLSLVCNAAYIHSRVRFEEGAPERDRPLAGQSPYLVNAGLFYQHDDKGISASLLYNRIGKRIESVGVPMQDQNEDIPDIYEMPRNSLDLTFSKKIGKAVEIKAGIQDMLNSKIEYKQFVKLTDKNGGKREREQLVRSYRPGVDINVGVSLKF

SEQ ID NO: 8428 - protein, 554 aa, Acinetobacter baumannii
MKYPKLCPLTAAIVISGFSSFANAQLGQNLAVDIRSLSMGNAVTADPPGISAVHFNPAALAKIDGLQTDVQGILANFDIQREFSAPPGYNVFGYSDDPIVCNDGPEVSANICTDFKDSVHGDVEYASLYVPILKKMVDLGAGYPLVAPTAGIAYKPPGSKVTYATAVYAPLVAGFGAENGNPGNYMGQQVAVERITYLSPSFGYQVNDHLSIGASVGMSYNALALKTDLRFPNEMIGVLRMVDEVVCKPFKNNNDMITDLLLFGICNTQEGMNPFGKMGALQVSLEQSLSPSYNLGLLWEPTDNFGFGMVYQSSAKMRLKGKYMIDNAKAPQQLVSGLNSSLTGQVLARILGLPSYVPDIESGLVAMDLEYPAHFQAGIKYKILPDLQLNLDVGWTDYSAWDKFKFEFDRQISLLKVAKLLSNNVTDNSLALPLKFTSPWSWGIGLEYSATDRLKLRAGYEPRASAIPDDKRNTMVPINNAQLFGLGVGYRFDADTDLDLSVGFLRSRDNIPACTSTLSNKCGVDNILLNPYAGLDVKTNTKVTALGLSYRTKW

SEQ ID NO: 8429 - protein, 461 aa, Acinetobacter baumannii
MNFVVNKKIFILGIASICTSTLHAAAFDKTGQSVAAFLQPGNYFEASLGITDADLSGVESGTNPSHHSILDIANTDYRPTAALKLQLAPQYSFGLLYDQPFGADTEYSGVNGFVATPKDTVMLPGITTTGLASATLGHAPTGNAKSEFDIQNLSFILGYQPTKNWNLYAGPVYQTFKSQVELRGNVFSLYNGYDFHTKTVSDLGWLAGLAYQIPEKAVKVSLTYRSAITHKVNATENAPLIDMLSTQQGRDLVNQHLDFMISIGQMTPQKKAYLNQIIANLPEQEDTGTTKFKSPDSVNLEFQTGLRQGTLLFGSLRWVNWSDLALQPYRFGEISKVVGVLSTPSRPEGFNLVRYYDDQWSLNLGLGQRFSPKWLGSVSVGWDSGAGDKVSTGGPTKGYYNLGVGAQYSPTSRYFISGGVKYYWLGDAKAQLGAQAGSDYYVGEFKDNHSVSYGLKIGYKF

SEQ ID NO: 8430 - protein, 794 aa, Acinetobacter baumannii
MLIDALDVTGDIHMSNNESTKKLGLLGALTLAVASIVSPAVAQDLVLEEVVVTATKRASKIQDISGTVNVLTGASIDRLKAFEFKDLELQTAGLTLSVPNARNASISLRGISTDPESGASSVVSVFWNDQVVRSDIAFGRLYDMDRVEILRGPQGTLQGRTSPGGSINLVTREASLTEPSGSIQASVADNDGINAQFAYGAPLVDGVFAARVAGVYDTNNSNDVTNTTTGLDDPEDEVSSLRLSATWQMTENLKSNFVYQYYDRDTERPSALRGSDALGIRPTVSAGDRVGFANSSEGATLDYDLYNLRFDWQLGNLDLMSVTGYNESTKNSLQENDRANYITLNGDPGSIDEASTNQNTITKTETLSQELRLSSSGNDVWDWMIGVFYLDQDTETSFTSNSVVAPPLNIGFSSVGAIPVTRDELAFFTFNEFHLSDRTTLEAGLRWTEYDSYRAADVFYGVLNYLPASLVPIADIVEGGIAAAFPIEGISDQYKNTKEDAITGSLTLRYDWTENTTVYAAYNRGYRPSGISINPTPAVALLPNGEADVLHDEESSNALEVGFKGRYLDGRAALNGAFYYQMFDGYFGFVRGIQVLDDAGNPNAISGGLIYNGDANIWGIELEGQILLGDRWSAGGALAYAKGEWDSGAQAPCNDRAPGEVLGFCDIGGESLGGEPELSVSLQSEYFIPAGSNEWYLRGLYKYTDERDNTDASAGLGITRGTLDDYHMVNVYAGLRHGGRQWDIGLWVKNLLDSDEVIYEQGPDAYDITTTGGSYTQTNILAERVLGLTVSYNF

SEQ ID NO: 8431 - protein, 754 aa, Acinetobacter baumannii
MSKRIIQSVLSVSVLASMMSMAFAAQNEQEQAEQTLEKPAEPVKLETIFVTAEEQVKQSLGVSVITKEDLAKLPVRNDISDYVRRMPGVNLTGNSATGQRGNNRQIDIRGMGPENTLILVDGKPINSRNSVRYGWKGERDTRGDSNWVPAEAIESIEVLRGPAAARYGSGAAGGVVNIITKKVTNETHGSVEFYTSQPEDSKEGSSNRVGFNVSGPLIKDVLSYRLYGNYNKTEADDVDINKSIGSTAAGREGVKNKDISGRLAWQATDQQTVLLDVSSSKQGNIYSGDSQLNANAEADAILSQLIGKETNTMYRDSYALTHEGDWSWGKSKLVAQYDKTHNKRLPEGLAGSVEGKINSLDDKATSRLETLRFNGEANIPFEYYLPQVLTVGTEWVEDRFKDNVSTTQGKDSSGSGYGDQLAKGDRSKMESRIASAYIEDNLKVTDSTDVVLGLRFDDHSKSGSNWSPSLNITQKLNDNFTLKGGVAKAYKAPNMYQNAEGYLLSTNGNGCPANIESRCLLQGNGDLKPETSVNKELGIQFQRDIVNASLTWFRNDYKDKIVAGTHVVGTADGSSTNANTGAVTNTKWNILRWENTPKALIQGFEGSLGLDFGDIRWTNNFTYMMDSKDKQTGNPLSLVPIYTINSIFDYDITDQLDVNFVFTQYGRQKSRQFAENRLESGIGSGGANSALKPSTVKSYSTAGINVGYKFSDQISTRVGVSNLFDKQILRDSNSISQTYNEPGRAYYASLKYSF

SEQ ID NO: 8432 - protein, 241 aa, Acinetobacter baumannii
MQLKQLAATCALLSATAMVQAKPIWQDFSVTGLYGENYEVVDDKETTITLEYAAKVKYADVFFFMDRMRGEDDYKSTYFELSPRLSLGEVSGKKLTYGPIKDVLISTTWESNTQNGNNFDNFLYGFAVDLDIPYFQYANLNFYRANNEKTDDDYQMTFVYGIPFKIASEDFLVDGFLDWSTAEDDHASELNWTTQWKWNVGKHISPDTRLYLGIEHSVWNNKFGIKGADENNVSALVKYHF

SEQ ID NO: 8433 - protein, 704 aa, Acinetobacter baumannii
MDLKLRLLSLSIAQLCCIPAAFADTNNSSTTLATIKIKAQQASDQTYKVDSSSSATRSEIALQDTPQSVSMVTQKVIEDIGATRLVEALDLAGGVTRANNFGGQGLTGFNMRGFTSGEFYRNGFPINRGYPNAPDSNTIERVDVLRGPSSSLYGRGDPGGTFNLISKTPKSEQQTTLGAQLSSEGLYRTTVDTTGTVPDAENIGYRLNVIAEGGDSYRDHVESKRYGIAPVIQWQATDATKVTFEADILRNQHPLDRGHTRYPTQKSFNSSPETYLWETGKYYNRLYNDNNMTQLRVEHDLGNDWKLNAGVQYLNGKLHGYAVEANGIQNDGETLGRNYNYRELKWQDTDAQINLTGNFQLLGLAHTLVTGLEYENYDYKSYIIRSSGDIGSYPINIYNPVLGQPLPELNRVTTHDRENLKTTALFVQDQIGLNERLSALLGLRFEHYEHDYKNLLPNTTNWNTSHDAFIPRLGLVYKASDDLSLYGNAAKSFKPNTGASRNGEGFDPEEGTAYELGFKWQALDNMLSIDSAIFYANKENVLTLDPVDSAYKVAAGEVRSRGIELNIAGQITPAWKIIGGYAYTDAEVTKDNTLQKGTALANIPKNSFNLLNIYEFQDGPLQGLGLGINQKYIDKRAGQTANSTYTMKGYAVTDLVSYYQATPKLRLNLDVKNIFDKVYDESAFNLYAYPGESRTVQLGMSYTF

SEQ ID NO: 8434 - protein, 416 aa, Acinetobacter baumannii
MSKLWMYSAVMLSGSVFASDFIDKSTVELTTRNFYFDRDYQEVSKYPAAKDWTQGFIFKANSGYTEGTIGFGLDVLATAGFKLDASAKYAGTGNLPRDTVTNEPASSYGEIGLTGKAKVSQTELKVGTLRPMNPVLVASPARLLPQTYRGISLESKDIKNFELQGAFIDKVNQRDSTNYENIRISAVNGRFKSAETNGLYYAGGYYNVSPALRLGLFYLDVNNLYDQMTTGFLYKWDINPQTRLSSYLHYYRSRDEGQAKAGLVDNDLYHAHFELKRQNHKFIFGTFQHFGETAFPYLTGGETGLLIDTWPGEFLNPKEKAYSFRYEYDFKDYVPGLRFMTRYTMGRNIYAPNLGGTNLKERETDFDIGYTIQTGWLKNLALRARYAIYDNNMLATANIKPVNETRINIDYTWKFK

SEQ ID NO: 8435 - protein, 426 aa, Acinetobacter baumannii
MKKTPLWVGVCLCPLFSQVVHAEFIADSKAELTLRNFYFDRDYKKDPYPYTAARDWAQGLIFKGQSGYTEGTVGFGVDVLAMAGFNLMGSRADDYARSGLLPVNTDNSRDDYYGKIGITGKAKFRKNELFVGDLVPQLPTIFSSPARLFPQTYRGIRFVSNEIPNLQLEGFYVDEVRQRDSIRYTDVGTDNINHRFNKAATTDSFYTLGGSYQLKDYRLRAYHAELKDIYQQQFLGFNGKQPLNDQLNFLSDVRFFNSEETGSKKIGEVDNRHISGLFGLNYQNHTVSLGYMQSFGSTGLPFLSGTESPVVLDFMSSDYSNKDEKVYSIRYEYDFKNARIGDVSLNGLRFMTRYAKGEDIDLLQYGDQRFKEDSLEFDLGYKIPEGKLKGLGMRARFSHYRNDMPTNMTFHSANETRLNVDYTFKF

SEQ ID NO: 8436 - protein, 702 aa, Acinetobacter baumannii
MELKYRGQNRTATIIKAGVSAAMAGTALGFAVPAFAQQASEGNTVLQQIVVTASGFEQNVKDAPASITVVTREDLEKGSYRDLTDALREVQGVSVTGIANEKDVFIRGLPGAYTLILVDGKRQSTRDARTNGNSGFEQSFVPPVSAIERIEVVRGPMSSLYGSDAMGGVINIITRKVGDVWSGSVTTEGTVQQHSKFGNSGQVSWYANGPILKDQLGLQLWGRGFTRGEDRILNGTTGAKEYDFNGRLTFTPNEDHDIYLEGGKTRLRRDAEPGDTLAATDANGTYNTNTRDHWSLSHTGRWGPTTSEFSFQQEWAERTNFTRNTRTGRVTENPRSPEIRNTVLDGKFTTPFELFGNHTLVTGGQYFEARLTDQNPGRRTDRDETFSATQWALFLEDEWRIVDNFALTGGLRLDNHEKYGNHFSPRLYGVWSATEELTIKGGVSTGFRAPEIRQIAPGYAYTTGGGGCSYGPSGTCGVIIGDPNLEAEKSTSYEIAALWDNGDIALGATYFYTDFKDKISNALVLNPDGTPARWSEDRNYRLWYNYNIDDAIIQGVELTATWYATSELTLRGNYTYTHSEQKTGDYEGFPLARTPEHMANLRGDWVTPIDGLEAWVSLNYHGSEINAGPRIGANGTPVTINGQSGRKYDAYTTLDIGAKYAVAENVDLNAAVYNVFDKDVGTDDFNTVMEGRRFWISMTAKF

SEQ ID NO: 8437 - protein, 326 aa, Acinetobacter baumannii
MDISTKKVEFSMKLKFLVLALCVPAIFTTHATTNYPLFIPDNISTDISLGSLSGKTKERVYHPKEGGRKISQLDWKYSNATIVRGGIDWKLIPKVSFGVSGWTTLGNQKASMVDKDWNNSNTPQVWTDQSWHPNTHLRDANEFELNLKGWLLNNLDYRLGLIAGYQESRYSFNAMGGSYIYSENGGNRNKKGAHPSGERTIGYKQLFKIPYIGLTANYRHENFEFGAELKYSGWVRSSDTDKHYQTETIFKDEIKNQNYCSVAANIGYYVTPSAKFYIEGSRNYISNKKGDTSLYEQSTNISGTIKNSASIEYIGFLTSAGIKYIF

SEQ ID NO: 8438 - protein, 805 aa, Acinetobacter baumannii
MNHKVLYRVALFCLFSMLSAVLMHAGEQQQQSKGIVTGRIVDQQKQPYYPVAVAIEGVYIGGYTNENGVYHINDVPAGSQTIVVSGIGVKTKKVPIHVTAGKVNRIPDIEIDTQAEELEEVQVIGKSEARRQQEQAYAISVLDIKKAYNSAAPLNKLLNNVSSVRIREEGGMGSNYNFSLNGFSGNQVKFFLDGIPMDNFGSSFNLANISANMAERVEVYKGVLPVNLGADALGGAVNIVSRRDANYLDATYSFGSFNTHKVSVNGAYTHLKTGFTVRANAFYNYSDNDYKVFVPIIDLATNKKINERWVRRFNDAYRSGGIRLETGITNKPYADYLLAGIILSKNDKDVQTGATMDAVYGGVKMKSESVIPSIRYKKDDLFLDGLSLSLYGTYNSVNTFNVDTIARRYNWLGESVPSTSAGEGYYTDSKIKNREWLGNGNISYVIDGHQSLILNHVVSAMRRTMNDKVRPDDENNNVPQQLTKNITGLGWQIRYDRWNANVFGKMYKLYSSTYKRLDEYTENARWEKVRDHKTNFGYGAAATYYILPSLQAKFSYEHAYRLPESIEMFGDGLIQQRNPDLKPESSRNLNLGLSFIQTFGAHQLSADGNFIYRYTTDFILKGVSLTSNPTTGYENLGKVLTKGVEAAVRYNYKDLFHTGAGFTYQDITDRQRYEKTKDSFVGEGITENITYKERLPNIPYLFANADAGVRFHDLIWRNSVLTFDYNLNYIHSYYLSFPGLGAKSSKKVIPEQFSHDLALGYSMDNGKYSVVVECTNLTNQKLYDNYRLQKPGRAFNVKLRYFFSK

SEQ ID NO: 8439 - protein, 691 aa, Acinetobacter baumannii
MPHSKFLLQPLWVAMLAVSHSGLVFAESEKNDADTNTLHSLAPIVVTAQQGNDANGLIVHADPKQPIQPVPATDGADYLQSIMGFNSIQSGGTNGDVTFRGMFGSRIKILTDGTENLGACPNRMDAPTSYISPESYDRISVIKGPQTVQYANTGSAATVLFERQPEKLTSEKPYRGQASVLLGSYGRIDHNIEAAVGDEKKYIRLNANRSESNSYQDGDGNTVPSAWKKWNADVALGFTPDENTWVEITGGKSDGESLYAGRSMDGSQFARESLGLRFEKKNITDVIKKIEGQVNYSYNDHVMDNFRLRIPPMTHDMMTHQMVVNPSEMQVTRRTLNTRFAMTSEWGKLNVITGIDSQQNHHAESMKSLMMDMPLTTNMKFQSYGAFGELGYQLSENSKLVTGARLDQVKIDALKLNDDRSETLPSGFIRLETQLPEHNAKSYIGLGYVERVPDYWELFSTAHGNSGMPKPTFNDLDTEKTLQLDMGYQHQHGAFNSWASAYVGLINDYILMSYHNHPTSGGHGHGSSFSAGAKNVDATIAGAEAGIGYQFTDRIQADLSAMYAWGKNTTDDKPLPQISPLEGRLNIRYVADKYNLGLLWRAVAEQNRVSLHQGNIVGYDLKPSKGFSTLSLNGSYNLRKDIDVSVGIDNVLDKTYTEHLNKAGSAGFGFASEEQFNNIGRNYWVRMSMKF

SEQ ID NO: 8440 - protein, 338 aa, Acinetobacter baumannii
MLKAQKLTLAVLISAAIISSAQASEQSEAKGFVEDANGSILFRTGYLTRDKKQGAKDTSSFAQSAIVNLESGFTPGIVGFGVGVVGDGSFKIGENNNAGNQMIPKHNDGSAYDHWGRGGGSVKARFSNTTVRYGTQVLDLPVLASNTGRMVPEYFTGTLLTSHEIKNLELVAGKFTKDQMSDQINTDADVFGKGLDRAIVWGGKYKFDDNLNASYYGLDSKNKLERHYANVNYKQPLANDSSLTYDFSGYHTKFDANARTYSATGFVAPDYADNGKAGEEKTNNILAISGTYATGPHSVMLAYQQNTGNVGYDYGQNADGFQSIYLPNSYMSDFIGNH

SEQ ID NO: 8441 - protein, 904 aa, Acinetobacter baumannii
MKKKYNVRSQATPKIGKTILKLSTLSLSMMCLTMAQAAETEQSSTDEKPTKVVKVAVTGSSIKGVAAQSASPITVVKVDEILKQGVTTTEEALAKISANQSSFVTAQNVGASGTVGSAADLRGIGANKTLILLNGRRLAANAYDSGVTNLNIIPLAMLDRIEVLRDGASAIYGTDAIGGVINFITKKQFTGLNISGGLTQPEQNGGDTQDVSVFGGYGDLDENGFNIFGVVDYRHGNDVMAKDRKVSKRGGLLPELGITKGSSGSFPANFYDTKTGTEGNPYAATGCGNNPLVYAQGGFCRYNSQAVIGIVPKTEDISALGRATFKLNDNLNAVAEYVYARNEITTSVAPDVFFDLTLNPDSKYYPGNGITPAMNKVSGPLELYIRSQAGNRVSSSINESHRIFGGLEGEAYGWDINTGITYAHSEAEDRLNSGYLNYKKTQEALNNGILNPFGPQAPEDAGLWDTLGVTGTYLKADVDSTTVDFTASRPIFTLPAGDVGFAIGASYRHDEWTSNVVSEVASQAPSTGVDPDEPTNKGKRDIKAVFTELHIPLHKTLEAQLAARYDDYSDFGDTFNPKFALRWEPIKQLMFRTSYSTGFRAPTLWEVNAPNSITNTSAYYNDPVLCPNGPPKNPGDTLPSGGVASRDCETQFDRKNGGNKDLNPEESKSFTAGLVLEPIKNLVLTLDYFNIEVENQIAALPEGDIFNNPTKYADKFVRNPDGTLNHIITTQDNMGDLKTSGVDVSLNYITPMTATGRFGFGIDGTYVIKYKYQNEKDGEWIGSLGAYVGDAPIIRWKHTANLYWNYQNWGVNFQQQFTRGYDDQNSSSSVAEGYRDHKVSDYTIYNISGTYKGFKNLEVTAGIKNIFDEDPPASNVGDNFQMGYDPRYADPLGRTYFVRGTYKF

SEQ ID NO: 8442 - protein, 772 aa, Acinetobacter baumannii
MEKMNVNNKIGVKSRNHIRSKQVLFKMTPCCLAISAIFAQQAYAETVTQTAEVSENATQKPVAQLQKIVVTATRTPKNIAEIAGTVQSIDQKQIIQQATAGRKVADILAQLVPSLASSSGTTSNYGQTMRGRNVLVMIDGVSQTGSRDVSRQLNSISPGMIERIEVISGATSIYGSGATGGIINIITKRADTSKPLSFETKVGITSSDTFRSDGLAYEVGQSVSFNKGNIDGFLGANFTSRGSQFDGNGDRISLSPWQGSTMDTDTIDVNGRLNFNLNDTQTLSFGAQYYKDKQDTDYGPDYSYLPTTSKSNDATTPTYKAIKGLKLSNPLFTERYAVNSQYQNQDFLGQILNVEAYYRNEKSRFFPYGLSNKSVTSVNQSQSEIEVAGLRSTMQTDLNIANRDMKITYGLDYDWEKDKQFVDILATQYPYLVYTPTGQRKGYGPNTEIQNIGAFVQSDYAVTDKLNLQAGIRYQYIQADTDAYIPSRETTMVPAGSTHDDKPLFNLGAVYKLTDAQQVYANFSQGFSFPDVQRMLRDVSTYTVSTANLQPITVNSYELGWRLNQDDGLNLGLTGFYNTSDKTVQFNNRAAKVVDTDQRVYGAEATISYPFMENYKVGGTLGYTRGQYKDVANKWHELNSFTVAPVKGTLFAEWDNNEGYGVRVQMQAIKGTNKAYKDDRELAAFATTQDEAFQNAVKNDANSAAQIKGYTTMDVLAHFPAWKGRVDFGVYNVWNRQYRTVFAQQAAVSNANPLLAIPAEGRTYGLSYTFNY

SEQ ID NO: 8443 - protein, 1086 aa, Acinetobacter baumannii
MFIILTIYIKRRMMSKRMKNMRVLLLMILAVFSLSVSAQTITATGNVKDATGDPIIGASIVEKGNTSNGTITNLDGDFSLKVPANATLIVSYIGMKTQEIAIKGKNKIDVTLSDDTKALDEVVVIGYGTAKRKDITGSVATVSSEVLSAVPVASATEALQGKMAGVQITTTEGSPDAEMKIRVRGGGSITGDNTPLFIVDGFPVESISDIPASDIEDMTVLKDASSTAIYGSRGANGVILVTTKSGKEGKLSVSYNTYYSWKKMAKTLETLSATDYVKWQREYALLRGNESKFTSLFGNWQDADLYENAPTNDWQDQVFGRTGNTFNHSLTISGGSDKTKFNMGYAHMNDKAIMLGSSFRRDNLSLKLNHKVNDKVSLDFSMRYANTTVNGAGANESKSEVSSADSRMKNVMIYPMFNFPDLSDSYDPDFQLTNPITSVYDTDRKQNRQTFNMNGSFSWEIFKNFKFKTEFGLDWYYNTDKKYYGPSTYNARTNSSDTEGVHPMAYFADTQRKTFRNTNTVNYNFKDIIKNKDHNLNVLVGEETINKKSSLNDDRLSFFPVSFTASQAWALSSQGTPYSVDKYTNADDNLLSYFGRVNYDFQSKYLISGTFRADGSSKFSKGNRWGYFPSAAVAWRISSEKFMEKTQNWLDDLKIRFSYGTAGNNNIPADQTSPVWSSGSTTWLNQFPSYWTSGIASGQSGSYASNPDLKWETTVTRNVGLDYTLFGGKLTGSIEYYKNTTKDLLIAFPVSGSGYDYQYRNLGKTENKGFEISLTWNIISKKNYELSFNGNVGFNKNKVKNLGTLSQYPASSGWASTQIQDDFIVKPGHSVGEIYGYVTAGRYEVSDFEDYYASGEKWVLKQDVASNAGVIGASYLRPGALKLKNIDDSDNVIDEKDRTVIGNTNPKASGGFALSGRVYGFDLSANFTYSIGNDVYNANKIEYTSSYQYYYRNMIDIMAEGKRWTNLDANGNLVNDPAQLAALNANTTMWSPYTSYVLTDWAVEDGSFLRLSTLTVGYTLPQSLTRKVGINNLRFYATCYNVFCLTGYSGFDPEVSTRNKTALTPGVDYSAYPKSRQFVIGLNLNF

SEQ ID NO: 8444 - protein, 368 aa, Acinetobacter baumannii
MKKLLLAAAVATLSVNAVQAAPTLYGKLNVSINQVDNKNFDGKSDVTEVNSNSSRIGVKGEEKLTDKLSAVYLAEWAISTDGSGSDTDLSARNRFIGLKTEGVGTLKVGKYDSYFKTSAGSNQDIFNDDTRLDITNIMYGENRLDNVVGFELDPKLLAGLTFNIMAQTGESTSDSKKGETGKDSKNDSFDSVSTSLGYENKDLGLAIAAAGDFGIKGKYAAYGLKDVYTDAYRVTGSYDIAKSGFVVGALWQHAEPTDDLTAYGQTYKSDGSIDKAGKAYRGLEEEAYAVTAAYKIPNTKLKVKAEYASAETQVNGQADRKIDLYGLGLDYQINKQARFYGIVAQQKRDWLNDDDKQTVVGTGIEYNF

SEQ ID NO: 8445 - protein, 721 aa, Acinetobacter baumannii
MRIIYIIFNLMNIPPRPFKLSVIACAICYANLTYAQDAQVQALQTIQVKASDAEQSSEQTKAYNVKNSSSATKLNIEAKETPQTINVVTRQQIEDFGLTSTRDVLRNTPGVTVSNQETERTTYMARGFEISNILTDGVGFPLSGYNYNNTNPDTYFYDRVEVVKGADSLTNAFGDPSATINNIRKRPTQEFQASDGVSYGSWDTQRYEADVSGSILPSGKVRGRIMGYEQTGDSYLDRYSAEKNGFAGIVEADLTDSTLLTAGYSQEQNKPNANNWGALPLLDANGKQISYDRSYNPNPDWAHWDNETQNAFVELKQKLNDQWNAKLTYNYLDTKHNSRLLYYYGYPKADGSGVSLTPWGGQEHQEKHAVDFNLEGTYKLFNREHEATLGYSYVRNHQQDKQSTGTINDSNVIKSTTTDWASWTPQSITWSAFTEAANYKQNINSIYAATRLHLNEDLKLLLGVNYVQAESKGESYSSPMSYSESKVSPYVGLTYNFTPEYTGYMSYTSIFRPQTGIDKDTNQALKPIEGKSYEMGVKSSWLDDRLTGTLSVFKTEQNNYPLRNSDGNPLNRKVPTSDLESQGVEVGLSGQITDNVNLSLGYAQFSIKDTKNGGEARIYNPNQTLNLLTTYTPPVLPKLKVGAGLQWQDGIKLYDSNVNGTIKQDAYALVNLMASYEVNDHITLQANGNNIFDKKYLNSFPDGQAFYGAPANYTVAVKFKY

SEQ ID NO: 8446 - protein, 755 aa, Acinetobacter baumannii
MHGLIYIAVAIFITLCFHMRQPGRPRRLSSPKDDAFMPVATPLFHRLPLAAAIALTLPLPALAATPKPTELDRVQVKVSTATRSERLLSDVPIRTEVLRKEDIALRAATDFSRAAELINGLRVESNCQNCNTSEVQLLGLPGAYNQLLFDGIPLLSTLGSVYGLEQIPAGFVDRIEVVKGGGSALYGPGAVAGVINLIPPLPARSGGHVQAGVDVLKGTPQKNADVRLDLVAKEADAGLSVIAQRNWNSGIDYNGDGYTEITRKNLKVGGLQAWYAPTPGTRLRLDLQVTDETRRGGNRLDQPEYLANIAESLDTKYRRGSVSWDQEINADVDFRLAYAFADIDRDSFYGGLGDVVTDPSAPGYDPSQLDPNVAGSAASRSWRQYGRTHNPLHYIDSQLNWRLGAHALAFGVQYKHEALRDDNRTGDGQRLAVLEDATFHNLGAFIQDEWSLRDNVDLVLGARVDKSSELDSAVFSPRIALAWQATPNLKWRAGIATGFRAPEIFVEDVHVDTLGGEQVRVRNTDGLKEERALTTLFGFDWRSDPANPVWSWDATASYARIRDTFALGEIQRGDDGQLSQLRYNASGSNVLGAETNLGWQPSPQWRLTAGASWYRSRFREPQRIFDDTGDGGDTVIESRDYLKTPRWTGLAQLSWMPAEPWETFVALRHTGPMAVLNNRLGELHRTRSFLVTDLGARWHRHLGAQAQQEVSVAAGVKNVFDQRQKDLEMGALRDSDYVYGPRFARSWYVNLRYAF

SEQ ID NO: 8447 - protein, 503 aa, Acinetobacter baumannii
MKLKHLSTAMILATLPATGVFAAALDRSGQSMSAFFQPGNYFEAGISVLDPDVAGKEAGSSATRRDIGDMANDYYFPSAALKLQINDQFSFGLLYDQPFGADAEYSGNNVFVSNPGSDTILSQKALGDLATSSIQKLVQASGSAFTPALIEVTKVTGGDPTKPTQTEILGALQQVAAGGNTTVGAGLTALQKTQAAINAANNYLGTGGTKVKVDTQNLSFVFGYQPTKNFNFYAGPVLQTVKGNVSLRGQAYSLYNGYDANIKETTGAGWLAGAAYQIPEIALRASVTYRSEIDHKVNIDENLSILNFPGLTSVLAGLDVPASKLQAINSSGKTTITTPQSVNLDFQTGIMADTVAFANVRWVNWKDFSIQPYKFGKVSEAVGGLIGRPNGFNLVEYSDDQWSVNAGVGRKLNDKWAGNVSVGWDSGAGNPVTTLGPTEGYWNVGLGVQYSPTPQTFIAGGVKYFWLGDAKAQTGAQAGSDEYVADFSDNNAIAYGLKLGYKF

SEQ ID NO: 8448 - protein, 709 aa, Candidatus Cloacamonas acidaminovorans
MRKWMGTALAVLAVTDAAAAHEAQAPRPDVEEIVITARARALEAGKLADTIQQTEVVGLGELRATQSAVLSEALQFSPGVRVNNECSMCAVKRVMLNGLGGQHTTFLIDGLPAHTLVSGFYGPDALSMAGVERIEIARGAGASLTAPEAIGGTINIVTQDPTSTGVTVNAAGGSFGYRQGDAVATYASDDGLFRALFSAQHDERDQVDGDDNGVSENPFLENTNYTARASFDPTQGSTVSLRGAYTRSEVFGGPVIGDTTASIGATLDGFRTSPDPSDRLFAGDDVRNRYIGKPWETTEWIETKRKELSGRYFQELTDDLNADLGVSWSKHEQDSFYEGFDYRADNKMLYLTGRLNWSIDADHLLTVGGDRRDETLRSASDAALGNPNYISDSFDYLTNGLFVQHTWTPLRELEVATALRLDWVEADFIDAQRPGTDIDETMVSPRIDLRYQHSDQWTSRVSAGRGYRAPLSFFESDHGILDAGQGFLIEVDELETSTSLTYALSYTGGRLNWTAALAWTAIDNLAALDEVEIDGNAVPVLTQRDETGHAYGGTIDIGYKLTDTLDLSLTLEKFEHDDVMRSIFGVAPIEERAILGLEWHPGAWDIDVNMTWIGPRDLTDYGYEGYEDAGLTIPKSTHADAFVTVDARIEYAVTEDIALYVGGRNLLDYTQVKDEETPLFFKPDGGYDVAYIYGPLRGRELYAGTRFSF

SEQ ID NO: 8449 - protein, 204 aa, Candidatus Cloacamonas acidaminovorans
MKRTLLAVAAVCALSSGAAFAQQAEGPWMVRVRAVNLDSANKDSTGLGLSINNKWMPELDVSYFFTPNIAAELVLTYPQKHDLRANGLGQIGSLKHLPPTLLAQYHFTNFGAFKPYVGAGVNYTRFSSVSFNPAVQAALNPSIKKNSFGGALQIGFDYALDKNWSLNFDVKKVFIETDVSSAGTKVGTFKVNPVLVGVGLGYRF

SEQ ID NO: 8450 - protein, 404 aa, Candidatus Cloacamonas acidaminovorans
MKQLIITIAALLLLPLAVMAQYEEDTENGVVSLNGKEGFTIATKKGDFVFKPYMLVQTSANINYYDDEGLDPAYNQDNIHNSGFSIPYAILGFTGKAFDRVTFNLSINAAGNGGNILQQAWFDVEIKKSFAIRVGKFKTPFSHAYLTTLGETLMPTLPTSLTSSVILPYSLNAVTPNIGMGFDLGVEVHGLVKDKFGYEVGIFNGTGSSVNVASKTFSDDWHIPSLLYAGRITYMPKGVMPSNQGSPNRLKEDKMLFGLSTSLNVESESESTNDFRAGAEFAMLKNRLYLGAEIYYMNVGFTKRQKIDESYNYLGGYVQGGYFVTNKLQATARYDFFNRNGLDTNGFLNMPAVGFNYFFTSCNLKLQAMYQFIGRTGHDTQLDRDNDDLGLAMHSGTVLLQYTF

SEQ ID NO: 8451 - protein, 358 aa, Candidatus Cloacamonas acidaminovorans
MQFLANGTGWDFILGGYYFTESVDGFIHIPIFFDPAAQFDQRGTGDTKAYAVFAHGSWEFVPRLKLVLGARYSHEKRTSEGVFTAPFVPIPTGGEKSFNAFTPKATLQFEPSDNLTVYGGVSKGFKSGGFTIGVPGPGVEPEKLLSYEVGLKAQMFDRRLTANIAAFWYDYTNMVVTRVVQAQTVEENAGKSTIKGIEVELTARPTSRLRIDASLGLLDAKFDSFTTPDPLNPAAGPISLAGNRLPGSAKYTARVGAQYDIPVGDIAKISISGDAFFSGDMYFDPYEHRGSYQPSYETYNASLTYDSGRWWSMTLWGRNLSNRTIVSNQLISADFWGYPRLTYLRDPRTYGIDFKAKF

SEQ ID NO: 8452 - protein, 254 aa, Acinetobacter baumannii
MSLIKRTVLFSLLLTISTVFSHSVHALEYKNSFGSINAGYADWNSGFVNVHRGEVWKVTADFGVNFKEAEFYSFIESNVLNHAVAGRNHTVSAMTHVRLFDSDYTFFGKIYGQWDNSWGDDLDMFYGAGYLGWSGSWGFFKPYIGLHNQSGDYVSQKYGQTSGWNGYVIGWTAAYNFNLFGEDFVLSDWNEIELDRNDAYTEQQFGRNGLNGGLTLAWKFYPRWKATVTYRYFANKLGYDGYGDQMIYMVGYSF

SEQ ID NO: 8453 - protein, 206 aa, Acinetobacter baumannii
MFIININKVGDIKVFKKALVIALMGVSSFTFAGNWQVKFGGSVIAPSEDTTTALGVVKADHEYAFTPSVEYFFGQTPFSAELLLATPINHDVLLDGQKVARIKQLPPTITAKYHFKNSTRFTPYIGIGATAFIPWDEQGVADKVKEDFGVAGQVGFNFQPADAKNWGVFVDVRYADISPEVTLTNGAKFDLDINPFVYTLGYSYKF

SEQ ID NO: 8454 - protein, 863 aa, Acinetobacter baumannii
MRHKCKLSFSVLMISYCFVQVTSAGKSRNAGLARLTSIVGGEKVPKGSALITESLIPSNNITISDGSVEIIDNGKVSMGATVEKGGKQIVTRGATAIGTKILGGKQLVFEDESFVDLENLKKRSSAYNATVSGGGGGVGQQNVYDGAMVWKTTVTRGGEQNLYIGPRKEGGIAEGTIVSGNGRQHILEEGRATNTTLNDEAVQVAYPGGVVDGLTINGHASAWLHVGTEVTGEIKVNGTGYLYLYAGDRTDHTTKEKLSVTGRSDETLFLVGERNNTDNQINMESLSGNGGTVSFSSIPYDPRHISLHVEKLSGNLNFHFNISGSNSDYLWIDSGAGNHKINVADSGVEITGHRLQKNGIIEINLVTDRSGGADFTLIDRSGKKIEAFDGGTYMYGLYKRERSANFSGDSTTWYLGKETAGRSGASSLPVDRKPKTRVALATSSNDASTGSQSHWDSSSSRRTGSNPQTANGAQNLTQTPKKRSPRHLREAQHPPVPPIISSPEDPAFGAIRPAGDPHSSDEQQKPIVSAEAQSLAEQMIMRPSYQDQSSLQSSQELSSSDFLTTPSTDAVLSMFVAPGLVFHNELQTVRVGRGTLDKNTALWTYAIKSKEKVATGYTDFKLEQMGLVLGISGLSELMDGEFHIGGFGSYDQTHVMHARGGMSGINTYSIGAYATYFDQSGWYVDGVLKYNHYQNHLKAVSTNGLAIEGNYNRWGLGTSFEVGYRFKPAQSSWIQPYAQFTWLQVEGKEIKLSNEMTGDMNPFTSLRSEVGLFAGYEVCSGGGASSMAYITAAWVRENRNSNHTTINKLHRFTTDLSGNAGRLGIGLSSFVSKKLKLYAEAHYGKGRKTKQSLQGVLGVRYSF

SEQ ID NO: 8455 - protein, 704 aa, Acinetobacter baumannii
MPHSKFLLQPLWVAMLAVSHSGLVFAESEKNDAETNTLHSLAPIVVTAQQGNDANGLIVHADPKQPIQPVPATDGADYLQSIMGFNSIQSGGTNGDVTFRGMFGSRIKILTDGTENLGACPNRMDAPTSYISPESYDQISVIKGPQTVQYANTGSAATVLFERLPEKLTSEKTYRGQASVLLGSYGRIDHNIEAAVGDEKKYIRLNANRSESNSYQDGDGNTVPSAWKKWNADVALGFTPDENTWVEITGGKSDGESLYAGRSMDGSQFARESLGLRFEKKNITDVIKKIEGQVNYSYNDHIMDNFSLRTPPLVEMNHGGMTMLMPNAMAMQVTRRTLNSRLAMTSEWNKWSLITGVDSQFNKHGGSMSSPTMPSMNVPYRQDMRFQSYGAFGELGYQWNDQNKLVTGVRLDRVTVEDERADSQAKGFNTKLEKTLPSAFVRWENQHPEHDLKSYIGLGYVERMPDYWELFSPKHGNAGSTNTFNGVNPEKTLQLDLGFQQQHGALNTWASAYAGLVDDYILMSYHHHPSMGMEGHDMSHDITAGAKNVDATIAGAEAGIGYQFTDRIQADLSAMYAWGKNTTDDKPLPQISPLEGRLNIRYVADKYNLGLLWRAVAEQNRVSLHQGNIVGYDLKPSKGFSTLSLNGSYNLRKDIDVSVGIDNVLDKTYTEHLNKAGSAGFGFASEEQFNNIGRNYWVRMSMKF

SEQ ID NO: 8456 - protein, 889 aa, Acinetobacter baumannii
MKKKYNVRSQATPKIGKTILKLSTLSLSMMCLTMAQAAETEQSSTDEKPTKVVKVAVTGSSIKGVAAQSASPITVVKVDEILKQGVTTTEEALAKISANQSNFVTASNVGTSKTAGSAANLRALGANKTLVLLNGRRLAANAYDSGVTNLNIIPLAMLDRIEVLRDGASSIYGTDAIGGVINFITKKQFTGLNLTAGYQKPEQKGGEQQDYSIFGGFGDLDENGYNVFGVVDYRKGDDVMAKDRKVSRRGGILPELGVNRTSSGSFPANVPGLGNPYASTGCGNNPLNSNDDGTCRYNSQAVIGIVPKTEDISAMGRATFKLNDNFNAIAEYLYARSEVTTSVAPDVFFDLTLDPSSKYYPGKGITPALAGATGTIPLYLRSQSGNRVSNSINQSHRLFAGIEGETHGWDINSGVTYAHSSASDAIVSGYLNFDKTQEALNNGILNPFGPQNPEDANVWNELGVEGKYLKANLDTTTVDFTASRPIFKLPAGDVAFAVGASYRYEDWTSKVVTDVARVAPSTGVDPDEPVNTGDRNIKSVFTEFHIPLHKTLEAQIAARYDDYNDFGDTFNPKFALRWEPIKQLMFRTTYSTGFRAPTLWEVNGANSITNTGASYNDPVLCPGGVVQSGGKKERDCNMQFDRQNGGNKTLDPEESKSFTAGLVFEPIKNLAFTLDYFNIEVDKQIATLSETAIFNDPVKYADKFVRNPDGSLDYIITTQQNLGGIKTSGFDVGLSWVSPMTATGRFGFNIDGTYITDYKYQAEPNGEWIGVAGSYSGLDYQSIILRWKHTANLNWNYENWALNLQQNFSRGYQDQNSNGQNHRVSDYTTYNISGTYKGFKNLEVTAGIKNIFDEDPPASNVIDNFQMGYDPRYADPLGRTYFVRGTYKF

SEQ ID NO: 8457 - protein, 438 aa, Acinetobacter baumannii
MLKAQKLTLAVLISAAIISSAQASEQSEAKGFVEDANGSILFRTGYLTRDKKQGAKDTSSVAQSAIVSIESGFTPGIVGFGVGVVGDGSFKIGENKNAGNQMIPKHNDGSAYDHWARGGGSVKARFSNTTVRYGTQVLDLPVLASNTGRMVPEYFTGTLLTSHEIKNLEVVAGKFTKDQMSDQINTDADASGRGLDRAIVWGAKYKFNDNLNASYYGLDSKNALERHYANVNFKQPLANDSSLTYDFSGYHTKFDANAHTYSATGTVAPNYAADGIAGEEKTNNIWAISGTYATGPHSVMLAYQQNTGNVGYDYGQNADGFQSIYLPNSYMSDFIGNHEKSAQIQYNVDFGKLGVLPGLNWTTAFVYGWDIKVRNVTDDAQEREFFNQVKYTVQSGFAKDASLRIRNSYYRASDAYQGAYIGDTNEWRIFLDIPVKLF

SEQ ID NO: 8458 - protein, 215 aa, Acinetobacter baumannii
MKKLLLAAAGVVALTGMTAPAALAEKGDWQFRVRAITVQPDEGADIQTIGGDVDIDTSVVPEFDISYFFTDNIAAELILGVTPHDVMAVDTAVGDLDLGDVTLLPPTLTLQYHFNPEGQVRPYLGAGVNYTIFFNDDLPSGTILDGIDYDPSFGLALQAGVDYAINERWFLNFDVKKVWINTDVTVDASTALNAVVNADVDIDPWIVGVGFGWRY

SEQ ID NO: 8459 - protein, 439 aa, Acinetobacter baumannii
MPNVMKLSVLTIAVLGSQFTLANEPWSQDRQWLLGDWNGKRQQLEQQGYKFTASIMSQAATNLDGGYNDSNTFENAAQLSLGANFDLEKIAGWKDTTASLVVTKRDGNALTLERIKDPRSSQLGNAQEIYGRGKIWRLSQAWVKKGFVDNTVQVKFGRMGMSEDFNSSQCEFQNLLLCGGQLGKSIGSIWYNSPVGVWATNVKYQFAPDWTLGVGVYEVNPDNIKTESNSDGFNLDMNNVKGATIPVELAWKPKLAAFNGLPGEYKVGALYSTAEANDIKTAGKVHDGKQSFWINAQQQLSHAGQDPKRGLYVSFNGVVNDKATTFVQSTQQLALWYKGPFDSRPNDSIGFGIANYVVNDRAKDKQIATNESRGYYSYDPIASDYIPIQDDELNVELNYTYQWSPAVMLRPNIQYIHQPAGVKEVDDAWVAGLSVKVNF

SEQ ID NO: 8460 - protein, 708 aa, Acinetobacter baumannii
MLFYGKCDAYRYIYLYTSKFIAIKTNWKSIMKIKQITYLIGMALFAAHGQAAVNNTESAPKKLQTETSHDVMSVWSTPLAADANVITESQMKQLNKTNVAQALSTLPGVAIQKSGNRNETQVNVRGFDSRQVPVFFDGIPTYVPYDGTLDLGRFMTSELASVELSTGYTSLLQGPNLMGGAINLTTATPKKPFEANLSFNQGFARGADNAHNVSARLGGRNDLGFIQVSGSQYKQRFMGLPSSDDNNPYAGTHGRRTNSATDDKRLMLKMGWTPREADEYVVTYIKQDGDKNSAPNANSDKQQIWQWPAYDKESIYFNGTTQVTDNIALQSRIYHDSFKNTLHQYKSVKDYQKGNYNYSRYDDYSNGADLRADFTVRELDMLSFAAHWKEDVHRSRSNKTNPFDRYKDQTWSVSTEYQWVATDKLDIIGGIGYDWRDSDDGKRYIYNKKTGAMEGVQHYDNNNQHAFNWEMMARYHLENEDTVQFSVSERSRFPTQKERYTENKMKNDDSFLINPHLDAERALTFDLTYKGHFTPVWSYTASTYYNHVSDAIMAHHVGENKKGGALLQNRNSGKVNYVGADIGTTGQITDWMEAGINYSYIHADPQHYSVRHVAELPTHKAFAWVKFTPYQPMSITITEEARSWAFNYVDSEDKVRGFAKTDLRVDYDLGHGLSVNSSINNLFDKSYEYTDGYIEEGRNYWLGIEYKY

SEQ ID NO: 8461 - protein, 562 aa, Acinetobacter baumannii
MKTHILLARVLACAALVLVTPGYSSEKIPVTGSGFVAKDDSLRTFFDAMALQLKEPVIVSKMAARKKITGNFEFHDPNALLEKLSLQLGLIWYFDGQAIYIYDASEMRNAVVSLRNVSLNEFNNFLKRSGLYNKNYPLRGDNRKGTFYVSGPPVYVDMVVNAATMMDKQNDGIELGRQKIGVMRLNNTFVGDRTYNLRDQKMVIPGIATAIERLLQGEEQPLGNIVSSEPPAMPAFSANGEKGKAANYAGGMSLQEALKQNAAAGNIKIVAYPDTNSLLVKGTAEQVHFIEMLVKALDVAKRHVELSLWIVDLNKSDLERLGTSWSGTITIGDKLGVSLNQSSISTLDGSRFIAAVNALEEKKQATVVSRPVLLTQENVPAIFDNNRTFYTKLIGERNVALEHVTYGTMIRVLPRFSADGQIEMSLDIEDGNDKTPQSDTTTSVDALPEVGRTLISTIARVPHGKSLLVGGYTRDANTDTVQSIPFLGKLPLIGSLFRYSSKNKSNVVRVFMIEPKEIVDPLTPDASESVNNILKQSGAWSGDDKLQKWVRVYLDRGQEAIK

SEQ ID NO: 8462 - protein, 673 aa, Acinetobacter baumannii
MKRAFINTSIVSALALTASAAMAEETEQLNEIEVVGSVAKAGKVDYMTPKSVDVIGEQQIADENAQKVDQALRYQAGIVTEPYGGDNDTDWFKIRGFDASMTLDGTALGKNGFFVWLPNTYGLESIEVVKGADSFTYGAMETGGIVNLVSKRPGKDPKGEIKLTAGNKDERGIGFDVSNKFTDNLRYRVVGDYNKRHGQVNGTWLESYYFAPSLTWDISDKAAFTLLASVQKDVGVPVNPFLPAYGSLIDTPNGTIKRGINLGEPDQDYTDRSQYSIGYEYNNKFAEGWTFAQNYRFSRLNIDQYNTFAWSSDTISNAYRGYSYTVGHTTNHTIDNRLSKAWKLGDVENLTTVGVDYQHSETKGLNNGFGTVNPINMFHPVYNQTPYNPTGTDYNLKSIQLGLYAQNQLRYQNLTWNVSARHDKARADSEANGADTSYNVSHNSYSSGLMYQFDNGLAPYASYSESFRAIAGNDGYGRAYKPYEGKQYEVGLKYLPSFVDGTFSVAWFDLEEKNTLVNDPSQIQVQAGKQTSHGVEVQANLAFSDNISGQFAYTYTKAKTDLAYNQTVRTALIPRHAYSAKLNYRFTDNLLSGLTVGAGVRYTGSTVDEQYYKGYKVGNYTLADLFAKYEFADNWIAQLNVDNLFNKKYLASCSYYCYYGEGRKLTANLTYKF

SEQ ID NO: 8463 - protein, 734 aa, Acinetobacter baumannii
MSLLRLDRLHYCILMSMGCISSPLVWAEDLNSDVAKLPTLHVEATRTDTGYLQTPASVFRIEAPQVDSSSQVNLTEVVKGIPSLQIRNRENYAQDLQLSMRGFGARSTFGVRGIRLYVDGIPATMPDGQGQTSNIDLSSLDHVEVLTGPFSSLYGNSSGGTILTSTKEGQGKDSIELSYSGGSHDKSRAGLVLQGGAKGANEPSYIISSSYFDTDGYREHSGAEKVLNNAKLSWNLDDGSKINWVTNYVKIHADDPMGLERKDWQANPKQIAPYVKKWGFNARKDIEQTQTGITWFKPINDQHELYAMAYLGNRQVTQYQSIPQGQVVVENGKPVYTGQKSPKHAGGVIDFERNYYGADFRWTGKELLPNTTVSIGVAFDAMDEERKGFENFNADGIYGVKGNLRRDEDNTLWNIDPYLQASWQFLPTWRLDTGVRYSNVHYKSKDHFTSGPDEYGTVNGDDSGKTDYEKVLPSAALSWQILPELMAYVSYAKGFETPTFTEMAYHTDISKSGFNFGLKPSTSDTYETGLKSQNLLGDFTLAVFQTKTKNDIVSAGNLGGRSTFRNADKTLREGVEFAWNKKLWRDLTATASYTYLDATFDANVPEKLDQDNKVLASAIPTGNAIPGIAKNQAYASLAWQPSHGLYGGVDVQYMDKVYVNDTNSDAAPSYSVTSANVGYAWVMGDWKVNSFARVDNLFDKKYAGSVIVNDGNSRYFEPADGRNWSAGLRVIKQF

SEQ ID NO: 8464 - protein, 476 aa, Acinetobacter baumannii
MKLKHLSTAMILATLPATGVFAAALDRSGQSMSAFFQPGNYFEAGISVLDPDVAGKEAGSSATRRDIGDMANDYYFPSAALKLQINDQFSFGLLYDQPFGADAEYSGNNVFVSQPGSDSVLSATAIDGIVTKKATEALQAQGLPVNDQTLALAKGQVLASPQFKQLAGALAAANNYLGNGGTKVKVDTQNLSFVFGYQPTKNFNFYAGPVLQTVKGNVSLRGQAYSLYNGYDADIKETTGAGWLAGAAYQIPEIALRASVTYRSEIDHKVDINENLSLLNFPGLTSVLTGLDVPASKLQAINSSGKTTITTPQSVNLDFQTGIMADTVAFANVRWVNWKDFSIQPYKFGKVSEAVGGLVGRPNGFNLVEYSDDQWSVNAGVGRKLNDKWAGNVSVGWDSGAGNPVTTLGPTEGYWNVGLGVQYSPTPQTFIAGGVKYFWLGDAKAQTGAQAGSDQYVADFSDNNAIAYGLKLGYKF

SEQ ID NO: 8465 - protein, 1188 aa, Acinetobacter baumannii
MSKRGRTFHEQLQFKKLSHALHRVYSHKSAVLLTAMVGIMPFQPHAAELDTTLPNSNESTGSFAPSNIDIPSQPLDAALKQLARTTGISVAFDSKLATGKTAPAVKGRMKADEALRLLLAGSGLESTIDKDNAVIKPAAEKSAIDFQQVDAVEVRAKRFYEIGPLPGLGLTKEEIPGNVQSLTAKDIKEAHALSLTDLMNSKLQSVNVNDYQGNPFQMDVQYRGFTAGPQIGTPQGLSVFFDGIRVNEPFGDVVNWDMIPLNALASFDVFPGSNPIFGLGTLGGALSMKTKDGFNNTEVNAEILTGSFGRRQLQAEGGWNNGTVAGFAAANIFLEDGWRENSPSKVNQVFGKGSYRTDKLDLNLSSLVVWNDLIGNGLMPNEMYKQDRNGVFTSPDTTDNRLWQFQLSGSYFVNDNFTITAQAYRRNSKRKSLGADVYTQHGTQTVKRNLRPGEQFTCLFDSTNDYGLPDYYLIDLGNPSDLGDMAANQQFWDFISGNPPEESFNKPLPEEAAAFIAGAQRNFYGPFQNYRARLLYMAQNGAPPDTSMGEPTVGSGFEPGWVYDPSVLLQYREFVGDAFSQAGIAMSNFYYYTDDGVKHVVVPVFPNNASTCAEWKWGADGTDLTGRDPLEVPYGNTTDPTFVDGAAQPGGTAPGVVEGTPTSILTDTNITQVTEGASIQFNWNFEKHKFMVGASVDMPSARYKSSQMLGLFDAERDAYLAPDAIRDQYAAADQSISNNNFSGRQVTKSIYFSETWSPIETFHITGSARYNATKGKNKIASRTFGYNVYDLSDLEAFPDDYGVCRNGVCPTTGYITPDASGILNDPEKEKFSYYSLNPSLGISWQAKDNLNIYGSWSQGTRVPSVIELGCAFDDTPVQIGPGKYLERSLAQNRSCSLPTTLSGDPYLPQIKAQTFDIGLRGKLNENIEWNLGAYRTDLKDDIYMVTFPGNRSFFDTIGNTRRQGIEAGITATFDKLKLRLNYALTDATFQDTFWMAANDNSSSVENVIGNNQFGRRIQVTPGDRMPGVPLHNLNATLSYAITSNWQIGLTAIGHSMAYVRGNENNKHRAGVTLIDSYEDTATGAVRQIARSPTTSAGTVAGYITFNLQTSYKLNSEWTLGLRVNNILDKEYFNAGSLGRNPFSPSVYGAIGPDGYNHNSNDWLTTNFLAPGAPRAFWISLSYEFDPRK

SEQ ID NO: 8466 - protein, 375 aa, Acinetobacter baumannii
MMKKSFASLLTSLILLPAYSHADSPYFSLKDGDGFKRFSISAGWLHAMPQGKANPVYINTSVAEGTQSKVGDVSTDSVLNAIDQSTVAGKAWYGLLNTGYKDLLGGNTLPSALAGTATINGLSQWEAPNTGLEAQNADTLGILTNYYFTDNWSLEIKAGIPPKVDIKGKGTIYAPLSGSATPLKDGSLLGNAIGNIISQAGGDIPLKQDIKITDLEQGKRAASVRAWLPAAELHYQFGRSGVNKFRPYVGVGVMYAYFNEVKLNPDIEADLITAGHMIQNIQDNKAGAALDKKTSSANPIVDVKATDTFAPIATIGATYDFNENWFAVGSVSYSKMNNEAKITVTDSNTGKELINSKTKIDIDPLITYVGVGYRF

SEQ ID NO: 8467 - protein, 554 aa, Acinetobacter baumannii
MKYPKLCPLTAAIVISGFSSFANAQLGQNLAVDIRSLSMGNAVTADPPGISAVHFNPAALAKIDGLQTDVQGILANFDIQREFSAPPGYNIFGYSDDPLVCNDGPEVSANICTDFKGSVHGDVEYASLYVPILKKMVDLGAGYPLVAPTAGIAYKPPGSKVTYATAMYAPLVAGFGAENGNPGNYMGQQVAVERITYLSPSFGYQVNDHLSIGASVGMSYNAIALKTDLRFPNEMIGVLRMVDDVVCAPFKDNNDMITDLLLLGICNAKEGMNPFNKMGALQVSLEQSLSPSYNLGLLWEPTDDFGFGMVYQSAAKMRLKGKYMIDNAKAPQELVRGLNSSATGQILAAILGLPGYVPDIESGLVAMDLEYPAHFQAGIKYKILPDLQLNLDVGWTDYSAWNKFKFEFDRQITLLKVAKLLSNDVTDNSLALPLKFTSPWSWGIGLEYSATDRLKLRAGYEPRASSIPNDKRNTMVPINNAQLFGLGVGYRFDADTDLDLSVGFLRSRDNIPACTSTLSNKCGVDNILLNPYSGLDVKTNTKVTVLGLSYRTKW

SEQ ID NO: 8468 - protein, 199 aa, Escherichia coli
MRKLYAAILSAAICLTVSGAPAWASEQQATLSAGYLHVSTNAPGSDNLNGINVKYRYEFTDTLGLVTSFSYAGDRNRQITRYSDTRWHEDSVRNRWFSVMAGPSVRVNEWFSAYAMAGVAYSRVSTFSGDYLRVTDNKGKTHDVLTGSDDGRHSNTSLAWGAGVQFNPTESVAIDIAYEGSGSGDWRTDGFIVGVGYKF

SEQ ID NO: 8469 - protein, 210 aa, Wolbachia sp. wMel
GPISDEETSYYVRLQYNGEFLPLFTKVDGITYKKDKSDYSPLKPSFIAGGGAFGYKMDDIRVDVEGVYSYLNKNDVKDVTFDPANTIADSVTAISGLVNVYYDIAIEDMPITPYIGVGVGAAYISTPLEPAVNDQKSKFGFAGQVKAGVSYDVTPEVKLYAGARYFGSYGANFDGKKTDPKDSTRQVTDAGAYKVLYSTVGAEAGVAFNF

SEQ ID NO: 8470 - protein, 203 aa, Wolbachia sp.
GPISDEETSYYVRLQYNGEILPLFTKIEGIEYKKATDIHNPLKASFIAGGGAFGYKMDDIRVDVEGLYSQLNKNDVTGAAFNPDTVADSLTAISGLVNVYYDIAIEDMPITLYVGVGVGAAYISTPLKDAVNGQKSKFGFAGQVNAGVSYDVTPEVKLYAGARYFGSLGAHFDKDTAAASKDKGELKVLYSTGGAEAGVAFNF

SEQ ID NO: 8471 - protein, 175 aa, Wolbachia endosymbiont of Helicoverpa armigera
FPFYTKVDGIINALGKEKDSPLTRSFIAGGGAFGYKMDDIRVDVEGLYSQLAKDTAVVNTSETNVADSLTAFSGLVNVYYDIAIEDMPITPYVGVGVGAAYISNPSKADAVKDQKGFGFAYQAKAGVSYDVTPEIKLFAGARYFGSYGASFDKAAKDDTGIKNVVYSTVGAEAGV

SEQ ID NO: 8472 - protein, 197 aa, Wolbachia endosymbiont of Pieris rapae
GPISDEETSYYVRLQYNGEVLPFKTKITGITHKSNKAEDSPLKASFLAGGGAFGYKMDDIRVDVEGLYSQLSKDGDIADSPAIAESLTAFSGLVNVYYDVAIEDMPVTPYIGVGVGTAYVSNPLATKVTDDKASGFAFAYQAKAGVSYDVTPEIKLYAGARYFGSYGANFGKTAKDDGGIKVLYSAVGAEAGVAFNF

SEQ ID NO: 8473 - protein, 147 aa, Wolbachia endosymbiont of Grapholitha molesta
GPISDEETSYYVRLQYNGEVLPFKTRIDGIEYKKGTEVHDPLKASFMAGGAAFGYKMDDIRVDVEGLYSQLNKNDVSGATFTPTTVANSVAAFSGLVNVDYDIAIEDMPITPYVGVGVGAAYISNPSEASAVKGQKGFGFAYQAKAG

SEQ ID NO: 8474 - protein, 199 aa, Wolbachia endosymbiont of Pandemis dumetana
GPISDEETSYYVRLQYNGEILPFYTKVDGITNATGKEKDSPLTRSFIAGGGAFGYKMDDIRVDVEGLYSQLAKDTDVVNTSETNVADSLTAFSGLVNVYYDIAIEDMPITPYVGVGVGAAYISNPSKAGVVKDQKGFGFAYQAKAGVSYDVTPEIKLFAGARYFGSYGASFDKAAKDDAGTKNVVYSTVGAEAGVAFNF

SEQ ID NO: 8475 - protein, 147 aa, Wolbachia endosymbiont of Cnidocampa flavescens
GPISDEETSYYVRLQYNGEVLPFKTRIDGIEYKKGTEVHDPLKASFMAGGAAFGYKMDDIRVDVEGLYSQLNKNDVSGATFTPTTVANSVAAFSGLVNVYYDIAIEDMPITPYVGVGVGAAYISNPSEASAVKGQKGFGFAYQAKAG

SEQ ID NO: 8476 - protein, 205 aa, Wolbachia endosymbiont of Trichogramma ostriniae
GPISDEETSCYIRLQYNGEFLPLFTKIDGVTGLKKTADTADTIDLYNASFIAGGGAFGYKMDDIRVDVEGIYSWLNKDTDVTGASVPAGGVANNLTAISGLVNVYYDVAIEDMPITPYIGVGVGAAYINNPLVTKVTGDKDSGFGVAYQAKAGVSYDVTPEIKLYAGARYFGSYGANFGKTTKDGAGIKVLYSTVGAEAGVAFNF

SEQ ID NO: 8477 - protein, 543 aa, Flammeovirga yaeyamensis
FDQETIDNTPGATEIDDLLQLIPNMVDSGQGNSMPTVRGIDGSGPSTGGLASFAGTSPRLNMSIDGRSLTYSEIAFGPRSLWDMQQVEVYLGPQSYIQGRNASAGAIVMKTNDPTHHFESAVKAGIGERNYTQTAAMISAPIIQDELAFRLSFDQQKRDSFVDLASYEPAGDAKKIEMNSVRGKLLYEPSALAGFKTTLGVSHMDSRGPQSESTNVVGNEAFRPVYETKSLSTAWDISWQLNEVLTFENNLVYSKFAYDRYTNPTPRQKGDFTTEGKEFHVEPLLRYLSLDGRVNALVGARYYKSSQDDEYIDATSANPMSGSTKTQSAFAELTYALTQSIDVTVAGRYEKERVKRKVSDPRFKLDHDDTLSVFLPKFDIAFKPDMAQTFGFKVAKGYNAGGAGLAFNSIQFAGFSPYQFEDEYIWNYELYTRHRLGNSVELMTNTFYNDFDNMQMTQTLSNGDVLIANLDNAKTYGAEIGTRWYATDSLELFANLGLLGTEYKEASGDSKDLPRAPSMTGNLGGQYSFFDGFELSANAAYTG

SEQ ID NO: 8478 - protein, 194 aa, Wolbachia endosymbiont of Coleosoma octomaculatum
GPISDEETSYYVRLQYNGEVLPFKTRIDGIEYKKGTEVHDPLKASSMAGGAAFGYKMDDIRVDVEGLYSQLNKNDVSGATFTPTTVANSVAAFSGLVNVYYDIAIEDMPITPYVGVGVGAAYISNPSEASAVKDQKGFGFAYQAKAGVSYDVTPEIKLFAGARYFGSYGASFNKEAVSATKEINVLYSAVGAEA

SEQ ID NO: 8479 - protein, 212 aa, Wolbachia endosymbiont of Araneus ventricosus
GPISDEETSYYVRLQYNGEFLPLFTKIDGATGAKKKTADTGTTTDLYKASFMAGGGAFGYKMDDIRVDVEGLYSQLSKDTLDVAPTPAIAESLTAISGLVNVYYDVAIEDMPITPYVGVGVGAAYISTPLATAVSSQNGKFAFAGQVRAGVSYDITPEIKLYAGARYFGSFGAHFDGEKQDPTDASKKVADKDAYKVLYSTVGAEAGVAFNF

SEQ ID NO: 8480 - protein, 184 aa, Wolbachia endosymbiont of Xylosandrus germanus
SYYVRLQYNGEFLPLFTKVDGITYKKDKSDYSPLKPSFIAGGGAFGYKMDDIRVDVEGVYSYLNKNDVKDVTFDPANTIADSVTAISGLVNVYYDIAIEDMPITPYIGVGVGAAYISTPLEPAVNDQKSKFGFAGQVKAGVSYDVTPEVKLYAGARYFGSYGANFDGKKTDPKDSTKQVTDAGA

SEQ ID NO: 8481 - protein, 192 aa, Wolbachia endosymbiont of Xylosandrus germanus
SYYIRLQYNGEFLPLFTKIDGITYKKDKSDYSPLKPSFIAGGGAFGYKMDDIRVDVEGVYSYLNKNDVKDVVFTPADTIANSLTAISGLVNVYYDIAIEDMPITPYVGVGVGAAYISTPLATAVNSQNGKFAFAGQVKAGVSYDVTPEIKLYAGARYFGSYGAHFDGEKVDGTKKVADKAHIKSFTALLVQK

SEQ ID NO: 8482 - protein, 179 aa, Wolbachia endosymbiont of Xylosandrus germanus
SYYVRLQYNGEILPLFTKIDGIARKTGKDNDSPLKPSFMAGGGAFGYKMDDIRVDVEGLYSWLNKDADVVDDTVADNLTAISGLVNVYYDIAIEDMPITPYIGAGVGAAYISTPLATAVSSQNGKFAFAGQARAGVSYDITPEIKLYAGARYFGSYGANFDKTDKDGKGELKVLYSTVG

SEQ ID NO: 8483 - protein, 187 aa, Wolbachia endosymbiont of Xylosandrus germanus
SYYIRLQYNGEILPLFTKVDGITYKKDNSDYSPLKASFLAGGGAFGYKMDDIRVDVEGVYSYLNKNNVKDARFTPDTIADSVTAISGLVNVYYDIAIEDMPITPYVGVGVGAAYISTPLKDAVNDQKSKFGFAGQVKAGVSYDVTPEVKLYAGARYFGSYGANFDKSGGEKDKGGYTVLYSTVGAEA

SEQ ID NO: 8484 - protein, 183 aa, Wolbachia endosymbiont of Xylosandrus germanus
SYYVRLQYNGEILPIYTEVDGITKLTGKEKDSPLTRSFIAGGGAFGYKTSDIRVDVEGLYSQLTKDVTVVSDGKAADSVTAFSGLVNVYYDVVIEDIPITPYVGVGVGASYLSNPSSVTAVKDQKGFGFAYQAKAGVSYDVTPGIKLFAGARYFGSYGASFNKEILSGNKEMKVLYSTVGAEA

SEQ ID NO: 8485 - protein, 200 aa, Escherichia albertii TW07627
MHTMIPAAVAASLAFLAAAPAAAQSAGEMTFGLGLGSVMPKSDNGTLTAGDLEVGNEIQPTITFEYFIRDNLGIEILAATPFKHDLKVDGSGIGSIKHLPPTVTLQYHFPTGGAFAPFIGAGVTYVTFFEESSPLGDLKLDDSWGLSVHAGFDYWLNDRNAIRADVRWMDIDSDVTLDGGDLGTAEIDPVVVGVSYIWKF

SEQ ID NO: 8486 - protein, 73 aa, Escherichia albertii TW07627
MIIKAEVQNLLDKRYVDPLDAGNDAASQRYYSSLNDSLACKINESTCNDGSDKSVLYNFARGRTYILSLNYKF

SEQ ID NO: 8487 - protein, 660 aa, Escherichia albertii TW07627
MSRPQFTSLRLSLLALAVSATLPTFAFATETMTVTATGNARSSFEAPMMVSVIDTSAPENQTATSATDLLRYVPGITLDGTGRTNGQDVNMRGYDHRGVLVLVDGVRQGTDTGHLNGTFLDPALIKRVEIVRGPSALLYGSGALGGVISYDTVDAKDLLQEGQSSGFRVFGTGGTGDHSLGLGASAFGRTENLDGIVAWSSRDRGDLRQSNGETAPNDESINNMLAKGTWQIDSAQSLSGLVRYYNNDAREPKNPQTVEASDSSNPMVDRSTIQRDAQLSYKLAPQGNDWLNADAKIYWSEVRINAQNTGSSGEYREQITKGARLENRSTLFADSFASHLLTYGGEYYRQEQHPGGATTGFPQAKIDFSSGWLQDEITLRDLPITLLGGTRYDSYRGSSDGYKDVDADKWSSRAGMTINPTNWLMLFGSYAQAFRAPTMGEMYNDSKHFSIGRFYTNYWVPNPNLRPETNETQEYGFGLRFDDLMLSNDALEFKASYFDTKAKDYISTTVDFAAATTMSYNVPNAKIWGWDVMTKYTTDLFSLDVAYNRTRGKDTDTGEYISSINPDTVTSTLNIPIAHSGFSVGWVGTFADRSTHISSSYSKQPGYGVNDFYVSYQGQQALKGMTTTLVLGNAFDKEYWSPQGIPQDGRNGKIFVSYQW

SEQ ID NO: 8488 - protein, 446 aa, Escherichia albertii TW07627
MSQKTLFTKSALAVAVALISTQAWSAGFQLNEFSSSGLGRAYSGEGAIADDAGNVSRNPALITMFDRPTFSAGAVYIDPDVDITGHSDLTGQSANAKNIAPTAWVPNLHFVAPINDQFGWGASITSNYGLATEFTDNYAAGIYGGKTDLQTINLNLSGAYRLNNSWSFGLGFDAVYAKAKIERYAGSLGPLLSQQLIAQGVPASLTNGINTPDSQIAHLKGDEWGFGWNAGILYELDKDNRWGLTYRSEVKIDFDGDYKSSINPNLNNILGNMGLPYGTMGATQNGSLTLNLPEMWEISGYNRVAPQWAIHYSMAYTSWSQFQELKAKGDSGQTLFYKDEGFRDAYRIALGTTYYYDKNWTFRTGIAYDDSPVPADKRSISIPDQDRLWLSAGLTYAFNEDASIDVGASYMHGQKVKFTEGEGAAAYSFESEGKAWLFGTNFNYAF

SEQ ID NO: 8489 - protein, 204 aa, Escherichia albertii TW07627
MCGQTRRWPQSWRANTSATHRARAATVGFGEAAGNFKSGSKYDLGVGYSVGGFSAALTWDRQNGAGTSSTPADTTDYIQGIHAGASYDFGALKLFAGYRNYKRAFTTAAASQRSDMYWAGASYDVTPAFTLCGAVYKQNIKGGTDADPILFSVRGQYALSKRTTAYLSAGYAKAKNGQNVSLSRDVVGYGNNQVGVTAGLQHRF

SEQ ID NO: 8490 - protein, 367 aa, Escherichia albertii TW07627
MKVKVLSLLVPALLVAGAANAAEVYNKDGNKLDLYGKVDGLHYFSDNKDVDGDQTYMRLGFKGETQVTDQLTGYGQWEYQIQGNSAENENNSWTRVAFAGLKFQDVGSFDYGRNYGVVYDVTSWTDVLPEFGGDTYGSDNFMQQRGNGFATYRNTDFFGLVDGLNFAVQYQGKNGSVSGEGMTNNGRGALRQNGDGVGGSITYDYEGFGIGGAISSSKRTDDQNSPLYIGNGDRAETYTGGLKYDANNIYLAAQYTQTYNATRVGSLGWANKAQNFEAVAQYQFDFGLRPSVAYLQSKGKNLGVINGRNYDDEDILKYVDVGATYYFNKNMSTYVDYKINLLDDNQFTRDAGINTDNIVALGLVYQF

SEQ ID NO: 8491 - protein, 1015 aa, Escherichia albertii TW07627
MQQSNIATNRQPNKAIEKLHAFAWLAWCFSQNRGKIVMFRLVKAPLHIAPTLFLLLTHAPLVYAQTTQVTATQPQTSINEFSFSIPAQNANEALTELAKQANTTLLFPFDLAKKVKTNALEGTFTLNEALSQLLKDTELAVVVDEAGMLSIRSRSSLLAKANQANKEEKASEEGNNGLEKIAVVGTRNAPRSAVDSPVPLDVIGSKALRSQGNSDVLSMLSVMVPSLNVNDQPINDASSLVRPANLRGMSSDHTLLLLNGKRRHRSAVITFLGGGLSDGAQGPDISIIPAYALKQVEVLRDGASAQYGSDAIAGVINFVLKDAREGGSVALKLGGYSEGDGELFQIQLNNGFAIGDKGFLNATAEYRQQNGTSRSVQRSDAQALIEQGNTFIQTPSQVWGALDVNEDIKLALNAGTAISQLTEFYSFATAARRKITGGFYFRNPQTREGVFSRTDPNTGESRLIVADLDGLENGIACPSITLSTNNVLQDPDYQRIADNTTELGANCFAFNEWFPGGFTPKFGGTITDASLAMGIRHELPKGWAMDASATLGYSDIEYTISNTVNPSLGPRTPTSFSPGGVSQIERTLNLDFSKLIQSIFEDPISIGLGAEWRKETYFQKAGDEASYIAGPFALEPPLGLSEGFSIGSNGFPGYQPQSAGHWSRNNWALYADVELFLTEAMQVGLAARVEHFSDFGSTFDGKLSMRYKLNDTFALRGSVNTGFKAPTVGQSNVINVTTAYGVNGLEDQATLPPTDLISLQLGATPLTPEESVNFSLGMVMQASDNFFATLDYFNIRLSDRISTTSAIPLTEQDISALVAQGRPDAVKYNAAKYFTNDFDTKTQGVDLVVNYSFSYNDWANALLLAYNWTDTQVERLTLYPALVNDEMQLLPNLTPSRIRMLEDNLPAHRGSVTLEQVKDNWALTWRLNYYGEFYEDHLDASAGMDIYGSALTTFDAQLAWKVQPHIQLTLGAQNLFDALPDENPFQGEVGALYPPTSPGGINGAFYYAGIEYTFN

SEQ ID NO: 8492 - protein, 759 aa, Escherichia albertii TW07627
MTSWHRPRLTAALLLSALSLPALTAPALAQEAPAPQGGTAGGTAGTAAGKAAVRQEIEEIIITGTIAFRNRTSDPNPVLAYDLEYFQRFEPVSVGEMLKRVPGVTFTSDVLEYDAVQMRGLPAGYTQVLINGRTAPGGEADRSFFVDRIPAELVERVEIVRAPRADQPSEGVAGTLNVITKDSARFAGGFAKIGGLINDDGKIRPSAAVAYADTLRSGDTSYWVALNYQGRRNPKEKVTDFYDGDFEEFTGRELQSDTRDGVDISANGELTTTLGGGSLRLFGLVVDTDRDEDETSLTYEGDSPAALELDEVEIQRERIGQRTYALGAEATLPLGAGDLGLAAGWSGFREDTTAETDEGDTVAEAGLVERETLDTDDDEVTGTVSYRFGPEGFRTKLGVDLLHKKRDNAERTFEIDGGDVEEETPPGAIYTIKETRIDPYARLSLDLTDRVMLDLGARYEMTDREVDSDGEDGSHDSKNLNPSAHLRYNPTASDHFLLSVARTVRRPDYDLLAPYRQEEEPADDDELIGNPSLANEMAWGIDVGYERQIGRRGIFGVNVFYRDVTDVIELVNTGEEAEAGGSVYQARNIGDGETWGVEADLSLPLDFAGLPDTGVFANYTWLDSSITDPFTGEDRRFNNQPRHVYNVGFIQTLPSWDVSFGASLSGRSGAEESSLDETIDLRYGQELEAFIEKRFAERFVLRLTGTNLLNRKKKEDFRFFDGDSVAEMLEARRTGDVDEAEKEREESGALFQVTLRAAF

SEQ ID NO: 8493 - protein, 468 aa, Escherichia albertii TW07627
MRTFSGKRSTLALAIAGVTAMSGFMAMPEARAEGFIDDSTLTGGIYYWQRERDRKDVTDGDKYKTNLSHSTWNANLDFQSGYAADMFGLDIAVFTAIEMAENGDSSHPNEIAFSKSNKAYDEDWSGDKSGISLYKAAAKFKYGPVWARAGYIQPTGQTLLAPHWSFMPGTYQGAEAGANFDYGDAGALSFSYMWTNEYKAPWHLEMDEFYQNDKTTKVDYLHSLGAKYDFKNNFVLEAAFGQAEGYIDQYFAKASYKFDIAGSPLTTSYQFYGTRDKVDDRSVNDLYDGTAWLQALTFGYRAADVVDLRLEGTWVKADGQQGYFLQRMTPTYASSNGRLDIWWDNRSDFNANGEKAVFFGAMYDLKNWNLPGFAIGASYVYAWDAKPATWQSNPDAYYDKNRTIEESAYSLDAVYTIQDGRAKGTMFKLHFTEYDNHSDIPSWGGGYGNIFQDERDVKFMVIAPFTIF

SEQ ID NO: 8494 - protein, 140 aa, Escherichia albertii TW07627
MGTSASYRGLRVGFTWGFGGVAGAFTQNEVMSLGLAYNNGPFAFGAGYLFAKNPNFSLFGTSATSNAPAAANALNITSPVFSGYAAAASQRVFGAGASYQIGKATIGTLLTSTQLNDIGGTPVNGAAPAIGVVGTLSAAR

SEQ ID NO: 8495 - protein, 772 aa, Escherichia albertii TW07627
MQEDAESLDAIVVTGVTNPKAKIESSVSVTTLGTTSIAQSAPRTTAEIFRTIPGIRSESSGGEGNSNISVRGVPISSGGSKYVQIQEDGLPVLLYGDISFATADIFTRFDANVSRIEAIRGGSASTQTSNAPGGIINIISKTGQSEGGTIGTTFGANYDSFRTDFAYGTEIADDLYMHAGGFYRVGEGIRDAGFTANNGGQLKLSLMKKFDKGSVRVYAKYLNDKAIAYLPGPIQVTGTNADPTWESAPNFDATTGSLHTPNLTQTLRLGSDGQPSRGDVADGMNPISTAVGISANFDLGNEWKVSNNGRFSSNNGAFISPFPSQIATAADIADSFGAGSTLQLIDGTPVANESLVARIHMFDVELENFNNFMNDLKLSKSYDNLDITLGYFKSIQNISMNWTWNSYLQEVQGENARLINAFDPTGAALSENGLYAYGTPFWGNLARNYDTQYNVSAPYVNVALEASEKLNIDASIRFDMGKVDGNFTGGTESVVDINNDGVISAPELSVYSVNNAEPTAVNYDYDYVSYSLGLNYKIQDRQAVFARYSRGAAAKADRILFSGLDYQNSDRINALDFLNQAEIGYKQGFDSGALYITGFYSKTTEQAGFEATNPDLIIDNDYQSFGVEVEGSYRMEDFTVRGAVTYTNATLESGDNDGNTPRRQPDFIYNLIPSYNFGADQKNSVGLSFVGQTKAYAQDTNELIMPGFVIVNGFLNVGITKDLNANLSANNIFDTLGITESEEGSIVEGQTNYLRARALPGRSVSLGLQYTF

SEQ ID NO: 8496 - protein, 294 aa, Escherichia albertii TW07627
MKKTLLAAGAVLALSSSFTVNAAENDKPQYLSDWWHQSVNVVGSYHTRFGPQLRNDTYLEYEAFAKKDWFDFYGYADAPVFFGGNSDAKGIWNHGSPLFMEIEPRFSIDKLTNTDLSFGPFKEWYFANNYIYDMGRNKDGRQSTWYMGLGTDIDTGLPMSLSMNVYAKYQWQNYGAANENEWDGYRFKVKYFVPITDLWGGQLSYIGFTNFDWGSDLGDDSGYANNGIKTRTNNSIASSHILALNYDHWHYSVVARYWHNGGQWNDDAELNFGNGNFNVRSTGWGGYLVVGYNF

SEQ ID NO: 8497 - protein, 241 aa, Escherichia albertii TW07627
MNITLRRLIAASTLGLSFYACADSASINYRHTFTEDDSIHSDRIKLSYRKDSGLGFAAEIKYKTAGDREDVAYDNMVNNGHEFTVDYNYKMSPRSTWTPAFQMDSTKDATTYKFGLKYNYKLSDTWYVATRVRHDARNLDRDQIDHSKPDRAKDNQNTTRLEGWLGYTPSGPWAFEYQYIHFTTDYIRYDNKKRDYEQNLIIKYKLNKQWAPFMEVGDIKVNSYTDDRQARWRLGIQYNFL

SEQ ID NO: 8498 - protein, 351 aa, Escherichia albertii TW07627
MKKSTLALMMMGFVASTATQAAEVYNKNANKLDVYGKIKAMHYFSDYDSKDGDQTYVRFGIKGETQINEDLTGYGRWESEFSGNKTESDSSQQKTRLAFAGVKLKNYGSFDYGRNLGALYDVEAWTDMFPEFGGDSSAQTDNFMTKRASGLATYRNTDFFGLVDGLDLTLQYQGKNEGREAKKQNGDGVGTSLSYDFGGTDFAVSAAYTSSDRTNDQNLLARAQGSKAEAWATGLKYDANNIYLATMYSETRKMTPISGGFANKAQNFEAVAQYQFDFGLRPSLGYVLSKGKDIEGVGSEDLVNYIDVGLTYYFNKNMNAFVDYKINQLKSDNKLGINDDDIVALGMTYQF

SEQ ID NO: 8499 - protein, 928 aa, Escherichia albertii TW07627
MRMKKNFAYHPLSAAIFAALISPTVSANTQTNTNTERLELDEVIVTESRYAHERQNEVTGLGKVVKNYHEMSKNQILGIRDLTRYDPGISVVEQGRGASSGYAIRGVDKNRVSLLVDGLPQAQHYHTLGSDANGGAINEIEYENIRSIELSKGASSAEYGSGALGGAIGFRTKDAQDIIKEGQHWGLDSKTSYASKNSHFLQSIAAAGEAGGFEALVIATHRHGKETKIHSEANKLKHNIRRITGFENRYDLYPNSAQNAPGGSFFIVEDTCPTLDCTPRARVKLNRDNFPVRTFPEYTPEERKQLEQIPYRTEQLSAQEYTGKDRIAPNPLDYKSNSVFMKFGYHFNSSHYLGAILENTKQHYDIRDMQTPAYYTKDDINLSLRNHVYEGDNILDGLVFNTRIPYGLRYSHVKFFDERHHKRRLGFNYQYTPENNRWLDNIKLSADKQDIELYSRLHRLHCSDYPVVDKNCRPTLDKSWSMYRTERNNYQEKHRVIHLEFDKALNAGQGVFKQTHKLNLGLGFESFNSLMDHGDMTAQYTKGGYTSYRGRGRLDNPYIYRRDPRSIETVSLCNNTHGDILNCEPRKIKGDSHFVSFRDLVISEYVDLGLGVRFDQHRFKSDDPWTLSRTYRNWSWNGGITLKPTEFVSLSYRISNGFRVLPFYELYGKRDHIGLKDNEYVQRAQRSHQLEPEKSTNHEIGVSFKGQFGYLDVSYFRNNYKNMIATACKRIIQKSHCFYNYHNIQDVALNGINLVAKFDLHGILSMLPDGFYSSVAYNRVKVKERKLTDSRLDSVNDPILDAIQPSTLCAWIRLRFTQKKNGELALLPPILKPKTPMRWQAHVITAYIRVDLGGKLTGSWYTHDITGYINYKNYTLRGGIYNVTNRKYSTWESVRQSGVNAVNQDRGSNYTRFAAPGRNFSLAFEMKF

SEQ ID NO: 8500 - protein, 724 aa, Escherichia albertii TW07627
MQISSKKKTIHFQRVTTAVALAFAGASHAAEEGGALPEVSVSAKKEASYKVDRVSSPKFTEPLLDTPKSITVVNEELIQARGLMSLTDILRTTPGVTLGSGEGGTPMGDRPFIRGYEASTDLQIDGIRQVGRFSHEIFNLESVEIIKGPGSMQNGRGSTGGVINMVTKKPKAENFTSAGVTWGTDQTKRFTVDTNWLLGDEAALRINLVHHDANVAGREAVELERKGIAAALALGLNTSTRANVSFYHFESDDTPDLGLPFSAGGALRTPPRVDRDNFYGLKNRDFREQNADQITLRLEHDFDHGFTLRNTTMYTRTTNQYIMTRPSFANAAAFANGIVDQSIRGSRRLTEGMLNQTDYFGSVELFGMKHNISTGIEISKEELSSGGYQTATGGNTNAAGTTTDLYNPNPYAPFPGGPFRRTDYGDPFKYNTRAWYASDTIHFNEQWQANVGIRLDHYRVVDTSDPTVHRKDRMFNYTLGLLYKPAPNGSVYFNLGTSSNPTGETAGQSGGADGVAGGRLTAANMNVAPERTRAVELGTKWDVFNNRLSLTAAIFETKKTDARAADPTTGEVALVGDNSVKGIDLGAAGNITDKWSVWGGVVFMDPVLDKFAANTTSDYSGNQSKFIAKRSGSLWTMYKVTPKFSVGGGAIYAGKRYLDDANTMFFDSTWRWDASATYEVNQKLSLRLNVLNLTDERIYDASHVGIFAVMAPGRSALLNATYHF

SEQ ID NO: 8501 - protein, 212 aa, Escherichia albertii TW07627
MKKLTVAALAVTTLLSGSAYAHEAGEFFMRAGSATVRPTEGAGGTLGSLGGFSVTNNTQLGLTFTYMATDNIGVELLAATPFRHKIGTRATGDIATVHHLPPTLMAQWYFGDASSKFRPYVGAGINYTTFFDNGFNDHGKEAGLSDLSLKDSWGAAGQVGVDYLINRDWLVNMSVWYMDIDTTANYKLGGAQQHDSVRLDPWVFMFSAGYRF

SEQ ID NO: 8502 - protein, 1055 aa, Escherichia albertii TW07627
MQKIKNKFIVRTILATTVTTVLSACGGGLVRIDTPTPTPTPTPTPTPTPTPTPTPTPTPTPTPTPTPTPTPTPTPTPTPTPTPTPTPTPTPTPTPTPTPTPTPTPTPTPTPTPTPTPTPTPTPTPTPTPTPTPTPTPTPTPTPTPTLPPLQPSLAAKIGRHLELTNTEAAHALGLTGSGFIIGMVDTGVNRNNIALQGKVIRNGVYNFQTDYHDPSAPDDVDNHGTLVAQLIAGKPVEHWPGGIAPGASIFSARVFTSEEEFEVYMDEQIASSHIMDTYEAEASKIKLINADMIAVGVRIQNNSWGHSRAGMWTDPKTTNLFADTYRDFVIGNNGLVVFSTGNEKLSQPNGLARLPSLLTAEGSPSAADLEKGWLAVAGLDSFGHPDQLGSYSNHCGVAMHYCLAAPGNVLVIDSNVTTTPIGNDGYEEQRGTSFAAPLVSGAAALVWEAYPYFSNDLVRQTLLGTATDLGAPGVDEVFGYGALNVGKAVRGPAKFDWGDVKVSFNDSRSIWFNDISGGGGLIKDGTGTLVLAGSANQYSGATQVLGGTLQVSSLGESAVSIAHSATLIGSGRFGGAVSNAGTLEIGTDGLKVQGDYTQSETGRLALNVGDQLSVAGHATLQGGELQVLGKRDYVSLNTSYNVLHADGGLTGTFSGLTWGPAVLLGEGQLHYGANDANVTLQRLDVNAAARALGIVDTVAQASARRVEQAFREIDIQQDQGRGQLSTSFMAAAAALQQSGSAQMASASLHSLSGQGHVAATASSFDVVDAGRRSLATRLGERPLGERTVTWRQSLGGSGQDGTAGGTFALSGWLLGRDTQLASGDIVGFAFGQSEASPSGSVSGLRGLDRQVQGRMYVQRSQGPLYVLGQLGFGSFQRRLDRQLQLGHWSDWASSRYRGQFFSGSVEAGYHWRRGAWALTPYVGVDQTQLKTDGFREQGGAGFGLQVQASQAIRSQLLAGVRTELGWRGVKLRGYGEWQQTLRQSGLNPQASFTATSSWTPLVASPWSSRSGGLLGLSMVWPVGMTAGEWSMGVEHFFGARKRSDSLGLRYQLSF

SEQ ID NO: 8503 - protein, 212 aa, Escherichia albertii TW07627
MKKLTVAALAVSTLLSGSALAHESGEFFIRAGSATVRPTEGAGGTLGSLNGFDVSNNTQLGLTFTYMATDNIGIELLAATPFRHKIGTGDTGDIATVRHLPPTLMAQWYFGDASSKLRPYIGAGVNYTTFFDEGFNNNGKETGLSDLSLKDSWGMAGQVGMDYLINRDWLINMSVWYMDIDTTASYKLGGAQQHDSVRLDPWVFMFSAGYRF

SEQ ID NO: 8504 - protein, 1089 aa, Escherichia albertii TW07627
MKINFKGILTLFLALIVQLSFAQEKTVSGTVSDESGLPLPGVNILVKGTTNGKQTDIDGKYTIDVNVGDVLVFSYVSFATQSITVGEANTINVTLKEDVSVLDEVVITALGLEKKKDDDLSSTSIVKVDQLKKSGEAGVLQALSGKTSGVNITRNSGDPGAGAYIQIRGQNTILGDSSPLIVVDGAIVSNNSIGGGTGGVVQQSRLNDINQEDIESISVLKGASAAAVYGTGAANGVIVIKTKRGSRGGKRWNIEYKNSFSFDQVNVEWEKQGIYGQGNGGVDHLTGSGLSNTGNTYGGRIDARSGAADVIDTSGAYFEAANGTLYYPVTQRNSTAVYNKANRDAVFKTGVTNENNISFSHSGDDSRTFVSLSNWDQDGIYNGASDYRRTSVRLNSDVDFSDRFTLKLSSTYIDIESNRVQTGSNLNGLYLGYLRTSPDFDIRDYVGTHFDAAGIPTPNSHRGYRQHLGSRRTFNATDGTFSYNSPSYNNPLWTTNKQKNLNDVSRFIIAPEANFKINDNLLLTGRYSMDYYQDNRLSYEPAGSAGDGTNGEYEEDRITESNQNINLFLTGNFDIMDDLRMDFTVGTQFFQRKYKRLSSEESNFTNPDEIFLNGGNAVSTNSNFDDYILKTRKSGAFAVLNFDYKNEFLFELTARGEYLSELPNAGMIFYPSASAGWNFTKYLENSDWFSFGKLRASYGEVGIGPDAYKTDNYLTTGGVGSGWGDGYDGASYGNPLTRASLRGNPDLKEERVKEMEIGFDTRFFDNRLSLSATYYDRTTEDALLELPIPNSTGFDSQVLNAAQISNKGIELDLSGKIINNADLQWNMNISYTKNTSLVEDMAGSAFFGLNGFTSNSSGVAEGQPFGIIRGTRYARDDNGDYILNANGFPTASPTTDFISDPNPDWRGGLGTSVSYKGFTLSAQFETSQGNDVWNGTRGVLTHFGIHPDTAVETVASQDLVTAGGDIIPAGTTFRGIERDFGAGPVAINQDWWQGNGGGFGDVGENFHEDASWTRLREVSLFYTLPRDIVSKIGMTNAEIGVTGRNLVLWTKVEGFDPDNNLTGASKGRGLEYFSNPGTKSFLTTIRLSF

SEQ ID NO: 8505 - protein, 384 aa, Escherichia albertii TW07627
MELVMRKTVVAALVGMAFGANATSMDNIRISGFGSVGIGKSDNAIGYAGYTDEKLDSEQETLAGVQFDFQVNERAKFVTQVVANSRYDYDPKFEMAYASYDFDSFTARAGKLRLPLFFYSDYTDLGYAYPMIRPSQELYENIVLKGYTGADFLIPIELEDSSLLLQPLVGIGTIDEEDSIVGEVKLDQLYGLSANWNVDDFTFRGSYLVAETNPSCDFNTSTDPYCRQLAPLLDSQDGQFISLGAQYDNGDLLVNVEAADVQIEGQFYDYQSVSGLVGYRINEFTPYLSVSWVETTDNDERENMMITAVKETMNYERISYSIGNRWDFAKNMSLKADVTYVDYRDTSGGFQTNVETSAANPFMATGNYLEDSSIVYSARLDFVF

SEQ ID NO: 8506 - protein, 383 aa, Escherichia albertii TW07627
MYSAITLKYSSRHHLTPTKLDDKCRQTKKCFISSLGLAFNFNEIKKQALFSSVLFLLAVPAYAQVENSTSHEFSDYSDTRQNNAHAYVGLRGGGTYFEGACSSNGSECNDNTFGYGLYGGYQFISWFALEGAVTHYGTPDASYGLKNISAEVLGSELTGVFSYDLSESFDAYARVGVAYQNIEKNSTGGSELTSNEWGMLSALGVDYRVSQNWSLRGEYQFIDGIGNSELMKSDMHFLSLGLTYHFGQEKALIVATTALAVATPPMVITDKVITTKSTSQTLSGLYFNSSKIKTSPELTNVVVQLLQTKEGDIEVIGHTDSLGSKKYNQWLSEKRAQVVADYLVKEGVDPSRIIVKGEGESSFVSSNETAEGRAKNRRVKIKY

SEQ ID NO: 8507 - protein, 171 aa, Escherichia albertii TW07627
MKKIACLSALAAVLAFSAGTAVAATSTVTGGYAQSDAQGVANKMSGFNLKYRYEQDDNPLGVIGSFTYTEKDRTNGAGDYNKGQYYGITAGPAYRLNDWASIYGVVGVGYGKFQTTDYPTYKHDTSNYGFSYGAGLQFNPMENVALDFSYEQSRIRSVDVGTWIAGVGYRF

SEQ ID NO: 8508 - protein, 199 aa, Escherichia albertii TW07627
MRKLCAVILSAVVWLVAAGTPASAAEHQSTLSAGYLQSHTDMPGNDDLKGVNVKYRYEFTDTLGLVTSFSYAGDKNRQLTRYSDTRWHEDSVRNRWFSMMAGPSVRVNEWFSAYAMAGVAYSRVSTFSGDYLRVTDNKGKTHDVLTGSDDGRHSNTSLAWGAGVQFNPTESVAIDIAYEGSGSGDWRTDGFIVGVGYKF

SEQ ID NO: 8509 - protein, 358 aa, Escherichia albertii TW07627
MDDNEAQKMKKTAIAIAVALAGFATVAQAAPKDNTWYAGGKLGWSQFHDTGWYNSSLNNDGPTHESQLGAGAFGGYQVNPYVGFEMGYDWLGRMPYKGDNVNGAFKAQGVQLTAKLGYPVTDDLDVYTRLGGMVWRADSSNSIAGDDHDTGVSPVFAGGVEWAMTRDIATRLEYQWVNNIGDGATVGVRPDNGMLSVGVSYRFGQQEDAPVVAPAPAPAPEVQTKHFTLKSDVLFNFNKATLKPEGQQALDQLYTQLSNLDPKDGSVVVLGFTDRIGSDAYNQGLSEKRAQSVVDYLVSKGIPANKISPRGMGESNPVTGNTCDNVKPRAALIDCLAPDRRVEIEVKGIKDVVTQPAA

SEQ ID NO: 8510 - protein, 208 aa, Escherichia albertii TW07627
MMKRLVVGAAALVAAGWTASAEAADLSYGQRAPYTVNQPLNAYSWAGPYLGGNIGYEWGSVDNNPSKPSGFVGGIQAGYNFQNGPWVFGVEGDIQAAGADDTFAPWKFSNPWFGTLRGRVGYAFSNVLFYGTAGLAFGELRAQTFGWTESHTSAGWTIGAGAEVGLAPNWSAKLEYLYIDLSTSQFAITGVSNGYTASVVRAGVNYHF

SEQ ID NO: 8511 - protein, 395 aa, Escherichia albertii TW07627
MKRKVLAMLVPALLVAGAANAAEVYNKDGNKLDFYGKVAGLHYFSDNSGADGDMSYARIGFKGETQIADQFTGYGQWEYNLQANGTEGDGDNSATRLAFAGLGFGQNGTFDYGRNYGVVYDIEAWTDMLPEFGGDTYAGADNFMNGRTNGVATYRNNGFFGQVDGLNFALQYQGNNEGSGDGFLFGQEGSGSGDGRKLSKENGDGYGMSTSYNFDFGLSFGAAYSNSDRTDEQTKPDFHNTRAGDRNDITAGSETAEAWTVGAKYDANNVYLAAMYAETRNMTGYGDANAIANKTQNFEVVAQYQFDFGLRPSIAYLQSKGKDLGGWAHDGNGDPRYTNKDLVKYVEVGATYYFNKNMSTYVDYKINLLDNDDDFYEANGIATDDIVAVGLVYQF

SEQ ID NO: 8512 - protein, 653 aa, Escherichia albertii TW07627
MKKLKISLLPLTAFVAATVHAETLDTIDVVSDNFSPQAENIAAKGVTKVRQATKMSDVIRGVPGVNVNGARSTVERYNIRGVSEEYLNVTVDGARQNGYSFHHNGNYGIDPEILKRVDIDVGSNSVSTGAGSLGGSMKFETVDAADMLEEGENFGGKVKYGYGSNGNSNQGTAMLYGRRGNLDLLGYFNYRHQRDGEDGNGLKNKNKGHLSNYLFKTKYNISNEQWIKASAERYTNTALSCYRANMGMCLGDVPQPGEPGYVETNHGKAYTELTRKTYTLSYGFNPEHNNWVNIKANAYNTETEVASMGSPKSKVRTVGGTLSNTSEFELGVTSHQFLVGGEYYNSKAQALGSVNNAYVADMDSTSVYVEDKIALGNLMIIPGVRFDHYKADLASDFDKSYHRFSKALGLKYSLTDNLIVFANYTELFKGPDAGEIYLRGTRAYDGNLEAARGDNKEVGFSYAKDGLFSDIDGFSFTAKYFKTDYDNINQTVSASRCVNTSAISSGSIYCNLGKVDIKGVEAQAKYRYEDTSFSVSYARARSEQKSTGLAAFADTGDRYNFTLSQYISSAQVELGWNTMYVRAIDVDDSTLKESYAVSNMYVSWSPAQAKGLELTFGIDNIFDKAYKDHSTQYYGSVDLDPGRNYKLSVSYKF

SEQ ID NO: 8513 - protein, 614 aa, Escherichia albertii TW07627
MIKKASLLTAFSVTAFSAWAQDTSPDTLVVTANRFEQPRSTVLAPTTVVTRQDIDRWQSTSVNDVLRRLPGVDITQNGGSGQLSSIFIRGTNASHVLVLIDGVRLNLAGVSGSADLSQFPIALVQRVEYIRGPRSAVYGSDAIGGVVNIITTRDEPGTEISAGWGSNSYQNYDVSTQQQLGDKTRVTLLGDYAHTHGYDVVAYGNTGTQAQTDNDGFLSKTLYGALEHNFTDAWSGFVRGYGYDNRTNYDAYYSPGSPLLDTRKLYSQSWDAGLRYNGELIKSQLITSYSHSKDYNYDPHYGRYDSSATLDEMKQYTVQWANNVIVGHGSIGAGVDWQKQTTTPGTGYVEDGYDQRNTGIYLTGLQQVGDFTFEGAARSDDNSQFGRHGTWQTSAGWEFIEGYRFIASYGTSYKAPNLGQLYGFYGNPNLDPEKSKQWEGAFEGLTAGVNWRISGYRNDVSDLIDYDDHTLKYYNEGKARIKGVEATANFDTGPLTHTVSYDYVDARNAITDTPLLRRAKQQVKYQLDWQLYDFDWGITYQYLGTRYDKDYSSYPYQTVKMGGVSLWDLAVAYPVTSHLTVRGKIANLFDKDYETVYGYQTAGREYTLSGSYTF

SEQ ID NO: 8514 - protein, 199 aa, Escherichia albertii TW07627
MRKLCAVILSAVVWLVAAGTPASAAEHQSTLSAGYLQTHTDMPGSDDLKGINVKYRYEFTDTLGLVTSFSYAGDKNRQLTRYSDTRWHEDSVRNRWFSVMAGPSVRVNEWFSAYAMAGVAYSRVSTFSGDYLRVTDNKGKTHDVLTGSDDGRHSDTSLAWGAGVQFNPIESVAIDIAYEGSGSGDWRTDGFIVGVGYKF

SEQ ID NO: 8515 - protein, 199 aa, Escherichia albertii TW07627
MRKLCAVILSAVVWQVAAATPASAAEHQSTLSAGYLHASTNVPGSDDLNGINVKYRYEFTDALGLITSFSYANAEDEQKTRYSDTRWHEDSVRNRWFSVMAGPSVRVNEWFSAYAMAGVAYSRVSTFSGDYLRVTDNKGKTHDVLTGSDDGRHSNTSLAWGAGVQFNPTESVAVDLAYEGSGSGDWRTDAFIVGIGYRF

SEQ ID NO: 8516 - protein, 363 aa, Burkholderia ambifaria IOP40-10
MTKKTLLALAACTIPAAAFAQSSVTMFGLLDAGISYVSNEGGHGNAKFDDNIFFPNLLGFEGKEDLGAGTRAIFRLVNQFSLANGSMIGGGLFARTAYVGLQNDRYGTLTLGNQYEFMVDSLAASGNEIAQDLVGLYGFRNGPFDKLALSNNPTGAFDWDRVAGSNRVANSVKYTSASISGLTFGALYGFGNVAGSVGANNTVSVGASYDNGPFGAGAAYTNQKYGAADGRPATTVRNWSAGAHYMLGTVTAKALFTTVHNAWNGAGAWSAETGAAWHPSPVWVIGASYTYMKGNDTLDNAHAHQLLAAVQYWLSKRTMVYVAGVHQRASRGSHAQINGVMDANGASSGALQSVARIGFSTRF

SEQ ID NO: 8517 - protein, 262 aa, Burkholderia ambifaria IOP40-10
MKRSSRNSLSRSIKTLTLAVALLLPFAAPQKACAGAALWQETNLQYLWGNNFRIAPTKEKDHNQATITIEHADAWKYGDNFLFLDITNPTEKDIAMYGEISPRLSIGKITGLDLSAPFIKDVLLAGTLEVGTYPSGGGFHNYLYGLGLSLNLPKFNFADLNLYVRNSMDKQGVTYQVTPVWQVPFNIGKASFVCEGFVDIAGGEGNSAFNIDAQPRLLLDAGKLWGSPGNLYVGTEFIYWRNKYGFSGINEYAPQVMVKWVL

SEQ ID NO: 8518 - protein, 694 aa, Burkholderia ambifaria IOP40-10
MVGAAFAQENTAAPTSAATNMLPAVSVSASAVRDPGEGYNPTNAVSATRIDAPLRDIPQTVNVVTAEVMRDQHANSLQDVLKNVAGVGFSTGDGQRDQVTIRGFSAIADQFVDGIRDDALYFRDLSNVDRVEVVKGPAAVLYGRGSSGGLINRVTKKPGIDVTNLGVSYGSWADRRVEADVGRVLANGAAAFRITGAHEEAKSYRSQQFLNRTAVAPSFEFRIAPKTTVLLQADYLEDRRVTDFGIPAYKGRPVDVPASAYYGAANAGEVDYSRSRVYSSTATIKHEFNEQWSIRNATRYYHYSLDRNNTLVGSVNEANRTFTLNHGNVYREEHGWFNQTDLTQKATLFGMKHELLYGMEFGQQNKDLVNYSTPVAGANGKPMNFDLFAPALPTLPLHTSTTPAANNLGIFKTLGFYTQDLISFNDQWKALVGIRYDRFEQETLDRRPKQPGLSRTDTAWSPRLGLVWQPTRTQSYYVSWSRSFQPSGEAFSLAANNAELAPEITTNTEIGAKYDWLGGKATTTISVFRLDRSNIKVANGAGTALIPIGEQRTDGVELSGAAELSHGWRVLAGYAYLDATVTNSTAALQGKRATLTPRHFGNLWLTKNLGSGFGVGGGLNFVGARMADPQNTVTLPGYVTADMMAWYARGPMSLQLNLYNLFNKGYIVSAHGSNANLNLPGAPRSVMATLRYEM

SEQ ID NO: 8519 - protein, 734 aa, Burkholderia ambifaria IOP40-10
MLNRTPFASALALAFALPIASPALAQSTSAEPSPAAAAKPGDAPPAAAAARETLPTISVSGQAVQQDFQAERSTVGAKTPTALRDIPQSVTVINKALMESQGLTSFQDALRNAPGITIGGAEGGQIGNNINLRGFTAQNDIYLDGFRDRNQYYRDTFDLDSVEVLYGPSSMLFGRGSTGGVINQVSKKANLKPSAEVSTTIGTNDRYRTSVDLNRPLGATSAFRINAFGQSLGSTRDVMKNKDYGIAPELRFGIGTPTEVTLSALIQHNYDMPDYGVLAVNGHPAPVPKNTFYGLTDDRTIQDVQTVSARIDHRVNDALTISNRTSFSHSMTDARETAANAVLTGPLSSSTALTNGNYTSLPMSALYVRLASHDRVIENHSVDNDTMAHFKFDTGFVKHDLIGGVEVGHDSYTNQAYTRSGLPILSLINPAYLASTPTNATQTPANHAESGATTLAAYLNDTVSIGRDWKFVGGLRWDRFQAHLANTVSAPRYASQTNYFTSVRAGVIYQPTESQSYYFSYGTSFNPSLETLTVTNNTQNLSPEHTKSYEVGGKWDLLNDNLSVTSALFQQEKSNARTQTSTGEYLLEGDVRVRGFQASVTGHITPKWQVFGSYTYMNGVILGARDGTQGKTLANTPRNTFTLWTTYAFTPHWEIGGGPTYMSGRYAANTDYVQVGGYTRWDATAAYHAKQWDLRLNLLNLTNKFYYDALIQSDGGRAVPGVGRTFLATLDYRF

SEQ ID NO: 8520 - protein, 979 aa, Burkholderia ambifaria IOP40-10
MKQKKTTQFLMFSFLFLLPLAMVAQTIKGKVVDASGVSLPYMNVIVKGTSNGTTTNDTGEFNLTVKSLPTTIVVSAMGFARREILVKNISFLTVVVQQDNVSLEEIVVIGSRNPNRSIIDSPVPIDIVDIKELAVASPQVNLNQILNFVAPSFTSNTQTISDGTDHVDPASLRGLGPDQVLVLINGKRRHTSSLINVNGTFGRGSVGTDLNAIPAAAIKRLEVLRDGAAAQYGSDAIAGVINIVLNETVNELSLAVTTGANFSKNSNSQTGGVDGETTNISASYGLPLGEYGGFINFSGDFDVREEYNRMKEWEGNIFNGYNVVERLANAADYDTTRFLSLANGLDPASNEYNTTLNDLKGFANAAGYSTNAGDGLSQLQTKLGVDATDAELAARDQNRSDYNMRVGQSRVRGGRFFANFKLPLDDNGTELYSFAGISSRNGNSAGFYRLPNQSRTFTPAYNNGFLPEINSTISDQSLAVGIKGKIGEWNVDFSNAYGKNAFDFIIGNTYNTSLGNASPTVFDAGGFSFTQNTTNLDISKFYEDTFEGFGVAFGGEHRIENYQIISGEEASYTQYQADGSTFNGISGTSPLKDFFGRSRPGGAQVFPGFGPKNELDRARNSVAAYLDLDAKFSEEFSTTFATRYENYSDFGSTINFKLASIYKATDNLRIRASFNTGFRAPSLHQLNYNSTSTIFQDGVPLEVGTFANDSRAAQLLGIPQLKEETSNSFSAGFTAKLPEANLTFTVDGYVVNIADRVVYTGQFKPLLDSNDVPIDAANTELASLLVQANATAASFFANAIDTESKGIDVVISHKARLGNSTRLKSDLSGTFSQTRQVGGIKSSQILKDAGQENTYFPEDSRIYLEEAVPRTKVNLTNTLTTGKFNIFFRNVYFGKVSEATNSMANQQNFSSKVVTDLSLGYKATENLTLTVGANNLLDVYPDRAIEANRSSGRFDWSRRSQQFGVSGRFLFARVSLNLK

SEQ ID NO: 8521 - protein, 714 aa, Burkholderia ambifaria IOP40-10
MTLRTTLMMMQACGALVFSTVIFAENAANNITQDSYLNDGESKVKDGSNIELQTLQVQGRALSYYKEDEAALATRTSTPIDETPQSVQVVTEALIEDQAARQITDLYRSISGMSQNNVSTVTLRGFSQDEVLYDGLKGDPFGDFSIPQLFTIEQIQVLKGPSGAIYGAGEPGGVINYVTKKPTYEEKNTLKVSAGNKDFLSGSVESSGPANEDASQRYRVGIYSDGQDSYRNNVEEENRIIDLGYAWDIDENNTLTVQYTDIHQYISGARLRGIPTDDDGNFLADTSWNNNEKSDFQELDAQVFQTRLDHSINSWLDSNFSVRYFENTETQKYHEINKLLDSNSDGTADTTQRQYRDQVRTRKGITFAGNLIAELGDHTVLVGSDYFHQKNSFLYSYANKANGVSNLSLTDPIYGQDDVNSYIMDLKTDETTTTDQIGLYIQDQWKVTEQLDLLAGARIDHFEEQYQDHTTNNSKQEYNDTGYSSRIGATYRINNNWKPYTSFSTGFVPQEAEKQAHSKNGEFFDPEESQQLEAGVRSYFFNNKLNINLAVYHIDRKNILQKDTDDTSKYISIGKIRSQGFEVDALADITPRWVANVSYAYNDVKVTDAAEGVYFANTPYHQLGLWSRYDFPSINSSIAFGADYVSQQKNRNNQTVKPYTVYDMSWQTKWQDWKFQLNVKNLFDKEYAVSGFTDKIGSFVGERRRVYLSAAYDF

SEQ ID NO: 8522 - protein, 729 aa, Burkholderia ambifaria IOP40-10
MGTATGSVRRAIAIAAGGTLCVAAAGGAHAQASNAAATPAADAAATLPKIDVTGQAGRASRGLVGLRTATATRTDTPVAEIPQTTNVVTAQQIEMTGATDLNQALRYVPGFATFGSDTRTDWYAALRGFTPTLYVDGVAAPNTAVIANWRVDPYTIDSIAVLRGPTSVLYGAGEPGAIVDAHTKLADGERVREAGVQIGNDARKQTMLDIGDTLDADGRYAYRFVGIARDGNAVTGPNADRRVAVAPSFRWRPTADTSLTVSASFLQDHGDISSNFLPASGTVLPNRNGRLSQDIYMGDPTFNDYRKKQWSLGYALEHRVNPIWTLRQEVRWSRLSLDDATVFGNGLMPGSTTNMMRFAGLFLLNYSRLDIDNRAQARFATGPLEHTLLLGLQFDRQTTTNSVWLALAPSLNLYHPVYRPVTAAIFSGRTSLGHVDQYTAMNSLGAYAQDQIRWNRWTLTLGGREDRVNARFDDRATGIGTQQDVSAFSGRVGLTYRGDAGWSPYVSYSTSFDPVIGVRMYGGGLPKPTRGKQTEAGLRWQPAGRNLMLTAAVYRIDQTNVLTPTPTNLDRTGTSSVQTGKVRSRGIELSAVGNVTRELSIVASYVYQDVKNVQANDASLNNWPVSVPLPRQMASLWTDWTWHTGALAGLGIGAGVRYQSASAGAPDNSLTVPSTTLYDLAMHYELRHWRFALNVANVFDRRYVSGCQSYAVCVFGNERTVLASAKYNW

SEQ ID NO: 8523 - protein, 827 aa, Burkholderia ambifaria IOP40-10
MRHTRGEEVSPKTRRTVISVAVAAGVFHGAAWAQEAGAGDAAAAGATSASRAAAPASSASAAAAPDGKVQVQDRVVITGSRTETRASKSLTPIDVIGGDQLRATGQTNLRDALVKLSPSITRTSYSGDAGVLTDTLSLHGLTPDHVLVLVNGKRRHTTANITLDPGLNQGSTGVDIDTIPVGLIDHIEVLRDGASAQYGSDAIAGVINIILKRNTRGGELATTNGQTYSGDGFKTSESATIGLNLADEGFLDLSAGFDRQNHTIRTGPDDYFGRFPQGQGYYNPILGDPSSSRETVGFNAGYYLGDDVELYGFGTYAHRNGDAYQNYRPPSVLPQVYPNGFVPVETINENDYSVTAGVKGKNLFGWAWDLSTTYGGDHSVFGMRNSANTGLYAASGFTPTTFHLSTVSNTQLTNNLDLSRAFNVPLLPAPLNVAVGVEQRRETYTIRNGEQASWIDGGSAALPGLAPVSASDISRNVIGTYVDLSTYLTPKWQVNLAGRYEHYNDVGDTTNGKVSTRYQFSPAIAVRGSVSSGFRAPSLAQESYTSVTTSPASVGGILATTSPGARLIGAQALKPEQSTSYNFGLVLNPVRNLQLTIDAYQINIRNRIVLGGTASGAAAIAALEGAGLSVPGSVPASAVSASYFTNGANTRTRGIDLAGTYHTGFGRYGQVDWDFGVNLNTTSVTHVANGSNGKPSLNGQQIASLSTTTPKNKIIIGGTWRLDKWAVTLHETRYGKTSGEGTYFVGPNAFSTSQFVHYEEAARYVTDLEVRYDVTKQFQIAAGAQNLFDVRPSKLPFETQLEGIQYSGGSTIGVNGGFYYLRARYLF

SEQ ID NO: 8524 - protein, 701 aa, Burkholderia ambifaria IOP40-10
MSRKNWAAAPMAIVVGTAGLSAADAQELSLPAIEVSGQRTTAPFRAPESTSATRTETDVMEIPFAVSSVDKKLIQTVAATRGEDLYDWVAGVARQNNFGGLWDNYAVRGFAGDGNTSGTDYLVNGFSWNRGISVPRDTATLERMEVLKGPASALYGRGDPGGLISYTTKQPQFARANTIGVSAGSYGALRETLDSTGPVTKSLAYRFIAMNEDNGSFRDTVSSKRYLFAPSFTWDIGANTTLHYEFETARQRAPLDRGVVAVNGQLGAVPASRFMGEPRDGDYDVRNSGHQFTLEHRFNADWSVNAGFAQRDTDLSGRSSEAFALQPDGRTLWRRYRQVAFHSNDVQGRVEVAGKARTAGIGHTFVMGADAYRFNYDQFVARSTPTAAAPYAIDIFDPVYGQPAPVPRTATNLLERDDGQGLYAQDTLAFGPHWKVLAGLRWDRFHQSVENRLKGVTTTQLQTALSPRLGIVYEASPALSLYANTAYSFRPNNGADVNGRAFDPEKGHGYEAGVKWAGTRWLATVAAFYVNKRNVLTADPANAGFSRAAGEVRSRGVEFEWNGELGHGLRGIVNLAYVDAQVTHDSVLTPGARLVDIPRLSGSALLMYETALPLVDKAGAGAGVIYVGRRAGNTANTQDGFDLPAYATVQLNGYVQVNKHLRASVVLNNLFNRTYYVSSYNNLWVTPGAPRSLFASLAYSF

SEQ ID NO: 8525 - protein, 382 aa, Burkholderia ambifaria IOP40-10
MNTKTRNGLLAAGACCALAAPGAHAQSSVTLYGIIDTGVEFVSHANAAGDHVVRMPGVTGELPSRWGLRGTEDLGGGYQAVFTLESGFNVRGGDLGQGGRLFGRQAFVGLKSGFGTLAFGRQYTMTYLALQGADIIGPDIYGLGSLDAYVPNGRADNAVTYVGTYRGVTLGAAYSFGRDGAGTGNSPGQGTCAGQVPGDAVQCRNWSVMLKYDSAYFGAAASYEEQRGGTGAAANFFDGVAPVAFTSSGGKDARTHVSAYAQAAGARIGAGWIGRRVSTGSPAAAGAHSDLFFLGASYAIKPDFVVDGEGYRIVNSAHDTRATMATLRATYLLTKRTAVYAQSSYLWNSAHARYAVSGGGAGTTPGQGMGQLGAMVGVRHMF

SEQ ID NO: 8526 - protein, 375 aa, Burkholderia ambifaria IOP40-10
MKRKTLALSIAAAGLCAGHAHAQSTVQLYGLMDLSFPTYRTHADANGKHVIGMGNEGEPWFSGSRWGLKGAEDIGGGTKIIFRLESEFVVANGQMEDEGQIFDRDAWVGVEDERFGKLTAGFQNTIARDAATIYGDAYGSAKLSTEEGGWTNSNNFKQMIFYAAGPTGTRYNNGVAWKKLFSNGIFASAGYQFSNSTSFATGSAYQAALGYNGGPFAVSGFYNHVNHNGFRNQTFSVGGNYTFDIVRLNAGYFRYNGDQGPLGQRHDDSWTVSMKIAPKGALDYELGYQQMRIKNAANNADGFTPNANLGAFSLTNGVANGFKETIYGSVFYHLSKRTEVYLAGDYMKLHGGYTVSSTFGAKNQLELTSGIRTRF

SEQ ID NO: 8527 - protein, 355 aa, Burkholderia ambifaria IOP40-10
MKQQRILPLSTTLLAGLTALPAHAELEVTPYGSLRIQTEAVFVDQAQPGEDDSYTGLRDAYSRLGVTANYNDFEHFDISATVEFPINSARLRAEDPTFFHELYKEDNNSMPRVADITVSNDRYGSLRVGTQWLAYYNTVAYPLDFFSSFYSGYATQASFRRDAITYTTPSMGGLTATISGVDLTDEQGTSYLDTIQYALSYAVNDDLAFGIGYQDSEQDSAKHADQAGISAAWAPGNWRFAAKVEQLLTNNNTVQDDDPLTYNLMGSYSWAKYTLRAMVAHGEETDEGDAFFQGDSAQIGLDYRHTENLKFFAEYFYEELGYAIYTPNSDSFNPLAGYHAESDGQVLTVGMRFDF

SEQ ID NO: 8528 - protein, 466 aa, Burkholderia ambifaria IOP40-10
MRKIIILAAFLVLTTISYAQSLGYQNLALLFSEDNANTTARVAAMSGAFGALGGDISVMNINPAGLAFYNNSYFSGSFNSRNTAIESNYYGNSANNENQFFNIAQAGAVLVFKSAYASDWSKFVLGINYQVTKDFTNSFNASGNSGFATFTKYPLDTNETVLNYNEAQGQRFTNEYSGDKTEINIAFSSIHKEKLYVGASLNFYDLNFGQKSTLVEFNNDADGNELDASLYQQNSTTGGGFSLNVGFIYKAHKNFRFGLSYQTPTVFAEVLEETNIVDNDGHMGDTEIFASEDSEFTYSNNIDEYGDNFFPSQRFMYSLKTPSELTASAAFIFGKRGLLSLDYINKRYQNIRLSNSDFSAENQFFQNGLRNTHALNIGTEWRFESFSVRGGYNFAQAPIAVALDSDSLRGYSFGGGYNFGKFKLDVAYSNNNRTSFYNAYPQFPSINSIELQTDNRIFTTTLTIGL

SEQ ID NO: 8529 - protein, 743 aa, Burkholderia ambifaria IOP40-10
MTVNRTTASPARRRRAKVGLGVGLGITLFAAQAAAAQGDTPAPDADAAGSATLPTITVSGERGNALRVRNASVAGLDDTPLRDTPASVSVVTRAQLDDQQAKRLSDVVRNDASVVNDYAPVGYFEGFAIRGFPVDLASAIRIDGLTVSGEQNVPLENKERVEILKGLAGIDSGVVAPGGVINFVTKRSANVASVTGGVDSRGSTSAAVDLGRRFGPDNQFGFRINAAKENMHSYIDGTNGRRTFGSIAADWDISPRASLQLNAEFQQWIQRSAPGYQLLGGTVVPSIKTTSKALGTQPWAKPVTTDALNLNARFDYQFNDDWKAYIAAGRSRTMIDDNSAFAYGCSYAASCTAGATSPFFFGANGDYDVYDFRSPGEYRRNDDLRAVTTGKFATGPLRHELTLGVSVQRRVVSMADAVYDYVGSENVYGPDTTFSPSPNSPGPSYPRLDAWQYGVFGLDRISIGEHWQVLAGGKQVLLRQRSWSSLDGDTTHTDRSVFLPQVALVYKPVNVLSLYASYSKALSLGDQAPVRATNAYAFLPPVESHQFEVGAKYDWLDRLSLTAAVFSISKPFQFADPDASGTSYTFVQRGTQRHQGIELGAAGRVTERLGLTASVAAIRARAYDSGSPAYEGHQIINVPALRATVYADYAVPGVAGLNVLGGVEYSAARNANEEGTARVPSWFVFNLGARYTTKIGGHRTVLRVSVDNLFNKFYWRDAGEQQSDAYLFPGAPRTARVSLTYDF

SEQ ID NO: 8530 - protein, 403 aa, Burkholderia ambifaria IOP40-10
MKKTLVTLSVLSATSAAFAAPDANTFYLGAKAGWASTHKDINQFDSKYQNDKRYNPEFTTWGIHRNSVTYGVFGGYQIFNQNKMGLALELGYDYYGQMKGSSQNKVALDVPTPRGPRPPIHKPKPKGDLNRQFKHTAHGANLSLKPSYEILPNLDVYGKVGMGLVRNDYKFILDLQSKDQHVKDETKLHTLKPSLLLGTGVEYAITPELALRTEYQYLNKAGNLYKAAKYKNISTSLAYAPDIHSVSVGLSYRFGQGGKIEPTPVVVEPEVVSKNFAFSSDVLFDFAKADLKQEAAQVLDATNTEIVNLGLATPAIQVNGYTDRIGSGDVNLKLSQRRAETVANYLVAKGQNPVSINAVGYGEANPITGNTCDAVKGRKQLIACLAPDRRVEVQIQGTKEVTM

SEQ ID NO: 8531 - protein, 397 aa, Burkholderia ambifaria IOP40-10
MNKQLIAAPLLLSLAGIAAAQSSVTLYGIVDAGVTYRSNERVGSAGAYTGHSSVGLTTGNLSGSRWGIKGSEDLGGGMRALFVLENGFDITNGTSGQGGRQFGRQAFVGLGSDRYGTVTLGRQYTSLDDFVSPVGPSSYIGGFGAHPGDIDDLDQTARVDSSIKYTSANYSGFTFGALYGFGSQPGSMKQRNTWSVGAAYAAGPLRVGVGYERSDNSKTGATDPTAGKWQSTDDGLFNSSINEGYASAQSQQIIATGATYDFGSAVVGVNYSNVQYRSGGQSLFTGHATFNVAGVFTRWNVRPQTQLFAGYSYTRGSDVDGVDDRAQYHNVTLGAVYDLSKRTSVYLLGAYQHASGMTLDALGRPVAATASVSDKANGHSSDSRSQAIVSLGLRQKF

SEQ ID NO: 8532 - protein, 722 aa, Burkholderia ambifaria IOP40-10
MPSRRTPCRARTTRPWRTRLPALLTLCVASGAHAAGAEPVAPAPDAASAAEHALPAINVSASAAVDPTVGYQPRTTSIAGGDDRALKEIPQSVAVVSSSVMQDQQARSLDDVLGNISGVTQTNTLGGTRDAFIKRGFGSNNDGSVLVDGVRTPVLHSYLATIDRVEVLKGPASLLYGMQDPGGVINLVTRKPEDTFGGSISASRTSHRGSNAQFDLTGPLGRPGQVAGGTLAFRLTGEYDTSRYWRSFGRERNALIAPALSWHDANTSIDVSYQYVDYTMPFDRGTVLVNGRPDDALRYRRYEEAWSQSSGIQETLRTRIEHRFSDAWRVRATYGWGRDRYDQFITRATAFNSRTGALTRSSDANLGRNDSDQIATLGLLGNVTLAGMQHAIYVGGEYERQRSFRGDTIRGKATTGFNLYDPVYGLLAPGGVPNPKQSDSRSVVHAYSTIVQDSVKITDRLTAVGGLRWENWQQESGMGRPFVFADRSRGSVWLPQFGLAYALTPALTAYANVSRSFKPNVASNVAAPLAPEYGRVLEAGLKFSLKPAITGTLAVYQIDKRNVAVTVDDITSTIGTARSRGIELDVAGQITRHLSVIGSYAYTNANDRDSNTPLVNVARHTGSLFAVYDTAIANLPGRWRFGGGARLVGARSGDTANRFTLPGYVSVDAFAAYETTIGKFPTRFQLNVKNLLDKTYYPSSNNNLIVAVGEPRLVTLTTTVSF

SEQ ID NO: 8533 - protein, 315 aa, Burkholderia ambifaria IOP40-10
MQTKLLAIMLAAPVVFSSQEASASDFFGPEKISTEINLGTLSGKTKERVYEPEEGGRKVSQLDWKYSNAAILKGAVNWELNPWLSVGAAGWTTLNSRGGNMVDQDWMDSGTPGTWTDESRHPDTRLNYANEFDLNVKGWFLKESDYRLAIMAGYQESRYSFNATGGTYIYSENGGFRNETGALPDKIKVIGYKQHFKIPYVGLTGNYRYDNFEFGGAFKYSGWVRGSDNDEHYVRQTTFRSKVINQNYYSVAVNAGYYITPEAKVYIEGVWSRLTNKKGDTSLYDRSDNTSEHNNNGAGIENYNFITTAGLKYTF

SEQ ID NO: 8534 - protein, 794 aa, Burkholderia ambifaria IOP40-10
MNAPGDCPHQETKYIMSNDTALGRGGALCCVLATVAVIETPSTASAQPNSDTMLPAVTITEPARQSLRSQPDRASRASAARRATHQADSRTSATLPSATPPATAPGTMNVEGEPGPLNLGVPNAAGSLVGLTPRETPATVNIVTQRDMQEKGLRTMVETFNSVPGVMSGNLPGEPGVISMRGFSRAATGYAIDGVRAPDPLIVSRDFDTFNFERVEILKGPASVIQGVGALAGAVNLLTKQPMLGQAGAQGLLSYGSFNSLRTGIDINAPLSTNAAVRSTLSYGQSDGFIDDTRSRKVGATTSGMLAPTDRLTFTGSASFFHDEFRTPYQGIPLIARSAARDPTNLISAPGGLVIDRSIRNQNYNVENGLMTSDTMWLRGGAEYKLTDNWTLKNNLSFFKADRYWANSEDFTFNAATGLLDRSTTKITHAHQFWSERAVASYDGIIGGFRNRFATGLEYVEIDFDSNRRFGSTTPVDPFNPARGYFPADTAANFSTRQDFTSGLKTFAAFAENAVNLTPDWLMLASIRHESMKLDRRIDDLNTGAVNRFDKTFDNLSWRVGTVYNVTPGTAVFGQYNRAAVPIATLVLSNTANGRFDLSTGSSIEGGIKSSLWNDRVVTTASVYQIEQDNILTRDPTTPALTVQGGSQRSRGVELDVAVSLTPQWKVSGNASFIKAEFTELYSATQDLRGNRPINVPAQAFMVSTSYRFDPVPLTIGASAQHVGSFYTDTANTIEVRGRTLLDAWLAYDIGGGTLRLRGRNLTNAFYANWSGYSPTQVYLGAPRSFDLSYNIKF

SEQ ID NO: 8535 - protein, 631 aa, Burkholderia ambifaria IOP40-10
MVKNTGELKKLSDTYENLSNLLTNFNNLNKAVTNASSPSEINATIDNLKANTQGLIGEKTNSPAYQAVYLALNAAVGLWNVIAYNVQCGPGKSGQQSVTFDGQPGHNSSSINCNLTGYNNGVSGPLSIDNFKTLNQAYQTIQQALKQDSGFPVLDSKGKQVTITITTQTNGASKSETTTTTNNAQTLLQEASKMISVLTTNCPWVNTAHNSNGGAPWGLNTTGNVCQVFATEFSAVTSMIKNAQEIVTQAQSLNNPQNNQNAPQDFNPYTSADRAFAQNMLNHAQAQAKMLELADQIKKDLNTIPSQFVSNYLAACRNGGGTLPNEGVTSNTWGAGCAYVEETITTLNNSLAHFGTQAEQIKQSELLARTILDFRGSLSNLNNTYNSITTTASNTPNSPFLKDLISQSTNPNNPGGLQAVYQVNQSAYSQLLSATQELGHNPFRRIGLISSQTNNGAMNGIGVQIGYKQFFGEKRRWGLRYYGFFDYNHAYIKSSFFNSASDVFTYGVGTDVLYNFINDKATKNSKISFGVFGGIALAGTSWLNSQYVNLATFNNFYSAKMNVANFQFLFNLGLRMNLAKNKKKASDHAAQHGVELGVKIPTINTNYYSLLGTQLQYRRLYSVYLNYVFAY

SEQ ID NO: 8536 - protein, 696 aa, Burkholderia ambifaria IOP40-10
MQKSLLATLISSLLLAPSSYANEPQSTTDIEVISIKGSRLDKAATATGLPLTLRETPQSVTIIDQEFIQSFSLNSVADLMFLTPGIYAQKAETNRYFFSSRGNPITNFQFDGVPVNYSSFFNDASTDTILFDRVEVVRGATGLLTGAGEPSAAINLIRKRPKAAPGGYVSAKVGAWDSYRVEGDASVDVTESGDVQARFAAAYEKSDSYIDLAEDENLQVYGVITAKLSDNTLFTLGADYSDRDPKGSTWGGLPLFYADGSLANDLSRSTTTAASWSSWQRNGANVFATLEHNFDNNWDVKFDVEHREDEMDGHLLYLYGAPDKTTGLGMGASAMIYQSTRKQDAARLFASGPFELFGREHKLTAGLLYSKQDTTADSYYPLNSISIGNFFEWDGSVAEPSYPSTPIYQEGEETQKGAYLATQINLHDQWMLLLGGRISQYKFESNAAADYNNSDVFTPYAGLIYNLNDSISIYTSYTEIFLPQDARDANNKRLEPMTGNNIELGAKGDFFDEKLTASIAVFKVQKENVAEPDDNALPLPGGNYPMHLVDGTSNQGYEVELNGRPTEDWDLFFSYTHSESEDQDGVAFSTYLPKDLIRLSSLYHFDGALEHLTVGGNLSWQSKIYKDKAGPNGERSEQDSYYLVNLMTSYQLTDDAKVQLNINNLFDKKYYSSIDFYNQGFFGEPRNIELSLSYNF

SEQ ID NO: 8537 - protein, 1029 aa, Burkholderia ambifaria IOP40-10
MNFSRNLLRTALLSSAAAAAALSMPTFAAAQTSEVGVDEVVVTGSRIRRPELTSVQPLQVITTERMEERGFTNVADALNDIPSVGVPISPVGDQGSFGVGRNFINIFNLGTNRTLTLVNGRRFVGGNPASIFTGAAAGGQVDLNVIPTGLVDRIETVQAGGSAVYGSDAIAGVINIITKQDYDGVEVDGRYGWSDGGYDDWRARITAGKNFLDGRLSLSGSYEYNETGQLGFVDRQRTAEQLTFALNPANTSGSDNIPGQVIWLNRRIPEVTTGGLPFQANTSSLGRLVTIASPSGGRVTAQFGPGGVLVPYDAGTFVQPSVASGGEGMNLAELSSLISPVKRHVATAFAKFDVTDNIRVNGEFFYSQFDAVEPYNQPIYNAPLFGGNSSMLRMSTANPFLPAATRAALLDPANGLAADAANPGERIFYLSRASVDIGNNKTSADGETFRGVLSVEGDFDFLDRNFFWNLAYIHGQSDGSFQSPNIIQTRFLQAIDVVRDASGAVVCRDPSNGCAPLNMFGDGAPSQAALDFIGVQFESEYKILQTVYEANFGGDILDLPAGPWSFAAGFEARYEKSDFNPNAPQEAGVGRSAAITALTGKFDTKEFYGETLLPIFGGDFTFPLLHRLEIEGAYRDVDHSQAGSGKAWSYGGRWYPIPDLMIRAQKSRSFRAPAITELFLPTATSFMTATDPCHQANINSGPNPAVRRANCEAAFTALGLPADYSLVSQIQQATVQGATSGNPDLQNEIGKQWSIGMVYQPSFVPGLSINFDWVNIRLEDAINNFTLTSILQVCYDSPGGNADACSRFDRGTAASGRPGQILGRDEAIGNGSNSIGPQTGYINAGYTNFEGFTAGVNYRIDFVDWLGGAFGNMWGGNPGRVDVDLDIFHVERQETSVTGLGFDLNRDHGEIGNAKWRAKLETSYSRDPVAIVWTTNWIDESRFNNDFTIETRYPLKVDEYFLHDLSVTVNLDALTDRFGMGVLNDARARFVVRNVFDTKPPHGATNSANAYGTYDFIGRYFQAGLTARF

SEQ ID NO: 8538 - protein, 901 aa, Burkholderia ambifaria IOP40-10
MKNQYKLKPVALAVGLGLFASAPAALAQQADEADVERESTIEEVVTTGSRLQGSAAAVVQERKNQAFVADILGAEQLSRSGDSDAASALRRVTGLTLVDGKFIYVRGLGERYSSARINGASIPSPDLTRNVIPLDIIPSTIIESMAVQKVFSPSMPAAFGGGNIDIRTRSLPDDFVFSVEAGVGMNSNADEGYTYNRDDSGIPAGIKDAIGRYQGDFSLRNIVNTDGLTGSGNSAGNQARAINASLAKQLPRDMVLKKESLDPNMDFKATLGNSFDESFFGGTIGVLAAASYDNDWDVSERKNAVISNNATADCSTSLATVEDISKSCYNTFEETTVTTETERLNGFFTAGYELDTHSVSYTKIYLEDSEDESEFGIKQSPNGSNLKTIVGTGIANREHEFKYEERVLNVDQFRGQHTLMDYWGIGFDWQYTESKAETDIPTEVSYRFDDIYDTEGNFSETRVTGDDNRAIFQFVDMEDNVKSYGGNLSLPLAFSGIELELKAGYDFVDKARYYSTSRFSLDNASGSRLSVLDDLDDVLGVTGYLTDDVIDDNDFRISFREPGAPNADDYLAAQKIDAYYGEFDAIFDNTWRVSGGVRYEDFKQVSLATSSLIFSEQDLNNYFNPERVLESTIAEDDLYTALSLTYMASDNYQLRFGYGETVVRPDLRETVPVAYYDPITDIRTFGRAGLESSDLRNYDARFEYYADNGDNYTIAAFYKDIENPIESVLQVGDEDYTLSYVNGESAEVYGVELEWLHDLGYLANGFFTSGNLTWSDSEASIDPALAGNLTNRTKRMTGHSEYVANFQLNYDSANGEHATSLVYNVFGERILAAGIGGREDAYEQPFHSLDLVYNYYPSFNSKIGLKVKNLLGEDQEVTQSDILVRSKEVGTVVSLSYSYEF

SEQ ID NO: 8539 - protein, 642 aa, Burkholderia ambifaria IOP40-10
MNLRHLLATSAASALLCPLAHAAGDTTPAEASPPAAGTELPTIAVTDTRRLPESFDQRYATTQVLTRADLERLSPSEPSITQALATLPGVTVSSNGGPGSSASVSIRGSSASQVAVFIDGIPIGSPTTGIAPWADLPTEAFERVEVISGPAAASFGANAMGGVVQLFTRRAAGQPNQTSVSFGGGSNKTFDTQLRTSGTVPSTGPLAALGGLTYSLGLHDYNTAGIDATQPVLPYHEAGRNPYHAQDLDARLGYARDNWSVSTFALYHRSDLSYDNAGFANRQLDHQLTTGVAFHLDITRDTQFAQSFGYASDRQFLYANDPTIPTDQIDSQRISVSTSLTHQEHGFRLFGLPLSGETKLAYDFTREQAFLPADLPDGIPTRNDSAFSLHQSATLGSVTLFVAGRHEIIMGKAVNTGNVALSWAITPVYAARVSYGNAFRLPSFNDLYYPGYGNPNLNPERSDSVEAALDANTAYGTFSAAIYDTRVNNLIAYNPATFSPMNIGRAHIRGIDLSYKGTIGRSTPVSIAVGILNPQDVTNESWLSRRPRQTFSASVDHTWDELRLHALSTGATLSYGGTTFDDPANTTYLPSYLSVNLRASYKVNAHLTVSATLSNLFDRQYMTAYGYNTLGRTAFGKISYTF

SEQ ID NO: 8540 - protein, 394 aa, Burkholderia ambifaria IOP40-10
MIKKSVVLGLVSIGSIGAHAQSSVTLYGVVDAGLAYTNNQGGASNIQQTSGKLSGSRWGLKGSEDLGGGLQAVFTLESGFRPSDGGLGQGGRLFGRSAYVGLNKTGIGTLTFGRQYEPITDLVAPYSGSGFWSPATHIGDNDNLNQSFRINNAVKFRSATIAGFTADVLYAFSNQANGGAGTGFSNNNAWGVSANYVNGSFSAGAGYVRLNHPNATSNTSGAVGGATTTTGNDYSGAFFYGLNGGVRKQQIGVAGANYALGRATLGFAWSHTQLDYVDGSSRKFNNYDVNGRYQITPAATLIGVYTFTDGRASGLPGTGGQTLKPRWHQFTLGFDYALSKRTDIYLSGIYQLAAGDASTASSGGYRRIAAISNIGSASSTNRQVALVSGLRVKF

SEQ ID NO: 8541 - protein, 369 aa, Burkholderia ambifaria IOP40-10
MTLRLKHLAWLIAAAAPAAASAQTSVTLYGRIDGGVEYLNHIATPNGSSTRWSAEGGDWGTSMFGLKGFEDLGGGMSTVFNLETAFQVMNGTTGGGRLWSRRAYVGLKSDTWGQLQAGRNLFIDSDGVWEFDPFVQQAFSSASLVRGRNWQQSSNNIEYHSPVIGGFDVQAQYAFGNQSRGFNYGAADDFGRSDGIMISYHSPVLDVRGIYDELRDNNGKFSNIFTASREYFVGANVKVSKFKIQGAYTHYQAPDSPAGVADRADHYWLGATYTATPQWAVTGGGYYVKVGDGGGDASHDPSGHAIMYVLGTTYNLSKRTFLYGTVAYVRNGGNSNFSLIASPRDATSGTSPMTGESQTGAYVGMMHTF

SEQ ID NO: 8542 - protein, 976 aa, Burkholderia ambifaria IOP40-10
MTPRDIGDDDMTAKTWTWLGSASALAMMLAGAPALAAPAAKPTLAIPAGDLATALPYFSRATGLQVLADPALLKGKRTEGVRGQFEAERGLTELLRGTGLNFVRNGGAAILRPMAQRVSTAPAPVAAQAAPVAPTAAQAEEPAMLEALVVTGGFANSLARALADKRKAANVVDAISAEDIGKFPSNNIAEALQRVPGVAITRDRGEGLFVRVRGLGPNFQIVTLNGRSAAVNENMRDSGQSGRQFRFDTLPSELVAGVEVGKSPLASLDEGALGGVVDVKTFRPLDLGRSTLALSATASRPQLAGKTDPRLSGLASWTNAEGTFGVLAALVFDQRTLRQDRITGVGWSYADPASTLGKTMIAQGISLYPTAIRPTLEREDRERKGVVLSAQYRPSDETEITVDASYTKLDDHYDELTYSVDQNVATLAAGSAVIKDGVLVGGTVNSTTQIGREVSDLAHDNLMVAGRIRQKLEDWTLTADLAYARAFSETSNPITRTRLLGPIGQTTFSMTKVDDDAVPSVRLATADLGNPSLLPFRRIEWRENNATDDETALQFDAERPLSWGLLSRVQFGVKYRERSRDYNRADINYTTNLAGKFFGAEYFDAFPVSSFLGKVDGTLPTNWAMPDPAAFWGLADKTQRGTARADKRNSYQVSEDIAAGYILGDVESKVFNAPLRGQLGVRVARTEQISAGHADNGSAAIPVRYKETYTDVLPTANFALELTDTLQARFAAAKVITRPSLADLAPRLTLNSSGTVLTAVGGNPLLKPFEAWQYDATLEWYFAPGSALIAGAFYKDITTFVYSQKTNIVVDGQTYLLTSPTNGGSAKIKGIELAYQHLFKRLPAPFDGLGFLANYTYTDTEATYSPTLKDEMVNVAKNSFNLTAFYEKDRFAARASYSWVDDVLQDVGGAGLSALNDSAFGSLDASVSYKITPSITAAVEAQNLTNASQWQFVKGGWFGGYTHYGRTLSFGLRAKF

SEQ ID NO: 8543 - protein, 376 aa, Burkholderia ambifaria IOP40-10
MNHPNGRADRLAVPRATLAAALLACASLPALAHSSVTLYGRIDTAIEYANAGPNHVTRMGSGNLWASQWGLKGVENLGGGYAAIFKLEDGFNAASGALSNSSALFGREAWVGITGPFGGVQFGELYTILHTTLVTYSLPGLGAGLAWGNATNNFVGPAFLRVRNSMRYTSPRYAGFMLRAMAARGANGAAGQPATLGDTYGAGLNYARGGLSIDVDTMQQKFSPVAASALGATSTAANGNYTLGAISYDFSVVKIAALYMRHRGGPDVAAAIDSQSAYPHSDTMELSATVPIGRASLLLSIGHYRKVADSDGNADSYGIRFDYPLSKRTVLYTGAAMVRNGAHARFVVNGAAGGGVAVAKPGATASSIVAGILTSF

SEQ ID NO: 8544 - protein, 1144 aa, Burkholderia ambifaria IOP40-10
MKLFTLFFACSLGLAHASESYAQKAIVNVEVQNKTVGEILKEIEKQSEFDFFFDNTLIDLNRRVSVTSRNGDIFKVLEKVFKGTNVKYSILDKKIVLTTNADNTQTVQQITFKVIGKVVDNMGESVIGATVLEQGTTNGTVTDMDGNFELVVSNKEVTLEISYIGYSKSVVKSKVGVPVTVTLKEDTEVLDEVVVVGYGTQKKVNLTGAVSQVGEKALESRPVQNVSQALQGLVPGMTFGVDAKGGQLNNTPSVSIRGAGTIGKGSTGSPLILIDGVEGNMNLLNPLDIESISVLKDASASSIYGSRAPFGVILITTKQGKTGKPVVSYNTNIRFNSPLTDYDMMDSYRFMHYYNDARTNGGQAAYFSDEQIANVLAYQRGEVGKIIPVTTSNTYTHNWANANTDWYDVFFKDHAMSQEHSLSLSGGTERFSYYLSGNFMDQEGLLNYADESYYRYSVNGKINAKINKNISLSYNTKWFRTNYEAPSYLNQLFFHQIMRKWPNAFVTDPQGYWADNSEIIPLKEGGRMKEDLDQNFQQLQLDVTPLPGWNIHLQGNMRITTNFTHTDRQAVYAHDANGEPYAIAITNATQPGQSRVIEKGTKNEFYTVNLFSDYSRQLGDHYFKVMGGFNAEHQNVRTLSTQRDGIIVPDLPTIDTSTEQDVAGGGYNHWATAGFFGRLNYNYKEKYLLEVNGRYDGTSRFMKDQRWNFFPSFSLGWNVARENFWKPLESVVNQFKLRGSWGELGNQNTSNLYPFYEILPVKSNSGNWLVNGGKTNTADIPSLVSTLLTWERVRSFNVGFDFGAFSNRLTGSFDYFVRKAVDMVGPAPQLPLVLGIAPAIVNNADMKSYGFEIELSWRDRIGEVDYGVKFNLADAQQKVVKYPNTTNAFSDWYAGKMSGEIWGYTSLGIAKTDEEMKEHLASLPNGGQNQLGNKWGAGDIMYADINGDGKIDGGKGTLADPGDQRIIGNSTPRYNFGLVLDASYKGFDVSIFFQGVGKRDYAPIVGTNGAVFWGAVNNIWQSMAMEEHFDYFRPEGHPMGANLNGYYPRPDFTSNKNHQVQTRYLQDASYIRLKNLQIGYTLPKQWINKLHINRCRVYVSGDNLWTGTSLASMFDPETLAAGDWGSGKTYPLSKVISFGLNVNF

SEQ ID NO: 8545 - protein, 385 aa, Burkholderia ambifaria IOP40-10
MKKSLLALVALGAFAGAAHAQSSVTLYGIIDEGFIFNNNAKGGHLYGLSSGVMQGSRFGLRGTEDLGSGLKAIFVLENGFDVNSGKLGQGGLMFGRQAYVGLSSQYGTVTLGRQYDSVVDFVGPLEAGDQWGGYIAAHPGDLDNFNNAYRVNNAVKYTSPTYGGFSFGGMYSFGGQAGQFSKNQVWSLGAGYNNGPLVLGVGYLNARTPANFGGMFNTGASAAATAVSSPVYGAYANSANTYQVIGAGGAYTFGAATIGATYSNTKFKGFSVGPFVNQTATFNNGEINFKYQLTPALIVGAAYDYTQGSKIDGNSAAKYHQGSLGVDYFLSKRTDVYVIGVYQHASGNALDAAGNVVQAHASINGLDPSSTSNQVAARVGIRHKF

SEQ ID NO: 8546 - protein, 277 aa, Burkholderia ambifaria IOP40-10
MKKTLLCAAAGAAALAPLAAHAQSAGSNVVTLGWFHIMPQQSSTPMTTNVAPTPINTPLRLPPSFTSPGTGLHTSGADTVGLTVSHFLTDHIAVTSVAGVPPVFKVSGQGTIRPPGPAGALGTQNIGLGSVNPIVKSVRQWSPAVILQYYFAQANAKFRPFLGLGVSYNWFSDLQLNTNFIKQTQDNLGAILAAGAGKPGTTSVEAKASSSWQPVFNAGLQYNITEHFGLVASVTYIPLKTTSTVTIKAADGTVLSESKSDLKADPIISYVGMTYKF

SEQ ID NO: 8547 - protein, 498 aa, Burkholderia ambifaria IOP40-10
MAQVINTNSLSLITQNNINKNQSALSSSIERLSSGLRINSAKDDAAGQAIANRFTSNIKGLTQAARNANDGISVAQTTEGALSEINNNLQRVRELTVQATTGTNSESDLSSIQDEIKSRLDEIDRVSGQTQFNGVNVLAKNGSMKIQVGANDNQTITIDLKQIDAKTLGLDGFSVKNNDTVTTSAPVTAFGATTTNNIKLTGITLSTEAATDTGGTNPASIEGVYTDNGNDYYAKITGGDNDGKYYAVTVANDGTVTMATGATANATVTDANTTKATTITSGGTPVQIDNTAGSATANLGAVSLVKLQDSKGNDTDTYALKDTNGNLYAADVNETTGAVSVKTITYTDSSGAASSPTAVKLGGDDGKTEVVDIDGKTYDSADLNGGNLQTGLTAGGEALTAVANGKTTDPLKALDDAIASVDKFRSSLGAVQNRLDSAVTNLNNTTTNLSEAQSRIQDADYATEVSNMSKAQIIQQAGNSVLAKANQVPQQVLSLLQG

SEQ ID NO: 8548 - protein, 361 aa, Burkholderia ambifaria IOP40-10
MNKTLIVAAAAASFATVAHAQSSVTLYGVLDAGITYQSNVGGKSLWSMGSGVYQSRFGLRGSEDLGGGLKAIFTLESGFNIGNGKLGNNGGMFNRQAFVGLSSQYGTVTLGKQYDATQDYLAPLTATGSWGGTYFAHPINNDRLSTNGDVALNNSIKYTSANYAGLQFGGTYSFSNNTNFGNNRRYSAGAAYQFQGLKLAAAYSQANLGDGTNTSGASSINAQGRVRTYGAAAGYAFGPAQVGAAWTQSRIDNQANGVGTLRADNYEVNAKYNLTPALGLGAAYTYTNAKVNNGSSHWNQFGVQADYALSKRTDVYAQAVYQRGAKGNNIVGTGIYNGDNTTASSSSINQTAATVGLRHRF

SEQ ID NO: 8549 - protein, 274 aa, Burkholderia ambifaria IOP40-10
MKKLIVAGVVAGVSTLASAQQAGDNVATLGWLHIMPQDSTNGLTTNLANMPINGPLRLPGSFTSPGTSLTVNNADTVGLTLTHFFTDHIAVTSVLGVPPEFTLTGHGVIKPPGPAGALGSVNMDNPANQPAVKNARQWSPTIILQYYFNSSTAKFRPFVGIGVAYSWFSNIELNGNFARDINENLGSVLAAGAGKPGATSVEGKASSSFTPVYNIGASYAIDKHWGLTATLTYMPLKTYSSLVIKAADGSTLATTRTKLKADPLITFVGISYKF

SEQ ID NO: 8550 - protein, 1025 aa, Burkholderia ambifaria IOP40-10
MQRIRLLVLLLLCVVCQQTFAQQRTISGLVISAEDHEPLIGATISVQGNEAHGVVTDIDGKYTLEVGPDDKILVVAYLGMKTQLIKVPKKEHLNVVLQPETMNLEEVVVTGYGNFTKSSFTGSANTLKGDMMKDIPVMSVEQKLQGMTTGVSITSSSGQPGANQSIRIRGMGSFNASQEPLFVIDGVPVTSGSLSAGGADAAYMNNSKTNIMSTLNPADIENITIIKDAAAASLYGSRAANGVILITTKKGKAGKAQVSFNMSGGFSNAAVDFRPTLNGDQRRELLYEGLVNYATDKQMADPTGYADGEIDKYASVPSMGYTDWRKELLRTAIQQDYEASVSGGNEKTTFYASLGYNSQEGLAKNSSLDRYSARLNMTQKVGRYGEVGANMMFTQMNQEMNEERGSAINPYLCVAMTMTPSMLVRDEAGNYVGAYDGTQLNPLRDILTDYNRTRMTRMFSTGYAAVEPIKGLKIKETLSYDYTIQKDSRYYNPLSSAGPKSGSDAQSSKGFIEYGKLISSTSVNYVKTFAQKHHLDVLAAYEVESYQTDKASGERSNIPSYAGLTEPDNAAVLNSFVSSTQDYRMLSYISRLNYDYDDRYYLAGSFRRDGSSRLSPDNRWGNFWSVSGMWHVSNEAFMQPVKHILSDLKIRASYGVNGNQPSSLYGYMGLYAFGQSYMGGSGSYESSIPNSNLGWEKNYNLNVGLDVSFINRIFLSVEYYNRDTKDLLYSLPISATTGFTNYLSNVGQLNNRGVELELRTINFANDNFNWTTVFNLSHNKNKIVSLNGQLEQSIEGTWFIHKVGLPYYTFYVTEYAGVNPDTGKAMYYRNKEIPQEDGTVIIDRSLTEDASEAQAIPYKSVNPKVSGGLTNMLNYKWLDLSFTLTYSLGGYSYDKVGTYIENGASNIYTSRYNLPVYAMDRWQEPGDQTDVPRFVYGEDAGPQNSSRYIHSTNHLRLKNLTFGFTLPSEWTRKVLIDKARIYFSGSNLLTWAKWKQYDPETPVNGEVFCEAPAMRTFNFGVQLTF

SEQ ID NO: 8551 - protein, 1080 aa, Burkholderia ambifaria IOP40-10
MRKQLHIIFRLVMFSCILLFVSQEASAQITFSVKNQTIRQTIRVIEKKADYSFFYTDKLPGLDQKISLTVSNESIDAVLEKVFKGSSISYKIESGKQVVLTLKSEQNAPQKGDKKTITGVVADRRGEPLIGVTVRVEGENIGTATDIDGRFSLEAPVGAKISFSYIGYVSQSHTVNKQNIYNVSLSEDSQVLEEVVVVGYGFMKRKDITTAVSVVSTADIEERPIMTAAQAIQGKAAGIQVVQPSGMPGSGVTIRVRGATSVQASNEPLYVVDGLPSDDISNISPNDIESMQILKDASSAAIYGARAANGVVLITTKRGKIGAPQVKMSAYVGFSKLGKKIDALNTEQYKDLMKDLKAVSDVAPNIPESETRYVDWTDLFFGTGVNQNYQLSVANGTEKLQYFVSGGYSDEQGIVEKAHFNRYNFRANLDSEQTKWLKMALNFAYSHTGGQWVNESRSSLRAGSILSVVNTPPFMQKRNPYDPNEYDEQAYGARILNPLAANAADSNTNTDHINGSLGFTVDILKGLKFKTTFGIELTNEHWDYYLDPISTSDGRGTKGRVEESFSRNFEWLFENLLTYDCSFNKHNLSILGGATQQRAQYNGSWMAGFDLAESYPDIHSISAANQLDKDACGSSASAWTLASFLGRVAYNYDSRYLLTVNFRADGSSRFAPGHRWGTFPSVSAGWRISGEKFMQPLQDIVTDLKLRAGWGMNGNQGGFGNYAYMASMSVSKLPVSEGNLYPGLAIKPGSAANKELTWEKTSQWNLGLDLTMFDSRLSFSVDAYYKKTTDLLLTVSLPENVVPSSVTRNDGEMVNKGMEFTLSSQNFKGNFQWNTDFNISFNRNKLTKLGLNKVYYYAEMYESKEKAVILKEGLPLGTFFGYISEGVDPETGDIIYRDLNGNGFIDPEDRTTLGNAQPKFIYGMTNTFSYAGFDLSVFLQGSQGNKIFNASRIDMEGMTDFRNQSVRVLDRWKRPGMITNVPRVGNTENNHNSSRFVEDGSYLRLKTVTLSYNFPKKWLNKIHLSRLQAYVTGQNLFTLTKYKGYDPEVNAFGGDSVAQGVDYGTYPQSRAVIFGLNIEF

SEQ ID NO: 8552 - protein, 753 aa, Burkholderia ambifaria IOP40-10
MRRMTNQMLRMASGSAIAALLAISGQASAQAAAEAENQGLEDIVVTAQRRSESIQNVPVAVTAFNTQELQRANIQDVGAYFQNTPNVFITDSPVRSGNNVSSSALGLALRGISNVGGNASSFGIYLDDFNISNIALNPHLIDMERIEVLRGPQGTYFGRNASGGVMSLNTAKPDTRGFAGEVNAMAGRFGSYELGGMVNVPLNDMVAIRAAGKWETSNGEFNNKAPIGGGNGRDYKAARLSLRATPTEQLTIDLSYNYTREKDDDFGLIHTGVLSDFIKSICPGVTFSCPVDSNLGFYPNNRRNYAHDAPLVVDNEYHIAVGRVAWTGENVGVTSITGYGSAKFDRSGELDFSSVDFLREGFNYERRKSFSQEFRVQSVGDKRLNWIVGAVYAQDKHREGEFIAAGVQNDIGLPEDFPIELSHYNQKITSKALFAEATFDVTDALSLTAGARYSHDKIKRFEDQIEFGGPLQAVQGSRSFSDVSPRFVIKYKAADHVNLYASASKGWKSGGFELDPQRARSDFGAETLWNYEVGVKSTLLDNRLRANLALFYIDWNNVQVSSGVIGRDANGNIINYAGISNAASATSKGAELELLAAPTDQLELGLNIGYLKARFDKFADARTNFGTVDLSGKPLPKAPEWTLSTFAQYTVPLTGDFEAFVRGEYFYTDDAYTTVNNIAAVLTGQPRFPYEVKGYGKANLRIGVENDRFRIVGYVENLFDKKYYTASFDFGFANGAAVVPGLRRWGVRGSVKF

SEQ ID NO: 8553 - protein, 747 aa, Burkholderia ambifaria IOP40-10
MKSRPDELKLGKFTTLCSVLAASPAFADGTPPAAPASTEGHLAPIEIQGKTEHSYKADFSASAKFTAPLVDTPKSVTVIPQELIQSSGAATLTEALRTVPGITFGAGEGGNPLGDRPFIRGYDTQGSMFVDGMRDTGATTREIFNTERVEITKGSDGAYGGRGGAGGSINLITKAPHLGTTAAASAGLGTDRYRRFTADGNWQFAEHAAFRLNLMSHNNDVAGRDAVNNERWGVAPSIAFGLGTPTRVTASYYHLQTDDMPDGGIPYFYTTSNKPANVGTIYPAPVDRHNFYGLIDRDFRKTTSDISTIKIEHDITPNLTVRNTTRYTESTQDYIWTQPDDSQGNVVNGKVWRRNNNRNSSINSLANLTELFGEFRTGPFKHSFTTGIELSREWGKRDSYTVATDKGTICQKGIGAASGYNCTSLWSPNPNDPWAGSITRNNDYAHARTTTKSIYGFDTIEITPRWQVNAGVRVDDYSTRFTDTKANGGKTYTRDDTLFNWQAGLVFKPAQNGSIYASYATSSTPAGMMLGEGSETQSLTPGRGGVGPNADQLSPEKNRSIELGTKWNVLNDKLSLTAALFQIDTTNARVTLPNNQYAMVSNKRVQGLELGLAGQITKQWQVFGGYTYMKSQLRDNGKDAANNGNRFPNTPKHSLTMWSNYDVTPKFTVGGGAFYMSEVFGDPANLRAVPSYWRFDAMAQYRINKKLDLQLNVNNLFNRTYFDQAYPAHYASIAPGRSAFVTLNARY

SEQ ID NO: 8554 - protein, 243 aa, Burkholderia ambifaria IOP40-10
MKRKLAITGAAALAFAFAGGTAHAQSAGDFYVSTGWLHLAPQDSSDPLFLYGVGGTPINQSVPNTGAGISDADTLALATGYFVTDHIATEFIAGIPPKFDITGKGQFSNFGTLGRAYQWSPALLLKYYFNDANAKFRPYVGVGATYIWFTGAKITNSAFENGVLGGPTSAQTSNQWAPVFNAGFTYNFTKHWFAGFSMSYIPVSVTATFTTARRTPVGTLTETSKAHISLNPIVTYLNVGYRF

SEQ ID NO: 8555 - protein, 815 aa, Burkholderia ambifaria IOP40-10
MPAPHGLSPLSKAFLMRRAFQRRMLPHSLAMALSLPLAGYVQAQEIEFDIPPQALGSALQEFGRQADIQVLYRPEEVRNKRSSAIKGKLEPNQAITELLRGTGASVDFQGNAITISVAEAADSSVDLGATMITSNQLGTITEDSGSYTPGTIATATRLVLTPRETPQSITVVTRQNMDDFGLNNIDDVMRHTPGITVSAYDTDRNNYYARGFSINNFQYDGIPSTARNVGYSAGNTLSDMAIYDRVEVLKGATGLLTGAGSLGATINLIRKKPTHEFKGHVELGAGSWDNYRSELDVSGPLTESGNVRGRAVAAYQDKHSFMDHYERKTSVYYGILEFDLNPDTMLTVGADYQDNDPKGSGWSGSFPLFDSQGNRNDVSRSFNNGAKWSSWEQYTRTVFANLEHNFANGWVGKVQLDHKINGYHAPLGAIMGDWPAPDNSAKIVAQKYTGETKSNSLDIYLTGPFQFLGREHELVVGTSASFSHWEGKSYWNLRNYDNTTDDFINWDGDIGKPDWGTPSQYIDDKTRQLGSYMTARFNVTDDLNLFLGGRVVDYRVTGLNPTIRESGRFIPYVGAVYDLNDTYSVYASYTDIFMPQDSWYRDSSNKLLEPDEGQNYEIGIKGEYLDGRLNTSLAYFEIHEENRAEEDALYNSKPTNPAITYAYKGIKAKTKGYEAEISGELAPGWQVQAGYTHKIIRDDSGKKVSTWEPQDQLSLYTSYKFKGALDKLTVGGGARWQGKSWQMVYNNPRSRWEKFSQEDYWLVDLMARYQITDKLSASVNVNNVFDKTYYTNIGFYTSASYGDPRNLMFSTRWDF

SEQ ID NO: 8556 - protein, 360 aa, Burkholderia ambifaria IOP40-10
METNVTRMIRFAVPTMAGLLAASGAMAQGSVTLYGIVDQSIRYTTHANASNDASVQMANGAITNSRWGLKGSEALGGGLKAIFQLESGFEPQNGQLDGALFGRYAYVGLASDWGTVKLGRQATEAFNLFGDLDPLTVGNYTANMWPYLLTQGRASNTVSYDGTFGGLDVGASYGFGGVAGSLGANAYWGTHVSYTLGGLMVGATYQQVRDLNSRAQQAWGAGARYAIGAATLYAGYLGGIDRTGMLDRQLLNAPGRDVSYGSFADNPRRDAIFYTGVSVKVTPAVSVTGVAYYDDIRNVNGVAGNGGKRYTGVLEAEYALSKATQVYATLDYNRVTGGAFTEMPGRGNQTGLAAGLRHLF

SEQ ID NO: 8557 - protein, 360 aa, Burkholderia ambifaria IOP40-10
MKKALVAAALMAAGVVTAHAQSSVTLYGRLDAGLEYLNGLQNGHQVRAESGDWGTSLWGLKGSEDIGGGNKVLFHLEGAFNTMNGGLGTSGSIWDRFATVGISNDRYGTLLLGRELAIANGVWDFDPLGQSSWSSASLVRGRNWNKTSNNVSYQSPQFYGLDFYGQFAFSNSTSFNGNTTAGQPGRAAGAQVTYTNALFQLRGIYDETRDSNGRFSDVFNYSREYFAGLNVFLGQFKLQAAYQSSHADGSGGPAVNNGITGTQQVWGGVTWQATPAAALIAAVYHVNANHGGGNANIYTVGGSYNISKRTLFDLQVATVRNSSTANFGLNANGAGTAVSTGNPHPGGSQTGVYAGIQHLF

SEQ ID NO: 8558 - protein, 841 aa, Burkholderia ambifaria IOP40-10
MHKRVLLALTASLICQESLFAKEKDYTLGKVSTAGKKDRSDYSGQVNLGYSGITAPKSWQDEEVKKYTGSRTVISNKALTQQANQSIEEALQNVPGLQIRNATGVGAMPTIQIRGFGAGGSGHSDATLMLVNGIPVYMAPYAHIELDIFPVTFQAIDRIDVIKGGGSVQYGPNTYGGIVNIITKPIPTQWENQAAERITYWAKARNAGFAAPPDKTGDPSFIKSLGNNLLYNTYVRSGGMINKHVGIQAQANWVRGQGFRDNSPSSISNYWLDGIYDINESNGIKAYYQYYDFAIAQPGSLSEQDYKINRFANLRPLNQKGGRSQRFGAVYENRFGDLDRVGGTFSFTYYGQLMTRDFQVSSSYNSANMVTCFSEAACRAAGLPAGYNLAVPYYATNYNGWAEVENPVRSINNAFEPKVNLIVNTGKVKQTFIMGLRFMTTTFLQRQYLNTNECATKTSGEGAGFLCEGANVMSGWKPHIKHGVYRNWNNWRNNYTAVYLSDRIEAWDGRFFIVPGLRYAFVQYNNENAANWAQIPEKDLRKIKHMNNWMPSTNIGFIPVQGDHNVLTYFNYQRSFVPPQLDVLSYGGAEYFTQHFDTVEAGARYTYKDKFSFNADYFRIWARDFATGQYSVYTSGPMKGNVRPINGYSQGVELELYYRPIRGLQFHAAFNYIDTRVTSHGPLTDLNGDVLKGTSYNKHFPFVSPFQFILDARYNWRKTTIGISSYFYSRAYSGISNSAAGGYYGMQYYSGGNNYESVLNSGYQCEAWCMTQHEGLLPWYWVWNIQVSQIFWENGRHRVTGSLQINNIFNMKYYFTGIGSSPAGLQPAPGRSVTAYLNYTF

SEQ ID NO: 8559 - protein, 677 aa, Burkholderia ambifaria IOP40-10
MLLAAVAHAQADTAAPSMPTPPQTTPLAPIFVTANPLGDTELIAPTAQLSGDALTRRQADSLGETLNGLPGVSTTTYGPMVGRPIIRGMDGDRIRLLQNGVAAYDASSLSYDHAVPQDPLSIERVEIVRGPAALLYGGNAVGGVVNTIDNRIPREAIEGVTGALDARYGGANSVRAGAAQVEGGNGRFAFHVDAFDREASKLRIPGYARSSAQRAIDGPDTPQPSGNVPNSDGRVHGGAAGASYTWADGFAGLSYSGYESNYGSVAEDDVRLRMRQERLALASEVRNLSGPFTKLKFDFAYTDYRHKEVDNGETATTFRNRGYEARIEARHRRIGPFEGAIGVQFGRNTFSALGDEMLVPSTRTNSVALFGLEEWQVDPALKLSLGGRFEHVKVDPDPAGVEKFALAQPRDFNAGSVSAGALFSLTPVWSVAANVAYTERAPTFYELYSNGPHDATGQFLIGNPNASKEKAVSTDLSLRYASGPNRGSVGVFYNRFSNYLTEYNTGRVVDDDGEPVAPGADGSLNEAIYRGVRAEFYGVEVDGKWRAFSQRGHTVDLELTADYTHARNVDTGQPLPRIAPLRATLAADYGYGPFGARAQVTHAWSQHRVPDNDFPTGGYTSLGVMLTYKFRVGATHWLAYLRGDNLTNQEIRYATSVVRGFAPQGGRSVMAGLRTTF

SEQ ID NO: 8560 - protein, 490 aa, Burkholderia ambifaria IOP40-10
MKKQKTIGTASKMLLAWGLPALAGVSLTGVAHADDAAPAPLTVAQAAPAAGASSTVAQATTPNAVINAEATQAVTPPDEPSAQSKSKGFIADSHLDFLFRNYSDVLDSKGGPHRHAWVQGAMANFESGFTTGLIGIGFDASLYAALKLDGGQGAGSMVHIAKGGGGGNQLAWAYPGIYDIKARISNTVVKYGLQAVDNPFMEQHDNRALPPTFLGATIVSNEFKNVMLEAGSFTKTDARGHTTLTNLTTQYGGTRINRLTYVGGTWDYSPNGEVALYANQADDVWHQYYASVKHSIGSTQTIKWTGFGNVYSTHDTGDALQGKIDNNAYSLSLAAQHGPHELLLGFQQVLGDQFFDYLNETNGIFLTNSMDVDYNAPHEKSLQLRYTFYGKEAGLPGFKAMVWGVTGWGADGSAGAANDPSKSSIYWANGAPVQGRHHEFGFIPSYTFQSGKLKDTKVTFIAMWHNGSAHYSDATNREYRLVVNVPLHAF

SEQ ID NO: 8561 - protein, 401 aa, Burkholderia ambifaria IOP40-10
MKIGRLAAAVAALGCAHAYAQTSGSVTLYGTVDTGILYSTNQQFTRADGSTGGGHAWQMGGGNLVPSRFGFQGAEPLGGGLDAVFTLEQQFLSANGQALQGGTAFSRQAWVGLRQDGIGTLGLGRQYDSYTDMLGAYVSSNNWATPYGSHLGDVDNLNAAFNFNNAVKFTSADFRGLTFGGTFSFGGQAGDFAAKRGYALAATYSRAPVALSIGYLNLRQPLDAALGGANGYIGDFACSNPGAMFCLLQDARSMRAFGAGGSLTLGAATIALTYTHTRLDDSRYLTTAAQPRPQAFTFDIGELNVTYLFTPALQGGIAYIFNAAHTDTRGTTRFHQLNVGANYSLSKRTALYAVAIGQLASGTGLGTDANGQPANNAQIPVLANSNSNRQLAVMGGIRVNF

SEQ ID NO: 8562 - protein, 370 aa, Burkholderia ambifaria IOP40-10
MKTLYKLAPLAMLGAFATHAGAQSSITLYGLISAGVGFATNQGGKNAWQALSGTNQNPRWGLKGKEDLGQGLSAVFQLENGFNVMTGTAAQNGREFGRMAYVGLADRTYGALTLGRQYDAIHDYIGPVIIASNGVNIGDNDNGYNDIRVQNSVKYVSPVYYGLKFTALYGFSNTTGFANNSAYSFGLGYERGPLRWSVVYAQYNHPYSATNQDGAIANDYASPLLIFSKSAMSPAAYASRQRIAGTGGFYTIGRAQFAAMFTDVRYDYLDNSHLHLQNLGVNVVYTMTPQLFLGAAYAFTNGKYDVIDKRPKWHQVNLQADYFLSKRTDVALTVIAQQAAGDADHAQIFAYARSTGTRQMMATLGVRHVF

SEQ ID NO: 8563 - protein, 786 aa, Burkholderia ambifaria IOP40-10
MNGDTPTKVAIATGTIRQARGGAFRTVTAAVLLSLVSQACLAQSATPGSTIALDPILVEQSRQPERSAVRSRTVVSRPSASAPTAAQQQAQPAQSADVVRRRFDVLPGGVALVAQQDMASRGNPTLANSLSGIPGLIVQNFLGSNDQPRIQMRGAAQQNPAERGVLILNNGLPINRADGSFIVGFANPQQAESIEVYRGYMANRLGATVLSGAINFVSPTGSSQPGAQIGVSGGSFGQFNTSGQVGGKKDNVDAFFQFDNTRRDGFRDYNSSERVSVNGNVGVALSENVKTRFFMGYTDLGFDVAGPLNKAALYADPKQTATGPRVVGGVATNPGPNAVRDKPRREASQFMVGNRTTATFDAHLFDVAMGYTYTDDQFRFPISSGVRTTQGGDFTGVARYAYNPAAALLPLFETTAQYSVGSADRGYYLNQSGQTGAQFGANRLNAQTLSLYAGANVPVWQQWVLSPSISYAHATRDNDDVYTAARRPTIAYNPSNPTALLPNGSVATQSSSYSRNYSGWSPSLALTYRPDAMQTFFIAGSHSFEPPTHDDLIATVNSTPNSSPGRPTPNGASLAAAAFATPNLSAQTANTVEGGWRGRTDRFSWDIVTYYSWVDNELLTLRDVTGAALAAVNADRTTHFGVELGAGVKFTDRLSGRLAYTYQDFRFADDPVRGNNHLGGVVPHLIHAQLQLQATDAWMVQGAVRWSPTEVAVDNMNTLFADPYAVADLRTEYQIDKTFRVFGEITNLFDKTYAATTLVVDQATSGQAAFLPADGRGFYAGIKAKF

SEQ ID NO: 8564 - protein, 638 aa, Burkholderia ambifaria IOP40-10
MSFYNCTLVTAIATASLSSFGVSASTNEIEQIIVSGTRSEQPSVQIPASIQVVTAEDIKLSGASSLIQILNAQAGIQINDLIGAGSRATSISMRGFGENNVNNVLVLVDGRKLNNPSLAGPDLSAIALKDVERVEIIQGSAGTLFGDQATGGVINVITKRSKELSASVEAGRGTDDLEVYRGSISHGLDNGLFYRVSAEKVLEDNYRVNNEANYSNVLANVGYEHTSFRLFAEILQVEDKLNLPGSLNRANIASDRKQTFNPSEFTNQSSDAYRIGGDVHLTDNWTISAEYTDRETDSAGQTSWGFDWTGTTSVETLNPRAVGIIATANGDILVTSGFDLQESEYQSDLTGSDSEQSLSDFYAQVVVPVTANISVTAGGRYSELEETDNLSGTDNDDDISVFQIGAAYQVNADTRLFLRRDEGFRWANIDENGYSDQPVGEILAPQESTSWEAGVETRIDAVSFSALLYQMTIDNEIYYDPTVNLFGANSNLDESDRVGIVLDSRWKVSERINLQINYSYVDAEVSAGLYSGNTVPFVASQTANLVATFVISDNWSIYVDAQHTGSRYGANDDANSNGELGGYTLYNANINWQYHQFSVNFRANNLTGKKYNGFESTGYNYAYPAKEETFEITAGYTF

SEQ ID NO: 8565 - protein, 363 aa, Burkholderia ambifaria IOP40-10
MKSRAERSIRTAIVTGSAAVAGLAAGAAHAQSSVTMYGIMDAGIEYANHAAPDGGNSFKLKSGNKNTSRWGLRGIEDLGGGLKAVFRLESGIDLANGASDDGPDSIFARRATVGLKGKWGEVSLGRNFTVTYDYMLPFDPMGYAQNYSWATSSMATGGRKDGLFTRSSNAVRYDGEFGGFKFGALYGFGNVPGSVKTSSKYDFALGYEAGPFAAVVTFDRQNGAADSVTPADTVNYIQGIHAGLSYDFGDLKTMAGYRNYRRTYHTSAANQLSDMYWVGGSYQFTPTFSLIAAVYHQNIKGGTDADPTLVSVRANYALSKRTVLYAAGAFAIAQHGQKVGVSRDFAGYGTTQVGVTAGIQQRF

SEQ ID NO: 8566 - protein, 358 aa, Burkholderia ambifaria IOP40-10
MKAFARRASRTSVKLIAAAACVAAAAPVHAQSSVSLYGQVDEWVGATKFPGGDRAWNVSGGGMSTSYWGLHGAEDLGDGYKAIFTLESFFRAQNGQYGRFQGDTFFARNAYVGISSPYGTVTAGRLTTHLFLSTILFNPFYDSYTFSPMVYHVFLGLGTFPTYPSDQGAVGDSGWNNAVGYTSPSFGGLNFGAMYALGNQAGDNRSKKWSAQFNYANGPFAATAVYQYVNFNNSPQDLSALVTGMKSQGIALVGATYDLKLVKLFGQYMYTKNDQVAGSWHVNTAQGGVSVPIGVGNAMASYAYSRDAGGLDQTRQTWAVGYDYPLSKRTDVYAAYMNDHISGLSTGNTFGAGIRAKF

SEQ ID NO: 8567 - protein, 733 aa, Burkholderia ambifaria IOP40-10
MSRCIQSRATPPRRASASVAFAMMTCAAAPACADEGEPRHAPHLSPIFVHGERDAGSRVDRSGSAKYATPLLDVPQTITVVPRVVLDEQQALSLREALSNVAGITFNAGEGGGGSGDMFNIRGFGANANMQIDGLRDSAQNNRSDLFNIEAVEVIKGPNSVFGGAGTTGGSVNLVSKTPKAGASTEAGTMLGTSGYRRVTLDANRPLPGTDDRAAFRLNAMAHVNEVPGRDDIRKRRWGVAPSLAFGLGTPTRVTLGYFHQYDNNLPDYGLPAHNGQVLAGVSRDSYFGWRNLDRERITSDAFTVKAEHDVSSGLKVQNLSRYAHLNRDTVISASHVNLQGLPPGRYKPAGPQGYGRDASTTMWANQTNITSEFATLGIGHTLVTGFEISRETYGRTTYSYGLNRFYPADGFALAAPPGVWQGPARRQDSARNDTALVVKALYAFDTISLGRHWDVDVGLRHDWIDGWAESTPAGKPTERADSDDRHLSTRAALVFKPTDNGRAYFAYGTSFNPSAEFLVTTGSGVSAATGALAPEKNESFELGAKWEGLAGIALNGALFQTEKKNARERMADGSYALVGRQRVRGVELGAAGKVTPRWDLFANYTYLASVTLSSPATPRREGQALGNTPRHAFNVWTTYRLPAGWTMGYGSHFVGRRNVTSQGDGKLGAYWVHSLMAGYEVSRRLRFQLNVDNLFDRAYVERVRQVSGSESRSSAVELGDGRSAMLSAVYTF

SEQ ID NO: 8568 - protein, 386 aa, Burkholderia ambifaria IOP40-10
MNKKLLTIAILAATAGTAHAQSSVTLYGVIDAGISYVNHSKTANGGSGKLFKYDDGVAQGSRWGLRGTEDLGGGLKAIFVLENGFNSGNGAIGQGGAIFGRQAYVGLSQSQFGTVTLGRQYSFSTDILGSNYSTGGNTVAGNYAYHVNDVDQLTSSRINNAVKFQSANYAGFTFGALYGFSNSTDFAGAPATTTGTTTTAGSSRAYSFGVNYANGPFALGAAYTDIRFPSQSSPAFSTTIANISTGNIRDLRTYGVGGRYIFGPATAWALWTRTQFTPVAAGASGTFYNAYEAGLKYAFTPALSAAAGYTYTNATQNGGSAHWNQGNLGLDYALSKRTDVYGLVVYQKASGNNVQAQIGSSTSYFNTSGTGSSNQLAARVGIRHKF

SEQ ID NO: 8569 - protein, 761 aa, Burkholderia ambifaria IOP40-10
MHCYPLARRPICAALFGVFGLSAAPAYADSATYVDSSSKGANPPPPALVAASTRGDAALLDPVTVTATRTATAASRTAASVSVITDDDLEEQQATNIKDALRYEPGVTVRRTAYRPGSAALGGGRDGDSSINIRGLEGNRVLLMEGGIRLPNAFSFGPLEAGRGDYADLDTLKRIEILRGPASALYGSDGLTGAVNFITKDPRDLLSIYGKPTYFSFRPSYDSADRSVGATVSAAGGNDRVQGMIIADGRRGHEVDTRGSNNSASTLRTTSNPQDVYSESLLGKLVLTPTTRDTIKFTAETVQRRVSTDVLSAINRPATLGLSTHDRLERNRFSVDYDFRDDAFRWFQTAHVQFYYQDAKQDQYAFETRGRQPSRSRDNQYQERTFGGAAFAESGFSTGPLAHKLLYGADGSLSRVTNLRDGTVPGVGEAFPNKAFPDTDYTLFGAFVQDQIGYGRLLVTPGLRFDTYRLSPSQNGPLFTGTAVSTSANEVSPRVAVLYEITPALIPYAQYAHGFRAPTPDQVNSSFSNPVYGYTSIGNPNLKPETSDTFEAGLRGKAGTGYGIVRYSAAAFTGRYRDFISRTTIAGSGRPADPFVFQYVNFADARIHGLEGRAEWVMPNGITLKTAMAFTRGSTRNDGAASQPLNTINPFSAVFGVRYEPGERWFVQTDLLFQAAKRDNDIDKSDCSNKACFAPPSSFVVDLRGGYRFNKHVSATIGIRNLFDRKYWNWSDVRGIAADSQVLDAYTSSGRTVAVSMKVDF

SEQ ID NO: 8570 - protein, 195 aa, Burkholderia ambifaria IOP40-10
MAFWSRFNDLSISAIVLDGTGAVQNLGLVGKTQTLGLESEFAWRQTDMFGMTSSMTLQDPQTRGLSNAGTAVAGLNGKQISRTPKYIVSLSPTLYFDLVGKQTELTATAYRIGQRYLDYTNATALPAYTSYDIGMSSYLSQRLELQLHVANVSNSVGLTEGNARVDTLSGQGTSEAIYARPIFGRNYTASLTWRW

SEQ ID NO: 8571 - protein, 189 aa, Burkholderia ambifaria IOP40-10
MKRLIVGISGASGAIYGVRLLQVLRDVTDIETHLVMSQAARQTLSLETDFSLREVQALADVTHDARDIAASISSGSFQTLGMVILPCSIKTLSGIVHSYTDGLLTRAADVVLKERRPLVLCVRETPLHLGHLRLMTQAAEIGAVIMPPVPAFYHRPQSLDDVINQTVNRVLDQFAITLPEDLFARWQGA

SEQ ID NO: 8572 - protein, 405 aa, Burkholderia ambifaria IOP40-10
MKKRVAFAMTAVGLAAATAAHAQSSVTLYGIVDNAIAWQNNSSATGATTGGHSKVQMATGIWAGSRFGLKGSEDLGGGTKAIFQLEAGFNANNGSSQWTNGIFTRQAWVGLSNQTYGTLTAGRQYTAYYTLLSPYSPTTWLTGYYGAHPGDIDSLDTSYRANNSLVYMSPKFYGFTVGGSYSFGGVAGSVNRGSTWSAAVQYLNGPAGIAVGFQRINNATLGGGVWGANSTAQNGLDTSGNGAEQAVSSINNGYKTAQAQQRLAVTAGYQFTPAWDVSVSYSNVQYIPGTLSGFRNTAIFNTAGAVLHWKAAPQWDFAAGYSYTRATESNGISSSAKYHQVTLSQYYSLSKRTGLYAVEAYQHASGNTLTPTGGVILATTSTGDGVGAGSKQNQIAAGVGLIHRF

SEQ ID NO: 8573 - protein, 687 aa, Burkholderia ambifaria IOP40-10
MLKLTIPALAVGAMSAAAAAEAARAAGAPTDDAAVLLPPVEVVASPLTTPLVIVTDPKTPRQPLPASDGADYLKTIPGFTSMRSGGTNGDPVLRGMFGSRLNILANGMPTLGACPNRMDAPTSYIAPESYDKVTVVKGPQTVLYGPGASAGTVLFERVTPRFERPGMRFDGSVVGGSFGRNDQNVDVTAGTPDVYGRVSANHAHAQDYKDGNGNTVPSQWDKWNADAALGWTPDDHTRVELTAGTGDGYARYAGRGMDGAHFRRETFGLSFDKRHLGDVLERIEARVYYNEADHVMDNYTLRQPDPTSSMPMRMASEVRRRTLGARAAATFRFGDDFKLVTGVDAQSNRLDARSAMGRQNYGDQPWDAQATMWNAGAFGELTWYASDAARVIGGARVDYASARDKRATTSGMMASKPNPTFDDDRARVLPSGFVRYERDLASLPVTWYAGVGHAERYPDYWELFSAKRGPAGSVNAFSAVQPEKTTQLDIGAQYKSDRVDAWVSAYAGYVQDYILFNYAAGMMGPTTQATNVNAQIFGGEAGVSWRPVAPLRVETSLAYAWGRNATSGDPLPQMPPLEARVGLEYTRGAWSAGGLWRIVAPQHRYALNEGNVVGKDFGPSAGFGVLSLHAQYNVSKKVQISVGVDNLLDKAYAEHLNLAGNAGFGYPANAPVMEPGRTAWVRVSAKL

SEQ ID NO: 8574 - protein, 385 aa, Burkholderia ambifaria IOP40-10
MKKLALSTLSLALLGAAGAAHAQSSVTLYGVIDTSIAWVHGNDGQANNSWQMLSGNLQGSRFGLKGAEDLGGGLKAIFQLENGFDPGTGKLNQGGRMFGRQAFVGLESNQYGTLTLGRQYDPLVDLVQAVTADNYFGSTFATPGDVDNNDNSLRVSNAIKYTSPVIAGFQAEGMYALGGVAGKTGAGQTWSVAAAYNNGPVGVAAGYFYANNPSPTTAGLRSGWGSTTSDNIVDGPINSGYASAKSIGIAQVAGQYVIGPVTVGLGYSNAQYKPDAFSGFGSTEKYNTGRGFVTYQVTPPLLLGLGYSYTKASGDTDAKYHQVSLGADYSLSKRTDVYLVGAYQHASGTQLVNGVQQSAQASIGSYGFAGKSSAEMVALGLRHKF

SEQ ID NO: 8575 - protein, 386 aa, Burkholderia ambifaria IOP40-10
MKRTTLSLISIASFAAIPVAHAQSSVTLYGVIDTSITYVNHAQGKDNAWMLGNSSAGNLAGSRWGVKGTEDLGGGLKALFQLENGFDPSNGRMGQGSRMFGRQAFVGLTSDRYGTLTFGRQYDPLIDLVQGITADNYLGSVFATAGDVDNYDNSFRVDNAVKYTSAVYSGLQFSAMYSFGGIAGSTGAANSYSAAVSYNNGPFSVAGGYFHTTNSPASNTQRSGWTSSSDGTFDGPVNSGYASAHSIGIARIAGQYVAGPFTFGLGYSNAQYRRDGSSVFGSNEHYNTGQGFVNYQATNALLVGVGYSYTRSGGDTSATYHQVSAGADYNLSKRTDVYLTAAYQHASGQTGDGKGGSMAAQASIGSYGYAGTSSQTMVNLGLRHRF

SEQ ID NO: 8576 - protein, 394 aa, Burkholderia ambifaria IOP40-10
MNWRLIFVAMPALCAAPAFAQGSVTLYGLVDAGIDYTNNVGGHSAWQMASGFAQGSRWGLKGTEDLGGGYSALFQIENGFNVNSGTLAQGGRMFGRQAYVGLGNTRFGTLTLGRQYDSVVDYLAPTTANGSWGVYPFSHPLDNDNTGNTFRVNNTVKYASPDFAGFSFGGTYSFSNDTGFANNRQWSVGAQYEQGGLLVGAAFLNADNPGATAGGAIAGSGSVGADANFASARLRIFGAGINYTAGPATLGFAYTNSNVTRPTANVGYLFGDETIEPVAGPLAGGTVTAIKYQNFEVNGKYQFTPAFFVGAQYVYTTVRYDATTGSAKPKIHSIGLMADYNLSKRTDVYLMGAYQRVAGDATGSSLDQAVIPGAADLSSTSKQVMVHAGIRHKF

SEQ ID NO: 8577 - protein, 259 aa, Burkholderia ambifaria IOP40-10
MLALSVTAFAAKPTLPKSYTVRYTHNFGRIDGFVQIPKGGQFNTTSERRPTFDELNIKNINYPELFVGAKWDNFGIYYGIKYKSFKGDTTLNEDLKTHDLQLRKGDKISSKHLYAFHNLGFSYDFKLNSKFTVTPKIEFSVFQFSYKFSSSGSTTVSNDERKFNAGGIRVGGEANYQFTDDFGLRFDVMTHIPHDSIKSSLDTSLTGSYNLYRNGNTEVNVLAGIGYDSFKYRDTQKDMQNFMDSKTKPVYKLGLELKF

SEQ ID NO: 8578 - protein, 805 aa, Burkholderia ambifaria IOP40-10
MKASVLILFLFFLQTFVYGQYKISGTVVSDANKPINKVQIYNESGALLAQTGILGKFNFSTKREALQLIFYVEEYQLKNVYLQLVDYVDLKVTLEIFSQNLSEIQIKARTVKVFELKRLKDVEGTSIFAGKKTEVVLVDQSAANLAANNARQIFNQIAGLNIFQNDDAGLQLNIGGRGLNPNRTANFNTRQNGYDISADVLGYPESYYTPASEGLKEIQIVRGAASLQYGTQFGGLINFITKKPSTKPLEVVTRNTVGSFGLYTNFTSFSGTKGKFSYYTYLNYKQGNGFRPNSNFDSKNIFTHLEYKLNEKDVLSFEVTYLDYLAQQPGGLTDRTFNENPLQSNRARNWFKVDWLLYNFKWEHVFSNKTNFSFNLFGLDATRKALGFRERRVDLADSGGARELLIGDFNNFGFEARFLTKYTVFGKKATYLIGTKLYKADNTDFQGPGTNTADANFTSASSAFPDYRIQGSFRNPNTNIALFGENIFYITDKISITPGARLEYIKTASTGLGKITNTDSAGNPIGSIENVVDSAKERSFVLLGFGASYKKNAVVEFYGNISQNYRSITFSDLNIVNPSNAVDRNLQDEKGFSIDFGVRGNWNNWLSFDANLFGLFYKERIGFLFTQIPPINNVGQLRTNIGDASIFGIESVFDFNLQKILKMSREHTFNYFINTSFINSEYTKAITSGILGKKVEFVPDVNIKTGLKFGFKNFSSSLQYTYLSSQYTDAQNSGSGDVSGVVGEIPAYGILDFSTSYKYQFAKIEAGINNLLDNSYFTRRATGYPGPGIIPSAPRNWYVGLEFKF

SEQ ID NO: 8579 - protein, 384 aa, Burkholderia ambifaria IOP40-10
MKKHVIFAAALAAFAAPAFAQDSVTLYGLIDEGFNYTNNVNVHGVGKTDYQLASGYAQGSRWGLKGSEELGGGLKAIFTLENGFDVNNGRFNQGGRMFGRQAFVGLSASRFGTLTFGRQYDSVVDYLAPLTANGNWGGTLFSHPFDNDNTDNSFRVNNTVKYASPDWNGLSFGGTYSFSNSTGFATNRQYSLGAQYSLAGLQVAAAYLQANSPGVGNAGAIAADDANFVADRLRIFGGGINYTFGPATVGFVYTKTDVKNPVSTVYLPASTFSGLGLTATKFQNFEINGKYQLTSDFYLGAQYVYTDGKFDAATGSFKPKYHTVGLMADYSLSKRTDVYLQGAWQKVAGDKTGTAADGGYVVGTDGPSSSSNQFAVRAAIRHKF

SEQ ID NO: 8580 - protein, 355 aa, Burkholderia ambifaria IOP40-10
MKSRIVIGCAALASALASPSGFAQSSVTLYGNLDAALLYTSKTLDSATGANAGHQFSMADTGMTPTTFGMTGTEDLGGGLKAKFQLESGFAVTNGAFAHSNGNIFGRQAWVGLDGAFGTVKAGVQYSPFLLAIFDSDPRSFSHFGSGLVNYVDNVLVTGLFNPNAVSYTSPTIAGLTGSAMFAFGGKAGDFQAGRQYSASLKYEHGGFMINAGFYNGNDGTNPTPTASTVAFVGRTIGAAYRFGPVTAKASFASYKVAGSFSNNVYGGGLDYQATPTVDLNGGVWFTSDRNDTANHSLLAAVGSTYSLSKATALYAQVAMVNNHGAMDTGLGITNALYAVNGTTVGANVGIRHMF

SEQ ID NO: 8581 - protein, 707 aa, Burkholderia ambifaria IOP40-10
MAGLAFVLLTFSAAGLAPQSAAPDAIPPVVLDDVEVLAQRGRALVAPERELDGAQIDALGAYDIGEAIRRLSEDYALGEAPMIVVNGRRMADPGVFSGFPPDALVRIEVLPPEAAGLYGAGDPARRVVNIVLQRRFASRDGRAELSRPTAGGTSRAALDLRRSSIIETRTSQFGLKADRTTALRAGERDLTRDPAPGGDAATLRPASENYAADLVQTGAFGDWSASLRANARAQESRTVSVRDGEPAESRRSHQGLSLTGGLNGALAGWSTQVMLSSLWSRGEQSGLSPSQSEQQSISANLELGRPLLDLPAGPVSVNLSGQASRARSVVERPQGDQTSTGRTLGLNGGVSMPLARRSADGDDGLWGDLLMTLGADLSESDSGRGEGLNAALSWTPLSALRFNASLSSARRTVPDLQRFEPEYYGEPVVVFDFVRGEAVEVLPILGGDPGLRPPRSDHLMLSAAAGPFTALALQGGVNFERAEAVDDIGALPAPTPQLEAAFPERFQRDASGRLVSIDQRPLNIRSALSESLSSSLTANVPLGDEGARRGVLRVTLNHSWRLTNRTTIHEALPELDRLAGDGGGVSRQSLGLSIDARRGRWGVNIGARWRDGYRFRRDFGRDGPDDLRIAPFSAVNLKLTRKFERAIAGRDEGTRRGVGLQVELEIANLFDARPKARLGDGRPAPGYGRDDQDPLGRTVQLSLKRRF

SEQ ID NO: 8582 - protein, 942 aa, Burkholderia ambifaria IOP40-10
MTTGMKHIVKVFTLLFLFLTVGSTAKADEKVNVVKQGTVRGRIIDATKQTLPGASIYIEKLHAGVTSDVNGFYTFPNLEPGTYTVKVSYVGYSPVELKITIPEGRTLEKDVVMNEGVELQEVVVGGAFQGQRRAVNSQKNSLGIKNVVSADQVGKFPDSNIGDALKRISGINVQYDQGEARFGQVRGTSADMSSVTINGNRVPSAEGDTRNVQLDLIPADMIQTIEVNKVVTPDMDADAIGGSINLITKNSPYKRFISATAGTGYNWISDKAQLNLGFTYGDRFFNDKLGLILSASYQNSPSGSDDIEFVWDKDVETGELCITDYQVRQYYVTRERQSYSAALDWDINENHKLTFKGIFNNRNDWENRYRLNVKGINLEEDDNGNEYCSINNKGAVRVQTKGGTPDNRNARLERQRTMDFTLGGEHLFGKLDTKWSVNYAKASEERPNERYIDYQLKKQKFTMDLSDERKPLLTPQEGSAMYLNDDFSLKEVTEQQEDIQEKDFKFKLDFSLPLTKGKFGNHLRFGTKVVHKTKDKEIDFYEYTPLDEDGFDKASLAAAVDQNRDGYMPGKQYKAGSFISKEYLGELDLNNASLFEKNQVQEELATNFNAKETVAAGYLRFDQKLGEKWDLMLGLRLENTHVKYSGSQYDADEDKTTRTAYESDSYLNVLPSVLVKYDVNDDFKVRASFTNTIARPKYAALAPNITIKRSDNSISLGNPGLKPTISYNFDLSGEYYFKSIGLVSAGVFYKKINDFIVDQTMRNYNYNGTTYTKFSQPRNSGNADLLGVEVAYQRDFSFIAPALKCIGFYGTYTYSYSRVDNFNFEGRENESGLRLPGSPEHTANASLFFEKSGVSLRLSYNYASAFIDEMGAEKFYDRYYDAVNYMDANASYTFGKKLKTTFYAEATNLLNQPLRYYQGTKERTMQSEHYGVKVNAGVKINF

SEQ ID NO: 8583 - protein, 374 aa, Burkholderia ambifaria IOP40-10
MKTKLAALAALAGCSALAHAQSSVTLYGVVDTGLLYQSTSAASFRPNAPNTGKVFRMKDGGIYSSFWGIKGSEDLGGGYKVNFKLQGSFDSGTGRLQLSDTPGAVAIFNQIASLGVSGPFGTVTAGRQIVPMIYAMADTDVRNAQFFGSVLTAWLGLNTAAGWPATSTNGAIGALYDSNALVYQSPTFAGVSLALEYAPGGVAGQFQGGTRESVVLRYSNYGLNASAVYYNGHDTNPAPGVAPTGVDNNRFVYVGAKYTVRDFSVSASYGNGRNPAHADRVNLDMLSAGVGYRFTPALQVASAVYYLKDRNRSANRSTAVVLTADYSLSKRTMVYAQAGHVNNRGTMDQMLVYGQPVAPGVGTTAAMVGLRHNF

SEQ ID NO: 8584 - protein, 357 aa, Burkholderia graminis C4D1M
MKKTALTMAISSVLLAGGAQAATVYNQNDTKLDIGGRAQGMYYGTDDNGSEGDQSYLRLHVAGETKIDNELTAFGFAEYNLPVSGSDNDELRYAYAGIKHDRFGAFSYGRQDGLFTKAVNNYTDVLPEWGGDGLGKDTEVFGTGRTNGLAQYIYTYQGLTLGAQFTGNNDPQNADRSPTSWTKGSTEGFAVSANYDFDMGLSLGTAYNQAGKTDEQAANAAFGGDRDAKLYGVGAKYAVGDLYLAATYSHGEDHMYVSTFNGYAEKMDGYEAVAQYAFGKFKPSLAYLRTDVKDNARGIDDTATEYVSIGAWYNFTDNFNAYVDYKINLLDNVNGTHTNSLGKNTDDVVAVALQYNF

SEQ ID NO: 8585 - protein, 810 aa, Burkholderia graminis C4D1M
MTGNMDVTNAAAGTITGATAAIRANSGSISVTNFGTISSPTGFAASANANLTITNGVTGSITGGMAANLGFAHVTNHGTISGLNNIAIFAFTDVNVTNGVGGQITSLINNGIYASNGVATVVNSGTLSAGGFGYAIRAETSAVVTNNAGAQISGGDTGVRASLGSVSVINYGSISGLAGNGIYASTGGSDVFNAGTITGGTAAIQFAGSGNVLTLAPGSVISGNVLGGGSDTFQLGGSGAATFDVSTLGAAAQYRGFTTFNKVDDSVWTLTGTGSFSGDVNVGGGALIVNGNIASASNLVVNAGGTLGGNGIVGNTVINGGILSPGNSVGTINVQRSLVFTAASTYLVQVSSAASDLTNVTGAATLAGTVRVALANGTLRFNSPYTILTAGALNGSRFDSVATPTGISGSLTYSGGTVQLVLASGLGEIAGLNINQQAVATALDMAFNSFGNVPSAFGGIFAGNVPANLTQASGELATGSQQTTFDAMNLFVNLLADPFTAGRDGTAPTPVSFGKEGAADSYAGGRRRPGAERDAYAMIAKTPSAIDFGQRWSVWGAGYGGSQTTDGNAVQGSNTSTSRIAGTAVGADYRISPFTQVGFALAGGGTNFVVANGLGSGRSDLFQAGAFVRHTAGSAYVSGALAYGWQDITTNRTVTIAGSDQLRAQFNANAWAGRIEGGYRLITPWAGIGLTPYAAAQFATFELPGYAERAIVGANTFALAYAAKTATSPRSELGFRTDRSLALPGAILTLRSRFGWAHDYNIDRGIAATFQGVAGRILRRRRCIACARRGAHLGNRRGELAERFLARRDL

SEQ ID NO: 8586 - protein, 266 aa, Burkholderia graminis C4D1M
MKLSEGIFKLDDIDGNGGGKRYQSISSMKTPFSDELSFGINQEIGNVILDARYIHRQNKNRIILKEEGQQGKKVRHFARGKDYSNNVYTLQIQNKDSWKFWQTEWRASLGFDWLNTKGIDIGVGYDPNSIVILDGKQMTELEMRSKVNNNREEWMARIGVDMSMPNYNLEWTNRIYVKAPIKGVNQLDTGRGSSQLPIYRSYNYGTHTQWDTSLRWQPKIFGKHSAIVKFDILNVLNQTRKGLSSKEDYGFYAAGREFWLELGYEF

SEQ ID NO: 8587 - protein, 880 aa, Burkholderia graminis C4D1M
MDKTNTCQFKKNPIALLISLTLGFPIPIVSAQEIEEEVETLRLETITVEAQKRRQSMQTVPVSVSAFSGKQLNQAVLKDIFDVASMVPASSAFQTQNVTNTSFSIRGIGTSSQNFGLDPSVGLYVDGIYRARQSSMVNNLVDIEAVEVLRGPQGTLFGKNTPSGAILIRSVAPSHDGANNFIEGTVGNYGLINYSAAASLSAIDNVLALRVTGFGSQRDGFVSEVNSGSDVLNDRDRWGARLQALYTPSDDVTLRIIADYAKIDEICCAAPVQVSNAQATGIEGKFGTDRLLSQAPFNATIFDGSDFFDHKVALSFLPESQVEDSGLSAELNWNINEQFTLVSISAYRNFDSYDNIDSDFTDVHLFGTRNDSQQNSFSQELRIDYTSDLVTGILGAYYFRQDLDLDYSLYTGEQFNDFFLAGFAQGAFNDLLAGIDALSIATNGLVAASASPAPASTSFDHRAEQKHESYAIFGQIDYQLSETLTLTTGLRYTDESKDLSTIFSEVLPADSVFPTFFTSVGDPADPESIVPGSLLYGAGLAGNVLAGIQANTIDITTANGQAALAALAPFQTLGWGFNPLGAITAARSDISDTLDDDQITGTLKLSYTPNRDTLMYVSYGTGYKSGGTNTDRITEGFDPIFAAEKSRSLEIGIKKDFPEQDLRVNAAVHSTNVDDIQANTFTGTGFNLQNAGDYKTSGLEVELTWLPTDTIEVGFVYARVNAEYDNFMRGNCWIAYTWHTGITDPGQEVSESGAPNPYCDRSGDRPTGEPEDYAMLRVKKDFTISDGIDAHIVAEYSYTGDVVLDGSNDPFAVQDSYNLLNLRFFMNFAKYDMDLVFWGRNVLDEEYINHVNFNTPLQEGKFNAYISDPATFGITLRKRF

SEQ ID NO: 8588 - protein, 427 aa, Burkholderia graminis C4D1M
MQTTTLTRVAAALALAAGPAPAFAAGFQLLEQNASGIANAYAGSAAVAEDASTIFFNPAGMTALRERELSVGLAAVRPRFEFSDRGSTATGALGGDGGDAGSWAYLPNAYVSWALRPDLYVGVGLGAPFGLITEYDDNWVGAAHSVSFDIKTYNINPSIAWRINERVSVGGGLSWQRMEVEYERVAAVLPAPLPLSSTRAILDADSDAWGWNVGALITLSPATRLGLSYRSAIKHTLEGDLKVKGAAAGLSPALSSGKAKADVELPDTFILSAVHRLDERWELLGDISWTGWSKIDKVDIVRDSGPLSGVTVQTLDTDFRDTWRVALGAGYRLNAAWKLKAGLAWDQSPVKDRAHRLVSLPDNDRTWFAAGAQWMPGGGARVDLGLAYLYVPKTKIDNDQAALGRGRVTGEYDSSVWILGAQYSVAF

SEQ ID NO: 8589 - protein, 804 aa, Burkholderia graminis C4D1M
MKKRYIFKLSLLALSICSQFSVATELNLDFIHGISAIPSILKTDTTLPAGQYVVDVLVNNERTGRANLVITEEDEKNNHLCLSHEWLDSAGVMMKKDAYDYAFDREKQCYVLTRNSHTKVDFDYGAQTLKFNIPQAYLLSKTDPARWDYGLNGGRLKYYTNFNKNVHDDVNVFGNLDATINLGRWVLSSNMNMSHDRDKTEITSSDLTLSTAISQVQGDLLLGKSQTRTELFSDFNFYGVALRSNSNMRPWESRGYAPGITGIASTPSRITVKQNGYTVYSKMVPAGPYRLDDLRPMGNGELVVTVEDESGNKTEQVYPVTTLPTLLRPGEFQYNVAVGKKNNNNELDKAFHSDTGLFWLGSLDYGFSTTTLNSAFILNDDYQAAGLGGTQMLGGLGALSLSANMSKASYDNGEVKTGESFSAKYAKSFTDRTDLQLLTYRYQSKGYVEFADFNPKDIWSYARYGGQRSRYEARLSHRFDGTYLSGSYWRQDYWMREGTDTGSTLSFSTSVFDSVSVFLNGAYSKYAWSDKADYAVSLSLSVPFDLKGTRHYSSNSVGYTRTGGTTFNTSVSAMPTERLNYSLSANAGSTGDRGASASASYAFDAIQTNLGVSRSYNKHGNSHTSFSGSVSGSVLGTSESGPLFTKESSDTVGIVSIPGVEGVSVNGSMPTNRDGNTVVWLSEYSENNININMDNVPDDMEFETTSFNVVPTEKAMVYRKFGFENVLRYILRVKNAQGNYLTGGDAKTEQGLNAGFISNNGVLLMNMLAEPKAVSVNIGNGKQCRFSTAGLKANTNKVQEVRCE

SEQ ID NO: 8590 - protein, 3210 aa, Burkholderia graminis C4D1M
MRLHRQVAIAITTAWVFSAFFSGGAWAAQQTINYSNGSGSNFSEVETGVTGGMPSVTLTNAGTVSMVLDAGTSSDGTPFTGLNDLGFVAGVLYSNTMINEFNKRGFRFFEKSSTNFSFDEITYMQGSARDSDKTYQLVLTGFSNDIQTVTETVTLPKGGEANSGLQDLFTLTRGTDFNDSAWQDVDTVTMAFTRSPGADSRYLIRSIKIDDAAVSDSTAPTFVSASSTPTDDATNVSVSNNIEIAFDENIELKSGNITIRNVTDSRDFEVFNVATESDGTTTSPGAGRISVTNNKVYLNPTSDLAGNRTYAIHIESSAVADSANNSFAGISDDATFNFTTVDTTPNAPSTPDLDASSDTGPLNTDNITSDTTPTFSGTSESGSIVTLYSDQVGGGATVIGTGTATGGNWQITTNELASGITHAISAKASDSDDNVSSASNALSVTIDTIAPSVVSITTPIEADSIVNAAEDNDVLIAGSGAEAGNSVTVTITDNNSSVSRTVTADNSGNWTLSGSELDVSGLNNGTLTVSATQADIAGNISTAASQSVTLDNAAPSAVTITTPIETDGIVNAAEDNDVLIAGSGAEVGNSVTVTITDNNSSVSRTVTADNSGNWTLSGSELDVSAFNNGTLTVSATQADIAGNTSTAATQSITLDNADPSAVIINTPIETDGVVNAAEDNDVLIAGFSAEAGNSVTVTITDNNSSVSRTVTADNSGSWTLSGSELDVSGLNNGTLIVAVTQSDTAGNTSRVTTQSITLDNAAPSAVTITTPIETDGIVNAVEDNDVLIAGSGAEAGNSVTVTITDNNSSVSRTVTTDNSGNWTLSGSELDISGLSNGTLTVSATQADIAGNISTVATQSVTLDNAAPSAVTISTPIAIDGIVNAAEDNDVLIAGSGAEAGNSVTVTITDNNNSVSRTVTADNTGAWTTIGSEFDVSAFNNGTLTVAASQSDAAGNTSSIDSTTITLDNVRPTVSLSSSDLDLISGETASITFTLSEFSSDFTESDVTVTGGSLSNFAGSGDNYTATFTPDRDSTSTATINVAADFFTDAAGNSNTAAPQLSITVDSLVPSVTISSDKLALKADETATITFTLSEASSDFTEADITVSGGTLSGFAGSGSSYTATFTPTEESATSGTIEVATGTFTDASGNTNSAATPLSISVDTVLPTVSITSSSAALKAGETATLTFTLSEAATDFSEADVTVAGGTLSNFAGSSASYTATFTPAEESTEDATIDVAAEKFSDAAGNLNTAATQLLISVDTGIPTGHSISIDQESINKTNEQAMSFTFAAAEVNAMFTYSVTDGTTTIDGASQTISSETMQVTGIDVTILQEGTLTVSVVVTDAAGNASDAVTDTVTKRYDVAPTVVDDSFSTEEDTAKQFNLLANDSDVNDDMVASSTTIKTQPIKGQVSISNGVVTYTPNNNETGTDSFTYTVKDALLQESQEATVTVTIMAINDAPVAKALTINTDEDTASAAVSARSQAEDVEDGIPTGDLSLVSLPQKGQVAIDQTVGTFVYTPNPNENGSDSFTYTIADSEGGVSLAATVSVNIGSVNDSPVAEEDSFTFDEDITSTLDILSNDSDIEDGSFTPSSITLQDLGQGEGVYSFATVSVNVDGTLKIVPTANVNGQHSFTYMLTDSGQAVSVPATVTLNITPVNDAPVAVDNSAQLLEGGSFEVNVLGNDSDADVGDSFELTSVTVVDTPAHGSVNVTASGAIVYNPNENYFGEDSFTYTVADLAGAVSNAATVTMTVTPVNDAPMAQAQSQTLDEDNSLVITLVGSDIDNDDDTLQYLITEQVSHGVLEQLTNNSWRYTPEADFNGSDFFLFKVNDGDLDSTEVRVDLTVNAVNDTPTATDISATGEEEIPLTITLNGNDAEGSSLSYQIVKSPVNGNVTVTGNHAVYTGNSNFFGQDSFTYSVSDGELTSGVALVTITVNNVNDAPVITGTPSAQVDEDSVYQFVPAALDNDPADTLTYLIANKPPWATFDKTTGALSGTPSNRYVGTYPGIVISVSDGSISSSLSAFSITVNNVNDAPVISGSPATQVNEDSTYLFTPQVSDVDSQAFTFSIVNKPSWASFDASTGTLSGTPDNGDVGKYQGIVISVSDGLTTTMLNRFSIVVNNVNDAPVISGTPALTVNEGSTYRFALQASDVDSSSLSFSIRNKPSWATFDRATGLLSGTPENEHVGSTNNIVISVSDGELSTSLAAFSITVINVNDEPVAVNDTYVFTESNDGSYLLDVLSNDSDVDLDTLQLEWVKPTSGTATIVGSQIQLVTTSIGTVAVQYSVKDGNGGKATAKAIVTIKSAKLDAPTIAAPSDIEVNATSLFTKVALGSAVARDSTGKLLPVSLVDSTTFFRPGTNTVYWRTQDSDGNVAEASQTVTVYPLISISKDAQTTEGTNHSVSIHLNGPSPSYPVIIPYTVSGSTDSDDHTLTSGEVVIPSGTEGKLSFELLNDGQNEGVETLVIDLDSTLNLGSKRRYTLTIFEENVAPKVTVSVSQTGEQRSQIENGVEPVTITSSVSDANMSDIHSFRWSSDSDVLNQAIAGQMYSETLTFSPQLLSSAIYNLQLTVTDNGTPPLSVTRNVYLEVVQTLAELGSEDSDGDLIPDDQEGHNDSDGDGIPDYLDAISDCNVIQQVVSEKDRFLIEGQPGVCLRKGITILTNATGGALLLDEELPKDINMKSIGGIFDFVVTNLPLPGQSYQLVLPQRLPVPANAVYRKYNAEQGWIDFIEDAQNTVSSSAGEAGYCPPPGHSSWSQGLTEGDWCVQLTIEDGGPNDDDGLANGSVVDPGVVAARVSNNTLPQAIDDNAFVSLNGTVTIDVLSNDADADGDGLKVSRASVDIGSVSVVDNKLSYVTQPQYYGEALITYSVTDGNGGTGSAKVTVNVVNSQNPNAVDDNITTDDRTPVTVYVLANDTDPDNDTLKLVSVQAQYGQAVMNADQSVTYTPTSGFEGNDVLTYIIQDSQGLQDAGKVIVTVKLVRDVKVENTSAGSLGGMVLMLLILLGAMQRYGRNSALALIAVFSFSSQAGWYVDVQMGSSHADERDAVKGDNVISTDNTGFYRSVGLGYTFSDQWSGTIRYIDMGEGSATLRSATTSPEDYHANVASIAPLLVKGMGFDIGYKFWQYNSWSAKLSLGGLFWDTDIESTYQGSKITTEVDGFDGYIGAEVGYNLSDNWEIGVQGARYFLHENDVDIIALQLRYFFEPLAAY

SEQ ID NO: 8591 - protein, 357 aa, Burkholderia graminis C4D1M
MKHIIAAGLTAICATTGAWAQSSVTLYGSLDAGVAYVSNVGGHSKWMEEQGNMQPDRWGLKGVEDLGGGLKTVFQLENGFYTNTGAFAKSGVLFNRQAFVGLSSDTIGTLTLGHQTPFSFDVLGPLSTAYLAASWYAFHPGNIDELADTGVVPFDNSVKFRSASFNGFQVGAMMGLGNTTNFSTGKTLSFALSYANGPFKAGATYANEHDRTPSIVTTGINNFQGVAAANYTADKVENMGAGASYQFGKLLVHGLYTRVKLESAGHSDTYQSYDVGANYQFTPFNSVAGGAATTTLAGHRWTQFEIGDIYALSKSTQLYVNALYERAGSNTDAAFFTAGVSSGRNQTVILTGIHHSF

SEQ ID NO: 8592 - protein, 868 aa, Burkholderia graminis C4D1M
MRALRGSLIASVALLPGVAQAQQAVTLGEISVVSTSPVGAGGGNSSGAQNLDTLAQAAPTLPAPAGGVRLRGSEQPLNKIPSTVETVTARQIEVDQGSDNVIATLARRTPGVNLNDSQGNANRVDLSYRGFTASSVQGVPQGLAVYQNGVRINEAFGDVVNFDLIPPQAIQRIDVVTGNPVFGLNAIGGAVNIQMKNGFTWQGTEISAWGGSDARTAGYLEYGKISGPWSFYFTGDGLNDRGWRYQNPSTIGRLYADLGYRSQDSEFHLIGLAARSFYGAAAATPVDFTHLDPRAIFTYPQTQTTQVGTLQLTGRVDLSPTWDLAGNAYYRRFSEFYVDGNQGNFENCSSRSSFRGSLCYQDDAFNVNAPPTSQVAARRAYANQFAILGLNNRTIPFLRNIPYGTIDTTLTEAESYGGSLQAANRDRIFGLNNAFVVGGSVDASTFAFKSSSQLGVINPNLSITVDPNNPYYGTIPGLGTPDIRTLGAIGLAPSNVSGSTLYLGLYATDTLDVTDRLSLTGGFRLNYARIQTRDQTGFAPDVTGAHEYTKVNPLAGLTYQFDPALNLYGGYSESNRAPTPLELSCSSPTQPCLLPNSLVADPPLKQVTGRTYEAGFRGVIPAFLSGGALTYKAGVYRTDLSNDLYQVAVAGNAARAYYINVPATRRQGIEVGAEYAVTPDLLVYANYALVDATFQFNATLSSPNNPLASTGAAGGAAGGDVIPNGGIRVRPGDKIPLIPDRQIKAGFEYSITPNWRFGLNVSAFSSSYYRGDESNLNRKLPAYYVMNLTTKYQVSKNLEIFGLITNLTNNRYATFGTFAETGAVAGNLSINDPRTTTLAQPLSIYAGLTYRFGADPVPMAPEPIIRKY

SEQ ID NO: 8593 - protein, 377 aa, Burkholderia graminis C4D1M
MKKSLIVVAVAASFASVAHAQSSVTLYGLLDAGLTYTSNVNHNSKWAAGSGGINQSMFGLRGSEDLGSGLKAVFTLESGFNINNGKFANNNGMFNRQAFVGLSSAQFGTVTLGRQYDAAQDYLAPLTATGSWGGTYFAHPFNNDNLNTNGGYAVNNSIKYASANYAGFSFGGTYGFSNQAGAFANNREYSVGAAYQWQGLRLGAAYAQQNNPGAGNNGASDSSYVNALAGNVGNFRQREFGVAGSYAFGPATVGLAWTQSRSDNFTGGQQSLRANNYEVNGKYNVTPALGLGVAYTFTDGKGYGVGANGGSESVRYHQIGLQADYSLSRRTDVYAQAVYQHAMGDGGVASIYSGDITQLPSSSKNQTAATVGLRHRF

SEQ ID NO: 8594 - protein, 498 aa, Burkholderia graminis C4D1M
MKTMRGLLLATGAALLSTAAAQAADLPLKAKAVEYVKVCSLYGTGFYYIPGTDTCIKLGGYLRAETALWTNSNYGGAYSGQAGADNRLSNRYQMRSRENLNIDTRTATEYGVVRTYFETVMNWTSGSYAGAGAGATSYTGDAISGGSIGVYYAFIQFAGFTMGKAVSTFDAPWTNYPGNNFDGLVGGSGSNNGVNQFTYTADFGQGISAAVSLEDQTQFFTTNIWNTSGITAAGVLGGSYGASAFGGTVAPDIIGMVRIDQAWGLFQASFAAHDNHAAYYGAAETSGHPSDKWGWAAQLSLSVKNIPTGAGDVLNLQAVYTDGASRYNFQSLASTSYSMYGSTGVTGAYQSIGFAGVGDAVFGTGTGLSTVQTWGMRGAFTHNWNPNWNSALYGAYAQVRYGQTGASLICAGIAATGMLTAGSTCNPDFNLGQIGLITRWTPVKNLTFSADVTYSHLDQKYSGTAIAPAVASTAKPAAIYQLKDQDTVSMLLRAQRNW

SEQ ID NO: 8595 - protein, 681 aa, Burkholderia graminis C4D1M
MMTKTMLLASAAAILLASAAQAADLTPEQVAAQAEAAQRGVLIFQPDFFAAQRPNTALEMVQRVPGFSVQDGSGARGFEGAVGNILINGARPASKNDTGSNVLSRTQANRVERIELIRGGAPGVDMQGYSVVVNVILKKGANRQSIVSWNTSQFDGGRDLYGGSYQFTATDGDKSWGVTLSDGIGSSDSNGPGTNIRRDSTGKIIRDEKYLNDSWGGGRSIRGNYSAPLAGGKIEATARFGVNDWNQWQTLTSAIAERRSNYVDDEQSGELGLTYTRPLAPNWALETRAIHSFENFESASTSDETLNGVKAAQQRFTAEGDSGESIFRAQLRHDWSKAITVETGGEVAYNMLDVKQAYSVGGAAVPLPSASVKVEELRGEAFSKATWRVNPRLTLEGGLRLETSTIKQSGDAQNEKSFFYAKPRFLATWTPAANNQLRFRFERQLGQLDFDDFAASSDLEDGNVYGGNVELKPEQRWITEIGYERRFWGEGIFAITYRHDEIIGVIDRLPLPGNLSAVGNIGDATLDRLSLNIVVPTDKLGITGGRFTFKNDWNETHVKDPTTGKDRPISGVRPTQANIGFQQDLLKYKTQWGINWLPLLGQGTYDVDQTSVWRGAQYYEAFAEYKPTPTLAIRAQLNLWDDFSIRRTVFANRGPNRAIAFVEDRAINPRTFWQLRIRQTF

SEQ ID NO: 8596 - protein, 275 aa, Burkholderia graminis C4D1M
MFGSSFFKGENPMRRQIHMASVGAIAIAIAGSALAAEPPVYTPPPPPPPIFTWSGLYLGVQVGYAWGSDPVDEVDVLTPRFANNAFFNLQPKGVLGGAHVGYNLQFTNWNWLSSSGVVIGLEGSVDGSSLSGTRTSASGLTMRLRTETQGSLRARIGLAWDRLLIYGTGGAAFAGFDDNYVTVFGTPFFVDEQDSKTRTGWTVGGGVDYAITPNWSIGVEYRYSDFGRTTDYPAVFVGTVPTDGNVFFTHHLTQNQVQARFTYLFSTPAPVVAKY

SEQ ID NO: 8597 - protein, 629 aa, Burkholderia graminis C4D1M
MLSPIARAALLAFASLPIVVHAQAASSSASSSAQDSSAAEPSAAVLSPVVVTADRAPQALVDTIPQTSLFDQQDIADTTATDLPGLLQLAPGAQISRTGGPGSTASLSLRGASSTQSLLLIDGVRVDSVSLGAPQLAQIPLDQIDHVEVVNGNVSALYGSGAIGGVVQVFTKDGGDHPPRFNFSLGYGSYHTQTQQAGVNGALDKDGKTTFSISLARSKDDGFSSLNTKEAPNANPNANGYLNESISASLRHKFNDRWDAGVSYFQSNGNNSYDNAYGVPTDLNNLYSKVRQVSAFANGKLADWWTTHFIVAEGDDRSVSNTNGVYNGRFDTDNRQYTWQNDFALAAQQKLQVGYEHLDQSLDSDTFAAPDRHVDSGFAGYTGRFGRNQIQANVRRDQYSDFGGANSYYLGYGFDITGHWKVSASYSDSFRAPSFDDLYYPFSGNPSIQPERSHSIEAALQYASNALGVMRLTAFQTRYSNLINYEQVTPGIYLAENVGHAKVQGLEGSWSGHVGKTDVRASVTLQNPVDLDNDADLVRRARRFGALTVNRSIAGWRVGGEWIVSGPSNDSSGKLGGYGVVNLSARYNITKAWYVAAQIQNLLDKDYETAYSYNSPRRGAYLTVGWQQQ

SEQ ID NO: 8598 - protein, 315 aa, Burkholderia graminis C4D1M
MKKALIASTALLLTAGVAAADVKISGYGRTGVIYYENDSDVNESRVQSRLRMNIDASSSTDSGVDFGARFRLQWDQGEEGEAQTNAGKLWVSAQGFTVEVGNVDTAFASNGLIYETGLGSYDRSVGFSAVTGAFFAYDSNGYGIDEVDRVGIRALYTLGDLTLQASYVDPDQSGTVIGVEEEFGFSVDYTWNERLELSAAAAFNGAGIDGNDIYFLGARYAVMDNARIGLNFVDAGDEEDGYDGKTIALYGDYTLADGRTNLEAYIANNDRDSNETDNAFGIGVNYDLGGARLGASLQRDYAENVTADFGVRFEF

SEQ ID NO: 8599 - protein, 217 aa, Burkholderia graminis C4D1M
MLDAQKSYFPSSALEIDIMNYKDIINACILSGVFLLHSPSALADTPSVGVSKGQESLQPAAEGNLWQRLIRNVSLAWNSPHQELYIPVNTWHNRWTYDDEKIASYNERPWGVGYGKYRYDEDNNWHSVYAMAFMDSHNRVEPILGYGYQKMWIPGEREGWRFGAGFTASITARYEYHYIPLPLPLPLISIEYNRLSLQTTYIPGTYNNGNVLFTWIR

SEQ ID NO: 8600 - protein, 1015 aa, Burkholderia graminis C4D1M
MNKKLLQRRDTGFRLKLIGNIKDRMLSFLLMLFLFTCAGSAKAQEKITGTVKDAGGPMVGVGVQLKGTGVSTLTDGDGRFSITLPAGQKGVLVFSFIGYTTKEVPVSGTQPLQVTLVESSSDLSEVVVVGYGTQRKQDLTGAISVVKATDVKKRQATTVAESLQGLATGIRVRGGGQAGSEAQIQIRGLKNFSGTNPLYVIDGLVTTANRDFNPADIESIQILKDASAAAIYGSRAANGVIIITTKRGAEGPTKIDVSAKTTLQTIPRYDLAKTEEFSRLNFMAYDNAGATRQNLDLSVNTDWQDEAFRVGQVQDYSMSFSGGSKDATYFISAGYFGNKGAVISTDFDRINFRVNTKSTKGIFTIGENLAISNAKTDEMSGNPIIDVVRMLPTIPVYNSANPGGYGYGDEGRARTFGSNPVAIADLDDRTNENLRIRGNLFSELQFLPSLKYRISLGYETSRDHFTYLRKEGNWTLNQAYDPAIFNENRGESSTALIENTLSFTETFGKHNINVLAGQSYQRDNYAQIWGRKRNILANPAGGYYEVLDQGNEPQTGGFKNRTDLISYFGRFEYNYADKYLVNGVIRTDGVSRFGKDHKFGVFPSISGAWRISQEEFFKTSWINDLKLRANYGTLGSSNIGPYDYIAFINTFPTIVMGPGQAVQPGSTQVQLANPDLRWEEVTQQNYGFDATVLDNKLTISAEYFISKTKDVLLRYPLLTSTGNDGGNPYVNGATLGNRGFEFTATYQENSNPFKYSVTGNLTTLRNKVIDLGYGKNRTFVGNTVTEVGRPIGMWYVLQTDGLFQNAAEVANYKNAAGKVIQPTAQPGDIRFKDNNGDGAITNADKVIAGNPWADYELGLNFNASYKDFTFSMDWFASFGSLVFNGPRSVTDMFSDNTNYRAGIQPWTPENPNTDVPRAFYGSTINSRGDTDRWLENGSFARMKYIGISYNLPDDLMKKIGFRNAQVTLSGQNLITITKYSGLDPEFSNNSIFEKGYDFGAFPNLRMVSVGLQFGF

SEQ ID NO: 8601 - protein, 138 aa, Burkholderia graminis C4D1M
MAPGSNARQRYPPMNKQSGMTLLEVLLAMSIFTAVALTLMSSMQGQRNAIERMRNETLALWIADNQLQSQDSFGEENTSSSGKELINGEEWNWRSDIHSSKDGTLLERTITVTLPSGQTTSLTRYQSIDNKSGQAQDD

SEQ ID NO: 8602 - protein, 404 aa, Burkholderia graminis C4D1M
MKRIALSTLSLALLGAAGAAHAQSSVTLYGLIDDSIQFVHNTVDASGNNKNLWGLAAGNLQGSRWGMKGTEDLGGGLKAIFQLESGFNPNNGKMGSYGTGTKLFGRQAYVGLTHDAYGTVTLGRQYDPLVDLVQPLTADNYFGSTFTTPGDVDNNDNSSRTNNAIKYVSPVWSGFQFEGMYALGGVAGSTGAGQSWAGAATWAGGPFSVAAGYFRMENGNTLASRGLTPATAGVGPGTWNASGTSDGTFDGSTINSGYQSAKSIDITSAAAQYVTGPFTFNIRYSFAQYKPDGFSAFHEQEKYHVAGGYAGYQLTPAMLIGLGYTYTHGAGDTSATYHQVSLGGDYNLSKRTDLYLIGAYQHANGTQRIDGTRTATATASVGSYGFQSASSSQEIVSLGIRHKF

SEQ ID NO: 8603 - protein, 468 aa, Burkholderia graminis C4D1M
MKHNPMKIRYLALAAILLGAPVYISPTRATDISSEDVNKLLQRIDELEQKVKVLERNREVDQEIATEKSKAAPTVSLGSNGLLVRSADTNFVMNIHGYAQVDGRFYLNDRETANDTFLLRRVRPIIEGTVYDKFDYRLMLDVATGNVTGSSAANNALIDDAYVNARFFNQFQVQVGKYKSPVGLERLKSTADLVFVETGFATQLTPNYDTGVMIHNALFNTPVNYAIGIFNGAGDAGSDDLDVSDEGKDVVGRLFLQPFLNRDVDSLRGLGFGVAGSIGHHNGPLATYKTAGQQTFFSYSTTTTANGSQYRLDPQLFYYWGPFGILSEYVLSSQEVRSTAAGTPPNARFNNTAWQVEASYLLTGEQNTFKTINPLHPFGPVNGGWGAFELALRVQQLSLDKDAFPKYVTSTSAKEATAWGVGANWYLNRNVKLNLDYEATSFRGGSKVKNAVTAHEEHVILSRVQFSF

SEQ ID NO: 8604 - protein, 1109 aa, Burkholderia graminis C4D1M
MQRLPAALTPFISEICDRKPANLFNHLYINFNLKTMSHMKTQFISLLIALLAGLLPLQAQQVSISGIVTDKKLNEPIIGASVVVKGTSNGCITDLDGNFQLNNVASGSTLVVSYIGYQTQEIPVQKGKTSYQVTLSEDTQTLDEVVVVGFGTQKKVNLTGAVASVDNKKLESRPVTSVGQALQGVVPGLNVSIPDAGGKLDANPSFNIRGTGNLGTGSSASPLVLIDGVAGDLNQLNPQDIDNISVLMDAASAAIYGSRAPFGVILVTTKKGKQGKTSISYSNNLRWSRPTNIPDMLDAYTFAQYFNRAIDNTGSGEAHFFSDITMDRIQQYMRGEITTTADPSLSQNGNCFAFNQNSNDNQNWPRNFIDKTAFGQEHNVSLSGGNEKIQYYVSGAFLSQDGQMNYANDNKKRYNASARISAEITKWMRLEFNSRFIREDIGMPTFLKLYGDRFFAETTKLHPNMPLYDNNGHYTRNPKLMQLTSGGRSNTQDDTYFTQGSLILTPMKGLTIHGDLALRTGSFEHLYNVARVYLYDKDNNPIPEQWLGGDADLAAGKTWAYSEQQRETMITTSLYADYSLNFLEKHNLKVMLGMNSESYRYNNVWAKRSDVMNDNNPDVNTSTGTQSNGAYRGEWSSLGYFGRLNYDFDGRYLFEFNIRRDGSSRFQADSRWATFPSVSIGWNVARESFWEPLSKWVNTLKPRFSYGSLGNQNTDSYYPTYAIQNVTVGSPDAGGRWLLDAANKSNIAGAPGLVSSLLTWERVYSYNYGVDFGAFNNRLSGYFNYFIRDTKDMVGPAQEISPIVGAEAPKRNNTSLRTKGWEFQLNWQDRIGELNYNIAFNLSDSRTKITEYPNASKSLSTYYTGQYLGEIWGYESVGMAKTDEEMAAHLEKVDQNTIPGVTLAASGWKAGDMMYADLDGDGKITNGENTVDNPGDRKVIGNDTPRFRFGLNIGAEWKGFDLSIFFQGVAKRDYLLSGMVFWGVDGDAWSSTGYKEHWDFFRPEGDPLGANVNAYYPRPLWKSNQNRQSQSQFVQNAAYIRLKNLQIGYTLPKAWVHKIGLERVRVFFSGDNLWTGTSINKNFDPEALYQNGMTYPLSRTLSCGVNVTL

SEQ ID NO: 8605 - protein, 534 aa, Burkholderia graminis C4D1M
MMWAGASAQRRADYGGARAACRNRIAHARTRPRRCRLSAGPPAIGQHSPRGGRRRARHYLEFGKKLFSFRRFRLEPVRPTMSAAAARPAATSHTRSAYRGFACGRRRPRAAGATRRPRAAARKVPRTTGSPPGDKTIMNKQLIAAPLLLSLAGIASAQGSVTLYGIVDAGVTYRSNERAGAPRAYTGHSNVGLTTGNLSGSRWGIKGSEDLGGGLRALFVLENGFDIANGTSGQGGRQFGRQAFVGLGSDRYGSITLGRQYTSLDDFVSPVGPSSFVGGFGAHPGDIDDLDQTARVDNSIKYTSANYSGFTFGALYGFGGQPGSITQRNTWSVGAAYAAGPLRVGVGYERSDNSKTGASDTTIGKWQSTDDGLFNSSINEGYASAQSQQIVATGATYDFGPAVVGMNYSHVQYRGGDRSLFTGHATFNVAGVFARWNVRPQTQLFAGYSYTRGGEVDGIDERAQYHNVTLGAIYDLSKRTSVYLLGAYQHASGTTLDALGRPVAATASVSDKANGHSAASQSQTIVSVGLRQRF

SEQ ID NO: 8606 - protein, 1203 aa, Burkholderia graminis C4D1M
MKRVAAVLALCFLSLLAATPAFAQAVFGNIFGTVTDPQGAAVPGATVTVSNVRKGTSDTATTNESGNYQVTHLIPDEYSVKVEAKGFKTFEQKSVSVSADQSARLDAQVQLGSESQTVEVTSEAPQLQTDRADVAITFNQTYVEDLPVLNRNFTQFELMSPGTQKLVGWSHASTENPQGSQQIFVNGQHFSGTNFELDGTDNQDPILGIIVVNPNLDAVTETKIALQNYDAEMGKAVAGFVTAQTKSGSNEIHGSAFYFRRSDANQARDPFTQFQPDAITGRMIPYARWQQFGGSVGGPIIKNKLFFFGDYQGTRQVNGQTQVLTVPTAKTVSSCAAALGNPALNCDLSDYLGNVGGGGQVYMPNSSNSSTFTGGTKFDGNLIPGNLLSPQAVALLKLFPAPNSSGIDGKGVLNNFVGGGSGPFNQNSFDTRIDYNMTDRTQLFGRFSLDYFNLSGAPAFTQLGSAGFGLNGLAGSSITHNYSLSSTVTHTFSNSLLADFRFGWFRYNPQTHKYFEGKTPASDVGIPGANLGDLATSGWPAFNMDTGADGNGSGTGTSVSDFGESLNIGRCNCPLTEKEDQFQGVNNWTKIHGNHTFKFGADIRSATNLRVPSDANRTGQFNFNHLATSNGGVGGLALGTFLLGDVTTYDRFASTSLDAAEHQWRFFFYGQDTWRITPKLTLNIGLRWEDYTPEAISGKDLGGLGVITAGGNGTLTPNGAVVRVAGEGPYDTSLNVNHKLDAFAPRFGLAYQFDDKTVIRMGYGRSFDMGVFGSNFGHAISQNLPVLVHQNISASSQGLGSDNYVTAFTLGTGAPPATYPVPVNGVLPIRGPDNSVDPRIRPGSQTLPTIDVWNLTIQRQLTATTTLEIAYVGNKGSHTFAGNGPAYNVNQPSIVGLAAGVPQANRRPFYNAWVYPDFTDPNTGQPLVCCSSDLGNYFGNNANSLYNALQVKAEKRMSNGLQFITHYTWSRSLRYDNNYFVDDPHVAYGPDNQNRSHVFVANVVYDLPFGRGKKFAGGVGKAADLAIGGWEFSSTTNWSSGLPFTPGTAFCNNDVGVCRPDKAGAFALGAGKFDPAAHSVTYYTPENLFTGTGAWSAPVLGTIGNSGWDSLYGPRLFTTDATLMKNFAITERVKAQFRMDVFNLFNHPVLGFNSNQGNTCVLFYNNGNPADTTNSNCGSGGKITDIEADTTMRALQFAVRINF

SEQ ID NO: 8607 - protein, 985 aa, Burkholderia graminis C4D1M
MWTGSPDGEAVRALHGEVLMSKSYRQQSPWKAFSCLIPVVIVGVQLGQPAAAETKSLKKTHTRKAVKTHQAPAAAQAKPAAVPPAAKAAHVPPSDLVSHDQEQVHVTGFGTSSGRQLKAQNEMMSLSAKDLARLPAQNVTEALARLPGVTVMPTSMQGNFGGIDTAARGTGATVSLRGMNGQYNINQINGIDVAEAAPFSRTVSLDLLPPTGFFRIDANKTLTPGMDGDAIGGIVNFEMPNAFDYGHGTHGSLQLGGQYNEKAADYGASAIGGNGAAEISSVFGKSDQFGFYMSGYYNQRYFAAGEQTYSGGEWGVSRAMDAQGDLYPGQDPVKSLQLFGVDPQASIGVTKRYGGTAGFEWRPDSSTRVYLQGTESYSDTQQDIYQVAIHGNDSGASSAGMISYVEQADGSYAPSITRTNVHYWYETNPTLEQLGTMKLGMDKKLGRFSISPSAFLSWGTISRDHIETSAWQSGVAAFDGAPNFVYKDGMPTVGLTSAQAAVANGTLDFPTHNRGEYVQSDAWQLRTGTSLDMSYRLDRFHIDTISAGFKYQTSWRNYINRDTEGQDNGGSGAYPAGGTLSQTGLVDGSLSSLIPGAYNFYTPTISRSALLSNYLADPYNWKYMDKDAWNGNTIGGTETVYAGYVSAQMHFGKLQVVPGIRFEQSDLHNTYWASGNEGVSTADAHYGWSATNSHYFKALPSIHLTYRPRQDTVYRASVWTSYTRPSFFQLSGGSQITRNDDGTLSITTGNPNLKATTAVNYDLSWQWMPSSTTSFSLAGFYKQLSNYIYDNGGSYNNETTTAGIANSVSHPENGGSATLFGLEFAFEHQFKGLPAPFDGLGVRGTATWEMSRAHLNNAYLSSTENMQDAPRWMTNAGAFYNKGSFQFDLNWRFVDAYLYEYGLWGTPNNFKTNLNSSSLDAWVQPSLNLDAHLGYAVTKRLHVDFSAQNLGVNRFYRLTIGRHSNAVPQNILTSRTFFLNAGYRF

SEQ ID NO: 8608 - protein, 1278 aa, Burkholderia graminis C4D1M
MKTTRPQRTVISLAIATALSAMAPTVALGQTVISVNTTATQYWSDNDFTVNSGITLNSEPGDAAIYASSGSTQGNFLNKGTINGTFGGLFSSAAINQLQNNGLIRGETYYGVASLQGAEINAFINNGSISGAPAGMLNEGVISSFVNQQTGAIYGLVNASTGTIADLANKGFISQLDNSGMIVGLSNTGSISTLVNASSATIIDLVNEGTITKVENSGILSGSAGFGSGLFNTGTITLVENKTGGFIQALGNSGSIATLNNAGTLDGMFGLLNMRDTNPDGGNIGTLNNSGSITGGYYGGITNSAGTIGVLRNSGTITSTASDGIFNGANSEIVALTNTETGVISGFKTGIFNAGLITSITNNGDIHGPTAISNGGQITSMGPSPTTMHYAGTIGTLSNTGTISGIGSAGDGVAISNATNSQIGLLSNSGSISGDEVAIINRGTIGKLDNGKLGIVEGATGIWNIGTITELTNSGKISVSGPPVAGGSYSISNQGLITSLINNQGGVISDANYAIENAGSGTITTLLNNGLIKGRYTGFKNDGGSIGSIINNGSIEGDEFGIENRENIGVLNNNGRIFGGIAGIFIYNIGVFTELNNSGTITGDTFAGVVNYSKITSLNNKPGGLIQNGVYNDSFGTIDTLNNQGTIAGSSSSTTAYALSNDGHIGTLNNSGLLTSPVDAIYLGGTGTIDSFINSGKVAGNIRNYSVGFDLVIQGGSGTTFGVLTGSSGGTGAADIGLIDNPYGQLVFGAGNQLLNDHINVGTSGNSVVNLDGVLQVNNYINITGDYAQRAAATLNIGVARNAIANGDGADLGYGRLIVSGSAVIDAGSSVMLKKTGAYRFANGQRYVVVQANGSGTNYNETALNYGATGYNGTITGSTIASGGNLSLLLTLDGAADNQATNSNGQNTLNALFSYTGTDAGLMNLFNAAAASGSSDEGNRAGAQLSPAAGKAGVAGASTAVSQQVTGIAFDRLNNTSTVAGLGSNGLSAGDGMRDQAAWGQAFGGKASADARDGVSGYHASYAGLLLGADTAWNDQWRIGGLFNYASTSVSNDDDNAGSYSRINSYGLSAYAGYTGEPWYLNVSVGAMRSDVKAHRVVDLTGFHGVADSNYNGMQYVAAAQLGYPIKVDQLLPGAVLTPLAGLVYSSLRQDGYTETGGNGAALQVGSSSTHSVKSDLGFKLERAYKTTYGLLKPSVQLLWRHEYSDTRLQSIANFAADTTGATSFASQGAKPVKDTGVLSLGATLLRSDKLTLSANYTLEQGGGYSSQTGSLLARWRF

SEQ ID NO: 8609 - protein, 755 aa, Burkholderia graminis C4D1M
MHCYTLARRPICAALFGAFGLSAATAHADSTPQGATSPSTILVAASTRGDAALLDPVTVTANRTATATSRTAASVSVITDEDLEEQQATNIKDALRYEPGVTVRRTAYRPGSAALGGGRDGDSSINIRGLEGNRVLLMEDGIRLPNAFSFGPLEAGRGDYADLDTLKRIEILRGPASALYGSDGLTGAVNFITKDPRDLLSIYNKPYYFSFRPSYDSADRSVGATVSAAGGNDRVQGMIIADGRRGHEVDTRGSNNSASTLRTTSNPQDVYSESLLGKLVLTPTTRDTIKFTAETVQRRVSTDVLSAISPPTTLGLTTYDRLERNRFSVDYDFRDDAFRWFQTAHVQFYYQEAKQDQYAFETRGRAASRSRDNQYKERTFGGSAFAESGFTTGPFAHKLLYGVDGSVSRVTNMRDGTVPGVGEAFPNKAFPDTDYTLFGAFVQDQIGYGRLLVTPGLRFDTYRLSPTENDPLFTGKAVSTSANELSPRVAVLYEITPAVIPYVQYAHGFRAPTPDQVNSSFSNPVYGYTSIGNPNLKPETSDTFEAGLRGKAGTGYGVVRYSAAAFTGRYRNFISRTTIAGSGRPTDPFVFQYVNFADARIHGLEGRAEWVMPNGITLKTAMAFTKGSTQNDGTASQPLNTVNPFSAVFGVRYEPTERWYVQTDLLFQAAKRDKDIDKSDCSNKACFSPPSSFVVDLRGGYRFNKHVSATIGIRNLFDRKYWNWSDVRGIAADSQVLDAYTSSGRTVAVSMKVDF

SEQ ID NO: 8610 - protein, 2356 aa, Burkholderia graminis C4D1M
MKRSLNCSYRLVWSEVQRAFIVVSELTRAKGKRASGAVLLTAAVGSSLASGGAFAFTPDVTSSVQDELVQNGTQQVLVGGTTTNHIIGAQGNQIVAGGLTQKTTLNDGGVQIVRQQGVANGTVINDGLQFVEKDGQAQRTVVLEGGVQQVAGSAVHTVVGNGGEQHVQASGTATTTIINNGGTQSVDGTSISAVVNDGGHQLVERGGYARNTTVNNGGVQYVSAGGSSSDGVIFGGGIQQVSGTASGTSINDGGSQQVQVGGQSRDAQINNRGTQAVDGTAISAIVKDGGTQIVNRGGLAKNTQVNSGGLQHVSLGGASADAHLFGGTQQLAGTASNTQIDAGAQQHIEATGLSVSATVNSGGLQNVDGTANYATIKDGGVQLVQTGGHANSTVVRDGGIQDVALGGSASDSILLGGTQQLAGNAGGTIIGDGGVQHVKTGGSASGSLINAGGLQRVDGTAKDTTINDKGIQLVNSGGLADNTAVHSGGLQYIAQGGAASEGTVFGGGIQQVSGMASGTSVNDGGSQQVQVTGKAIGTQINNRGTQAVDGTAISAVVKEGGTQLVNKGGLAKDTQVNSGGLQHVSLGGASADAHLFGGTQQLAGTASNTQIDAGGEQHIEATGLSVSATVNSGGLQNVDGTANFATVNDGGTQLIQTGGHANSTVVRSGGVQDVKLGGAASGSILLGGTQQLAGTAGDTIIGDGGVQHVQVGANASGTLINAGGLQRVDGTAKTTTINDKGIQLVNRGGKADSTAINSGGLQYVAEGGSASDSVVFGGGIQQVSGNASGTSVNDGGSQQVQVTGQATGTQINNRGTQAVDGTAISAIVKDGGTQIVNSGGLAKNTQVNSGGLQHVSVGGASADAHLFGGVQQLAGTASNTQIDSGAEQHIEATGKSVSATVNSGGLQNVDGTANYATINDGGVQLVQNGGHANSTVVRSGGVQDVKLGGAASDSVLLGGIQSVSGTAGRTVIGQGAIQHVKTGGLAFASLVNAGGLQRVDGTATSAVVNKDGIQLVNSGGLARATTVNSGGLEHINFGGASSDGVIFGGGAQVVAGMASGTSISDGGVQLVTKTGMANDTHVNRGGVQSVDGTVTSAVVKDGGTQIINNGGLARGSIVTSGGLQHINKGGASSTAKIFAGGTQVVAGTASGTSIGDRGTQLVQETGKAVDAQINQGGTQAVDGTAISAVINDGGLQIVNVGGLAAGSIVHSGGVQHVKLGGAASDGTVFGGGTQLVEGTASGTSISDGGVQLIMASGHAKGTLVNSGGVQRVDGQSFDAVINNGGQQIVDPYGWSRSTVINAGGTQILANSAVAISTVMNGGEQHVNNGAQALATRLLGGTQNIGSGGKAFDTRVEKGGVQNVNSGGYTYGGTIATGGRENVFTGGTTDFTVVEGTQIVDGHSIVTILQNNGYQRVNKDALADVTMVFDNGVMDVYGTSIGSELYENGEQRVYAGANVTSTWLNDDAKQTVYNGAVVTETNNRGGEQNLLSGGRAVNTSMDTGAVQNIGAGATAENTVLINGSVQNVRGTADGAELAADAVQNVYRGGVAKNTSLYGRTAQNIYNGGQAFNTNIEYGGVQNVLTGGTATSTTINLGGTQNVNSGGTVISTIIKAGGIQNVNEGGIVIDNTVVGDQVVNNGGTVASSTVSENGSQSVTLGGTAIATTVTKGGVQYIRKGGVADQTIIHQGGMLAVADAAEATNIDLNSGAGIIAGTDTTVNGTNALGQFSIANKLANSVLLEGGGVLTVAADGIANNTVVQDGGKLNVADGGILTGTTALKDGSAIAGNVTNTGKLSVTTDKSDNTIAANINGTGSLYKDGDGKLTVSGILKQTGGTWLQSGTLVFSGLEAVTDVIAQLGTSLQLTNGTSLTGMIDPTDLTVDAGSTWLMTGNSLLDNLTLGGSIDYQAPTGAFVPKTLTVTNLTGNGGTITLNTLFQGGTATTDSLILDGGTATGNTRIAIRNQGGLGARTTGDGIQVVNAINGATTTDDAFSLANNLQAGAYNYSLRQGAGNESWYLTTASGSGDENGPQNYRSAMYLYTSLYAQAMDYDSALLGSLDSRRYAARSPSEDGSNLWARFQAGQLSHDHGGADLRNGNTPESKGGYTFLQIGSDLWRGQASSMEWGVGIYGAAGLSAIDVQRSEKSKAGTVRDDAYSAGLYVNGVHESGWWVDVVAQGTRHNFDTNPRDGDGMKTHGWGYVGSFETGLPFDIGSGLVLEPQVQYQYRGVNLKDGNDDAADVQFGDGHSQQVRAGLRFGNNATLKESGNPPPVSWWVRPSFIQTFDSKGDVNVSAPGVAGSEVSFNPDQDGTAAALDVGIDGQIRDNVTLGVRAGYTKTIDDAGTGGYGGQVTLKVSF

SEQ ID NO: 8611 - protein, 931 aa, Burkholderia graminis C4D1M
MSIFPQQGLQGCRRSARLLWLSVGLAVSLPALASDHRTRHSIDIARQPLSTALMALAQQTGLQISVESQLLLNLNAPAVQGELSAEQALAKLLKGSQLEWIYIGDDALMVQRATRPRTDPVRLGNTKVPGELSLPQGETRVDRATIEAMPAGNGDITSLLRSHPNVQFDDAQLSSKTPGEIGPANISINGAQFYQNAFLVDGINMNNDIDPAEYRVQLLDAVPGRSQGLALDTDLLENITVLDSNVPAAYGGFNGGVIDAQTRAPTQALHGKFSVQTTRSAWTQYHVDESEEQRMENSGSPDEQPKFDKVTVRGTLQGHLTDNFGLLGSFSQKRSTIPLGFYSYNNVEEMGFHEEKQQRRIDNYFLKSVWKASDQLTVETSVTHAPEESHYFRANVANSGYDNKAGGTQVNLRTVWDGDLARVEQNLAWSGQEQSRQSDSADYWTWRKSATKDWGIGNKATSNTLEGGWGDIEQQQRTWQYKLNADWRSVDWLGMTHRPQTGLEFSRQYVRYERLTDSSTYVTPAATTTCTNGAGVTDSVACNIGQTLNGWAGQYMKSRTRYATGEFDFTTTSWGSWLQDEITLGQLTLRPGVRVDSDDYMDKTTWAPRFSLEYDLFGDRTTLLNAGVNRYYGRSVSSWQLQDGRNRLRFNETRDSLDKPWVVKSNAANQVRFNQLDIPYDDELMLGVVQQWAGVEYALKYVNRKGRDQVVQVSGKTLGEPSTDPTLASNYTTYTNDGKSETDTYTLTVTPLQRWTLLGTQTGGQLALNWTDSKASAPTYVAAENLYYQNSVIQYQGSFINYDDRPASNFNRPWTARLTTITEIPQANLQWSNFWRYRAGYKRIGDTGRNVDYMGTSVDVWEEQKFQAALTWDTRLGWRIPTARDQNVFINVDVFNVLDKKSVNANQTVNSNSVSTYEVGRQYWLEVGYAF

SEQ ID NO: 8612 - protein, 381 aa, Burkholderia graminis C4D1M
MKKTLMVAALTGVFATAAHAQSSVTLYGLIDAGITYTNNQHGHSNWQETSGSVNGSRWGLRGSEDLGGGLKAIFTLENGFGINDGTLKQGGREFGRQAFVGLTSDQFGAVTLGRQYDSMVDYVGPLALTGTQYGGTQFAHPFDNDNLNNSFRVNNSVKYQSVNYGGFKFGALYGFSNQADGFANNRAYSAGASYNWGGLNLAAAYLQLNSNGASGAAAAFNSGGAVSSDNTFFAGRQQTWGAGANYAFGPATVGLVYSQTNLSSLAGIGAGASGQTGGIGFANNSAHFQNFEANARYALTPAVSIAGSYTYTRASLAGTRPHWNQFNLQTAYALSKRTDVYLQGEYQQVNDNAVVDADINGLAASGNNKQVAVTAGLRHRF

SEQ ID NO: 8613 - protein, 417 aa, Burkholderia graminis C4D1M
MKKTILVSLTACYLFANGYKIPEQSLNGLALSAANVANANGADSAYYNPANMTFNNPNKNYFELTSLFIHLNKVKFQNNNGEIYYSRKEDFALPIFHFASKDYNSYRFGLSIIYPGGLSKRWDDTIPEAGAKEFTLKTIEINPSIAKKINENLAIAFGIRFVKSEGIANVLGLKPNGNGTYTPLYSEYLNGTSFDKGWNGAISYRLNNSTKFAVTYRSKINLSLSGNASGYYSLALLQQPTTAVKTFNTKGKVTIPLPATLNIAFAKTFNKTTIEFVYDRTYWSSYKKLDFDFEDPIVNAIFGTAKQKNWKDVNTYRIGITHKCTDKLTAMLGYAYDKTPVPDSTIDFSLPDSDKHIFSGGIKYKYDDRLTIGFSALYTKQKNRNAKIYDNISNSYINGTFKEGGAYLFAFGMNYSY

SEQ ID NO: 8614 - protein, 330 aa, Burkholderia graminis C4D1M
MKKLAVVVAFTLGTSMANAASVSDFYIGSKLGYSQVDSDCASEFQCDKDSASVGAYLGYQYNDNVAVEYGVDYLGHHTTSKKRSLHLTDVLTTDVLAISLAPKFSYSLTDNLALFTKIGAAYMIAEEENDVVATASAGAEYALTQNLKLRAEYQRFEKMSDIHIEDMSFNNFSFGISYQFGEQNQAVVESAESHQDIVEPKVEVAATKVELKHEGLTQVIYFGFDSTKVSQESEQKLLEIQKLLVSYPQSQVEIVGFTDDRGASQYNEKLAKRRAQSIAKYLESKGVKADQISLTSKGELDPVASNHSEDGRVKNRRVEVSIPEFQIIAQ

SEQ ID NO: 8615 - protein, 805 aa, Burkholderia graminis C4D1M
MFRNLLLLFMGVLLMANQAIAQADVTGKIKDKDGEPVIAAVVALLTSPGDKMVKAAVAKNDGTFTIKMVKAGSYKLQIRVLGYKDYSSKAFTVSGNATKALDAITLENDIESLGEVVVKAEKPLVQVLADKTVFNVDNTVGTTGSSGFDLLRKAPGVIVDNNDNVMVEGKSGVLFYINGKPSVLRGEDLVNYLKTLQATDIEAIEIITQPSSKYDAEGNAGIINIKLKRDKSLGTNGTVSLGLIAGQYNRYTSSLSFNNRTKKTSLYGAYSNRIGRSFNFINFYRIQNGTTFDSRSRTVRDRNGHNLRLGFDYYLSKKSTLGAIVTGSFNEMFANNDSRTPIIPNGATTPSQVLVAESDAHNKTFNGYANVNYKYEGDKGRSLNIDVDYGQYISDRTNLQPNRFFDGDEAIIVSENITFFDTPVNIGVFSAQLNYTQNFLKGVLGIGGKYALVSTDNNFQFYDRVGGVDILNIAQTNEFFYDEQVTAAYFNYNRKFKKLNIQFGLRMEHTASDGRLESMQANADNQVKRDYVNWFPSGGLTYNLNRTNTLALNYSRRIRRPNYQVLNPFEYRIDGLSFRKGNPFLQPQYTDNVKLSHTYKYTLTTSLSYSFTSDYFAQVTEALPDNRNFLMTRNVANRRVINLGIAYPTRLTKWWSIYFSLNAYRSIFEATNPAFIGISQNAMSLYAQNTFKLPGGLTAEISGWYSSPSLWGGTYQVKSLGALNFAFQKKLLGNKITARLAFNDVLYTSPWRGDTFFPNLSIYGSGGWDSRQVRFSLSYNFGRKEIKRARKRKTSIENEKGRMGN

SEQ ID NO: 8616 - protein, 179 aa, Burkholderia graminis C4D1M
MKWITTLAPLSLALSLGISVANAASDASNTVSFGYAQSTLKIDGEKIGKDNKGFNLKYRHELDSVLGIVASFTHTKQNYGMPGDSDGKRKVEYYSLMVGPSWRFNEFVSAYALIGATQGKSTHTKPRMVSNTVSKTSMGYGAGLQFNPVKHVAIDTAYEYAKIEDVKIGTWIVGVGYRF

SEQ ID NO: 8617 - protein, 1000 aa, Burkholderia graminis C4D1M
MCTDRKIKSFKWCLLVSFLLVNIVMHAQERKVTGKITSSEDLLGLPGANVYIKNSSVGATADMDGNYTVIVGEKNAVLVFNFVGFQTVEIPVGTKSIINVSLKPDTKALDEVIVVGYGTRKKSDITGSISSVTAKELTSFPVLNAEQALQGRAAGVSVMTNNGGEPGAPVKIRVRGGTSINASGDALVVVDGFAGVSMPAPQDIASIEVLKDASATAIYGSRGSNGVIMVTTKKGKVGKPVIEFSNSTSVQSVNNKLHLLNADQFAAYRKSFTTHTQGPANTDWQDVIYRDGMISNTQLSFSGGSENVRYYVSGTYFNQNGVVINSGIDRYTIVSNLEADLSPKLKVGLNTFTSKQNKEGIISQTGAGGTGAAGVIAAAYRFMPDKGIYNEDGTYTTTAPIGDDIDNPYATAMENILETVSIVNRNNFFAQYQITKDLDFKTTLGLTDNNSQTGRFIPSTLIAGKNIKGEASVNNTRFSSFLTENYLTFKREVISKGMLTVLAGYSYQKNKNENSYAASRGFLTNTNSYRNLGAGTVFLKPDSGLSETELISAFGRLNFDYDDKYLFTFTARRDGSSSFSQNYKYGTFPSGAVGWNIGKENFLKDSKTVSNLKLRASYGATGNPSIGAYSTLSRFSEIYYVSGDVITNAVQLTSLDNPNLKWETSYQQDYGIDLGLFDNRISITADYYKTITKDLLFNRPLPGVSGIASQLQNVGELENKGWELGITSRNFTGPDFTWSTNFNISSNKNKVLKLADNKDLLINSAPGHFLATESQILRVGQPVGSFFGFIYDGVIQQGETVLPGNFETAPGGEKFRDVNGDGKLDSQDKTIIGNPNPDFIFGFNNDFTYKNLDLNIFFQGSQGNQILNYTLMELASGNNNATTEVLDAWTPTNTDTNVPANAARTKRITSRFVYDGSYIRLKNVSLGYSLDEKVVSKLGLSKVRFYISAQNLWTITNYPGSDPETNYLNDTNSRSNTNLGLDYGGYPNVRTFTAGFNLKF

SEQ ID NO: 8618 - protein, 947 aa, Burkholderia graminis C4D1M
MHKITQAVKLALLGGSIVMTNSALAQQSDDAANSVEKIQITGSRILREGAIAPSPVTVLSGESLLNTGAMNIGEALNELPALASTYSLSNSGQFIGTAGLSLLDLRGMGTERTLVLVNGKRHVASSAGTSSVDTNTIPTSWIERVEIITGGASAVYGADAVTGVVNFILKDKIEGLQVSATKGYADNHDYSNDKYSFSYGTNFNDDRGNIAFSVEHSSQESLNALDNPWTSTSFRNLANTAQNDDNRDSLDVPDDIYTPNAGIYALSNAGTFAIGDDYYSFNPNGSVRDVYLGDNVDGIACENCDFINLNQFSELQPEFDRTNYNLKLSYDVTDNIRGYVEGKYARTRSTNVGQPAFFFFESEADAITIQNDNPYAGDDLLALMGANNLTKITIDRMLTDVGRRTEDDERETTAFVAGLEGYINDDWGFETYITRGETKLERANKNNLVLANFYNAVDAVEADDGSIVCRDTAAQAAGCVPLNLLGDGAPSEAARNYVNTTSVGNSTITQTVVGGSVNNSGIYELPAGYVGFAAGIEYRKEESEIEEPDNAEGTFFNVLGEDKGDFDVKEAYVEFSAPLLTDLPGIQDLNFETALRIADYSTIGNAKSWKLGLDWQVYEDLRVRATHSSALRAPNISELYGEASQTFFSIDDPCKTSELGQLADASTRTSNCAALGVPADFDSDYDSARIEGEQGGNINLRAEESKSTTVGVVYQPAYLEGFVATVDYWKIELTDAISSVDSQTILDRCVDNTSGVSNDYCSLITRDASGEISQIRSFSLNLSGQDASGVDFELGYDFDALGGSFKTNLIGTYLIERKEYPFQEDTSDFVEYAGTAGESEWQGMLSMSYMVDAWQAGIKTRYLERVSIYDNQELAVNPNRSSLMEYGSYAISDVTVGYAFENGISLTVGVDNVFNRDLPFGTTGTGEKTGAYENIGRFGYITLSYAM

SEQ ID NO: 8619 - protein, 378 aa, Burkholderia graminis C4D1M
MFRINLIRYVALLFIITLNLDCISVAFSSQVIYGTQNAARVTGKSLKRIYFLQLGAFSQKSNAQQLARKVQARTQYPVIISHSGNAFSVRVGPVNTQELHQLSIKLSQNSNLALINHHSSPKQALNIKSKPQIPVKETSRPPSTHSVAKEMVDKKGSWYVAAKIGGQETTPDDQFTVNNDSGFASPFDKDIYTNSSDSSLVLGIGGGYRFTNMILPAISVGIYYSHFFNMDINGQVIQYSLPEFTNYNYQWKVKSDLVLASVKANIFRWKNLMPFVQGGVGASSNRASQYYENALPDVTPRISPNFANHTTTVIAYQLGAGLDWEIKPQWLLSLGYEYSDLGKVRSGYGTDSWGRETLSSKNLTSNAGTLGFTYLFHG

SEQ ID NO: 8620 - protein, 676 aa, Burkholderia graminis C4D1M
MRFTSRPSHAALAMAFAAAPVFAAEPEAVTLTPITISADPLGQNQNSTASPVTVLDGQALVERRQGTLGDTLNGLPGVHSDTFGAGASRPVIRGQTSPRVSVLSDGSSLLDASAISPDHAITIEPLLADRIEVLRGPATLRFGGGSIGGVVNVLDKRIPTEKPEGGLAAEAELRGATGTKERAGIIGITAGTDSFVVRVEGLKRRSSDYAVPHWSSGKLAGSYSESTQGSVGMSWIGPRGYIGLAFTHIESEYGLPGHNHEYEGCHPHGTHLHCGHHDHDHDHDDHAHEEGQVPYVRLRSNRTDLRAEYSDPLPGFSKLRLRGGFTDYQHDEIEGGQVGTTFKNQGFDTRLELEHKPWMGLRGVIGLQTAFSDFRAQGEEAFLPRSKTRSNGLFLLEEYRLNDWRFEAGARQDWQSISPEGGLKKSRLSGTSLSAAAIWDFAPSYSVALSLSRSQRMPSAQELYADGVHLATNTYEIGNAGLTRETSRNIDLTLRKHEGDTTFSLSAFHNRVNNYIYANTLDRFEDFRLIEYTQKDAEFVGIEGELKHQFTPILSAGVFGDYVRGKLTGGQGNLPRIPAARLGARANFKWQAWSGGLEYAYVFRQKDIASYESETPGYALVNAVLSYRFKAAGAQYDVYVRGNNLLDKLAYNHASFLSSVAPLPGRSVMLGVRMSY

SEQ ID NO: 8621 - protein, 1100 aa, Burkholderia graminis C4D1M
MKVDSVKNNRRALFALLLCSGFIASHPLTVFASSNEVQATQQQNLTVSGVVKDNAGEPVIGASIAVKGGTTGTISDIDGKFSLNVAKGAILEVSFIGYKTQEFKIDSSKSLNIVLKDDTEMLDEVVVVGYGTMRKKDLTGSVVQINPTKIADQNPTSVQDVLRGTPGLQIGYDASAKGTDASIQLRGQNSLGTNASPMIVLDGMPFYGELSEINPDDIAQIDVLKDASSAAIYGAKAAAGVIIITTKKGKEGKPVINVSANLSVVNKSDYRDYYDAAGYLKFHQDWRKMYYTYGQGEDGLYGYYQAKDGNGNVLYPEGYFDDPRTMSESEQQKWMTNVGASGIGPSDGETALNLFARRLQFYNSPLMMDNFLNGRMVDWNDATFRTGFNQDYNASISGATERVNYYFSLGYVNNEGAVQGNEYNAFRSNMKINAKITDWLEVGANVNFQDRSDGDIQVSLGSNYWDANMLRNSPYASMYDEDGNYEQYPMSGLPSNGGYNYYFDRQYYDLEKGYTVLNTIFNAKITLPAGFTYSFNIAPRYQWYYDRYWMSADLPDASASSRGVNRGWSKNFDWNLNNTITWDKTFGDHHFTATLVQEAEEHRYWSDNINARNITPSDALGFHYTSGANKSQSSFSTNDTHYTAASYLGRLFYGLKDRYMITGTFRRDGYSGFGANNPWGNFGSVGVSWVFSEEKFMSATRDWFDMGKLRLSWGTNGNREFGDVYSTLANLALAGGNMVYYQNGNSNVVNPLYMSRLAAPNLEWEKTKAWNVGLDLSFFNGRLTANMDYYFKKTTDMIMSQRLPNFSGFGSIMANLGEVQNQGFEIALNSTNIQNKDFTWNTSVGFSINKNKINHIYYDYDENGVEKDDTSNGWFIGQPIGTIWYYETDGVWQNTPEDIKAAALVGQKPGDPKVVNNYTEDDQILEDGTRIPVYNDNDKVYQGTTAPPIYWNMRNDFTLWKDLTLSISLYSYMGHKSRAGYWLNQENGGSQVTNGFNVAAREYWTPDNPTNDYCRLEAVGPNTGLSGGVDKVYNRSFVRLDDITIGYTLPRKWTHKFMVDRIRLTATCKNVCTIDGWEYGDPETGGLATRSFNFGINVTL

SEQ ID NO: 8622 - protein, 1045 aa, Burkholderia graminis C4D1M
MKKLYTSGRSKSRLVFVVPIFLLMLVQVASAQVKKYSLSGRVTDGVSGSGIPGVVVKVMNTSFATATNADGRYTLAFDLAPASRQVSFSSIGFKTQTKALQLGDQLQLSLSAVLVTDNIGLDEVIVTGTSQGTTRKQMGSYVTSVKGSDLVKAPSGNALASLQGKALGAQISQNSGDPAGGMSVRLRGVSSINSSSEPLYIVDGVIVSNATNRVTNTSSNYDGESFIGNIGQNRMVDINPNDIERIEVINGAAAAAIYGSRANAGVVQIFTKRGLSGTPQVSFSTSVVVSELRKKLDVNQSPVKFGGSVDTFTQDVIQLTGTPSVLLTNTTPVTRYDYQDYIFQTALGTDNNVSVSGGNDNTKFYTSAGYFSNEGIIKNTNFKRYNFRANVDQTLSDWAKMTAGFSYIHSDANEKPDGNSFFSPMNSITIIGNFHDLFTRDALGNLRAVGERGRVNPVSVIEDIKQRQFSNRVIANTGVKMTPLKGVTIDYTMGVDNTVQNGTTFIPPFDYNVSTGFYGGGITLDPALNGYASAANATTTLFNNELNFTYDTGITKDLLSTTQLGASYQYQKDLISLLNGRGLAPFVETVNGASTVLPNNDRRSEFSVSGAYLQQNFKYKDHLFVTGAVRIDQSTVFGEDNRTQAYLKGNVSYVLSSADYWKSLGVSDWWDAFKLRAAYGESGNLTGIGAYDRFNEYLAYSFLGKISLLSKPGLANSAVAPERQRELELGTDMSFFKNRLGFTINWYSKKVQDLLLAVVIAPTTGFSSLLDNYGSLENKGVELSLTGTPLLSNDFRWNTTFIFSRNRNKVVNSGALRLISTNAGAPVAIMDDQAVGVFYGTFFARNPDGSLLTNAAGIPQQERGIQTSANEFIPQRGSDGLPTGTTLRKVLGDPNPDYTLSFVNDFSYKKLSLHIQLDAVQGGEVWNADWRTRQGVGSGKIAELEQTGQLPRGYIAGVYPTEEWRIDDGSFVKLREVSLSYRVGNVKFFKDLNINLSGRNLISWDNYKGYDPELNSGGQSTILRNIDFGAVPIPRTFSLGMQFKF

SEQ ID NO: 8623 - protein, 459 aa, Burkholderia graminis C4D1M
MKKTSTALLALSLSSFGALVQAEPASQTFIPTGLSTKNAQAEANGFFEDQHLTGTTRNWYANELKRRDEVFRYNDNGIPEQTSRRINWQQGTIVNYSSGFTQGVVGFSTELALYNAIALDRDTDDFAGNSNRTLAHSDGDAVGQWSKMGLGNVKARVSNTVLTMGRQSVNTPVIAFIGNRALPSSFQGFAVQSDELNNLSLQGGSFDRVSPRMEQSLDKFRSEYGDRSKPADRLDMFGGDYKPTDSLTASFYASNLEDFWHQYYFAFTHELGDSKVFALSTNLNYYKTKDAGQSKLGAIDNDTYSLSFTGTHNAHSVSLAYQEVNGNEYFDYAHDTNAIFLANSLLSDFNGPNEKSLQIAYVLNMAEYGVPGLKFNIYQARGWDIDGTHYKGTGYTDVLAMDGETHYEYGIGSSYSVQSGPLKATAVRATYTTHRASENQADGNINEFRLVTTIPFNIL

SEQ ID NO: 8624 - protein, 76 aa, Burkholderia graminis C4D1M
MMKKTAAIISACMLTFALSACSGSNYVMHTNDGRTIVSDGKPQTDNDTGMISYKDANGNKQQINRTDVKEMVELDQ

SEQ ID NO: 8625 - protein, 933 aa, Burkholderia graminis C4D1M
MKQRALALAIKRIVWAELALTATLAVPAFAQSQPAPGAVAVADAVATSAPAAATVAQASGTASTPAATGAAAPDVAPGAAATGDTAPAAPAVNGQGKVAQIKRFEVTGSLIRQSDKTGFQQVQTITPKEIQASGAVTVTDFLRNATANSANSWGEGQSGNFAAGAAGIALRGLSEKYTLVLVDGQRVAPYAFFSNSVDSFFDLNTLPLNDIERIEIVKTGAVSQYGSDAIGGVVNIITKHNFRGLQLDGSIGSAINAGNGDGTTKFGVLGGFGDLNADRFNVTAALSYYKSNGFTLADRDSTRHQDFTGKPGGFSLLGPSYWNMPDGSAQALNGCPFGGAVRQAATNSLSAGLPGTICAFNTAESTSILPMTERLNAKLHGDFKINDTTTAFADFLESYNTTTTNDGLWNNVIGNPQNPALVWNPQTQLLSPFNTVVPVTNPYNTTGAATPLTYAFPNTVAQKTWANYWRAAAGIKGSFTLPYGDWDWATSVSHSQSTVSNVFTNQLNVNALNNIYQNGTLNFANPAATPNAFNGLYQEANNLGISKLDTIDATLSTPNLFHLPTGDVGIGFGAQFTHQSETLTPGSEYLSGAVVSPDLQTVNGARNVAAVYYQVNVPILENLTFSQAGRYDHYTDVGGAFSPRFALRYQPIKALTLYTSYNRGFRAPTFVEDSKSQTLGIQVDPATGQNYTSITVGNPNLAPERTRNFNIGFQVSPARYTDIGFDWYKIRIDNVIGQGKPSQVVTDPTTGQLLYKVIPYQNLGYLDTNGFEGTFRQGLPLKGWGMLTLSGDWAYINSYKIGFPGSAPVNGAGNNFTITQPFGGSFPRWRGNTTLDWNYRKFDAALTWQFTGPYAQNLLPEPPKVGSYSQFNLMLTYTGFKNWTIYGGIDNIFNRTPPYDPIFANGTLSQSGYDTSVYSYIGRFAQVGATYKF

SEQ ID NO: 8626 - protein, 228 aa, Burkholderia graminis C4D1M
MKLSLFATAAVLCLTGTAAFAQATHDGRWYIAPTVGVVINDNQRQKDTGGAVGLAVGKALNEKWNVEFGSQYIKHNSNDKQASLGVDGLYFFNRNPDFAPYAVVGLGWVREGSNFGGHNDNALLKAGLGFTKQLTDNIDFRTDARYQVHGNKGNSGGSGNLGDWVISAGLNIALGPKAQAPAPAYVAPAYVAPAPEPIAVTPPPVVAPVEPAPAPYVAPQRATKQDRN

SEQ ID NO: 8627 - protein, 651 aa, Burkholderia graminis C4D1M
MKKRLVLGVMLALWAQLGWAEPTTQSLNDVVVTATRTTGNLQMVGGTSVEVITAKDIEARHLTTVTEVLQTVPGLQLSNNGGMGAPSKVFIRGADSKNTLLLIDGIAANDPTDVNRGADFSNILLDNVERIEIVKGPMSVLYGSNATAGVINIITRSGSQGVHGYAGVEAGTYNTKKFSGGLNGSLGNSDFSLAVSRLTSQGYSIANADNNDIPHAGNTSEDDEWENTTFSGKFDAPLCAAATLTGVIRYADAEMDLDDWGSGYAGDRFDYDPMLWSYVAAPDGKKENSLETRRLFTRLNLHALLFDGQVISDVDYKFSRQERDAYDNDDNDSYDYLGKTDEWSWQATWQVVPSNRLTAGIGYLSESSESSSADEEDAETLSVWLQDQFTMGGLDLIAGLRYDDHDRFGGKSTWRIAPAYQIEATGTTVRGSYATGFRTPSLYELYSAYGDEDLDPEKSRSWELGVDQNLFGDQVVASVTWFRTIFEDRIDWDSSRVIPGMAWPGGYAQLDGESETEGVEVAFHLFADKPLSCRLDYTYNDTEDPDGARMSRRPLHKVHAGIRYAIGDFSCNVDGYWVDEREAISSALDENGNAVETLDAYVLVNLAADYDVNDNLTLYARIDNLFDEHYEEAWSYATAGQSFYLGGKVRF

SEQ ID NO: 8628 - protein, 241 aa, Burkholderia graminis C4D1M
MKLKQAVTGMAVLACMSTAAHAQSAGTFFVSTGWFHLAPQSSSDPLTVTSIGGSPTNITEANTGATLDSADTIGFTGGYFITDHIATEFVIGVPPSFDLQGSGSLEQYGKLGQAKQWSPTLLFKYYFNAPTASLRPYLGLGVSRVSFTDAKITNSAFEANVLKGPTTVSTDSSWVPVFNAGFTYAFNQHWFAGVSISYLPLSTTAKLSSQSTTPVGTLTIQSQTKIKLNPIVSYVNVGYRF

SEQ ID NO: 8629 - protein, 174 aa, Burkholderia graminis C4D1M
MKKALATLIALALPAAALAEGASGFYVQADAAHAKASSSLGSAKGFSPRISAGYRINDLRFAVDYTRYKNYKAPSTDFKLYSIGASAIYDFDTQSPVKPYLGARLSLNRASVDLGGSDSFSQTSTGLGVLAGVSYAVTPNVDLDAGYRYNYIGKVNTVKNVRSGELSAGVRVKF

SEQ ID NO: 8630 - protein, 417 aa, Burkholderia graminis C4D1M
MAQTPPPSGNPAASQSAPGTGELGRLLGLPEDGALRLSGVWVGNATEQWSGGFSRSTDEAQALLVEASLDLGKAIGLENTWIWVQGLQVNATSNAGTASGSVQGSNSLAAAPPLDRTELFEYAIRKDFFQGRLRVVAGKQSASTVFANINRPDATDDPRYEVSSLTSLAFTPVYSMPTLLGRLPGYTNSALGLRFTLQPGWFDNRSYLSAGVFDGRGGLGAASVQTGLTLPSLSGPLFNIMEVGSGWVVGDARKPGSFGVGVWSQGGESLLCNPLDPQQCISDLGAWGLYVLLDQRLSSFRADQDSSGINAFFSAGWSPSITNQMNASITGGFTLQGPLEARPNDSLGVGLSWARLNTRGFLSEAFNSHELMLQGYAQIALAEALFLQPTLTLLPRVGNKDAGNDSLSGLLQLTMLF

SEQ ID NO: 8631 - protein, 173 aa, Burkholderia graminis C4D1M
MKKIFVLFIVFFLTLSCSYAQKGKQAIGFGLSYGTEIESIGLGIKYQYNITNPIRIEPSLNYFFENDNVSMLDVNVNFHYLFAVSGSVKLYPLFGLTLSNWMFDGYDLDLDWDGDHLHFDDGGNHNECRFGVNLGAGAELTLPRNWAMNFEFRYQLVSNFDQGVINIGAAYRF

SEQ ID NO: 8632 - protein, 719 aa, Burkholderia graminis C4D1M
MMNRTLSRAAHLLSCAALAFPAAAEETAPQSTDLLSEAGPILETQGDDILVTGDVLQSSVVASVKTPTPIIDVPQSLTITTEKEIVDRGFTSIGQIVDYTPGVNTSQGEGHRDAIVFRGVRSTADFFIDGIRDDVQYYRGLYNLQQVEILRGPNALLFGRGGTGGVLNRVTKKGELNANFAGGQVALDTFGEFSVQGDINLSSSETFAFRLNASYENLNNHRDFYDGERIGINPTARIALGEDTTLDLAYEYANHDRFVDRGIVTGTDGRPVEAFEEIVFGDPELNFLDLEAHLLRANLQHNFSDNWKGVVSAFYGDYDKLYSNFYASGYDQANTPGQVTTDGYVDTTTRENLILSGNLVGEFETGSVGHTLLIGAEYINTQSVNDRFNPVWDQTNDDNEIFAVQRPLALRGGVGVNASGQVTTVAFSDLNDFTDGDLDVFSIFIQDEIKLTEWLNVVVGGRFDSFDLTVIDLANGGAVQSRKDEEFSPRGGLIIKPQDNISIYASYSESFLPRSGEQFASLGGNAAALDPDEFVNLEAGVKWDILDRLSLTAAVFEIEQSTPEVDDTDPALLVVVDSTISGFEFQLQGEVMPGWQVSAGYSYLDGEQVDQTGPTGLRPRELPENMFSIWNQITVTDRFGIGVGLTHQDESFINNSNSAILPSYTRIDAAAYYEVSENWRVQVNVENLTDTLYFPNSHSTHQASVGAPLNARFAINGRF

SEQ ID NO: 8633 - protein, 386 aa, Burkholderia graminis C4D1M
MNKQVFALAVSTALSAAFAAPASAQTSVTLYGVLDEGINYTNNVGRGHVYELASGYAQGSRWGLKGAEELGGGLKAIFQLENGFDVSSGRLNQGGRMFGRQAFVGLSANQFGTLTFGRQYDSVVDYLAQTTANGNWAGSLFSHPYDNDNTDNSFRLDNSVKYTSPSLSGFQFGGVYSFSNDTNFANNRAYSFGGQYSYGGLLVAAAYLQADNPGNGANGAITANDASFIAARMRVFGGGITYTFGPATAGFVYTNSNYLDPTGNGYLGVTPLVPPGVLLNSLKYQNFEVNGKYQISPMLFVGAQYVYTMETYDASSGGVKPKIHSFGLMADYNLSKRTDVYIQGEYQQVTGDSTYSILDDAFNVGTQSPSSTSKQVVVRAAIRHKF

SEQ ID NO: 8634 - protein, 369 aa, Burkholderia graminis C4D1M
MKRICICIAAFSYAVSAHAGGFEQVNQSAAAAGVSNAFAATASDASALAYNPAGIAWQSGVSVSAGIDLNYRNSSVKIPGGVASNTGTEPTFGQVYAAWVPRDGRLSAGIGFSPMYAANNNWSDAFGTASGVGKLTVDHTTADLVYAINSDLAVGMGGDWYVTRATLSQGTNNFKATDIASFGGHASLLWKPLPAWSIGAVYRSGASVSMSKSTSSLAFKLPDQATLALAHDFNDVWRLETDVKWTRWSVLKSMNVVTAGVVSQPNSLNLRDTLTVMAGLTWTWRENTQIRLGYAYDQGANRSRNYNPLIADQDGHRVSLGGGGDMFGMHMDLAYQYTFYSSKTATGAYAGNYRDRKQSIVFTVSNQFD

SEQ ID NO: 8635 - protein, 179 aa, Burkholderia graminis C4D1M
MNSSFVKKSVALAVLAATAPLAAFAQQSSVQLYGIVDAAVRHTTNEGPTKSGKTQMIGGGMSQSRWGINITEDLGGGLAAIANLEARFLTDTGEQAAASYFQQSWVGIRSSSFGQVTLGRQYNMLFDLVTSTYASFPYSPYMEAYKPEIGMSMGARASNMVKYLAEFGPVRGALQYSFD

SEQ ID NO: 8636 - protein, 389 aa, Burkholderia graminis C4D1M
MKKSLLALAALGAFAGVAHAQSSVTLYGIIDEGFNINTNSGGKHLYNLSSGVLQGSRWGLRGTEDLGGGLKAIFVLENGFDVNNGKLGQGGLMFGRQAYVGLSSQFGTVTLGRQYDSVVDYVGPLEAGDQWGGYIAAHPGDIDNFNNAYRTNNTVKFTSANYGGLTFGGTYSFGGIAGNVTSNQIWSLGAGYNNGPLVLGVAYLNARTPAASGGLFNNGGTATTAAGAVTSPVYAGFSSANTYQVIGAGGAYTFGAATVGVTYSNIRFGNLGASFASPFKGQSATFNNAELNFKYQLTPALLVGAAYDYTRGAEINGNSRAQYHQGAVGVDYFLSKRTDVYVTGVYQHALGDTVTAAGNVVDATAGINGLTGSSNQNQFTARVGIRHKF

SEQ ID NO: 8637 - protein, 359 aa, Burkholderia pseudomallei
MDKRLSALCGLGLASAGACAQTSVTLYGVADAYVEYATNQADAKGEPAALARMGSGGKSGSRWGIKGTEVLGGGWRAAFRLESGVNLNNGAGTGAGGFDRSAWVGLEHPRWGALRFGRQYTTMFDIMEHYSPTGAYSTLYEPDGAIVGISFRENNVVKYLATAGPLTFEAHYAFSNEPGAFQASAAHGAGFEYTGGALSFAFAYDDVHTPQAGGFAHLRRYAAAAMLTVEATQLIAGAAHGQGNVATPSVVTRYTFWWIGVRQAITPVVQLIGALYAERVRAQNPASPPAARHASGTPQQATLQLNYFVSKTTTLYAATGYARHAALDFDNYNYGFLHYSLAGARAGSAGVAVGVRKLF

SEQ ID NO: 8638 - protein, 390 aa, Burkholderia pseudomallei
MKQTKHLAALAVPAGFLLSAGVHAQSSVTLYGIVDAGIAYVHNVQGADGRNEASLFKFSSGNLSGSRWGLRGTEDLGGGLAALFQLENGFNLGTGQQNGNREFGRKAIVGLASNTWGSVTLGRQYDPVVDLVQGLTEDNYFGGVFATPGDLDNYDNSLRVSNSVKYTSPVLSGFQFEALYGFGGVAGATGSGRTYSFAASYANGPLSLGAGYLYADGGANATNGVRTWTGSSDTLFNTVINQGFASAKSIQIVRAGGQYVLGSATFGLAYSNTQYRRDSLSAFSDTAKFNSGSAFFNYQFSPALRAGVGYNYTSLTGPASAHYHQVNLGAGYALSKRTDLYALFGYQKASGHTLGANGAVIDAQASVGSYGANSGTDSQELAIVGIRHKF

SEQ ID NO: 8639 - protein, 680 aa, Burkholderia pseudomallei
MQPCLNMSIVRNSALPLPCLSRSETFKKVRSHMKFMKVLTPWIYRKDLWVTAFLLTAIPGSFAHTLVDIAGEPRHAAQATGVSGDGKIVIGMKVPDDPFAITVGFQYIDGHLQPLEAVRPQCSVYPNGITPDGTVIVGTNYAIGMGSVAVKWVNGKVSELPMLPDTLDSVASAVSADGRVIGGNRNINLGASVAVKWEDDVITQLPSLPDAMNACVNGISSDGSIIVGTMVDVSWRNTAVQWIGDQLSVIGTLGGTTSVASAISTDGTVIVGGSENADSQTHAYAYKNGVMSDIGTLGGFYSLAHAVSSDGSVIVGVSTNSEHRYHAFQYADGQMVDLGTLGGPESYAQGVSGDGKVIVGRAQVPSGDWHAFLCPFQAPSPAPVHGGSTVVTSQNPRGMVDINATYSSLKNSQQQLQRLLIQHSAKVESVSSGAPSFTSVKGAISKQSPAVQNDVQKGTFLSYRSQVHGNVQNQQLLTGAFMDWKLASAPKCGFKVALHYGSQDALVERAALPYTEQGLGSSVLSGFGGQVQGRYDFNLGETVVLQPFMGIQVLHLSREGYSEKNVRFPVSYDSVAYSAATSFMGAHVFASLSPKMSTAATLGVERDLNSHIDEFKGSVSAMGNFVLENSTVSVLRPFASLAMYYDVRQQQLVTLSVVMNQQPLTGTLSLVSQSSYNLSF

SEQ ID NO: 8640 - protein, 384 aa, Burkholderia pseudomallei
MKNIRFACATAGVLAATAAHAQSSVTLYGLIDAGIMYTNNVASGNSHGGLVQATTGAVNGSRFGVRGTEDLGGGLKALFVLENGFNAENGKLGQDGRLFGRFAYVGLSDNRFGTLTIGRQYDSLVDFVAPLSATAGTFGDASFAHPFDNDNLNHSLRINNAIKYTSNTYAGLKFGGMYAMSNSTDFATNRAYSFGASYTRGPLNVAAGYLQINGSKGTTAGSPGAVDIVESAANGKGGFSLGADRMRSYGGGLNYAFGPATLGFVYTRAEYENTASFGSTGGTVRFNNYELNGKYQLTPAFSVGGAYTYTDGHVENTVKYGSDPKWHQVDLMAVYRLSVRTDVYLEGMYQHASGRNYVAMINTAGGASSTGNQVVAAVGLRTRF

SEQ ID NO: 8641 - protein, 379 aa, Burkholderia pseudomallei
MRHSARLLACGALCATAAHAHAQSSVTLYGIVDTGIEFVSHASAKGGSAWRMPAVTGELPSRWGLRGVEDLGGGYRALFVLESGFNPRGGELGQGGRLFGRQAYVGLRAPFGTLAFGRQYMMTYVALQGADIIGPDIYGLGSLDAYIPNGRADNAVTYVGSYRGVTLGAGYSFGRDSAGTGNSPGQGTCVGSVPGRAVECRSGSAMLKYDAERFGVAASYEEQRGGANAAANFFDGAAPMPIASSADKDTRAHVSAYANAGPVKLGAGWIGRRVSTDAPAAPDVRTDLFFVGAAYRATPFVTIDGEAYRIVDARHDARATMATLRASFSLSKRTAVYAQTAYLWNSAHARYSVSGGGGGTMPAAGVGQLGAMVGVRHMF

SEQ ID NO: 8642 - protein, 1131 aa, Burkholderia pseudomallei
MLMTRHKKRKTMKRSGAKLLAPVVVAAAAAVAARPGWAQAAPYPDPGRRGDPASWRTPEFTNAWGLGAMHAEYAYAAGYTGANVAIGVLDSGYYAQHPELPDSRFVPVTAAGVSGVLNPNNNNHGTLVSGVVGGARDGVGMHGVAPDATVYEGNTNATDGFRFGVSDPKFPASDAKYFAEAYDALAAKGVRIISNSWGSQPANENYSTLNKLTDAYKLHEAVRTATGRGTWLDAAAKVSRDGVINNFSSGNTGYDNASLRGAYAYFHPELEGHWMTTTGYDQLSGQVYNQCGIAKWWCVMAPTGVPSTSYSGGAAAPTGATYANFNGTSAAAPHASAALALIMERFPYMTSEQALSVLFTTAQNMEPDPSRPDYTNNGLFSTVHPAKPGASGVPNAFGGWGLVDLRRAMNGPGQLLGTFDAALPAGTADVWSNDISDVALAARKREDDAEHRAWLDTLRTKGWEHGLPAGASDGDRIDYALGVARETAYQAREYQGSLVKSGGGTLTLAGANTYRGPTTVDGGELRIDGSIAARAVVNPAGRLTVNGRAADIAVNGGVATIAGTSANLSIDRQGRAAVTGTTADVRVASGFASLGGTSGNVAVGALGVAAITGRTADVAVDGGRASLDGASGNVAVGNGGVVSGSGTVRTLTAAANGTVAPGHSVGTLTVSGDVRFAPGSIYAVEVSPGGAGDRIVAGGRAQIDGGALALALENTPPPLTPEQSRSVLGRRFEILNAAGGVAGRFDAPSGYLFVNPVLAYGPTTVSLTIDRNATPFASVARTANERGVADALETADPGSAVYNSVLFAASAQAPQATLAQLTGEIYPAAYAALVNESRQVREAALERLWTARGAPGRAGAWARLLGAWGSARGGDVNGYTSSTGGFLAGADAALLDSVRAGGFAGYSHTGVNLRNQPSSASFDSFHLGAYAGWQPGALGVRIGAAHAWHRGGVDRAVQYGAVAENETTALHAETTQVFGEAGYRFALDGAATLEPFFGVAYVHLKNQGTTETGGAAALRVRQGNHDVTFSTLGVRGETRLGLTSRLQLTLQGSAGWQHALTDGQPSGTLAFATGSDTFTVSSVPVAKDAAVLNVGAGLELGKNGWLRVGYSGSLASRQSEHAVQGSLHWKF

SEQ ID NO: 8643 - protein, 1035 aa, Burkholderia pseudomallei
MRAKVNCMQVMRSTLTLLCLMFLCTLNAVAQQLNVTGSVKDALGEYIIGASVLVKGTTNGTITDIDGNFSVSGVEKGSVLEISYIGYVSQSITINDEKPLQIILKEDSETLEEVVVVGYGVQKKANLTGAVTSMKSDELLKSRAANATTALVGQMPGLISKQASGEPGADDASIFIRGIATFQGDASPAYIIDGIERTSADFARMDPNDIESINVLKDAASAAIFGMRGANGVIVITTKRGTDGKASIKYSGSVSIQSPTKLPEFANSYDYARLANQYFGSEIYSAEAIQKYKDGSDPELYPNTNWYDEMLTKNAIQNQHNISISGGNEKIRYYVSGGFLNQGGLWEDLNYKRYNLRSNIDAQITKTTRLGVDVSGRLEKSLNSGSSYTIFKELVRNTPVLLCRYPDGTFAFPDATHPNIVAANQPGGSYSKGETFVVDARVELEQELDFITEGLSAKGVMSYSRNNYTNKAWSVSPYVYSKDANNEYVLNPRTSPSLNLTQNQTNYQEYQLQVNYNRSFGLHNVTAMAMVLARKGFSSTSSMFRNSFDSEILDQINAGNTDGQTMNAVDSETARASYMARVNYNYASKYLVEFNIRRDGSENFAPDKRWGTFASASLGWVVSEEPFFESLKNTINFLKIRGSYGTLGNDNTGGVSFPFYSRFELYQGAVASNGFMNNLGDYAFGDLVTKGLVPGAIANSLATWEKSNKANIALDATLFNNLNFTVDLFTERRTNILTQRTAEVPSSFGGILPLENIGIVNNKGIDLSLNYHNSIGKVNYSVGGNFTFARNKIVEMAEAEGTSEYMRQTGRPINGYYGYKTDGIFQSQEEIDSYAKQEVAGVGYDTQIGDIKYVDVDGNGVVNSDDMTYLGYGNIPEIIYGINGSLNWKNFDFSFLMQGAAHAQVYLKGGIILPYFNQGNLPQFWVNEAWTEENPSNRYPRLAESVHNFPATDVPGVQTYLYNASYLRLKNIEVGYTFPTSWLSRIGVTNARVYVNAQNLFTISDVPQIDPENTEQEGWTYPQMKSFNFGLSLQF

SEQ ID NO: 8644 - protein, 681 aa, Burkholderia pseudomallei
MSLLLAASLAHGETGAPPAERRSDAPPATALAPIFVTANPLGASALSSPTASLSGDALTLRRTDSLGDTLNGLPGVSTTTYGPLVGRPIIRGMDGDRIRLLQNGVAAYDASSLSYDHAVPQDPLSVERIEIVRGPAALLYGGNAVGGVVNTIDNRIPREAITGVSGALDASYGGANNARAGAALVEGGNGRFAFHLDAFGRETDALRIPGHAHSARQRALDGEDASEPYGRLPNSDGRRYGGAAGGSYTWADGYVGASYSGYESNYGSVAETDARLQMRQERVALASEVRNLRGPFSQLKFDFGYTNYQHKEIEDGVTGTTFRNHGYEARVEARHRKLGPFEGALGVQVGQNTFSALGGEALAPTTRTTSVALFGLEQWQATDALKLSAGARIEHVRLDPSANGDDKFGFARSRDFNAGSVSAGALYQLAPAWSLAGNVSYTERAPTFYELYANGPHGATGQYLIGRPDAQKEKAVSTDLALRYASGPNRGSIGVFYSRLRNYLAEYDTGRLVDDDGVPVAPGADDALREAVYRGVRAEFYGVELEGRWRAFERRGHRVDLELSADYTHARNADTGEPLPRIAPLRATLAADYGYGPFGARAQLTHAWAQHRVPEHDLATDGYTSLGVVLTYKLRVGATNWLAYLRGDNLTNQDIRYASSVVRNIAPQGGRSVSIGMRTTF

SEQ ID NO: 8645 - protein, 749 aa, Burkholderia pseudomallei
MTSTFLRHAPTARGDHARRRRRAITLTVPALAAGAFHLAPAVAQTSEAVHGHGTLGASGVASRADTDAASAKSDGAVREAASAAASRTTTGAAPDATTLPTIEIVAAPESTPLVVVTDPKTPRQPLPASDGADYLKTIPGFASIRSGGTNGDPVLRGMFGSRLNILANGMPTLGACPGRMDAPTSYIAPESYDKVTLVKGPQTVLYGPGASAGTVLFERVTPRFKTPGMRFDGSVVGGSFGRNDQNVDVTAGTPDFYGRVSANHAHSQDYEDGNGRTVPSQWDKWNADAALGWTPDDNTRLELTAGTGDGYARYAGRGMDGAHFRRETFGLKFDKKHIGDVLDRIEAQVFYNEADHVMDNYTLRMPDPTSSMPMRMASEVRRRTLGARVAATLRLTDAFKLVTGVDAQSNRLDSRSAMGMQNYGDKPWNPQANMWNAGAFGELTWYASDASRVIGGARIDYAAARDKRATTGGMKMSMRNPTFDDLRSRVLPSGFVRYERDLASLPVTWYAGIGHAQRFPDYWELFSAKRGPNGSINAFSAIKPEKTTQLDIGAQYKSDKLDAWVSAYAGYVQDFILFDYATGPMGQITRATNVNAQIMGGEVGASWRPLAPWRFEGSLAYAWGRNVQSGAPLPQMPPLEARFGVEYTRGPWSAGGLWRVVAPQHRYALNEGNVVGKDFGPSAGFGVLSLHAQYNVSKTVQISVGVDNVLDKAYAEHLNLAGNAGFGYPANLPVTEPGRTAWVRLSTKL

SEQ ID NO: 8646 - protein, 622 aa, Burkholderia pseudomallei
MNRAPRLILPVLLPTLLCSVTDFAYAEVQTKNATAIEQITVEASPTANKEPVGTFDSPVSNLEYDPRVDVQSRNMAEAQADVTIRGGIFENTGFRVGSATLFDPQSGHYFAEIPIAPQMLRGPAIFTAADNALYGVNSSVGTVSFAWKPISTGGSVSLGVGSNDFNLQSLHAGVNIPLDGITDWQLGVEGEFSHSQSDGSIDYGDHDFTRASSRVQLVGPDSQTDLFFGSQEKFFGWPNLYTPFGVNETEDLKTQLFMLNHKQNYSAESSFEVSTYYRKHEDHYVYSRENPMSFEAFHQTDVKSLALSGRHAYSTSFALNYSAQFINDSIESTTLENNFTSRNYYKVSVLPEYQMALESDQHLTIRLGAAFDDTNRDDSEISLIGDITLNTQNSDGTERTVYLSYAQASQVAGYTAIGGSDTGGLFRSNYNLERESTKNLELGLLLERQSWRFNSAVFYRQDDNLTDWTYSFDATSARFANPVDINTSGVEFLATKHFDNAEIIASYSFLKKSENYGAADIDASFYALNYPDHRLTLAAIWNPTDILEFRIDNEWRKQHENTLRSGDDDALFTHLTLKIMPPQIKNLFITLAADNLWNESFQEIPGTPGRGEQYTLSATYSW

SEQ ID NO: 8647 - protein, 896 aa, Burkholderia pseudomallei
MKKFYLILICLVATLSTSFAQSGSIKGRVMDKETGEALIGASVIIKGTSQGVTTNVKGDFLMQNVAVGKQTIEISYIGYEKYETTLTVLAGRIMRLPTLKLDPQAMGLKEVQVLASFQDEKRQQPTPISTISALDIKEKMGAQEFPEMLKSTPGVFVSTGGGAFGGSSVRIRGFGSENTAVLINGIPVNDMESGRVFWSNWGGMNDVTRNQQVQRGLGASKLAVSSIGGTINIITKPTEFRKGVRVSYAMSNRSWKHRAMVSASTGLMKGDWAVTVLGSTRQGEGFREGTSADSWAYFLSAYKGFGKNHQLVFTAFGAPQVTEGGRSATLETYQTVGDERYNPAWGFRDGKRFSSARNRYHKPKFMLNHYWDISPKTTLSTSVYYSFGRGGGTSINRTADVGNPVPFNITQGADESTYQVDWAGLIAQNQAVTPTNIITGNDNTLVRGRLSQYMIQESRNDHNWLGALTTLNSHINENLSITTGLDYRWYRGFHYQTVNDLLGGDFWLDRERFNDRPDNNLLRPNFLAKEGDRIGYDYTGTVGWLGAFAQAEYSLGNLDLFVTGTVVQSQFQRNGKFLHEEFIDSSLGKSELHQFTNYTVKAGANYKITGRHNVFFNSGMFTRAPFFRDAYVDARVSNTIRGGLNNEEILSLEAGYGYRSPTFAANLNVYQTYWQNRTLTMGTFASYVNPATGEFVDDFVTVRMAGVGALHRGIEFDFLWQMLPALTLKGMASIGDWRWMGNAKATIFTDPGLQIINDNQTVYNDRLKVGGSAQSVAALNLNYRSPKYWYAGISYNFYDNMYADYNPVEKTNPEPYFNQVERLNNAYTFDIYGGKSFKLKKGLILQVKFNVNNLFDNRFVIDSNQRTASFNDPNPSPFVQYYFGRTFFISTVLQIR

SEQ ID NO: 8648 - protein, 778 aa, Burkholderia pseudomallei
MFHQLAAPGARRRLAAACAAALAWPAAHAASTAAAVPADSTPAAAAEMTASGKTLDTVKVTAQRAAFAPDTPGVVEALTREQIDSHVNVTTEDALKYAPNLMVRRRYIGDRNSVFAGRDFNELQSARGLVYADGILLSNLLGSSYSYPPRWSLIQPDDIARVDVLYGPFSALYPGNAIGSTVQITTHKPQRLEASVSTQFFTQRYRDGYGFADSFGGNHQSARIADRVGRFWYALSLDRLENDSQPMQYASPNGAFDPRLGAPVPVTGAVSDIGPNGRPRTIVGAQTIERTEQLNETLRFGYAFTDHVDATVTLGHWENHYRQHGDTFLRDAAGNPVYGGNVSFGGRNYTVSPGAFAPQTGDQENWLYGLGLDARLASGWKLSATASAYEVSRDVLRSASGAPPGAWDGGPGTVFHGDGTGWRTVDLRAESPDVRGHRFSFGYHFDTYFLRNATYNTADWQNAVPTTLVNRYRGNTRTQALYAQDAWRVAPGWLATLGLRYERWDAYGGELGGATATLGYAERGATAFSPKLSLEWQPASAWRLRLSFATGTRFPTVAELFQGTISNNAIVNNNPNLQPEKAIDWDFTAERDVGFGVVRASVFQSDLRNSIYSQTTLAGASTYTNVSNVDRVRVRGVELAFSGQDVALKGLDVDANVSATNAQTLADAANPNYVGARWPRIPRMRANLLASYRFDEHWMTSVGVRYSGRQYNALDNSDMNPGVYGGTSSFMVVDLKARYRFDRHWLASFGIDNVTDRRYYVFHPYPGRTFYGELKWSL

SEQ ID NO: 8649 - protein, 671 aa, Burkholderia pseudomallei
MRGPLCAGGALMLLTMAPPTMAEEATADNAEPSAGVITLDLLTVTANKRRQTEFDVAGAVSVATGDDLERDGITQTDRLDAVFPELQSMGRSSRVYNNFTLRGLSSADFYGPAVGLNVDGVPQLPHTYAQSLRNAERVELVKGPQGAVYGRGALGGVINVETALPGEEPEAWTDLQVFGGGHRASAGASSGQWRGWAIQGMANDAVAGGSLDDPLRGLKNVDESRDTGGRVSLHYLPSEVPLQARLKLGTQRYRSEEEYYVPLDTLSRKRVNPVVETPKLNRRIDDVSLDATYDLTDKWSITGLVSYQRMDLDRTFGTYGIDTKEFQDSLYGELRAAYESESTSLLFGYNGQKQHYKYEDLDYGSGVGDMGGPMSDNTMVTHAVFTDGTYRFLPHWELSAGARVAWEKAESLMTIPGAPGSNVDHKNDATFWAVTPHAALAYLLTDEHRLWAGVGRGYKPGGFNKAGTSSLDTAAYDSETALSVEGGWKYRSTTGTRRAEVTLYDIESQNVQGYSGPAGLETLGNMGDARSLGIEVNTAFVVFEDHEISLGGMANRSSFTDGPYKGNTVPYAPAYSFRASWTSYLGNRGQWQPSATVRHVGEHYFDTDNTLRQGSYTVLDASLNYETDFGVTVGVYGNNLTDTLYQVYANRSVGAQLGAPREVGLHLTARF

SEQ ID NO: 8650 - protein, 756 aa, Burkholderia pseudomallei
MSRAPHAPSRRRAFGRGFAAAARAAHGAPVAHGAHACFAAASRRATAVERCVTALACAVTASGALAAEAEPADAARGPHRELPTVRVTSDGAHASPLSTPLAAGSRLKLASLDTPASVEAITSAQIAARGDRTIVDAVTRATGFSTAAAPGNGGTALSVRGFAGQESVTTLVDGVRLYPGAGTVTFPFSTWSAERIEVLRGPASVLYGEGAIGGVANVVTRRPRRERSTTLQAGIGTQGEKRVALDTTGALGPRLSYRFHLSDERARGFVERGDAHVTAVGGALKLDVDSRLSITLDYDYGRQKPATYFGVPATNGVLERALRERNYNVGDATIAYHDTWTRLAATYRAGNGVTLDAQLYYLATRRHWRNAESYALDPAARTVARSDYLEIFHRERQFGERFTARIDSRVFGRANRLVLGAEFNQIAFDGANNAPYRGESTVAAAGFDPGAFASPDPTLPRFRTRTHQAAAFIENRLEVLPRLAWVSGLRYDHLSFHRDDLIAGGAFDKTFAHTGWRSGLVYEIAPGLAAYAQYTTGAQGVGSLVTLSASQANYTLATGRQWEAGIKHEIDGARAYWTLAVYDIVKRGLVSVDPLNPARAQQIGRQSSRGVELAGGVRLPGGVTVDANAALLRARYDAFGQRVGDTVVQRAGNVPHDIAQQSANLWIGWAFAPGWRANAGLRYVGPRYGDDANRVPVPSYTVFDASLAWRATRDVDLAFYARNLANRTYAASTSNGGAQWLLGPSRSVELVATLRF

SEQ ID NO: 8651 - protein, 685 aa, Burkholderia pseudomallei
MRTPFVRAALAALSGLPCIALAQGDASASSASFASSVSYAPAAASPADADSALSTAPAAAAASPASGAARGAEAVSADAASAVASGASSASPARAASAAQLAPVVVTARRGPQRLADAIPQTTLFDARDIADSGATDLPGLLALAPGAQIVRNGGPGASASLFLRGAQPTQSLVLIDGVRVDSASLGQSQIAQLPLDQIERVEVVNGNVSSLYGSGAIGGVVQVFTKNGGNHPPRFDFSAGYGSYHTQTQSAGASGRLDPDGRTTFSVSLARLKTDGFSALDPARKPQANPNANGYLNESASASLRHTFSDKWNAGVTYFQANGRNSYDDAYGSPADLNDLYSRVQQLSAFANGALADGWTTRVSVSSGEDRNQSALNGAYTDHFNTDNRQYTWQNDFAIARGHKIQAGYERLDQSFESNKYSAPERHVNSGWLGYTGRIGDSRFQANVRRDQYSDFGGANSYYLGYGFDVTEHWTVSASYSSAFRAPSFNDLYYPNSGNLSIRHERSHSVEAAVQYASDDVGVVRVTAFQTRYTNLIDYRPGASGPYYVAQNVGRAKVQGVEGSWQGHVGGTDVRIAATLQNPVDETAGRDLNRRARRFASISANRSFGGWRVGGEWLASGARDDFGDRLGGYGIVNLSARYDITKSWYVSARIDNLFDKDYELAYAYNTPRRGAYVTLGWQQR

SEQ ID NO: 8652 - protein, 737 aa, Burkholderia pseudomallei
MEWATSTRVRAIAAGVAFYAAAAGHAQAQAAQPGTDAWQPGGEAKADTAAGGTLPAISVSGAAERDASVGLVARRSMTGTKTDTPIIEIPQTINVVTAQQIEATGATDINQAFRYIPGFSSYGSDNRSDWYAALRGFTPTVFVDGLQVPNTINLSSWRVDPYMIDSIAVLRGPTSVLYGQGDPGAIVDVQSKLANGERIRELGVQVGNYARKQLMFDIGDTIGKDGTLSYRIVGVGRDGNAQTGPLADQRVSFAPSLKWQPNADTSLTLAATYLQDWGDTSSNFLPSRGTVLPNPNGTISDDLYTADANFDHYRKKQWSLGYQFEHKLNPVWTLRQNVRWMHLSLDDASVYGGGLDDADPTMATMTRYAGLFQFNYSRFDVDNQAQAKFTTGPLSHTLLFGFDYNRQTTTDSEWLAKGPSLNLYRPVYTPIPSDIFSGPNAYPRTDTKTTLNAFGLYVQDQIKWRRWVLTLGGRQDWTRTSQDDIANAASFRQNDHAFSGRVGLTYLGDYGLAPYLSYSTSFNPQIGLKLAGGGLATPTKGRQIEAGLRWQPPGKNLMLNAAVYQINQTNVAMSNPNDPTSSTFVQVGEVRSRGVELSAVGNLSRELSVIAAYVYQDVKNVRANDNTLNKWPVDVPRPRQIASLWADWTWRTGPLTGFGVGAGVRYMSAAAGAADNSLTVPSYTLFDAALHYELRNWRFALNATNLFNRRYVAGCQSDAVCMYGNQRTVIATAKYNW

SEQ ID NO: 8653 - protein, 407 aa, Burkholderia pseudomallei
MSARAARQLPGNRRLARLAGAAAAACAAGFGASTAHAQSSVVLYGLIDTSITYANNQRTHGAGSPGSPGWAVTSGALNASRWGLRGREDLGDGVSAIFALENGFSGASGALSQKGVDMFGRQAWIGLKSKEGGALTLGRQYDLILDFVTPLGASGPGWGGNLAVHPYDNDDSNRNIRINNAVKYTSPTYRGWTLGAMYGFSNTAGQFGNNAAWSAGLSYANGPLKLGAGYLRINRNPNAANANGALSTTDGSATITGGSQQIWAVAGRYAFGPHSIGAAWSHSATDRVSGVLQGASIAKLDGNSLVFDNFTLDGRYVVTPRLSLAAAYTYTMGRFDARSGETRPKWNHMVAQADYAFSIRTDAYLEAVYQRVSGGNGIPAFNATIWTLTPSANGNQVVVALGLRHRF

SEQ ID NO: 8654 - protein, 355 aa, Burkholderia pseudomallei
MTTLRLRSPHRCGPPALAAAATLAALSGPAHAQSTLTLYGVADAGVQYLSRADGRHAAWRLQNYGILPSQLGIKGEEDLGGGWRSRFQLEQGINLNDGTATVPGYAFFRGAYVGMGGPAGTVTLGRQFSTLFDKTLFYDPLWYASYSGQGVLVPLSANFVDHSIKFQSATFAGFDVEALAAMAGIAGNTRAGRVLELGGQFTSSGLSASAVLHRSHGTAQGGADRSAQRRDIGTFAARYAFASLPLTVHAGVQRLTGELDPARTIVWGGARYQASERFGFAGGIYHTDSPTPQVGHPTLFIASTTCSLSKRTVAYLNLGYAKNSGRSAQTVYEYDPTPLAGASQFGAMLGMYHVF

SEQ ID NO: 8655 - protein, 123 aa, Burkholderia pseudomallei
MKHGIKALLITLSLACAGMSHSALAAASVAKPTAVETKAEAPAAQSKAAVPAKASDEEGTRVSINNASAEELARAMNGVGLKKAQAIVSYREEYGPFKTVEDLKQVPGMGNSLVERNLAVLTL

SEQ ID NO: 8656 - protein, 397 aa, Burkholderia pseudomallei
MKFLSLPFCLAPLFLSSLANASQPYSDTLTGDWGGNRSHIKDNGLSLDAEYTNVYQSAVYGSPSNSNEFTHRFDLFAALDTENAGLWNNGTFRTQLIYLNGDANDFGFSSLSVPNSAHYADSSSPFFSSLYYTHKFDDNTNLLFGKIDAFELLRNAPFYGGATRHGFMNIAFSAPPSGVTPPSFIGGILNHTIGDTRIMAMIYDPRDRYDDNLGFNDWFDDGVNFSLGATHSFKLFDRSSTFGMSGTYSTEEGVDYSSLGETAKYKYNIRAQATHNIYENNDDTIAVYLRAAAADGNPNIIDGTFVGGFGGNAFFFDRPQDQWGAGYYYYNLSNALQNSISDLPLGAELKDEQGFEIYYAFQATPWLTFTADAQYVTPAVSTQSKVALFGLRTNIVF

SEQ ID NO: 8657 - protein, 747 aa, Escherichia coli
MARSKTAQPKHSLRKIAVVVATAVSGMSVYAQAAVEPKEDTITVTAAPAPQESAWGPAATIAARQSATGTKTDTPIQKVPQSISVVTAEEMALHQPKSVKEALSYTPGVSVGTRGASNTYDHLIIRGFAAEGQSQNNYLNGLKLQGNFYNDAVIDPYMLERAEIMRGPVSVLYGKSSPGGLLNMVSKRPTTEPLKEVQFKAGTDSLFQTGFDFSDALDDDGVYSYRLTGLARSANAQQKGSEEQRYAIAPAFTWRPDDKTNFTFLSYFQNEPETGYYGWLPKEGTVEPLPNGKRLPTDFNEGAKNNTYSRNEKMVGYSFDHEFNDTFTVRQNLRFAENKTSQNSVYGYGVCSDPANAYSKQCAALAPADKGHYLARKYVVDDEKLQNFSVDTQLQSKFATGDIDHTLLTGVDFMRMRNDINAWFGYDDSVPLLDLYNPVNTDFDFNAKDPANSGPYRILNKQKQTGVYVQDQAQWDKVLVTLGGRYDWADQESLNRVAGTTDKRDDKQFTWRGGVNYLFDNGVTPYFSYSESFEPSSQVGKDGNIFAPSKGKQYEVGVKYVPEDRPIVVTGAVYNLTKTNNLMADPEGSFFSVEGGEIRARGVEIEAKAALSASVNVVGSYTYTDAEYTTDTTYKGNTPAQVPKHMASLWADYTFFDGPLSGLTLGTGGRYTGSSYGDPANSFKVGSYTVVDALVRYDLARVGMAGSNVALHVNNLFDREYVASCFNTYGCFWGAERQVVATATFRF

SEQ ID NO: 8658 - protein, 199 aa, Escherichia coli
MRKVCAAILSAAICLAVSGAPAWASEHQSTLSAGYLQTHTDMPGSDDLKGINVKYRYEFTDTLGLITSFSYANAEDEQKTHYSDTRWHEDSVRNRWFSVMAGPSVRVNEWFSAYAMAGVAYSRVSTFSGDYLRVTDNKGKTHDVLTGSDGGRHSNTSLAWGAGVQFNPTESVAIDLAYEGSGSGDWRTDGFIVGVGYKF

SEQ ID NO: 8659 - protein, 1325 aa, Escherichia coli
MNRIYRVIWNCTLQVFQACSELTRRAGKTSTVNLRKSSGLTTKFSRLTLGVLLALSGSASGASLEVDNDQITNIDTDVAYDAYLVGWYGTGVLNILAGGNASLTTITTSVIGANEDSEGTVNVLGGTWRLYDSGNNARPLNVGQSGTGTLNIKQKGHVDGGYLRLGSSTGGVGTVNVEGEDSVLTTELFEIGSYGTGSLNITDKGYVTSSIVAILGYQAGSNGQVVVEKGGEWLIKNNDSSIEFQIGNQGTGEATIREGGLVTAENTIIGGNATGIGTLNVQDQDSVITVRRLYNGYFGNGTVNISNNGLINNKEYSLVGVQDGSHGVVNVTDKGHWNFLGTGEAFRYIYIGDAGDGELNVSSEGKVDSGIITAGMKETGTGNITVKDKNSVITNLGTNLGYDGHGEMNISNQGLVVSNGGSSLGYGETGVGNVSITTGGMWEVNKNVYTTIGVAGVGNLNISDGGKFVSQNITFLGDKASGIGTLNLMDATSSFDTVGINVGNFGSGIVNVSNGATLNSTGYGFIGGNASGKGIVNISTDSLWNLKTSSTNAQLLQVGVLGTGELNITTGGIVKARDTQIALNDKSKGDVRVDGQNSLLETFNMYVGTSGTGTLTLTNNGTLNVEGGEVYLGVFEPAVGTLNIGAAHGEAAADAGFITNATKVEFGLGEGVFVFNHTNNSDAGYQVDMLITGDDKDGKVIHDAGHTVFNAGNTYSGKTLVNDGLLTIASHTADGVTGMGSSEVTIANPGTLDILASTNSAGDYTLTNALKGDGLMRVQLSSSDKMFGFTHATGTEFAGVAQLKDSTFTLERDNTAALTHAMLQSDSENTTSVKVGEQSIGGLAMNGGTIIFDTDIPAATLAEGYISVDTLVVGAGDYTWKGRNYQVNGTGDVLIDVPKPWNDPMANNPLTTLNLLEHDDSHVGVQLVKAQTVIGSGGSLTLRDLQGDEVEADKTLHIAQNGTVVAEGDYGFRLTTAPGNGLYVNYGLKALNIHGGQKLTLAEHGGAYGATADMSAKIGGEGDLAINTVRQVSLSNGQNDYQGATYVQMGTLRTDADGALGNTRELNISNAAIVDLNGSTQTVETFTGQMGSTVLFKEGALTVNKGGISQGELTGGGNLNVTGGTLAIEGLNARYNALTSISPNAEVSLDNTQGLGRGNIANDGLLTLKNVTGELRNSISGKGIVSATARTDVELDGDNSRFVGQFNIDTGSALSVNEQKNLGDASVINNGLLTISTERSWAMTHSISGSGDVTKLGTGILTLNNDSAAYQGTTDIVGGEIAFGSDSAINMASQHINIHNSGVMSGNVTTAGDMNVMPGGGTACR

SEQ ID NO: 8660 - protein, 790 aa, Escherichia coli
MKRVLIPGVILCGADVAQAVDDKNMYMHFFEEMTVYAPVPVPVNGNTHYTSESIERLPTGNGNISDLLRTNPAVRMDSTQSTSLNQGDIRPEKISIHGASPYQNAYLIDGISATNNLNPANESDASSATNISGMSQGYYLDVSLLDNVTLYDSFVPVEFGRFNGGVIDAKIKRFNADDSKVKLGYRTTRSDWLTSHIDENNKSAFNQGSSGSTYYSPDFKKNFYTLSFNQELADNFGVTAGLSRRQSDITRADYVSNDGIVAGRAQYKNVIDTALSKFTWFASDRFTHDLTLKYTGSSRDYNTSTFPQSDREMGNKSYGLAWDMDTQLAWAKLRTTVGWDHISDYTRHDHDIWYTELSCTYGDITGRCTRGGLGHISQAVDNYTFKTRLDWQKFAVGNVSHQPYFGAEYIYSDAWTERHNQSESYVINAAGKKTNHTIYLKGKGRLGIDNYTLYMADRISWRNVSLMPGVRYDYDNYLSNHNISPRFMTEWDIFANQTSMITAGYNRYYGGNILDMGLRDIRNSWTESVSGNKTLTRYQDLKTPYNDELAMGLQQKIGKNVIARANYVYREAHDQISKSSRTDSATKTTITEYNNDGKTKTHSFSLSFELAEPLHIRQVDINPQIVFSYIKSKGNLSLNNGYEESNTGDNQVVYNGNLVSYDSVPVADFNNPLKISLNMDFTHQPSGLVWANTLAWQEARKARIILGKTNAQYISEYSDYKQYVDEKLDSSLTWDTRLSWTPQFLKQQNLTISADILNVLDSKTAVDTTNTGVATYASGRTFWLDVSMKF

SEQ ID NO: 8661 - protein, 774 aa, Escherichia coli
MTPLRVFRKTTPLVNAIRLSLLPLAGLSFSAFAAQVNIAPGSLDKALNQYAAHSGFTLSVDASLTRGKQSNGLHGDYDVESGLQQLLDGSGLQVKPLGNNSWTLEPAPAPKEDALTVVGDWLGDARENDVFEHAGARDVIRREDFAKTGATTMREVLNRIPGVSAPENNGTGSHDLAMNFGIRGLSPRLASRSTVLMDGIPVPFAPYGQPQLSLAPISLGNMDAIDVVRGGGAVRYGPQSVGGVVNFVTRAIPQDFGIEAGVEGQLSPTSSQNNPKETHNLMVGGTADNGFGTALLYSGTRGSDWREHSATRIDDLMLKSKYAPDEVHTFNSLLQYYDGEADMPGGLSRADYDADRWQSTRPYDRFWGRRKLASLGYQFQPDSQHKFNIQGFYTQTLRSGYLEQGKRITLSPRNYWVRGIEPRYSQIFMIGPSAHEVGVGYRYVNESTHEMRYYTATSSGQLPSGSSPYDRDTRSGTEAHAWYLDDKIDIGNWTITPGMRFEHIESYQNNAITGTHEEVSYNAPLPALNVLYHLTDSWNLYANTEGSFGTVQYSQIGKAVQSGNVEPEKARTWELGTRYDDGALTAEMGLFLINFNNQYDSNQTNDTVTARGKTRHTGLETQARYDLGTLTPTLDNVSIYASYAYVNAEIREKGDTYGNLVPFSPKHKGTLGVDYKPGNWTFNLNSDFQSSQFADNANTVKESADGSTGRIPGFMLWGARVAYDFGPQMADLNLAFGVKNIFDQDYFIRSYDDNNKGIYAGQPRTLYMQGSLKF

SEQ ID NO: 8662 - protein, 955 aa, Escherichia coli
MGIKQHNGNTKADRLAELKIRSPSIQLIKFGAIGLNAIIFSPLLIAADTGSQYGTNITINDGDRITGDTADPSGNLYGVMTPAGNTPGNINLGNDVTVNVNDASGYAKGIIIQGKNSTLTANRLTVDVVGQTSAIGINLIGDYTHADLGTGSTIKSNDDGIIIGHSSTLTATQFTIENSNGIGLTINDYGTSVDLGSGSKITTDGSTGVYIGGLNGNNANGAARFTATDLTIDVQGYSAMGINVQKNSVVDLGTNSTIKTNGDNAHGLWSFGQVSANALTVDVTGAAANGVEVRGGTTTIGADSHISSAQGGGLVTSGSDATINFTGTAAQRNSIFSGGSYGASAQTATAVVNMQNTDITVDRNGSLALGLWALSGGRITGDSLAITGAAGARGIYAMTNSQIDLTSDLVIDMSTPDQMAIATQHDDGYAASRINASGRMLINGSVLSKGGLINLDMHPGSVWTGSSLSDNVNGGKLDVAMNNSVWNVTSNSNLDTLALSHSTVDFASHGSTAGTFATLNVENLSGNSTFIMRADVVGEGNGVNNKGDLLNISGSSAGNHVLAIRNQGSEATTGNEVLTVVKTTDGAASFSASSQVELGGYLYDVRKNGTNWELYASGTVPEPTPNPEPTPAPAQPPIVNPDPTPEPAPTPKPTTTADAGGNYLNVGYLLNYVENRTLMQRMGDLRNQSKDGNIWLRSYGGSLDSFASGKLSGFDMGYSGIQFGGDKRLSDVMPLYVGLYIGSTHASPDYSGGDGTARSDYMGMYASYMAHNGFYSDLVVKASRQKNSFHVLDSQNNGVNANGTANGLSISLEAGQRFNLTPTGYGFYIEPQTQLTYSHQNEMAMKASNGLNIHLNHYESLLGRASMILGYDITAGKSQLNIYVKTGAIREFSGDTEYLLNNSREKYSFKGNGWNNGVGVSAQYNKQHTFYLEADYTQGNLFDQKQVNGGYRFSF

SEQ ID NO: 8663 - protein, 614 aa, Escherichia coli
MIKKASLLTACSVTAFSAWAQDTSPDTLVVTANRFEQPRSTVLAPTTVVTRQDIDRWQSTSVNDVLRRLPGVDITQNGGSGQLSSIFIRGTNASHVLVLIDGVRLNLAGVSGSADLSQFPIALVQRVEYIRGPRSAVYGSDAIGGVVNIITTRDEPGTEISAGWGSNSYQNYDVSTQQQLGDKTRVTLLGDYAHTHGYDVVAYGNTGTQAQTDNDGFLSKTLYGALEHNFTDAWSGFVRGYGYDNRTNYDAYYSPGSPLLDTRKLYSQSWDAGLRYNGELIKSQLITSYSHSKDYNYDPHFGRYDSSATLDEMKQYTVQWANNVIVGHGSIGAGVDWQKQTTTPGTGYVENGYDQRNTGIYLTGLQQVGDFTFEGAARSDDNSQFGRHGTWQTSAGWEFIEGYRFIASYGTSYKAPNLGQLYGFYGNPNLDPEKSKQWEGAFEGLTAGVNWRISGYRNDVSDLIDYDDHTLKYYNEGKARIKGVEATANFDTGPLTHTVSYDYVDARNAITDTPLLRRAKQQVKYQLDWQLYDFDWGITYQYLGTRYDKDYSSYPYQTVKMGGVSLWDLAVAYPVTSHLTVRGKIANLFDKDYETVYGYQTAGREYTLSGSYTF

SEQ ID NO: 8664 - protein, 1526 aa, Escherichia coli
MNRTSPYYCRRSVLSLLISALIYAPPGMAAFTTNVIGVVNDETVDGNQKVDERGTTNNTHIINHGQQNVHGGVSNGSLIESGGYQDIGSHNNFVGQANNTTINGGRQSIHDGGISTGTTIESGNQDVYKGGISNGTTIKGGASRVEGGSANGILIDGGSQIVKVQGHADGTTINKSGSQDVVQGSLATNTTINGGRQYVEQSTVETTTIKNGGEQRVYESRALDTTIEGGTQSLNSKSTAKNTHIYSGGTQIVDNTSTSDVIEVYSGGVLDVRGGTATNVTQHDGAILKTNTNGTTVSGTNSEGAFSIHNHVADNVLLENGGHLDINAYGSANKTIIKDKGTMSVLTNAKADATRIDNGGVMDVAGNATNTIINGGTQNINNYGIATGTNINSGTQNIKSGGKADTTIISSGSRQVVEKDGTAIGSNISAGGSLIVYTGGIAHGVNQETGSALVANTGAGTDIEGYNKLSHFTITGGEANYVVLENTGELTVVAKTSAKNTTIDTGGKLIVQKEAKTDSTRLNNGGVLEVQDGGEAKHVEQQSGGALIASTTSGTLIEGTNSYGDAFYIRNSEAKNVVLENAGSLTVVTGSRAVDTIINANGKMDVYGKDVGTVLNSAGTQTIYASATSDKANIKGGKQTVYGLATEANIESGEQIVDGGSTEKTHINGGTQTVQNYGKAINTDIVSGLQQIMANGTAEGSIINGGSQVVNEGGLAENSVLNDGGTLDVREKGSATGIQQSSQGALVATTRATRVTGTRADGVAFSIEQGAANNILLANGGVLTVESDTSSDKTQVNMGGREIVKTKATATGTTLTGGEQIVEGVANETTINDGGIQTVSANGEAIKTKINEGGTLTVNDNGKATDIVQNSGAALQTSTANGIEISGTHQYGTFSISGNLATNMLLENGGNLLVLAGTEARDSTVGKGGAMQNLGQDSATKVNSGGQYTLGRSKDEFQALARAEDLQVAGGTAIVYAGTLADASVSGATGSLSLMTPRDNVTPVKLEGAVRITDSATLTLGNGVDTTLADLTAASRGSVWLNSNNSCAGTSNCEYRVNSLLLNDGDVYLSAQTAAPATTNGIYNTLTTNELSGSGNFYLHTNVAGSRGDQLVVNNNATGNFKIFVQDTGVSPQSDDAMTLVKTGGGDASFTLGNTGGFVDLGTYEYVLKSDGNSNWNLTNDVKPNPDPIPNPKPDPKPDPKPDPNPKPDPTPDPTPTPVPEKRITPSTAAVLNMAATLPLVFDAELNSIRERLNIMKASPHNNNVWGATYNTRNNVTTDAGAGFEQTLTGMTVGIDSRNDIPEGITTLGAFMGYSHSHIGFDRGGHGSVGSYSLGGYASWEHESGFYLDGVVKLNRFKSNVAGKMSSGGAANGSYHSNGLGGHIETGMRFTDGNWNLTPYASLTGFTADNPEYHLSNGMKSKSVDTRSIYRELGATLSYNMRLGNGMEVEPWLKAAVRKEFVDDNRVKVNSDGNFVNYLSGRRGIYQAGIKASFSSTLSGHLGVGYSHSAGVESPWNAVAGVNWSF

SEQ ID NO: 8665 - protein, 371 aa, Escherichia coli
MLSRWRYSWRILDDNEAQKMKKTAIAIAVALAGFATVAQAAPKDNTWYAGAKLGWSQYHDTGFINNDGPTHENQLGAGAFGGYQVNPYVGFEMGYDWLGRMPYKGDNINGAYKAQGVQLTAKLGYPITDDLDVYTRLGGMVWRADTKSNVPGPGGASNKDHDTGVSPVFAGGIEYAITPEIATRLEYQWTNNIGDANTIGTRPDNGLLSVGVSYRFGQQEAAPVVAPAPAPAPEVQTKHFTLKSDVLFNFNKSTLKPEGQQALDQLYSQLSNLDPKDGSVVVLGFTDRIGSDAYNQGLSEKRAQSVVDYLISKGIPSDKISARGMGESNPVTGNTCDNVKPRAALIDCLAPDRRVEIEVKGVKDVVTQPQA

SEQ ID NO: 8666 - protein, 1234 aa, Escherichia coli
MIASLFSANGVAAVTDSCQGYDVKASCQASRQSLSGITQDWSIADGQWLVFSDMTNNASGGAVFLQQGAEFSLLPENETGMTLFANNTVTGEYNNGGAIFAKENSTLNLTDVIFSGNVAGGYGGAIYSSGTNDTGAVDLRVTNAMFRNNIANDGKGGAIYTINNDVYLSDVIFDNNQAYTSTSYSDGDGGAIDVTDNNSDSKHPSGYTIVNNTAFTNNTAEGYGGAIYTNSVTAPYLIDISVDDSYSQNGGVLVDENNSAAGYGDGPSSAAGGFMYLGLSEVTFDIADGKTLVIGNTENDGAVDSIAGTGLITKTGSGDLVLNADNNDFTGEMQIENGEVTLGRSNSLMNVGDTHCQDDPQDCYGLTIGSIDQYQNQAELNVGSTQQTFVHALTGFQNGTLNIDAGGNVTVNQGSFAGIIEGAGQLTIAQNGSYVLAGAQPMALTGDIVVDDGAVLSLEGDAADLTALQDDPQSIVLNGGVLDLSDFSTWQSGTSYNDGLEVSGSSGTVIGSQDVVDLAGGDNLHIGGDGKDGVYVVVDASDGQVSLANNNSYLGTTQIASGTLMVSDNSQLGDTHYNRQVIFTDKQQESVMEITSDVDTRSDAAGHGRDIEMRADGEVAVDAGVDTQWGALMADSSGEHQDEGSTLTKTGAGTLELTASGTTQSAVRVEEGTLKADVADILPYASSLWVGDGATFVTGADQDIQSIDTTSSGTIDISDGTVLRLTGQDTSVALNASLFNGDGTLVNATDGVTLTGELNTNLETDSLTYLSNVTVNGNLTNTSGAVSLQNGVAGDTLTVNGDYTGGGTLLLDSELNGDDSASDQLVLNGNTAGNTTVVINPITGIGEPISTGIKVVDFAADPTQFQNNAQFSLAGSGYVNMGAYDYTLVEDNNDWYLRSQEVTPPSPPDPDPTPDPDPTPDPDPTPDPEPTPAYQPVLNAKVGGYLNNLRAANQAFMMERRDHAGGDGQTLNLRVIGGDYHYTAAGQLAQHEDTSTVQLSVDLFRGRWGDDGEWMLGIVGGYSDNQGDSRSSMTGTRADNQNHGYAVGLTSSWFQHGKQKQGAWLDNWLQYAWFSNDVSEHEDGTDHYHSSGIIALLEAGYQWLPGRGVVIEPQAQVIYQGVQQDDFTAANRARVSQSQGDDIQTRLGLHSEWRTAVHVIPTLDLNYYHDPHSTEIEEDGSTISDDAVKQRGEIKVGVTGNISQRVSLRGSVAWQKGSDDFAQTAGFLSMTVKW

SEQ ID NO: 8667 - protein, 376 aa, Escherichia coli
MKVKVLSLLVPALLVAGAANAAEVYNKDGNKLDLYGKVDGLHYFSDNKSEDGDQTYVRLGFKGETQVTDQLTGYGQWEYQIQGNTSEDNKENSWTRVAFAGLKFQDVGSFDYGRNYGVVYDVTSWTDVLPEFGGDTYGSDNFMQQRGNGFATYRNTDFFGLVDGLNFAVQYQGKNGSVSGEGMTNNGRGALRQNGDGVGGSITYDYEGFGIGAAVSSSKRTDDQNGSYISNGVVRNYIGTGDRAETYTGGLKYDANNIYLAAQYTQTYNATRVGSLGWANKAQNFEAVAQYQFDFGLRPSVAYLQSKGKNLGVINGRNYDDEDILKYVDVGATYYFNKNMSTYVDYKINLLDDNQFTRDAGINTDNIVALGLVYQF

SEQ ID NO: 8668 - protein, 863 aa, Escherichia coli
MHQSGSVSLCRSAISVLVATALYSPIALASTVEYGETVDGVVLEKDIQLVYGTANNTKINPGGEQHIKEFGISSNTEINGGYQYIEMNGTAEYSVLNDGYQIVQMGGAANQTTLNNGVLQVYGAANDPTIKGGRLIVEKDGITVLAAIEKGGLLEVKEGGLAIAVDQKAGGAIKASTRVMEVFGTNRLGQFEIKNGIANNMLLENGGSLRVEENDFAYNTTVDSGGLLEVMDGGTATGVDKKAGGKLIVSTNALEVSGTNSKGQFSIKDGVSKNYELDDGSGLIVMEDTQAIDTILDEHATMQSLGKDTGTRVQANAVYDLGRSDQNGSITYSSKAISENMVINNGRANVWAGTMVNVSVRGNDGILEVMKPQINYAPAMLVGKVVVSEGASLRTHGAVDTSKADVSLENSAWTIIADITTTNQNTRLNLANLAMSGANVIMMDESVTRSSVTASAENFTTLTTNTLSGNGNFYMRTDMANHQSDQLNVTGQATGDFKIFVTDTGASPAAGDSLTLVTTGGGDAAFTLGNAGGVVDIGTYEYTLLDNGNHSWSLAENRAQITPSTTDVLNMAAAQPLVFDAELDTVRERLGSVKGVSYDTAMWSSAINTRNNVTTDAGAGFEQTLTGLTLGIDSRFSREESSTIRGLFFGYSHSDIGFDRGGKGNVDSYTLGAYAGWEHQNGAYVDGVVKVDRFANTIHGKMSNGATAFGDYNSNGAGAHVESGFRWVDGLWSVRPYLAFTGFTTDGQDYTLSNGMRADVGNTRILRAEAGTAVSYHMDLQNGTTLEPWLKAAVRQEYADSNQVKVNDDGKFNNDVAGTRGVYQAGIRSSFTPTLSGHLSVSYGNGAGVESPWNTQAGVVWTF

SEQ ID NO: 8669 - protein, 186 aa, Escherichia coli
MNVSKYVAIFSFVFIQLISVGKVFANADEWMTTFRENIAQTWQQPEHYDLYIPAITWHARFAYDKEKTDRYNERPWGGGFGLSRWDEKGNWHGLYAMAFKDSWNKWEPIAGYGWESTWRPLADENFHLGLGFTAGVTARDNWNYIPLPVLLPLASVGYGPVTFQMTYIPGTYNNGNVYFAWMRFQF

SEQ ID NO: 8670 - protein, 746 aa, Escherichia coli
MNKKIHSLALLVNLGIYGVAQAQEPTDTPVSHDDTIVVTAAEQNLQAPGVSTITADEIRKNPVARDVSEIIRTMPGVNLTGNSTSGQRGNNRQIDIRGMGPENTLILIDGKPVSSRNSVRQGWRGERDTRGDTSWVPPEMIERIEVLRGPAAARYGNGAAGGVVNIITKKGSGEWHGSWDAYFNAPEHKEEGATKRTNFSLTGPLGDEFSFRLYGNLDKTQADAWDINQGHQSARAGTYATTLPAGREGVINKDINGVVRWDFAPLQSLELEAGYSRQGNLYAGDTQNTNSDAYTRSKYGDETNRLYRQNYSLTWNGGWDNGVTTSNWVQYEHTRNSRIPEGLAGGTEGKFNEKATQDFVDNDLDDVMLHSEVNLPIDFLVNQTLTLGTEWNQQRMKDLSSNTQALTGTNTGGAIDGVSATDRSPYSKAEIFSLFAENNMELTDSTIVTPGLRFDHHSIVGNNWSPALNISQGLGDDFTLKMGIARAYKAPSLYQTNPNYILYSKGQGCYASAGGCYLQGNDDLKAETSINKEIGLEFKRDGWLAGITWFRNDYRNKIEAGYVAVGQNAVGTDLYQWDNVPKAVVEGLEGSLNVPVSETVMWTNNITYMLKSENKTTGDRLSIIPEYTLNSTLSWQAREDLSMQTTFTWYGKQQPKKYNYKGQPAVGPETKEISPYSIVGLSATWDVTKNVSLTGGVDNLFDKRLWRAGNAQTTGDLAGANYIAGAGAYTYNEPGRTWYMSVNTHF

SEQ ID NO: 8671 - protein, 357 aa, Escherichia coli
MKRKVLAMLVPALLVAGAANAAEIYNKDGNKVDFYGKMVGERIWSNTDDNNSENEDTSYARFGVKGETQITSELTGFGQFEYNLDASKPEGSNQEKTRLTFAGLKYNELGSFDYGRNYGVAYDAAAYTDMLVEWGGDSWASADNFMNGRTNGVATYRNSDFFGLVDGLNFAVQYQGKNSNRGVTKQNGDGYALSVDYNIEGFGFVGAYSKSDRTNEQAGDGYGDNAEVWSLAAKYDANNIYAAMMYGETRNMTVLANDHFANKTQNFEAVVQYQFDFGLRPSLGYVYSKGKDLYARNGHKGVDADRVNYIEVGTWYYFNKNMNVYTAYKFNLLDKDDAAITDAATDDQFAVGIVYQF

SEQ ID NO: 8672 - protein, 966 aa, Escherichia coli
MHSWKKKLVVSQLALACTLAITSQANAANYDTWTYIDNPVTALDWDHMDKAGTVDGNYVNYSGFVYYNNTNGDFDQSFNGDTVNGTISTYYLNHDYADSTANQLDISNSVIHGSITSMLPGGYYDRFDADGNNLGGYDFYTDAVVDTHWRDGDVFTLNIANTTIDDDYEALYFTDSYKDGDVTKHTNETFDTSEGVAVNLDVESNINISNNSRVAGIALSQGNTYNETYTTESHTWDNNISVKDSTVTSGSNYILDSNTYGKTGHFGNSDEPSDYAGPGDVAMSFTASGSDYAMKNNVFLSNSTLMGDVAFTSTWNSNFDPNGHDSNGDGVKDTNGGWTDDSLNVDELNLTLDNGSKWVGQAIYNVAETSAMYDVATNSLTPDATYENNDWKRVVDDKVFQSGVFNVALNNGSEWDTTGRSIVDTLTVNNGSQVNVSESKLTSDTIDLTNGSSLNIGEDGYVDTDHLTINSYSTVALTESTGWGADYNLYANTITVTNGGVLDVNVDQFDTEAFRTDKLELTSGNIADHNGNVVSGVFDIHSSDYVLNADLVNDRTWDTSKSNYGYGIVAMNSDGHLTINGNGDVDNGTELDNSSVDNVVAATGNYKVRIDNATGAIADYKDKEIIYVNDVNTNATFSAANKADLGAYTYQAEQRGNTVVLQQMELTDYANMALSIPSANTNIWNLEQDTVGTRLTNSRHGLADNGGAWVSYFGGNFNGDNGTINYDQDVNGIMVGVDTKIDGNNAKWIVGAAAGFAKGDMNDRSGQVDQDSQTAYIYSSAHFANNVFVDGSLSYSHFNNDLSATMSNGTYVDGSTNSDAWGFGLKAGYDFKLGDAGYVTPYGSISGLFQSGDDYQLSNDMKVDGQSYDSMRYELGVDAGYTFTYSEDQALTPYFKLAYVYDDSNNDNDVNGDSIDNGTEGSAVRVGLGTQFSFTKNFSAYTDANYLGGGDVDQDWSANVGVKYTW

SEQ ID NO: 8673 - protein, 351 aa, Escherichia coli
MKKSTLALVVMGIVASASVQAAEIYNKDGNKLDVYGKVKAMHYMSDNDSKDGDQSYIRFGFKGETQINDQLTGYGRWEAEFAGNKAESDTAQQKTRLAFAGLKYKDLGSFDYGRKLGALYDVEAWTDMFPEFGGYSSAQTDNFMTKRASGLATYRNTDFFGVIDGLNLTLQYQGKNENRDVKKQNGDGFGTSLTYDFGGSDFAISGAYTNSDRTNEQNLQSRGTGKRAEAWATGLKYDANNIYLATFYSETRKMTPITGGFANKTQNFEAVAQYQFDFGLRPSLGYVLSKGKDIEGIGGEDLVNYIDVGATYYFNKNMSAFVDYKINQLDSDNKLNINNDDIVAIGMTYQF

SEQ ID NO: 8674 - protein, 308 aa, Pseudomonas putida
MIRARRPLPSHSVSVEAKQRKPRAPQSDAAGDWARFFPRHVVRQLQQFAFMLLNGTVPGAPKGNNTRMKKILILTACIGALCAAAPSFGTDLAGQPVKVKAAPLPVAAPIIDWSGYYMGANGGWGTSHNCWDFNGITSEGCHNSTGGTVGGQIGYRWQIFNMVYGLEGQGNWADFRGSNVSTAFPTDTVGTTTDAFGLLTGHIGYAFNAVLLYGKGGAAVTSNTYYVNSVATGTELGKNNDVRWGGVLGAGAEVSLTPNWSAGVEYNHLFMQRSNISFPAALGADRAHQDVDLITARLNYKFGWPFAR

SEQ ID NO: 8675 - protein, 453 aa, Pseudomonas putida
MKIASVLALPLSGYAFSVHATQVFDLEGYGAISRAMGGTSSSYYTGNAALISNPATLSFAPDGNQFELGLDVVTTDIKVHDSHGAEPKSSTRSNNRAPYVGPQLSYVAQLDDWRFGAGLFVSSGLGTEYGSKSFLSQTENGIQTSFDNSSRLIVLRAPIGFSYQATSKLTFGASVDLVWTSLNLELLLPSSQVGALTAQGNLSGGLVPSLAGFVGTGGAAHFSLSRNSTAGGAVDAVGWGGRLGLTYKLTDNTVLGAMYNFKTSVGDLEGKATLSAISGDGAVLPLDGDIRVKNFEMPASLTLGLAHQFNERWVVAADIKRAYWGDVMDSMNVAFISQLGGIDVALPHRYQDITVASIGTAYKYNNDLTLRAGYSYAQQALDSELILPVIPAYLKRHVTFGGEYDFDKDSRINLAISFGLRERVQTPSYLAGTEMLRQSHSQINAVVSYSKNF

SEQ ID NO: 8676 - protein, 426 aa, Pseudomonas putida
MKKVMLKSTISLAVALASTQLFASGFALNEQSISGMGTGFAGRSSSAEDASTVYGNPAGMSLLQRDQVTVGVAAIDAKTNLKNVKGGPPGGTSDGDMVPFTSVPMGFFVKQLGNGWALGLGAYAPFGLVTNYESTSASRYYGDKSVVKVVTLQPTVSYAFNDMVSIGFGPTINRLSGELTSATPFPNPALFGRNDGSVKIKGDDTAIGYNVGIIVQPTDTTRLGLTYHSKVKYKLEGHTNIAGPGFGPFNGGRYDASLDITTPEVVDFSVTQKLDDQWTVYAGSTWTRWSRLKDITVNNEGVPALLGGSRGPIGTITEPQNWHDTWASAVGVSYKVNKEWVLRSGLSVDQAPTNNTDRSVRIPTGDRKAISFGAGYSPTEDLTLDLAVSYLKEEDVNVNRTGKGNAYSATYQNSAWGYGLGATYKF

SEQ ID NO: 8677 - protein, 712 aa, Pseudomonas putida
MKFTFFLMLGTSALALSAGVATAQDAVDLGEIIIQSEEDPTGPVVGYAAGTTASTKSGRSLLETPSSVTVVTTDQIEDTAANNLSEALGYAAGVVTEAYGADPRFDSISVRGADLQNQIYLNGLQFSRSTRPNYGAPSLDLYGMERVELLRGPNSVLYGAGSPAGLVNLIQKRAQSDGDTTELGLHADGNGSHYVFGDANRVVDDRFAYRIVGKAGNRVLGIDEYDNPGAYLGFAAKYQATDATTVEFLLSYQDDDPDSPSGVPNGLVGTRSDEDLRDFYFGNEALEYGDRKVLNLGAQVTHTFDNGWRLVSNTGVTKFDWSYSNLFVGGVTGTDVARTQLLQDEDVTSYATDLRLEGSALTGDVLHNLAFGIDASRFEETALSVFYYGQDSIDFAAPDYSPITPVRDGASWYANKNVTVEQVGIYASDEIEYGNWRAGLALRHDRNKSEGQSNTLYTVPGSGGTPGTVDLTRDDSATTGQASLGYVWDNGVSAYLSYGTSFQSFAEPGDTGTALDPTTGEQWEVGAKYLPATLDAYLSASVYQLEEKNRPVYVQNGAGVRAYDQVGKSRIRGLELEGRANLADGWSVTGGYSYTDSEIIGGDNNGNELGLTPKHTFKLWASKEIQGGPLAGLTVGAGARFIGERYAFNANANQLDSVTLLDAAVSYDFDDGTELQVNVTNLTDEAYVSSVGYFSTYYGDGRTISATLSKKW

SEQ ID NO: 8678 - protein, 379 aa, Pseudomonas putida
MSRSPVKDLTVLSRWRYSWRILDDNEAQKMKKTAIAIAVALAGFATVAQAAPKDNTWYTGAKLGWSQYHDTGFIPNNGPTHENQLGAGAFGGYQVNPYVGFEMGYDWLGRMPYKGDNINGAYKAQGVQLTAKLGYPITDDLDIYTRLGGMVWRADTKANVPGGASFKDHDTGVSPVFAGGVEYAITPEIATRLEYQWTNNIGDAHTIGTRPDNGMLSLGVSYRFGQGEVAPVVAPAPAPAPEVQTKHFTLKSDVLFTFNKATLKPEGQAALDQLYSQLSNLDPKDGSVVVLGYTDRIGSDAYNQALSERRAQSVVDYLISKGIPADKISARGMGESNPVTGNTCDNVKQRAALIDCLAPDRRVEIEVKGIKDVVTQPQA

SEQ ID NO: 8679 - protein, 1244 aa, Pseudomonas putida
MSGFIAVTSPENVHASDVGNILPYQTYRDFAQNRGVFQPGASNITLYDKNGNPAGVLDKVPMMDFSSVDKLGIATLVNPQYVVSVKHNGGYQSVRYGNYTYTIVDRNNHWGLDFHAPRLNKIVTEVIPSEMTHAGTVNNIYNDKTRFPVFYRMGSGTQYIKTPSGKLQQIAGGYSYLTGGTVGSLHSYQKGEMISTSSGQIYNIANGPMATYGEAGDSGSPLFGWDTTINKWTLVGVLTSGNGAGGNGNNWAVIPVNYVKGILAQDSDPAVNNTSSEKILWNFDSQTGTGSLTQGSQRWDMHGSVNGTNLNNGKNLTFLGSDGQMMLNNAVDQGAGTLTFDANYTVSPSTNETWKGGGIIVNDDHTVDWQVNGVKGDNLHKLGTGTLKVNGTGVNPGGLNVGEGTVILAQRPDSDGNVQAFNIVDIVSGRPTVVLSDDKQVNPDNIIWDYRGGKLDINGNSLTFHQLNGADDGAILTNSGKQATVNLDFNKPNATTTVANIWHGHFTGNVDVSNAATTSTQNDFVMDGGMNIQGSFTQQNGRLFIQGHPVIHAASSQAVANKLKTFGDNSVLTQPVSFTQSDWENRQFSMTQLNLNNADFSLARNASLSTLINADHSTVTLGSENLYIDLNDGNGAKTTPSFGQSKATNAADQSRFSGRVQLKNGSTLNINEHFVGGIDSADSSVTVASTDALFSQYSRFRHSSLSLADGAKLTVTSGLASDRGVTAGAGSTLSLLSGQYAAERWSLAGQGTTLNVAAGATLAGNIQADNVASINFGVTDQIGSVIRVTGYRGNINAPLADVTMTNIGWQADSGSTVKSLDLKGSQVSFNQTGGPGSLTVDDFVASNSQFIVNTDGKTADTVTVKQSLTGKNNVLTVVPTALPVNNEVSSVPLVTAPKSTSADVLTLNPVTQHAGFHTFTPQVGIVESEDSKQWLLEGFDVQQDKALLQSGKSFMDMEYKNFLTEMNNLNYRMGDLRNTLGESGTWARIFSGTGSAEAGYSDSWTHLQIGADRKHTFDGADLFTGVTATFTNSNRHGDGWSGQTKSTGVGVYTSVMFDSGLYVDAIGKYVRHDNHYSVSEMGMPEQDYNSHSWYLGAETGWRFFLPGETFIQPQTELVYGKASGNQFAWQSAGSDIRMQRDQMKPLIGRTGVESGKTFRGKDWELMTVAGVHYQYDLFNPSKTVVHDFAGDTYIRNGKDNRVNFSLGVNTRIKENTRISLNIERSAFGHYDIDKAINANIRYSF

SEQ ID NO: 8680 - protein, 227 aa, Pseudomonas putida
MNKSLLGASLVALALAAPAAHAYQAGDMILRAGAITTAPNESSGDLKFDGNKVSGTKATLDSDTQLGLTFAYMLTDHIGLELLAATPFKHTVGVKGLGGGLDGKLADIKQLPPTLSLQYYPMEPNSRFQPYAGVGINYTLFFDEDLSSARKEQGFSNLKLQDSVGIAGQLGMDYMLTDNLLVNASVWYVDIDTKASVNGPTALGYSKTKVDVDVDPWVYMVGLGYKF

SEQ ID NO: 8681 - protein, 842 aa, Pseudomonas putida
MSISDRRRGHHAVSLHLSLPRAALPRPIATAIALALCGLTVLATSPAAAAQDAQTASAARQRYSIPAGPLAPALRSLAGSANLLLSFTAAQTDGRTTAGLDGDYTAAGALTAVLAGSGLQAVPLQTGGYVLRPAPAAVTSQGEVDAWLLPTVKVTAQAERRAATSGTGSYTARAVSIGRGEQRLKDIPQSISVVTRQLMDEQNITSVYDALASTTGITIVQSPQGGKYIYARGFDITTVQYDGVPLNRGMYGRASNYSANMGIYDRAEVLRGAAGLLQGAGNPSGAVNLVRKRPLDVPGVSVMLQAGSWDRYGALLDASANLTDDGALRARGVIDYQDQRSFVDGVERRTPTYYGTLDYSVSPQTQVSLAASYEEFEGRPFFGGLPSYTDGRDIGLPRSTNLGAQWNRQSSSNRGLYLDLDHRFNADWVFKLSAVQVHERHNLKYASSSRAINPANGTGALLAARTISEADVAGVDANVIGHFNALGRRHELVLGSNYAETTVDTVYGNKNNFQTFNVFSLQRNVRAISDEEIFASAREARHGTSRELGLYSALRWQLTDPLKAIVGARVSWHDTRWNTTTTGLSPSQSIEHTRETGQVTPYAGLLYALTPTWSAYASYADIFQPQNAQNEAGDMLKPMTGANYELGLKGEWLDGRINTAFALFQVEQKNRAQADLSTSPTCRNNDFCYIDTGKVRSRGFDAEFSGEVLRDWNLFAGYTFNRTTYLQDVSSQGQTFNSYTPKHLLRVWTTYRLPGVLQDVTVGGGVSAQSAAYRQIGAATADIPGRAVWNALARYQVNRQWSLAVNLNNVFDKRYYSTLSSFVNGRYYGEPRNVMVTLRGAL

SEQ ID NO: 8682 - protein, 429 aa, Pseudomonas putida
MLSSQPQAFAPTRSFIARPSAIASALALAGVAPMSQAAFFEDSTATFETRNMYFNRDFRDGTSAQQSKRDEWAQGFILNFESGYTDGTVGFGLDALGMLGIKLDSSPDRTDSGLLPTHDDGKAADEYSKLGLTGKVKISQTELKIGTLIPELPTLQPNDGRILPQTFEGGLLTSKEIKGLTFTGGRIDKAKDRNDTNWEDLALNNKNGRFGGTFSADNLALGGLDYQFTDRITGSYHFAQLDDIYRQHFIGMVATQPWGPGTLGADLRLAMSDDAGAAKAGNIDNTTVNGMLSYALGGHKVSAAWQQLSGESAFPYVDGADPYLVNFVQINDFAGADERSWQARYDYNFAALGVPGLTFMTRYISGDNVSRAAGGEGKEWERNTELKYVVQSGPLKNVAVRLRNATFRSNFARDADEVRLLVSYSVALW

SEQ ID NO: 8683 - protein, 261 aa, Pseudomonas putida
MFSLKGTVMKTALLASVAMLFTSSAMAADIIVAEPAPVAVDTFSWTGGYIGINAGYAGGKFKHPFSGIEQDGAQDFSGSLDVTASGFVGGVQAGYNWQLANGLVLGGEADFQGSTVKSKLVDNGDLSDIGVAGNLSGDESFVLETKVQWFGTVRARLGFTPTERLMVYGTGGLAYGKVKTSLSAYDDGESFSAGNSKTKAGWTLGAGVEYAVTNNWTLKSEYLYTDLGKRSFNYIDEENVNINMENKVNFHTVRLGLNYKF

SEQ ID NO: 8684 - protein, 685 aa, Pseudomonas putida
MLCSPLRLSPLAAALWLASTSSQAVELQPQVITANPLGSTQLAAPSTVLEGDALLQQQHGSLGETLNKQPGVASTWFGPGASRPVIRGLDGDRIRILRNGVGALDASSLSYDHAVPLDPVNVERVEIVRGPAALLYGGNAIGGVVNTFDNRIPDSPIDGIHGAGELRYGGADTTRSSAGKLEAGNGAFALHLDANSRQFNDLRIPGYARSAKVRDADEPGSKHRLENSDGRQDGGAIGGSYHWEHGYTGLSYSRYDSNYGSVAEPGVRLDMQQDHYGFASELRDLDGPFSSVKVDAGYTDYQHREIESGEVHTTFKNKGYEARIEARHQPLGPVEGVIGAQVSRNEFSALGEEAFVPYTDTDSLALFLLEQWQATERLNLSLGARLEHTRIDPDAKGNETFADADSASSFNAFSLSSGAVYQLDSVWALAANLGYTERAPTFYELYANGAHVATGAYEVGDPNLNKEKAISGDLALRFDNGTHKGSVGVFYSHFRNYIGLIGTGNLRGGHDHDHGDEDHDHDHDHGHDHGEFPEYAYQGVRARFYGIEAQDRWQLLENRYGSFALELSGDYTRAKNLDSGEPLPRIAPLRLNSGLVWELDRWQARVDVQHASAQHRKPANETSTEGYTTLGASVGYRFDIGQSQWLAFVRGENLTDQTVRYASSILRDIAPAPGRSVEVGLRTTF

SEQ ID NO: 8685 - protein, 1042 aa, Pseudomonas putida
MNSKLRFLLISLFIFFVAALQASADGDIRVSGVVMSEGEPLPGASVLVKGTHNGTVTDVDGKYTLTVPADGTLVFSFIGLKTTEQKVNGRTVVNAELLPDSEQLDEVMVVAYATAKKYSFTGAASTVKGSEIAKMQVSNVSRALEGTVSGLQASAPSGQPGTDAEIRIRGIGSINASSAPLYVVDGVPFDGSINSINPEDIASLTVLKDAASAALYGSRGANGVIIITTKQGHTDSKTTVSINASFGGSNRAIRDYDRVGTNQYFELYWEALRNQYALNSDKYTPQTAAAQASKDLVGKLMGGGPNPYGPNYPQPVGTDGKLLAGATPLWNVDWQKEMEQQALRTEVGLNVSGGGKTNQYYFSAGYLNDKGIALESGYQRFNLRSNISSEITRWLRGGVNMSYAHSIQNYPVSSDAKTSNVINAGRLMPDFYPVYEMNADGTYKLDSEGKRIYDFGSYRPSGATANWNLPATLPNDKSERMRDEFSGRTFLEVTFLEGLKFKTSFNFDLIDYNTLDYTNPKIGPAVNTGGGASREYTRTFSWTWNNIVTYDKTFGEHHFNILAGQEAYSYRYDVLQAARSNMAVPDMPELAVGSLVTAGTGYRIDYSLLGYLINAQYDYRSKYFFSASYRRDGSSRFAPGTRWGNFWSLGASWRIDREAFMQNTADWLSALTLKASYGAQGNDNLGTYYASSGLYSIVSQAGENALVSDRLATPDLKWETNLNLNVGIDFSLFDNRFSGSFDFFQRRSKDLLYSRPLATSLGYTSMDENIGALKNTGFEIDLKGTLIHTRDFMWRMGVNLTHYKNVVTDLPLKDMPVTGVTRLKEGRSVYDFYLREWAGVDSDNGDPLWYKNVKDEQGNITGRTTTNDYAQADYYYVDKSSLPKVYGGFNTAFSYKGFELSAIFAYSIGGYIVDRDITMLWSNGSNPGRAWSTEILKRWTPENRYTDVPALKTVSNNWNSNSTRNLFNNSYLRMKNITLSYNFPQPLIKKISLNSLQLFVQADNLLTFSKNQGLDPEQGITGLTYYRYPAMRSISGGLNVSF

SEQ ID NO: 8686 - protein, 207 aa, Pseudomonas putida
MPLPDFRLIRLLPLAALVLTACSVTTPKGPGKSPDSPQWRQHQQDVRNLNQYQTRGAFAYISDQQKVYARFFWQQTGQDRYRLLLTNPLGSTELELNAQPGNVQLVDNKGQRYTADDAEEMIGKLTGMPIPLNSLRQWILGLPGDATDYKLDDQYRLSEITYSQNGKNWKVVYGGYDTKTQPAMPANMELTDGGQRIKLKMDNWIVK

SEQ ID NO: 8687 - protein, 683 aa, Pseudomonas putida
MPSFRFFFSASLFSLILCSVVFGVDATAVTTSTDHSLPLSLGKIQVEGTHDGATLVDSKLGSVDVLSDDLLQGQHVDYTWEVFMRAQGVQVTQFKMGTESGRISFRGFNGEGRINAIKLLIDGIPSNDNAGGMPYLDAISPLGMSAIEIVRGTNDPRYGLNAIAGHVDVITRSGGNDGLLSVTTGDFGTRKIQWVKGIERAAWSQNYVVSWLDSDGYRDHARAIKRAVSGKWGYADPRDAWRAGLSVRYFHNDAQEPGYLTYDAAVADPRSSPAYSGQDHSQRQTVQTALHLDGRMSEAFHWTAKSYINRYTNDRVVKFTAASARQERYTDETHRGVLTNAIWRPSVDWAYEFSIEGGVDAQWQSNVSRRYRMLDGQRGTVLRDWDFDLDTYGAYLQSMIRVNDSLKLVSAYRVDRIDGRFIDIASGLRYPVYRYGTIQQPKFSVSYDVSQDVTVYANWGRTFQIGSGNGAYRTQADDLAPSMNDGWETGLTFKPWSWANARLVYWQQRASGEVATLLGTNGAIAINEVGNLGKTLRNGWDAQLNLQPDEQWRVWLGYSRQEAEIAIPDPSVPATRGKQIENVPRWLTNVGAEWQVLPKLKLSAWGNGQGNYYVERTNTLGRYGRYFLSNLSATWLLSNKSELTLQLNNVTNRFYVYAWYDSGLSGYSPGDGRALYLTWNLTF

SEQ ID NO: 8688 - protein, 343 aa, Pseudomonas putida
MKLKNTLGLAIGSLIAATSIGALAQGQGAVEIEGYAKKQYFDSDRNFKNDGILPGGSIGYFLTDDVELRLAYDEVHNARANDGKNVKGANTALDALYHFNNPGDMLRPYVSGGFSDQSIDQNGSNGRNRSTFANVGGGAKLYFTDNFYARAGVEAQYNIDQGNTEWAPSVGLGVNFGGGSKPAAAPVPAPEVCSDSDNDGVCDNVDKCPDTPANVTVDADGCPAVAEVVRVELDVKFDFDKSVVKPNSYGDIKNLADFMKQYPSTSTTVEGHTDSVGPDAYNQKLSERRANAVKQVLTNQYGVESSRVQSVGYGESRPVADNKTEAGRAVNRRVEAQVEAQAK

SEQ ID NO: 8689 - protein, 980 aa, Pseudomonas putida
MSGAVVHLVNEGIGFESNRRTDDQGTAQWGGLSTAGAYSVFIEENDQFYEARVSDVELRADATRSVTLVLRPVAAYELDEVVVEGGRSVADVNRVNAEVSSSLSAATLEDLPVEGRNFTQSLYRLPNVTPSTGFFAEAPNVTINGTNGLYTQYLIDGMDNNEQFLGGPQFDVPTGIVKDVTVLTSTYSAEYGRTGNGIFNVTTKSGSNQWTGEAFYLTRPGQPLDGEFGADTPTQRDLSGNTVKSGFQRQQGGFALGGPIVEDQTFFHVNVEHTTDFKDNRLDAPGVRQTIDGRNHLTYASARVDHRWNDRWRSTARLNANRVQIENQGGGLTGGVTFASAASTEERDGVHAALQNTYVGDKLVYESNFQYSWFNWDAGNPRNPSSPQVDVEGPGGTLRARLGHPGFTFDSVENTFQLQQKVSYSLGDHNLKAGADLLLSDHSLAGGGNPNGNYTVQLTQSQFDRFRSANLDPSLTPAELHGALGVDAQALDVTRYRVELRPSSFGTRQDLIGLYVEDEFSPLSDLTITAGLRWDYDSLSEATLGREHGDWNNIAPRLGLNYSLDERTTLRGGYGIFYDKIVYSVVSDALQVNTNTDGFRAQIAELVDQGRLPSGTNVEEVTFNGNRTLGATPPPDYLEGPTASTVEATPTDVLSQAQILNPNGYENPETHQFSLGVQRQFGDDLLAYVDLTHTRTYNLYRIRDLNAPAPFEITEDDLEDVLNDPERDPSDLVRSVAEANEARPVAPRPGGARRITMTETKGEARYWAANVNLVKDRADDLYSYRVSYTLSSRRNNTDDINFRAEDANDFEDEWGPSVNDRRHVISAVGTVYPTDRLRVTLASLLQSGQPINRVPNACDPGKGSEGEICFGTRDLNGDGTYRGGQYVGDSDRFPGAERNTDRLPWSTRFDLSLQYGWSIGAGRVVARADVFNVLNTKNLSGFANNATQSNQIQVGPPGADIEEKNAGPPRQFQFGLRYEF

SEQ ID NO: 8690 - protein, 744 aa, Pseudomonas putida
MQCRTSPNSLALAFVALASPAMMATAAEAEEQRAGEVLEVPVADNALVIQDTLITAEREARQALGTSIITAEDIKRHPPANDLSDIIRREPGVNLTGNSASGARGNNRQIDLRGMGPENTLILIDGKPSSARNAVRYGWNGDRDTRGETNWVPAEAVERIEILRGPAAARYGSGAMGGVVNIITKRPSDELKGSVSLYTQLPEDSAEGASRRANFNLGGGLTDNLGFRLYGGLAKTDADDLDINAGHATSALVAGREGVRNKDINGLLSWKLNDEHRLEASAGYSRQGNIFAGDTMNSNGGGDVDFVSSLYGHETNVMQRSTYDLTHLGDFTWGTSKTTLAYEYVRNWRLNEGLAGRTEGAPSDEGGAMSRLRNTRLSSEVNLPFAMGSTEHVLTLGGEYLYEALNDQGSLRPQSSDPTSNGGLVGFDRSSSKMTARSYALFVEDNIIVGDTTITPGLRFDHHETFGDNFSPSLNLSHKLTEALSVKGGIARAYKVPNLYQSNPNYLLYSRGNGCSVQQTNNGGCYLQGNADLKPEISVNKEIGLQYDRGTWRTSATYFRNDYKNKIIGDTDVLYTIGTGSRVTQWDNAGKARVEGIEGNLFIELTPTLDWNTNLTWMLDNDNRETGEPLSVIPEYTVNTTLDWRATEQLSFQVAGTYFGKQKSPTYNYRTQQDYDKTAQQDVEAYGLVDVSAGYKFNANYDVRVGVNNVFDKQILRGGNASSSGANTYNQPGRAVFAALNINF

SEQ ID NO: 8691 - protein, 361 aa, Pseudomonas putida
MDRFGLGIDDTFSTYIGKRNTEGGPRASSIEHNAFRLVVGTEGEINDNWTYDFSMQYGSTSSSEAYLNDFFGPRIKTALSANDESCAATAGCIPYEVFTYQGISQESAKALTGVAVKNGVTEQIVIGGYVTGELDLTVPSADAPIAVVLGSEYREENYERITDEVYAQGLLLGQGGATKSLTGGYDLTEFYGEASIPLVSGAPMVEQLTMELGYRYSDYSTTGGVDTYKVAFDWTPMDDYKVRASYNRAVRAPNVAELFSEQSKGLWGGNDPCAGASPQLKQEECARTGVSAAQYGNVSKSPANQYNGLFGGNPDLQPEVADTMSFGIVAQPIDNLNFSIDYWDIELEEVIGSVGPELLPG

SEQ ID NO: 8692 - protein, 445 aa, Pseudomonas putida
MNRLLLALPLLGLAPLALADTAQSQSNGFLADSSWNLLNRSVFDQRDYKHGGRNSAARNAYKPRNERNGKAEEWAYGLMGTFQSGFTQGLIGVGVDAHAYLGVQLDSGGGRAGKARLLGVDNDGHPKNEYSRAGAALKLRVSDTVLSYGEQRVKTPVFSSSDSRLLPETATGFFLTSNEVDNLKLVAGHFNESTDRNASSHDQGFVVNYSNGRQGNSFDLAGAVWNPGAAFSGSLYTSRYEDSWNQHYLGSTLSHALDDQRSISLDLNLYRTTDTGKALSGRIDNTTWSLLSRYNQGPHSFSLGWQQVDGNTPFDYVTRGAIFIANAVQMSDFNAPNEKSWQARYDLNMGAYGVPGLNLVALYVRGFDIDGTHVDPNGGYAYLGYGKGGKHWERDLEARYVVQSGKAKGTTFSVRHNVHRGNTAQAELDGDQIRLAVEWPLSGGF

SEQ ID NO: 8693 - protein, 659 aa, Pseudomonas putida
MFSSAHFAPFLCEETMKLFQQLLVAPAALGLLAPVAANAAELNINGVSDYAASGEQVTSISQFSDVYPTDWAYQALSNLIERYGCVAGYPNGTYRGNRAMTRYEAAALLNACLDRITEVTDELKRLMKEFEKELAILKGRVDGLEARVGELEATQFSTTTKLKGKTTFVIGGSSFGGDAYVREQFGRNLFIGSKYGYDNAESFSYTDVNGKEKTFDNPFYYSGSKKVYKGRKMADVANQYLGAVTFNYDQQLDFLTSFTGKDLLKVKLRGGNFGPSAFGGASTGIPSFLGGQYSTQSTLETAFEGGATNNNVVLNRVFYQFPLGENFTVTAGGVVRQDDMLAVWPSAYPADTVLDFFTYAGAPGAYNLNLGQGAGIWWQNDGFSVSANYVSNNGNVSKATNGYSADYAVYSNGTDVYTVFQDSQDCTASGGIATDCAGGTGTVQLAYTDDNWGVAAAYNYSSQYASALNPATATPLASNITALGNTNSVGLSAYWSPEESGWMPSISAGWGLNSTSGADNDTYRISKNGGSYSKSKGYTNLFGYDFQSATTQSWSVGLQWTDVFLKGNTAGMAVGQKGFVTALDLSNNKFDFGYGNSNKAEERLVRDGQYAWEWWYMFQVTDNISVTPALFYMSRPLGSATQGVQFNQFGGLLKTTFKF

SEQ ID NO: 8694 - protein, 451 aa, Pseudomonas putida
MLQRFRPLLLSPILAIALSFSTFPLISQEKPEASKDQQPPKVAETKEVTSSGKEPSNTNVTNPNPTTTGTVTAPSENKSNWETGLGKGIRGTSNDGKHNIQLRFRSQLQGNQSFQIDPSQDTTNFLVRRTRLQLKAGLFNDTWLVNLQLGFAERDMESQRRNTLRDANIIYNQYRDVKVAFGQMKIPFSRQRWNSSSALQTVDRSSVTAEFNLDRDVGAYLFSEDLFGSKRMFAYYLGVFGGQGRNRVERQTPGVLTVARLTFSPFGGMSKSGSDNDWLSEVDFARYKDPKISFGVSGAYNKNSDRALSTHGTEYSFAKFNYSHAAGDIYFKWMGFSFQYEWLWRRANTAYVERTVSSALSREYSRSGQGHFVQLGYLFTNQYELVVRFGEFRPLGETDPNLKYSREVGGALSYYFAEHNLKWQTDYFYYTGTPTAAEGDHVVRTQIQVFY

SEQ ID NO: 8695 - protein, 358 aa, Pseudomonas putida
MKSTSNPLRFDSIFYAVSTSLLLATPVETIAYELQGDPTSPGFLQQPLAAQLSLDPLSASGLSLGTLNAFSQQMSERHRQAPPDLIASQWAQFFPTSARGRALPPAQLEAPSQQLMIGPDLFVRETAAGDVHRAGIFVGHNNLQSSFKGMRPLLGDKQRKAVNLSGESLGVYWSMTHEQGWHLDAVAMGSRIDVMGRGENGQRLDDSGHAMTFSVEGGYPIRLGGNWVIEPQAQLINQQFFPGNQVQEETLQAFDSQPSWSGRVGAKLSGRYEVRGMPIEPYVRTNVWYDFSNADEVKLDQVDKISSSRYSTTVELGLGLVARVTPSVAMFVSADYSSDVDDNDLNGLIGSLGVRMRW

SEQ ID NO: 8696 - protein, 524 aa, Pseudomonas putida
MRPVLKLFQQLLVAPAALGLLAPLAANATELNINGVSDYAASGEQVTSITQFSDVYPTDWAYQALSNLIERYGCVAGYPNGTYRGNRAMTRFEAAALLNACLDRVTEVTDELKRLMKEFEKELAILKGRVDGLEARVGELEATQFSTTTKLSGLATFVVGANNFSGTKSKADPANRDFGATTFNYDLQLSLETSFTGKDLLITILRSGNFGENSVFGGNPNGLSTLETAFQEDSGANSVGIDKLYYQFPVANSLTFTLGARVGQEDMLAVWPSAYPSDPILDVTTLNGAPAAYNKNLGPGAGVSWSTDSGFSISANYVAAQGSSSDPNAGGIGTEFSEASGTVQLAYESENWNIAAIWSGVQSPSELVGGFGTTFAADNYFSGRKAFMNAWGIGGSWQPQESGWIPSISAGYGYNALYAKNVGDVTTSQSWNLGLEWSDVFLKGNNAGMAVGQPVFATDLKGDEVPADGNYVWEWWYQFQVTDNISVTPALFYLSRPEGQNTDLNGGDDTLSQLGGLVKTTFKF

SEQ ID NO: 8697 - protein, 993 aa, Pseudomonas putida
MSVRGVVKDASNGDVLPGVSISIKGTTIGTQTDFDGVYSLANVKSGAVLVYNYLGYEVKEVVVNQETIDVLLSQATESLDEIVVIGYGTQSKKEVTGAVSVVSSATIEDLNPTRIEQALQGQVAGVNITQSSGSPGAGSNIRIRGVSTNGDSRPLILLDGRVIEDLSVVNPSDIESINILKDASAGIYGVRAANGVILVKTKSGRKNTDFQSILNISAGFQNTTREIPLLNATEYALLANEAYAANGEALPFATVSGLGQGTDWQNAVFETAPIYSIDYTLNKGTERSTYSLGLSVTSQDGIVGGSKANFNRRNIRFNFDTDLTDNLKFTSSTIYTNTNKKNLIENALGSILFNALNMPPTTSVRDSNGNFSLPPVIGTGIEVANPLAQIDNANNRTWVNKISGSYGLSYKFLDYFTAETRYQANYAVSTANTYNKVANFGNNNVFNVDLGTFTDFSQSFFDYTFDAFINYERVYNDVHSVKAMIGTSVFKTTGRFQTILTSNAEGDDLNSVIIGTPVLNGDGLEIFRNNNNGDNLVYDSRLLSYFTRLQYAYDSKYLFSAVLRRDGSTNFGPKNKFGFFPTASLGWVASEEDFLQDSDIISFLKLRASYGIIGNDRIPGFRFVSVLNGEAEYVFDNQLAQGIALGPIANPEIKWEEQKPLDIGVDLELFDKVNITMDYFKKTTEDLLVSAQTSGIIGVAAPGSSVPVVNAGTVVNSGFEFAIGYRESISEDFDFNVNYNFTTLDNNVTFVGNSTGIIEGGSFGVGQDPPSRMEAGFPIGYFYGYQTDGLFQTQADVNAHATQTNAAPGDLRFVDVNGDGVIDADDRTYIGDPIADVTMGLNLSFNYKNFDFNAYAFASLGNEIVRNYERTLPLTNRATYFLDRWTGPGTSNTVPRVTTGATGNNLFSDFFVEDGSFLRLQSVQLGYSVGDAALEKLQFNKLRFYVSASNLFTLTKYKGYDPTTSNGAPIGGGIDQGFYPSPRTFLFGMNVNF

SEQ ID NO: 8698 - protein, 749 aa, Pseudomonas putida
MPATIATRSHIASRPNMTTPYPFLIRALIAGMFSSAMGISYVYAEESAQAKNQPDGTQTLDTVHVKAAPIKHQQGLNIDKPSEAGSRLGLTIRENPASVAVASRQQMEETGARNFQDAANSLPGVNASAPPGHGGFVAYRGFTGAQVNQLFNGISLQYNSANRPVDAWVYDRVELVGGPSSFLYGSGSIGGSLNYVTKLATRDEEIREARISYARYDTMETALGLNHALNGNNWIRLDFSRNTSNGYIDRQQREADSLALSWLADITPELSHTLALEHHVEQEDSPYWGTPTLNPQAGRLKIDTSNRFANYNVADGRYEQRVTWARSITEYHFNAQTSLRNTFYHYTGQRDFRNLEVYRYNADNSAILRSGAYMQRHDQELNGNRVEILHKGALFGLQSDWSFGVDYNVNRQTVFPTSVSSVFDTVAPGNPDPGGFSDIPGMGNGLQKGRSTKTRTLSAFIENRQFLAQRLSLVTGLRYDHIDLHLDNNPGASPATVDRRWDAFTGRAGLVFDVTEDANLYAQYSTSAEPPGGTLTSASAAQVDNNFKLSTGYQVEVGSKLNYLDGRGTATIAAYHIVRRDFPVTDPQDRNNTIQVGQQTSNGIELATSLQITPKLHAEGNIAWTNARYDDFNEAVGTGVASRKGRHPINVPDQVANLRLHYEITPGWQAGIGARYVASVYANNANTMWVPSYTLFDVHTKYRVSKNADVVARIRNLTNETYARFIHQTNTQYYVGEPRSLEVALHVRF

SEQ ID NO: 8699 - protein, 636 aa, Pseudomonas putida
MFPRFLCSLSVLSLSIAAVHAADLDTPRLQGIDNFRDIAGITTAYSTTHDGTMRAGVFYRSNALTPTASDLATLNGLGIKAVYDLRTPSEIAGTPDTMISGATYQNIDIIGATTSGANITTVSFKSAADAIAMMQQTNRAFVSDAGMRGQLGVLFNELAGVDGAALFHCTAGKDRTGWTAAVLQSIAGVDDATIMSNYLATNDYTAARVAKTLAMMPPSMAAIYAPLLGVEASYLQAGLDQVSAQYGSMDNYLKQGLGLSQETIYVLRGKMVEYNSLPGQAGLIGNAAAGAQLLQELQNSKLSGTYSAYNYYLQSAIDAGTLSGVESTVGGQVHADAASYLLRQNAMIEQAAAPFASGTDLKVGQYRLWSTALAGYLGTDGSAHAQSSNEHSQGLMVGVTQRFSEQLSARGGIGYSKGSVGGAGGETDTDFTFLDLGARYGFTSLERGLFVDANISAGYVDYDSKRDLGGGLGSAKGDTHGNLSGATLALGYRMPMNDVVLEPSLGVRVSRLDLSGFQEKGSELALNVDDIQETRRSAVANLDVSFAPMSMGAWQLVPGVRVGYEHVLGDHQVDSEGHLLGLDIEQRAAFDNRDQFSGGVNLMANLGALSLGAEVGASGGGDSHGFSGGLKASYQF

SEQ ID NO: 8700 - protein, 659 aa, Pseudomonas putida
MPSPEPALPAFRRLRPAPSRPPALLRAPRMAPLTLAAALLPAPLLAADSSEAPATFRLPTQSVVSRQSTGSIEPASAAATVFTHDDIERLQVQSVPELLNRVPGVVMAQGGGRGALSGAFIRGANPGQTLVLVDGVRINSAASGVARLEFLDPGRIERIEVIRGPLASQYGADAIGGLIRIFTRRGEPGLRPRLRLAVGNRGAFEREFDLAGSDERTRFDLGASQVESQGFDRSSDNRGRDADHDGFRSRALDLTLEHRFADNLQAGLNLLDQRGESELDDVYSFRPGDPYERFVVSSVAAHLEIRPSEAWTSRIETGHFENRSENRDDHNLVNNHSFDTYRDSLAWFNTLRLDERRQLLLGAEWYEERLHGELDYDETRRWNRAAFVRHSYRGEGLGVEIGLRHDDNQRFGSEESWSAALTLDLARATELILSYAEGFHAPSFSELYFPPTPLYGGNPDLAPERSKSYEIQLRGEHRGTHWSLSAYRTEVDDLIVETSRPGNLSDRLENIDRARLQGLELALSRDILGWRAALAASLVDPRDRDSGHTLPRRARRNLSLDLDRRFGAFSAGIGWQAVSSRYEDDANEHGIAGYALLGLRGSWQMSEALKWQVKIDNLLDKEYSQVLYNRPDTPFYTSFGLHEFRQDGRSALLSLTWTP

SEQ ID NO: 8701 - protein, 577 aa, Pseudomonas putida
MPVNDPFGGWVYWSRLPTGAVERVVITRGGGAGAWGNAALAGTVRIETTPPAGSEAELSGGSDDTWQALAATAGRAGPVTLGLTANAFTTGGAPVVRRDRRGPVDVNADADALWADGVAQARFGSVAATAKLSVFRETRGNGTPYTGNRTEAVEGSLRLVGEGALPWEAVLYARDWEFSSTFSGVDDDRAGETPALDQYKVPASALGGIVQIGLEPVPGHSTDLGLDLRWTEGETRERYFFQNGGFTRERRAGGDQIIAGLFAEHVWTARPDLLLSAGVRLDGWWNRGGFRTEVVRATGAPLLDSRVPDRDGRVLNGRAGVDWQATDALALRGAVYTGFRLPTLNEFHRPFRVGNDITEANPGLDPERLAGGEVGLRLTPRPGLTLSATLFHVELEDAVDNVVLTRTPGAYAPLGIVVPAGGSLAQRRNLDRIEVDGIEAELRLEPRDDLSLSLSYLFSAAEIASAPGFPALEGNRVGQAPRHQGTVEATWRPLEPALLRLQVRAASDAFENSENDRRLSPYVVADLYAGWDLSRTLHLFGTVENLTDRLVETGVRSDGLTNIGPGRQWQVGLKARW

SEQ ID NO: 8702 - protein, 625 aa, Pseudomonas putida
MNTSTAGSKFPLEIDRVPQSIQVITEDAFQDQGAQSIGDIMKQMPSANVFGLRFGRFPSVTIRGFGTEQIRNGIQQLFFAGTDFSALSYIQNVEVLKGPGSVLFGQGGNGGGIINVVTKRPYDRLGAEVSFTRGGWTGFGGDITRGQWDINALLTPDGALKARFTGQVERSDTFINFQDLDRENFGLALTYDNGGPVRAFINAEYQHRETLPNPGLPAVGTVQGSDVGQVLRNTFLGEPKFDKLTVDAPLVQAWVEFDVLDNWNNIFKNWKVIPRYQYQQFNGSQDQVFLGATTVDPVNGDILVSRSGRTDFNEKDVIHIGQIDITGMIDTGPLTHQILLSGDYQNKRSPSDGNDNNKWFNRINVPAIDALNPAYLSSAPQINPNIVTFGQNYQVWAATFQDVVSITPYFDLMGGFRYTTASGGPRGNLVNRVRPGNNEVDNTSFQIGGTFHVTDSIHLFSGYGEGFNLNLAGQKADGSAFAPGEFDQVEAGIKADFPWGLRGTTSFFDITRSNVTTPDRQNPGFSVQTGEVRHRGAELELAYQVTPQWYFQGGYAFIDSDITQSNAGDEGNRFQNTPTHQGNVWTHYQFDRGLLRNLTLSSGVNFVGDRPLDNATTVELTNFTI

SEQ ID NO: 8703 - protein, 832 aa, Pseudomonas putida
MNRTNHRIALACAGLAALLPCLVRAQANPPTAAPAVADEVVELPQFVISEKRANPYLSGQALSTSRVAMLVQDIPQTVSVVTAEFMKDSMSFRMLDAAKYVTPVVESTLPWGGDRYTIRGFQVSQEFIDGSVISGGSGYSMSIPQFNLDRIEVIKGPNAILVPGGSPGGVMNPITKEPMSKDAASVTLNLAQYNGNDFGVDVNRVLNEQNKMAFRLVFGIWRNDQLYIKNHFRNGYEISPSFSVELSPVMKLVVKADFLQNRETNLAGLPIDPSVGSNQTAVIARGLPRDWSFGNSDDNRHRSTERLSAELRTTMGSHVTSRLYVMADHVRRIDPGGTGSALSTGTAAGRTGGGSRNPTTGMYEPGVNWSTVANGDGTVSAVSTAVPITDPSTWIYTRNNGKVDLEYEEAHLKNDYAAQFDGAWFKSTTLGGLAADFSKVRFLSWGAAPRGDVANNNLNAITYPPYVFPQIRPADFSLPNPTSVQSGGDLTSRQYTLQAFLFETFKAWNDRIQVSAGVSRFYGNLSRTDNTLTALNATILNTAPTYAITTNAKTLGLVIKPIKQISLFASRNTTGGAMPGELSAGTYLEKTTTFGPDAYHATPVTVQQFRPTSGSQDEFGVKTSALAGRLTASFAHFKISQQNYGVPNSEYYTLVAQGRQAEANLLQNPIYLDLASKGWEFEATYSPVKNLTILGNYTSFKERQPITDVRVRGVPDKAGALYLDYQFTSGPLTGFGINVGVEYKGDVAGENVNAYTTTMPIRGIGLVPQQPSFLVAGRTLVNIGFSYKRPNWSVRFMVANAFDKDYILAAGSRTSAVVGDPRNIKGSFTYTF

SEQ ID NO: 8704 - protein, 1088 aa, Pseudomonas putida
MNQTNKVFYTLVAIFLSCSIEMAGQVQKVISGTVTELFGKTAEPLVGVNVNLVNNQNRSLGGGITNLNGQYNVKVPEGEKDLTIVYSYIGMKTKRIKYTGQTLLNVTLESESMAVDEVVVSARRLNRNDLGISDKEMVSATQKVDMEKLIAAAPVVSIEEALQGQLGGVDIVLGGDPGSRSAIRIRGTSTLNASSDPLIVIDGVPYPTEISDDFNFSTATEEDLGALLNISPNDIASVEVLKDASATAIWGTQGANGVLVIKTKQGTVGKTRFSFSSKWTMKEDPSTIPMLNGKEYTSLMQESIWNSAKYIGLNNPGNKYLNMLSDAPAIGDNPDWRYYDEYNQNTNWLDYVRQKALVSDNSFSMNGGGEKATYRFSLGYMSDIGTTIGTSMNRLNTSMVINYQFSNKLKFGADFSYSQTNTDANWTNTIRSEALSKMPNKSPFTVNDLTGALTDEYFTYHDPNFEGSFNGKSNYNPVAMAHEAINRTVQREGKITFRADYEILPGFYYKGWASINMRAIKTRRFLPQVVTGVEQVNKYANQSADAYSDQLALQTENKLMYIKNWNDKHNIIANVLVRTGQYINSGYNSEVYGNASSDLSDPVVGTTISDMNSSESETRNVSFVGVLNYTLLNRYVVHGSLNAEGNSAMGRNERMGYFPAVGLAWNFQNEPLLEKARDKWLDEAKFRFSIGQSGRAPSGASVYLGAYVKGTDYMNMSATKQARMQLDNLKWETSTEYNYGLDASVLKGRLRFTFDYYYKTVKDLLQKNYKLPSTTSFGSISYFNSGKMENKGWEFRTDVVIFENKDWRINGYVNFSRNENKITELPANMVQENYSPKNGAYAARAEVGRPIGSFYGYRYKGVYQNTDATYARDAEGNVMNDAKGRPIVMKNLTATCQPGDAMYEDINHDGVINQYDIVYLGNANPTLTGGAGLTVKYKQFSINTFFHGRFGQSVVNTARMNNESMHGNANQSTAVLRRWKNEGDITDIPRALYGEGFNYLGSDRFVEDTSFLRLKQLTLNYAFPKSICNKLGITSLTCFVTGYNLFTWSSYTGQDPEVNLPSRPTDLATDGATTPVSRRYTFGFNLSF

SEQ ID NO: 8705 - protein, 829 aa, Pseudomonas putida
MKLNNVVSGVLCSSIAVCIAPSVQAQISITNIQINPTDRGIEIILETPPGADPPIFSGSFGTTFFAEISDAQLNLLTGGNFLQENPAEGIESIRVTQLPNNVVEITVIGRETLPIVNLNREDGGLVLSLDTSEPTPDTETEETQEGEDDEAIELVVTDDDREDDYYQPDEGGSTAVGTDTPLRDIPFSVQTVPEEVIRDQQVIRLDDALRNVSGVQQNSRDPRGQRFQIRGFDSSSVLRDGFRQTFGRFGNSGFQDLTNVERVTVLKGPASILYGASEPGGVINIVTKQPQEEAFYEVQFQAGNRGFLSPTIDLNSPLNADKTLLYRINFSYRNEESFRDFDTYMERKFIAPSLTWKPSDQTNLTLNLEYSDDDRPADFGVIAIGDQVIDTPNARVFGEPQDFLRGETLRVGYKFEHEFSDNFKFENAFTYLRYDTRFVNAFSLFFDENTDTLFRSFIELDQPSTNYEMKTKLISNFNTWSIKHKFLVGLDLNRREQLGNIGRGSFTPSASIPLNVFDPVYGTVPYPDFNQQPIFTFSDTQQDRLGVSVQDQIELFENLKVVAGFRYDSTEQENLNRNNPNAEENVQYEDAVSPRVGIVYQPIEEVSLYGSYSESFYPNPDQTVNLEFLDPEQSEQYEIGIRAELLNKKLSINLAYFDITKNNVAVADPLFPTFSVAVGEQNSRGVELDIIGEIIPGLNVVFNYANITAEITEDNDITLIGNRLVNVPEHSANLWLTYQIQDGFFEGLGFGGGFNYVDDRFGDLDNSFRLESYTLGNAAIFYERDNWRLALNIRNVFDRNYIQGSENSRTDEIYPGEPFTAIGSLTIRF

SEQ ID NO: 8706 - protein, 709 aa, Pseudomonas putida
MRRTFVSLCVLHAVSPLAFAEPETLSDPNQIELQALSITSTADSERADGPVEGYKATRSASATRTDTALHETPQSVSVVPNDVLVDTGATRLQEGLDYAGGVGRANNFGGQGLTTFTVRGFTTGEFYRNGFPINRGYPNAPDANTVERLEVIRGPASSLYGRGDPGGTFNVVSKQPLPESKVTLGSQFDDQGMHRATLDATGPLSQDGSLAYRLNVLGEGGDSFRDDVESERYDVAPVISWQVNDATKITFEGDFMRNNHPLDRGLTRYPTQTGSASRDTYIWEKGSDNLLHNDNNMAQVRFEHLLNDNWTLGGGFQYLDGSLKGNAVEGSNLLADGRTLQRNFNYRKLEWTDRDWQLNLTGHFDTGTLSHTLLTGIEYENYHYSSIIRRSSASYPIDIYDPVLGQPRPALAAVPTTWDSENLQTWAFFIQDQVALTERLKALAGVRFERFEHDYDDKRPANRDFSKGENGVTPRFGLIYDLTDTVAVYANTARSFKPNTGTPASGGGFDPEKGKSYELGVKWEALDRQLSVDAAIYQITKENVLTRDPNDSTNTYSIAAGEVRSRGLDINVAGNLTPEWRMIGGYAYVDAEVTKDTTLPKGTHLANIPRNTFSLLNTYEFQDGLAKGLGLGVGVKYVDDRAGQTSTATYTMERYSVVDLLSFYKVNEHVRLNLDVKNVFNKGYDEGAFNSYVYPGAPRTVQAGVSYTF

SEQ ID NO: 8707 - protein, 422 aa, Pseudomonas putida
MPSAIRITPTLLLALASTTALADGDLLTRSTLTGDWGGLRHQLEEDGVKVTGDYSGETAYNAHGGLHRSARYSQNVKLGVQFDLSKLYGLDNGGKVQLTVNDRRGNSASEDLVGNRLPIQENFGGLYTRLTELSYERTLFTPALNVKLGYMAMGNDLGGLDSGILCNFMNAGFCGHPLNMSGGSGWTNYPNAHLGVRVKYDLSPSWQLRVAAFNVDPESNGNSSRAWHLGPKHTTGTVVPVELVYKLQGELPGEYKLGYYYDSSDVKRIGSDDEVSGRSGHYLLVDQAVWNDQGSPGRSLHAFGQYSASSKAASPFTKWYGAGVVLYKPFEGRPKDTVALGYGRAVPNPRSRDVLEDAAFNAGQQFPDIDSAEQLIELSYGYQATPWLNLRPDVQYIIEPGAFSGKDIDNALVVGLQVKATF

SEQ ID NO: 8708 - protein, 659 aa, Pseudomonas putida
MNTASRQLLPLSAAILFTFTNYAQANKTNDDMEVMVVTASGYEQLIKNAPASISVIDREELASRFYRDLTDAMTDVPGVIVTGGGDRKDISLRGMANGYTLILIDGQRQTSRETRPNSDGPGVEGAWTPPIGAIERIEVIRGPMSSLYGSDAIGGVINIITRKTPEHWYGEVRLDSTIQQSNESGNINQANFFTAGSLVDELLGVQLYGQFTKRDEDDLVAGFRGKEQNNLKAKFIVTPNKNHEVTLELGRAEQTLDATVGKTIAPLAPGDECGRSGCPESTTTQYEQKTISVSHNGYYDFGSSNSYIKYDEYNNKSREMLIKNTDAQTMWSIPLASEHNATLGASYKKEDLTDHTSNKLSDVSQIDNEQWSIFSEDEWRTSELFALTGGIRYDHDGNFGGHISPRLYGVLNASDNLTVKGGISTGFKAPSLRATTPEWGQVSRGGNIYGNANLAPEKSINYEVGVYYDKGEKFSTSATVFYNQFDDKISRIACPLTQCTDGPNEFGSDPTTYVNVDEAVTQGFELSASLKLSSKVSASANYTYTESEQKTGAYAGSPLNQLPTHLLQTSVNWVLSDAFSAWARMHYRGEESQPTTGPSQSSLIAPSYTTADLGANYQLSNNIKLGVGVYNLFDKEISEVEYGYVEDGRRYWASLAWQF

SEQ ID NO: 8709 - protein, 2194 aa, Pseudomonas putida
MFRMRQGVRRLGSRWFSAAAALPSKIAGLGLAAGLASMALPVQAMAIPAAAPRLEWASGSTYTNADTLTFGLSFDTDVRNADPTDFEMLGTTATITSIVMQGGSSSSYLATVSGGDLADLNGSVRLILSASQDIENLAGAPLTDLATVNPEDTIVNNTRPDCAFTTAATAPVTSTFTVDVTCTPQNGWADTIIGFESSDLVLSNASLESFSFTSSTYAGSFVLRPLDSGTVTVDLPADSLYDEASNTNTASTQFSISSDVTVPTVTMNPWSLSPYSGPLTLGITFSESVTGFDPTTDLVLSNATIAVLSSSSRSFTLTVTPTAQGAFTVDLPAGVAVDADGFANTAATQFAGVYDTDAPVYTLSSAVASPAIDNFTLDISVSEDVHFQSSYLTVTNGTASGLSGSGSNYQVTIRPSSNTEGTVTVELEAGAAPDRAGNDNAAATPFSVAYDVKSPQIDLIERLSPAAAVTNADSLTFAVTFTEDVTGFDAGDLRILSDEATTPTTGTITQVVATSASQYQVTVSGGNLASIGGNYSTGASASLTVFATTSPTVEDIAGRAMTSYSAATTQEYYEIDNTQPGLTISGPALGTSNFTVTFTFAEDVTGFSLDDVVATNVTLANLSGSGDVYTAEATASGGTPITINVAAGAAQDEAGNTSTAASEFSIAFDETAPTVLSIERDTPTGEYTNATSLTWLVTFSEAVQGVGIPDFAVDGTTGSVISVASAGGNAYDVIVGGGDLSTMTGTVTLSFAAGASITDANGLALTEASPSGTNEDSYRVSHAAPVIASLTRQTPASEYTNADSLTWDMQFSSISSFFSLDADDFTLTGTTADLAVTRYSIGFYITASGGDLASSNGEIRLRLNSGIYPDEFGNELNGSTDPTGANENTYWLDNTVPTVAIYTDGPGGSSDPFEVTVAFSEVVSGFDASDLDIGNATASEIVETLAGRFFTFNLTPSGDGLVSLAVNAAIAQDAAGNDNTAAETWSEYFDNTAPYVTNVEFVTTGGSPTNSDTLQWAIALSEAVENVDASDFALLNSFGSTLSISQPQSTVIVVSASGGDLANKEGLVTLTTGSLDIADLGGNRLTSMEVTGGTDERAVTMDNTAPVVSFSYDDYYVSGSFDVAVNLNEAVTGFTSDDLAVSNGTVTALVANGDNFIATISPTAAGQISLSLAPDQMTDTAGNGNAAAGPSYFVYDPVAPSLTTIARAYPTDETTDSDYVVWGINFSETVGNVDASDFQIAGTTATLFVSGGRGGDAGGSGSRASAEDRGPGGPSYQYSVTAQGGDLATLNGTVTLSLASGNDIADVAGTTLASTVPTGTNDNTFILENDVLAPTVVLSSASSDPVSGAFTLDVAFSEDVTGFALEDLVVSNGTASDLSGSGADYTVTITPAGDGAVTVDLAADSASDDAGNGNVAATSFIIENDQSAPSVVLSSAAAEPVVDAFTLIITFSEDVTGFELADLVVTNADLSDLAGDGAVYTVVVTPSGGSPVAVDLAADSAVDGAGNGNTAADTYAIITDNTPPNLEISVPGEETEGVFTATFLFSEAVTGFEADDITVTNGDLSEFTAIDETSWSVTVTPQTIGTITLGVAAGAAEDAAGNASLAAEASLEAVAEPIEVAVVVAEDVEDPTEISATARVTNPGSQPVDFLVEVDVPWLDVDPRSGTIPSLGELELTIAVNEFANDLEAGTYTGTVTVINLSGGGAAAKTPNAHARAAGNTTVVAIPLTVTIAERRGSIQLVSTTPGGVQRDAVFDFVSSDADLDAISLATQGGHAASTPVRKLLGSYDVTQILPEGWRLDSLSCIGDTDNGSVIDLAAGRVDIDLDANETIICTFANTRDEAEVRLATQRAIRNFLVRRADSLLNAAPDLTRRVRDRNTTSPGQFSADINGGNRIVSMGASLAGMRYHAAASTPQMPGEDGVRPADSGNADIWLAANYASVSDERSGDAADSAFGVVQLGVDWAVDDRTVAGVMLQHDWADETTDEIAIRAGAVRGARVSGSGWMAGPYVVREIREGVWFDALALYGQSDNTVDPLGLYEDTFETDRFMVRMNLSGEWRSGDWRIRPSVSLAHFQETQDGYSDSLGISIPEQTIAIGRLRAGPEIAYRFDTATGGWWEPTIGLTGVWDYNPAELLDLDGQLVGTGGLRADAKLGLRGQLAPGASILLEMDIDGLGEADFEARGARVEVRFSFN

SEQ ID NO: 8710 - protein, 787 aa, Pseudomonas putida
MSPSYTCRFTPGLLAGTAIALCLTLGAFSKTVWAQEAEPAAIDDEQEKSEANEETEASTKPISPAYKFTPVTVTATRNERSLLDTAGNITRITSDDLDKRMDNTIAETFRYEPGIVVPRQVSGADPFDSNGGIQIRGAGGNRTQIIVDGSRTLEGITDNTRDVVDTSNMKAVEIVRGPTSVLWGSDGLGGVVNFITKDPVDYFKDADDMVAGNASAHYSSLDNSYVESVTGAFRLTTGPNPLEALFTFTRRDAEEPELSNARNVATPDGTTCPRDPAATPCNEFDPRDITSNNLLTKLVWSPSANNQLRLTGEYFTRETTVDQNSSRETTATYTQTGYRRVQDIQRWRIALDQDWQVGLPWLDALKWQLSYSPQEIKHRGDRRRILLPSNDDQQLLYTLDYSETFYEADIQLNSSFNIGASSHALTYGFDGDYAETEYFRRDITNNLTTGTSTTAVAGGFNFADAETTRADIYVQDEIGLFGERLTLTPGARLSTYKITPDPGPGYQIVPGAEPREMEETDLQLKFGAIYDVWGPYSVYGAYGEGFKMPTAQQLYQSLNSLPFFALVPNPNLRPESVKNYEAGLRGSFERGYFSINYFKADYEDFIQNFVPVAGSATDLTYANLSRVNVWGIEASGGYQFTPNWRTNFSAAHMRGSQQVTAGAQETTFNGAPPLNVVIGLNYVEPAYGLDIELVSTLQKATTRVEDRATDFAPSGYAILDLLTSWEVVPGVKLRADAYNLLDQRYFAAGNAGFPIGTDATLAVQRLNPIELQVGYGRFVKVGLELTF

SEQ ID NO: 8711 - protein, 764 aa, Pseudomonas putida
MRREAKMAQTTLKPIVLSILLINTPLLSQAHGTEQSVGLETVSVVGKSRPRATSGLLHTSTASDKIISGDTLRQKAVNLGDALDGVPGIHASQYGGGASAPVIRGQTGRRIKVLNHHGETGDMADFSPDHAIMVDSALSQQVEILRGPVTLLYSSGNVAGLVDVADGKIPEKMPENGVSGELGLRLSSGNLEKLTSGGINIGLGKNFVLHTEGLYRKSGDYAVPRYRNLKRLPDSHADSQTGSIGLSWVGEKGFIGAAYSDRRDQYGLPAHSHEYDDCHADIIWQKSLINKRYLQLYPHLLTEEDIDYDNPGLSCGFHDDDDAHAHAHNGKPWIDLRNKRYELRAEWKQPFPGFEALRVHLNRNDYRHDEKAGDAVENFFNNQTQNARIELRHQPIGRLKGSWGVQYLGQKSSALSATSEAVKQPMLLDNKVQHYSFFGVEQANWDNFTLEGGVRVEKQKASIRYDKALIDRENYYNHPLPDLGAHRQTARSFALSGNWYFTPQHKLSLTASHQERLPSTQELYAHGKHVATNTFEVGNKHLNKERSNNIELALGYEGDRWQYNLALYRNRFGNYIYAQTLNDGRGPKSIEDDSEMKLVRYNQSGADFYGAEGEIYFKPTPRYRIGVSGDYVRGRLKNLPSLPGREDAYGNRPLIAQADQNAPRVPAARLGVHLKASLTDRIDANLDYYRVFAQNKLARYETRTPGHHMLNLGANYRRNTRYGEWNWYVKADNLLNQSVYAHSSFLSDTPQMGRSFTGGVNVKF

SEQ ID NO: 8712 - protein, 801 aa, Pseudomonas putida
MLVGHTASAQLTLRGKITDSHNVPVPGATVKLVETTQIIITDREGVFLIPDLKAGTYNFIVSYIGFETKRVKFAFDAENDLLNIVLADQQNALQSVEVVGRKEQSYKNTRSFSGTKTETLLKHVPQSVSYVTKEVIDDQQAFRAGDIIKNVSGASTFSYYNNDITLRGFRTSTALINGLRTATEGWSQPILANVERVEVIKGPASALFANTDPGGTVNTVTKKPLDENRKAINFATGSYNTYRVSSDFTGPMNDSKTLLYRLNLAYQNAESFRVLQGGEDFMIAPSFSFIPDDKTKVNFDFVYSKSKSRLDRGQPIFGATAGTDLNSTPTSFAIGKRNDFLHELNLFVTASLQRKISDHVSFNASYMKFMYDEDLLEHRTSNRYAVDELGASIPTLMEMQTIRRQGKNYNDNITMYVVSDFKTGPLEHTLLTGYDYLQNQTPVGNSSYNARGYLSADRSTSIATYVPGSSSRYYIVNGRPVPNVPHFDLVNPDYSFSDISNYINVSSQTAPTKYYVNGIYIQDQIKWGKLRALLALRQEYYTDIQNVNTPTSKKIEQKALIPRVGLVYSPVDEVNLYGTYTEGYQPQTAGTIGDPARFGGPFDPLISNMIEFGAKTEWFQNRLSLNLAVYRIEQNNILINANDQGNPELLRQVGQQQSKGFELDVNGMVMQNLSLTANFAYSEATITESADPTEIGTLLPNAPKIQGGFWAKYNFIIPELKGIGVGAGVNYTGKRNTLSKILTLPEYTIVNTALYYNVDKFKLSANLNNIFDKTHWVGGYDFNRLFPGTPRNFMVGIGYTF

SEQ ID NO: 8713 - protein, 715 aa, Pseudomonas putida
MPVSTLIQGCSVFPGTPPYPRLLILTALLGGPAVADDLFIDTSDLPQVLTATRLKQSPAAVPGSMTVLDSELIRASGARDIPELLRLVPGMMIGYGAGNQPTVNYHGSNVNDARRMQVLIDGRSVYRAGLATVDWSDIPLAMEDIERIEVFRGPNTVSYGANALMAVVNILTRNPADSHGTRLKVTRGQDGINDFYASHGFGWDGGDMRLSVSGQQDDGFDENQFGQDYRDSRRLTRFNLSASHNLAVDQTLEWQLAAKEGSNQRPYTYQPVFAKYEAGNNADVNAKDYAGSLRWTKDFSSEHSLYIQGSAQHFDRQQVWRACDALESFSAELTQLWQMNPDFAEKVARGVALGDLPTTSDPVLSALSNKVQEQWKAGGNQPVCGDVDQSTRETRYDLEIQDTLSLTDSLRLLSGMNYRYDRADSQTYFNGSLDDQTWRLFGQLEWRADEHWILQGGAMFEDSRLSGSSLTPRVAVNYLITPRHGLRAVYSEAVRSPDMFENNVNWSYTVKNLSTNAFGQQHGEYFVKTRGPGDLDQERMRSRELGYNGFFSDIGLNMDVKLFYDEITGMISEPLKNNQYIASNANKARFSGSEAQLDWRPTLRDRLRLTYAYVDAWASNPDDRRLSAHNSGSAGWMREWGAGWSSALFYYGDDALNQYRYERLDLRLAKRFRVDGSNLELAALWQQRLDDEPTTAVQNRFDSRHRLSVSAELEF

SEQ ID NO: 8714 - protein, 940 aa, Pseudomonas putida
MSETFRSGIPSQVYSRLFLILAICILASAPVRAQQPPDTLRMDFAFTGMKPVDALKELSRQQQLTIFYVADWLPDSPLSRSYRDATMGDILDDLLTGTELNYFRYDSHTIALTRNSRIYDELPEGFFGTPIERRPENDEPSRPPAPLPIFVSEETQPEERQVETVRIGRQTPGQAADLYTLEGYVRERESRMPVADVAILITNRGLGTATDANGYYRLELPPGLQELRTRFIGMEPVRRQVILYNSGQLDLLVEEAVEQLDEVVVQADADRNVEAVTAGTDRIDSEESKDIPLVLGERNLLEVAASLPGISKAGEGATGLNVRGGRTDQNQFLLNHALVYNPTHFFGIFQALNPFVTESVDIYKGSIPVEFGGRLSAVFDIRTVDGDTLDLRGEGSVGPVTANLAFEIPVNKGRSSLVLGGRAAYSDWILRSVGEERLSGTEASFYDFIATYTDRINSRNQLKATAYYSKDRFSITRDSLVGYSNRAASVAWNHTFDERNLATFTLANSRYAFDIGFDGEANTDFDLGYSVEETELRAWNRFRMNKCHQLTYGLAAKYYRVNPGIRTPAGPDSDVEPTQIPREQALEGGLFLSDRFTVSDRLELEAGVRYSFFGALGPSRQREYPEGQPRDPGTATDTLSFGSGDFVKTYGGPEIRASARYLLAPELSLRAGYSNMYQYIHTLTNTTTVSPIDTWKLSDYNIRPQKSRQVSLGIFKNINEAEIEVSLEGYYKWSEDVLDFKTGARLLLNEEVETEVIQGEGQAYGLEFLIRRNRGRLNGWLGYTYSRTRVRFDSPYPSEQINDGEFFPANFDRPHDLSLVANYRFTRRYSLSMNFSYQTGRPVTYPVGQYYFNNSEYVLYSDRNKFRIPDYIRLDLGINIEGNHRKEKLAHSFWTISVYNVLGRSNPYSVYFVSEGGEVKALQSSIFAIPIPSITYNFKF

SEQ ID NO: 8715 - protein, 110 aa, Pseudomonas putida
MSVTIQGNTSTVISNNSAPEGTSEIAKITRQIQVLTEKLGKISSEEGMTTQQKKEMAALVQKQIESLWAQLEQLLRQQAEKKNEDATVQPDKKEEKKDDTNTAGTIDIYV

SEQ ID NO: 8716 - protein, 374 aa, Pseudomonas putida
MRLFSLKTITLAVGALCATGASFAQSSVTLYGIADLGVTFVDGNDSWNGLTSGNNLTSRLGVRGTEDLGGGLKANFRLEGGINLDVGDGASGYAGATAGSGFAFKRNSTVGLQGGFGEVRMGRELTAAYNAVARYDVFGSVGLGASQLWGDGGISDATGLSTTARTTNLRVSNMVTYLTPNFAGFKAAVNYGFGEVAGANSNRRYMSLGANYDNGPISAGLGLERLSRDVSTVAATAQGGDISAWSLGGSYDFGVAKLLAGYRQSKVDDFDAVLGAENKRKGYMLAVTAPVGGSGLVRAAYNRYEDEQTAAADAKADHFAIGYVHSLSKRTSLYGTYAYIKNKNNGTRFSINGSTNGLDNGKQQGLQVGVTHSF

SEQ ID NO: 8717 - protein, 809 aa, Pseudomonas putida
MNNNKPLPRFRALALALAVSTVAVGSQAAEAANALHIQAQPLGSALNQLGQQTSLQLFFSPELVAGKQAPAVSGNLAPVQALQQLLQGSGLTYEMSGDTVVVKPLPTTLDLGSGSLELAPTDIKVVGDWLGDAQQSVVQNHPGARTVVRREAMVEKGAMNVRDVLRGIPGVQVQDSNGTGGSDLSLNVGVRGLTSRLSPRSTVLIDGIPAAFAPYGQPQLSMAPISSGNLDSIDVVRGAGSVRYGPQNVGGVINFVTRAIPEKASAELSTTLETSQHGGWKHTESAFVGGTADNGMGVALLYTGVNGNGYRESNNGNDIDDVILKTHWAPTDVDEFWLNFHYYDGRADMPGGLTQAQYDSNPYQSLRDYDYFAGRRKDVSFKWQRQLDDATQFEVLTYYTDSFRGSTIASRDMKTLSSYPRNYHTFAIEPRVSRIFFAGPTTQEVSVGYRYLKEAMREQSTRLALIDNVPTVTPTSDGHVFQDRSGGTEASAYYIDDKIDVGNWTITPGVRFEHINTDWRDRPVLDANNRPVAEKKRSITSDEPLPALSVMYHVSDAWKVFANYETSFGSLQYFQLGQGGSGNSTANGLEPEKAKTYEIGTRYDNGGFAGELTAFYIDFDDELQYISNDVGWTNLGATKHQGIEASVRYDLAGLDPRLDGLSVSGGYTYTRATYEGDIPGFKGRDLPFYSRQVATAGVRYAVNRWTWNLDAYAQSKQRAPGTGINADGSFNGDYITEPSADGQYGDIPGYVTWHARGGYEFGPELSNLKLAAGVKNLFDKQYFTRSSDNNAGLYVGEPRTFYVQASVGF

SEQ ID NO: 8718 - protein, 768 aa, Pseudomonas putida
MRQYVPSAVSSPRLIVSAIGVALSASSVYAADPAASSAITLDATSVNGKAEQASTDYKVEKAASQKYTAPLVDTPRSVTVIPQQVIKDTNALTLQDALRTVPGITFGAGEGGNPQGDRPFIRGFDAQGDTYLDGVRDTGAQTREIFAIESVEVAKGPNSAIGGRGAAGGTINLVSKRAHLGNSLDGAWTWGSDQTQRYTFDGNYQFSDTVAGRLNLMTHESNVAGRDKVNYDRWGIAPSLAFGLGTPTRVNLDYYHLESDDLPDSGIPYSIPTNGSGGRTSAHPSKPDDGGDSDNFYGLTGRDFRKSRVDIATFAIEHDLTDSLTIKNTLRHGNSMQDYILTQPDDSKGNVNNGSVWRRANTRVGNTATTTNQTDLFGEFYLGGLKNSFSTGIELSREESKRSTYNVDTNTRGSTATTCNPSLIGANSGYNCTSLGNPNPDDPWNGAISRNYAGTDTKGTTRALYVFDTLELTPDWLLNMGLRYDHFDTQYRTYDAAGATVVNTKGIAAKGRDKSEFVTGQLGLVWKPAENGSIYVSYATSATPPGAMLGEGMEGNPPPNSTDRNGNLLSSDMEPEETTNYEIGTKWDLLDQRLSLTAALFRTEKENARVQVDTTTYENVGETRVQGIELSASGKITDKWQVFAGYTYMQARQIDGGPLGKANDGNQLPNTPNNSASLWTTYSITPKLTVGGGAFYVDDVYGSVANTTMVDSYVRYDAMAAYKLTKNVDLQLNVQNLTNEVYYDKAFSTHFANQAAGRTALLTTSVHF

SEQ ID NO: 8719 - protein, 748 aa, Pseudomonas putida
MKSKQSALSVAILASLLLASNASIAATLEEVVVTARKQAESLVDTPVAVSVLGAEFFEKSGFTTMTDVVKFVPGFDYSPTSSVRANGTRIRGIRTASYSEGFESSVAVVIDGVVMAREAAGFFDLYDIESVEVIKGPQGTLFGKNASAGVINVRTKQPEYEFSGGGDIMFGTYGERRIRGSVTGPLIDDTLAYRITGSTNENDGVIDNKYAGENDVNSKDTWSLRAKFLYEPTDQLSATLTLDTVKEDNKCCIATWRTSGDDIGLIGAAYTPNALQLQEALDLAGITAGAGNRSVAIFEDRINQESEANGVALQLSYDLGETQLTSITAWRDYYIDEFNEADQLSNTDLNNRNGTEADSEQISQEFRLTGNINDAVSYVAGLYYFNEDIDADGSIYVELGAFGLFNSRTRSIRSVETTNLAAFGEVNWDLTDKFTLIVGGRFSDEEKDATFSRMGTSIDPNLPFATLFSGDYIGAQNSEDTNFSGRVIGRYNITDNVNTYVAWSRGYKGPGFDVGDGANGAFANETGGLPFVDAEVPTLIEIGFKGWFLDNTLSVNTALFHQSTEDLQTIRALPNGGVSNLAIGEVVSDGFEADFMYLTPVEGLTITGSLTYLDVVYEEFLQEPELEGENFEGVPEWAYSLIANYDFQLGDGGWSGFARAEYSWQDDKNASTGNTERTLIEDYGLLNIRAGLTSPSKKYSATLAVENATDEDYPYWIGGSTFSALGSTATSQYLGPDRIVRLTLGAKF

SEQ ID NO: 8720 - protein, 258 aa, Pseudomonas putida
MKRIAMLAAACVIAVPAFAQNVATVNGKPITQKSLDEFVKLVVSQGATDSPQLREQIKQEMINRQVFVQAAEKDGVAKQADVQTEIELARQGILVRALMADYLQKHPVTDAQVKAEYEKIKKEQAGKMEYKVRHILVEDEKTANDLLAQVKSNKNKFDDLAKKNSKDPGSAERGGDLGWAPATNYVQPFAEAVTKLKKGQLVDKPVQTQFGWHVIQVDDTRPVEFPAMDQVRPQLEEMLRQQTLANYQKQLREQAKIQ

SEQ ID NO: 8721 - protein, 260 aa, Pseudomonas putida
MRTINSLILAGGLLACGTTFGGDLLQWQNNSLTYLWGKNFKVNPETQQTFTFEHADAWKYGDNFFFVDKIFYQGKKDANNGPNTYYGEFSPRLSFGKIFDQKLEFGPVKDVLLAMTYEFGEGDTESYLIGPGFDLAIPGFDYFQLNFYNRTTDGSRAGDNVWQITPVWSYTIPVGDSDVLIDGFMDWVVDNDENRHGTYQANLHFNPQIKYDLGKALHLGEKQLYVGVEYDYWKNKYGIKDSDAFTTDQNTMSFLVKVHF

SEQ ID NO: 8722 - protein, 446 aa, Pseudomonas putida
MRVMKWSMIALAVSAGTSQFAIASSQDDAKGFIEDSTLTAKTRAMYMNRDYKDGVGNVRRGNGTYTTGTDDKTSGYRQDTGISELLTYQSGFTQGTVGFGVDAMAMGSVKLDGGSGRAGNGLFATNGSGEPENTQSKLGGAAKFRISDTVLKYGNQFVSSPVFTTDDGRLLPEVATGTLITSNEIKGLELIGGRFTALSAQTGMGRDSINGRSRVTGKQNPGLSSADIVGATYSGLENFIFAVHASDVEDYWKKQYFNVNYTLPLSEKQSLNFDFNGYRSKDDGKKLAGDLDNRVWSLAAAYSIEAHKFTVAYQQSSGKTGYNYGVDGGGTVYVANSVQISDFVGEDERSWQARYDLNMASFGVPGLSFMTRYIRGSNVTVADSSDGKEHEWDVEAKYVLQEGPAKDLSFRLRNAIYRGTNSDYRATNYDNLNDLRLIVEYPLSIL

SEQ ID NO: 8723 - protein, 447 aa, Pseudomonas putida
MEQRKRISTLGSLALLAVVGSGGVQAAEAFSSESKWMTGDWGGTRTELLEKGYDFTLDYVGEVAGNLHGGYNDDKTARYSDQFALGAHLDLQKILGWHDAEFKLAITERSGRNLSNDRISDPRAGQFSSVQEVWGRGQTWRLTQMWVKQKYFDGALDVKFGRFGEGEDFNSFPCDFQNLAFCGSQVGNWVGGIWYNWPVSQWALRVKYNITPEFFVQVGAFEQNPSNLETGNGFKLSGSGTKGAILPVEAVWSPKVNGLPGEYRLGYYYSTAKADDVFDDVNGNPQALSGEAFKSHSSKHGWWVVAQQQVTAHGGDVNRGLSLFANFTVHDKATNVVDNYQQVGLVYKGAFDARPKDDIGFGVARIHVNDDVKKRAELLNAQSGINDYDNPGFVPLQRTEYNAELYYGFHVTNWLTVRPNLQYIKSPGGVDQVDNALVAGLKIQSSF

SEQ ID NO: 8724 - protein, 862 aa, Pseudomonas putida
MSTGPTRSSTLPRRTGQLSLLTLALLASGACSLPALAAEPAQASSPRMGDYRFSIGQQPLVSAINAFSQVTGWQVGFSAELADGVASPGVQGSLPPDAALKRLLHGTGLSFRKISNGNVVLERQTVGNVIALQQVTVSATRSAQDVSQVPSTVSVQTREQLDRQNVNNIQDLVRYEPGVSVAGTGQRSGLNGYNIRGIDGERILTQVDGVSIPDSFFYGPYAQTQRNYVDPEIVKRVEILRGPASVLYGSNAIGGAVSYFTLDPDDIIKPGKDVGARLKTGYSSADESWLTSATVAGREGDFDGLLHLSQRNGHETETHGSHSGAGLSRTEANPMDVRTTNVLAKLGWNYADDARLGFTYERYKDDRDQNILSAVGGPFIPGFGGMGYYKARNGNDTITRERFGINHEFGLDSLVADHVKWSLNYQIAKTDQHTEEVYAPPGRQVLRTRDTTYKDRQWVFDAQLDKAFSIGATDHLLTYGTTIKHEKITGSRSGTGTCLTVGSGCSAAGAERPADGQVLVSDFPDPTVNTYSLFVQDEIRWNNWTFMPGARYDYTRMEPKFTDEFLRGLESTGTAPTSQDDSDKKWHRVSPKLGVTYAFNDNYTWYGQYAEGFRTPTAKAMYGKFVNLEEGYRVEGNPGLEPEKSKSYETGLRGNFDAGNFDVAVFYNKYRDFIDEDAVQSANLEQTFQANNIKHATIKGAEVKGRLNLDHFGAPQGLYTQGSIAYTYGRNDDTGEPLNSVNPLKGVFGLGYEQQNYGGLLSWTLVKRKTRVDDSSFYSPDGSSSKFRTPGYGVLDLTGFYKVTDDVTINAGLYNLTDKKYWQWDSVRSYDGQGEAAVTQPANIDRLTMPGRNFGINVVWDI

SEQ ID NO: 8725 - protein, 629 aa, Pseudomonas putida
MRKAPLLRFTLASLALACSQALAGPSPYSTLIVFGDSLADAGQFPDLVGGTPGARFTNRDADGNFAPVSPMILGGRLGVAPGDLNPSTSVGIQPDGNNWAVGGYTTQQILDSITTTSETVIPPGNPNAGLVLRERPGYLANGLRADPNALYYLTGGGNDFLQGLVNSPADAVAAGARLAASAQALQQGGARYIMVWLLPDLGQTPNFSGTPQQNPLSLLSAAFNQSLISQLGQIDAQIIPLNIPLLLSEALASPSQFGLASDQNLVGTCYSGDSCVENPVYGINGTTPDPTKLLFNDSVHPTIAGQQLIADYAYSILAAPWELTLLPEMAHASLRAHQDELRNQWQTPWQAVGQWQAFVASGAQDLDFDGQHSAASGDGRGYNLTVGGSYRLNDAWRLGLAGGANRQKLEAGEQDSDYKLNSYMASAFAQYRQDRWWADAALTAGHLDYSDLKRTFALGVNDRSEKGDTDGEAWAMSGRLGYNLAADTSNWQLAPFISADYARVKVDGYDEKSGRSTALGFDDQERTSRRLGVGLLGSVQVLPSTRLFAEVAQEHEFEDDEQDVTMHLTSLPANDFTLTGYTPHSDLTRASLGVSHELVAGVHLRGNYNWRKSDELTQQGISVGVSVDF

SEQ ID NO: 8726 - protein, 810 aa, Pseudomonas putida
MSRAVDHILRPSLMALAIGLAAPLTSPALFAAEQSTSRAYNLPSAPLATTLNQIASQAGIALAIDPALVSGRTSAPVSGQYDGLGALQAALSGTGLQLQQSSAGSYSLVAVPDGTLALPETTVNATSASESAWGPVEGYVAKRTAAGTKTDTALVEVPRSVSVATREQMKDRGVHSLDDAVRYMPGIVSASFGSDTRYDWMRVRGFEPTQFLDGLPLPRGVYANPKAETWNLDRLALLRGPASSIYGQTPPGGLLDMVSRRPQAESAHEIELQYGSDNHRQINFASTGKIDDEGRFLYGVSGVIRDSGTQIDHIDNKRYNIAPSLTWNIDEDTTLTFLTQFTRDDTGATSQFRPIQGTKIDMPFGKISHHKNLGDPDYEFYDRTYYALGYAFEHRINDVWQFRQNLRYTKSDLSFQTITPGSYNKSSPPVQDDGTVSRMSTNTDEDISQFAVDNNFQADFATGDIDHTLLIGLDHQRINTNYLSIFDFNVPDSNVNNPVYGLPITRPDRSTAFYDYNQKTRQTGLYVQDQMALGNWRLTLGGREDWVHTGTKFFNQGDATNTQRDKKFSGNAAISYVFDSGFVPYLSYAESFQPSSNASVSASDSFKPTEGKQWELGVKYQPPGSNTLLSAAVYDLTQKNVSVTNTVGGVTITSQTGEVKVRGLELEAVSDVTDNLKVIAAYTLAKSEVQDGDFKGNRLQLMPNQQASIWGDYTWHSGVLDGFGIGLGARYTGNTYGDQGNTYLGKAKAYTVFDGSVHYDLGRLNGSLEGASVAVTATNLLNKDYLSTCDSYYCYYGDERSVVASATYKF

SEQ ID NO: 8727 - protein, 439 aa, Pseudomonas putida
MLKTRISLVALAMIAATQAQANEQADSKGFIEDSHANVLLRNAYINRDKKHGTDDQIEWGQAFIANFSSGFTQGTVGVGVDAFGLYAVRLDGGKGHNGGGGVDFFKPHETTNAEGNASSPHNLARGGAAVKFRISNTVLKYGDQMPALPVLQYDDARLLPESFTGTLITSKEIQGLELNAGRFTQEARKSAEGRDSGGLKSINVFGGSYKFTDNFTASLYTADNEDVMKKHYLGLNYVFPIASDQSLTLDFNGYKSDIDHKYVQAAGLNGDSNTIWSLAATYAYGAHSFTLAHQRSTGSTGYNYGFYQNAGGVGDGGSTIYLANSYWSDFNAEDERSWQLGYGLDFGAYGIPGLTYKLAYVVGDNINTRNVANPQGFGEGKEREIFNQIRYVVQDGPAKDLSIKLRSSFVRTNNAVQQNGYNDDGNEVRVFVEYPISIF

SEQ ID NO: 8728 - protein, 444 aa, Pseudomonas putida
MPSAFRFTPLFIALTATIPFAAQADEDKADGFIEGSSFNLHFRNAYFNRDNHNAGVRDTREWGQGAVARFESGYTPGVVGFGLDAHAMLGLKLDGGGGHAGTSILPEHIKDDGELGAAPHSFSTAGAAVKLKAFDTELKAGDLFLTNPVIAGGETRMLPQTFRGVSLTNTSIDGLLLEGGQVSFTHPYNQSGHRRIDTYYGSLDEHDKSKHLNWAGASWSGTENITANLYAAELKDIWNQYYADFDYTYVVNDLVSLNPGVHFYHTQDTGQALLGKIDNNTYSVHFTVNAGFHSVTAAYQRVNGNTPFDYINLGDSVYLDNSRMYSDFNAPNERSWKLQYGYDFAGVGVPGLSTSLSYSRGEADLTKATQDTTHYDYYREDGKNAMHWERDLDVKYVFQEGDLKDLSVLVRYATHRGSQGYASIDSNSDNDEVRVIVDYPLNVF

SEQ ID NO: 8729 - protein, 726 aa, Pseudomonas putida
MSRIPSAPTLGLAALFGAACAPGFAIAQEAGAAARSLPQVEVTDDAPSPNGRLDLDTPSDTASRLGLTPRETPASVTVVDRSVIDARGAQNTQEILRAIPGVTAHDAPGNIGVSYRGFGAGSIGQMFNGINVQYSIAARPVDSWIYDRVEAIGGPSSFLFGSGALGGSINYITKTPERSDFAEARLRLGTQHLREASFGLNRRVAGDGGAGSHYARIDVNHRDANGWTDGTGRRSTQLAASLLSDLGGGLRHTLAYEFQDENVARPYWGTPALNPVAGTMRIDPGIRFKNFNSSDAIYAQRVQWLRSVTEWQATDALQWKNTFYAYDALRDYRNVERYRYDPGNTAVIRSGALLQRHDQDMWGNRIEGLYKGRLGSAKSDWSFGLDFSVNRQTRFPNSLPGTVSTVDPYAFVTERFFEVTGMVPGLRPDRDNRVRTTAFYLENRTALTPSLHLVTALRHERIDLDLVNRRTVDAANPATFHRGYKPTTGRIGLVRDVAPGASLYAQYATAADPPSGVLSTASFADVRNNSELTTGRQVEIGTKLDFWQGKGTATLAAYGIRRQNIATQDPNDSALTVLVGEQSSRGVELALGLRPTRQWSLQGNLTSVDARYERFMRGGVSLAGRTPTNTPAMVANLWVSYAFTPRLEASLGVRHVSKVYADAENTASWPGYTLLDLGLGWKVSKAVTVVGRIRNATDRIHAVHVGSATAYLGAPRTADVSLCVAF

SEQ ID NO: 8730 - protein, 450 aa, Pseudomonas putida
MYKSSLALAVALGVLAQQAGAAGFIEDSKLSVSSRTMYFNNDNREAPGSKPRPDVRESGQGFKLDYISGFTQGTVGFGVDAQALWGIHLDGGKGYHQDGSTFMPSDSNGSSVAQWARFGANAKARFSKTEAHFGSALAPNLPILVSNDGRLLPQTFEGGIVTSKEIDNLTINAGQLTHAMGRASSNRTGLSVQGAYRDSNKFRFGGLDYKLTPDLTLQYYYSNLEDFYKQHFLGATHVFKIADDQSFKTDLRYFDSSSDGKNGSGNGYNFGNNGGYAKHTGEVDNKTWSAMFTYTLGGHALMLGHQQVSDDGGFVWLNQGNVRKDGSTSPLEGNGGASFYLFTDSMINQFAKAGENTTFGQYSYDFARLGVPGLKASVAYLRGEDGRATNGHGTFSEWERDARVDYVLQEGALKGLGFSLRQGVYRGTGSGSANDQDQTRFIVNYTYAFM

SEQ ID NO: 8731 - protein, 730 aa, Pseudomonas putida
MIHLRPGAAFQRAAALALPRRPARSTLPALRLGRHALTPLALCLSQAAFAQSGTAVDGTAQSPAQLQEVRINAGTEKDVGFAPTEAQTAGKMPMRRLETPQSVGVVTREQMESRQITNLQQALQTVAGVSPVNFGRRGVDDLNIRGFRSTESVLIDGLVQSVGMWTRLNPYGYERFEVLKGAASVLYGQVQPGGIVNAVSKRPRREALTEVGVEVGSFGQRTLQADLNRPLNESGKAAFRINAQVANSDDPTDFIYRRDRWIAPSLSLDLGPQTDLVVFATYNQSQWMRQQGVTPYGTVLPNRNGPVRRTLYTGDPSFGGYDIETKSLGYALEHRFSPALTLRQNVRYETEGGTGNLVANSTLQSNQRLQNRTATRQYMDDEMLATDTSVLAKFAALGVQHQLVAGLDARTGKSWLGRRTCSIAPMDLFNPVYGVAARCPAGLTIDAPERLTVAGLYAQDQIRLTPQWTVLAGLRRDWSTNTIDDRIAREKTRQKDSATTLSAGVVYEFVPGWAAYASYGESFLPVSGTSFSGAPFVPETGKQWETGLKYEAPDRSVTGSLALFDLKRSNVTTADPVNATFQVQTGTQRARGLELEVGAELQRHWKLTGAYTYTDSEVTRDNNAAIVGKPLNLTPRSTFALWATYQLPQMPQLTLGAGARHVTRQVGSYPFSLPAYTVVDLSVGYTGPSYRITAGVKNVFDRAYYDGAINANVVSPSLPRNFSVGLTYFF

SEQ ID NO: 8732 - protein, 416 aa, Pseudomonas putida
MKILPVPMLAAGLVLLPSFAQAEFFADGKAGLELRNFYFNRDYRQPGASQSYSEEWAQGFLLRYESGYTEGLFGLGVDALGLLGVRLDSSPERSGSGLLPYSTSHRRAAHDYSSLGLTAKLRVSHSTLKIGSLMPRLPVVQFNDTRLHPQTFQGGLLEVNEIDGLALQFGQLRQVKQRDSTNAEDLGITRGNKRNVLAGRHPGSDRFDFAGGTYRWSERLSSSYHYANLEDFYRQHYLGVQHLLPLADDQSLKSDIRWARSTDEGGSRVDNRALNALFTYRLGGHAFGLGYQRMSGDSGFAYLAGTDPYLVNFVQIGDFANKDERSWQLRYDYDFAAIGLPGLTFMSRYLRGEHIDLLDGGGRGKEWERDTDIAYLVQSGPLKNLGIKLRNGTFRSDFGNDIDETRLIVSYALPLW

SEQ ID NO: 8733 - protein, 473 aa, Yersinia pseudotuberculosis
MVTHCHIAAHKAKRKTLALAIAGVLFGTGFMAAPEARADGFIDDSSLTGGIYYWQRQRDRKDMTPTSPEYGKYVANLHHSTFNANLAFSSGYVADMFGLDLAAFGAVEISNSGPAAPNEIGFSDAKTRWDEKWTGDKSGVSVYRAAAKFKLGDFWARGGYIQPTGQTLLAPHWSFMPGTYRGAEGGAKFDFDTAGALSMSYMWTDEYKAPWYQNMYHFRQADGLTGVSYLHSFGAKYDFKNNLVMEAAFGQAKDYMDQYFAKASYAFPVAGNDLRTTYQFYGAKDKVDGGASNANDVYDGLAWLQALTLGYTTGPFDLRLEGTWAKADGNQGYFLQRMTPGYATSNGRLDVWWDSRSDFNANGEKALFGCVMYDLKNWNMAGWSVGTSYAYGWDAKPSTNPKFDQNTRLKESAWNFDILYTLQEGRAKGTLFKLHYTLYDNHTNIPSYGGGFGNVFQDEKDVKFIVIAPFTLF

SEQ ID NO: 8734 - protein, 433 aa, Yersinia pseudotuberculosis
MNQKNLFARSALAIAVAVISSNASAAGFLLNEYSTSALGRAFSGAGAVGDNASEGSRNPAAMMLFDRPTMSIGAVYIDPTVDIKGRDDDKYTANNIAPNAVVPNAHFIFPINDKWAVGTSMTTNFGLATDFHKDYAAGLVGGKTDLKTVNLNLSGAYRINDNFSFGLGANAVYADAEITRHMGEKAKGLGGLGITPSTDAAKLKGDDWGYGWNAGLLYEINQDNRLSFTYRSKVKVKFEDGKYSNGIPNLPLPPIQELNPTGGKTVKGTLDLNLPDVWEFSGYHKVDPKWALHYSVSYTGWSTFKDLTAYRKSDGKELFHKPENFDDAWRLALGTTYFYDDNWTFRTGIAYDESPVPSKYRSISIPDQDRYWLTAGTTYAFNKDTSVDLGIAYMYGKKVNINERLIEKDPTSEVRFKSEGSAWLYGVNFNYTF

SEQ ID NO: 8735 - protein, 1067 aa, Yersinia pseudotuberculosis
MKKNRSTLSPCFRKTLIASLLVPLCSPLYSWAVQTASITDGSTMVISGGYDTEANNQTAVFVQGSGSTINGGSDVVIETTGVGAIGANASEGGTLGLTGSTIKTENSVAFGVLNDKGTVNLQGGTITTKGQTAYGVYSSGLGSNTDIHSSEITTSYSLTHAIYGAGGTGLTLNNTTLNTSGSGSYGIYLDGSGGSLTGADNTINSTHATNGAGIYISSGGSNATLDNTTLNITKGAVGVNVGEGSSITMDGLIATGNITNLFKVSGNASVSNANIELAAGGVLMAQGSSASNQAVIILNNVDAISNSGGTTLVDVNKDADVTINEGSYHSKGNNAKGIWVRDNSSSLNVDNAVIITEGVNATAIENRGTAIVENTTVITKGNNSHGLYSEQSLDATNMAISTAGIGSIGAAAAKGGNLNLNDALIETTGNSGMVLGTFADSSISAKNITGLSTGAGAYALWVDDGSSILLEESQITTQGQGAGGIYASNTGTGSHTAYTQVTLNNSQIHSEQGPGIWANGADINVDVKNGSQLTGGNGLLVYASSNAGAASNVNVNGDNHAVLLGDIHAAENSNINLALNNNSVWTGAATNAKQVDIDSSSIWNLTGDADVESMHVLGQMNFISNSSDTHSRAPYDNFSTLTINSNVTGSGSFTFNVQLGDNDSPVDRLYVIGNASGDHGVQVINQGGLGALTTGDGINLITVDGETHSGSFTMSNSVSAGAYEYFLYQIDGNRWNLQSNLINPDPGVDPGGETAYRPEVPGYIAAPWLNAFYGFTTLGSLHERRGSAEGAAEGFNQDSWGRIRGQHNNFEAGRFSYDSNIWFMQLGHDVYQAKNAAGTQVTGGMMITLGKQNSDTRDRARAINPDLSIDTGKIKTEAYGFGGYYTLMTEEGGYLDIVSQATLYRNNYESQHNTKHNGYGVVMSAEVGQPYPLAAGWVVEPQGQLKYQYLHLSPKNFNDAISEIGGTDYSVGQVRAGLRLFSDSSEKRDIKPYLTTDVLHQLGRNPQVTVATVDIRPDFTKTFWQGGAGVTAKVNSQVDLYADAKYQKSFDGKLDGYLGNLGVKVSF

SEQ ID NO: 8736 - protein, 680 aa, Yersinia pseudotuberculosis
MSPVSHARHCRAVLSSSCVLTSIALLGAFSAAAQQSASPHLLPPVEVDPPHKPAARKPVVAGRSHARSAASAQRPVAPAAASPTGIATPAAEAGRSITVVTDKDIATQQGRSLPDILSTVPGLTVVQAGGPGGQSTVSTRGTSANHTKLVIDGVDVGNVTNSNGAPDVEHLLTADIQRLEVLRGPQSGLYGADALGGVISITTRKGDGPAQATGSIETGAYRSFNQTAGLSGSKDQFNYAFNIAHLHAGDVPVTPWQLLPPGRKAIGNAYDNVTASTRLGVDLNEAWTLNALVRHTDASLLFTGDSGSPSFPNATQSHHTDRQLTTREEAVWSLLGGRIRNHFGVNYVNNWSYDLAPGNPAPTIATGERIKYDWRAVAEIAPRNHLVVGLEQQAERLKAADVLAENGNKAGFVELQTEFAKRWFVVASLRDDVDDRFGGHGTYRIAPAVILPVTETRLKASYGTGFKVPTLSQLYQNFPAFNFFANPNLKPEASIGYDAGFEQPLFDDRLRFGATYFHNDITNLISFNANATSFANIGFATTEGTESFVAAKLTDRIWLRADYTFTRAVDASTGQQLLRQPREKWSATATWLPVDALTLSATLLRVGDWLDISRDGTTTGLVAPGYTLVNLRGDYALSDQVKLFARIDNLFNRHYQNPTGFLAPGFGMFGGIRMATSGLQ

SEQ ID NO: 8737 - protein, 681 aa, Yersinia pseudotuberculosis
MISGKNKVCKKKLLACAVTSAISAFASNAIADTTSLAAMNRSAINISSTHNSNKKLNDADVITVTAPLYSPLVVATSPKVPRQPVPASDGADYLRTIPGFSLVRNGGTNGDVVFRGMFGSRLKILTDGAEILGTCPSRMDAPTSYISPENFDLLTVVKGPQSVLWGPGASAGTILFERERPHFDQSGVKGNASVLAGSNGRWDKNLDASLGNEQGYLRMMGNQSRAADYKDGNNVRVPSQWDKWNADMALGWTPDTDTLLELSVGKGNGESRYGGRGMDGSQFLRESLAARVEKSNIGEVLDKIEAKINYTYVNHIMDNKTLRTPPMMAMSSNLDRRMLGGRVMGTWLWQDLKLDAGTDMQTNTHRKNKQGNWDKNARFMNNGVFGELTWAASEQNKLISGARLDRHQVTNYTRAGEPTRSATLPAAFMRVEHNLANAPVMLYAGLGHTERFPDYWELFSPKFGPAGSTSAFEGVKSEKTTQIDIGGQYSGEQFRGWLSAYIGRVNDFILFKYDPKNLRISQADNINATIMGGEMGMEYALTPYWKADASLAYAWGENTRDNRPLPQIPPLEARLGLTFEAGDWSSSALWRLVNSQHRVAINEGNVVGKDFSSSAGFGVLSANVAYKVNKQVKLSSGIDNLLNKAYSEHLNLAGNSGFGYSVNTPLNEPGRTLWAKLNLTF

SEQ ID NO: 8738 - protein, 211 aa, Yersinia pseudotuberculosis
MKKITLALLAVASLVPTAASAHEAGDYIFRAGTATVRPNAGSDDVLGNGSFKVDNNTQLGLTFSYLITDNIGVELLAATPFNHKVGLAGVGTIADVKQLPPTLMAQYYFRDKQDKLRPYLGIGLNYTKFFDEKFNATGSDIGLTNLSVKDSWGVAGQAGMDYMVSENWMLNMSVWWMNIESDVKFNLAGEEHSINTRLDPWVFMFGAGYRF

SEQ ID NO: 8739 - protein, 1004 aa, Yersinia pseudotuberculosis
MKNSNRSPKNISRNFKHHKETSLSSKNKSPIATCVAAALFIFGSSSVIANPDHEGIVVGKSILNKKQSAVNAIINEGNSLVLTDSASAEHTAVNTGSIFTLKEDSTADITSVTGGFFSLSGSSKANINTVLSGGWLEVNDDASITETTISSDIEKKSTVRLYQDGSATKTTVGDNGILYVSGDSRAEETHVTKGGKLIVYSESQGPTLKNTQIAGTLTLKSDVTLEGKTEFVSSATIKTTGHLIDNQGQLIFNSDKDIVIEAMIDGQGSLTKENPLTTLTLSSAGDAWVASYVYSGETHINAGNLKLANTHFFGSPISGNPNTRLILEKSTLDTTVQGSSVFIDKHSIWNMQGDSNIHHLDILDSGRHDLNNPGKTGNQLIINGDYFSDNGTLIFHSQLAGDDSVTDHILIKGNTGGHTNVRVINVNGEGNKTDSGIQLIEVRGISDGEFSQVGRITAGAYEYRLGRGKDELSKNWYLSSDITDYSSDGVPEAELPGILVLKSDNAAVFSAKLADYALQAVGGVVDSFTQPETSPPSNTPELTVPDPKRANAAAFSAKLADYALQTVGGVVDSFTQPETSPPSNTPELTVPDPKRANAEAFSAKLADYALQAVGGVVDTFTSPEQTTATPDSTPKPTDLAVNPASTPKSTDSAVKPASTPKPTDLAVKPVNTVISSAKTAAPKRQTLVHTPENGSYIANIAMARNLFTTRLEDRTGHYLYKDIVTGQWQPTSMWMHTQGGRSQFGHTVEQLNIKGNYYSVQLGGDIAQWATNEQDSGRIGVLAGLGKATNHSHSKVTSYHSRGSVDGYNLGIYATWFADQQHNTGVYIDTLAQYSWFNNAVNGQDKAEEKYKSSGFTTSIESGYTFNLANSDQLSYFIQPNAQITWAGINAQTHKTADGAVVSYRNNGHFITRIGAKAYLQTHDSLNTKFTPFVAVNWIHQNQNTGTIISGQGIDNKIQNSTEFNVGVESQIDQQLHIWANINHQMGRYNYTDTNALVGVKYHF

SEQ ID NO: 8740 - protein, 1150 aa, Yersinia pseudotuberculosis
MNNHGIFSPDRTKVRTLLSIKSIFLFLLFTFAFEMAYASSVYSQTKVFTMQSAEKTVLQVFKEIEKNSEFIIFYRDGVIDLNRKVSVNVVNQSVDKILEQLLAHTDNGFTIKDRQIIIYKKETSATPSVSQQKNKIKVTGVVTDAKGESIIGANVVVKGNPTIGAITNMEGRYEVMLPSDDVILLVSYLGYNTEEIKVKGRRNINVVLHEDSKALDEVVIVGYGKQKKESVVVSMSSIKPKDIVVPSRSLNNSLAGQVAGLIAVQRSGEPGYDNAEFWIRGVSTFAGGTSPLVLVDGVPRNMSDIEPDEIETFSVLKDAAATAIYGAEGANGVVLVTTKRGRVEKAKISFKTEHTISSPTRLPEFVGSADYLSLYNEALRNDGEGPQFSDELIAHYRNNDDPDLYPNTNWIDELLRKNTFSHRYTLNVRGGTEKAKYFVSGAYYNESGLFKNRPNGIYDTNIGIDRFNLRSNIDMAVSSTTTVGVDLAMQYLINNYPGTGTSTIFRSMLITPPYAFPAVYSDGTVATYAQERDANMRNPYNLLMNSGYAKEYRTGIQSKVNVNQKLDFITKGLSANLNVSYDYDSEMIIRREYNPTRYHATGRDELGQLIFSTVVSGNPDIQDPKNSATSATKKIYIDASINYKRTFGKHDVGAMLLYMQKETQQHNVPLPFRKQGFVGRATYGYDGRYFIEGNFGYTGSEAFAEGNRFGFFPAIGAAYYLSNESFYPEAIKKVVNKLKLRASVGRTGNDKTGQERFLYRPTFTTNAGGFTQGIGDTGGTNGIGNGIVEGRFAAPYLAWEIEDKQNYGFDLGLFDNRIDIIFDYFRSERRDILLQRRTVPQLGGLRQDPWQNFGKVRNQGIDMSMNLNQQIGKLKLSARGTFTFTRNKILEYDELPQKYGYQAVTGTRVSENTLYIADRLYTEDDFIVSTNANGLKTYKLRSELPRPTLGGLIGPGDIKYVDVNGDGVIDSYDQVRGVGNPSTPEIIYGFGLNAEYKGFYASIFFQGAGNTSVLLGGATSEGWYPFSWGVDQSNYRTFALDRWTENNPSQDVIIPRLHKNNANNANNRVASTWWLRNGSFLRLKNIEFGYQLPKKFMDKIGFEAARIYIMGYNLAVWDDIKYFDPEAGNANAGLNYPLPRTFTLGLDFTF

SEQ ID NO: 8741 - protein, 3705 aa, Yersinia pseudotuberculosis
  misc_feature (751)..(751): Xaa can be any naturally occurring amino acid
  misc_feature (753)..(754): Xaa can be any naturally occurring amino acid
  misc_feature (1221)..(1221): Xaa can be any naturally occurring amino acid
  misc_feature (2040)..(2040): Xaa can be any naturally occurring amino acid
  misc_feature (2067)..(2067): Xaa can be any naturally occurring amino acid
  misc_feature (2112)..(2112): Xaa can be any naturally occurring amino acid
  misc_feature (2118)..(2119): Xaa can be any naturally occurring amino acid
MNTIFKVIWNASLNVWVVVSELAKGRIKTKSSRNLISEGVLPKFEQSMVSKLFRKNLLALSLGSIVFLSTGPVFAADITVSTQAELSAALSNGTYDKIILGADITLIGSLTVNMTSNQVVIDGQGKFGLTVNNTTNYGLVVSSGSGTLTLQNMSKIDSANYYSMVVLNGANTAVNVIYNNIDFLGSSQLIYMGAYGAATNSIMTFGDILNDVVVNDRAQEIGEVNKLAFTGRFHVTHTGSSVTSFVSTGGANNTSTMDFASGADVKIDRTGSTGDLTSTGVNAFAYTFADGASFELIANQNVFSGTTTNRGLEIGSYNSIDGFGSGVKIVLQSRSDGSIISGNGIDNATTNAAGINNNASGDANVIYNLGTGSILKATNTGILATKNANNASDIYIRSAGDITAATGISATHNGTGTVKIKNDGTITSTTAGIAISSASIKEISVDNTDGTITATAGTGVNVLASAILNLFGGTINTSATANGITFAGTEGGHTLTDLTINLLGTGIALSNVAGVNLTLSNVTLNTLNGTALNSLTGLTLVDSLNGRNTINIEGAGIGIAATNTELNTFDAEALDINVNGAGIGIQATGGGVNLSASNLIINVANTLGTALQITDGIDNTTTIGNEIQLNAENATAINFLGSSSKTLNNNGTIKGSVIFAGVADHIINNNGTLDGTLTTGAGNDTLVLDSSSQSNDVINLGDGNNSVTIQNGATVSSIITGNGNDTFTINGMSVGSTYLGSLDAGTGLNTXNXXASTDELAAATSLQGFTNINLVDSHITLVSDDNIGSGMVNIDSSSELLFGSTFDGILHATLGAGTGSAIVNNSANVSLEQASMFAGTWQVNQGGALTASNSNQLGSAKIGLDGTLNLDNIALFNHVLTGNGTLNVAKNLATTAFDFGSTVGGAFSGIVNLTKTTFALSADNAAALASATLKLSDDSVTTVGTTDRTLHGLDLSGGTLIFDGAVPQSQTSGVVTVTDLALNSGTVNITGSGSWDNTDPLATNVSILEQDRAGSTLELINATNVTGDIDALDLLVNGTAITSGTQGVQSAIQQGGSTVANAIHNYGLASSNSNGDSGLYVNYTLSALELLADGADALLLATESGLTANRVLNAELFGVGGLVVDAQNGALTLANGSNRYEGTTTVTAGELILGANGAFGQTSLLDIASGASANINGYSQTVGAVTNVGTVTLGSGGVLTSGLLTNGGILDLTGGALNLTXGGASTVAGGLTGAGTLNINGGNLSVSAANSGLSGQTHIADVASVTLTDTGTLGTSAVEVLGTLNLNGANAAMTNVLSGDGTINTNAAVTLSGNNSFSGAHQIGTDGELTVGQASNLGASSATVNLGTLTSHLILNGVSESIANVLSGVAGSTVDIIGGADTALTANNSGFLGQYALAGNSKLTVASTNNLGASSSVALAGAGDTLSLSGFNGTFGNSVTGSGVLQVTDDAEVTLTSSNGVSNAVTIDIADATLNLDDIALFNHVLTGNGLLNVAKNDASTAFDFGSTVGGAFSGIVNLTNTTFALSADNAAALARATLKLSDDSVTTVGATDRTLHGLDLNGGTLIFDGSPPQSQANGVVTVTDLALNSGTISITGAGNWENEHPVTPPNVSLLEQDRGDILLELINAANVTGNANNLDLLVDGTAITSGTQGVESAIQQGGSTVANAIHNYGLTSSNGNGGSGLYVNYTLSALELLANGANALLLATESGLTANRVLNAELFGVGGLVVDAQNGALTLANGNNRYEGTTTVTAGELILGANGAFGQTSLLNIASGASANINGYRQTVGAVTNSGAVTLGNGGVLTSGLLTNGGILDLTGGALNLAAGGSSTVAGGLTGAGTLNINGGDLAVSATNSGLSGQTHIADVASVTLTGTGTLGTSAVEVLGTLNLNGANAAMTNVLSGGGVINTNAAVTLSGNNSFSGAHQIGTDGELTVGQASNLGASSATVNLGTLTSHLILNGVSESIANVLSGVAGSTVDIIGGADTALTANNSGFLGQYALAGNSKLTVASTNNLGASSSVALAGAGDTLSLSGFNXTFGNSVTGSGVLQVTDDAEVTLTSSNXVGNTVKVDIADATLYVNDIALLDHVLTENGTLNVAKYLATTAFDXGSTVGXXFSGIVNLTNTTFALSADNAAALARATLKLSDDSVTTVGTTDRILHGLDLNGGTLIFDGSPPQSQANGVVTVTDLALNSGTISITGAGNWENEHPVTPPNVSLLEQDRGDILLQLIDADNVTGNANDLELMINGTTISAGQGVQSTVQQGGYTVANATHNYGMTSNGGSGLYVNYTLSALELLADGANALLLATESGLTANRELNAELSGVGGLVVDAQNGALTLANGNNRYEGTTTVTAGELILGANGAFGQTSLLNIASGASANINGYRQTVGAVTNTGTVTLGNGGELTSTDTLINTGMINVTDGILNLENGGASSISGGLTGNGILNIKGGDFTISIDNNGLAGQTNISDGASVTLGNGGTIIGTGNLGSSVIDVLGDLNLVADNSLANVISGDGTINTTATVTLSGNSSFSGAHQIGTNGELTVGQASNLGASSATVNLGTLTSHLILNGVSESIANVLSGVAGSTVDIIGGADTALTANNSGFLGQYALAGNSKLTVASTNNLGASSSVALAGTGDTLSLSGFNGTFGNSVTGSGVLQVTDDAEVTLTSSNGVSNAVTIDIADATLNLDDIALFNHALTGNGLLNVAKNDASTAFDFGATVGGAFTGTVNLNNSTFDLSGNNTTVLAQATLKLSSGNLTSVGNGVQNIGTLAMNGGTLLFDNIVDNAGIITSDGTIAANSINTTGGGEVRVNLPSNLAPSLDGLSVMELDEGEIIVTLATGAATGTGHELTLTDENGDPISAVTYQGVHNAGSTSAAATGSFNYGMTTGEDYDGLYVNYGLTALELLSTGSEALVLTAILANNGTQSNDLSAQITGSGDLAFASANDGSTASLSNSTNSYTGTTWVSSGNLRLDADSALGQTSLLAMSTATHVDINGTQQVVGELATEGGSTLDLNDGKLTVTGGGQIDGALTGGGELVLSGGLLNVSYDNAGFTGSTDIANGAVAHLSQAQGLGNGTINNNGTLHLDNTIGTLFNALTGSDGEVLLSNNASVQLAGDNSGYSGLFTNQAGSILIANSAEHLGGSSIANSGALILDTGSVWELTNTISGTGTLVKRGSGTVKIEGDTVSAGLTTIEEGLLQLGSSAVTQTLSLEESLQERALLVSFASNMANLTSNVLITANGSLGGYGQVTGNVENYGNLIMPNALTGGDFGTFTIDGNYTGDEGMITFNTILAGDTSVTDRLVITGDTAGQSYVTVNNIGGVGARTFEGIKIIDVGGDSAGQFTLNGRAVGGAYEYFLYQGGASTPDDGNWYLRTEADDRRPEPASYTANLAAANNMFVTSLADRMGETLYTDVFTGEQKTTSLWLRNEGSHNRSRDDSGELKTQDNRYVMQLGGDVAQWSRNAQDLWRVGVMAGYANSSSSTVAQVAGYRSTGSVDGYSVGIYGSWLADNADDTGAYVDSWVQYSWFDNRVSGQDLATEKYDSKGFTASVEGGYAFKVGESVNQSYFIQPKAQVVWMGVKADDHTETNGTVISGDGNGNIQTRLGAKAFINPSDKAKVSGPAFKPFVEANWIHNTKDFGTTLDGVTVKQAGTANIAELKLGVDGQVNSQLNLWGNIGQQVGNKGYSETSVVLGVKYNF

SEQ ID NO: 8742 - protein, 690 aa, Yersinia pseudotuberculosis
MMVFYRKYLTVTFLISLPCLAWSQSHNNSKDELDTITVVAQKINQQQQKTPISISVLTGFDLERENIENIYESIMRIPNVYMVKAGNPSDAGFFTMRGTTPGMEGIQSVGFFIDGVYANTFDTELLDVDRIEVLRGPQATLYGRNTESGVINVITKNPEFSPEYKIGLSYGNYNRTQVTTVLGGSINDSEQFSYRAALKYLYGNGYFKRDYDGKNNVDNLNDFSGRFKLRWQPMDDGWDVMTTFDIQNRRNGNTSFTALDKIKSGQKYVDSNYIGKSDVDAYKGQVNAVYTFDDIDFTSVSAYVDERKVDNQDLDFTRLSISELLMNRKTKQFSQEFRLNSKYSGPFNWLIGSYYFYQDDENEIDFRYLPYNLAQIRKSDIKTNNYAVFGNVNYYLLNDVELVAGARYDYEKKKLNFLMDNGFNPYQPYSHDNNSNSFGAFLPKVGLNYYITGDAMLYTSIARGYKSGGFNTLGPQSSRAYNAEYMTTYEAGVKTEWFDRTVRWNTSLFWNDMKDQQVEVAYYPISYSVNSGKSLSRGLESEFEWRITRGLTAFANVGYTDAYFKNFPTEIKVDNNYIPVNYKDNRPANSPRYTYSIGADYNFLNGYFVNATYNVKGSTYLDNANSKKQPAYGLLNLTAGYENKDYGVNLWIKNILDETYVTRAFKMDDGVWYGRAGEPINFGVNFNVKF

SEQ ID NO: 8743 - protein, 654 aa, Yersinia pseudotuberculosis
MYIPNRQPRLRSAPARAGFAFAGLLPLLGGQAQAVEFSFLDNEVSGSLDTTLSYGTLWRVQGQDKSNNDINTNDGNRNFDTGLVSEVYKITSDLEATWRNYGVFIRGTAFYDTQIMDKRNDYYSHNDPSQPSQSYPHDDRFTSQTRDIAGHKAEILDAYVYGSWDIGNMPLSARFGRQVFNWGEGIFYRGGVNTTNPVDAAKYRLPGSELKEVLMPVEALSFNIGLTDNLSMETFYQWNWKETRLDPVGTFFSETDLFADGGNTGYSDFTGTALDTPVPGFGNVIGLYQALGNNPLLSGALKNTGLYANGVTPAYGNVMKVSSIGKDINARNDGQFGVAFRYIAEELNSTEFGFYFVNYHSKEPTLYADIGDYAGADLAALANTLRPIAGNLAEALANGLVTADVMGNINARREFAEDIRMYGFSFNTTVGDASVFGELAYRPNLPIGIAATNDLIGDLAHGAAEAANGGQINVGGQMVGLGGQIHNYERVEAFNTSLGTIYNFGPSLSFDSLTGVAELASEHLRGSSLKYTAYDGSTRYYAGRGNSSYVSGGDRGDQVNRNAYGYTLLLSGTWNDVFAGVNVSPYVVYKDDFEGNSYQTGNFIEGRKAYTLGIKATYLNSLEGELQYTEFYGGGQNNNIRDRDNIGLTVKYSF

SEQ ID NO: 8744 - protein, 941 aa, Yersinia pseudotuberculosis
MKHKFTFSFFLSVAWLTYFHSSEARDIPFLLPTPSIDSFLTSSSINTLGEQTNLQGQIQSNSINMTLKDYKDIYALFQISSNGEKRCRYNILSLEATQGPIVFIGNSTSNTGGAIYADTRLKITDSQEIILFANNLARASFVRNIFDYPIFSGAVYARYVDITHNKQPVYFVKNIAASEGGAIFTSIDVLLADNQSACFFCDNAVTLTDQNRCKGGALRLERFNCLNNRGSVVFANNLAGEGGGISAIHHCSFSGNLGNIIFKNNKALRRSGGAMHSPTITLENNPGIISFHNNSSAVQGGACLCTNFTLRNNNHVYFTNNSSPQGGALFTNSNSQVRISADKGHVIFNNNCLLDTNREYRNSITLGNNANVQFGAKKNFCVLFYDPIQHENSTTHNLIINPSTEDLGCVVFSGAKVNGSPKTENNLFSRTNNATESNLFSRSKNTIELQNGVLAIEDQAGVSTYKFQQTGGTLCLGNGGTLAAREKAANAKDAALTINNLGIILPQQLQHNAQAPKIWVYPSANNNTFTENTQATVTLSGNLTLTNEEGDNPYDDVDLSKNTQRVPLLYLCDNTDKKINITNLNIEAINAQSHYGHQGIWSPYWEEHTTQTNPASALTANTSHKTLYADWTSTGYIPNPKYQTALVANVLWETVYTMLSGILPPEHSDQITNIYGKALGIIANQRSHAKKPGFRMQSRGYSVGTSAKTQTHHKISFGFVQSFAHLKEKGSENKAASKNYLGTLQFHIPWLYDRILTSASLAYNYAPHEIKHIATDQTSQGTFSSHTWGLSITHAFPFTHPYITLIPFIEAHAIKASLTSFKETGKFPRKFATKSALYNLSMPLGITGQWHNTFHLPTTWNLKIAYQPVVYRHYPKILTTLLASNGSWLSSGTPVDRHSFSLRVANSVWLFSKLQMSFAYQGDLSSSTFCNYLKAGSTLAF

SEQ ID NO: 8745 - protein, 257 aa, Yersinia pseudotuberculosis
MKNKSKLLACCLMALPISSFSIGNNNLIGVGVSAGNSIYQVKKKTAVEPFLMLDLSFGNFYMRGAAGLSELGYQHVFTPSFSTSLFLSPFDGAPIKRKDLKPGYDSIQDRKTQVAVGLGLDYDLSDLFNLPNTNISLEMKKGRRGFNSDITLTRTFMLTDKLSISPSFGLSYYSAKYTNYYFGIKKAELNKTKLKSVYHPKKAYSGHIALNSHYAITDHIGMGLSFSWETYSKAIKKSPIVKRSGEISSALNFYYMF

SEQ ID NO: 8746 - protein, 1269 aa, Yersinia pseudotuberculosis
MHIQFREPISTSPAQPDAGRQHLFSRVPAAVMNPITLAIIVAFSTLVLPQTAWAACNSSGVGTYVCEGENNTAISLFGTDIAVETRPGFGITEHEITDSALSLTGSGTISYLDTNSSALDTDSRYSLYIKNDTLITEQSASINVQSNGSISSGVYIDNQSSDDSTIRVDLSGILSSSLSGAPALSIFSSAGNDSTIILNTHAISGVTGIQSDNNSQNGATITHVDVTGDINVENSGVSIRNAANGGTSIINFNSKSINTEYNSFYIQNTNYVGGVITDINIDGDISSANSQAARIYNYTNGGLASLRFRANNVTGSTGLYIDNSSQNGAVTDIILTGDLTATSGSALQANAYSDEGNIETAIKLNNVYSLYDALNISDYTRSGNILHDLDISGTITAENGTGIKVMGAAGEGSSTMLINVNNITSSSQSLDINNYNFLGSAFSAITATGHLTAEWGQGAMLQTHSSLGDATTLIHFNDITAMSSGISLINEANQGTSTADITVTGQINVSHGEGITLNALTTDGRTLVNVDVNNIASEYDAIRLYNYNYNDNYATGVDDGTGADNGTSTIDLITRGALVSQQGYGINIETNTADTYVTVGGLVHGGNGTAIGIHRLDNIQTSATLELQSGYALEGVTQALVFTGSYAEINDAALDLANSHLVLGGAGDAAFDLTRIDNREEAILDGDPNRITGFGTLTKTNNSIWTLTGANMADGDANAFLSANIAGGILVLDNATLGLTPDAGALTGATVNRLSAADIAADPTRVATETGALTLAEGGALSSLGDSVLSGNLISAGGILLSNHYTGGNGAATDDRLTVTGTYFGENNGSGEGAWLALDTVLGDDDSATDRLVINGDATGTTSVRVNNAGGLGDKTLNGINLITVDGLAQDDTFLLAGDYVTTDGYQAVVAGAYAYTLQADGEAATAGRNWYLSSELMLTEGVRYQVGVPLYEQYPQVLAALNTLPTLQQRVGNRYGAPGALADLNFDDNQWAWGRIEGSHQVTDPARSTSGSQREIDVWKLQTGIDVPLYQSQGGSLLTGGVNFTYGKAKADIHSFFGDGRINSAGYGLGTSLTWYGNNGVYVDGQLQTMWFDSDLSSRTAGHAVASGNNGRGYTSAIEAGKGYTLSHGLSLTPQMQVTYSRVDFDTFRDPFDSEVSLQEGDSLRGRLGVSLNKETTWSAKDGTTRRSHIYSHLDLHNEFLNGSKVQVSGVEFATRDERQSVGLGAGGTYEWQNGRYAVYGNVNLLGATRNISDNYAVGGTIGARVSW

SEQ ID NO: 8747 - protein, 714 aa, Yersinia pseudotuberculosis
MNKINMFMLSTFMRSMFMRSTLIPSTFILSTLLLPAVVLAEDTIIVERNRSQTDSYQATTSVTANRSPANIIDTPQNVTVVTHPVLEDYDVTNLGEALYFVSGITQSNTLGGTQDALIKRGFGNNRDGSILHDGIRSIQARNFTPTSERVEVLKGPSSMLYGMNEPGGLINVISKKPQLDPHVHLEANASSFKGGGGQLDVTGPLGESGFAGRLIIDHQETDYWRNFGRNRQTVVAPSLDWYGENTTVHLAWERMEYLVPFDRGTVIDPRTGKPVDTPRDRRFDESYNATRGDQDTVTFSINHDLNEFWSTQLNYAFSRNSYSDNQARATAFNAETGVLTRQSDATANAKSHSQAVQWVVNGDLDWGFTHHQLMFGIDYEARRVFRGDMIRGSKNNGFNVYDPIYGTLPPSTAVSAADSDQRENIDSRALFIQDSMRLNEHWLLLGGLRYDSFDVMAGKGRPFKKNTDSSDSRLVPRAGVVYNLNDWSSLYVSYTESFKPNVSIATAIDALPPEYGKSWEAGYKIDINNRVTGTLAVYDIHKRNIMVSELVDGETVTRTAGKARSRGLELDMAGKVTDSLSLIGSYAYTDARLTEDPDNNGNDLPNVARHTAALFLSRDFGSTSLISGDEVKAGIGARYVGKRAGDAANSFWLDNYTVADAFIAWKMPLSGYQLKWQLNVKNLFDKTYYPSSANNLRIAIGEPRQVVLQGSIDF

SEQ ID NO: 8748 - protein, 728 aa, Yersinia pseudotuberculosis
MHNKFKANTLAISIAAILLSVSFNTLAVVCPPEAPAGSSCDAFIANDGKAVSLANDLYITNGNALTYSGNTPFVAQYLRKNIIATGTDAHAIYADANTVFNNNINLERGISIISENGTAIKIDGSFSHTAAAPNFGIAVKDGSIVRGNGAAIDFRDAQTAIRMDINGSIYGDILGNGVTGNKINFAYQGATANALFDGYTISGVEKLENWGNLSIIAKDRTITWSGDFTNKNNASLDFKIGDEVDLASPILLVEGKTVFNTGSKALFSYVGSNINDIVNKDIILIQSNGGMSGPIDVAQNEITVVSNLSPLLAQTDSWVTTTDPIVNGGISGNQLVVRYGVNYEGTDNFLDLALQGGANQYQLNAANYIVSYALSQYNKTQSEASGELLALLTSAGNSSAGIASIADQITPNAEGGEVRAALRMVDKMRDQIDNRSLYLRNQSAATPWNFWAQTLYAHSRQSSGTYTPGYQTNGYGINVGVDRRFNDESLFGVSLGYQNANINIHSYGNEKDVDSYELMAYTGWFDDRYFFNGNVNMGYNSNSSTRNIGENTGYQGNTKATADYNSLQMGYQVKAGMTFDLDVVKLQPSVAYNYQWLRVDDYAEFGSPASLEVDRQSYSVKHLGAGLTAFNTYELGMGLLTPSLTLMGYRDLNDTEIIVKKAGLTTDQGKGKGRFIVEGDSVGNNIFEAKMNSNLQLKNNLSLDGNINYYKRGDYNEGYIGLSVSKHF

SEQ ID NO: 8749 - protein, 113 aa, Yersinia pseudotuberculosis
MGINSNTYSAKTEFVLNVGTKFFNDTLDSGVKVSYHSGKSNPSDWLAGTAANPILEIPSDYTIDLYSQYELNANTQLFFAINNVTDRYQVRPGSVVSMPDPGRTITLGFEISY

SEQ ID NO: 8750 - protein, 199 aa, Yersinia pseudotuberculosis
MNYKDIINACILSGVFLLHSPSALADTPSVGVSKGQESLQPAAEGNLWQRLIRNVSLAWNSPHQELYIPVNTWHNRWTYDDEKIASYNERPWGVGYGKYRYDEDNNWHSVYAMAFMDSHNRVEPILGYGYQKMWIPGEREGWRFGAGFTASITARYEYHYIPLPLPLPLISIEYNRLSLQTTYIPGTYNNGNVLFTWIR

SEQ ID NO: 8751 - protein, 753 aa, Yersinia pseudotuberculosis
MRILEKNHGKSRVRFNCTHPIKPAAWVLAANVSLLGCAYAATDENNSQKKERENNPANTTITVTASPLRHAGVTEDSGSYNTSSMSTATGLNISARETPQSVSVMTKQRMRDQNLNSVESAVNNITGISVRQFDNDRFGFTSRGMAVNNVMRDGVATFYDTRFNYGDNTLDTDMFDRIEVVRGAAGLMAGPGNPSAVINLVRKRPTQDFRGSVSAGVGSWEKWRTALDISGPLNSEGSVRGRFVTAYEDKNSFVNRYDQSKNPFYGILEIDVTPNTLFTFGADTQRTLTRGGMFGGLPLFNSAGGRTNYAQSATTASDWASAETRTQTLFSSLQHNFDNGWNIKGTFTFDNDKLRQDVMWPTGYPDPQTNIGMRPGSLSLIDGARRQQNYDIQVNGQYSLFGRQHQLSLGWNRQRQNIDNDYYLATCNATRTCPDLGDFTQPGWQYPKPVWSDKRAYGSKGRSDQSSQYVVTQLSLIDPLTLILGGRLTTWETRGDNFGTPQNARYKNEFVPYSGLTYDINRDLSVYTSYTEIFNPENRRDRNNTLLAPVSGQNYEAGLKGVAFDNSLDYSLAVFEIRQNNMPVPDTTAPRLPDNSQPYFAVDGTKTRGFEAEVSGKMTEDWNISAGYTQYNVKLPSSNTQTPVTPVTPRKVLKLFTTYTLPGQLNDLTLGGGVNWQSQIARNLSSPIGIQQIGQGSFAIYSLMSRYQFTPQLSLTVNLDNLFNQHYYTQIGQYNQYLLGAPRNVDATVRYTF

SEQ ID NO: 8752 - protein, 631 aa, Yersinia pseudotuberculosis
MIIKNTMTIKKYTLLTALSVTAFSGWAQGNNTTDNNDEMVVTANRFPQPKSSVLAPVDVVTRADIDRWQSTNINDVLRRLPGVDIAQDGGMGQRSSLFIRGTNSSHVLVLIDGVRLNQAGITGASDLSQIPISLVQRIEYIRGPRSAVYGSDAIGGVINILTGRDKPGTTLSAGLGSNGYQTYDGSTQQKLGEDTTVTLAGNYTYSKGYDVVAGMPGAGGPRQPDRDGFMGKMLWAGLEHQFNEQFNGFARVYGFDNRSDYDGYTNYSNPLALIDTRKLSSRTYDTGLRYKNGIYASQFIASYNRTKDYNYSPLFGQHDITASLDEAEQYNLQWGNTFQLTNGMISAGADWQEQRTERKSSNQNTTADFTQHNTGIYLTGQQQISDVTLEGAVRSDDNSQFGWHSTWQTSAGWEFIDGYRLIGSYGTAYKAPNLMQLYSAYGGNANLKPEESKQWEGGVEGLTGPLTWRLSAYRNDIDQLIDYSNLTNGYFNINKATIKGVEWTGSFDTGPLSHQVTLEYLDPRNADTHEILVRRAKQQVKYQLDWQVADLDWSVTYQYLGQRYDKDYSTYPEETVELGGVSLWDLAVSYPVTSHLTVRGRIANLFDKDYEMVYGYQTPGREYYFTGSYNF

SEQ ID NO: 8753 - protein, 806 aa, Yersinia pseudotuberculosis
MALCHEKDSLLLSAAMPHLLPPLIGLYLSFCPSGLWAESTALTPQDARKPSPSFSEQSPNTDLPKAEKIAETSKATDKPLSPDSLPKAKMPLPSTSKEDGEIVVTSKKQSDVIQNTGRSISLISGDTLTTRNVNTVFDLQYQTVSLQVTPQFGSGQPVFAMRGVGFNNYSSNNASSVLVYIDGVANPVSFATNGMMFDIQHVEIARGAQGTASGRNTTGGSINYILNRPSDHYTGGISVQYGRFNATKIDGYISGGINDRLRFRLAGQSEQGGAWQHNDQGQSLGRTNRNAARLLFDYDANDSLTFELNLHGSYDRSDSSGLHLFAPLTAVSGQSTPADQSRYITRWGTSAAFAKEIGVNPNSKPFSHIDTGGVSFKSKQEFSFASLTNLFSYDGIKRREYDNFDASTLGLADVAFNTKARVLANEIRLESDPQDRLSWVGGLYYSHQSLSDRYQSGFTDASYATEGDVSYNQRVDTIAAFGQVNYRFSDKLHFIGGFRIEHESRSLLNLTSHYITDGVITNPDNVSSHKNTQFTQPTGKLEVDYNPVKNDMLYASFTRGIKSGGFTTYNSDNAALSAKPFKAESVLAYEVGNKLTLPKSHLTLNVAGFYYGYSNQQIQSATFDSKNGGLIGQIVNAPRSHLYGGEIEATWMPIKSLTLSQSAGWAIGQYDRFSSLKGVQKLPDNSYVGIYKSRKGEALPFPQFTLNGSASYRWTIGDFYLTTGMNYSRRSRYHSFYGGVYNVPAYSLWGADITLSPKNSRWTVAIFGKNIFNKRYDITRNFFISGDNVALSGMPATWGIRLSGKF

SEQ ID NO: 8754 - protein, 108 aa, Yersinia pseudotuberculosis
MMKRNILAVVIPALLAAGAANAAEIYNKDGNKLDLYGKVDARHSFSDNNKQDGDKSYVRFGFKGETQITDQLTGYGQWEYNIQANNAEDTGAQDGQRNPSGLCWSEIC

SEQ ID NO: 8755 - protein, 556 aa, Yersinia pseudotuberculosis
MAKTWWNIVNPVVLGGTWAVCTVPNALAQIEGYNPISQTNALEQVTSVSQLRDVSPGDWAYEALRSLVERYGCIAGYPDGTYRGNRALTRFEFAAGLNACLQQIERLLPNGELEGSDLATLRRLVQEFEAELATLGARVDNLEGRVAFLEDNQFSTTTKFRGEVSFSLSSVFGDEKADGSGEELEDEVVFDNRVRLFLTTSFTGEDLLLTRLDALNPVPFGPGEGDNPNITGTSMTRLAFDEGNDNDVAIGKIRYSFSLGEMAASHNQEEEEHGHGAVKDAKLSFMIDAVGGEFAGNFANYNEFFSEELTGAISRFGRFNPIYYQGLEGTGASLTYNFNSALNLSLGYLAPNANDPSQKNGLFNGSYAAIAQLGIEPSEGLRLGLTYVRSYYPGGQVVVSGETGSELANVPFGEDTATSADQFGLSASLRLSPAFTLSGWGGLTLAHAQDNGFNNGVLVGEGDDATIFNWAVTLALPDFGSEGSLLGFVVGQPPKVTDNDGGFEDDDTSWHLEAQYRYQLTDNIAINPGVFVILNPEHDDNNDTIWVGTLRTIFEF

SEQ ID NO: 8756 - protein, 368 aa, Yersinia pseudotuberculosis
MNKTLLTLAVTAATIGTQANALEIYNKEGTQMSIGGHATIGLTGAHAGKDARVEEKSPRINLEVIHDLGNGFKADFKGEWAMNMLEGGKNTFTTRLGYIGIGHETYGRIAAGTQWSPYYMAAGVVDTPIGWSNDFLYDNQGLFGTARADKLAAYYNTIDFDEAGALTIGAGWQGANSVDETIGYKQDGKTVAGAGDQVYSTKTQTWLSSQNRGQVALGYTISGFNVNYAFNSGNVVERNVAKLAESNLVSAKYGNFGAGLYVAATFADNKNMNSFDSKLIAKTQAVDSILAYGFDMGLNLILKHEEMQDTENNVRVKSGTSVQAEYTINPRVRAYTGYNFDNQGETGANVDYRKAQDNQFIIGTRFYL

SEQ ID NO: 8757 - protein, 161 aa, Yersinia pseudotuberculosis
MGGAVNQTTINNGVLQVYGAANDPTIKGGRGDAAFTLGNAGSVVDISTYEYTLLDNGNHSWSLAENRVQMPPSTTDVLNMAAAQPLVFDVELDTVRGRLGSVKGVNYDTAMWSSAINSRNNVNTDAGAGFEQTLTGLTLGIDSRFSREESSTTQAGVVWTF

SEQ ID NO: 8758 - protein, 311 aa, Yersinia pseudotuberculosis
MNKEALAKKGAGALALLILSHPAVANNNTDTAGNVTVSTSLGLLNAESIESVYQSSEPNQKLSQLNWEANNTPIVKMDIAWDALPRLTLTAKGWSTLSSGQGVMDNYDWLTPQQTQWSDWSHHEKTNLNYANEIDINAKIWFLKQHNYRVGPILGYQENNQSWTAYGGNFNYNNGANIFTAPDGIVGVGYKQKFDMLYIGLAGSYRYQQLEFNALLKYSNWVNANAYDNHYNRKVSFKDSSKNSSYYSAVIDVGYYFTENTKLFVEAAWNQYSEGRGETQTLNYATGNVGSSKSGIEYQSQTLTVGFQYKF

SEQ ID NO: 8759 - protein, 759 aa, Yersinia pseudotuberculosis
MNTNSKKTYLSIAISSILYASTAMNANADSCTDYTVTDICEQSKYGAGEFHNIKLGDGVTAGSEDHHFVFNGEGYELYNSNANFSAQIASGTIRYTEVNNSHFTVNAHHFPDDTIYAGRAENTTLNDSLMWVATSADQTLAKGNSMVVVSTQMAMVDQIFVTTLNDGSLPFDPVITNSRYEDTSYEMLWGMKNEAKGWDTKATSHDSVFVDASKQSIEANGHSIGATFYDRATQVVKAGGESQDTHLFDHSYSWVYAEAKLTGLTEVNDAATVYLNAAATQGAYAENVVLNGEDTTLMVRASLDNNAYATVDNLILNGGEVVFQQSSGDQYASLNIGTLSGSGSFLFNTSIAEGKGNFVTIANASGEHKVIVNDSGHEITSPDMTTLDLIHDLSGDATFTLASISGANIIEVDGGTYVYSLNTWDNSARAGGNLWYLGSGLNTGTELEPEPEEKTTPSTDAVLSMASSNQFIFDGEMQNLRFRKGDLNNNKGDGASVWGRYLTNNTRVNAAHDAAYRLQQDGFEIGADKVLEMSSGQLVLGGFTSYSNNRVKHARGGNSTVDSYSLGAYGTYFDNSGYYVDAVVKANRFKNSLNAHMTNGGSVQSDYNQNAIGGSLEAGYHYSLSNNWFVEPYVRTSYYTAQDKDIALNNGMTANIDNNRSAKGEIGTHLGTKIDLNNGAIIRPYAKVAIEREFIKSNTVTINQVNDFNNDLSGHTAKYGLGMDINLTKQTSVYAEANYRNGTHVESPIMANIGFRINF

SEQ ID NO: 8760 - protein, 371 aa, Yersinia pseudotuberculosis
MKRNILAILIPTLLVATTSHAAEIYNKDGNKLDLYGKVKALHYFSDNTKSDGDKSYVRLGFKGVTQIMDELSGYGQWEYNFAANYAESQEAKDNKTRLAFAGLRYGNLGSIDYGRNYGVLYDIAAWTDMLPEFGNDSYTRTDNFMTGRTTGVATYRNTDFFGLVDGLKFSLQYQGKNGAEGETNNGRADTSKQNGDGFGLSSSYEIGAGVSVGAAYASSNRTLAQKNSTFGKGDKADAWTTGLKYSDNGVYLAANYAETRNMTPISGNAVINNVSTSVSGFANKTQNIELVAQYLFDFGLKPSIAYIQSKGKDIEGIGDTDLVKYVDIGATYYFNKNMSTYVDYKINQLNDDNKLKLNTDNVVALGLVYQF

SEQ ID NO: 8761 - protein, 707 aa, Burkholderia cenocepacia
MTVSLARPPVRPRRVAAALACLAASLAHADDSSGDAAVLPALNITAAHDSPQHLTDTISTGALGTRRQLDTPFSTTIVTSEELEARQPYKLGDVFANDASVSDNSGAYSAWASYMTVRGMQLDWQNGYKIDGLPFVTYGITMPYEQLERVELLKGLGGFLYGFVTPGGVVNYVTKQPGAEPVRSVDVNYRSTNVWTEHVDLGQRFGPNDMFGARLNATHEEGKTYNDGNIRRDSVSLALQANLTRDLSVSFGALYQDRRTTGQTPSIFTGSYPGGALPATISGGSTNLGGKDQYLNTNLQLYTAGLQYQLAPDWQLDVAYSYSKATRRRNESTLYLQDAAGNYTDSRYVGMEDHRFSQWRAMVEGKVRTGPLSHQIVLGASWQKQANDYSANSVFVPLGAGNLYAPNPYRYESPHGFIQYRTSEIVQKSLFASDTVQLTERWSVLAGVRYMNYEQRAFQASGAEDPGYRQNGVVTPTFAVMFKLAPTTTAYASYAESLEPGSRVNDVYANAGQVLKPLRSKQYELGIKSEHARWSATAALFRIERSAEYANAANVYVQDGESIIQGIEVGARAKFGAHWNAGVDAMLLDAWYANGIGNNGNRVAGAPRFVLAGDLGYAVPGVPGLTLGVDAKFTGATPLRAAGGLDAPGFLVVNAGARYLTRVGRHDVTLRASIDNVLNRRYWEYQYADYVKPGDPRTVSLSAKIDF

SEQ ID NO: 8762 - protein, 277 aa, Burkholderia cenocepacia
MKKTLLCAAAGAAAVAPLAAHAQSAGSNVVTLGWFHIMPLQSSTPMRTNVAPTPINTPLRLPPSFTSAGTGLHTSGADTVGLTVSHFLTDHIAVTSVAGVPPVFKVSGQGTIKPPGPAGALGTQNIGLGSVNPIVKSVRQWSPAVILQYYFGQATAKFRPFLGLGVSYNWFSDLQLNTNFIKQTQDNLGAILAAGAGKPGTTSVEAKASSSWQPVFNAGLQYNLTEHFGLVASVTYIPLKTTSTVTIKAADGSVLAESKSDLKADPIISYVGMTYKF

SEQ ID NO: 8763 - protein, 348 aa, Burkholderia cenocepacia
MTTPRFIRTAAAAATLAACGAAAHAQSALTLYGALDAGVQYLTHADGHRSTVRLQNYGILPSQVGIKGHEDLGGSWRALFKLEQGLNLNDGTATVPGYAFFRGAYVGIAGPVGTVTLGRQFSVLFDKTLFYDPLWYGSYSGQGVLVPMNANFIDHSVKYQSPTFAGFDVEALAATAGVAGNTRAGRVLELGGQYTSNGLSVGAVLHQAHGDVSAADDVSARRRELGTLAARYAFATLPLTVYAGVERLTGDLDAARTIVWGGARYLTSNGIGLNAGVYHTDSHTPAIGHPTLFIASTTYALSKRTVAYVNLGYARNSGQSSQTVYEYDPTPLAGASQFGAMVGMYHLF

SEQ ID NO: 8764 - protein, 383 aa, Burkholderia cenocepacia
MKKSLLALVALGAFAGAAHAQSSVTLYGIIDEGFLFNNNAGGKHLYGLASGVMQGSRFGLRGTEDLGGGLKAIFTLENGFDVNSGRLGQGGLMFGRQAYVGLSSQYGTVTLGRQYDSVVDFVGPLEAGDQWGGYIAAHPGDLDNFNNAYRVNNAVKFTSANYGGLTFGGLYSFGGQAGQFSKNQVWSLGAGYTNGPLVLGVGYLNARTPNQFGGMFNNGSASSSVSSPVYGAYANNANTYQVIGAGGAYTFGAATIGATYSNTKFKGFSAGPFVNQTATFNNGEINFKYQLTPALILGAAYDYTQGSKIDGNSAAKYHQGSLGVDYFLSKRTDVYAIGVYQHASGNVLDSNGNVLKATAAINGLAGSSTSNQVAARVGIRHKF

SEQ ID NO: 8765 - protein, 1762 aa, Burkholderia cenocepacia
MNHSFRSIWSEAAGCWVAVAETTRTRGKRSGGASGSSQRTARKATHHAARRSPLRVAALGAALAALSAGTVHASTCGNGAAVANGGTCALGSFSPTVNNDLVGATTVSGGDRVGLTGAWTGATGDMGYTPMPLGNTSIISGNPNQPLVTLGGKTQSVGTPDSITGGRTSVATYDSSAFVSSTAGSTVVQVYHDVNDNQYVNTRIGTVANSGGTLDVSIGNPANAPAATGNVMTIAAKQSDLAYADGTGSAPSVINWNSRNQIWFITGDYLASGGPVGSIELDVPTYAGTFTAFDGSTWTVTDAASLAAYNDFLVRSVRNGALGSQTAYDTAFGQAVTLSPQTFEYANDVSPGDKNALPRNYPSAMHGTGANATLHIGKDGQIDFRGSNTIDESAAVVAENGAHFVNDGRLSGDFTLVRLLSGASGVNNGTISSGYTVGDNVNTGGATPSDNFGLNTYVEGSGVYANGAGTTFVNNGVMNVGAWNLTRNRLDLQNYAVAATDGARASNAGTINVGVNATTLDSQVIGGLVAGGSFTNEAGGTIYLGRAAQYDPSSPEAANDVALSAHGYGILLGASGTASNLGTIVIGTQTQNGAALASIGSTSGTLTNAGAIVVNGAAPGTPLANVGMLAADTAATVTNTGTITLNGVNGIGIMVVGTGTNATAATSTGTIDVAGGLDPASGTRNYGVWAEGPLAKATLDGALNLTGTGAIGVHARSGATIDVGANAVPAFMSGTHQIGFYAYGAGSKINVAAQHLSVDTDDSTLFRVAGGAAYTGASAAGALTTDVNGQRARGVLATDAGTTLSTGNAIYDVNGANGIAIAVEGGAKGTIDPGTTINLNAAGATAGIVDGQAHDLAGAAAGAPVATTLTNHAAVTSSTAGVTGFIAQNLGTLENRSTVLLTGAGSTGVVAGTLGTVNNASTIRVSNGTGALVQGASATLANAGSIEADDGVAGVRLTGAGASVALSGAGTVIANGSADGVLIDSTVTGGGIAAGATSIAVGGSGSGIHNLGANATIALSGTQVATTGNGAAGLASTGAGARIATDAATVVRTAGADALGLSVSGADSTLAANGTTVATTGANAHAIVMDGGATALLSGAKISASGAAADGIVAQNGGRIADTGSSLASVAGNGATANSGGVLALTGTALTGATAGVLTSDTLANGATSSVLVDGGSVTSSTGPAFAARGGTADIAVRNGTVVTAGNGTLLNLANGSNVTFSASAVNLAGDIVSDASSTGNVFLANGTTLTGKIDPVALSVDGTSTWRMTGSSVLSSLNNAGLVAFAAPTGSPTLTGSYKTLTTGGYVGNGGTLALNTYLGADTSPTDRLIVNGGTASGTTGLKIANTAGTGAQTTGDGIPVVVTANGGTTAASAFHLAGPVQAGAYEYRLYRGGQGDANGWYLRSQLDQTDPGDPIHPSGGDGGNNGNGNANGNGGTLAYRPGVSGYAMTPLLNVDYGFSTLGRLHERVGDIYNVEKQQPGNRDGVWGRIGGQSLDANAGRFSADERTFFAQFGKDWTLDQAPDGAGRTHAGVTASIGVSNASFSDMARAGSPDLSTSTGSVEMHAQSVGGYWTRYLPDGTYFDSVGQVTHYGNRYRDSYGNEASQNGFGVALSQEVGKPFAIGALPVAVEPQAQLMYQYLKLNGFNDNVSAVSGTTTNALRGRVGVRIFRPNLQSDAGGGAATPYFTADVLHDFLSPGQTVVGGTPFATHLGRTWYELGVGVTAGFGKSGELYANAKIARNIGGDYRRGIVGQVGYRYSW

SEQ ID NO: 8766 - protein, 234 aa, Burkholderia cenocepacia
MKKALSLVMVFLVAVAFSATGYSADKYISGNIGISWLNDYESSESRDGSFIPNTGLFEFGSGLTLAAAFGCDYGDYRAEAEIGYQSGDVDTFAFGTGERDPFAMDMTGDVTILSIMGNGYYDIALGSDVELFLMAGAGFAQVNFDDVAAAEEEQMMGPNLALNVTEVAFAYQIGAGLALPVSDGIMLEAKYRYFATTDFTVSDDFDLPLNGIEDTEWVGNIESHSAMLGMRVML

SEQ ID NO: 8767 - protein, 383 aa, Burkholderia cenocepacia
MKKTLIVTALSGVFVTAAHAQSSVTLYGLIDAGITYTNNQGGHSSWSERSGQINGSRWGLRGTEDLGGGLKAIFVLENGFNIANGTLGQNGREFGRQAFVGLSQDQFGSLTLGRQYDSVVDYIGPLSLTGTQFGGTQFAHPFDNDNLNNSFRINNSVKYTSVNFGGLKFGALYGFSNSNQFSNNRAYSAGVSYTYAGFNIGAGYLQLNNDTSGLTAAAVTNSAGAVAGDNTFVGKRQRVFGGGLNYTFGPATAGFVFTQTRVNRALGISAGASGVSSGLGLDGTFARFNNYEVNARYALTPALSLAGSYTYTAGFLDGRHPGWNQFNLQTDYALSKRTDVYVQGVYQRVSTDGLGIGAYVNGLGGASSTNKQIAVTAGLRHRF

SEQ ID NO: 8768 - protein, 784 aa, Burkholderia cenocepacia
MSFTFAARPSRGRLALACAAVFAWPAAQAAAIDGASADPAPGRSGNPAGRAASIAAVVPAQQGDTLTEVSVTARRQPVDPDTPAVVESITREQIDAHTNVTTEDALKYAPNLMVRKRYIGDRNSVFAGRDFNELQSARGLVYADGLLLSNLLGSSYAYPPRWSLIAPDDIERVDVLYGPFSALYPGNAIGSTVLLTTRRPDKLEASLSTQFFTQRYHDGYGLADSFGGNHQTARIANRIGKFWFSLSLDRLENDGQPMQYASPNSAYNPKLGAAVPVTGAATDIGPNGKPRTIVGAQNIERTEQLNETVRMGYAFTDRVDATLTLGHWENHYRQHGETFLRDAAGNPVYGGNVSIGGRNMTVAPSAFAPQRGDQENWLYALGLNGRLESGWRLSGVVSAYDVSRDVLRAASTAQGGAGTLFQGDGTGWRTLDLKAEAPEVKGHAFTFGYHYDNYFLRNVTYNTADWLAGPTTSLASVYQGDTRTQALFAQDAWRFAPGWLATLGLRYERWDAYGGALGNAGGTLGYADRGANALSPKVALQWDATDVWRFRVSFATGTRFPTVGELFQGTISNNAIVNNNPGLRPEKAIDWDFTAERDVGVGVVRASVFQSDLRDSIYSQTTVSGASTVTNISNVDRVRVRGVELGFSGRNVGLRGLDVDANVSASNAQILADTANPAYVGSRFPRIPRMRANLLASYRFDEHWLASVGVRYSGRQFNTLDNSDVNPDVYGGTSIFTVVDLKARYRFDRHWTASVGIDNLTDRRYYVFHPYPGRTFFGELKWSL

SEQ ID NO: 8769 - protein, 356 aa, Burkholderia cenocepacia
MTKHIETRGIDCRVRPVHAGFRLTVALACVAGSGTASAQDGVTLYGVIDEFAQVVNTGNGYTAAINSGGQWGSRFGLKGGEDIGGGQKIEFALENGFNPNDGSLASAGSLFNRQAWVGIAGQWGKVRAGRQNSPLFNDQGGQDAFGGVTQASGMDNLTVFAFRTSNTLSYQSPEIAGFQGGLYFGFGDAGGVRSAGSSQQFDLTYEHGPFGAFVAGQWLKNAVATTTDRTIMAGASYAIGKATVYGGFSAVKWADLGIDSRVYGLSVKYQFNPANYVALGYAYLHDQSSQGNHADQLGLMYEYDLSKRTSFYGALSYLRNRNQAGYTLAGAANPGLPLAYPGANARGVQLGIVHRF

SEQ ID NO: 8770 - protein, 1886 aa, Burkholderia cenocepacia
MTTRHSKNITGTTGAIDSSLLGSAYSYYGGVVQTAHSSGKTASGVKRVFAAAMLSGASVLAVGIAGTGNAAAGTCVGPINETYTCAGTFDDTIEYDSGVDDVTLVLGPGSFIDTTENTSEHDHDNAGIVVVGESDMAIVNNGSIFTGDNTTWVETDEEYGYYAYLGDGHHGIAAYSNWDDAAVENTAFGTIVTTSSESHGMVAEALEGSASADNAGLIGTSGEDSHGISATAKYSVDVVNSGTITTDGTYSHGIWAALDSEYGYGSFGGIIEISNSGSIETSGESASGISANAEEGDVEIANSGSIVTEGDEALGIWAHGDDVDVVNTADGSIVTYGADAHGVYIFGDTVSLSNAGTIETYGEDAHAVVAYSGGIDTTTIVNTGLIQATGEEADAIRASGPTVRITNDVIEEDEEVVDYGVIRSEDGAAIHVTEADDARLYNNGAIYGNVSIETDEYGYAVNTGSISSDRKWKAALAIDAEEGDVVVVNDGDIEASGRKAKGVELEGYDVTLTNTGSIETWGSDGHAVDLEGDEEYGEVTLNNSGLIQASGEEADAVRASGETVRITNQAVLVPGETDAYDTTIYGIIRSEDGAAIRVDESDVVYVVNDGFIYSNISIEADDYAYVSNAGSVSSDRRWKAAVSADVEEGNAVIVNDGEIVTTASRAAGIEVDVELGDAYVVNSGTITTGSLEEGEPEGGWRSHGIDVFAEDTVLVLNTGDVTTYGHKAKGIRIETQEGTAAGVNSGTIDTWGEDSTGLIVTATSREHYDGYSYFDISGIALAGNIGSVETRGDDAMGVVAVAEGNFAAALNVLGGSISTSGDDAHGLVAVSGFESVEDALEGSEYSEGGEGSYAIAVNGLPPQLLAGFSGIGTEMGSGVLGEIADVLAEALPEGEYDPADFRSTIVTTGDGAIGVLAVSSNGGAVAGNLYGDVVTGVLHEEGYSVGGDHAYGVAAMSVDEGGAIAFNAYNASIVTNGAYAHGLLAISEDGDAMAMNKYASSIVTNGLGAVGIRVWTDGESDEYSSADALVWNVGSSVTTYGQGAQGIVAFSEEGDVTVANAPMTIGEGEDEEILAGLIETHGDEADGIWASGESDVDVYNSGSIITHGEGANGISASGDEVDIDNSGTIQTSGDEAFGVDMRGWSVSLDNSGTISTSGKYAHAVVGDSYSDLTTTVYNSGTIEATGKYANAVRVSGPTVHVTNTEDGVISSGDVAIYAFETKYASIANHGEVEGSIHVSAYDYEDFASTYIVNTGSVSGDIDTSFGESDDIIIVDGGTVGGAIFTGDGEDEVTISGTGVSIAKGIHGDGEGDLHVLFEQDDTVTFSDGIEGYAISNAHFVGFSSGTTVFDGVNIHTEEGEILVGEDATLATTIENAFAFADETSVLGRLKVVAGSSFGFSGDVVFDEGGTFETGLTGDGAGVVTGDTVRFASGSTIHVDAGAGFTETVGSDFLIASSESESGVTDDGASVTDNLILFKFLKVMNGDVVSEGAADELFLRIEVEETAFDLETEAKGTGNLLSVASALDVYIETQPLDNPLVQYLLQFETEEEQLAALLKVIKDTVPDESNASAGATIASTDLIYDMIMDRLSGGGFVVADGGMTGLSAGDAVLGGDGNWALWGRVGGSKASFTPSGVNGFDADSWGVSLGLDGEVAPALRLGFGGFYIASDVEENGAGANSTNDIAGYGFTTYMSWRPGAWYVNGALGYGMNTYDSRRTSLGSVNTADYDGTQFVARAEAGYMIVSGQWDLTPNVGLRYNRVDIDGYAETGPLPISVNSQTVDSLRAVAGVNARYTMPLDGGGKLIPEFGVKLLGELADPDGAITGQIVGGGVFVTQTTPRDDISYGVGTGITYEASDKFSIRVTYDGEFQSDYDEQALSAAIRWAF

SEQ ID NO: 8771 - protein, 140 aa, Burkholderia cenocepacia
MLGATATATATAAAHAQSSVALHGLLDASIAYTNNQSGKHAWGTHTWRQGRGLPSNTVFGLSGSDGPGARLRVAPRAGRIVDAYASRGDDRHPASVPTARRERHRASGARTARELGVPPPRAKAHWRARPVVECAPPLPG

SEQ ID NO: 8772 - protein, 386 aa, Burkholderia cenocepacia
MKRTTLSLISLASFAAMPVAHAQSSVTLYGVIDTSITYVNHAQGKDNAWMLGNSSAGNLAGSRWGVKGTEDLGGGLKALFQLENGFDPSNGRQGQGGRLFGRQAFVGLTSDRYGTLTFGRQYDPLVDLVQGITADNYLGSAFATPGDVDNYDNSFRVDNAVKYTSAVYSGLQFAAMYSFGGIAGSTGAAQSYSAAVSYNNGPFSVAGGYFHATNSPASNGVRNGWTSSSDGTFDGPINSGYASAHSFGIARIAGQYVAGPFTFGVGYSNAQYRRDASSVFGSNEHYNTGQGFVNYQATNALLVGVGYSYTRSGGDTSATYHQVSAGADYSLSKRTDVYLTAAYQHASGQTGDGNGGSMAAQASIGSYGYAGTSSQTMVNLGLRHRF

SEQ ID NO: 8773 - protein, 754 aa, Burkholderia cenocepacia
MKKVEQKKMEWATGTRLRAIAAAASVAFGTAAAGHAYAQTAPAVNAGATASASSAQTGATATTSTSAQNGTLPAITVNAASAGDGTVGLVAKRSTTGTKTDTPLNEIPQTINVVTAQQIEMTGATDVNAALRYVPGFSSYGSDNRSDWYAALRGFTPTAYVNGLQVPNTINLASWRVDPYMIDSISVLRGPTSVLYGAGDPGAIIDVHTKLADGERVREAGVQIGNYARKQFMIDVGDKLDPDGKYAYRFVGVARDGNALTGPNNDQRVALAPSFRWRPDADTSLTLSATYLQDWGDISSNFLPAQGTVLPNPNGQINKDIYEGDGNFNYYRKKQWSVGYQFERNLTPAWTFRQNTRLMHLSLDNGSVFGNGFVEGSTTDVSRWAGVFQMNYSRFDIDNNLEGRFATGPLQHTLLLGFQYNRQTATDSEWLAAAPPLNIYSPVYQPVTTAVFTPDATFRTNTYTTMNTFGLYAQDQIKWNRWTLTLGGREDWVNMRMDDRAAGTSTKADVTAFTGRVGLTYQGDYGLSPYVSYATSFNPLIGVNLVGGGLPQPTRGKQIEAGLRWQPPGKNLMLNAAIYQINQTNVLTSALPSQDPTGTKSVQTGEVRSRGIELSATGKVTRNLSVIASYVYQDVKNVQANDVSLNNWPVDIPRPRQMASLWTDWTWYTGPLAGFGLGGGIRYQSASAGAADNSLTVSSVTLFDAGLHYDTRNWRFAVNGTNLFNRHYISGCQSNNVCIFGTDRTVIATAKYNW

SEQ ID NO: 8774 - protein, 712 aa, Burkholderia cenocepacia
MSKRQISGRRFPVLALSLCSIAGVASCPAAAAEFDDELPAVEVRSRRHPNDPRAESVSTATRTASDPRDVPQTIDSVSVEETLSYGGRTLADALAGVPGVSNTSDTRFDSFRIRGFSSAGDLLLDGMRDDAQYVRSLGNIERVEVLKGPAAALYGRGSGGGVINRITKQPLPENFGHVSATTGSYGRLGASVDLNRMLSSAWSMRLNAGREHAGSFRDHVDGTRQFVAPSIKWHDARRSWLLQFEYDTYRRVPDRGMPAPVAAVDAAGKPLAFSLPSAPRATFFGAAGRDTIRDETMNWRSVFTHALDGDWELRHTLGVLDLRSTFDNTYVTQSYVAKPRDYRHVQRARYLQDMTQLNVQTGVELGGKVATGPALHHLLFGIEYGWQKRTPALWQADAAPVPVTGPDRFALVGSTPRPYAMNRHRVSDYALFAQDRVDLGRAWKLLGGLRAERFDVDSTNALNGLHARRTTTAWSPRLGVVWSPVGAHSLYASYSKNFAPVGGDLIGITPDARGNANDLGPQYTRQYEIGVKSDWRDGALSTTLALFQLDLYNRRIADPVRPGFFDLTGLERNRGLELGVAGRLTGDWFVRGGIGWQHARVVDAEPKYAGKRSAGVSASNGSLFVSHAPLRGFFAELGVVYEGARYADRDNLLELPAYLRWDGKAGYRTRDLEVTLAAVNLADRDYYANATGLAQIVPGAPRTFTLTAAYKF

SEQ ID NO: 8775 - protein, 375 aa, Burkholderia cenocepacia
MKRKTLALSIAAAGLCAGHAHAQSSVQLYGLMDLSFPTYRTHADANGKHVIGMGNEGEPWFSGSRWGLRGAEDIGGGTKIIFRLESEFVVANGQMEDEGQIFDRDAWVGVEDERFGKLTAGFQNTIARDAATIYGDAYGSARLSTEEGGWTNSNNFKQMIFYAAGPTGTRYNNGVAWKKLFSNGIFASAGYQFSNSTSFATGSAYQAALGYNGGPFNVSGFYNHVNHNGFRNQTFSVGGNYTFDIVRLNAGYFRYNGDQGPLGQRHDDSWTVSMKIAPKGALDYELGYQQMRIKNAANNADGFTPNANLGAFSLTNGVANGFKETIYGSVFYHLSKRTEVYLAGDYMKLHGGYTVSSTFGAKNQLELTSGIRTRF

SEQ ID NO: 8776 - protein, 906 aa, Burkholderia cenocepacia
MKPTALGSAIRSIVWAEVALTAALGTSAYAQTTPVDGNVAAEQAGSATAAAPAPASGTAAGGQTVKKLDKFEVTGSLIRTSDKVGHTEVQVITAKEIQQSGYTTVADFLRSTSANSASSWGQTTMNSSAPGGAGMALRGLSEKYTLVLVDGQRVANYAQSVNFTDTFFDVNAIPLNMVERVEIVKTGAVSVYGSDAIAGVVNIITKKNFQGLQIDGQLGKAQHPGDGQGNFSVLAGFGDLNSDRFNVTAAASYYRDSGSTLGDRDMTSAQDFTQYPGGLAAPLGPNQQSYWSLADGSRVPLSPCPPGSKTSATNCTYNPAASTSLVPSTTRLNAKVRATFKIDDNTQAYAGFWVSRDETVQLQGPASISSTTNVYNPSTGSVSPLPRTVPVSNPYNPFGVPTAINLTFPGNVVGADTVSTFWMANTGVKGSFDTGRFGAWDWSADYGHSQSTVDTTYRNRINVAGLENMLANGTYNFSNPAATPNGLNGVFTDDDQQAISKVDSVTAKASTSNLFTLPGGPVGLGLGTEFRHESSTINPQTLASQGVSAPANVQTVEGSRNVAAAFYQVDIPILRNLTFTQAGRYDHYSDFGGAFSPSFALRFQPVQMLTTYASYSRGFRAPTLVENSQAVYLSHQNLVDPNDPSGVPTKHFTTEQVAGNPNLQPEHTKNYNIGFQLSPDAMTDIGAAFYKVRIDGVIGTDDPNAVLVANDPSRVVRNADGSVRYLVQHFVNLGALDTDGFDLNFRKALRTKYGTFTLAGDWTYVWHFKLHSPGTAPQDFAGNNLALLQPFGASNPRWKGNTSVSWDYRQLTTTLTWQYTGPYTNAVAAEFGDGGTGSVASYSQFNLMFNYRGFKHWTIYGGITNLFDKKPPFDVEWQAVPDITGYDQSLYTNLGRFFQVGATYRF

SEQ ID NO: 8777 - protein, 935 aa, Burkholderia cenocepacia
MKQRVLALAIKRIVWAELALTAALAPPAFAQSQPAPGAVAIADAVASGAPVTVAQAGGTPGAAAATGTAAPAAPDAAAGAAAEVTPAAPGANGQGKVAQIKRFEVTGSLIRQADKTGFQQVQTITPKEIQASGAVTVTDFLRDAAANSANSWGEGQSGNFAAGAAGIALRGLSEKYTLVMVDGQRVAPYAFFSNSVDSFFDLNTIPLNDIERIEIVKTGAVSQYGSDAIGGVVNIITKHNFRGLQLDGSLGSAINAGNGDGTVKFGVLGGFGDLNADRFNVTAALSYYKSNGFTLADRDSTRNQDFTGKPGGFSLLAPSYWNMPGGVAQALSGGCPFGGSVHPAVSNSLSAGSPGTVCGYNTAESTSILPMTERLNAKLHADFKIDDKTTAFADFLESYNTTTTNDGLWNNVIGNSQNPALVWNPQTKLLSPFNFTVPVSNPYNTTGAATPLTYAFPNTVAQKTWANYWRAAAGIKGSFTLPYGDWDWATSVSHSQSTVSNVFTNQLNVNALNNIYQNGTLNFANPAATPNAFNGLYQEANNLGISKLDTIDATVSTPNLFHLPAGDVGIGFGAQFTHQSETLTPGSEYLSGAVITPDLETVDGQRNVAAVYYQINVPILENLTFSQAGRYDHYTDVGGAFSPRFALRYQPIKALTLYTSYNRGFRAPTFVEDSKSQTLGIQIDPATGQNYTSITVGNPNLAPERTRNFNIGFQVSPSRYTDIGFDWYKIRIDNVIGQGTPSQIATDPTTGQLLYKVIPYQNLGYLDTNGFEGTFRQGLPLKGWGTVTLSGDWAYINSYKIGFPGGTPVNGAGNNFTITQPFGGSFPRWRGNTTLDWNYRKFDAALTWQFTGPYAQNLTPAPAPSKVGSYSQFNLMMSYTGFKNWTIYGGINNLFNRTPPYDPIFANGTLDQSGYDTSVYSYIGRFAQIGATYKF

SEQ ID NO: 8778 - protein, 213 aa, Burkholderia cenocepacia
MHKTIRTCVTAAAVAAAFAAMPSLSHAASPGEGINQGDVLVRLRAISIQPNERASDTLGALNVGVNNAIVPELDFTYMIRDYLGVELILGTSRHQLTSSLGNLGGVGVLPPTLLLQYHFNHAGKVRPYVGAGVNYTYFYNNGLNVGGQGVSINKSSFGPALQFGVDVQVTKKIFMNVDVKKIWMSTDATLGDKGIGTLHIDPLIVGVGVGMKF

SEQ ID NO: 8779 - protein, 363 aa, Burkholderia cenocepacia
MTKKTFLALAACTFPAAAFAQSSVTMFGLMDTGISYVSNQGGHGAAKFDDNIFFPNLLGFEGKEDLGAGTRAIFRLVNQYSLGNGAIIGGGLFARTAYVGLQNDRYGTLTLGNQYEFMVDALAASGNEIAQDLVGLYGFRNGPFDRLALPNNPTGAFDWDRVAGSNRVANSVKYTSPSLSGLTFGALYGFGNVAGSIGANNTVSVGASYDHGPFGAGAAYTNQKYGAADGLPPTSVRNWGAGVHYTVGTVTGKALFTTVHNARNGAGAWSAEAGAAWRPSPVWVIGASYTYMKGNDTLDDTHAHQFLAAIQYWLSKRTMVYVAGVHQRASHGGNAQINGVMDANGASSGALQSIARVGFSTRF

SEQ ID NO: 8780 - protein, 389 aa, Burkholderia cenocepacia
MKRRSKKLPWYVFAPALLLAGTAHAQQSITLYGLIDEGLNFTSNAGGHRAWQMSSGDTFGSRWGLKGSEDLGGGDKAIFQLENGFNVNSGKLGQDSSMFGRQAFVGLSSSRYGTLTLGRQYDTSVDALGFGGITAAGNWAGDIATHPFDNDNTDWDFRVNNAVKYVTPTYRGLTAEAMYGFSNQPGGFSNNRVWGATLNYQSGNLTAAASYLKLNNPGLAAGGAVNSGDLFNGSSQQDIGVAASYQFTHVLVGAAWSHVDVYNPAGNAWIDNTALQNGATWNAWKFDNFELNAQYYFTHALWLGASYTFTMAHLYTSDTKYVPKWHQIGMMLDYDLSKRTSLYLQGAWQHVVSARTGTSFDEAQIVDASAGASSGPNQMVYRMGMVHRF

SEQ ID NO: 8781 - protein, 1040 aa, Burkholderia cenocepacia
MKKYLAIFLLMLVVPLTISAQQTITVTGTVTDTQDEPMIGVNITVKDVAGLGTITDINGNFSIKMEPYHRLVFSYIGYDDVEVLVKEQHTVNVKMKESEASVLDEVVVTGMGAQKKLTVTGAVTNVNVGDLKRFPTSNMSNALAGNVPGIIARQTSGQPGKSTSEFWIRGISTFGASSSAYILVDGFERSSLDELNIEDIESFTVLKDASATAIYGSKGANGVVLITTKRGKAGKINIDAKVETSYNTRTITPEFVDGLSYASLMNEALVTRNLGMAYQPEELELFRTQMDPDFYPNVDWMDLILKNGAWSYRANLNMNGGGNTARYFVSASYTEDQGMYNTDQTLRDDYDTNANYKKWNYRMNVDIDITKSTLLKLGIAGSLAKRNSPGLADNEMLWGMLFGYNPIATPVYYSNGYAPISHRDNVNKLNPWVASTQTGYNEDWQNNVQTNVTLEQNFDFITKGLKFVGRFGYDTDNSNWINRHRQPDLYKANGRRQETGEIIYEKMFSAYDMTQSSGSSGKRREFLDLLLSWERAFGNHHGGVTFRYTQDSEKRTVDIGTDIKNGVSKRNQGLAGRFTYNWNYRYFVDFNFGYTGSENFAPGNQFGFFPAFSLAWNVAEESFVKNNLKWMNMFKIRYSHGKVGNDNIGDNNRFPYLYTIATTGYNSEGKPNYVYNWGFGDYGKSFIGTHYTQMASNGITWEVATKDDLGIDLSLFNDKFTATVDYFHEKRTGIFLTREFLPDITGLESKPKANVGEVKSQGFDGNFALKQKLGEVDMTIRGNITYSKNEVLEKDEENQVYSYLYQKGYRVDQVKGLIAEGLFADYDDIRTSPKQEFGTVQPGDIKYKDVNGDGVVNDNDKVAIGATTTPNLVYGIGASFAWKGIDVNVHFQGAGKSTFPIYGKCVYAFSESDWGNIFKDMISDRWVDSETAAKLGLHANENPNATYPRLTYGENKNNQQTSTYWMRDGRYIRLKNLDIGYTLPKSIVNKLHFNNIRIYIAGSNLITWSKFKTWDPETGNPRGEAYPLTKSVTMGLSVNL

SEQ ID NO: 8782 - protein, 478 aa, Burkholderia cenocepacia
MLLAWGLPALAGVSLTGVAHADDAAPAPLTVAQAAPAAGASSTVAQATTPNAVINAEATQAVTPPDEPSAQSKSKGFIADSHLDFLFRNYSDVLDSKGGPHRHAWVQGAMANFESGFTTGLIGIGFDASLYAALKLDGGQGAGSMVHIAKGGGGGNQLAWAYPGIYDIKARISNTVVKYGLQAVDNPFMEQHDNRALPPTFLGATIVSNEFKNVMLEAGSFTKTDARGHTTLTNLTTQYGGTRINRLTYVGGTWDYSPNGEVALYANQADDVWHQYYASVKHSIGSTQTIKWTGFGNVYSTHDTGDALQGKIDNNAYSLSLAAQHGPHELLLGFQQVLGDQFFDYLNETNGIFLTNSMDVDYNAPHEKSLQLRYTFYGKEAGLPGFKAMVWGVTGWGADGSAGAANDPSKSSIYWSNGAPVQGRHHEFGFIPSYTFQSGKLKDTKVTFIAMWHNGSAHYSDATNTEYRLVVNLPLHAF

SEQ ID NO: 8783 - protein, 350 aa, Burkholderia cenocepacia
MQRKAFLVGACVLCATPAHASSVTLYGIVDSYVEFDRIGSLSSMRQSGGGASTSRFGLTGVEDLGGGTSTKFVLESGFSPADGSFQGGTLFYRQAYVSLQNTRYGDLRLGRQYTPAFYVVYDGDPFGLNERLSPLALLATSTDTITSNTTPPIPRFNQAASYLSPDWNGLRVMATYGFPTPNALSTQAGRNYGAGLQYRIGGLYVGAGFQGDTSAGNLAPVISPSTTRHYVFAANYAFARVKLYAAFLYGVGTAARLPAFSTASVGASINVGALDRVLVSVVRRDVKGSANDATALGVGYDHPLSKRTSLYARYLYMKNGGDARNTVVAGLQPQPGGTEQVFALGIVHRF

SEQ ID NO: 8784 - protein, 642 aa, Burkholderia cenocepacia
MNIRHLLATSAATALLSPLAHAAGDTAQAQPAAPASGADLPTISVTDTRHLPESFDRRYASTQVLTREDLDRLSPADPSITQALATLPGVTVAQNGGPGSSASVSIRGSSASQVAVFIDGIRIGSPTTGIAPWADLPTEAFERVEVISGPAAASFGNNAMGGVVQLFTRRAANQPNRTTVSFGGGSNKTFDTQFRTSGTVPPTGPLAALGGLTYSLGLHDYNTAGIDATRPFFYGHEDGRNPYHAQDLDARLGYARDNWSISTFALYHRSDLSYDNSGYANRELDHQLTTGVAFHLDITPDTQFDQSFGYANDRQFIYADNPALATDQINSQRISTSTSLTHQERGFHLFGLPLSGESKLAYDFTREQAFLPVDIPGGVPTRNDSAFSLHQSATLGRVTMFVAGRHEIIAGQAVNTGNAALSWAITPVYTARVSYGNAFRLPTFNDLYYPGYGNPNLSPERSTSVEAALDANTAYGMFTAAIYDTRVNNLIAYNPATFSPMNIGRSHIRGIDLSYKGTIGRSTPVSVAVGILNPQDETNQTWLSRRPRQTVSLNVDHTWDELKLHALSTGASLLYGGSTFDDPANRQYLASYLTVSLRASYRINAHLTVSASLSNLFDRQYMTAYGYNTLGRTAFGKVSYTF

SEQ ID NO: 8785 - protein, 755 aa, Burkholderia cenocepacia
MHCYTLARRPICAALFGAFGLSAAPAHADSSPQGAPPPSAVLTAASARGEAALLDPVTVTATRTATAASRTAASVSVITDEDLEEQQATNIKDALRYEPGITVRRTAYRPGSAALGGGRDGDSSINIRGLEGNRVLLMEDGIRLPNAFSFGPLEAGRGDYADLDTLKRIEILRGPASALYGSDGLTGAVNFITKDPRDLLSIYHKPYYFSFRPSYDSTDRSIGATVSAAGGNDRIQGMIIADGRRGHEVDTRGDNNSASTLRTTSNPQDVYSESLLGKLVLTPTTRDTIKFTAETVQRRVSTDVLSAINAPATLGLTTHDRLERNRFSVDYDFRDDAFRWFQTAHVQFYYQDAKQDQYAFETRGRLPSRSRDNQYKERTFGGAAFAESGFSTGPLAHKLLYGVDGSLSRVTNLRDGTVPGVGEAFPNKAFPDTDYTLFGAFVQDQIGYGRLLVTPGLRFDTYRLSPTENDPLFTGKAVSTSANELSPRVAVLYEITPAVIPYVQYAHGFRAPTPDQVNSSFSNPVYGYTSIGNPNLKPETSDTFEAGLRGKAGTGYGVVRYSAAAFTGRYRNFISRTTLAGSGRPVDPFVFQYVNFADARIHGLEGRAEWVMPNGITLKTAMAFTKGSTQNDGAASQPLNTVNPFSAVFGVRYEPTERWFVQTDLLFQAAKRDKDVDKSDCSNKACFTPPSSFVVDLRGGYRFNKHVSATIGIRNLFDRKYWNWSDVRGIAADSQVLDAYSSPGRTVAVSMKVDF

SEQ ID NO: 8786 - protein, 692 aa, Burkholderia cenocepacia
MRDLPRLPLRPLSSLSLILFAAVAHAQTEPPAVSGTPPTTALAPIFVTANPLGDSELIAPTVQLSGDALTRRQADSLGETLNGLPGVSTTTYGPMVGRPIIRGMDGDRIRLLQNGVAAYDASSLSYDHAVPQDPLSIERVEIVRGPAALLYGGNAVGGVVNTIDNRIPREAIQGVTGALDARYGGANSVRAGAAQVEGGNGRFAFHVDAFDRETSKLRIPGYARSSAQRAIDGPDTPQPYGNVPNSDGRVHGGAVGASYTWADGFAGLSYSGYESNYGSVAESDVRLRMRQERLALASEMRNLSGPFTKLKFDFAYTDYRHKEVDNGETATTFRNRGYEARIEATHRKIGPFEGAIGVQFGQNTFSALGDEMLVPSTRTNSVALFGLEEWQVVPALKLSLGGRFEHVKVDPDPAGVEKFAGAQPREFNAGSLSAGALFSLTPVWSVAANVAYTERAPTFYELYSNGPHDATGQFLIGNPNASKEKAVSTDLSLRYASGPNRGSVGVFYNRFSNYLTEYNTGRVVDDDGEPVAPGTDGSLNEAIYRGVRAEFYGIELDGKWRAFARRGHTVDLELTADYTHARNVDTGQPLPRIAPLRATLAADYGYGPFGARAQVTHAWSQHRVPDNDFSTDGYTSLGVMLTYKFRVGPTHWLAYLRGDNLTNQEIRYSTSVVRGFAPEGGRSVMAGLRTTF

SEQ ID NO: 8787 - protein, 729 aa, Burkholderia cenocepacia
MNQGGRQIPAMQQQRRSPYRFPAFSKLACAAMLLASAAARAADAPGTAVAAATGETLPDVVVSATRSEQRRFDAPAAVDSVPVDPLRSATPLVNLSEVLAGVPGVAVRDRQNYSQDLQLAVRGFGTRSTFGVRGVRLYVDGIPATMPDGQGQASTADLANASRVEVLRGPFAQLYGNASGGVVQVFTPDPPKDGFTGRVSTGFGSDGQWQAGVALAGGDERLGGSLDAWTYQTDGYREHSAARRYQLNARVVAQPASGTRVTGQFNYFNQPLAQDPLGLTRAQADANPRQAVAAATQFDTGKTVEQAQAGVVVDHQVSGTDSVSARLYGGTRNLYQRLGFSGAAPTSSGGIVDLDRTFGGAALSWSRHTTTGAGLPLLWSAGLEANGMRDGRNGYVNQNGAQGALRRDETNTATDLGAFAQFDWSFHPAWQLVGGARASRVRLGIDDHFITAASPDDSGHASYSNVSPVLGVVWHALDSLNVYANLGRGFETPTLTEVAYGPGGVGSNLGLQASTSRQGEIGIKWQGSGQRLEAALFDADSHDEVVPQSNNAGRTVYQNVSGVRRRGLELGWRGGFLDQVGTPGQGGGSRIEAGLAYTWLDAYFGDGFVNAQGQAVAAGNRLPGTARHSLAADLSWRPLAPLTLGAELRVDSRVYADDLNTQAAPGYAVINLRAGYAFRIGPTRLYLFGRIDNLADRRYIGSVIVNEANGRYFEPAPGRRFFIGLRAAL

SEQ ID NO: 8788 - protein, 375 aa, Burkholderia cenocepacia
MKKAVVGTLSLAFVSAVAHAQSSVTLYGMLDAGIAYTNNQSGKHAWQQGSGLLSNTVFGLSGNEDLGGGLHALFRLESGFNLNNGMQSYRNTLFGRRAYVGLQSDQYGTLTLGRQYDAVVDYLGPLAMANNGDGNNLASHPFDNDNLDDSFYIDNAVKYASPTLAGWQFGGLYGFGNAAGGFANNRAYSAGVSYANGPVSLGAAYLQLNRGGLTTGGALSANDAPNFPAVRQRVMGAGGSYAFDRLTIGALWTHTMFDETAASSLPGALNALRFDNYEVNARYALTPAVSFTGAYTFTDGRYDDATDSHRPKWHQATLMADYALSKRTDAYAETVYQHAFGVPSGATLGFANVTGLAASSTRTQVVATVGIRHRF

SEQ ID NO: 8789 - protein, 817 aa, Burkholderia cenocepacia
MLSMTSRRVSEFLGRGSALGLLACTALTAPAFAQSAAPRPQSDQLEEVVVTARRTEENLQSTPVAVTALGAAALERAQVADVTDLQRTTPSLSIATGAPSASGFAFVAMRGQGNLQALVSNDPAVAIYVDGVYIPRPSQGLTDLLDLQRVEVLRGPQGTLFGRNTIGGAVNILTADPNDEFGGMVKVEAGNYDQRGASLVVNGALTDKLSGRLVAATKSRDGYGHDVPLNRDVWSQDSDFVRGKLKYESGPVQLVLSGDYNKISDNGQFTALHAYAPELFGPTGSFGPFGLAPTLNASLHNQGFYDSYATGFFIPSSNPNYATLPANIKAMYAMPLGNRLEAYGFGLNGSVDLGGATLKSITAYRFSDTDGVVDTDGTPVPILTTWAGYSSKQWSQELQINGGFGDKFTYIAGGYYSDEKGQEFSRSQNFGFLPYSATTRPYAGLAGQNLADVHNTSLGVFGQGYYQLTDSLRLAGGLRWTWDDRDTKLYNYSTWGVASTCNLPSPDVAGVCAQTQKTSFDYPAWTFGLDWQIDEDVFAYIQTRRASKSGGWNTRAGGLPAFRPETTRDVEAGFKATWLENRLRTNIAVFHSWQSDVQRNAAALTPAGASTQFIVNAGDARVYGVELEGAYRPWTGMELTANLSLMNGEYKSGSFIEQQSVPGVALAGCTPAGTSSICPVNRSAEELPQLPKRQFNLGATQSLPTSFGRVTLHADYAYLGKQYYNPVTPAAQQSATTKAIYAASNAITETPGYGLLNARFTVEFDAHDIELAIYGKNLTSKHYNVRQFADVYAAGLGFATDFIGEPRTYGASLTKRF

SEQ ID NO: 8790 - protein, 386 aa, Burkholderia cenocepacia
MKTPVRLAMMSGALLATAHAAHASEVTLYGLFDTSLTYVWNANADGKNLVGLGNGNLLGNRFGVKGAEDLGGGLKAIFTLENGFNPNTGALGQGNRMFGRQAFVGLESARWGSLTLGRQYDPLADLIWPVTGDFYFGSVYATPGDVDNYDTSSRTDNAVKYTSPLINGFQFVGMYALGGVAGKSGAGQTWSAGLSYSNGPVDVAGGYYYAANRSSLANGIRTGWNGTSDGTFDGSLVNGGYISAKSMGIARGALRYNFAPFAVGIDYSNALYKADAMSAFHSTQKYDTARGFFNFQATPSLLVGVGYSYTRARGDTSATYHQVSAGADYVLSKRTDLYAVGAWQRANGEQRTLDGGTQTAQASIGSYGYGGTRTQGIVNLGLRHRF

SEQ ID NO: 8791 - protein, 743 aa, Burkholderia cenocepacia
MTVNRTTAAPARRRRAKVGLGVGLGVTLFAAQAAVAQGDTPAPGTEAAGNATLPAITVSGERGQPLRAREASVAGLDDAPLRDTPASVNVITRALIDDQQAKRLSDVVRNDASVVNDYAPVGYFEGFAIRGFPVDLASAIRIDGLTVSGEQNVPLENKERVEILKGLAGIDSGVVAPGGVINFVTKRSANVASVTGGVDSRGSTSAAIDLGRRFGPDHQFGFRINAAKENMHSYIDGTNGRRTFGSIAADWDISPRASLQLNAEFQQWIQRSAPGYQLLGGTVVPSVKTTSKALGTQPWAKPVTTDALNLNARFDYQFNDDWKAYVAVGRSRTMIDDNSAFAYGCSYAASCAAGATSPFFFGANGDYDVYDFRSPGEYRRNDDLRAVTTGKFATGPLRHELTLGVSVQRRVVHMADAVYDYVGSENIYGPDLTFPPSPNSPGPSYPRLDAWQYGVFGLDRISIGEHWQVLAGGKEVLLRQRSWSSLDGETTHTDRSVFLPQVALVYKPVNVLSLYASYSKALSLGDQAPVRATNAYAFLPPVESHQIEVGAKYDWLDRLSLTAAVFSISKPFQFADPDASGTSYTFVQRGTQRHQGIELGAAGRVTERLGLTASVAAIRARAVDSGSPAYEGHQIINVPALRASLYADYAVPGVAGLNVLGGVEYSAARNANEEGTARVPSWFVFNLGARYTTKIGGHRTVLRVSVDNLFNKFYWRDAGEQQGDAYLFPGAPRTARVSLTYDF

SEQ ID NO: 8792 - protein, 352 aa, Burkholderia cenocepacia
MKKMIAAALIGALWGSAHAQSSVTLFGRIGGGVRWVNGLPGGSQVGYNNNIIAGNEFGIRGREDLGGGLKALFVLDGAFNSGTGALKTSGTLFSQAAYVGLAGDFGRLTLGRQFNAAEDLGIALDPLGGRGQSLAVEPGVQFDGNFFTLDSRFNNTIKYLGQVGGLRFGANYSPGGVAGSSHAGTSYSTAAMYTYSDLMGGVSYAKTYSPDGSQSAQTIQAGGTLQLGRTRFYVSYASLNVSANKAGAPSRRDDIPSFGVVVQPLPSVQLSAAAFYDRARNLGNVSGADGHKLTTYAIAEYFLSKRTELYVEVDRNGMTGAYMRDPATIAALNLRRGASATTGVSIGLMTQF

SEQ ID NO: 8793 - protein, 372 aa, Burkholderia cenocepacia
MNHPNGRADRLAVPLAALLACMTLPAAAQSSVTLYGRIDTAIEYANAGPNHVTRMGSGNLWASQWGLKGVEDLGGGYATIFKLEDGFNAASGALSNSSALFGREAWVGITGPFGGVQFGELYTILHTTLVTYSLPGLGAGLAWGNATNNFVGPAFLRVRNSMRYTSPRYAGFLLRAMAARGTNGAAGQPATLGDTYGAGLNYVRGGLSVDVDYMQQKFSPVAASTLGATSTAANGNYTLGAISYDFSVVKVAALYLRHRGGPDVATAIDSQSAYPHSDIMELSATVPIGRASLLLSIGHYRKVADSDGNADSYGIRFDYPLSKRTVLYTGAAMVRNGAHARFVVNGAAGGGVAVAKPGATASSLVAGILTSF

SEQ ID NO: 8794 - protein, 370 aa, Burkholderia cenocepacia
MKTLYKLAPLAMLGAFATHACAQSSITLYGLISAGVGFATNQGGKNAWQALSGTNQNPRWGLKGKEDLGQGLSAVFQLENGFNVMTGTAAQNGREFGRMAYVGLADRTYGSLTFGRQYDAIHDYIGPVIIASNGVNIGDNDNGYNDIRVQHSVKYVSPVYYGLKFTALYGFSNATGFANNSAYSFGLGYERGPLRWSAVYAQYNHPYSATNQDGAIANDYASPLLIFSKSAMTPAAYASRQRIAGTGGFYTIGRAQFAAMFTDVRYDYLDNSHLHLQNLGVNVVYTMTPQLFLGAAYAFTNGKYDVIDKRPKWHQVNLQADYFLSKRTDVALTVIAQQAAGDADHAQIFAYARSTGTRQMMATLGVRHVF

SEQ ID NO: 8795 - protein, 397 aa, Burkholderia cenocepacia
MNKQLIAAPLLLSLAGLASAQSSVTLYGIVDAGVTYRSNERVGTAGAYTGHSSVGLTTGNLSGSRWGIKGSEDLGGGLRALFVLENGFDITNGTSGQGGRQFGRQAFVGVGSDRYGSITLGRQYTSLDDFVSPVGPSSFIGGFGAHPGDIDDLDQTARVDSSIKYTSANYAGFTFGALYGFGGQPGSMKQRNTWSVGAAYAAGPLRVGVGYERSDNSKTGATDTTLGKWQSTDDGLFNSSINEGYASAQSQQIIATGATYDFGPAVVGVNYSNVQYRSGDRSLFSGHATFNVAGVFARWNVRPQTQLFAGYSYTRGSDVDGIDDRAQYHNVTLGAVYDLSKRTSVYLLGAYQHASGMTLDALGRPVAATASVSDKANGHSSDTQSQAIVSLGLRQRF

SEQ ID NO: 8796 - protein, 713 aa, Burkholderia cenocepacia
MPSRQRAVPRAALSSTLLVSSLALTAPVTAQTAPESAATLSEISVSGTGRPAGPAETAGSLTVPSVAAQRAAVNATVGSVAFVDATTFQNRYANTVRDVLKDVPGVFVQERYGQEMRLSIRGSGIARGFHVRGIELLQDGIPLNLADGSGDFYQIDPLSLRSVEVYKGGNALTFGATTLGGAVNFVTPTAYTALAPNVLRIDGGSFNTIREHFQVSRISGPADVLISGTLTNSDGFRDHETQRTRNFNANFGYQLAPGIETRFYLGFYDTDQKLPGSLSLFNALNAPRLANPAAITGNQSRKVTTERIANRTSFELEVGRIDIDSWAIHKNLEHPIFQVIDQDGWTYGVAPRWAGTFDLGGFRNDLILGLRAFAGINEARQFVNVAGLRGAQTLDARQSASNYEAYAENRFWFLPDVALMTGAKLFSSNRTYSNRGGLPASPTARFANVTYEGINPKLGLLWQPLPDIQVFADVTRSRDVPDFSDLVQTNTLGTTFVPLAAQRAWTYEAGSRGRIDRLAWDVTLYRAELRDALINFTPNPGLNIPAATFNAPRTRHQGVEAAVTLDLTEDLTGIGDRLSLTQIWTHNDFRFVGDAVFGNNRIAGVPVNVLRTVLGYRHPSGFYFAPALDWVPEGAFADHANTLKVPGYALLGLQTGIDFANGVSLFVDARNLTDERYVSDIAVVTNAATVAGGPVAFFPGNGRSVFGGVRASF

SEQ ID NO: 8797 - protein, 771 aa, Burkholderia cenocepacia
MFRKKLIVTALGGLLTGGAVSLPAWAEDGAATAGAPDAKLAQQAQDDAAAAASKAVRANRGTAIRETNLGTVTVTARRRKESIQDVPVAVSALSGDAIKNNELRVINDVTKYVPNFTGQSTEGRERPRWFLRGVGSNDPSDLSLSPIGVYFDDVYINSVFGQGFPLFDLDHIEVLRGPQGTLWGKNTVGGALSITSQKPTFDVSGYGKIGLGQYNSRLAEAAIGGPIGKNDVLAARVSVYHENADSFYTNTVQQGRFGGFHDNAVRFQVLAVPTSDTDFLFNIHGRNYTGGGNAWHAEGAGRGGTNQFGFVGSSDPYTVSLNAPSSDHISTWGTSLTAHWRINPAVSLTSITAFEGLHRWYQDDADYSPVDVARSHDRLSSRQFSQEFRLESPQKDRLSWIIGTHLFTEQLAEQGAGGGLPGSPSPAYYHLTDLTQHTQSAAIFGSVKYRFTDRFNVTGGLRYTIERKTINLTGLQDTGNVTFSDPNSWWSPSSVSSPLAVSARQNQTNTWRAPTWDLTPEYALSNNVRAYFRYARGFRSGGYNGNAYTQSTVSTVSPEYLTDYEVGIKSEWFDKRLIVNASVFHYDYRDIQVFALAPNPFGGPPVSTLSNAGQGRADGFELELKAQPVNSLYLFANLGILDTRYTEFRNVQTAVGNSFARSPHTTLNAGFDYRVPVSFGTLTAGGDVNYRSREYFSATRQTMPQLWQGGYTVLNAHVSYTTPNQKYIVTGYVTNLTNKVYKKLELLPSYGAYPALYGDPRTVGITLTAKI

SEQ ID NO: 8798 - protein, 733 aa, Burkholderia cenocepacia
MKFNIITRILFPVLCMGGSQTALAEEKAKNIAELDTVTVYGTVENPNFENFSKAGSVSSRAMNVNAMQSLDSIVRSVAGGYTQIDPGQGGVSVNIRNMSGLGRVNTLVDGVPQTQLGTSANGGGKFHTDGNGPMSQFSTLIDQNFLTRVDIAKGYNNGAAGLNALAGSANFKTIDVEDILLEQHKVGVLSRFNYGNNDLGKNGMLALAGKVDVLESGSLGSLLAFSKSSISQNYRRGNGTMATDSAYMQGLKNHPESYMGKIAFKPNQDSEFKLSGRQYKNSLVGRNIDSVTYSLESSYQPQSDWIDLKFLTAVTETKQDFHDDAKLWTLEDASTKNKMWMFDLNNTSRFESGKKYSRDLPESKNNDGAISNAAFGPAGKQNIDSLYLDTEWKYGIVTLNSSLHYSRYQLKGYKPECDSDDMDYCFPSFGFDVNKKHYKLNPSATLAFQVADWFQPFVSYKQTSRSPNVQEMFNTSRNGLSVNPFLKPESAKTYEIGFNIHQDNVLLNNDILGLKAVYFNSRIKDYLYNLSLYGCGPTVCRNSSDATNAIQFQIYVNHPEKVKNRGWEVELAYDSDAFFVNGSYTRTESTAPTSKGATILYGFGTEAYTQLPKDYATLELGAKLLDKKLTLSSIFKYTGKAKRVGIDLDEDGNIIHEQLPNIPVIIDLYANYKVNKHLTLKAGVQNVMNRNYLDALNAYNSSTAEEYDYDTDTYRFTNSARGRTYTLGAEVRF

SEQ ID NO: 8799 - protein, 707 aa, Burkholderia cenocepacia
MKFRLMLPAAVLAALSPAGQAQTQERSVDGAGAMLAPIRVDAQKAPALTQPLDTGSHLGLSPLETPASVEQINRATLDTRGDSSIIDAVSRAAGISASPHPGNGNSELAARGFVGASSVTQLYDGVRPYGAIGVTFPFDTWSVDHIDVLRGPASVIYGEGAIGGVVNIVPKKPTRTPIRNELQVGGGTEGTARAAFGSGGAINDKLSYRFDISGNRSSNWVDRGDSRNLSVSGALRYDVTPDLYVTASYAQGFMHPMQYFGVPLVNGARDRALDKKNYNVGDADIAFRDSWATVSANWQPSDSLNVTSTLYRMKSNRHWKDAEYYTYLPSSAQVRRSSYTEIFHDQEQYGNVTTATVGGALLGMRNTFSAGVEFNHTTFQHDNNSPYAGTSTVDPFNFDPGSFINTAGTFPKYRSQSNQYALFAENRLEITPRWSVIGGLRYDHASVNRDDLVNGGAFTKVFANTGWRIGTVYDVRPGLAVYGQYSVAADPVSSLLSLNASKANFTLATGRQIEIGVKQSFLDGKAEWTLAAYRIVKSNLLTADPVNPNQSIQVGQQSSRGLEATVGAEIAKDWRVDANVSILRAKYDDFQQSSGGTTVSRAGNVPVSVPQRLANLWVSWRFAPDWTGIAGVKYVGKRFADTANQLVMPSYTTVDLGLAWKPRKDTTITARAYNVFNRRYVQSAYYNETQYLLGNDRRVEVLANYRF

SEQ ID NO: 8800 - protein, 362 aa, Burkholderia cenocepacia
MKLRFGAVAMLVIAQGAYAQSSVTLFGLIDSGISYVSNEGGGKNVKFDDGIFTPNLFGLRGTEDLGGGYRATFALVNQFSMANGSIIGTGIFGRNAYVGIESDRFGNITLGNQYDFMVDALFAKGNAISMDISGLYGFRNGPFQRLALPNNPTGAFDWDRTAGSKPVANSVKYSSPTIAGFSGGVMYAFGGVAGSIGADNAVSAGLNYEVGAFGIGAAYTNEKYGPAPGTPSTSVRNWGVGMHYDFGAVTAKALLTTVHNSFNDAGVWMAEAGGMWRIRPDVFLGAKYMYMKGNEAVNDNHAHQVSVALQYLLSKRTMVYVSGDYQRANSGANAQINGVLDPNGASSSATQAVARIGLHTMF

SEQ ID NO: 8801 - protein, 356 aa, Burkholderia cenocepacia
MKSRTWTMCAALLGAAASTSSFAQSSVTLYGDLDAALLYTNRSLDSATGGNAGRQFALTDTGMTPTNFGITGTEDLGGGLHARFKLESGFNITDGAFGHSNGNFFGRQAWVGIDGGFGETKVGLQFSPFVLAILGSDPRNVSHFGAALVPYVDNVLVTGLFNPNAISYTSPTIAGLTASAMFGFGGKAGDFQAGRQYSGSLTYTNGGFMLNAALYDGNGGTSPTPVASTVAFVGRTIGAGYTFGPVTGKASFTSYKVAGSFSNNVYSAGLDYRVTPALDLNTGAWYTTDRNDSHNHSLLAAIGADYSLSKRTGLYAQVGVVNNHGAMNTGLGITGGALYGLPGTTVGVNAGIHHVF

SEQ ID NO: 8802 - protein, 777 aa, Burkholderia cenocepacia
MIRRPKAAGWYGAMRRGRRARCVGVTVGTLALFGLPPGSVRAQQQPDGGAIAPAEPPAIVLPAVVVVGTTPLPGIGTPLSKVPANVQSVRATELDAQHRATLTDFFAANLPSVTISDAQGNPYQADVNYRGFTASPLLGTPQGLSVFVDGVRVNEPFGDVVNWDILPTQAIDRVQLIPGSNPVYGLNTLGGALAITTKNGRSNPGGEAEVSGGSWGRKTASVEQGGTIGSNLDYYATANVANDGGWADHNASRVRQAFGKLRYTDADTTLSIAAGGADNTLSGTQTIPRSFLDNRKQAYTYPDRNRNSAGYLTLSGERFFGEHVELSGNAYYRHLRNTNTSSNNNTDYGSVDEDGTVDTVQGSNAQSTIVTDSYGGSVQLTLLGKLGGMANRLVAGVSADVANSSYVASSQDASFTDARAAIGIGDFVPQTSAKTRNANVGVYLSDALSLTPHWTLTLSGRYDWSKARIGDESGVQPLLDGSHVFSRFNPAVGLNWNPVPGFTTYATYNEGMRSPTAIELACADPAAPCSLPNDFIADPALKPVISKTFEAGMRGRIGGATTWSAAAYRTTLTDDIQFISSPASAQGYFRNVGDTRRQGIELAGRTRVGPLGVGLSYSYVDATYRSSWTEHSPANSAADANGNVTVKPGDRIPGIPAHTVKLRLDYAATPAWDIGANVTWRGGVYARGDENNGDVNGRIAGYVLVDLDMRYRITKRFEVFASVTNLLDKRYASFGALGQNFFNGPNHTFDGAHPVNEQFVGPGAPRGAWVGVRYAWD

SEQ ID NO: 8803 - protein, 818 aa, Burkholderia cenocepacia
MIKRDIRSTASAIILTMGLMDAASMAQAQTMPADGSDIVVTARRSSEKLKDVPASISVIDNSTIKNAGVVTITQMTNLVSGMTIVANTSQVGDTQINIRGINGARDAESNVALVVDGILKTNTSALNQYQGDLQQVEILKGPQGAYYGRNAAAGAIVMTTKAPGDMFVVEGRASYATQDTRLLQGSVSGPISETAGFVLSGDYRSTDGFYRNTGPTPATRGHSVDDSRNWNIGGRIVLTPTDADRIDLKARYGKIRATPLAFDAVFALPGFAGAFGNPLFDEDVNDHKLVYNRNIRGANRLTSKEASAKFSHDMGWATLTSWVSYSNIREDLLSDAAAGSLGRFNQRASCRASVAALSAAGVQLPQPQFLAPTPEASILGAYTPTTCDGIQYTVRNQKDVSGEIRLASNPGGPLSWFAGAYYLHINRHFGTAINEDQGLGALRSLYNGPASINPTSLLFDDRYKTNVYAGFGSLEYALSDRLTFSGALRFDREDRKVDPLVPNVIDPITNGPINPGFSVGAIVPKSRKYQQLQPKVAIRFKASDELNLFADWGVGFKAGGFNSQGSTAIIDQNFNGPLGSNINISDDYRKERSSAYEAGFKASLFDRRLTMDGAVYYTTVHDMQFFEFYTGNFGILRVVSNIDKVRLYGAEMSLSYRVVPGWTLFANGNVTRSKILKNNTRADTVGNKSPNTSDYTINLGTQVIEPIGEGLNLTFRADYRITGPTWFSTVQNQTKRSIFDLFFPGLGTGEYAKSRRDAYGILDLRAGVQAERWSLTGFVRNLTKKKYLTEVVVAPEFGGEFVSQGEGRTIGLELGWRL

SEQ ID NO: 8804 - protein, 940 aa, Burkholderia cenocepacia
MMQFKPNLLTVALLAAGFSMQVLAAEPSEEKDVNKEDAANIEVITVKGFRTSVIKSLNEKRFGDTVSESISADDLGALPDQSIADALTRLPGITAVRTGGQASGLNIRGLDGDFVFATLNGREQVTTGSKRAIEFDQYPSELISQAAVYKSPKASLIEGGVAGTVELKTADPLRAAKEQNFTFNARGAFNDRADEVADANEYGNRLSFSYQGKFLEETLGVALGYAHLYQPFVASQFIGLRFNDAKKDVNGDGVVESISEGFEMQQKGGEDTRDGYMAAIHWRPNDNWSFKGDLFHSQFDSENFARGFRVKSLQNGTITNANIKNGSMIGGTVSTDGTDNFALFVVNDNDSKYSELTSGSFNVEWNNGDALTVSADISYSKADGEFVNGGTRAVVYQDIDNEIRAAESISYQLNDLNPASISVTNDYTDLSTLGLKEVGMWPYNQQNDLIAYKLDFNYQLDTAFVSSVEFGVRYSEREFNAQRSQAGYGFEFGHNPANQPVLRLTDDMTSVVNFGGELAGYPSFLAIDFDKAVDLVNAQLAATGQDPFAPTANWSNNWTMIQSGAVNEDVLAGYVQANLEFDLADVKVTGNLGLRVVHTDQSSTGLQQVGFGLGEAITDEKGVVSTDYIRNEVGKTYTDYLPSLNLNFHLTDNDQLRFAAASVMARPPIDKLKSGMGSWYDDAATPGYKKYNAWGNTSPLLDPFYADQFDLSYEHYFEDSEGAVVVALFYKDIKSFINNFTIQPFDFEAAGFLVPDTIIDNGVEFPVVKDEGQYQTAINNDKGGYIRGVELAYTQVFDFLPDPLSGLGFTGSYSYSDSEVQFTTDLSGSSLDIPLPGLSEHVVNTTLFYTLDGFDTRLSMRYRSGYVSEQVAVETQLAFFDAETIFDYQASYALDNGLKFLFQINNLTDEPNKTYFGEEYQTGTIQSFGRQYFLGMSYSM

SEQ ID NO: 8805 - protein, 344 aa, Burkholderia cenocepacia
MRKIVWGLARACAVSVGMWGIPGVVHAHSSVSLYGLIDAFVGETHAPGAAGSAWQVGSGGMTTSYWGVTGSEDLGHGMKAVFTLEGFFRVNAGQLGSFNGQSFFGRNAFVGLSGRFGEVTIGRNTAPLFVSTLLFNPFGNSFAFSPMISHGYLGSAMGAASVQSDTAIDSSVLYQTPEVGGLSGSLLYSNAGVAGHTGQANYSANVLYFAGAFSATAAVQSLHTASLFLNGATAQTAWLVGGAYRIHATKLMFQYERVSNNSNVTDDTVQVGASARFGMGSMLLSWAGTRRRPVTGSGLRWSTFALGYDYPLSKRTDIYAAWRYDTVTHASSGNGVGAGVRMRF

SEQ ID NO: 8806 - protein, 725 aa, Burkholderia cenocepacia
MTIALTLKRSAVLCALALAAPHVSLAEETITVSAVPAQTAASPTEGYTVKTSTGATKTDQPLITTAQSVSVVTRQQMEDQGALSVNSALNYTAGAFTGFSGGATRYDTISLRGFHGGDVNNTFLDGLRLMSDGGSYNVLQVDPWFLERIDVIKGPSSALYGQTIPGGVVMESSKRPLFSPEGHLRASVGNHNTRNTAFDYTDAINDEWAYRITGLTKYTDTQYEKTRDERYAISPQLLWQPGESTSLLLRAYLEKDPSGGYHGSVPASGSLDATSHGKLDTGFSDVEPGNDEFKRYQQLYSYAFSHDFNDTWSFRSNGSYTHSNLDLKQAYQIGWADASKNELTRYYSGEHSSLNAWAMDNQLEARFNTGDLAHTVVLGGEYHKFTNNLSDDAGYTTNLNPWTGVSGGAGGFWYYDPLDPTYATRLQGLQRKDMKRVYEQTGVYLQDEMVWNRWHMDLSGRFDHLETKNRVITPSAGTDTTDHRKDDHFSGRASLLYAFENGLSPYLSYSTAVTPQVLTDARGKLLKPTTSEQYEGGLKYQPPGTSDLYSIAVYDLMQKDVGNRVVVGSYFEPAGKVHSQGVELEAHTQLTSRFSAIANYTWNHVRFEDAIDGNNKNTPYVTPDQMANLWGHYQFDYGLSAGAGVRYIGKQWADNENTRRVPSVTLVDAMVKADLGAWNSALKGAFVQVNANNLTGRDYVAGCYGTGYCYWGAERSVTATVGYDF

SEQ ID NO: 8807 - protein, 379 aa, Burkholderia cenocepacia
MKKTLIAGAGAAALLTPLAHAQSSVTLYGLIDAGIAYTNNVNGASQWRMTTGTINGSRFGLRGTEDLGGGLKALFVLENGFNANNGGLGQDGKLFGRHAYVGLSRAGYGTLTLGRQYDTMVDFVAPLSATSGDFGDTGFAHPFDNDNLNHSLRINNAVKYTSDTIAGFKVGALYAFSNSANFSANRAYSVAASYTNGPLKLAGAYLQMNGTKGSTSASPGATDSAEAKSLNQGGWSIGSDRMRTYGGVSYVFGPATVGFVYTRSQYDNTGAFGSSGQIAFNNYDVNVRYAVTPAVSVGAAYVYTDASVSNPDSKHGTDPKWHQANLQAVYKLSRRTDLYAEAMFQHASGRGYQAFINTSGGASSTANQVVGTIGMRTRF

SEQ ID NO: 8808 - protein, 760 aa, Burkholderia cenocepacia
MAIKIRRYLFLILISIIFSLKTNAQETDKKLPLSEILKTLESQFNIQFNYAEDAILKTEIAPPPKQLSLNKTLQYLENLTNFEYILTNDDVVLVISKTNDLELQKLSEVMVSGYIVKGINKLSNGTFDIDISDFDILPGLIDTDVLQAVQAFPGIQSINETVSNINIRGGTHDQNLILWDDIKMYQSGHFFGLISMFNPQITQRVSLTKNGSGTEFTDGVSGTIAMQTDNEITREFKGNLGVNFIDANGFADLPISEKSSLQVAARKSISDLTETPTYNNYFERISQNTEVENNTMNIANSDKQFDFYDASLRWIYNINDKERLRVNFITVANELMFNENTNETSRASSLKQNSIAGAIHYSKIWNNKWQTIFEGYETDYKLRSLNANILDNQRFLQENKVSETSIKFKVNYAINDRLQLLNGYHFVETEVTNLDDVDNPLFRLLVSEVVRTHGVFSQVSYKSNDRNTRLISGLRYNYISKFKKHILEPRLSFSHKFLQYFSFEALGEFKHQNVSQVINFQNDFLGIEKRRWQLSNDSNIPVIKSKQASMGVSYNKSGWLFSAEAYYKKVKGITTQSQGFQNQYEFAKTDGEYKVKGVDVIIRKQLNNFNSWLSYSYMDNSYTFNFLSENSFPSNFDIAHAITFGTNYTSEKLKISAGLNWHSGRPKTSPVVDNEINGDAINYNATNSEQLNDYLRIDISALYDFKLTKTTKANLGLSVWNLLDKKNTINSFYRLNDGVVNEVRQRSLGITPNIIFRVNF

SEQ ID NO: 8809 - protein, 762 aa, Burkholderia cenocepacia
MKQLSRFKPISRFLVPITLFCSWSLIPVPAAAQDAATSPDTVISQGGTSPDAATAQDAVATQDAGKEKEKNATLPEIKVTTGRVRPGTIEDVARTGSKTDTPLRDIPATVNVVPASTLKEQGVIEMNDAMRNVSSVQPLMGGGYGFANSFTSRGLALSFFRDYIPDGNLQNNYFRTMYDIERIEVLKGPGSALFGVAGPGGSLNLVTKQPRYSFGLSAGTMLGSFGTRNGYVDVTGAIPYLPNVAGRLIADMEHTDGFRGLERNIVEASPSFTWRLADDKTLHVDYDHRELKIKPDNYGILFDANSNIANVSRDTRYYSRFNKTDHTINRLGLTHHWTLSDTLSMRTAFVYDARTLELLRNAGGNQGNAAGFSTGRTAYQQFDNAGYTTLQNEFVWKTSTGPVKHTFLGGFEYKNVDINAARSTYTLDRINIFNPVVETSLNDPKVNGGSLTFDRHIGSDQVSFYAQDQIDLTEQFKLRLGIRNDLVKYSDKGLQRANPTAHGSPIRYREIVQTKSMTTYSTGGVYQPTQNLAFYAGYSTGAFINLSTEPQALSTAPETSDQVEVGAKMMLFDGKADLNVALFQSSRNNYFVTLPGSGNIPTPDGKDRTRGVEVSLGFRPVAGWSIIGNGVVMDPETRAGNVATNSVLGITRSVFGTRPVGVATTMGNLWMTYEIQSGLARGLMFGFGVTYKGDSYADSLNLLKVPSYVVFDAAASYRIKKVDLAVNIKNLTDKTYYTNPTFAGALPGNPLSAFGSIRFNFN

SEQ ID NO: 8810 - protein, 363 aa, Burkholderia cenocepacia
MKSRAERSIRTAIVTGSAAVAGLAVGAAHAQSSVTMYGIMDAGIEYTNHAAPDGGNSFKLKSGNKNTSRWGLRGTEDLGGGLKAVFRLESGIDLANGASDDGPDSIFARRATVGLKGKWGEVSLGRNFTVTYDYMLPFDPMGYAQNYSWATSSMATGGRKDGLFTRSSNAVRYDGEFGGFKFGALYGFGNVPGSVKTSSKYDFALGYEAGPFAAVVTFDRQNGAADSVTPADTVNYIQGIHAGLSYDFGNLKTMAGYRNYRRTYHTSAANQLSDMYWVGGSYQFTPTFSLIAAVYHQNIKGGTDADPTLVSVRANYALSKRTVLYAAGAFAIAQHGQKVGVSRDFAGYGTTQVGVTAGIQQRF

SEQ ID NO: 8811 - protein, 402 aa, Burkholderia cenocepacia
MKNGRRLTAAAAMLGCLHAHAQTSGSVTLYGTVDTGIIYSTNQQFTRADGSTGGGHAWQMGGGNLVPSRFGFQGAEPLGGGLDAVFTLEQQFLSANGQALQGGTAFSRQAWVGLRQEGIGTLGLGRQYDSYTDMLGAYVSSNNWSTPYGSHLGDVDNLNAAFNFNNAVKFTSADFNGLTFGGTFSFGGQAGDFSAKRGYAVAATYTRAPVAFSVGYLDLHQPLDAALGGASSYIGDFACSNPGAMYCLLQDAGSMRAFGAGGSVTLGAATVALTYTHTRLGDSRYFSTAAQPRTQAFTFDIGELNVTYMFTPALQGGVAYIFNAAHTDGRGTTRFHQVNVGANYSLSKRTALYAVAIGQVASGTGLGTDADGNAANYAQIPVLANSNSSRQLAVMAGIRVNF

SEQ ID NO: 8812 - protein, 395 aa, Burkholderia cenocepacia
MKAPVNRYAILILSAASLGTTAAHAQSSVTLYGVVDDSLAYVNNQQGHSNVYMRDGNLYASKFGLRGDEDLGGGTHAIFDLQAGFNLNTGAQAAAGTIFNRQAFVGLRNASYGTVTAGRQYTPYFLLVGPYASSSWLTGATGAHPGDIDGLDTTIRVNNSVTYTSPTFAGLTASAMYAFGGIAGATGKGNTFSAALRYANGPVGIAAGYLRINSSGSSAGFLNPATASSGSFAVSVLNQGYLTAKAVEQVAAAGNYTLGDLTLGLNYSNVKYLPGNGSAFTDTAVFNTYGALAAYRFTPTFSVAGAFAYTLASKANGVASAARYQQYSLKESYSLSKRTTLYALQAYTHSSGQTLGAQGAGHIVDAAPIVGDSQQLTPSTTHGQFVGMAGIAVTF

SEQ ID NO: 8813 - protein, 359 aa, Burkholderia cenocepacia
MVKHAVAAAVIGMGAASGAWAQSSVVLYGSMDAGIAYVNNVGGHAKWAMIQGNTQPDRWGLKGKEDLGGGLSAIFQLENGFYTNNGQFATANTIWNRAAFVGLSSERYGTLTLGRQTPLTFDYLDPLSTAYLAMSWFAFHPGNIDGLAATGNVPYNNSVKYRSPTFAGFSAAATLALGNTTNFSTGKSVGVALNYVNGPFKASAVYSNEHDRAILISQTGITSFQGQNTANGYLANKVENIGAGASYQIGDFLVHGLYTRVKMQSNGFSDTFQSYDAGVNYRSSAFNTIAGGAATTTLAGRRWTQVELGDIYALSKRTQLYANVLYEHGSGGAKAAFFTAGVSSTANQVIVLTGIHHSF

SEQ ID NO: 8814 - protein, 1144 aa, Burkholderia cenocepacia
MKRKTLLLPFIIYNSNIKYFFRIMRISLFLLFVCVFQLMAEEADAQNAEIKLSQNSMTIKQLVKEIEAQTDYLVVFRDQDVDVNKTVSFNTKTATVADYLEMITKNTGISYQFENNYITLLSTSSKSVNQEKKKKISGQIVDTYGLAVIGANVVEKGTTNGTITDVDGNFSLEVDENSTLVVSYIGYTPQEIIVANKSNFSIKLKEDTEVLDEVVVVGYGTAKKKDLTGAVSSVKAEKLSAQAPRNVQDILRSNAAGLNIGIATDAKAEADLSVRGKGTLSAGSSPLIVLDGVIYEGNLSDITPEDIASVDVLKDASSSAVYGAKAANGVIAITTKKGIQGKPVINFNANISFAKSANQPKILDAEGFLKFRQDYNEGRNSDEYLAKYPQIFVNPFKLQGVDPLVWYNYDQSVPATSVTDKQLETQWLSRLNLLTPEIDNYFAGRITKWDDLVFQTGLQQDYTVSVSNATERTSQYYSLNWADREGIITGDKYTNFRARMNVKTEITSFLSVGMNAQFSSRNEGFLKCLWEQMTMISPYGANEVDNLESPYRRNPTGMDPVNPFYDNMYTERKDLYQNLNAKLYAEVKLPFGIEYTLNFTPYYSWHDYYNHYSSEGEKWEAIGGASVRTNTKQFSWQIDNIIRWKREFAQKHKVEVTLLANAEKAQYWSTTAEAQGYTPNDVLGYHQLQSGSVQKVSSDDTYQTGDALMARLFYSFNNKYMLTTSIRRDGYSAFGKKNPRATFPSVALGWVFTQEQFMQQANSWLNYAKLRISWGENGNRDIGQYAALAQMKSSLRPYIDQTGNIYTISQMFVNTMANHNLKWERTAAFNFGLDFSLFDELLSGSIETYVSKTNDLLVKRALPDVTGFNSVTANLGQLQNKGFELTLNANIINSKDFKWFASGNFSLNRRKINSLYGDMVDVLDENGNVIGQKESDDETNKWFIGQDPDRIWDYERAGVWQKDEREEAAIYGCQPGDFKYVDQNGDGIMNNKDKVFQGYTTPRFRWTLRNEWTYKNLSLSAVLYSYLGHYGAFQRAANNYSFPDRTSDYDFPRWTATNPINDYARIGSKNIGTNYVNKSFVRLENVTLSYHFPKEWINKFAIQSLRLSGSIQNAAVFAPHWNFWDPESGSVTPRTFNLGINVTL

SEQ ID NO: 8815 - protein, 858 aa, Burkholderia cenocepacia
MKLNGKFPVKFVKYFLILAVCCILLGAGSIYGLYRYIEPQLPDVATLKDVRLQIPMQIYSADGELIAQYGEKRRIPVTLDQIPPEMVKAFIATEDSRFYEHHGVDPVGIFRAASVALFSGHASQGASTITQQLARNFFLSPERTLMRKIKEVFLAIRIEQLLTKDEILELYLNKIYLGYRAYGVGAAAQVYFGKTVDQLTLNEMAVIAGLPKAPSTFNPLYSMDRAVARRNVVLSRMLDEGYITQQQFDQTRTEAINANYHAPEIAFSAPYLSEMVRQEMYNRYGESAYEDGYRIYTTITRKVQQAAQQAVRNNVLDYDMRHGYRGPANVLWKVGESAWDNNKITDTLKALPTYGPLLPAAVTSANPQQATAMLADGSTVALSMEGVRWARPYRSDTQQGPTPRKVTDVLQTGQQIWVRQVGDAWWLAQVPEVNSALVSINPQNGAVMALVGGFDFNQSKFNRATQALRQVGSNIKPFLYTAAMDKGLTLASMLNDVPISRWDASAGSDWQPKNSPPQYAGPIRLRQGLGQSKNVVMVRAMRAMGVDYAAEYLQRFGFPAQNIVHTESLALGSASFTPMQVARGYAVMANGGFLVDPWFISKIENDQGGVIFEAKPKVACPECDIPVIYGDTQKSNVLENNDVEDVAISREQQNVSVPMPQLEQANQALVAKTGAQEYAPHVINTPLAFLIKSALNTNIFGEPGWQGTGWRAGRDLQRRDIGGKTGTTNSSKDAWFSGYGPGVVTSVWIGFDDHRRNLGHTTASGAIKDQISGYEGGAKSAQPAWDAYMKAVLEGVPEQPLTPPPGIVTVNIDRSTGQLANGGNSREEYFIEGTQPTQQAVHEVGTTIIDNGEAQELF

SEQ ID NO: 8816 - protein, 394 aa, Burkholderia cenocepacia
MIKKTVVLGLVSIGSVSAHAQSSVTLYGVVDAGIAYTNNQGGASNIQQTSGKLSGSRWGLKGAEDLGGGLQAVFTLEGGFRPSDGGLGQGGRLFGRSAYVGLGKKGLGTLTFGRQYEPITDLVAQYSGSGIWSPATHVGDNDNLNQSFRLNNAVKFRSDTIAGFTADLLYAFSNQANGGAGTGFSNNNAWGASANYVNGPLSVGGGYVRLNHPNATSNTSGAVGGATSTTGNDYSGAFFYGLNGGVLKQQIGAVGANYSLGRTTLGFAWSHTQLDYLDGSSRKFNNYDVNARYQITPAATLIGVYTFTDGRASGLPGTSGQTLKPRWHQFTLGFDYALSKRTDIYVSGIYQLAAGDASTATSGGYRKIAAISNIGSASSTNRQLAFVSGLRVKF

SEQ ID NO: 8817 - protein, 396 aa, Burkholderia cenocepacia
MKTAVCTAAAVCALAAPLAACAQSSVTLYGIIDTGIAWTNTVASSIRAPGASRWSMATGWGSGDRVGLLGREDLGGGLSAVFQLEMGFSGLNGTSSQGGRLFGRQAYVGLSSTRYGKLTLGRQYDYTFDYVAPLMSWLMFGSIYGAHIGDVDDSFQTFRLNNSVKYEVSPLAGLKLGALYAFSNQAGGDAGRGFANNRAYGFGLDYLRGPLHVVASYLQLNDPSAGLASANNPGGAIGDEYSGSTSIFYNAGFVERQRITALGAGYSFGAASVNFVFTNTLLDYRGGSSLRINNYEINGRCYFTPVLMAGVGYIFTDGHGYTGSGATSFAAGDRPRWHQVDAGIAYLLSKRTDLHMSMVYQRLAGDASTVAINFFGPAGAGRSSQIAVLAGLRHRF

SEQ ID NO: 8818 - protein, 651 aa, Burkholderia cenocepacia
MSRRNRLSNACHRARLIPAFALFPLSAFADQALHLEPTVVTATSTLRQLGDAPASVSVISRDELALRPVQDLEDALRGTAGLQFTGVGMTRRGVSIRGMGSEHTLVLIDGQRIGNAGGAVAHADFDLGWVPVEAIERIEVVRGPMSSLYGSEALGGVVNVITRRSTDAWQGAAQLNGGVREDGRGGQTHQLGVYTGGPLVPGVIGLSLTGETRRRQETPLHRDTRLSEIEGRDAQSASATLSWTPDAAQRIDLGFASGEEDRWRNTRTAGRAPVDYESRDRIERERLSLAHSGDWVWGKTSVRAYRNSLERNNRYTNGVIPTSPRQELTDDVIDGSASLQADTHLFTLGGEWRKEQLEDRGFASGDARIIHRALFLQDEIEFAPSWSLVVGNRFDRHEEYGWHNSPRAYLVHHVSDALTLKGGGGRGFKAPSLKQLSPGYSAIGGGGMFTIYGNPDLEPEINTTYELSADYQGSGWTLNGGVFQNNVRGLIQTVCVASCGLRGREVRNYDNVDKARIRGLELGGGLDLPADLRWELNYTYLDAIDRSADRRLGDRARHLANTRLQWTPTADFTGQLRGEYVGSQLSYSSNTTYAVPAYSLWHLEISQRISDTLSIRGGIENLTDRDFSDAADNYAFTEPGRTYHVGVSLSF

SEQ ID NO: 8819 - protein, 725 aa, Burkholderia cenocepacia
MWMETGTGRRARAIAAGGAWCVAAAGAAHAQAPAPGAAVAVLPAIDVRGPVDAASSVGLVGRRTATGTKTDTPVDEIPQTLNLVTAQQIDMTGAADLNQALRYVPGFATFGADSRTDWYAALRGFTPTLYVDGLPAPNTAVIANWRVDPYTIDSIAVLRGPTSVLYGAGEPGAIVDAHTKLADGERVREAGVQIGNDARKQAMLDVGDRLDPDGKYAYRFVGIARDGNAVTGPNGDRRVALAPSFRWRPNADTSLTLSATFLQDSGDISSNFLPASGTVLPNPNGRLSQDLYMGDPSFNDYRKKQWSLGYALEHRVNAIWSLHQDVRWSHLSLDDATVFGNGLAPRSTTNMMRFAGLFQLNYSRFDIDNHAQARFGTGSLEHTLLFGVQFDRQTTTNSVWLALAPSLDLYHPVYRPVTAAIFSGPTSLGHVDQYTAMNGVGVYAQDQIRWQRWTLTLGGREDVVNARFDDRTAGTHAQQDVSAFSGRVGLTYRGDAGLSPYVSYSTSFDPVIGVRMFGGGLPKPTRGTQTEAGLRWQPAGRNLMLNAAVYQIDQTNVVTPTPVNLDPTATTSVQTGKVRSRGIELSAVGKVTHGLSIVASYAYQDVKNVQANDVSLSHWPVSVPLPRQMASMWADWTWHTGALAGLGVGGGVRYQSASAGAPDNSLTVPSATLYDLAIHYDLPRWRFAVNVANLFDRRYVSGCQSYAVCVFGNERTVLASAKYNW

SEQ ID NO: 8820 - protein, 4238 aa, Burkholderia cenocepacia
MRMRMGSNKKRAEARPKLLVPTGMLVALVGAGIVPVDALAACTGTTIVSCTGATTSYSNGTNNLNLTVAPLATVSVVPLLGGTALSLTGSGVTLTNNGRIDPALSGLSLVSNGTVVGNVGSASTVNVTNTSSGVMMGSTSSLLNGPALTVYNGTGGTTNITNAGTIGTTGLLGFSAGPTAQVVTTSGGAQVNFTNASGGAINGSVVLAPSGTPGAGNTFTNAGTVTGNVSLGAALGTSNTFNAQTGSSVGLGVDAGLGGNNTLNLQLNTAVGSPANGTIAVDTYGNFNNLGVQGGTWDLTGASTATNASLTGGTAIVHGAGALGTGTIVAGGGTLEAGAAGVNLLNNVALGTSLTVDGANGLALSGTIGGGGALNASGTGTLTLNGANSFTGGTNLTGGGGLVVGTGTALGTGALNVSSAGGTLGTSIGGTLLGNAVNIDTGVTLGLNGSANLGLSGTIAGNGGLAQTGAGTTTLLGANTFSGGTALSGGGLIAGTGAALGTGALHVTGAGGSLATNVGGTLLGNAVNLDAGATLGLNGAAGLSLGGTIAGNGGLAQSGTGTTTLLGVNTFSGGTALSGGGLIAGNGAALGTGALNVSGAGGTLATSVGGTLLGNAVNLGAGATLGLNGAADLSLGGVIGGSGHLAQSGAGTTTLLGANTFTGGTALSGGGLIAGNGAALGTGALNVSGTGGTLATNVAGTVLGNAVNLGAGATLGLNGAADLGLNGAISGAGGLALGGTGATTLSGANTFTGGASLTGGGSLIVGGNTALGVGGALNVSGLGGSLSADLAAGAALANDVNLNGASLTLNGANDLGLSGAIGGSGGLVLSGTGTTTLSGANTFGGGTTLSAGTLLAGSNTALGSGALNVAGAGGALGASVNGIALGNAMNLGAGATLALTGANDLGLNGVIGGSGGLAQIGSGITTLTGANTFSGGTTLSGGGILAGNGAALGTGALNVTGAGGSLGTTVGGTVLGNAIQLGAGAALTVGGANDLGLGGIISGSGGLSVNGPGRTTLTAAETFTGGTTIGSGTLAIGAGGSLAASSPVNLTGAGAQFNISGATTPQSIGTLSGVAGSTIDLGANHLTLAGSGSGVFAGNIGGAGGLTLAGTGSQALTGNNTYAGGTALTGGSLVVGSGAALGLGALDVNGSASLGASVPGVTLGNAVNLGAGVTLGLNGANDLGLSGTIAGNGGLAQTGSGTTTLLGANTFSGGTTLSGGGLIAGNGAALGTGALNVSGAGGTLATNVAGTLLGNAVNLGAGATLGLNGAADLSLGGVIAGNGGLAQTGSGTTTLLGANTFSGGTTLSGGGLIAGNGSALGTGALNVAGAGGSLGTNVGGTVLGNAVNLGAGATLTVGGANNLGLGGAISGGGNLSVSGPSITTLTGVGSYTGNTTIGNGSTLAVGAGGSLSGGSLFDLTGAGATFDLSAATSPQTTGGLVGTAGAAVNLGGNTLTLGGSGNGTFGGTIGGAGGLTLAGTGTETLTGTNTYTGGTLINSGTLAIGAGGSLAAGGAVNLGGAGATFDLSGAALPQVIGTLSGVAGSTVNLGGNGLTLGGAGSGTFGGTIAGAGGSLTLSGTGTETLNGANTYTGGTNLAGGGTLVAGNGAALGTGALNVAGAGGTLAASIAGTTLNNAVNLGAGSSLTLGGTNDLGLGGIIAGGGSLAQTGSGTTALTGANTYTGGTTLGAGGLSVGSNTALGTGALTVTGSGGALSASTANLLLANAVDLGIGSTLHLGGAFDFGLNGTISGAGGVVQSGAGTTTLGGANTYGGGTTLNSGGLSVGSNTALGSGALNVTGNGTLNASVSGTTLGNAVTLGAGATLGLNGANDLGLSGTISGSGGLAQTGAGTTTLTGTNTYDGGTTLSGGGLIAGNGSALGSGALNVTGAGGSLGTSVAGTTLGNAVNLGAGSTLTVGGANDLGLGGGISGSGGLSVSGPSTTTLTGVNTYTGNTTIGGGSTLAVGAGGGLSAGSALDLAGAGATLDISAATTPQTSGMLSGVAGTNVNLGGNTLTLAGAGNGSYAGTIGGTGGLTMAGTGTETLTGTNTYTGATTINSGTLAIGAGGSLSASSPVNLAGAGATFDVSGATTPQTTGTLSGVAGSTVNLGGNNLTLGGTGSGTYGGTIAGAGGSLTLSGTGTETLTGNNTYTGGTNLTGGGTLIAGSGSALGTGALNTSGAGGTLGTSVAGTTLTNAINLGSGSTLTVGGANNLGLGGAISGSGNLAVNGPSTTTLTGAGTYTGNTTIGNGSTLAVGAGGSLSSGSAIDLAGAGATLDVSAATSPQTTGTLSGAAGSAVNLGGNTLTLGGSGNGTFGGTVGGTGGLTLSGTGTETLTGTNTYTGATTINSGTLAIGAGGSLSGSSPVNLAGAGATFDVSGATTPQTTGTLSGVVGSTVNLGGNNLTLGGTGNGTYGGTIAGAGGSLTLSGTGTETLTGNNTYTGGTTLSGGGTLVAGNGSALGTGALNTSGAGGTLAASTPGTTLGNAVNLGAGSTLTVGGANNLGLGGAIGGSGNLAVNGPSTTTLSGANTYTGSTTIGGGSTLAVGAGGSLSSGSAIDLSGTGATLDLSAATSAQTTGALSGGAGTNVNLGGNTLTLGGAGSGTYGGVIGGTGGLTLSGTGTETLTGTNTYTGATTINSGTLAIGGNGSLSSSSPVSLTAAGATLDLSGAASPQSTGAISGVAGSTVNLGNNNLTLGGSASGTYAGNIAGTGGVTMSGTGTETLTGSNTYTGATTINSGTLAIGAGGSLSGTTPVSLTGAGATFDLSGATTPQTTGTLSGVAGSTVNLGGNNLTLGGSGSGTYDGTIAGAGGSLTLGGTGTETLTGVNTYTGGTSLTGGGTLIAGNGSALGTGALNTSGAGGTLGTSVAGTTLGNAVNLGAGSTLTVGGANNLGLGGTISGSGNLAVNGPSTTTLTGVGTYTGNTTIGNGSTLAVGAGGSLSGGSAVDLAGAGATLDLSAATSPQSTGALSGVSGSTVNLGGNALTLGGSGSGTYGGTIAGTGGSLTLAGTGTETLNGTNTYTGGTTLSGGGTLLAGSGSALGTGALNTSGAGGALGTSVAGTTLGNAVNLGAGSTLTVGGANNLGLGGAIGGSGNLAVNGPSTTTLTGAGTYTGNTTIGNGSTLAVGAGGSLSAGSAVDLSGTGATLDLSAATTPQTTGAVSGVSGSTVNLGSNTLTLAGAGNGTYGGTVAGTGGLTLSGSGTQTLTGNNSYTGATTINSGTLAIGAGGSLSGSSPLSLTGAGATFDVSGATTPQTTTALSGVAGSTVNLGGNNLTLGGSGSGTFGGTIAGAGGSLTLSGTGTETLTGPNTYSGGTNLTGGGTLVAGSNTALGTGTLNASGAGGTLAAGTPGTTLANAVNLGTGATLTVSGPNSLGLTGAISGSGTLAVNGPATTTLSGANTYTGGTSVTGGGTLLAGTPTALGSGTLSVGGTGGTLGASVAGTTLGNAVNLGTGSTLTVGGVNNLGLSGPISGGGNLAVSGPSTTTLGGANVYTGNTTIGNGSTLAIGGNGSLSAGSALTLAGNGATLDVGAATTPQTASALSGAAGSTVNLGGNTLTVAGPAGGSFGGTIAGTGGFAVQGGGTQTLTGANTYTGGTTIGSGSMLALAGAGSLAPTSPVILAGSGATLNLAASAAPQSIGTLSGTTGSTVNLGATPLTVNTAGTSSFAGTLSGTGPLTLAGTGAQVLSGTNTLSGPTNVTGGTLAVTGSLASSPVTVGSGATVTGTGTVGGLVVSGGGTASVLQLGQPLKVAGNATFQPGSTLQVGATPQQSGGLDVTGSATLNGGSVQVVAATGQYQPGKLYTIVNAGAGVQGQFSAVNSTYAFLTPTLTYNPAQVLMSLAPNGTPFASVATTPDGQAVAGAVGTLGAGNPLFDTVLTSDATTANRAFTQLAGDLYPSTRSVLLSDSRYVRDAVLDRARLGSQPGGALCGCEAPVSADDHAAALDRRMAAENGCTPAKSYKPAVWGRLYGSHSRFNGDGVASIDRNLYGFIVGTDAEVSSHWRVGIAGGASRSQLNTDQNESAKVNGGTIALYASGRYDAWNVRGGVSQSWYRVHSERNPSFGSFADHDTASYDANATQVFTEIGYSTAIRNVSLEPFVGLAFASLHTGGFRENGGAAALQGDSDTTGLGFSTLGVRASTDVAVTTKGKVTAFGTVGWRHAFGNTQPASTLSFASGGSPFSVTGVPVARDAAVLEVGVDAAVTKNLSLGLSYSGQLGGHISDHALYGNLLWKF

SEQ ID NO: 8821 - protein, 785 aa, Burkholderia cenocepacia
MAQSNIYIQSRKHSAGRLSSSAGLVACATVLAGATLALPAQAQSAETTLKEVKVEGKADTGYTPGQLSSPKFTQPLVNTTQTVNVIKEQLLQEQGATTLTEALRNVPGAGTFYAGENGNTSTGDAVYMRGFDSSSSIYVDGVRDIGSISRDMFNIDQVEVTKGPAGTDYGRSAPTGAINLVSKQANLNNSFGGSLGLGSASYKRASIDLNRVVNAETGTAVRLNAMAQDANVAGRNSIENNRWGIAPSIAFGLNSPTRVFVNLLHIKQSNVPDGGVATIGLPGYTSPDAAGYAGRRAFLDSAARVNSKNFYGTASDHDDVTATMATLKVEHDFTSTTKLRNTTRWGETKQDYLLSAIMGQGYSANGVLGSNGLQTPNPADPSTWSMARLINTKDQVNRILTNQTNLSTSLATGSVQHDLSLGLELTREEQTNYGLVTSGSVPTRVSIYNPDSSVTLPAYVRNGADSKGKTDTVALYAFDTLKFNDQWQANLGLRLDRYKTSYNAMAVCTATSTTQPCGSNPVGTVVPTTSDGLSKSGTLLSWKAGLLYKPAPNGSVYLNYALSQQPPGGSNFALSAALNNAANPNMDPQKAKTLELGSKWELAEKNLMLSGALFRTEVTNEIVTNSDGTVGQTGKKIVQGLELGVIGQINKAWGVSAGYTVQNTKVDTGALVAADASNGLTYTPKNAFSLWSTYQLPFGLTVGGGARYAGGLKRGTDGAVGTPNHTDAYWVFDAMASYRVNKNLDIQLNVFNLFDKDYVAAINKSGYRYFPGIARSARLTANFKF

SEQ ID NO: 8822 - protein, 433 aa, Burkholderia cenocepacia
  misc_feature (363)..(413): Xaa can be any naturally occurring amino acid
MKQIRSFALLALPAALVAAGAHAQSSVTLYGIADAGIAYVHNAKNANGGNASSLVKFSSGNLSGSRWGLRGIEDLGSGLSALFQLENGFNIGTGALGQGGREFGRKAVVGLASSTYGTVTLGRQYDPIVDLVQGLTQDNYFGGVFATPGDLDNYDNSLRVSNSVKYTSPLISGFQFEALYGFGGVAGATGSGRTYSFGASYANGPLSLGAGYFYANGGTTVANGVRTWSSSSDTLFNTVINQGFSSAKSIQIVRVAGQYVAGPATFGLAYSNTQYGADTLSAFSQNAKFNNGSAFFNWQFSPALRAGVGYNYTSLTGPASAHYNQVNLGADYALSKRTDLYALFGYQKANGNTLDASGATVKXXXXXXXXXXXXXXXXXXXXXXXXXXXXXXXXXXXXXXXXXXXXXXXXXXXACRVYTVPLHVRHDTGSPAC

SEQ ID NO: 8823 - protein, 679 aa, Burkholderia cenocepacia
MKKTRIVTLINLLAFASICYSQTGAIPEQTIDTVIIQSTRIQSTLDRIPAAVSVIKTVPQDATRQQLSLQEYVQGVPGVFTQNVTNFAQDLRVSIRGFGARSSFGIRGIKLIVDGIPETTPDGQGQLDNLTLGIIDRIEVIKGPSSSLYGNASGGVIDIKTRSYDSENLGTEIKVGAGAFGFQNYQATAAIGDSLASYIFHANYIQSDGYRDQSGFEQINTNFKGRFALADSLYLTTILNYTDAPQADDPGGLTLEEVNTNRRQARDRNQLFKTGEAISQLKVGASLEWLINKKSSFTTYGFYSNRLFDGLLPFENGGIVDLNRNYMGQGAAYRYTKGHNTLQVGYDFAFQNDRRRRFQNLEGEQGDLSLSQKEKFTNLGVYLTDHFNIDKWLFTAGARFDYNKLSADDDFLSDGDDSGSVTLNSFNPSVGVSYAFAKAFIPFVNASTSFETPSLSEVSTSPDGLSGFNENLAPQKATSVEVGVKGALSNKLRYQVTTFSINTRDDLVPFELEAFPDREFYRNAGKTNRLGVEVEGQYAFSKNLQARASYTYSDFTYDEFTVGDADYAGNALPGIAKHMSTLGLLYDTEAGFSARVSANFIGSQFAQDSNDTAIDGYELVNVQLSYQTLFREIQIKPYLGINNALDQEYTDNVRINAFGNRFYEPAPGFTMYGGVILNF

SEQ ID NO: 8824 - protein, 1028 aa, Shewanella woodyi
MRNVKTWGILFLCLLLLPGVAYAQKRQIEGTVISQEDKEPLIGATVIVKGSLSGAETDLDGHFTLEVDPDAKFIIVDYIGMKQTQVPIPKSGILNVALQPEAMNLDEVVVTGYGNFSRSSFTGSANTLRADLLKEMPVVSIEQKLQGMTSGVNITGSSGQPGANASIRIRGMGSFNASNEPLFVIDGVPVTSGNLSTGSGSEASYMNNAKTNIMSTINPSDIENITVIKDAAAASLYGSRAANGVILITTKQGSKGRTRVTLNASAGFSDAAVDFRPTLNGEQRRELLYEGLVNYAQDQIAKDPASFTQTPEEYANANIGAYTSVPALGYTDWKDVLMRQAVHQNYEASVSGGSENTTVYSSLGYQKQEGLVENSSMERYSGRFNVQQKIGKRGEAGANLMFSQVNQEMNEERTSSINPFYCMAVATPPSYPVFNEDGSYANTYPGTNVNPLRDMRTDYNRVRMTRIFGTAHGAVEIIKGLKLKEVLSYDYSIQKDARYFNALSGAGPKSGSDAQSSKGFIEYGKLISSTSLNYVRTFANKHHLDVLAAYEAESFQTDKAAGEKSKMPSDQLFEPDNAAVINSFVSSTQDYRLLSYLTRLNYDYDNRYYIAGSFRRDGSSRLAPEHRWGNFWSVSGMWHLGAEDFMKAVKPVLSDVKIRASYGVNGNQPGSYYGYMGLYSYGKNYMDNPGSYESTQANPNLKWEKNYNMNLGLDLAFIDRIFVTLEYYNRDTKDLLYNRPISATTGFLNYLGNLGQLNNKGVELEVRSLNISNADFNWTTVLNLTHNKNKIVALDGNLDQVVESSWFIRKIGLPFNTFYVKEFAGVDPSSGNALYYKNTEDENGNLDRTLTQDVNEAQAVPYKQVDPKISGGLTNILSYKWFDLAFTLSYSLGGYSFDKTGTYIETDGASEGNRNLPIYELDRWQKPGDITDIPRFVLGRSDKVSGGSSRFVHSTDHLRLKNLTFGFTLPHNWTDKVLLDKVRVYFSGSNLLTWAKWKQYDPEVPVSGEVFCETPPMRTFSFGVEVNF

SEQ ID NO: 8825 - protein, 187 aa, Shewanella woodyi
MIKSLSALALATLGFNSAAQADISDFDSPRIYTGIGYGQYSFEFEDSENDTDFDDDAQMLKGYVGTQFNEYLSVELAYQNFDEVSDIDSKAEIDGVSLAARLGIPLTESFSVYAKGGWLEWDADIKQELPVGSVSTSQDGGDAFYGAGLEFAFSSNVQMRLEYERYKLDDDIDPDMDVASVSLQYMF

SEQ ID NO: 8826 - protein, 91 aa, Shewanella woodyi
MAWALMHSITSMKAKKAITQQSCSVSMNTSYFQMLVQFSFRSNFAKHRDIELGFKSPLFTNQFYKERGVDGSVDIFYKRNFSIDFNYMINF

SEQ ID NO: 8827 - protein, 1269 aa, Shewanella woodyi
MLVVDSGLQGVPLPGPPAAPAPAEVPAAAPDLHDWQARVLCLDWVLPGCRLPTAHSRGHFRRLDFRHAQHRTPPPGRPQTPGTFRRMPVRGRRMTDWWEVILATTAGEFSDLPDLEQATRIVVRLGMAGLLGGLLGWEREHRGKAAGVRTHMLVSMGAALFVLVAEQEGIAPADNSRVLQGIIAGVGFLGAGTILKSDGAHQIRGLTTAAGIWLTAAIGVAAGLGREATALLSTLMALLGQAPAADAAVELVAQARERGDALVQFRTPGRRQPAPVGHGGRAALGQGLQGVRDGRQRQPHALRDLDDGDAPQHGAWIAALVAGAAHAGDQALGFVEMQRRHGQPAAGPARTIHVAGQGGEDAEGRLAEGFDAQVRQALDNLCTALAAAGAAPRDVARLTVLVVDHSEERLRSFGAALLARWAGAALPASGRERIPCRVHRDDRPGVVCAGLLLLVPLGDKLERRRLVVALMALAACGLFLSGFAGSFGALAAGTLMTGLFSVAAQVLVPMAAALAAPGRSGRAVGLVMSGLLVGILAARSVAGLLSGVGGWSLVYRVGGIAILAVAVALWFALPALRTPNPPSYGQVLLSLATLARQHPRLRSRALLGGLSFGSVSVLFSTMALMLAGPAHRLGDAQIGLVGLAGVAGALMANWAGRMADRGREQWTTRASVLLLAASWGALWLGGASLPWFLVGVLAIDLALQGVHISNQNVIYALAPQARSRLNAVYMTTYFAGAALGSALGSAAWQHGGWGATCAAGLAVGFQRPVQAADEGAGQHRQRLALRPAHGHRDIDHPEGLLAVALPPALRAHMLQDGVQFRRLHGRFPPRPLRGLVLGQHLGAALLGLEGQHHVARARVDQAHPHSQPDRQAPVARSVDLGHHRDIPPVVDAQVAGLLRRRGEALHHRQGLRHHALHGRMAVPQHEELEAQRIAVALRRGLQGRAARCCPRGRWLQGFRRDAPRPDRPARMRATGGVTAGRSPVSFSISKVTTTEINAVNTHSKTTLAAAAALLAAAGTLPGAAHAQSNVTLYGRVVAGVEYINKIADPVTGQTNSLTRAADNQWGTSMIGFRGKEDLGGGLSAVFNLEGGFSATKGTTGSAFFNRRSLVGLSSASWGTLMFGKNLFNSNDVWNIDPTGQQFMSSATLVKKKNPLYLYSIRFNGLMIFVLELFKRVNLLVGATSVPPTIGSSKRIVRRAISLLPPTTLPALPTTTPTRATAEATHRAEEASQLYAVSVSLSVSTTLQCESWTPRPQASGSVNDPDWGDH

SEQ ID NO: 8828 - protein, 655 aa, Shewanella woodyi
MGTLGILPVVTDTFSPVTVVTRDQIAREQPRTLGDALFDKPGISSSTYAPGAASRPIIRGLDQARVRIQENGVINNGVSDLGEDHAVPVNPLINDRIEVIRGPATLRYGSGAIGGVVSAENNRVPTFIPLNGYTGQVTTGFSSVDNGRLGAATIDAGKDGIAVHADGFKTATDSYAIPGGIQRNSYTASQGGAVGISAIGDRGFVGIAFSHYDSLYGIPGGVAEQDRTRLDPRQDRVLSRGEYRPLDGLFEAIRYWAGYSVYRHDEIGIGEDGIEGMQAIFKNREAEGRVELQHVPVFTAIGKLTGALGFQSDRRVINSQLEAFLSKTESRANAVYLFEELEVRPGTRLQAAGRYEVDRLSSTAAQFPAGYVPADGQDPFQYALTRRFAPKSASIGALQDLPYGFVASLNGSYVERAPTSYELFSQGPHDATATFEIGNPTLKRERARTVEASIRKADGPLRLDATGYYTRYTGFIYRNYTGLFCDDDFASCGSGTENRQIVYQQQNATFYGAEIAAQYDAIPVGNGWFGVEGQFDFVRAQFDDGTNVPRIPPYRVGGGVFLRAEGWFARVNLLHAFAHTEIAPFETPTPGWNDLRAEISYTKSLDPAVYGASEVTLGLEGRNLLDDDIRNSASFKKDEILLPGRNVRFFLTARF

SEQ ID NO: 8829 - protein, 782 aa, Shewanella woodyi
MKPISFRVSLLLCAVSIIPISAVAATQPKTHPAAHPAAAPSESISVVRTLRQASGSGQMVRTHAEASVSTVDRAYITKQVASAGALNLVQNMPGANVATSDAFGMSNQVTMTLRGLNQQEIGFMVDGTPQNDPNNGTIYPSQLIDSENLQSASITQGSSPIDTPSYVDLGGQVSFKTIDPSHQFGGYASSMFGTWDAKKEFIRINTGDIGHTGIRGWMSFSDFYDQHFTGPGTDRRLHIDAKFLKEWGQGNRVAAVFTWAHQTISNYYEPTLAQWNATGRSNYYSPTYIQGGSPAANSAYWRMYQNPWEDFNIGLPSTFRLARNLTADVEPYFFHGSGGALSGTTLPTGGYYWGNQFESPGSTLPGASGGQAPAVQRYLNSPYRTGFVEKLNWTQGKNTLTLGNWYEYDDFSNWIDYTPVTASGAPQGPRGTDPTVMMANGRPLRSGDYNLMTQVNGIFLNDRLSLLHDHLQITGGIKAVMVDRVGTNHIPGTEYRIHDNSFQPLPRLMVRYDFNHEHQLFFNVTTGFRAPLGTSFFGSTSPATGQVTSLGAGQQKDEYSIAEEIGYRYQGRQVLGSVTFFNYNFTNRQIATQTYVGNLPVSTTINEGGQTSRGVDIELGTVPFMHFSPYASFEYLHTTIDNDFRVGNDYLPTKGKTAVQSPRFQASFGLSYDDSLFFGNFGLKYLSSQYSTFMNDEKMAAQTHGDMTIGVYLPSYRYIKHPKFQLNFVNLWNTHYLAGLGSVLPNARSTRGVNGTIIDAAGAPTYIIGAGFTVAAQLSTEF

SEQ ID NO: 8830 - protein, 738 aa, Shewanella woodyi
MIQCAFKIVMKAVGKNCASGQRPGCRDAPQALAPHCGPCLRRPSTLAIGVAVSCCAIPHGASIAGGVQQPEAQLRTVTVQGSQAEADATGEAASQGYVTRGQLENRPLLRPRELLETVPGLIVTQHSGDGKANQYFLRGFNLDHGTDLATTVASMPVNMRTHVHGQGYTDLNFVIPELVSGIAYKKGTYFAEEGDFSAAGAVRIDYVSSLPQGIAQLELGQHGYRRALLADSNQVGPGTLLYGFEWLGENGPWVLPEGVHKLNGVLRYSLPLGGGERLGITAMAYKNAWNSTDQVPQRAIDQGLISRFGHIDPTDGGASSRYSLSADWQRPLQDGQFKANAYMIKSRLQLFSNFTYALNNPERGDQFEQFENRVTTGANASRTWFGTLAGRDTESELGTQLRYERLDPITLNNTAARHSYQQVRSDRVNETSAALYLRNTVQWLPWLRTVAGLRADQFWYGVSSDNPANSGNGRDHIVSPKLSLVLSPTAKTDVFVNWGRGYHSNDVRGATATVDPSTGDPVQKVSVLVPATGCELGVRTGDVLPGLQLSASLWRLNIGSELVFSGDTGTTEPSRPSRRTGIELTAYYVPMAGLIIDADAAFSRARFRDHESIGDYIPESIQTTASMGLSANRGRWSFGARMRYFGPRPLIEDNSVRSASSFLVNLKLGYRVQKNVRIFAEVLNVLGKRANDIDYYYASLLKGETFPLDASGAAAGINDHHIHPAEPRTLRVGITWSF

SEQ ID NO: 8831 - protein, 718 aa, Shewanella woodyi
MMNTLRLSTLYSAIIIALSTAMPSYADDAAPNENTDKKIEKIEVKGSYIAGYNASTASGASKLELPISDIPQSVSVITSAQMSDFQLTNINTVLDTATGVNVERIETDRTYYTARGFDITNFQIDGIGLPLSSGSNHSDEDTAIYDRVEVIRGANGLMTGVGNPSATVNFIRKRPTADNQFNINASYGSFDNARLELDGTVNLGEKVAARAVAVKQVQDSYLDRYQQDKNVLYAMLEAQLSDNTTLSLSHAYIKNDTDGGLWGALPLYYTDGSATNYDRSTSTSANWSSWLVEKHNTVVELSHYFNDDWHLRATYSHKSTDEDTQLFYVYGTPDKTTELGLTGYGSEYDATESSDLADVYVKGDINLFGRDHQLVFGLNYSTSDKQEHSLYDYTTGNGFPAMPDLNTWEGNTPYPTFADSPLGSDVNSTQKAAYFTGRFNLFEDMHLITGGRFNQWEAKGESYGESRDTDAQDFIPYLGLVYRFMPELVAYASYTETFLAQIKRDINNQLIDPVTGESREVGLKSELFDGKLIASLAYFDVEQVNLAVPLNSNPDNTIFIAGDGINSKGYELDIAGEVYPGLQVSLGYTDFNINGRDDVAKLVKEYTPSKLFKLSAVYEFEQLEGLSFGVNMRWQDDISRTQDDVVADSFANAGDPIITKQDAYAIVDLMARYAFTDNISLTVNANNITDEKYLNSLYWAQGFYGAPANYSATVSWKM

SEQ ID NO: 8832 - protein, 341 aa, Shewanella woodyi
MNKKLIALAVAAASISSVATAAEVYSDETSSLAVGGRFEARAVLADVNKDENVTNTASSEVSDKSRVRINVAGKTDITEDFYGVGFFEKEFSSADSDNDETRYAYAGVGSQYGQLVYGKADGSLGMLTDFTDIMAYHGNEAGNKLAAADRTDNNLSYVGSFDLNGDNLTVKANYVFGGSDENEGYSAAAMYAMDMGLGFGAGYGEQDGQSSKNGNEDKTGKQAFGAISYTISDFYFSGLYQDSRNTVVNNDLIDESTGYEFAAAYTYGKAVFITTYNFLEDSNASGDASDLRDSIAIDGTYYFNKNFRTYASYKFNLLDANSSTTKAQASDEFVLGARYDF

SEQ ID NO: 8833 - protein, 1155 aa, Shewanella woodyi
MIINNRAYSENATADSDEVVIDLNDNTMTAERGVVVTNGNMKGLFYRFQRDPVTGEITFTNNALMNISQPTGSIKIETEGGKVSQKDEKGEFYNSFAYINVAKMTGAEAPNDKIYFGSPYIKYEDEKIYAKDAWVTTDFNIVNFQKEPQKAGYHIFSSDVIVEPDKQITLKNSDLFIGEKDVMPFTFPWFRANIRSGSTVPLFITIQSDDDYGAATSMGFLYGNRRDKFRGGFAPKFADKMGILVGRWENWYRFDNVGETRLNIDDWLIYAKEKSEPKNTNELPEYEKRHKRYKVELTHDYDGENGSFHFISQNSTRSMVGNLEELMDKYDNNNVYSSLGLKRFKFDKNIGFYNLNANLFNLGEAKDLSFTGKMSLVSDKKAYGLLVYDKIDDISYGSTIDHDLYTNLSLTKDNDKFKLNARYDYLYDMDPGSTAKDLMSRNERIGADFLLKENGLSISYDKRRGDDYRNFSFWEEDINTSARKRNVLGIDFSYTPTTVAKYEFNNFENIKASLGNYKVGNYTFTPSVSYNFLDRKLDTAKDTYRTTVLGSNRLAEFNRFENIVYNNTLERRADLNLSNDNETYRVGFGKTTSEIWSREGLFDGTYRKYENKSKFYEVQLGRQNLPLGSIGTFGIDGMFRQDKFDGSSDTTNLINLKLGNDLYLYKTENLDVTNKFKAEIQKYSFSGNKNNEEVRLITKSDYIKFDNSLVFDGKSTVTTYDIGYKNSKNPYGVKNKNGEQFTTGLGIKFDENTNLSLKYTDDKRFTSKTKSGKNVNDLSMKQYSVNFETKKYDLGFSNTDIDFVGDDFSTTTDFREDINEHRIRAGYKFDNSKVSLSYAEGKDKLKTDDGRYLDRKNRMYSVAYNIYGDVEQDFIGAFKTYRYGNNRIEDDIRNTDVYSFSYAYRDKRFEQEELMRYATLEYEKPKDQITNDEIEQIRAILDRKNSFYNQFELTRIQDETFRIGNYKKTLSAYVNFEKNKKRYSQTGNLKDSLSNFSGGLTVSYNRLGVGYTFTQKASWKNSGGSYKWSKDTKEHELSVYAKIGKPSQGWKIKTYAMFYDNKNDPTSSKNRKRSVDSIGVEIGKEMGYYEWAISYENRYKTSSRDYEWRVGVHFTLLTFPNNSLFGIGAKNRGGTTSTKPDGYLLDRPSQLKNSY

SEQ ID NO: 8834 - protein, 395 aa, Shewanella woodyi
MMMKKTLIATALVGLFASQTAFASEETQELRKVIEQQQKVLQDLERRLEATETRVEKTADVVEEVAESKSATTIGGYGELHYNNITDNKSGSDKKSIDFHRFVLFFGHEFSEKTRFFSEVELEHSLSGDGKPGEVELEQAYIEHDFSEMFTGKAGLFLMPVGIINETHEPPAFYGVERNPVEKNILPATWWEAGAALNVKAAPGLAFDGAVTSGLEVATEGSKAYNIRSGRQKVAKANASDLAYTARAKYTGVPGLELAATAQYQADITQSAGGVDTASATLLTAHAIYSIQGFTVKALYAQWDIDGNEAEALGRDEQNGWYIEPSYRFNESFGLFARYNEYDNEAGNSEDTKIEQTNVGINYWLHENVVFKADYEKVGGAKDSDGFNLGVGYQF

SEQ ID NO: 8835 - protein, 804 aa, Shewanella woodyi
MFHEPLTPCVAKRRSCTVRPPSAVLEQDSPMTSARRFHVTPLALALAVLLPVIAHAADPIPASAADAPVTPADAAGNATQLDAINVVSQGSTRQVQRISRQDIEQLTPGSSAFKAVEKLPGVQFQSADPFGTYEWSTQVTLHGFDQSRLGYTLDGIPLGNMSYGVTNGLHITRAIISENIGSVEIAQGAGALGTASNTNLGGTMQFYSADPQTTPGARLVQTVGSDATRRTFARADTGDRNGLSAYLSYANASTDKWKGFGDQQSEQANLKTVYQWGDGNRLSLFLDTSRRKEYDYMDLSLTSQRALGWDYDYLQPDWATAVQMARAYQTTGATSGVANGYPQSLAGLPDDYSWLDASYYAGGGLRRDNLAGLSGTFVFGGATLDAAGYYHANRGEGQWVTPYVVTSAQIPVSMRTTDYGLDRFGGTSALKWSWGNHDLEAGVWAENARTTQGRNYFALGNEGYTSLYNVYEAQTPFRRDFQQRYTTQTRMLYLQDTVRLLDDRLTVNYGAKALSTTTRAQSLVPTTALAQGRIRAEDNFLPQVGVNYKLDERQDIYASYSKNIAAFGFTPFATSQAAFDRSRSTLEPEESQTVQVGYRVQDAQFQLSADAYFTKFSNRLLTTSPCTAVQTCASILSNVGAVHSAGADLALMWRPIEGLSWLNSLSWNRSRYQDDYLNNGVVATAGKDVVGIPALMFSSSASYQIGNLRLDLDGKYVDKRYITFLNDSQVPSYWLFNAGARYDFGRLGGVADVALALNITNLTDKRYFASTGTNGYVASDPNGYNQTMVVGAPRQTFLSLDVKF

SEQ ID NO: 8836 - protein, 176 aa, Shewanella woodyi
MKYNNIIFLGLCLGLTTYSALSADSVIKISGRVLDYGCTVSSDSLNFTVDLQKNSARQFPTTGSTSPAVPFQITLSECSKGTTGVRVAFNGIEDAENNTLLKLDEGSNTASGLGIEILDANMRPVKLNDLHAGMQWIPLVPEQNNILPYSARLKSTQKSVNPGLVRASATFTLEFQ

SEQ ID NO: 8837 - protein, 656 aa, Shewanella woodyi
MTSFFTTQTICFTIVCFLCSSTAVFAQEENDLDDEQETVDFELTVIDQLLNQPVYAPSRQEETVQDATRAAYVINREQIEAQGYRTVNEALKYFPGIFIDSTAGSRLGAQSSQIFRGANSSSQTLILLDGRPLNRFDSGNFDLSNLTTDNVERIELIPGGSSVLFGSNAIGGVINIVTRQPGFNQPVAVEIGVDLGSFGYNRQNVGVSFGAETQAVRLAYDRTAAENDFDYDIAARGLSGVRDNAATNIQNVNLQVVNQLGDRHRLRFNGIYSSKDLEIPSSVSSPSPNATQYDNNWLLSLDLESRLGNSDDSLLTTRLFADLNDFRFFDENQFGTTDARYENNSFGAQIQHNWQLNETQNLTYGFDYRYLTAKAEDPGVFGFSYDENLSQGAIFARYGLDITPELTLNLGVRQDFNSLADGSVTSPSAGFAWQVGDSTRIRGNYARNFRVPTAVDLYFPGFSNPDLVPELGNSFDLGVDHRFSDRALVRLTYFNNTLDDAIVFDLGTFTPQNVRKARNQGLEAEVTLQLSRSLSAFANYTWNNSEILADADPTVVGNEVAFAGTDYFNVGLAYENPQGIYAGIFLKRVGDRLTNNANTESLAGYTNLDLRARYPISDTVNLTASVENLFDADFETFPAYPGVGRRFQIGVNAQFR

SEQ ID NO: 8838 - protein, 1194 aa, Shewanella woodyi
MSNIRKGVLFALAVVLLVFTFAPNAVSQGTYTAELRGQVTDNTGAMLPHATVTITADETGLSQTATTDDAGRYIFTALRPTTYTLRVQAKGFATSVHKNIVLAVNQQASMTFELKPAAANESVDVVDTAPLLDTGGASLGTEVTNEFISRMPIQNRDVTQLVYLSAGVTTLNNGGGYPYGTDFSSNGQRYGSAEFRLDGGLATGPEQGEGATTNVSYVPSTEVIQEFKVQNNSFAAEFGSNGGTVVNVLMKSGTNKFHGSGWWFGQRTELNANDFFSNRAGVPRTDNTRDQFGGALSGPIYKNKTFFLVDVEHVRQNNKNLISGRVPTDLERAGNFSETMVQDDNGNLVPVQLFNPFAYDPVTQTRQPFVGNVIPAGMITAIGQNLVNAYPAATGPIDPGTQTNFNVATVITSPNTQFDIKIDHQWNDRIHLMGRYSQANSEFDQPGAFYDGITSNTTTRNVVLEGTWTISPTLLWTNRAGLDRYYQKGTSQKVDLTTLGLPTLYMDANGIQRMPSMPVDNYSGLNDQQCCVDTVNGHTQYVFASQMSWIHGKHSFKYGWEGRIFLNNFYQPDYATGLFNFTKTITAEDPFGGSPANYGTGLAGMLLGFPQSGQINIKYGVADKSMQNAFYFQDDWKVTPKLSLSLGLRYEFSTPYTERHNRSQFDNFTGDSGVSLNLNPTGDPDLATLGLGTTDLKGTTVFATSNNRHVPSDLNNWGPRLGFAYQLAQNTVLRGGVGMFYGLSTATNFQYSGTSFRKDAAIHFTNDGGVTQYATLDNPFPTLPTNTVPGPQGTTYGKLAEWGFADSNDLGTLPDRNPEIYQWNIGVQHLLPWGIVISADYSANHSTHLPYGYPTRNRDFLSAAARQKVIALANAKGEAPSDLLNELYPNPFQSMFVGPTATFHEPDSIYNNDTIPLVNLLKPYPQFDGDFEGLPLTSANSWYNGLLVRFQKRPSHGLSFEGSYTYSHATDNSSYGANSWIFFNGSGLGQPQDLNNLKAEYSIGANDTPQRFTLATVYDLPFGRTRTFGGDMNRWVDGFVGGWSVNALLTLQSGQPIPFAMSNSQLWDGQQRPNLSCNPLSGMSLHDVAMSNDPNANYFNASCFADPGDQVPGNAPRFSSDARGQGIKNLDLGVFKDFAIHENMKLELRAEFFNFTNSVRFATPFSAWGDGSFGRVESQANQPRHMQVAIRFEF

SEQ ID NO: 8839 - protein, 426 aa, Shewanella woodyi
MKLLNVINFVFLMFVSSSSFAQVIEMNNSSLRDFVTWYSKQTGESVIVSPDVKGTVTVYSSDVKPENLRDFFISVLRANNFDMVGSIPSIIQKYNPNNQDYIDELPSSDNQEYDDNSAPSGGFFVPQNDNVTQTFKINNVRAKDLIRVVELFVKSNTSKSSNVLSVDGSNLLVVSAPKDILDNLPQFLSTVDLPTDQILIEGLIFEVQQGDALDFSFAAGSQRGTVAGGVNTDRLTSVLSSAGGSFGIFNGDVLGLSVRALKTNSHSKILSVPRILTLSGQKGSISVGQNVPFITGRVTGESANVNNPFQTVERQNVGISMSVFPVAMAGGNIVLDITSKADSLSSSTQASDVITNQRSIATTVNLRDGQTLLLGGLTDYKNTSQDSGVPFLSKIPLIGLLFSSRSDSNEESTLYVLVKATIVRAL

SEQ ID NO: 8840 - protein, 1032 aa, Shewanella woodyi
MDQKPNFLKRLISKRLIKTISTAAFIAAASSSTMGASVQKTVNVPTASFGTGTDWLPAVAVGNGDSLLYKCTGNTIIGNVNNTVTINNNGINPILQIGTATAGNTVGVAGVVGSKQLTIMMMNEASNLILGPNGVAAGNFAVAGEVGSYVGLLNINFSNTNSNVSIETDGFTSDVTFISNGGVNGAITLNAKGITLNGNITNLKAIDLNSNNLTFGGNNIQLLANGSAITFRANEQLTLTSASDIEINSNIAVTNDQQGSIDASGLASGQGLVIKGDIGNYSTSVRLGQFNIGSSATDFNAGNAAIGNLIFGNDGIALFAHNNYLITKTTNASGQGTIIFRPVVADNTNLVAGTNLGSADNPLAEINFAAPAGTNTDTILNVGQGVNLYATEITTAGVNTGSFNFNGGGTSIVSGTVGIAANKFNNITLTNNTTVKFTDDVISNGATTIGGNSTLQIANDYITDSIQGNAAGDTGTLQFVNTKGILVTLKGNPNPDNALAALQVSGSADVAIDGSVNINGEINLGANVLGFTDGISTWGNDTTISTTLTSDEVMGNIVISGAAEVKIAGLKTIKVQDNASIDFIGTKTYTLIQGDISADNGIDPNVVGTNRYVIYGLSGNTEALVTRTIDINNIENILNNDISGNGNPVIRHNLVTFLNPNNTGNAEQAYNNILLAQNTNDAATSFAATLTDTSTSVNNININVAKEEQGLIGYRLDELRYLCTPESDKMASSEGGVAAGDEPIDNVAYGVWFKPLYVDTHQSEKGGVAGYKAKTVGTVIGLDTLANDNLMIGAAIGLAKTDVKHQNYKRGDKTTIDSLSFSLYGAQQLVANFFVHGNAILSVNQVKNRSQRYVFDKNGNRSTQIASANYSNMTFGGNFMVGYDASLMDGLLVTPMAGLSYLKSSDESYKESGTTFANRQVYSKFSDRTDFIGGAKLMGYTINLADLIVYPEAHAFVIQKIGGRLSKTQYQLEGQVNPYITPSDKTARTTYNLGLSGTIRPDTKMEYGIGYDLNIAKKFISHQGTVKVRLNF

SEQ ID NO: 8841 - protein, 978 aa, Shewanella woodyi
MSLHNSRRNAMLMGASALVICGALPAIAQAQTTAPASSADTVEEVVVTGQRAALQSAQKLKQNAEQLVDSITATDIGALPDRSVTEALQRVAGVTIGRTADGRDADRISVEGSGVQVRGLSWVRGEVNGRDSFSAKAGRTLSFEDVPPELMSGVDVYKNPSADIIEGGVGGTVNLRTRLPFDSGKRNLAYSADSSWGDLSRKWEPSGSVLYSNRWDTKIGELGFLIDLSDSKLSSRTDTISVDPYFARTNTLVPGKTVYVPGGFGYRSLDFERERKGIAAALQWRPNEQWDASLQFLRSSASQASTEHAVGFNPGSTNGPATGTDFTYDSDGHFLKGTLAQTPGGSSLGSSTIDTRYSDRSSVTSDYALKVKYTPNDKWAFSGDIQYVYAKTKTVDNTAFNALNSDAAPASLDLTGSLPVITMNNDTAYTSNAANYYLQAAMDHHDRNEAAQWAERFDGDYSFDDGGWLKSFRFGVRHTFRQATTRETNYRWDTVAPSWSATAPISTLDGYQGYYGLYEFDNYFRGKAHLPATFVMPSAQFVNNYGDTSLVLSKIAQQNGGGWRPFNGVFDDQGQAGGKGSINHQKEETLAAYGLLRFGHDVSLWGDQREIDGNFGLRVVKTESQSLGMQVFTPNTTSTDIPAADQAFSNGAKSPYKGGRDYVSVLPSLNVRLKITPDMFIRFAAAKAIVRPDFQQLQPNYTISATNGFITGGTCSSTIPGGSQANCVYQYTANAGNPDLKPTRSTQFDVSYEWYFNSTGNVTATAFYKDIYNFVTNGSTNLNFTNNGVTRTVQVVQPYNAGHGTIKGFEVAYQQYYDFLPGVLRGLGTQANFTYVDSKGSRNAASNPYDTNQVGNIRTNGEELPLEGLSKKSYNVAALYDLGKVSARLAYNWRERYLLTTTAANINIPAWYGSYGQLDGSVFYTVNDALKIGFQAANLTNTRTKILVSYPGKPEEGLTNHNWVVADRRYSIVLRGTF

SEQ ID NO: 8842 - protein, 845 aa, Shewanella woodyi
MTIRKIYSLSLILSILSLFVSKNYAQAPAEVVKYTISGKVIDNELEVPLEYATISVENVDDPSIVNGGVTNANGEFSIEVKKGTYNILVEFISYETKEFNNRQVDTDLNLGTIKLGLGSENLDEVVVRAETTQVDIRLDKKIYNIGKDLTTAGGSVSDALNNVPSISVDIEGGISLRGNENVRILINGKPSAMAGFGNTDVLSQLPAEAIERVEVITSPSARYDAEGTAGIINIILRKKETLGFNGSVTVNGGIPENGSISANLNYRTDKFNLFTTTGYRYSESPGYAFFDTRYFEPRADVLLDSISYDRNIEDRDYDRINRGFNTNLGMEYYLSDMSSITGAIFYRIGDDRDVTNNLNDYLMGSEELLGTNRSEIENEEDESIQFSLNYVKKFDNKGHQLTADFQFENDNETQDAFIEEVVRYNNTERDNIDIPSESTITKEDQKEYLIQADYVLPIGEESQFEAGYRGNFENEITDYQLYQENNAGEFILNESQTNVFDYSENVQAIYSQYGTKFGSFSFLLGLRLENTNLKGKIDSELTEEELQEEFTFPIDTDFDNNYLGLFPTVNLIYELGEDENITLGYNRRINRPRGWYINPFPSRSSRNNIFQGNPNLNPAFSNAFDLGYLKKWDKLTLTSSVYYQRETDAFQRVQEEVFISGPSDQQIEVIRSIPFNLATNDRMGGELGFLYNPADWLRLNGSVNVFRFKLDGEFNGTDYSQDNSSWFGRFSSKVTLPLKIDWQTNLFYRGPSDEIQGTQEGILNVDLAFSKEILNEKATLSLNVRDIFNGRKRNSFTTTEFFEQDSEFQWRQGQSVNVSFIYRFNQQKQRQQRNGGNEDYDEGEF

SEQ ID NO: 8843 - protein, 831 aa, Shewanella woodyi
MKMLYVSAAIVPLLFVAPSHVLAQTAATKTAEAPGIPAANAPASREEVFSTGVAKGRDRLDSATSTSALRERDIEVSGGRSLGDLLRNLPGIRTESSTGDGSSAYTIRGLPLASGGSKYMQLQEDGLPVLEFGDFFNGAVDIYIRADLNLAAVESIRGGSSSTFASNSPAGVINLISKTGDVKGGTVLLTTGLDYDTNRVDFSYGAPINDKWRFHVGGFYRVGEGPRKVGFDAFKGGQLKFNVTRQFENGYVRLSGKYLDDRSPHYLPGPIRITGTNDDPVFSSFNTYDVRHDSMNAGNLGKLITLDADNKPVQMPLSQGMNALVKSIGLESQFEVQGWTITQRGRYSDIEGGTLRNLVANIFSGAAMPASLGGGTGTFSYATGPSAGQVITNLGALNGNGLVVGSSLNRIESRSLNNFINDLRATRAFDVGKGELTVTGGVYKSIQDYTSDWLYSNHLQDVAADGNSSLINYTNAAGVPQTQNGYLGFNRSGPTAFFRRSYDVRYNITAPYGSLNYRIGKMAIGGSLRYDGGRVRGDLYGADLGGGRIGIRSVDFNGDGVISVAESKTAFTPFDSPAPVHYNYGYVSYSVGVNYRVAEPFAVFARYSRGARAGADKLLFSTKVSTTDGRLINKSDGYDIVKQFEAGFKYRAPNFTVNVTAFSADTEDTNVQAGAITTDRTYKAYGVEAEGTYRHGPFSVRGGVTYTDAELVNDKLNAAVAGKVPRRQPDFIYQATPQLDLGQVTIGANIIGTTESWVQDNNLMKMPGYTLVGAFAQYRVTDKLQLMLNAENLFDKVAIIEITTPSVPANGIGLGRAANGRTVSMSARMHF

SEQ ID NO: 8844 - protein, 771 aa, Shewanella woodyi
MSIFSLRRLRAFVPPAMTALAVAPAHADTASADTTLPAVSVSANSAANESVAPRAVDPNLPASVETVTREQFSNWNVVNTEDVLKYMPNLAVRKRFIGDLNSIIAVRGTSNTQSARGLVYADGLLLSNLLGNNFSFPPRWSMVSPDEIQQVDVIYGPYSALYPGNSLGATVLISTRMPKKFEAEADVKAFTQHFSLYGVNRNFNGSEASASIGNQIGKFSFLLGVNHLENTSQPLQFATLAKSGTPAKAGDTPVTGAYFYNNQTNTPTAILGINGEGIEHTVQDQFKLKMQYDFTPTLQGAFTLGYWHQTYNSETSSFLRDANGNAVYGGKVSINGYEYTIPASAFAPSLGHSENWFYGVTLKTRNATGWNGEAIASYYDVSNSVARLASSGAPDNGAGTVTFGDGTGWKTLDLRSTYTPASTQAGLANHALAFGYHYDNYFLDNESYSTLNWRDGSATSFANAFAGKTQTQALYAQDAWRFLPRWKFVYGVRYEDWRAYDGSQALPGTRVALANASEQHFSPKASLSFDVSDDLTLRASIGRAYRFPTVSELFQGQINGSSIVNNNPNLKPEDDLSKELTAEWAHWNGIFRFSLFQDDVKNTIFSQTDTTVIPNVTNFQNIGKVRSRGVETSYAGENVFMRGLDLLASVAYTQSKIIANAQNPASVGKYFYRIPLWRVNVAATYRFDERAAVTLAARYSGRQYNTLTNTDTNPDVFGGTSSYTVADAKFTFRPTKLSEVGIGVDNIFDARYFVYHPYPGRTFYLEAKLRM

SEQ ID NO: 8845 - protein, 849 aa, Shewanella woodyi
MIRTSLHSSSKLSQAIKLGLIASVSTTAFTVSNTAYAQEETANVERISVTGSRIQRQDMETASPITIIDAATIKAEGFTSVDQMLQAQTSMAGAAAGSSTNNGSDGVAHVDLRGMGSQRTLVLLNGRRMVNSGSGADSAVDLNSIPIAMIARVEILKDGASAVYGSDAIAGVINIITKQDFEGFQFDVTGGMTDKSDGENGEISALYGFNTDTGNYTFGAAYSERRGVIQSDRDWTDPGASSFVPNGSLGGMVKDDNGNWVDRTEGYDYTQDSFYQTPSKRYSLFANMTQELGSDIVLTGDILYTKRKSHQQMAPQPANLDLDVCQAGDDPATCVELDQDMIDAGITPNDKGQVNYRRRMTDVGPRISTQDTDTLRVSAALAGSIDVNTGMDWDISYTYGKNKADTGVENSINAKIMTNAIYADQDAWFTGQPMTDQDLLNSVAYTEQADGGNEQHIFSAGLTGELFDLDAGAVAYAIGAEYRYESGYYNPDPIVVAGESTAAQQDPTDGNYSVISVFQEVSVPFTDKLTGEFALRFDDYSTFGNASTWKIGLTYAATDDLMIRTVAATGFRAPSVSELYGGNSGSFDYLVDPWGNEPDQQILVNRTSDDDLKPEESESYTAGLVYSPSYIDGMSLTLDWWRFKVTNAIARMDTQNGLQSCYDYQEKGIGNDSACVAFNIGENGDLEHLTNTLTNVGYQDTSGIDFNLAYSFEALSLDWRISNDTTYLLNFEQDGVDYTNTIDGNFGAYAQVRNNFSIKAGQDDWNVMYFNRYIGEMDDLGAGTKVDSILYHNVSASYFINDTWMVSAGVKNLTDEEPSNVSNGSDGGTVPEVYDTIGRQYYAGVTVKF

SEQ ID NO: 8846 - protein, 394 aa, Shewanella woodyi
MNRLIAAILAVGLAPAALAQEAAAPASSAPAESSEVDTAALKGQVDALAEQLAEMKTDVSGLKKLKFSGYVQPRFGWLEAAKYEKGAPQRDGFYVRRGRFKAVYDTDLAQYVIQLDATPSGVGLKEAYASFKLPFLKGFAIDAGLQLMPFGYDVGIRSSSDLDLLERAMFAGHFLKGEYDLGVALRGAYGPVNFKVGVFNGNGVDGAAGKDNDQRKDVIGRLGVDLGMITGGVSGWYGKTIDYTSATNETYDRVRLGADLQLYLDLLPVGGTALKGEYVWGKTAIGTGAGGAGDSLGLIGYGWDVILTQNVGPWNQVAVRYDTFNPNVKLDRNLAANQGKVFITDEVSAALHTILSSNLKLSVAYYHPMNREKGDTAPSDPKKDSFVAQLQAKF

SEQ ID NO: 8847 - protein, 583 aa, Shewanella woodyi
MKTIYNIKALCVMALLGSVATVSAQEDKTKEKNLNREMTLEREYDPTVQDASKVNTLPVIKEPVVKKMAIDYATFTVPADPEKEISLLPSGNIMTDIQYNKRRGYFNFGGGTYLNLNGDLGYHILSTDKDKLNIWFSHRSTNGKVKYIDTDFDKVKAKLNDNLGGLNFKHAFEKLSLDMGIKYGYSAFNYYGLPVYSPESSVTLVPENFDRETNQVNQTIQAKIGVESKEDAPVGYLLDLGYTNFSHKYALSKEQDGPTEHTFDVKFDLNARFGGEQRIGLGGNVEYFNYSLPTMGGQEYLEFENHAEATLSPYYKVSGDNWNLKLGANIMFVTGDNSKFMASPNITADVEVADKTELYLVAGGKLYSNSMYEISQVNRYINPTMELLPSRNYLDGTVGIRSGIAPGFWFDVFGGYKITSDEVFFAPTLLAPSVQGDIFANTSRALQANAKHAFGGVNLKYSYQQLFDINLKGVYNSWNVDDIEDAYGKPEMELTAGITVRPISQVTASLDYYLATGRKTFLGRSEGEKMKNINELNLTGTYTLNDTFGLYLKLNNVLFQKYELYYGYPMQSFSAMIGVNINF

SEQ ID NO: 8848 - protein, 712 aa, Shewanella woodyi
MKLTPVSAAVLSVLAASQVHAKSDVFSMEEVVVTANRIEQPVSEVAGSVAVVTSEEIEQKGETELYDALRHEPGVSVSGGAGRPQNITIRGMTGNRIMIIRDGIRSADGFGANDNNDKVGRDTFDLSNLESLEVVKGASSSVLGSGAVGGAVILKSKQPGEFLEDRDFYVDATGTYTGISNKYKGASNLAFRSGDTESLVNAAYWQGEETRNFSQDLYNRDLDGYSASYAINHFFSDDVMIKARAELYRQDQQRLEGSSSIQKDGKWHIEDFAEDESTEEYSAYLGAELTPLDPTWFEELDTKVYWRHTEVVTDTNRLMNSTDANGLLIKRRELEHKTFTDNTVGLRADFKQTLHASSAEHKLAYGVEIASDYYQREDNQKVLDWTGSNASQKQPFASARAYNIGLYFRDMIELEKWTLTGGLRFDAHRLSPDGQNDIGGYPLKDIDSSEISPSLSISREVFENNRVYLSYDHGYRAPEYDKAYGFVSHDFVPLTPFVIAPNMDLEAETSDSFEIGNKFDNGRAQLYVSAFYNKFQNFIDVVTTGQDNFGNYVKQYQNLHGVETYGAELSAAYAFTSSWKLSTKLGYVDGKDAEGEYVRSITPFEGNVGLNYQQQDFNAFATWNWAGAMDRVPSCQTSLGQKTECAQTEAWNTLDLGASYQITKDFRLSATIINLFDKEYIRYQDVAGIADESKRYSTEPGRYFTVNAKYIF

SEQ ID NO: 8849 - protein, 443 aa, Shewanella woodyi
MERINRATPFVAGFCGLLIAQQSYGEGFLEDSKASILARNFFSNADNRSGAAAPNYTQEWGQGFMLNYQSGYTPGSVGLGVDALGQLGVRLDSGKGRHYNPQSTAFNGNIFPTDSDGRAVDEFSSLGATLKARVSQTELKYGTLVPMLPVVMSTDRMLQQTFRGGQVQSKDLKDFTFIAGQLEHVMGRGSTNQMGMSIPGANNPLTGEFVNKFYYAGVDYKPVKDLTLQYYYGNLENFYKQNFLGLKYDLQLGPGTLRTDLRHFDNRSDGANGHDPSFYTVGYYGNGVTKGEVDSRLSSAQFTYLIDGHTFAAGYQAVTGDSDAVWLNQGDGSTAYFMTESMIGKFQRAGERTWQVRYGYDFARLGVPGLNFLAMYESGSNIQTSDGDKKEWERNVTLSYVLQSGPAKNLSIALRHAQLRTEFASQRDADEHRIIVSYPINIF

SEQ ID NO: 8850 - protein, 245 aa, Shewanella woodyi
MIKQRFGLMAKVCALMSAAVLASPATATNGYFANGYGGQSKSMAGAGVAVTTGVLGMAQNPATGVKVGNQAGFCLTTFAPNREVEIAPGGPLTPGTHKSQNDVFFIPCGGANWKLDDRSSLGAFVFGNGGMNTEFDTNFFAGLGAGSAPLGVNLEQAFITLNYARKVNDRLTLGISPILAVQRFKAQGLQAFSGLSISPGEVTNRGHDWSTGFGVNLGLLYEANPQWTFGAAYRNEIQMSKFSRY

SEQ ID NO: 8851 - protein, 344 aa, Shewanella woodyi
MKKTLISASVASVLTLASFGALADGPGFYGRLDLSATHSDTGATTQNGKEGAILENNFSHLGVKGSENIADGYDIVYQMEFGVDNTSNSNKTFTTRNTFLGLKTNAGTVLVGRNDHVFKQTEGGADVFGNTNADIDRLVAGQDRVGDGIWYYSPKIAGLVTLNATYLMEGNYTDEANKTSYDQQYALSATIGDKKLKAQNYYVAAAYNTIKGIDAYRGVAQVKLGDFKVAGIFQNTESQTTDQEGNSYFVNVVYNLNGVNLKAEYGKDEGGFGKYYKNITGGYEEGVTSDINVQVITVGADYKISKSTMVYGHYAMYEGDHKVGTATKDLEDDNVFTVGVRYNF

SEQ ID NO: 8852 - protein, 392 aa, Shewanella woodyi
MNKTLIASVIATLLTSNAAIASEETVELRKVITQQQEVLKSLEQRLNETEKKLEATADQVEVVTESTGGMFANTTIGGYGELHYNNYEDQDAKIDFHRFVLFFGHEFSDSIRFFSEFELEHSIAGEGKSGEVELEQAYVEVDINEATSSKVGLFLIPVGIINETHEPPTFYGVERNGVEKNIIPATWWEAGLSFNYKPVGGVSLDGAVTSGLEVGDDFKIRNGRQKVAKATAENLAYTGRVKYTAITGLELAATVQYQTDITQGGNNFDAPIDTADATLLEAHAVYQVNDFTVRALYARWDINGDEAKALGRDEQTGWYLEPSYRISEKVGVFARYAEYDNNAGNSDSTTVESTNVGVSYFLHEDVVLKADYEDLGGSIDSKGFNLGFGYQF

SEQ ID NO: 8853 - protein, 367 aa, Shewanella woodyi
MMNNTLKAILLTSMLPFAANAAQELTPWYVGGGLGVNNYEPNCDQKTMKQCGEDDPYAWDVFGGYLFNDYFGVELGYRDLGRAEWVDYANKLNDVGARGMTLGLVGFWPFADRWSLSAEAGAMNYLLSNNKQWGSEYYSDSGVAPYFGAGIGYNFTDNLKLQAKYRRYENLDEDKWNTLDMESNYWGLELSYRFGRAAPAAVAAPVVVAPKDSDNDGVTDDKDQCANTPSNHKVDANGCTVYREVTEKHELGSIRFANNSAVVNSASYGQIEKLANYMNQNPRATVLIGGHASNVGNPDYNMDLSERRANAVAELLVSKYGISQDRVSAKGYGITQPLIEGKSAEANKANRRIEAHVTGVRKEPVLK

SEQ ID NO: 8854 - protein, 845 aa, Shewanella woodyi
MDTKHYQAFPRVRLLLAVFLLTIMLTPLPAWAASPGSVKGTITDKTDGEGIIGASAMLENTTLGSASDVEGNYTISNIPAGTYRLKVNAIGYAPFFQTISVKTGETATINPQLEQTTVMASEIVVGAALYEQDRLEVPVTVSVVTDEKIKEEPNPTLDQVVENVPGVVVNRAGGYGSSTVQIRGSNTFQGGAIGTRVQGLYDGFPINTPVTGEVVWTNVNMNAADKVEVLKGAAATLYGSGAMGGVINVFGSLPDKFEVKAGASGGFYDDPPSSDKSEYYKDNTPWFWNTYVGIGDKRGDLNYNLLYTHADDDGYKETSQSLLNDVKLKARYDIDANQYIQLSSYYNATEGGYPTTWSFDNLILAETLVPHPEYAYDATTITSFAPWFPPTGITTPKSVYTDDTIERKNSLVGLNYVNLFSDDLSLDTRLYYTYNSSRINYNNTDADQTYATGVTREPGEFNQDKSNRYGAGVKLDFRASDQHRLLFGIDGNIVDVQSTQYTAELPAKNEFNDIQEKNLALFVQDEFKMTDKLTALLSVRYDWSGIDADEVSYVDYSLPVTVFVPGVGPVNTYPFTSTAEIENSSVDAISPRVALNYKATDDMSFRASWGRSFRAPTLAERFVRDAGLWGGNPNPALDKESMTAYEIGMYKVFSDRVSFDIAAYMNNYDNLIESVFLFNSADERYFFFENFRKARIWGIETSLNLKPVDELSLNLGYSYMNAKIVDYEPNVPPISIDNNPDPEWLPMRPEHTASISATWKATDRLTLNTTGRYVSEYKAVNAYTDPDGENYPGGFIVFNAGGKYKITDNLTGSFLCRNIANEQYEEAEWYRAPGRSFLLGLDFVY

SEQ ID NO: 8855 - protein, 725 aa, Shewanella woodyi
MQIRRKNIHKSCVILGALSVCIPSFVFAQNSDKNVVTELKPILIKGKKVEDTSNSITILTDRKTNKNIDEKQITDVYDVSRLNPSVSYNSENNSFVIRGLDANRVLTTMDGISLPWFNDIFRGGGGNTTFDFNALSTFDTIQGSDSSLYGSGALGGIIALRTLNPEDLIVEGKNWGSLIKGGYHSVDNSWRIDQAFAVRNYRTFLLFQGSYVEGHERKNMGTVGGYEERTRKNPSNFDKNNLLFKIHQYLSDNHRLGFTAERFGHNSNTHELNSSKRYAPGSVYERDDKLRERFSLSYNYKGNGDAVLDAFSGVLYWQRQSSRHVLTGVRVSAPKGDYLRDNFLRNINYGFNADALKKVDFGTTSHTLKFATNVSSSKFHHYLLGKDNCHIKEYARGCLFVPANRSDSPDTNGYNLGFVFEDEIGFVDDRFRVTPGIRYDWYKYVPQKTPSYEKALISDKFPPERSGSRFSPKLRMEWDVRNQVTLYAQWAQAFRAPRISELYVSYIKPSAYYVKGNPDLQPETSNGYDVGLRYGNANFGGSFNAFINQYKNFIDTEDRGPSEEFRFARRHYMNRFRVQIFGVETKAHLALKNGFHSNVSLAYSQGKDLDKKEYLNSIPPLKAVIGLGYAKEVWGGDIILTLAAKRDKVAEASDYQKIPGYHVVDMTGWWKPFGETGPILRAGVYNLFNTKYWNASELPSGKSSTPKDYYSQPGRNFKVSFVQKF

SEQ ID NO: 8856 - protein, 251 aa, Shewanella woodyi
MMNRKWLLLALVAAQPALADDMIQWWDFSATALYGDNYDLAPSERQTTITLETAGGWKYGDWFAFQDFIYFNGNNGGKDSTTYGEISPRFSASKILGKPVGVGAITDVSLALTYEEGEGPVKSFLYGVGLDFKIPYFSYFQLNTYRRDAISTGNLSDGWQLTPVFRMDFPVGHSNIVFDGFIDWVFSADNTGYEENFHFNPQVKYDLGAAIFGAHKKDKLFVGIEYDYWKNKYGVKGIDQNTYSVIAKYHF

SEQ ID NO: 8857 - protein, 420 aa, Shewanella woodyi
MLLIVLASFALIGASPAFGSGFAIYTQGAASLGQAAATIAHGEDPSVIFFNPALMSKFEGTQVEVGTTLLIPLRDFKSGLTGNSTSAEKDVFFPSTFFVTHRFTDKISLGLGVFNPFGLATEWADNWEGRYIATKSELTTYDINPVISWQVTPWLAIGGGPDFLILDTTLEKKLYFAPLGLADGGQRFKGDGHGVGWSFGALFEPHPDVSIGASYRSMVRVNVDGKAEFTLPNGAPAYFSLLFPDTDGDAQLNLPQRVHFGVCYKGFYPLTLEVAARWEGWSSFEQLIIRLDKPVAGSMVSVNNRNWHDVWTGSIGAKYQLNDRFALVAGYLYQGNPVPDSTFDPSIPDADAHLITIGTDFRYGALRAGLSYGFQKMVSRTKNNTVDDNPNDGFFNPLTAANGEYNTDIHLIGLTLSYMF

SEQ ID NO: 8858 - protein, 620 aa, Shewanella woodyi
MKIFLMLIMLTLYSFASENIEKLLQEYRKESELSKVTKKESAGLIDIFTRDDLEKMQVRTLLDVLKIVRLLHLTRTPNNVHLFSFPSAGYLPLSAIRLYINDHDMTSSSFGSALLIWGDMPIEYIDHIEFYRGSSSIEFGNETGLFIIKLYTKRPEREEGGKVRLLLDNKNSYETDLYYAHTTDTKLSWFAYVNSENINHKDYFHLNHRISSDKDGYNMYTNIFYNDYRIEIGNYKKKSDSFLGHSRNYTPDGGGLEAQHQYIHITTSNKYDYKFQVAYDNLYYDRTYIDPSGVPAGNLGLVTYYKTHFKDDIFSLVAERFFEYGKNSILLGGFYKYKKFTMDGRFDTTTTSYGNGLKLFSLYCEDRYKIDEYKTVVASFKQDFYRYDKVVPNRNRSVVRIGYLQNFNNGKFKIFLIDTYQPIDFYKLYSPNKIPFKANSKLKPPEIFALASSLQYKLDDQHSFRFQLGFNKAKNPILYTPSGYQNYSGNVIRKTTFSIEYDYHQDLFNRYKLAIFRGYNNQNIEYSPKYGAFFQAFNTYGKLDLYNELIYKSSYEYAGIKVDASIDYTAAIKYHITKDLSLGIRGENIFGRGFKQAYRNFPYAIPVTDRKFWINVEYLF

SEQ ID NO: 8859 - protein, 386 aa, Shewanella woodyi
MFPHKLSLVLIACMPLSSYAFNGVYNTGSGQVSSGMGGVSLAQGMDRTSIQDNPANLSFQNSGADAQLSLLNIRAKATLLNQPEGFHSDKVIPIPSLALVQHYNDRLSWGLSLTGAGAAVDYDEPAIHGFPSDKAKDNLAIVKASPTVSYKVLPNLSLGASLDLGIQQFRAKGVLAGVDGQGTPIFLESHGNQWAYGVGASIGSTWEFQPNWWLGASYSTEMKFSKLDDYKNDLLARSEGRINLPERYGIGIKHKINQKLTLAADIVRFNWQDADGLGKKGSFNWQNQTVYRAGVDYQLTPHDHLRFGYSHADSVVDAQDTLVNFYANAVANQSWTIGYGHDLGFATLNLSYEYAVNKTLNGTGNSTGTNLSNQNHVITLGISKDF

SEQ ID NO: 8860 - protein, 1067 aa, Shewanella woodyi
MKFNSKVSRISAAIALAVGMSTSVMAQETSSSMRGVITGPQGNPVANTKVIVTHEPTGTVNEFVTSADGTFTAKGLRVGGPYTVVIDSDKYQDAELDNLYLALGDTLRVTSQLKNNDMERISVSGSVIMTESGGASSNFGEETIDNMPSLSRDLKDIARINPLVSIRGNGEMSIAGGNPRSNSITVDGIGQNDDFGLNYGGYPTEQPPVSLSSIEQISVDVAPFSSKKGDFSGGTINAVTKSGTNEFEGEFFYEYSSPDMKGDSKRLNRITGSSGNDQGFREYETVDVEPIQKTSTFGMALSGPIIEDTLFFFTNYEEWNSKLDYQYGFQGSGASNEFYTTRENFEEFLSILENTYGVQDSLPGAPEDKDRKWLTKLSWNVNQDHRLDLTYQWQDNSDIRGHSSGGNTVVLNSRIYDYHTRMSNISARLYSDWSANFITEMGITYKDVVSDSITNADFGAVKVEEFFRGPAYEFGADQYRHANKVENQNLTFNFDATYLLGEHELAFGAEYERLRLYNKFVPESLGAWEFDSFDGFQNREIGNYNGTYDFSYQNAYTGNPEDAAYDAVRYTTALYVEDTFYPTPDLELTAGVRYERLSSDDKPTLNQNFVDTYGFSNQENLDGMDIILPRVSFKYYLNDDVTLRGGVGRFYGGVPNVWYSNPFTKDGITLVSANSDFINDYFANSSDPADFTQVPQAIKDSLEQGAGSTNYTDPNFELPNDWRAQLAADYSFDIPMVGNDFRATTSLLYIRKQDEAVWLNTALEPTGTAADGERIIYDTIYSGNRSDNFDIMMTNAEDHGRSYIFTQSLAKQWDNGLNVTMSYTHQDVEEVSPGSSSQAQSNYQHYVAKSRNQPFSARGDYEIEHSFKVTVGYEKEFFDGYKTNINLFYERRSGRPFSYTMSMYQDGDFGDTRDFYTQSAYLAYIPSGADDPNVDWDNSVSWDELSAVLDRAGIAPGGYIMDRNSGTQPWVTNLDLSIKQQIPGFAEGHRGTLYFTIDNLANLLNSDWGVEKRLGYPQVDLYDFGGLSDDGKYQIERLFNGYAPQNYDEYDIGASSWSVKLGVRYEF

SEQ ID NO: 8861 - protein, 383 aa, Shewanella woodyi
MLSNQASQNARPSSRFVLGAVTVASAALGCGAVHAQSSVTLYGIVDVGIEHINNTSTGGAQTREASGNLSGSRWGLKGVEDLGGGMKAIFQLEDGFNVNDGTTAQSTKGLGPNAATTSRLFGRQAWVGLSYRGQQLTFGRQNSLFYEQAVAFDPMGASSRYSVLSLDYAAAARIDNSAKYTGVFGPLTAQAMYSTRYDTGYGSEVPGAQLTGRFFSGALTFAQGPFAASLSYEQRNSNTVATNTGTERRATAAASYALGPVRGFVGYRYLRASNAFLPANPIRVANGAEASAAGLYWAGAQYTVSPAFVVTATAYYQDVHSTSADPWLAVLCADYLLSKRTDIYATAGFARNKGGSALGVNGYGTVAPGHNQTGVVIGMRQKF

SEQ ID NO: 8862 - protein, 363 aa, Shewanella woodyi
MKIGTMGAALLALSPTLAAAQSVTMYGVIDTGVEYVNKVGAGGDSLVRMPTLTGTVPSRWGLRGTEDLGGGLKSVFVLESGFAPDTGGANQGGRLFGRQALVGLSGKWGQLSLGRQYTMLFWANLDSDILGPNVYGAASLDSYLPNTRADNAVAYKGTFGGLTVGATYSFGRDAINAGPSPAGTNCAGENPASKSACREWSALIRYEHKGWGVTAAYDSLRGGPGAFGGLGNKSLTDDRLSLSGYVLLSRAKLGVGVIRRDNEGSATPRSELWYGGMAYDITPAFTLAGQVYYLKFHDSANKAMLYALRGAYAFSKRTSVYATAGFIDNGGQLAQSVSAGAAGSNPRAGGSQFGAMVGVKHVF

SEQ ID NO: 8863 - protein, 746 aa, Shewanella woodyi
MSISRTHSALLLCTAISLLPLAGPARAQDAASQENGTTTLEKIVVKGKRVKSANAAADTPLASQTTAEDIRKKDIGSIKDLGNTTEPGVDYVDSKPGRPGGLFIRGLGGARVVTLIDNIPVPYFNNFARQGQATTTLSDTSSSFDFSSLSSVDVVRGADSSRIGSGALGGALVLRTLEPEDLIGEGKDWGGVAKTSYDSEDRSVGGSLAVAKKIENTSVLFQGSYKRGNETDNRGTADIYGTRRTKPNPADTYESNLMFKIRQDLEGGHRIGLTAERYSLRNRSDMKTLQGVSVSGSTYRIGDYRGYEDTERDRVSLDYEYEAPSTDGVIDAANLSLYWTRLSKESGAGDRLTNNSLYIREDSMRNSAFGIVGGLESGFELGGVQHTVRFGGNAMTTDFSQELFANTAGVTSSSQSDMPDVSGKSLGLYLDDEIAFGNGFRLTPGLRFDSYDYDPDGSVSSNSGYRTFGLPSGNSGSRFSPKLLATYDVTPELQLFAQWSMAYRAPTINELYLNFSNISSGYAVVGNSALNPETSNGFEIGANYASGDLTGSLTLFHNKYKDFIEQYTTSTTLFPGFGGRGNGSLFTYRNRNNVEISGVEAKVRKELANGFFAHASLAYAYGKDTDTNEFIRTVAPFKSILGVGYAQEVWGTELTGVFSSGMRDDGVASTFDAPGYGVFNLTGWWEPEQTKGLRIQAGVYNLFDRKYWNGVGVRDVNPNSVSTVNQPVDFYTEAGRTFKISLTQKF

SEQ ID NO: 8864 - protein, 824 aa, Shewanella woodyi
MSKQHYLDTTSRLALVVMVAALIVPVGTHAQEVVDDDVPVIEPSPAETSAQVKEMTVVSERDKAGLLEQQPSDLLFGMKKPLLETPRSATFVSEETLSTYGVTTVDDLAAVSPGTFTSSFYGVEGALNVRGLLAETYFHGFKRIENRGTYQTPLGATSRIDILRGPPTANFGPGKVGGLLNLEPKTAKISEEAGYMTDVSGQVTGTLGSYDKKNGSFETGIPLNFGNTAGGVFVYGEIEDSESYYRGIKPEHQLLQTTAQFETMNGWTYGGGAMYYQSEGYVQTPGWNRVTQDLIDNGTYITGTNSGLIDANGNGYIDRGELPPGGLTHAPECFGGCDVPLVYRQLDTGVGTTKLSSRDVYTSPFDFSDTTTLTLYGDLIKAFDDGSELKIQAFYDSLDNERFVSYGFPADYDSYTVEGRVSYNFDVKVPDSPLTAAFNVGVSHRYYDAQKKESFNYGGIALDRRDIANGPTPTDTLGSPFLPGSGYTWDYNNKSTWHDTGLFAMADFDVADKLLVTLTGRYDWYSVDSEDTGSLCFCTPGPQSDTDSAFTYSAMALYKGPYGIRPYITYAETTAIEFGQAGDVSPTTVANGDWLSDGDLVEAGIKLEAFDGVLTGALAAYRQHRTVLDNVGGGVDETEGQGVELELRYLATENLSFTFAGNVQKTKFLGSYDAFYYFTPATFGYNPADYYGAGLVGYSFSGIAAITGDSYYAGEIEDRRIPEKVLSLFGTYTTDQYGWGHAGTTWGVRYVSETAGLASDPVRYPDYFLVQASAYADLKSWRIALNVDNVFDEEYFTPLQDLYGDVAVLPGKGREWRVTATYRF

SEQ ID NO: 8865 - protein, 388 aa, Shewanella woodyi
MNKKVLTTALLASAAAAGTAHAQSSVTLYGIIDAGISYANHSKNAAGGTDKIFKYDDGVAQGSRWGLRGTEDLGGGLKALFVLESGFNSGTGASGQNSTLFGRQAFVGVSKDGIGSLTFGRQYSFSTDYLGGAYSTGGNTVAGNYAYHINDVDQLTSSRINNSVKFSSANFAGFTFGGMYGFSNLAGQFAGAPGTSGAYRAYSFGANYAMGPLGIGAAYTDIRFPSAGSQPFSVAISNVATSAGTAVVRDLRSFGVGGRYVVGPATMWALWTNTHFEPTTGASTTYNNFEGGAKYAITPAFTAGLGYTYSRLTGATTGHFNQVDASVDYALSKRTDVYALGIFQDASGKTAAGAPIQAQIGSSTSYFSTSGSGSQNQLAFRVGMRHKF

SEQ ID NO: 8866 - protein, 386 aa, Shewanella woodyi
MKKSLLAAALFGAFAMSAHAQSSVTLYGLIDTGLVYTNNQFGHSNWQMVSSSTQNTVFGLKGSEDLGGGLHAVFKLEQGFLLNNGAQAFSGDGFGSQAWVGLQSDPYGTLTFGRQFDVMNDLVGPLTAEFNTSGGSMAAHPFENDNLAANSVVINNSVKYASPTYRGVTFETMYSFSNKAGDFGNNRSYGFGVSYAQGPVNLAAGYLQLNNAGNGAGAVTSGDASANFIAQRQRIWSLGGNYTFGPATVGLVWSHAQIDNASGVFSFGTGSYLGSGDTSAGSLGGSLRLDNYEVNAKYALTPALSVSGAYTYTHGAYNGSSPGWNTAMLQTDYSISKRTDFYLEGVYQNVHGAPADSVLSHAMINTLSPSATNTQVAVTVGMRHAF

SEQ ID NO: 8867 - protein, 381 aa, Shewanella woodyi
MNKRIIPALMASALATSAMAQSSVTLYGVIDEGFDYTNNVSGSKVYELQSGFAQGSRWGLKGTEDLGGGLRAVFQLENGFNLNNGRLGQGGLMFGRQAYVGLTSDSFGTVTLGRQYDSVVDYLGPVTANGNWAGYLFSHPYDSDNTDNTFRVNNTVKYTSPLFGGLQFGGTYSFSNDSGFANNRQYSAGGTYTVGGLVLAAAYLQANSPSATAGGAINNGGDENFVANALRVFGAGASYTFGLANVGFAYTNSYVRRPVSSGYVGAITPASGTLSSLRFQNFEVNGKYQFTPAFYVGAMYVYTRTDFNSSGGQLNPIYQSVGLMGDYLLSKRTDVYVQGVYQHVGGDRTGTVLDVAYIPGADGVSSGGNQVVVRVALRHKF

SEQ ID NO: 8868 - protein, 854 aa, Shewanella woodyi
MRVTKTKLSLAVLSALANTAYAEDLETSKINVYSPAPLPSIGLDQSIVPGSITVIQPQDVQQQSGVSLADYLNNNVQGISFNEVGGNPWQPEVFYRGYSAGSIAGNPQGLSIYVDGVRENQPFSDVVLWDTIPTWALSGAQVVGGSNPIYGLNTLGGAISMQTKNGKLFNKGVISATAGSWDRTAGLIEMGGIIDGTNIDYYFGYNHTSENGWRDHSPSHLNQAFGKIGMDLETGGRVELSYTGASNNLIGNGLAPKYLLGADNSGVNTVPDATENRYNKFNLAYTDLISDTVMLSANAYYIQSNRYTLNGDAEIEFDGDEFTNSGYSSINGRYMVNQGDDIDEIEAETRTTKTKQDKYGINAQLTFTDDLFGYKNHLVTGVNFETSLIGFVQNEYEGSSFIGNSRLIDTTTGEYENNSDLQGRTKTAGIYAVDTLSLNDQWHVTGGLRYNYTEIDNKDRRADQSAGSLTEKASYARINPTIGVTYKPTENYQTYASYSESNRAPTSIELGCSNPAIACSLPTQMADDPPLDDIVSKTYEAGASGRLTGDLKWNAAIYHAMNHDDIHFINNNAQNGLGYFDNVGRTRRDGIDVGVSGSGLFGMDLFGQGNKFSWSGSYGYVNATYDSDLRLVSDANTSRTVTTNSYNSYDDDALVDDDTDFASEVAVALYDLYDGTGLETDYNTANGVGAYDALNIETDADDADDWAEFVEDNIGIETSAIDVKRGDQLANIPQHRLKLRMNYNPAPNVRMGLTALGYGKSYMMGNENQKHQGDGENPGYFLLNADMSWSPAKNWMVSLKAINLLDKNYYNGGRLLMNGFTGVGNTARSEVFRGVGVIPGSPQAAWITVGYSFK

SEQ ID NO: 8869 - protein, 650 aa, Shewanella woodyi
MKKQQKALKVSTLALAMSMAYQVQADEIERDPILDVTDVIVVHGERASVTEAATTHWSVDAEEIKASGAQSLDQVLENVPGIYVRVGGDSTPRVDIRGLKTRHITFLINGVPASSTEDGQFDPSVIPTNQIARVDVSVGPTSVLYGPGGSAGVINIITKQGDESASLSGKVEAAADNTLNADISAAGSGDNWQGIMSVTHQETDGTPMPDDFEDTRNQIGDVRFNSDRKLTNYYAQGSYFINDSTKLMANYTQRDGEWGKSPTVDRKKTPSRIEDFNEQSMQLGAAHEINEKYVVRGFVYYNQTDMVENFYNHRLNNLNSIVESTSKVSGTNIQFISEFDYGAVLTTSAIVEKQDWSSHTTSLRNVVKGNGSGGGTGGGQGGSGDIDESLMVYTGAAEYQYQDDGKYGYSLGAAVHNYDLDVNSETDFSAQASAFYQVTDSSRIHTGLARKVRYPSISDLYAPNSGNVNLKAEVANQFELGLQQSLPFDSQLDISSYITDANDYIAKDDNNQEQNIGDYRFMGVDLQMTNQYFDSLGLTFAYSYIDTEDRATNERLQYRPTHNLRLQASYDFSFGLTTRLNAERVIDQVNGKGVQLDNYTLVDLSLSQNIWHDNLELYVRATNLFDELYYQSDFMPQAGRQVFVGINWQL

SEQ ID NO: 8870 - protein, 500 aa, Shewanella woodyi
MMKYFLVPFMLLSFSIMAQDITDALRFSTQEINGTARYTAMGGAFGALGGDISAININPASSAVFLTNKFSGSVDFTSINNDSFYGNNSILSSTSETDFDLNQIGAVFVFETNNENAVFDKLTLGFSYNRTNTFDDELRFQGNNSESISDYFLNRAQGVPLDLLTPRSGESVAELYQFLGEDEGFGAQQAFLGYEAFLINAEDPLDSQNTSYLSNVFGNNFSQNYFEQTRGSSGKYTLNGGGQIGDRIHLGVNFNLHFLDYRRLTRLDEFNSELTGINDIFFDNELRTRGSGISLQVGGIFKVTEGWRLGFTYDTPTWMNISDELSQRLETVSASQDVAIVDPNVINIYPDYNFKTPGRVSLSTAYVFGVSGLLSFDYSYKDFSAMEFTSDGFDIQNQDITNLITGAATYNFGGEYRILNTSLRAGYFLQESPYNNKALLDDTVGYSFGLGFSLGNTTLDLSYQRMEQDRQNILYQTDFSQEAQVQSVFNNYMLTLTFDL

SEQ ID NO: 8871 - protein, 869 aa, Shewanella woodyi
MYKNSLLANSVRFALIGGAAATAFAVPTVFAADEASADKVERIEVTGSRIKRSDLEGASPVTTITAEDMKVEGNFTVADALRNSNLNSFGSFSERSGSSAQSQATINLRGAGSDRTLVLIDGKRFPGSPTLGGSAANLNAIPMAAVERIEILTDGASSTYGSDAIAGVVNIIMKKNFQGLEFSVGAGSRDRDDGMTSKEFSVIAGYEMDKGNITFAWDHQDREGIADADREFTAPWTNDFDGNGIIDAYTETDGWSYYGANVRHPDGTFQPSTNCDALIAQYGEDTFRKMSGEQQFGPGSDLCMYAYGNVSYNKASIDRNTVYVDANYEVAEDVEWFGRVMFTQNTSFGRYAPPAAKWNNMAADHPENPWDVEATGYYRWVGIGTRDGTVDDYNQDYLTGLRGTVSAWNDAEWEFYYHYNKADNKSMGEYYLSYSGLAYNEANGIDLGSEAGINNMKATTLTQGTAEFHQYNAGIGFDAFELPGGQAAHYFGMEYFEQDFSEVYDAQSEAGLIGGSAGNSAGGDRQVWAAFYEVALPVIDSVEVNLAVRYDDYSDFGGNTAPKASVRWQALDNIVVRASYSEAFRAPALDQLYAATTFSAEDGTDYPGCTSNGVAEADCKEQQYDTWISANGDLGPETSEYINLGVAWDIVDNFGIKVDYFNLNIDNVISQRSITNVMEGIADGTLATTETFYVDRAPGTGGGLGPVLEVGTGYGNTDKLEISGVDVGLNANFETEVGDFAINWNNSFVLEYIEEVTGGQAAEDTAGWAGQPDYKSVFTTTYSMGDHRLSWNMNYTSSTYETKDEGELDSWLIHNISYTYDVGAYGAIMFAVNNLTDEDPVLTSDGKFEDTDLYNNYGREYTARYTLKF

SEQ ID NO: 8872 - protein, 740 aa, Shewanella woodyi
MYKNSFIANSVRFALISGAAATAMTAPTAFAADESVEVERIEVTGSRIKRSDLEGASPVTTITAADMKLEGNFTVADALRNSNLNSFGSFSERSGSSAQSQATINLRGAGSERTLVLIDGKRFPGSPTLGGASANLNAIPMAAVERIEILTDGGSSTYGSDAIAGVVNIIMKKNFQGLEFSVGGGSRDRDGGLTSKEFSVIGGYEMDKGNITFAFDHQDREGIADADRAYTAPWQRDFDGDGVINAYTETDGWSYYGANVRHPDTGVFQPSPLCDDLIAQYGNDVFARMSGEQQFGAGSELCMYAYGNVSYNKASVERNTVYVDANYEVAEDVEWFGRVMFTQNNSFGRYAPPAAKWNNMAADNPNNPFDVEATGYYRWVGIGTRDGNVDDYNQDFLTGLRGTISAWNDASWEFYYHYNKADNKSIGEYYLSYSGLAYNEANGIDLGSEAGINNMKATTLTQGRAEFQQYNAGIGFDAFELPGGEAAHYFGMEYFEQDFSETYDAQSEAGLVGGSAGNSAAGDRQVWAAFYEVALPVIENVEINLAARYDDYSDFGGNVSPKASVRWQALDNVVVRASYSEAFRAPALDQLYAATTYSAATGTDYPYCESNGVAEADCKAQQYDTWISANKDLGPETSEYVNIGVAWDIIDNFGIKVDYFNLNIDNVISQRSITNVMEGINSGTLAASDTFYVDRVASTGGKLGPALEVGTGYGNTDQLEITGIDVALNGNVETSFGDFS

SEQ ID NO: 8873 - protein, 403 aa, Shewanella woodyi
MKKTLVASALAAVIFVPTASAIEIYKDDKNAVEIGGYVDARIINTQGATEVVNGASRINFGFTRQMSDGWKAYTKLEWGVNPFGNTDIVYNSDSTLESQSGDFLNNRLGYVGLAHDTYGSITIGKQWGAWYDVVYNTNYGFVWDGNASGTYTYNKADGAVNGTGRGDKTVQYRNVFGDFSFAVQAQLKQDSFDINETATGASTLFPSTAKVAGVNNSNAVTTVEYNNTYGGSATYNVTENLVVTAGFNFGEFEATTSAGKRLTETDSIYGLGASWGNWGGEGVYAAFNVNKQEFHDTDNLNRMIQDAWGLESIASYKFDNGIRTFVSYNILEAGDEYEAAYNGDVFKRQFAVAGVHYVWDSNTVLYLEGRKDFSDFTSADKVQQAAMEVSEDDGIAIGIRYTL

SEQ ID NO: 8874 - protein, 1128 aa, Shewanella woodyi
MNEKQKRYVVKFQSIKKAMLAKVILFIALFFTGLINAENIDFDKKVTLKVENESLKNVFQKIENQANVHFMYESNQVNTNQKISLKLTNVSLEQALDKICGNFSLKYEIVSNNIVIKKTQKVVSADDQNKIIVSGTVYGGDDNMPLPGVGIKDKGSNAAGTTDFDGTFKLEINASEANLVFSYVGYVTQEVKVSQTSTITVKLPADMKQLQEVVVMGYGSVKKNEVLGAVGSVSMKETSSRTYNSAAELLQGTVAGVTVINDGGDPTASPTINIRGIGSLNAETPLIVLDGIIYSGSLNTINPNDIASISVLKDAASAAIYGARASGGVILITSKKGISDKINVDVNFQGGFQNVAKKLEVLNAAEYADAMNTARDNAGLPRIPAFDPAFEPTARTTKTNWMDEIFRTGQINDLSISVNGRTEKSNFFLSGSYRKNEGILLNTYGERYTVRANSSFKLAPNFTIGENLSYSLTDGQTANTSSSYTGAIQAAILYPPNATIYREDGSGQFGGVPEKYIGSYGDVINPVAYLKRLDNKNPISTILINPYAEWEIVPGLKVKSNWGYTRIQDNATDFTVKVTEPGKIFDFNRLTLKNLTVTDLLSEQTISYEKSFGKHNLKALAGYTYQETKKDFYTVEGTGFDNEDPSQRYLLNAKLIQQTAAGRSDEIISSYVGRINYDFNQKYLISGIVRRDGTSKLLENNRWKVYPSVSAGWLISEEEFMKGLNPIVSNLKLRASWGQIGNLGNLGPYQFSVPLVQTQALIGAVPSINYGYAESELSNPNLKWESSEQTNIGLDFTMLNNTLVGSVDAYVKKNKDMLVRDQLPGVSGTPQGRIVNSGDVENRGIEVSLTYQKTRGEFKYDVTANAGFLSNKIVSIKDDLNSLEPLGLSRVRSLPLANIYQVGSPVGAFYGYETDGLFQSNEEAKAYVNKDGVAYQPNAVAGDIKFKDENGDGVINNSDRKVLGSPFPKTTYSLNANFRYKGFDMNIFFSGAAGNSVFNAVKHTGLNASFPGYNLLADSKDAWSPTNRDTNVPVLSSTDNNNNFGRISDLYIEDASFLRLKNLSLGYTIKESWLNGKAKLRFFISGQNLFTITKYSGMDPEVGLKNFGMDLGRYPLSRIYMTGVNATF

SEQ ID NO: 8875 - protein, 791 aa, Shewanella woodyi
MKTSIWLVSSALCSILAAGPVLAQDKATAATGGQTLDEVVVTAERFGSGLARATFTLGAEDIQERPLGAEITQALVKVPGVQVSTGDARGGSFSFEIYMRGLSDEQIGLTLDGVPTGDSRFNGGSPPARFIESSNIGKITVSQSAGDIGAPSRFALGGFIDFATDAPRHDLGATVEAGVGSFDFRRIYGRVDSGEIAPGLSGYLTYSHQENDIWAGRESRGSERGHYELKLVKDFDNGSFLKARVSYNDQTDNDFNIVTKGEFKAAPRSDRALDAITGLPAKDIDFGGALGGWRKDWLTYLNGHFKLNDALSLDVNPYYQTLNGESFRYQDRQRILTGGDPRAVTGYNANGGAIRPALSTLRNSNVVGGPADMRVTPRERDRYGVTGEIKASNVFGSGHSLRVGGWWEGGESTEKRNFFPIIDSSRSIAYDRSKLNYVEYERTASVETTMLYAQDEFRALDDKLKVDLGLTWYDVKYDAKSPLEYKANVKFSQHSEVNPKLGATYQLAPAWELFGGYAKNFAGIPEDAFLGSTAVISPKDLDPVETENLDLGLRYVKPNMAFSIQAYDVDLKNNVGIVPRDPTAALDPDEVVRGNVATKAVNIAGIKTKGVELTGYYDFGAFDLYGAYSRQDAKHDNPAVGSAARKALAAVAVIGGAGVRDIPKNSFYGQVGWKPLEGLKLDANVRYVGDRVGGHIVAPTTFQEIGVEMIDGYALVGLTATYDLKRAGVPDLRFQLNVDNLFDEEYIGAVSGSTATQPEFGYTVATPNARTLDRYFIGAPRTYTLSVRTRF

SEQ ID NO: 8876 - protein, 175 aa, Shewanella woodyi
MKYFWIILPIWFVSKLLSNKNRGNGSTYSRTYRRTDDDFFNSYRSNGSSGSTNRTYGGTFNSREEAEEFFRTFFGGGFGQGTTGTSGSTYGGYSSQNSGSSYQRNTSSTYTTDKSKYYSILGVSRGASQDEIKKAYRKLAKEHHPDRFVNSSDSEKKYHENKMKEINDAYENLTK

SEQ ID NO: 8877 - protein, 368 aa, Shewanella woodyi
MMKKLLLAATVATLSLSAAHAAPTLYGKINLTLDQVDNSDFAGNNVTALNSNASRIGIKGEEKLTDNISVLYLAEWAISTDGSGSDTDLSARNRYLGLKFKDIGSLKAGKYDSYFKSAAGNNQDIFNDHTILDMTSVLHGEERLNNVIGFETDKNLIIPGLQFNIMSQQGEDTKTDNTTLGQEGKRNGFGDGISTSLSYDNKDYGLSAAIAGNFGVAGKYNAYSLSGIYSDAIRVTGSFDFSKYGVDGLVFGALWQNAKPTDDTVLTVSGTGTSAVTTTFKGLEEDAFSLTAAYVIPSTPWKIKGEYVESNTSVDSRSDRKISQYGLGVDYNLNKQARLYGVLAQQKRDWLASDDKKTVVGLGMEYNF

SEQ ID NO: 8878 - protein, 885 aa, Shewanella woodyi
MNTLRSSASLGVLAAAIASPAMAQDQQAQAPAQPQQQARQGGVGTIVVTATKRSEDLQDVAISVNAIGEEALDELGISTFDDYLVQLPNVTAGGSGPGQSTIYVRGLASTTPNLTTAGVAGLAPNVSLYLDEQPLAQPGRNLDVYAADLERIEVLAGPQGTLFGASSQAGVVRLITNKPSLAGFDAGFDLETSFTKGGETSYKGEAMVNVPVTNSLALRGVLYLDDRGGYIDNVQGTRTLRESARFRPAGTIRDNGVPVNALRGGFQAGANLGNVTFLPTDNAGLVEEDFNDTQYSGFRVSALYEFTPDWRLTVSHGRQSIESDGVFFADPALDLDDLEIQRFEEDRIEDDYSNTSWTVEGRLAMLDVVYTGAYTDRETEQRVDYTDYLFVGQYLPYYICDGSVTYPGAADPSGTCQPPNLYVASVTDTTVFTQELRFNTPQENRWRVTAGGFYSDLELKERNDFAYPGNVIAQPFGPFKPNFPQDGFTTDPGPFPADTIFRNDIRRTDKQWGIFGELSFDIVPDVLTITGGARYYDIEVDFEGSANGSFCNSFSATDQDAFGTDLNDLYDGDGQFTFIGSCDPALRQTFTQGQSIADIQAAGLSLGQATQVFNALQAPDVAKATGTIFKGTLTFTPNEDLLFYATYSEGFRPGLLNRPGGATNGAGFTVPFELETDEVKNYEIGWKMDLIDGQLRLNGSAFYVDISRLQTTIFDPSITNLFFSDNAADAEIKGIEGEFTIAPYSVPGLTVAGAFSILDTEITDVLTPTTDVVVGDELAYAPSFQGNLRVRYEWEAGDLRFHLQPQLVHSGSKFTDIITINRLELDSYTTFAMSAGVAKDNWSVEVFGENLSDTRAQIAGNFINDRARITTNRPLTAGIRFSWDY

SEQ ID NO: 8879 - protein, 416 aa, Shewanella woodyi
MNNNKKCAFFLLPILAGDSVPALAEGFLEDSRASLALRNFYMNRDFRDGVGRAKSEEWAQGFLFDYRSGYTEGTLGVGLDLLGKLGVRLDSGAGRSGTGLLPLRDDGSAAGDYARLDATAKLRLSRSELKVGGLVPKLPTIQPNYGRLFPQVFQGALLTSGELSGLSLNLGRLTEVSQRNEAGTSDLALFNRNRRFAGAAQADRFDLAGLDYRIAPDWTGSYHYGELEQVYAQHFLGLKGRIGVAADSLESDLRLALSRDTGGARGGRIDNRSFSGSLTYRLRNGQAFGLGYQRMSGDHGFPYLEGTDPYLVNFGQYNDFAEAGESSWQLRYDCDFAPLGVPGLSLMTRYFSGHGAKPKGADGSREWERDSDLRYVLQGGPLKGLGLVWRNATYRSAFSRDIDENRLYLTYELPLF

SEQ ID NO: 8880 - protein, 183 aa, Shewanella woodyi
MKLNSLLTAGILLAAATTPAFAAKDLGFYLGGQVNNTAIEDNIGTFDESAIGFGVYGGYNFNDSFGIEASIFATDSFVDEMDFRMAAMTISPVVRHAFTDSVTAYLKAGLVVNRTYSDDDDVDESYQGTGWLFGAGVDVTLTQSLALRVFYEISETAPESDERDDDFADISLVQYGVGLHYRF

SEQ ID NO: 8881 - protein, 1100 aa, Shewanella woodyi
MKKQSCFVSLLMLLLLFPLGAFAQQQMIKGQVVDDSGESIIGATIMVKGAKEGTLTDFDGNFSLKGKVGTTLSISYVGYSPLEVKVKKLEGNRFVLREDAKVLDEVVVVGMDKQKRSTITAAVATVSSEAIASRPVTDLTSALQGNVAGLNFSTDAVADGVGGEMGAEIKFNIRGTGSINKGEPYVLIDGVEQSLQNVNPNDIETISILKDASAAAVYGARAAYGVIIVTTKSGGKDKTRVSYNGTVGFSSPINMPKMMNSLEFAHYINERNDNDGKKHEISDALIEKMEGFMKNPYSTEFPGIEPNQNKTNWASSKDAVYANTDWFDYYFKDASIRHSHNLSISGGSDKVSYYVGLGYIYQEGLMDKVDDNLSKYNVNTKFQINANKWLKFNFNNNLTLNILKRPMANQTIFYGTIGQTIPNAPTHYPIESKYNDASEFRYLKESHYVENRISDAMSFSATITPLQGWDIVGEMKVRFDVEDNSFKRGYPTYEKPDGELSIDKSTKQGYVYPGMNWKNSRWGSYTRGNAFDYYLSPNILSSYIFGWGDHTFRAMAGFQMELQENSDGYTYKDGLLTSDIFSFANANGNLSGNEDRTHWATMGMYAKLNWNYQEVYFLEFSGRYDGSSRFAPGHRWGFFPSFSAGYDMARTDYFKGWNLPFSQLKLRVSYGRLGNQNGAGLYDYLGFMNLVPDSPDSWLLPGVSDTPSKGVLARTPKMISPYITWEKVDNANLGIDLMLFRNRLSVTADIYQRTTRDMIGPAEAIPSISGINTEDRSKINNATLRNRGWELSVNWQDRLKCGFSYGIGFNISDYKAVVTKYNNPEGLLYNNHTGLARNKGYYEGMDIGEIWGFQADDLFRTNREVDEYLKTVDLSFFKPGDKWQRGDVKYIDSNHDGKVDSGKGTLADHGDLKVIGNATPKYSFGFNLNAGYKGFEVSALFQGVAKRQFPISGAAYFFGGNSYFKEHLDHFNAQNPEGYLPRLTDDKQTLAANTGYNTTRYLLNAAYMRLKNLTVSYSFKPQLVQHIGLSNLRVYVTCDNLFTVSKLPKQFDPETLNQVNGWVGGSNDTAPALTSPLNANGNGRVYPMNRNFVFGIDVTF

SEQ ID NO: 8882 - protein, 710 aa, Shewanella woodyi
MSVSFNTLAVVCPPEAPAGSSCDAFIANDGKAVSLANDLYITNGNALTYSGNTPFVAQYLRKNIIATGTDAHAIYADANTVFNNNINLERGISIISENGTAIKIDGSFSHTAAAPNFGIAVKDGSIVRGNGAAIDFRDAQTAIRMDINGSIYGDILGNGVTGNKINFAYQGAAANALFDGYTISGVEKLENWGNLSIIAKDRTITWSGDFTNKNNASLDFKIGDEVDLASPILLVEGKTVFNTGSKALFSYVGSNINDIVNKDIILIQSNGGMSGPIDVAQNEITVVSNLSPLLAQTDSWVTTTDPIVNGGISGNQLVVRYGVNYEGTDNFLDLALQGGANQYQLNAANYIVSYALSQYNKTQSEASGELLALLTSAGNSSAGIASIADQITPNAEGGEVRAALRMVDKMRDQIDNRSLYLRNQSAATPWNFWAQTLYAHSRQSSGTYTPGYQTNGYGINVGVDRRFNDESLFGVSLGYQNANINIHSYGNEKDVDSYELMAYTGWFDDRYFFNGNVNMGYNSNSSTRNIGENTGYQGNTKATADYNSLQMGYQVKAGMTFDLDVVKLQPSVAYNYQWLRVDDYAEFGSPASLEVDRQSYSVKHLGAGLTAFNTYELGMGLLTPSLTLMGYRDLNDTEIIVKKAGLTTDQGKGKGRFIVEGDSVGNNIFEAKMNSNLQLKNNLSLDGNINYYKRGDYNEGYIGLSVSKHF

SEQ ID NO: 8883 - protein, 394 aa, Shewanella woodyi
MKTLTCMRMRAVALACLPFAGAVLSTNALAQSSVTLYGVVDNAFSYVSNQRGHSNFYMSQGNLQASKFGLLGAEELGGGTKAIFRLESGFNSLTGAQSSAGNIFNRQAYVGLSNDRYGTVTLGRQYTPYFNMVGALGPTGVLTGATGAHPGDLDALDTTLRFNNSITYASPTIAGFSFGAQYGLGGVPGSVTNGSNFSAALRYDYQSFSVAAGYVKLKDITTSQSLGSFAINSPVNNGYASASSTQMVAAAARYNFNDLMVGVNYSNVQYAPGSHSLFASEAVFNTYGAIATYRFTPSVIAGIGYSYTRASKANGIDDPAQYHQISLEQTYSLSKRTTFYALEAYQLARGRSLIASGSGTRIADAVAVVGDSQNTTPSSGPSQFVGMVGIRHAF

SEQ ID NO: 8884 - protein, 820 aa, Shewanella woodyi
MQQFRFSLLAVACASALFSGFISANEQNKSAEAVQEKKLKNKDVELITVYGRQNQVVMNSGLATKSNMSLMETPAAVVIVDEELINAQGVNNLQDLVRNISGVTQAGNNYGIGDNIVIRGLGANYTYDGMYGGAGLGNTFNPTRSLTNVESVEVLKGPATGLYGMGSAGGVINLIEKKPEFISSHEITAELGQWDTFALSIDSTGGLTDKLAYRIVAKSARSDGYRDIGTDRDEIYSSLKYVFDERQDLMLSASYIKDAIAVDSVGHPIRIYNAESVGGKTAGEVSWQDLINDPEGKGIQLSDAQRQQLAGSLADSDGLTPYEFGHNGIISPMAKDNEGEELRFKLTHNYFFNDNLFLNQQLQYRDYTSGFARQTGAYNYVYWNRGGTINANPRAPLVEDDVLYPFAARRQEYRKVEADETSLQYFADLRYDFEFAGIDNELLLNANYEDRDIRFKQHSIYDADKVLTNKAGDVTYQGTLPYIYDIRNPNWAEGSFEDHDPLMTSNYNKKVSAWGVGVQHVGYFGYGFSTRVGVAFNEIKQSYEHFGVDARYRASAAAPTSEADTNDDGITYNLGVTYMPTDDLSFFINHSKGRTAYSMLGGVKGDGSDRLDSESMSDDLGMRIKAFDDQMLTSIVFFKSSRTNLQYSNPEYDDGVSTPNVPKSFFDGKEETTGVELDMNAHLNERWMININGVYQDARDKKDPNRSSYDTRQKGVPYVTASTWVTYSADIFSLASPIDLSLGGKYVDDRSTNTSSFGIPDGYVQSYTVVDSAVSYQAESWKLQLNINNLFDEVYYNKAMFLGGMPGEERNAKLTFSYQI

SEQ ID NO: 8885 - protein, 315 aa, Shewanella woodyi
MKKILMLGGSLTVLALPQSAWATGLELSASPLTPTPDVSLPASPVNPPDLLAQTPTAPVSDIASLQAGSNPVKPAPATNVNSVSNLLLEAERGSAPQVTSVSQLSDVRPTDWAFQALQSLVEKYGCIAGYPDGTFRGNRAATRFELAAALNACLDVISDRFATKEDLATVRKLQEELAAELATLRGRVDGLEARTAKLEAQQFSTTTKLSGEAIFQATQYASGDRPVPAGFPQGFNGDVGDNLFVNGRSTLNLLTSFSGKDLLITSLQAGNYPTNTTGLPAGFPGTLAPQVTQVGSNNTFSLYTLQYRFPVLNDK

SEQ ID NO: 8886 - protein, 744 aa, Shewanella woodyi
MSSHRSRHLSSRTSTQSACLPSPKPLAAALHQAMLCLAVGSGGMSINAIAQTSTDKAPETTLPAVTVSAVAASDSTDLPAAYAGGQTARGGRLGMLGNRGSLDTPFSTTSYTAQRIEDQQAVTLADVLNADPSIRFTGQTGGVTDSFMIRGFPINEGNLSEVAFDGVYGVSPNYHLFPEYMERVEVLKGPAAMLYGMSPNSGVGGVVNLVPKRAGATDLTRFTLDYASDAQVGGAVDLSRRWGNDKEWGVRFNGLHRQGPTPLDDQKSRSEVAAVSLDYHGDRLRASLDLIEQYQWIDAPTRPFLVAPGIEVPAAPDGRRNVTQPWGWWKSNDVSTLLRVEYDVADNVTVYADAGGTRSDVSRLSDQTPTILNAAGDTSAAVQNWRFQINRMSFDTGVRAKFDTGPVKHALALQGNLYSDRIANANVAGTPVRSNIYHPVVSPEQSIAPPSFVPKVSDSTLSGVAVVDTVSTMDDRVALTLGLRYQQVESNNYNTATGAKSSSYDENAVTPLAGIVFRPWRNVSFYANYVEGLSKGDIAPATASNAGQVFAPYKTKQQEVGVKVDAGSIMATLAAFRMTKPSGQLFGTVYAVDSEQRNQGLELTVSGEVVRRVRLLGGITWLDGKLTKTNSTATQGNRPVGVPDFMANLGAEWDLPWLQGLTLTGALNYTGRTYVNQANTQSVPSWTTVDVGARYRTKVSGKTTTFRATVINAFDKHYWSGVASYSTISQGAPRTFLGSVTVDF

SEQ ID NO: 8887 - protein, 398 aa, Shewanella woodyi
MNRHDSVRAACCAMLVLAGTGAHAQSNVTLYGVIDAGIRYETHGVSYGADGSPVSTGRKISMADGGGLTESYWGLKGQEDLGGGLSAQFNVESHFGPNSGAIVPAGSPNFFQVAYVGLTSTSLGQLALGRQYNVPFEMVSLTYGSNLWAGPQDPYFNLFKPEQTMLAGARTSNMIQYGAQLGSLYLLAQYAPGGHAGGGVLGSQAGAAIAYAPDKGPFTVGASFMRTWDDVTHAKFDIYGGGGSVTLGNATVNAGYIENARDNDFTSFENGPFSSTDLAALGIISPAQVADPSTPGGFRRRKMALAGLTYRFTSAFTAAVNAWWTTQSGYTPDFDGRARQFQVIAGYSLSKRSMLYAEVDYAIYRGGLIGAQLVGVNGQSPSTSTTQLGATVGLRHYF

SEQ ID NO: 8888 - protein, 348 aa, Shewanella woodyi
MKFNRILAAALPVISLAASAQSSITLFGIVDVNGRYVKNSDLPSNMTMNNSGLSSGRFGFRGTEDLGGGLRAEFWLESDLYADTGTTNANGKFFQRRSTVSLAGGFGELRLGRDFTPAAQNPTKFDPFNVIGLANSNIISRLPGTFSNYYRSDNAIQYFTPKWSGFQAEVMYALDEDPVSSAGRHFGSRLTYDSGPLNLALTYGSTDVNAAGTKLKQYGAGASYDFGFARLMGYFQREDLPYGTYGTRIAGSEDRWQVGLTVPVGANYIRASYVRTDSRRGPVAFNGSDANRYAIGYVHNLSRRTALYGTLARVTNKGGANFSLNGGTTGLAAGGSSTGAELGMRHSF

SEQ ID NO: 8889 - protein, 913 aa, Shewanella woodyi
MMMNEASNLILGPNGVAAGNFAVAGEVGSYVGLLNINFSNTNSNVSIETDGFTSDVTFISNGGVNGAITLNAKGITLNGNITNLKAIDLNSNNLTFGGNNIQLLANGSAITFRANEQLTLTSASDIEINSNIAVTNDQQGSIDASGLASGQGLVIKGDIGNYSTSVRLGQFNIGSSATDFNAGNAAIGNLIFGNDGIALFAHNNYLITKTTNASGQGTIIFRPVVADNTNLVAGTNLGSADNPLAEINFAAPAGTNTDTILNVGQGVNLYATEITTAGVNTGSFNFNGGRTSIVSGTVGTAANKFNNITLTNNTTVKFTDDVISNGATTIGGNSTLQIANDYITDSIQGNAAGGTGTLQFVNTKGILVTLKGNPNPDNALAALQVSGSADVAIDGSVNINGEINLGANVLGFTDGISTWGNDTTISTTLTSDEVMGNIVISGAAEVKIAGLKTIKVQDNASIDFIGTKTYTLIQGDISADNGIDPNVVGTNRYVIYGLSGNTEALVTRTIDINNIENILNNDISGNGNPVIRHNLVTFLNPNNTGNAEQAYNNILLAQNTNDAATSFAATLTDTSTSVNNININVAKEEQGLIGYRLDELRYLCNPESDKMASSEGGVAAGDEPIDNVAYGVWFKPLYVDTHQSEKGGVAGYKAKTVGTVIGLDTLANDNLMIGAAIGLAKTDVKHQNYKRGDKTTIDSLSFSLYGAQQLVANFFVHGNAILSVNQVKNRSQRYVFDKNGNRSTQIASANYSNMTFGGNFMVGYDASLMDGLLVTPMAGLSYLKSSDESYKESGTTFANRQVYSKFSDRTDFIGGAKLMGYTINLADLIVYPEAHAFVIQKIGGRLSKTQYQLEGQVNPYITPSDKTARTTYNLGLSGTIRPDTKMEYGIGYDLNIAKKFISHQGTVKVRLNF

SEQ ID NO: 8890 - protein, 440 aa, Shewanella woodyi
MSKFHPALPMTAAILTAVLSQQLNAAGFIEDSKATLSFKNFYINQDVRNQEAPRSEEWGQGFFLDFKSGFTEGPVGFGLDVLAMHAVRLDGGGHAGKADIERTPGGMFPLESNGKAKTDFGRVGVTGKLRFSKTEARLGTLLPKMPVLVYNDGRLLPQLFHGAQITSNEIDNLSLTAGKLEHSTERNSGDSHGLSIGGANSGSKARFSNEFHFAGADYKATKDLLLQYYYGNLRDFYKQHFVGLVHDWKLPVGSLKTDLRYFYSDSDGKNESASGRAEGYVSSGADGSSGEVDNDLWSALFTYSLKGHALSLGYQKVSGDSDFPHINLGSGRSLHLITNAQLGKFASAGENTWVAGYAYDFAQLGVPGLKARLVYFSGDDIDAAGSDNKEWERNFRVDYAVQNGLFKGVGLSWLNAALRGNDSRNLDENRLVISYTLPLL

SEQ ID NO: 8891 - protein, 287 aa, Shewanella woodyi
MKNVKTFALAATAIAATMSAPTFAADRSDLRSGDYSWMQFNAMYAVNELPRSDADDGGHDYLEMEFGGRAGIVDLYGYVDVFNLANSSSGDKGAGKSKMFMKFAPRFSIDAMTGWDLSAGPIQEVYFSTLFNWGGGAISGVDADGNEHGGDVNMSFWGLGADVMVPWLGKTGMNLYATYDMNAKDWNGYQFSMNWFKPVMNFDNGSFVSFQGYVDYQFGADAVDDMYVPTTSSGGAAYFGLHWHSDNYALGYGLKAYQDVYLVKDDGGIVGLESTGFAHYFTATYKF

SEQ ID NO: 8892 - protein, 730 aa, Escherichia coli
MRVTTKQYHQDAKAQGERTKLRPLLQQLLLAGVLGPATGGLAMAAEPADPVPSAGPAAAANAGAGAPRSDAPVLNEVTVKASGLGLTSADMSTPATVLEGDVLTLRQAATLGETLDGEPGIHASHFGAGASRPIIRGMDGPRVQILSDGSELHDASTISPDHAVASEPMLATQIEVLRGPSALIYGGGGAMGGVVNILDDKIPTSIPRNGITGSAQLRGSTGAGETAGAFSLTGGAGQLAIHAEGMARDAGDYRVGSGWAPNGQSQGRVAGSFNRTDTGSLGLSWIGTQGYLGLAYTRQTARYGLPGHNHSFEGCHTHGDHLHCGGHDHGDEDGHDHGGDDHDHGSVPVVDLTSERWDLRGEWRNPTAGIAALRVRGGWTDYRHDEIEGGQVSTTFKNRAHDLRVEADLEPIAGWRGVIGLQTVQRKFSAEGEEAYVQPTETRRNSIYLLEEYRWQDWRWQAALRHERQTVDAQQSGISRSHSGTSFSLGSVWKFTPGYSLSASLTQGNRLPTAEELYANGLHMATSTYERGNADLKRERSQALDIGLRKTAGDTTFSVNAFHHRVKGYIYGATLDEHDGLQLLQYTQADARFTGVEGQVRQKLSRQWGVTLFGDAVRARLEDGSALPRIPAARVGLRVDTFYKGWDAQAEWVQVLRQNRVTAYETETDGYGMLNVSASYTLRTSGGMPWQFFIKGNNLTNRLAFAHTSFIKNAAPLMGRNITVGVKVSF

SEQ ID NO: 8893 - protein, 733 aa, Escherichia coli
MMISKKYTLWALNPLLLTMMAPAVAQQTDDETFVVSANRSNRTVAEMAQTTWVIENAELEQQIQGGKELKDALAQLIPGLDVSSRSRTNYGMNVRGRPLVVLVDGVRLNSSRTDSRQLDSIDPFNIDHIEVISGATSLYGGGSTGGLINIVTKKGQPETMMEFEAGTKSGFSSSKDHDERIAGAVSGGNEHISGRLSVAYQKFGGWFDGNGDATLLDNTQTGLQYSDRLDIMGTGTLNIDESRQLQLITQYYKSQGDDDYGLNLGKGFSAIRGTSTPFVSNGLNSDRIPGTERHLISLQYSDSAFLGQELVGQVYYRDESLRFYPFPTVNANKQVTAFSSSQQDTDQYGMKLTLNSKPMDGWQITWGLDADHERFTSNQMFFDLAQASASGGLNNKKIYTTGRYPSYDITNLAAFLQSGYDINNLFTLNGGVRYQYTENKIDDFIGYAQQRQIAAGKATSADAIPGGSVDYDNFLFNAGLLMHITERQQAWLNFSQGVELPDPGKYYGRGIYGAAVNGHLPLTKSVNVSDSKLEGVKVDSYELGWRFTGNNLRTQIAAYYSISDKSVVANKDLTISVVDDKRRIYGVEGAVDYLIPDTDWSTGVNFNVLKTESKVNGTWQKYDVKTASPSKATAYIGWAPDPWSLRVQSTTSFDVSDAQGYKVDGYTTADLLGSYQLPVGTLSFSIENLFDRDYTTVWGQRAPLYYSPGYGPASLYDYKGRGRTFGLNYSVLF

SEQ ID NO: 8894 - protein, 417 aa, Escherichia coli
MAMAVICLTAASGLTSAYAAQLADDEAGLRIRLKNELRRADKPSAGAGRDIYAWVQGGLLDFNSGYYSNIIGVEGGAYYVYKLGARADMSTRWYLDGDKSFGFALGAVKIKPSENSLLKLGRFGTDYSYGSLPYRIPLMAGSSQRTLPTVSEGALGYWALTPNIDLWGMWRSRVFLWTDSTTGIRDEGVYNSQTGKYDKHRARSFLAASWHDDTSRYSLGASVQKDVSNQIQSILEKSIPLDPNYTLKGELLGFYAQLEGLSRNTSQPNETALVSGQLTWNAPWGSVFGSGGYLRHAMNGAVVDTDIGYPFSLSLDRNREGMQSWQLGVNYRLTPQFTLTFAPIVTRGYESSKRDVRIEGTGILGGMNYRVSEGPLQGMNFFLAADKGREKRDGSTLGDRLNYWDVKMSIQYDFMLK

SEQ ID NO: 8895 - protein, 1806 aa, Escherichia coli
MNRIYRVIWNCTLQVFQACSELTRRVGKTSTVNLRKSSGLTTKFSRLTLGVLLALSGSASGASLEVDNGQITNIDTDVAYDAYLVGWYGTGVLNILADGNASLTTITTSVIGANEDSEGTVNVLGGTWRLYDSGNNARPLNVGQSGTGTLNIKQKGHVDGGYLRLGSSTGGVGTVNVEGEDSVLTTELFEIGSYGTGSLNITDKGYVTSSIVAILGYQANSNGKVIVEKGGEWLIKNNDSSIEFQIGNQGAGEATIREGGLITAENTIIGGNATGFGTLNVQDQDSVITVRRLYNGYFGNGTVNISNNGLINNKEYSLVGVQDGSHGVVNVTDKGHWNFLGTGEAFRYIYIGDAGDGELNVSSEGKVDSGIITAGMKETGTGNITVKDKNSVITNLGTNLGYDGHGEMDISNEGLVVSNGGSSLGYGETGVGNVSITTGGMWEVNKNVYTTIGVAGVGNLNISDGGKFVSQNITFLGDKASGIGTLNLMDATSSFDTVGINVGNFGSGIVNVSNGATLNSTGYGFIGGNASGKGIVNISTDSLWNLKTSSTNAQLLQVGVLGTGELNITTGGIVKARDTQIALNDKSKGDVRVDGQNSLLETFNMYVGTSGTGTLTLTNNGTLNVEGGEVYLGVFEPAVGTLNIGAAHGEAAADAGFITNATKVEFGLGEGVFVFNHTNNSDAGYQVDMLITGDDKDGKVIHDAGHTVFNAGNTYSGKTLVNDGLLTIASHTADGVTGMGSSEVTIANPGTLDILASTNSAGDYTLTNALKGDGLMRVQLSSSDKMFGFTHATGTEFAGVAQLKDSTFTLERDNTAALTHAMLQSDSENTTSVKVGEQSIGGLAMNGGTLIFDTDIPAATLAEGYISVDTLVVGAGDYTWKGRNYQVNGTGDVLIDVPKPWNDPMANNPLTTLNLLEHDDSHVGVQLVKAQTVIGSGGSLTLRDLQGDEVEADKTLHIAQNGTVVAEGDYGFRLTTAPGDGLYVNYGLKALNIHGGQKLTLAEHGGAYGATADMSAKIGGEGDLAINTVRQVSLSNGQNDYQGATYVQMGTLRTDADGALGNTRELNISNAAIVDLNGSTQTVETFTGQMGSTVLFKEGALTVNKGGISQGELTGGGNLNVTGGTLAIEGLNARYNALTSISPNAEVSLDNTQGLGRGNIANDGLLTLKNVTGELRNSISGKGIVSATARTDVELDGDNSRFVGQFNIDTGSALSVNEQKNLGDASVINNGLLTISTERSWAMTHSISGSGDVTKLGTGILTLNNDSAAYQGTTDIVGGEIAFGSDSAINMASQHINIHNSGVMSGNVTTAGDVNVMPGGTLRVAKTTIGGNLENGGTVQMNSEGGKPGNVLTVNGNYTGNNGLMTFNATLGGDNSPTDKMNVKGDTQGNTRVRVDNIGGVGAQTVNGIELIEVGGNSAGNFALTTGTVEAGAYVYTLAKGKGNDEKNWYLTSKWDGVTPPDTPDPINNPPVVDPEGPSVYRPEAGSYISNIAAANSLFSHRLHDRLGEPQYIDSLHSQGSASSMWMRHVGGHERSRAGDGQLNTQANRYVLQLGGDLAQWSSNAQDRWHLGVMAGYANQHSNTQSNRVGYKSDGRISGYSAGLYATWYQNDANKTGAYVDSWALYNWFDNSVSSDNRSADDYDSRGVTASVEGGYTFEAGTFSGSEGTLNTWYVQPQAQITWMGVKDSDHTRKDGTRIETEGDGNVQTRLGVKTYLNSHHQRDDGKQREFQPYIEANWINNSKVYAVKMNGQTVGREGARNLGEVRTGVEAKVNNNLSLWGNVGVQLGDKGYSDTQGMLGVKYSW

SEQ ID NO: 8896 - protein, 790 aa, Escherichia coli
MKRVLIPGVILCGADVAQAVDDKNMYMHVFEEMTVYAPVPVPVNGNTHYTSESIERLPTGNGNISDLLRTNPAVRMDSTQSTSLNQGDIRPEKISIHGASPYQNAYLIDGISATNNLNPANESDASSATNISGMSQGYYLDVSLLDNVTLYDSFVPVEFGRFNGGVIDAKIKRFNADDSSVKLGYRTTRSDWLTSHIDENNKSAFNQGSSGSTYYSPDFKKNFYTLSFNQELADNFGVTAGLSRRQSDITRADYVSNDGIVAGRAQYKNVIDTALSKFTWFASDRFTHDLTLKYTGSSRDYNTSTFPESDREMGNKSYGLAWDMDTQLAWAKLRTTVGWDHISDYTRHDHDIWYTELSCTYGDISGRCTRGGLGHISQAVDNYTFKTRLDWQKFTVGNVSHQPYFGAEYIYSDAWTERHNQSESYVINAAGKKTNHTIYHKGKGSLGIDNYTLYMADRISWRNVSLMPGVRYDYDNYLSNHNISPRFMTEWDIFADQTSMITAGYNRYYGGNILDMGLRDIRNSWTESVSGNKTLTRYQDLKTPYNDELAMGLQQKIGKNVIARANYVYREAHDQISKSSRTDSATKTTITEYNNDGKTKTHSFNLSFELAEPLHISQVDINPQIVFSYIKSKGNLSLNNGYEESNTGDNRVVYNGNLVSYDSVPVADFNNPLKISLNMDFTHQPSGLVWANTLTWQEARKARIILGKTNAQYISEYSDYKQYVDEKLDSSLTWDTRLSWTPQFLKQQNLTISADILNVLDSKTAVDTTNTGVATYASGRTFWLDVSMKF

SEQ ID NO: 8897 - protein, 366 aa, Escherichia coli
MKLKIVAVVVTGLLAANVAHAAEVYNKDGNKLDLYGKVTALRYFTDDKRDDGDKTYARLGFKGETQINDQMIGFGHWEYDFKGYNDEANGSRGNKTRLAYAGLKISEFGSLDYGRNYGVGYDIGSWTDMLPEFGGDTWSQKDVFMTYRTTGLATYRNYDFFGLIEGLNFAAQYQGKNKRTDNSHLYGADDTRANGDGFGISSTYVYDGFGIGAVYTKSDRTNAQERAAANPLNASGKNAELWATGIKYDANNIYFAANYDETLNMTTYGDGYISNKAQSFEVVAQYQFDFGLRPSLAYLKSKGRDLGRYADQDMIEYIDVGATYFFNKNMSTYVDYKINLIDESDFTRTVDIRTDNIVATGITYQF

SEQ ID NO: 8898 - protein, 700 aa, Escherichia coli
MKIFSVRQTVLPALLALSPVVFAADEQTMIVSAAPQVVSELDTPAAVSVVDGEEMRLATPRINLSESLTSVPGLQVQNRQNYAQDLQLSIRGFGSRSTYGIRGIRLYVDGIPATMPDGQGQTSNIDLSSVQNVEVLRGPFSALYGNASGGVMNVTTQTGQQPPTIEASSYYGSFGSWRYGLKATGATGDGTQPGDVDYTVSTTRFTTHGYRDHSGAQKNLANAKLGVRIDEASKLSLIFNSVDIKADDPGGLTKAEWKANPQQAPRAEQYDTRKTIKQTQAGLRYERSLSSRDDMSVMMYAGERETTQYQSIPMAPQLNPSHAGGVITLQRHYQGIDSRWTHRGELGVPVTFTTGLNYENMSENRKGYNNFRLNSGMPEYGQKGELRRDERNLMWNIDPYLQTQWQLSEKLSLDADVRYSSVWFDSNDHYVTPGNGDDSGDASYHKWLPAGSLKYAMTDAWNIYLAAGRGFETPTINELSYRADGQSGMNLGLKPSTNDTIEIGSKTRIGDGLLSLALFQTDTDDEIVVDSSSGGRTTYKNAGKTRRQGAELAWDQRFAGDFRVNASWTWLDATYRSNVCNEQDCNGNRMPGIARNMGFASIGYVPEDGWYAGTEARYMGDIMADDENTAKAPSYTLVGLFTGYKYNYHNLTVDLFGRVDNLFDKEYVGSVIVNESNGRYYEPSPGRNYGVGMNIAWRFE

SEQ ID NO: 8899 - protein, 253 aa, Escherichia coli
MSAKRRLLIACALTTIFYHLPAYSSLEYKGSFGSINAGYADWNSGFINTHRGEVWKVTADFGVNFKEAEFYSFYESNVLNHAVAGRNHTVSAMTHVRLFDSNMTFFGKIYGQWDNSWGDDLDMFYGLGYLGWNGSWGFFKPYIGLHNQSGDYVSAKYGQTNGWNGYVVGWTAVLPFTLFDEKFVLSNWNEIELDRNDAYAEQQFGRNGLNGGLTVAWKFYPRWKASVTWRYFDNKLGYDGFGDQMIYMLGYDF

SEQ ID NO: 8900 - protein, 1182 aa, Escherichia coli
MQKKRARERIIMFLCIISLLFTPVLAASQSNAMRVSLDLKSATVKEFFDAVKVQTGLNFIYSTEQVKNMPRITIQSNSQPISEVLNKVLANTGYSYEIEGNIVTIVYQQPKENVRTATGVVVDEGGLPLPGAYIKLSKTEHSTITDNEGKFSINLFHQKEPVLIVSYLGMIVQEVKVAGTKPMTIVMKSDVKSIDEVVVTGYQEIDRRKLASSISSIKGADLIGGEYLSIDKMLQGRLPGVAVMNMSSTPGAAPKIRIRGSSSITGNREPVWVVDGIILEEPVNISTEELNSPDKINLIGNAIGSVNPEDIERVDILKDASATAIYGIKAANGVIVVTTKQGKSQKPSISYTATLGITAPPTYDKMFRMNSADRIDMSIEMQERGLSFGSYKPSDIGYEGALQHLWNKDITYQEFLNQVKTLKGLNTDWYDLLFRTAFTHQHSVSITGGNDRSNYYMSMGYANNNSVTIGEGLERYNVLAKINTRINRNIHLGLKVSGSLSKAEHPHTSIDVYEYAYNTSRAIPLRTASNELYFYANEAGRNGVLSYNIMNELNHTGNKNDNSAIDVAVNLDWKVASWMRFSSILGLSRSNVTQENWGDEQSYYISSMRQSPYGKMLPNPIEDSEFAERYCLLPFGGELMTTNTRNTSYTWRNSLSLMQSFGKHEVSGSIGQEVRSSKYDGLSSTQYGYLPERGKKFVDIDPTVWKRYGALVKSHPDVVTDTKNNVISLYATAAYVYDSRYILNFNIRTDGSNKFGQSKSVRFLPIWSVSTRWNVINEKFMKNVDFLNDLAIRASYGIQGNVHPDQTPNLIASLGTLESMPQEYISTLYKLPNNKLKWEKTNSYNIAIDWAFWNNRIYGSLDVYYKKGVDQVVTKNVAPSTGASSVSINDGDVENKGWDLAVSFVPIQTRDWMWSLSFNTGKNYNKVLNAGNSAITWQDYIAGTLVSNGNAINSFYSYKFDKLDDQGFPTFKDINEKDEEGNAVVHSLQEMYDRAFVLSGKREPDLTGGFSTYLKYKNITFNALFSFSFGNKMRLNDLYESSGQRLPYPDQNMSSEFVNRWREPGDEDRTIIPVLSDKSLQINDKDVTYRIADNGWDMYNKSDIRVVSGSFLRCRSMSIRYDFKREWLKPVYLKGASVSFDMGNVFVIKDKALKGRDPEQIGFGSRSIPPQRSYSLRFNITL

SEQ ID NO: 8901 - protein, 377 aa, Escherichia coli
MKSKVLALLIPALLAAGAAHAAEVYNKDGNKLDLYGKVDGLHYFSDNSAKDGDQSYARLGFKGETQINDQLTGYGQWEYNIQANNTESSTNQSWTRLAFAGLKFADYGSFDYGRNYGVMYDIEGWTDMLPEFGGDSYTNADNFMTGRANGVATYRNTDFFGLVNGLNFAVQYQGNNEGASNGQEGTNNGRDVRHENGDGWGLSTTYDLGMGFSAGAAYTSSDRTNDQVNHTAAGGDKADAWTAGLKYDANNIYLATMYSETRNMTPFGDSDYAVANKTQNFEVTAQYQFDFGLRPAVSFLMSKGRDLHAAGGADNPAGVDDKDLVKYADVGATYYFNKNMSTYVDYKINLLDEDDSFYAANGISTDDIVALGLVYQF

SEQ ID NO: 8902 - protein, 747 aa, Escherichia coli
MARSKTAQPKHSLRKIAVVVATAVSGMSVYAQAAVEPKEDTITVTAAPAPQESAWGPAATIAARQSATGTKTDMPIQKVPQSISVVTAEEMALHQPKSVKEALSYTPGVSVGTRGASNTYDHLIIRGFAAEGQSQNNYLNGLKLQGNFYNDAVIDPYMLERAEIMRGPVSVLYGKSSPGGLLNMVSKRPTTEPLKEVQFKAGTDSLFQTGFDFSNALDDDGVYSYRLTGLARSANAQQKGSEEQRYAIAPAFTWRPDDKTNFTFLSYFQNEPETGYYGWLPKEGTVEPLPNGKRLPTDFNEGAKNNTYSRNEKMVGYSFDHEFNDTFTVRQNLRFAENKTSQNSVYGYGVCSDPANAYSKQCAALAPADKGHYLARKYVVDDEKLQNFSVDTQLQSKFATGDIDHTLLTGVDFMRMRNDINAWFGYDDSVPLLNLYNPVNTDFDFNAKDPANSGPYRILNKQKQTGVYVQEQAQWDKVLVTLGGRYDWADQESLNRVAGTTDKRDDKQFTWRGGVNYLFDNGVTPYFSYSESFEPSSQVGKDGNIFAPSKGKQYEVGVKYVPEDRPIVVTGAVYNLTKTNNLMADPEGSFFSVEGGEIHARGVEIEAKAALSASVNVVGSYTYTDAEYTTDTTYKGNTPAQVPKHMASLWADYTFFDGPLSGLTLGTGGRYTGSSYGDPANSFKVGSYTVVDALVRYDLARVGMAGSNVALHVNNLFDREYVASCFNTYGCFWGAERQVVATATFRF

SEQ ID NO: 8903 - protein, 212 aa, Escherichia coli
MKKLTVAALAVTTLLSGSAFAHEAGEFFMRAGSATVRPTEGAGGTLGSLGGFSVTNNTQLGLTFTYMATDNIGVELLAATPFRHKIGTRVPGDIATVHHLPPTLMAQWYFGDASSKFRPYVGAGINYTTFFDNGFNDHGKEAGLSDLSLKDSWGAAGQVGVDYLINRDWLVNMSVWYMDIDTTANYKLGGAQQHDSVRLDPWVFMFSAGYRF

SEQ ID NO: 8904 - protein, 351 aa, Escherichia coli
MKKSTLALVVMGITASASVQAAEVYNKNGNKLDLYGKVKAMHYMTDYDSKDGDQSYIRLGFKGETQINDELTGYGRWEAEFAGNKAESDSNQQKTRLAFAGSKLKNLGSFDYGRNLGALYDVEAWTDMFPEFGGDSSAQTDNFMTKRASGLATYRNTDFFGVVDGLDLTLQYQGKNQDRDVKKQNGDGFGTSVTYDFGGSDFAVSGAYTNSDRTNQQNLQTRGTGDKAEAWATGLKYDANDIYIATFYSETRNMTPISGGFANKTQNFEAVVQYQFDFGLRPSLGYVLSKGKDIEGVGNEDLVNYIDVGATYYFNKNMSAFVDYKINQLDSDNKLGINNDDIVAVGMVYQF

SEQ ID NO: 8905 - protein, 656 aa, Escherichia coli
MRLKKRYLCTALSLAFTQQAVAAQESDTLTVWSSPVSSTTTTVLDQPTMKALDKQNVAQALSVVPGVVLQKSGSRNEEQVKVRGFDSRQVPVYFDGVPIYVPYDGNLDLARILTNNLGAVEVSKGYSSLLQGPNQMGGAINITTQKPTKPLEASLGYRQGWSRSQDNAYDMHASFAVSSDLGYLQVSGSQLKQDFLGLPHGVNNDIAAKHGKMINSSADDKRGIVKLGFTPRENDEYTLTYIKQDGEKDNPPYSRNSGQKSRYWQWPEYDKESFYYQGTTQLNDRFTLKSRLYRDTFENTLMMYNSLADLKNKKGSYSHYSDYSDGAGLQLAADVRENDLLSFAVNWKDDVHREKGAPHAAYDRYEDRTWSLASEYQWAAADNVDVVAGISYDWRDSVEAKKHEKDGSITHYDDNNQSAFNWQVMGKYHFGNEDTLALSYYDRTRFPTLKERYTTSKPAYNQIAIVNPQLKPERARGVDLTWNGAFTHDWGFEVSVYYNRVSDAILSHNIDADTIQNQNSGTVDYSGLDAGIKGKISNILDVGLSYALIHADAKRKDIGKINDLPTQTMTAWMTLKPWEPLSVTLSEEARSSSYSNSDGSQKAAGFGVTHIRADYTLGHGFSVNASVNNLFDTKYAYSEGFIEEGRNFWAGIEYTF

SEQ ID NO: 8906 - protein, 378 aa, Escherichia coli
MGSKLTKYLTSVSLTLALFGNVYADDATPITTHPTTKETDTKIDTQADIKVETQTEKPETKTDRKGDFVANIFWQSAYATTSGMNISRVCLDSLNNNSFYFDIEGGALGLCLYQKNMAEKAGFHMDGAGYYTELSVGSPSFYKLGFKFASQKTNAKANIGHDEVASDYLSFGSYWEVHLFKGKFILAGNGLYSRGLHYLNHTHRKLLGACCASFESQTIGSALSFYFPLKAIKNDRLTVMPFFRLQAVLSRHDPFTEQGARVRTFSGSPKFDEFLDTSLPFGLHSQLAFHGRFPSIWELEVAYKPSTQRQLPVVSSKLVADDGTWVSTPTNVSRRAVSVNLRNETQVLKYLNMHVDYQCDLSSSTRSHYLLAGGKLSF

SEQ ID NO: 8907 - protein, 686 aa, Escherichia coli
MQGMEPIMEPAQQPAMVLTPARVSQPQSEAPASVTVIDRTLIEASGARELYEVLKLVPGMAAVKVDGNVPSVAYHPTLARDQRRMLVLLDGRSQYQPGLSRVSWNDMPVDIRDVERIEVTRGPAAAAYGANAFTAVINIITRDPRDISSSGVTMLGGNNGIRDAHLVGVHQLSNGAVRASVSRRADNGYDEPFEGKTLPDDKHIETLNTEWVWEADERNTLTVQAGGSQSRLERQQEAGLTDMGEYQDDPIQKGERAFLSLQWQHNFSRTHQLQILTYGQYNQEVTGFELCYLDPVTGKPGPGGGLFFSKELRDLYLQNGGDIEATFAAFPSDLDVMNRYLSLQSAGSPFCASSELDIQEVRYDLEIQDTLHLARWARLVSGAEVRHDRVQSDSYLGGTEDNVSYRLFGNLALDVLDPVTVNLGGYWERDQISDDHFSPRAGVNWRVFPGHHLRYVYSEALRTPDIYEERANINFQAQALSSPFGENAQTLLGWSPAYFFVTQQSPATFKPEKMRSWEVGYYGQFSAVELDVRYFQETLTNLLSTALNSFDFEPNNDGRVNHQGTEAQLTWRPAASHLFRVTGAHIHTRSNVKTEYRLAARNSGSALWSWQFSQHWAFSSAYYLSNDYNDNRFERVDMQLRFRHRAGPTELEWQAVVQHGLNKQPVVFPENRYQQDRMWFGVTVRM

SEQ ID NO: 8908 - protein, 729 aa, Escherichia coli
MLSTQFNRDNQHQAIIKPSLLAGCIALALLPSAAFAAPVTEETVIVEGSATAPDDGENDYNVTSTSAGTKMQMTQRDIPQSVTIVSQQRMEDQQLQTLGEVMENTLGISKSQADSDRALYYSRGFQIDNYMVDGIPTYFESRWNLGDALSDMALFERVEVVRGATGLMTGTGNPSAAINMVRKHATSREFKGDVSAEYGSWNKERYVADLQSPLTEDGKIRARIVGGYQNNDSWLDRYNSEKTFFSGIVDADLGDLTMLSAGYEYQRIDVNSPTWGGLPRWNTDGSSNSYDRARSTAPDWAYNDKEINKVFMTLKQRFADTWQATLNATHSEVEFDSKMMYVDAYVNKADGMLVGPYSNYGPGFDYVGGTGWNSGKRKVDALDLFADGSYELFGRQHNLMFGGSYSKQNNRYFSSWANIFPDEIGSFYNFNGNFPQTDWSPQSLAQDDTTHMKSLYAATRVTLADPLHLILGARYTNWRVDTLTYSMEKNHTTPYAGLVFDINDNWSTYASYTSIFQPQNDRDSSGKYLTPITGNNYELGLKSDWMNSRLTTTLAIFRIEQDNVAQSTGTPIPGSNGETAYKAVDGTVSKGVEFELNGAITDNWQLTFGATRYIAEDNEGNAVNPNLPRTTVKMFTSYRLPVMPELTVGGGVNWQNRVYTDTVTPYGTFRAEQGSYALVDLFTRYQVTKNFSLQGNVNNLFDKTYDTNVEGSIVYGAPRNFSITGTYQF

SEQ ID NO: 8909 - protein, 660 aa, Escherichia coli
MSRPQFTSLRLSLLALAVSATLPTFAFATETMTVTATGNARSSFEAPMMVSVIDTSAPENQTATSATDLLRHVPGITLDGTGRTNGQDINMRGYDHRGVLVLVDGIRQGTDTGHLNGTFLDPALIKRVEIVRGPSALLYGSGALGGVISYDTVDAKDLLQEGQSSGFRVFGTGGTGDHSLGLGASAFGRTENLDGIVAWSSRDRGDLRQSNGETAPNDESINNMLAKGTWQIDSAQSLSGLVRYYNNDAREPKNPQTVEASESSNPMVDRSTIQRDAQLSYKLAPQGNDWLNADAKIYWSEVRINAQNTGSSGEYREQITKGARLENRSTLFADSFASHLLTYGGEYYRQEQHPGGATTGFPQAKIDFSSGWLQDEITLRDLPITLLGGTRYDSYRGSSDGYKDVDADKWSSRAGMTINPTNWLMLFGSYAQAFRAPTMGEMYNDSKHFSIGRFYTNYWVPNPNLRPETNETQEYGFGLRFDDLMLSNDALEFKASYFDTKAKDYISTTVDFAAATTMSYNVPNAKIWGWDVMTKYTTDLFSLDVAYNRTRGKDTDTGEYISSINPDTVTSTLNIPIAHSGFSVGWVGTFADRSTHISSSYSKQPGYGVNDFYVSYQGQQALKGMTTTLVLGNAFDKEYWSPQGIPQDGRNGKIFVSYQW

SEQ ID NO: 8910 - protein, 676 aa, Escherichia coli
MLESHTITTGTDLQKLIPTLNVGVSIFGGTQQFSLRGVRTGVVSYLNEVPVDGVLADQMLWDLSSIQAISGPQGTLFGKNSTGGAVLFVPNQPGEEFEGYVEGRLGRFNLREGTAVVNLPVNDKLALRIGARVTKRDGIIDNLTGPDLQAQDHRSLRVSALFKPNAVLTNYTTFNYAHRDDTPYAQISGSGAGTPSCPTALPACVYGASYANELAAQRARGIRTVSIPLDASQSASPWQLTNVLSGHFGAVTAKYIFGYQKNKDRQFTSQLSIPLPVIIGLNQNRTSLKTREFQLLGSAFTERLTWVAGLYASDSDVNNFNSYLLFAPVGTPHNNNTTQQTGGNTTTDSKAAYAQGTLAVTDRFNVTVGARYTQDDVKTAQFGYSPGHVCNLPAALPSVNIATCTQRIAAKTDAVTYNLSADFKVSDDVLLYATTRKGYNAGGFNPNINDADLEVVRPEYITDYEGGLKADWSLGGMPVRTNISTFYAKYKDIQRTTSLVFDNLIVTGNFNAAKATIYGAQIEILARPVEPLTLQASYGYLHTKYDSFQNALLGDVTGNSFAQAPEDTLNVSATYRHALPSGELVANVSYAYISKVAYSDDNLTTPGNIAPGYGLVDARLDWKKVGGSAVDLGVYVKNATDKEYLLNTTDRTGRFGFDSRVYGDPRTFGVEIRYSF

SEQ ID NO: 8911 - protein, 358 aa, Escherichia coli
MDDNEAQKMKKTAIAIAVALAGFATVAQAAPKDNTWYTGAKLGWSQYHDTGFIPNNGPTHENQLGAGAFGGYQVNPYVGFEMGYDWLGRMPYKGDNINGAYKAQGVQLTAKLGYPITDDLDVYTRLGGMVWRADTKSNTPGGASYKDHDTGVSPVFAGGIEYAITPEIATRLEYQWTNNIGDAHTIGTRPDNGLLSVGVSYRFGQEEAAPMPAPTPAPAPEVQTKHFTLKSDVLFTFNKDNLKPEGKQALDQLYNQLNNLDPKDGSVVVLGFTDRIGSDAYNQGLSEKRAQSVVNYLISKGIPADKISARGMGESNPVTGNTCDNVKQRAALIDCLAPDRRVEIEVKGIKDVVTQPQA

SEQ ID NO: 8912 - protein, 232 aa, Escherichia coli
MIIKKSGGRWQLSLLASVVISAFFLNTAYAWQQEYIVDTQPGLSTERYTWDSDHQPDYNDILSQRIQSSQRALGLEVNLAEETPVDVTSSMSMGWNFPLYEQVTTGPVAALHYDGTTTSMYNEFGDSTTTLTDPLWHASVSTLGWRVDSRLGDLRPWAQISYNQQFGENIWKAQSGLSRMTATNQNGNWLDVTVGADMLLNQNIAAYAALTQAENTTNNSDYLYTMGVSARF

SEQ ID NO: 8913 - protein, 356 aa, Escherichia coli
MMKRNILAVIVPALLVAGTANAAEIYNKDGNKLDLYGKAVGLHYFSKGNGENSYGGNGDMTYARLGFKGETQINSDLTGYGQWEYNFQGNNSEGSDAQNGNKTRLAFAGLKFADVGSIDYGRNYGVVYDALGYTDMLPEFGGDTAYSDDFFVGRVGGVATYRNSNFFGLVDGLNFAVQYLGKNERDTARRSNGDGVGGSISYEYEGFGIVGAYGAADRTNLQEAQPLGQGKKAEQWATGLKYDANNVYLAANYGETRNATPIKGGFANKTQDILLVAQYQFDFGLRPSIAYTKSKAKDVEGIGDVDLVNYVEVGATYYFNKNMSTYVDYAINQIDSDNKLGVGSDDTVAVGIVYQF

SEQ ID NO: 8914 - protein, 948 aa, Escherichia coli
MKRHLNTSYRLVWNHITGTLVVASELARSRGKRAGVAIALSLAAVTSVPALAADTVVQAGETVNDGTLTNHDNQIVLGTANGMTISTGLEYGPDNEANTGGQWIQNGGIANNTTVTGGGLQRVNAGGSVSDTVISAGGGQSLQGQAVNTTLNGGEQWVHEGGIATGTVINEKGWQAVKSGAMATDTVVNTGAEGGPDAENGDTGQFVRGNAVRTTINKNGRQIVAAEGTANTTVVYAGGDQTVHGHALDTTLNGGYQYVHNGGTASGTVVNSDGWQIIKEGGLADFTTVNQKGKLQVNAGGTATNVTLKQGGALVTSTAATVTGSNRLGNFTVENGKADGVVLESGGRLDVLEGHSAWKTLVDDGGTLAVSAGGKATDVTMTSGGALIADSGATVEGTNASGKFSIDGTSGQASGLLLENGGSFTVNAGGLASNTTVGHRGTLTLAAGGSLSGRTQLSKGASMVLNGDVVSTGDIVNAGEIRFDNQTTPDAVLSRAVAKGDSPVTFHKLTTSNLTGQGGTINMRVRLDGSNTSDQLVINGGQATGKTWLAFTNVGNSNLGVATSGQGIRVVDAQNGATTEEGAFALSRPLQAGAFNYTLNRDSDEDWYLRSENAYRAEVPLYASMLTQAMDYDRILAGSRSHQTGVSGENNSVRLSIQGGHLGHDNNGGIARGATPESSGSYGFVRLEGDLLRTEVAGMSLTTGVYGAAGHSSVDVKDDDGSRAGTARDDAGSLGGYLNLVHTSSGLWADIVAQGTRHSMKASSDNNDFRARGWGWLGSLETGLPFSITDNLMLEPQLQYTWQGLSLDDGQDNAGYVKFGHGSAQHVRAGFRLGSHNDMNFGKGTSSRDTLRDSAKHSVRELPVNWWVQPSVIRTFSSRGDMSMGTAAAGSNMTFSPSRNGTSLDLQAGLEARVRENITLGVQAGYAHSVSGSSAEGYNGQATLNVTF

SEQ ID NO: 8915 - protein, 461 aa, Escherichia coli
MNFVVNKKIFILGIASICTSTLHAAAFDKTGQSVAAFLQPGNYFEASLGITDADLSGVESGTNPSHHSISDIANTDYRPTAALKLQLAPQYSFGLLYDQPFGADTEYSGVNGFVATPKDTVMLPGITTTGLASATLGHAPTGNAKSEFDIQNLSFILGYQPTKNWNLYAGPVYQTFKSQVELRGNVFSLYNGYDFHTKTVSDLGWLAGLAYQIPEKAVKVSLTYRSAITHKVNATENAPLIDMLSTQQGRDLVNQHLDFMISIGQMTPQKKAYLNQIIANLSEQEDTGTTKFKSPDSVNLEFQTGLRQGTSLFGSLRWVNWSDLALQPYRFGEISKVVGVLSTPSRPEGFNLVRYYDDQWSLNLGLGQRFSPKWLGSVSVGWDSGAGDKVSTGGPTKGYYNLGVGAQYSPTSRYFISGGVKYYWLGDAKAQLGAQAGSDYYVGEFKDNHSVSYGLKIGYKF

SEQ ID NO: 8916 - protein, 746 aa, Escherichia coli
MNKKIHSLALLVNLGIYGVAQAQEPTDTPVSHDDTIVVTAAEQNLQAPGVSTITADEIRKNPVARDVSEIIRTMPGVNLTGNSTSGQRGNNRQIDIRGMGPENTLILIDGKPVSSRNSVRQGWRGERDTRGDTSWVPPEMIERIEVLRGPAAARYGNGAAGGVVNIITKKGSGEWHGSWDAYFNAPEHKEEGATKRTNFSLTGPLGDEFSFRLYGNLDKTQADAWDINQGHQSARAGTYATTLPAGREGVINKDINGVVRWDFAPLQSLELEAGYSRQGNLYAGDTQNTNSDAYTRSKYGDETNRLYRQNYALTWNGGWDNGVTTSNWVQYEHTRNSRIPEGLAGGTEGKFNEKATQDFVDIDLDDVMLHSEVNLPIDFLVNQTLTLGTEWNQQRMKDLSSNTQALTGTNTGGAIDGVSATDRSPYSKAEIFSLFAENNMELTDSTIVTPGLRFDHHSIVGNNWSPALNISQGLGDDFTLKIGIARAYKAPSLYQTNPNYILYSKGQGCYASAGGCYLQGNDDLKVETSINKEIGLEFKRDGWLAGVTWFRNDYRNKIEAGYVAVGQNAVGTDLYQWDNVPKAVVEGLEGSLNVPVSETVMWTNNITYMLKSENKTTGDRLSIIPEYTLNSTLSWQAREDLSMQTTFTWYGKQQPKKYNYKGQPAVGPETKEISPYSIVGLSATWDVTKNVSLTGGVDNLFDKRLWRAGNAQTTGDLAGANYIAGAGAYTYNEPGRTWYMSINTHF

SEQ ID NO: 8917 - protein, 641 aa, Escherichia coli
MLAVDDDGETMVVTASSVEQNLKDAPASISVITQEDLQRKPVQNLKDVLKEVPGVQLTNEGDNRKGVSIRGLDSSYTLILVDGKRVNSRNAVFRHNDFDLNWIPVDSIERIEVVRGPMSSLYGSDALGGVVNIITKKIGQKWSGTVTVDTTIQEHRDRGDTYNGQFFTSGPLIDGVLGMKAYGSLAKREKDDPQNSTTTDTGETPRIEGFSSRDGNVEFAWTPNQNHDFTAGYGFDRQDRDSDSLDKNRLERQNYSVSHNGRWDYGTSELKYYGEKVENKNPGNSSPITSESNTVDGKYTLPLTAINQFLTVGGEWRHDKLSDAVNLTGGTSSKTSASQYALFVEDEWRIFEPLALTTGVRMDDHETYGEHWSPRAYLVYNATDTVTVKGGWATAFKAPSLLQLSPDWTSNSCRGACKIVGSPDLKPETSESWELGLYYMGEEGWLEGVESSVTVFRNDVKDRISISRTSDVNAAPGYQNFVGFETGANGRRIPVFSYYNVNKARIQGVETELKIPFNDEWKLSINYTYNDGRDVSNGENKPLSDLPFHTANGTLDWKPLALEDWSFYVSGHYTGQKRADSATAKTPGGYTIWNTGAAWQVTKDVKLRAGVLNLGDKDLSRDDYSYNEDGRRYFMAVDYRF

SEQ ID NO: 8918 - protein, 103 aa, Escherichia coli
MKVKVLSLLVPALLVAGAANAAEIYNKDGNKLDLYGKVDGLHYFSDNDSKDGDKTYMRLGFKGETQVTDQLTGYGQWEYQIQGNEPESDNSSWTRVAFAGLKF

SEQ ID NO: 8919 - protein, 829 aa, Escherichia coli
MRAFRTTTLLSASALSLLVAAPALAAGQESAPASNNEPALLGELVVTAQKRAQDPVDVPIAVTAYSGKFLEAIGVKAFDELSAFTPGFLVQNQSNNNSGFVMRGITSDSGSATDETRVSIYQDGVPISRSRGSYVELFDMERVEVAKGPQSTLFGRGALIGAVNLVQNKANPGGFDWALRAEAGTRGYRVGEGMVNFAVGESSALRIAARLRQTDGYVKDAAGGDPYDSTDSQAVRVGFHTEAGGLKFDLIGNYQVDDTTGTSFKSNTFNPSNPITGQALSDTSVGGFATLAPGAGFEGGAPLGLDRKVYGLTALADYRINDSLTLSSITATRAFHSTEVFDPDGSSLPILTFAEDAQGRQQSQELRLRYDAGGRFSGFVGANYFHETGSWRIPGQMDERLVLALLAGASPLGISRPTPQPQAVLTNPAYLAQVLQLGFGIPSSLATGFASNLKPIHREEFANYSENTTYDVYADGTLRLTDKLELTAGVRYTSEDREASYRSTVQNGRSILGVLLAAPTPTNLFLAAQPNAVNNAALPMLGLLNQPTANNGDTFSKSISDSGVTWRLVGRYAASEDLSLYASFARGRRPDVISTSAPAAPLGQPRFGIVKAEVVDSYEAGAKGKLMDGRLYLSGAVFRYDYDNFATTFRQGAQIVTLNAGKAKAYGFEGEARLQAGDFWTLFGTYGYNHARLESGLRKGNQFRLSPDHAVSVGALFSREGLGGKVTFTPTYTWRSKMFFDDNNDRADLQSAGLFPDTRLDEFQDAYGLLNVRLGFGAVDDRWKIEAFVENLNDKRYLKDAGNTGDSFGIPTFIAGKPRFMGIGITFRH

SEQ ID NO: 8920 - protein, 1250 aa, Escherichia coli
MRIIFLRKEYLSLLPSMIASLFSANGVAAVTDSCQGYDVKASCQASRQSLSGITQDWSIADGQWLVFSDMTNNASGGAVFLQQGAEFSLLPENETGMTLFANNTVTGEYNNGGAIFAKENSTLNLTDVIFSGNVAGGYGGAIYSSGTNDTGAVDLRVTNAMFRNNIANDGKGGAIYTINNDVYLSDVIFDNNQAYTSTSYSDGDGGAIDVTDNNSDSKHPSGYTIVNNTAFTNNTAEGYGGAIYTNSVTAPYLIDISVDDSYSQNGGVLVDENNSAAGYGDGPSSAAGGFMYLGLSEVTFDIADGKTLVIGNTENDGAVDSIAGTGLITKTGSGDLVLNADNNDFTGEMQIENGEVTLGRSNSLMNVGDTHCQDDPQDCYGLTIGSIDQYQNQAELNVGSTQQTFVHALTGFQNGTLNIDAGGNVTVNQGSFAGIIEGAGQLTIAQNGSYVLAGAQSMALTGDIVVDDGAVLSLEGDAADLTALQDDPQSIVLNGGVLDLSDFSTWQSGTSYNDGLEVSGSSGTVIGSQDVVDLAGGDNLHIGGDGKDGVYVVVDASDGQVSLANNNSYLGTTQIASGTLMVSDNSQLGDTHYNRQVIFTDKQQESVMEITSDVDTRSDAAGHGRDIEMRADGEVAVDAGVDTQWGALMADSSGQHQDEGSTLTKTGAGTLELTASGTTQSAVRVEEGTLKGDVADILPYASSLWVGDGATFVTGADQDIQSIDAISSGTIDISDGTVLRLTGQDTSVALNASLFNGDGTLVNATDGVTLTGELNTNLETDSLTYLSNVTVNGNLTNTSGAVSLQNGVAGDTLTVNGDYTGGGTLLLDSELNGDDSVSDQLVMNGNTAGNTTVVVNSITGIGEPTSTGIKVVDFAADPTQFQNNAQFSLAGSGYVNMGAYDYTLVEDNNDWYLRSQEVTPPSPPDPDPTPDPDPTPDPDPTPDPEPTPAYQPVLNAKVGGYLNNLRAANQAFMMERRDHAGGDGQTLNLRVIGGDYHYTAAGQLAQHEDTSTVQLSGDLFSGRWGTDGEWMLGIVGGYSDNQGDSRSNMTGTRADNQNHGYAVGLTSSWFQHGNQKQGAWLDSWLQYAWFSNDVSEQEDGTDHYHSSGIIASLEAGYQWLPGRGVVIEPQAQVIYQGVQQDDFTAANRARVSQSQGDDIQTRLGLHSEWRTAVHVIPTLDLNYYHDPHSTEIEEDGSTISDDAVKQRGEIKVGVTGNISQRVSLRGSVAWQKGSDDFAQTAGFLSMTVKW

SEQ ID NO: 8921 - protein, 760 aa, Escherichia coli
MENNRNFPARQFHSLTFFAGLCIGITPVAQALAAEGQANADDTLVVEASTPSLYAPQQSADPKFSRPVADTTRTMTVISEQVIKDQGATNLTDALKNVPGVGAFFAGENGNSTTGDAIYMRGADTSNSIYIDGIRDIGSVSRDTFNTEQVEVIKGPSGTDYGRSAPTGSINMISKQPRNDSGIDASASIGSAWFRRGTLDVNQVIGDTTAVRLNVMGEKTHDAGRDKVKNERYGVAPSVVFGLGTANRLYLNYLHVTQHNTPDGGIPTIGLPGYSAPSAGTAALNHSGKVDTHNFYGTDSDYDDSTTDTATMRFEHDINDNTTIRNTTRWSRVKQDYLMTAIMGGASNITQPTSDVNSWTWSRTANTKDVSNKILTNQTNLTSTFYTGAIGHDLSTGVEFTRETQTNYGVNPVTLPAVNIYHPDSSIHPGGLTRNGANANGQTDTFAIYAFDTLQITRDFELNGGIRLDNYHTEYDSATACGGSGRGAITCPAGVAKGSPVTTVDTAKSGNLVNWKAGALYHLTENGNVYINYAVSQQPPGGNNFALAQSGSGNSANRTDFKPQKANTSEIGTKWQVLDKRLLLTAALFRTDIENEVEQNDDGTYSQYGKKRVEGYEISVAGNITPAWQMIGGYTQQKATIKNGKDVAQDGSSSLPYTPEHAFTLWSQYQATDDISVGAGARYIGSMHKGSDGAVGTPAFTEGYWVADAKLGYRVNRNLDFQLNVYNLFDTDYVASINKSGYRYHPGEPRTFLLTANMHF

SEQ ID NO: 8922 - protein, 446 aa, Escherichia coli
MSQKTLFTKSALAVAVALISTQAWSAGFQLNEFSSSGLGRAYSGEGAIADDAGNVSRNPALITMFDRPTFSAGAVYIDPDVNISGTSPSGRSLKADNIAPTAWVPNMHFVAPINDQFGWGASITSNYGLATEFNDTYAGGSVGGTTDLETMNLNLSGAYRLNNAWSFGLGFNAVYARAKIERFAGDLGQLVAGQIMQSPAGQTQQGQALAATANGIDSNTKIAHLNGNQWGFGWNAGILYELDKNNRYALTYRSEVKIDFKGNYSSDLNRAFNNYGLPIPTATGGATQSGYLTLNLPEMWEVSGYNRVDPQWAIHYSLAYTSWSQFQQLKATSTSGDTLFQKHEGFKDAYRIALGTTYYYDDNWTFRTGIAFDDSPVPAQNRSISIPDQDRFWLSAGTTYAFNKDASVDVGVSYMHGQSVKINEGPYQFESEGKAWLFGTNFNYAF

SEQ ID NO: 8923 - protein, 811 aa, Escherichia coli
MNKIYILFLCLCYAVSAIMANTYKNDKEVTSPTDANIFGHVVDKATGEHLPGITIILKGTTIGSVTDDSGHYMLKNLPEGEFTIEVSFVGFKTVTKKVTTGKGKTQELNFELEEDLISLEGVVVSANRNETKRRLAPTLVKVLSPTVFEKTNSTTLAQGLVFQPGVRVENDCQNCGYSQVRINGMEGKYTQILIDSRPIFSALAGVYGLEQIPANMIERVEVIRGGGSALFGSSAIAGTINIITKEPIRNSGSFGHTISNLDGSGAYDNNTTLNLSWVSSDNKMGAYIYGQNRYRSAWDSNGDGFSELPKLKNQTIGFNGFYKTSAYSKLNIEYHHMEEYRRGGSGMKLPPHIAEDPELNGTGEAGLVEQLQHSINTGSLKFNLFTPNQKHNLSFYASGQHIHRDSYYSAYGRTTDFTGVTGAQYIYSFDKCLFMPADLTGGIEFSHDDLDDRATDKQKYREAALAEDPTATGQHLQELIEKYTPASLHQIINVWSAYAQNEWKNDKWSFLIGGRVDKNSIMDKAVFSPRANVRYNPTADVNLRLSYAEGFRAPQAFDEDLHISNVGGARVSIVRDPNLKEERSRSVNGSVDWYHYFGDFQVNMLLEGFYTKLSDPFVLSAPVESENGSLVQTRSNGSGAKVYGSTLEGKIVWRNKVQIQAGITVQRSLYDEPEEWSADKEHLTDAERYSDKILRTPNLYGYFTASYTPVKPFTIAFNGNYTGRMYVPHLMSEVNGTADVLVKSPDFFELGVKLSYDFRLTTAMTLQLNLGIQNLFDSYQNDFDKGATRDSGYIYGPGTPRTYYAGAKFSF

SEQ ID NO: 8924 - protein, 254 aa, Escherichia coli
MKKHLFTLTLSSVLAIPAVSHAEFKGGFADIGIHYLDWTSRTTEKSSTKSHKDDFGYLELEGGANFSWGEMYGFFDWENFYNDRHDKPGSEQRYTFKNTNRIYLGDTGFNLYLHAYGTYGSANRVNFHDDMFLYGIGYNFTGSGWWFKPFFAKRYTDQTYYTGDNGYVAGWVAGYSFMLGSEKFTLTNWNEYEFDRDATYAAGNGGKEGLNGAVALWWNATSHITTGIQYRYADDKLGEDFYQDAIIYSIKFNF

SEQ ID NO: 8925 - protein, 230 aa, Escherichia coli
MKKINAIILLSSLTSASVFAGAYVENREAYNLASDQGEVMLRVGYNFDMGAGIMLTNTYNFQREDELKHGYNEIEGWYPLFKPTDKLTIQPGGLINDKSIGSGGAVYLDVNYKFVPWFNLTVRNRYNHNNYSSTDLSGELDNNDTYEVGTYWNFKITEKFSYTFEPHYFIRVNDFNSSNGKDHHWEITNTFRYRINEHWLPYFELRWLDRNVEPYHREQNQIRIGTKYFF

SEQ ID NO: 8926 - protein, 866 aa, Escherichia coli
MCIGLALSCNAAAQQAASNADGAAPATSTLETVQVKGVRSSVESAIAIKQSNAEISDSIVAEDIGKLPDNSVAAALQRVTGVQVARAGGEVGQVLVRGLPNVITTLDGRNVFTTVGRDMELADVPAELLRSVEVYKTTGAQFQEGGIAGVVDVHLRRPFDFDQDSTIAGSVSALRGDQSGKTVPNGSLTISQRRDTAMGRMGWMGSVSYQRRPYQESNTLYGTYDAKPNPLDPAQQIYEPYSAGGLMARGDRKRKSANFSFQWAPSENSEVYFDTLYIGYDNRPQVNYWLPFPGLATPENTESVGLRPGSDVLAGLVARDMRTLSSTQAHKNASDTYQAALVGRWSGERMRASSELAYTYTTAENRSFTLDMNTQAPRLNMRSAGGAADVWITQADGSAYDITAPGNWELSQYYDSWNAQKGEEWAWRADATFDLELGPLRSVDVGARASRRTATNHSGDTGARDNPSGAPIYLSDVPGLASVTPGNMLDGARAFTSDRWASANQDFLLQQSIQVRTSMGQPPGPPDENPDLFFDDREDSYAIYAQVNYGFSLGSIPVDGRVGARATRLDSQLQGSQSLDGVLSPVSIDRRIDKVLPNYSANLSLHENLMLRLAGSTTITRPEFADLNPQLALYQSTESLPARGNGGNPQLRPVESRNADVSLEWYFRPGSLLSVAGFHRKIDGYIQNYAADESIDGIVYSISRPRNTGEGSLKGVEVGYTQFYDFLPGWWSGFGSQLNYTYLSAEADSPEGIGQPLTNVSKNSYNAILMYEYARFSARVAYNWRGDYVVSFNSSGDQPEQISQGREKWLDAAFNYELNKHVTLFAEATNLLGTTTNNYFGQRHGDFPREIASPERTYTLGFRFRL

SEQ ID NO: 8927 - protein, 614 aa, Escherichia coli
MIKKASLLTACSVTAFSAWAQDTSPDTLVVTANRFEQPRSTVLAPTTVVTRQDIDRWQSTSVNDVLRRLPGVDITQNGGSGQLSSIFIRGTNASHVLVLIDGVRLNLAGGSGSADLSQFPIALVQRVEYIRGPRSAVYGSDAIGGVVNIITTRDEPGTEISAGWGSNSYQNYDVSTQQQLGDKTRVTLLGDYAHTHGYDVVAYGNTGTQAQPDNDGFLSKTLYGALEHNFTDAWSGFVRGYGYDNRTNYDAYYSPGSPLVDTRKLYSQSWDAGLRYNGELIKSQLITSYSHSKDYNYDPHYGRYDSSATLDEMKQYTVQWANNIIIGHGNVGAGVDWQKQSTAPGTAYVKDGYDQRNTGIYLTGLQQVGDFTFEGAARSDDNSQFGRHGTWQTSAGWEFIEGYRFIASYGTSYKAPNLGQLYGFYGNPNLDPEKSKQWEGAFEGLTAGVNWRISGYRNDVSDLIDYDDHTLKYYNEGKARIKGVEATANFDTGPLTHTVSYDYVDARNAITDTPLLRRAKQQVKYQLDWQLYDFDWGITYQYLGTRYDKDYSSYPYQTVKMGGVSLWDLAVAYPVTSHLTVRGKIANLFDKDYETVYGYQTAGREYTLSGSYTF

SEQ ID NO: 8928 - protein, 147 aa, Escherichia coli
  misc_feature (70)..(70): Xaa can be any naturally occurring amino acid
MNTIHLRCLFRMNPLVWCLRADVAAELRSLRRYYHLSNGMESKSVDTRSIYRELGATLSYNMRLGNGMEXEPWLKAAVRKEFVDDNRVKVNNDGNFVNDLSGRRGIYQAAIKASFSSTFSGHLGVGYSHGAGVESPWNAVAGVNWSF

SEQ ID NO: 8929 - protein, 199 aa, Escherichia coli
MRKLCAVILSAVVWLVAAGTPASAAEHQSTLSAGYLQTHTDMPGSDDLKGINVKYRYEFTDTLGLVTSFSYANAKDEQKTHYSDTRWHEDSVRNRWFSMMAGPSVRVNEWFSAYAMAGMAYSRVSTFSGDYLRVTDNKGKTHDVLTGSDDGRHSNTSLAWGAGVQFNPTESVAIDLAYEGSGSGDWRTDGFIVGVGYKF

SEQ ID NO: 8930 - protein, 357 aa, Escherichia coli
MKRKVLAMLVPALLVAGAANAAEIYNKDGNKVDFYGKMVGERIWSNTDDNNSENEDTSYARFGVKGETQITSELTGFGQFEYNLDASKPEGSNQEKTRLTFAGLKYNELGSFDYGRNYGVAYDAAAYTDMLVEWGGDSWASADNFMNGRTNGVATYRNSDFFGLVDGLNFAVQYQGKNSNRGVTKQNGDGYALSVDYNIEGFGFVGAYSKSDRTNEQASDGYGDNAEVWSLAAKYDANNIYAAMMYGETRNMTVLANDHFANKTQNFEAVVQYQFDFGLRPSLGYVYSKGKDLYARDGHKGVDADRVNYIEVGTWYYFNKNMNVYTAYKFNLLDKDDAAITDAATDDQFAVGIVYQF

SEQ ID NO: 8931 - protein, 1378 aa, Escherichia coli
MSNPFYHQKNLVMKSSVPWLLISSAITFPLSSLATEKAALSSAPQNTGEQTLSSSDNYDGSSSSDTPFTCKNSSFASGTTYTLTSDVSFTNVSKTQDPKSQQSTAESQNSSQDTDKTDSPSAPTTDQSSDIENNKDSKGEEEENHPPHVLPEHSPTVDTGEEVTAPTEVPGTSETIETVGTPGASGTQGAPEDKQDKESSEEAGSTKVEEKTEADHEAKETEKEKETLESSLPHTPLSFTASSDVANEHGSPSPETKTPPTAVASQANGETNKSCFSNTDGSLTFVGGNHSLTFSNISVTAPGSAINNSAGSALTFSGFKDLSFVCATNQDQTKADSAIYVGPKATSGDGELSVQAEGSKANSHTEGSVNTALIKYAGIPADATATNGESQEDPATNVAPATQGGAEKEEAANSPDIILKQNVNITFSSNSSKTAGGAIRVSGSATIENNTGTCTFSNNNAKEQGGAISVNGNCDITGNKNVVFSGNQAQEIPAPSIVTVEEAAVEEPVEAKGSGGAIYCVKAPISIPATPIQPPKQTLPSLKSAALSGETHAKVAQKEEPSPDPCLTISGNASVIFDNNSSTVTGGAIHAKKVVLSSSGNMTFSNNSSGKGGAIYIADGGDISITATTGSIIFQGNKVTAADSITLPTKKEIAIAAESIEEKTDPSQASGSASAGMTSAFFTLANKAEIPAESQAKENSKPTCNSIHLGSGAKISQLRAQTGQTIFFYDPITTTAPAAAAVVTAKQPEASLAKATSGIPASASAVSVPAPAPTKTPLKINAPDTQDPEIQKVAAEAAQQSAVYNGKIVFSGEKLSSEDAKNPLNATSVIHNDVSLEAGTLVLSSGAGLLVDSFTQKEGSLIVMDGGTSIITNVTPASEGLQSRSTPPSPKNAIPVIRAVSKVIASSLINLRERADSGAGAVVPTIEESPDGSITITNLAVNLDSLENGKVITLAAKGGSGSVTLTGDLQFQDSSQNFYDNPLLNKNFTLNFLDISAPDAEKIHTEGFNIIPQGATSSNLGYQGKWEVTEVKDSSGKVSFEMKWVSTGYIPTANRRATLVPNSVWCSAIDMRAFQNLVEVSTEGEDFHRGLWISGISNFFHKDSTKVQEGFRHISSGYVVGVSTQPISNKVMDLAFCQMLGKSKDYRLADARSHVYAASIHTKCEKLVNHYTFSKRKGAILARKPEKSPIIFDAQLSYSLSHNSMTTKHTPNPSSRGKWNNHCVAGELGSYLPILVDHPAIEELFPFVKLHIVFVQQEDFKETQGGTENRNFQSAHFVNVSLPLGVRFEKTNKLNTYNIRLAYQPDIYRDAPKSKVFLPSVHTAWSTGATNLSRQAMILDGSDHHHLTDNLEVFCHGAFELRGSSRNYNVDIGGRYKF

SEQ ID NO: 8932 - protein, 254 aa, Escherichia coli
MYLGFPVQSILLFLLFSFTPLFVLAAEKTQLNFFLRPDTYLGFSVIRDTAHYNFKRNETSQELNFTDFDHFDWHGLGLGGEIYLGYEKFFRTHYYIGLEGFFNRSSNEGKIYFFDSNELYSRILKGSFKQKWQSGLAIHPGFYLPSVGIIYGRVGWIVSDVNLSGSITQSGPFGSFSGRFSNTKKKNGVQLGTGLELELTKNWRCRVEWDWNRLQDFIFDSQGRDSNNHRYQTTRIAKHPILEQFKLGLNWRFA

SEQ ID NO: 8933 - protein, 759 aa, Methylobacterium radiotolerans
MSAAQIERKRTEHSVVGYLTGAMSFAVVSAPALADTKKDAVSATLPEQTVTGTNGFKADAASGGKFTAPLLDTPKSVTVIPAEVLQGTGSVTLTEALRTVPGIAFGAGEGGNPVGDRPFIRGYDAQASTFLDGLRDIGAQSREMFNVESVEVIKGPSGAYEGRGAAGGAVNIVTKTPKLEHFTEGTLSVGNAAYKRATADGNYQIGEHAAFRLNAMAHDAAVAGRDVTSFSRWGIAPSIAFGLGTPTRATLSYYHLQSNDTPDTGIPYNNGTFNRRTDGRPQLFGPGDGAPVNVDRNVYYGLSRDFRRDRVDMGTFTLEHDVSSALKLRNTTRVARTSQDTVWTQPDDSQGNIFYGMVWRRANSRYSVANTVANRTEATGKFITGGLKHSYAAGLEFSRERSRNDTYNVATGSNRCPNGIGAAGGYNCADLFNPNPNDPWAGSIKLSNNPAETTVRTQSAYVFDTIELSPRWQVNGGLRFDRYSASATTSANAQGVRSSFSRDDNLLNYQLGLVFKPAQNGSIYLAYGTSSTPSGSVAGQGADTSALTPDRSGNRGDVLAPEKNRAYELGTKWNVLDSKLALTAAIFRVETTNARIVLQDGTAAMAGNKRVDGFELGWSGALTNRWQVFGGYTYLKSELRNNGGAGAAFGGTNGTAFPNTPKNSFSLWTTYQPMPKLTLGGGAYYVSKVWGSANPANPKWVPAYWRFDAMAAYRIDKHTTLQLNVQNVFDKVYFNQAYASHYASLAPGRTAILTLGIRY

SEQ ID NO: 8934 - protein, 704 aa, Methylobacterium radiotolerans
MVRQSILIFIAGVDVNKSNFSGSSGINALAGSANFRTLGVNDVITDDKPFGIILKGMTGSNATKSNFMTMAAGRKWLDNGGYVGVVYGYSQREVSQDYRIGGGERLASLGQDILAKEKEAYFRNAGYVLNSAGQWTPDLKKNIWSCNQTKPELAERIGSVQCTDYTRFDPRSKDRKKILEELNKGVNPENIPELQGREGDTFGVKATDKSFEDNKEQYSVAPIEPGSLQSRSRSHLLKFEYSDDHHTLGAQIRTLDNKIGSRKIENRNYQVNYNFNNNSYLDLNLMAAHNIGKTIYPKGGFFAGWQVADKLITKNVANIVDINNSHTFLLPKEIDLKTTLGFNYFTNEYSKNRFPEELSLFYNDASHDQGTYSHLGRFKGTRSLLPQRSVILQPSGKQKFKTVYFDTALSKGIYHLNYSVNFIHYAFNGEYVGYENGAEPILHKSGHKKAFNHSATLSAELSDYFMPFFTYSRTHRMPNIQEMFFSQVSDAGVNTALKPEQSDTYQLGFNTYKKGLFTQDDVLGIKLVGYRSFIKNYIHNVYGVWWRNGVVPTWASSNGFRFNIAHQNYQPIVKKSGAELELNYDMGRFFANVSYAYQRTNQPTNYADASPRPNNASKEDILKQGYGLSRVSMLPKDYGRLELGTRWFDQKLTLGMAARYYGKSKRATIEEEYINGSHYEKNTSSQRTYYAVKKQKRLKNNRLF

SEQ ID NO: 8935 - protein, 970 aa, Methylobacterium radiotolerans
MTRGLHRMPVLNLRALRAGTAYAALLAGALATPALAQTATAPAAQAADAVEEIIVVGSRIQRRDADGVGVVTTITEQDLKNSGAGSVGELLQKLPSAGVSLSTNGTQGTSYGASSINLRYLGGAEGSGNRVLVLVDGHRWVDGVGQRGFRDFVDLNTMPLGMIEGIEVLKDGASAIYGSDAIAGVVNIKTARDFDGVKLTAKYGATTHGDGQSYSTMANFGKRFDKSAILVSASYVKDKPILTTSRDLTRVTLVPVTAPGTSPNGLYILPGLSNNAYFGTPTGFATSASPVAFTAGATIGSGALADNAYRTASLPADYYNTQAQGIYSTGPSERWGVYARWTTDLSDSVRFKAEGLFNQRKSDQLFSPVLLDIGGSAGTIRGFSIANNQPFNPFGTANGVPTANALAFAANSAWRIRKVMTEVGNRDNVQDVKTWRIAGGFDGELNLFGREWSWDVYGLYSKNKIDTQALNGVNYDRLALGLGPNCATTAGCVPINLFSPMTAAQAEYIRFTARESNQTEIYDFTANITGELFQLPAGPLAIAAGVEHRKNKASDSPDPFVNALPTNIPTPASGSAFASNTTTTAQTRIATVGQYSLNEIYAEAAIPLLKDVPLAKTLDISLAARYSDYDTVGGDSTVKVGVGWRPIEDILVRGTYAQGFRAPSILELFQGGRQTSFQGTDPCNGGASANPSLPGCTGVPTGYNQVNFNLNGLIPGTISGNTKLKAETADTYSAGVAIKPRFAPGLSLTVDWYEITVRDAISSQSATQILNLCAQRAGVFCDLVSRDASTGAITNLLQGVLNLAEIKTSGVDTTLRYDFSNDLGKFAAVVDASYLESFKTTSPNPAGGAPIVDERAGKGDQPRSTYPHWKGQASFSWTGGSWNALWRGRYIGSTTDVVNAVKDAKTKAIFYNDLEGGYQFERYDTAISVGISNIFDKAPPASYANAPINYDIYTYDARGRYGYVRVSAKF

SEQ ID NO: 8936 - protein, 786 aa, Methylobacterium radiotolerans
MNARASLLAGLSSLALVATPATAQDAAAEDDGNIIIVTATKRDANLQDIPFSINAQTAEDIQKSGAVTLEDLSRNVAGLSVQNLGPGQSQVSVRGVSAGQVVRDQPGVKEQVGVYLDESVISLSLFTPDIDLYDLNRVETLRGPQGTLFGSGSVGGTIRYITNQPKIGVMEGSVEANLNLVDGDDIGGHLKGAVNVPMGDNAALRAVGYYTRYGGFINAIGPAGKEDVNSGERYGGRIALTFEPSDSLSITPRIVYQKVTADGFNRQEIYNLYANQFTTTRPAVTFDEREQYLLLREAFEDETLIADLKIDVGLGGATLTSVTSYINRDILVSRDASALTGSVSVDLGFPDAGVLLPSNLLDTTDLETWTQEVRVASDNDGPFQWLVGGFYSKIDRVYAQRLPTPGYDAVTDATLGAGTSAGARNGFGPDSPYNADLPYDIKQFAIFGEISYDLNDALTATAGGRYYDFKETRSFVSGGLFANGDNRTDSTKSSGFTPRFLLSYDVSDNVTVNAQASKGFRLGGVNDPLNLPLCSPQDAALFGAFQDYDDETLWNYELGVKTQGRGFTFNAAGFYNDIKNLQVTLDAGTCSSRIVFNVPKAHSMGVEFELGLSPADGLDLNLSGSLIEAEFDSTLPGALTVATGIRDGNRLPSVPKFQLTASGSYEWPIGDRANMYVAASFQHVGTRYTQPADQENNPRTFVHNLPFGGAPAGASTTVDLQLPDYQLVNLSAGVDFDNGLSLIAYVNNVFDENALLSFDRERGGRARLGYTVGQPRTFGITARKTF

SEQ ID NO: 8937 - protein, 777 aa, Methylobacterium radiotolerans
MGGTLKDLNFPAAGALSFVCASVLLISHTAAAQEAPAPASAPSASTESPTSATGRSLPAIVVETSRRRAAAMSPQRRPSQVSRSTASRRAPNPASAAAQPRPVSAGALQATLPAGFPGDQVARGAGVGLLGNRDVMSTPFSLTSFTEKLIRDQQSRTLLDVLGNDPSVRSNVPAYSGIQGFFIRGFPVFAQDIAFNGLYGVADSFNPALEPIERVEVQHGPSTMLSGMPPFGTIGGTINLIPKRAGDVPLTRFTTGFISNAQSYNAIDVGRRYGTNGEWGIRFNGAYQSGSTPIDNQKQEYGVTSLALDYRGERLRVGLDLGYQKVDFNSPLRNRSVLPGFPIPQAPDLRINQQQPWEYRDSNNKSAAIRAEYDLTDQLTVYAAYGHSEFHQVYFGGLPSIINARGDYRDTIQLTPFQTYSNTGEVGVRGQFETGPVKHRVGVAASGLWQDTGLTNIPVGAAITSNIYNPVYAPPRSDAGLPRTSPTTAERFNRSIAIADTMSILNDRVELTIGGRWQGIDAKTLSPVTGLVTSDARNDAFSPGAGLVIKPIERLSLYANYIEGLTSTAPPTNAVNLNQSFPATVSKQVEAGAKYDFGPVGVSVAGFEIKQPSGFLDPTTGVFALNGEQRNRGVELNVFGQPIQGLRVVGGVSWIEGVLTKASNPAYNGNTAVGVPTMQLNLYGEYDLPGPARGVTMTGRVIHTASQFYDQANTQSIPAWTTLDVGVRYTTKIDRVPVTLRANVQNVTGENYWATTGRGILSPGAPRTYLVSASFDF

SEQ ID NO: 8938 - protein, 808 aa, Methylobacterium radiotolerans
MRTRMTKLSGAVALIMAGTAMTPALAQGATDSDANYRDEIIVTAQKREENMQKVPIPMQALGTAKLEQYNVSNFNDYTKLLPSLSFQSGQPGNAKVYFRGVTSGGDGNHSGSLPSVGIYLDEQPITTIDGALDIHIYDIARIEALSGPQGTLYGASSQAGTIRIITNKPDPSGFAAGFDADINKVSHGAVGGKLEGFVNQPLSDAAALRVVGWYQRDAGFIDNVPGTRTFGTGVTINNAADVKKNYNRSTVIGGRAALGIEIDDNWTVTPTIFYQDQVNNGFFGYDPSVGDLKVQHFGRERFHDRYWQAALTVQGKIADFDITYAGAYLDRHIDAVSDYTDYAVTYDNLYAGGFSGYFTDNAGNYIDPSQHIAGRDHFTKNSQELRISSPSDKRFRVLAGLFYQRQTHDILQDYQIFGLADATSVNGRPGTIWLTKQFRVDKDYAAFGEASFDIVPDKLTLTGGLRAFKYNNSLVGFFGFGDGYSSRTGVAACFTDANGNYVGTLLPGAPCNNLGVVSGNNVLPKRVKGNGTTHRLNLTWKPTDDLMVYATWSRGFRPGGINRRGTIPPYSPDYLTNYELGWKTTWLDGKLRINGALFWEEWKKFQFSFLGANSFTEIHNGPNARSKGIELDFTFRPIEGLTLIGSGAYTDAKTRQNLCGIDDPTYSCAGAGNFISAPKGTRLPITSKWRYGGTARYDFDMGGKYQPYVQGTMTYASSASSDIRTLIFDPNGNPVNPAALTGKLRSYAIFDFSAGAKFGRWTWEAYVENAFDKRAQKTRLVTCGQCFDRPYVFPNTPQTIGMRIGWKY

SEQ ID NO: 8939 - protein, 230 aa, Methylobacterium radiotolerans
MSFSNYKVIAMPVLVANFVLGAATAWANENYPAKSAGYNQGDWVASFNFSKVYVGEELGDLNVGGGALPNADVSIGNDTTLTFDIAYFVSSNIAVDFFVGVPARAKFQGEKSISSLGRVSEVDYGPAILSLQYHYDSFERLYPYVGVGVGRVLFFDKTDGALSSFDIKDKWAPAFQVGLRYDLGNSWMLNSDVRYIPFKTDVTGTLGPVPVSTKIEVDPFILSLGASYVF

SEQ ID NO: 8940 - protein, 815 aa, Methylobacterium radiotolerans
MPPSLIRRRIYPAPFMAGLALLYSGIHVHAADAATDTKTSKPKHHRHAAGKAAAAGKAAAHNPAKAAPAPAVAATGTTAARPLYAPPGTTSTITPTEENLTVVGSPMNILHQDIGLSRMPQDVMHTPQTVNVVPQVLMEQQNVKTLDEALRNVPGITASVGEGEGGMSGDQFLIRGFQAQNDIYEDGLRDYGVYSRDSFDYDHISVIKGPSSEVFGNGTTGGAINMVTKMPHLGNSYSGQFSGGSADYYRGTLDVNQQIGESTAIRIAGMGNENDEVGRDDVYSHRWGIAPSIAFGLGKPTTLTIEYFHQTDNRIPDYGVPLLTKPGTTIARPATEFGVNRNNWYGTQYDQDDSNVDMLSAHLKHEFNSHITFYDDLRGGMYQRYFSASWEGCNATCNAAYFGNDPASALVDRRGHLGGPEPYQQNDWSVQNVASAIAKFNTGMLKHQIIAGWDVAHVYDRRTNYAYNYNGLNGTQTDTTGLVNPTNFVPGLLLGNVGQYSSNLVNISGVGRALHKTGVATDVGAFFSDQVWFAPWFSARAGFRWDHWDSHYSANEGMVGTGVSYGQNQDTYNPTVNLMYTPNDDTMVYFNWAQSTTPLGLYVTNSSEPLRATNEGYAPERSSLYEIGAKYNAFHGRMGFTVSAFRLEKGNSLLTDPTTGDVTPSSDRQRNQGFELSASGEILKNWNVIATYAYYDAKTIASATAADVGKRIQYAPKNSATFWSTYTIAPATPWNVTFGGGLTWRQSVWLDPANTAKVPDTVEWDAMISHSFLKHWKVAMNGYNLANRLNYSNLFSDRVTPSTGRAFLFNISATY

SEQ ID NO: 8941 - protein, 777 aa, Methylobacterium radiotolerans
MVPIWNFYGLHRASRLLLALGCGFAGTLAVVQDAGAVPTVSDLAATGGRAADLLVQEPSPAASPAPEPAVPVEPVASDPVPPAAVGSETFELDDVTVTGSFRRQRVRDIPGSVYVIDQKEIEQKGARTVGDALRGVPGVVSNLSGAGADVHSTYFIRGLPTTSTALLIDGRSLNNLNQEHVDLNELPVAGIDRIEVLTGGATTLYGSTAVGGVINVITKRPPKVFEGNVEVTYGSYGYSDYRAYVGGPLGESVRFNLYATYFNTNNDFFYRVERPGGPVPVFEDKRINGAFTSTNYGFDLDWEIMPRTTLNFTSYYRQGSRGISLFAIRDPRTSIPARDEAGNVVNLSADELGLNGALFPRILIDYYGFAVTSNTRLGEADDSNLQVRLSYDRGRTTEQEVEEGETEFATNDIGIFGTRVLHTWQVAPALNLSYGFDFLREGGNSFGSENPLIYEAAISQPSLFALASYKPADDVTVTLGLRGIFGTRATSREFNRDFNGALTPSVGVRWQVIPQLALRSTFSRVYKTPNFNDLFGRGEILGNPDLLAESGSTFDAGIDWQPSPTSLIRFSYFLNDIDNLQGYNLIEENSPEDQLLIDKFGYELNERVRVNFPRVRSSGFELAASWQFAPYWTLFATETYTDSRVEQAFKPAYTQTQYPLVPFHSGRAGFSYDSPGGFRGALFVNFQGLRSSDPLHIGPGFAELNSPAGLPIANAFALPPGALLPGYTTLDFSFRVPVTENLSVLGYLDNLTNTRYERNYGNGAPPVNFRLGLKAAF

SEQ ID NO: 8942 - protein, 363 aa, Methylobacterium radiotolerans
MKKLLLASAVAALSVSAANAAPTVYGKIFMTADYVDEELKNGNHDENGVEISSQGSRVGFKGLEPLSANTDVVYQLEYGIDVDGDDHETFKNRDTYLGLKNNSFGEFRAGKNQSTTDYINNVVVNEGYWDNLGSTKLGDEKEVSALTMADSSRINNSIVWMAPKFEGVPVQFAAMYANDDDYAGEKNSGWGASLLFDQGAGYTFGLAYEDDLNLRSEVETVTGKVFNGGDLIRGTATLDLATFNSGFPVTLGALYQEADYDNGDKKEKGYVISAQMGLTNFAKPATIYTQYNNTSNLNGVDGFDSSQIVVGGKYYYQKNMIAHAYIGQNDADNVVKIDKFGNRSPNLGDGKVFAVGGGLEYKF

SEQ ID NO: 8943 - protein, 1140 aa, Methylobacterium radiotolerans
MTRLKWTAMILGGASALALGAGTAMAQQRNFDLPEGRAADVLPSFALQSGLQIIAPSKKLRDTRTPRLQGAYDARQALKRIIRGTDLVIASDRNDVVTLRDRNLSALRGDNAAQRPIAFAQMQVAGTMSDAAPAPLPAEPQGNDGAEIVVVGTQIRGAKTTGALPVSVVGQEQVDAVAAVSGGDLFRSIPQLGGVTFNEQVLGGGSGNAARGDVSTVSLRGLGQGNTLLLINGRRTVLHPTSQAITGVVDSGVPTFGFNANTIPVGAIERVEVLRDGAAALYGSDAVAGVVNNVLKSNFTGATFDAQYGAAEGTNLREFTVNGLVGFNFGGGRGNISLFGGYAQKSKLYLSDQDYTANLDRRPYVVGTAFEGNAAFNGTSTSTPWGTFQATGSGIITSNGVALTNASQQFHIQPATNPGCQVAATTPGMCWDDASGTTQMATVDSNLRYDANQTFPDLTTQPSVKRINLFSFINYELTDNLDFFGELGFYRGKTDAIIGSGGSLGNIPITVAADAYWNPLGPTLLADGSANPNRLPGLVGVPDEGLPVTIRSLNYVDAGQKRVNVTNYQYRFLGGLRGSFGDWNWETAGLYTWATVKDVMDGTSSTLLQAAINKTTPDAYNPFNGGCVDTPAVGDCTPNDEAVVDSFRIQSTRRNKTSLALWDLKISNANLLDLWGGNSIGIASGVEFRRETYRDNRDPRQGGVAGVDITYTDAVTGIFYGSDLMGASPSPDVSGSRKVWSAYAELALPLVSPEMEIPMIRSFDIQVAGRYERYSDVGDVAKPKVAASWDLLQGFRLRGSWSQGFRAPNLEVLNTATLDRVNGGIEYILCEADLRAGRIGSFSQCARNVSVLRRSGGNPDLKPEESTSWNFGAVLQPPLPDGLGQVTFTVDRWRIKQKGVVGLLDYQNALNLDYLLRVQGSSNPAVVRRDPTADDIALVAGTGLAPVGELLYVTAPFQNLLPIQVDGIDFNLDYRVNTGSFGNFSLNVNAARLIKYQVDAPAAVQAVIDGQADGTINAAVPVSGGGDVVKRDGQPRWRISGNLTWDYGPVRIGAFTQFISDVYQNGVFDAAGNNFVVKGQTTVNLYATYKFDQGMMKGTAITIGARNIFDKNPPLASTGYLSSLYQPQARYWYTSIKKSF

SEQ ID NO: 8944 - protein, 679 aa, Methylobacterium radiotolerans
MSRSTPRPSRSLLWRLSPLSAALLIASQAHAVELPQQVITANPLGSTELAAPSTVLEGDQLTLEQKGSLGETLNKQPGVSSSYFGPGASRPIIRGLDGDRIRILQNGVGALDASSLSYDHAVPLDPVNVERIEIVRGPAALLYGGNAIGGVVNSFDNRIPTEAIEGIHGAGELRYGGADTTRSSAGKLEAGDGTFALHLDANSRQFNDLKIPGYARSRHAAASEDGDGKKGRLGNSDGRQDGGAIGGSYTWDDGYAGLSYSNYDSNYGSPAEEDVRIRMKQDHYAFASELRNLQGPFSSLKFNAGYTDYEHREIEGGETGTTFKNKGYEARVEARHQPLGPLEGVIGAQVNRNEFSALGEEAFVPQTDTNSGALFILEELQATERLRLSLGGRLEHTTVDPDSKGNTRFAQADKSSSFTAGSLSSGAVYTLTPVWSLAATLGYTERAPTFYELYANGAHVATGTYEVGSAKLSKEKAVSSDLALRFDNGIHKGSVGVFYSHFSNYIGLLGTGRTLNDEGEEDATGIPEYAYSGVRARFSGIEAQDRWTLGENAYGKFALELSGDYTRAKNLDNGQDLPRIAPLRLNSGLLWELDRWQARLDVQHAASQGRVPDNESGTDGYTTFGASAGYRFDIGHSQWLAFVKGENLTNQTVRYASSILRDIAPAAGRSVEVGLRTTF

SEQ ID NO: 8945 - protein, 638 aa, Methylobacterium radiotolerans
MRGFDSSSSIYVDGIRDLGSITRDVFNLEQIEVTKGPSGPDYGRTSPTGAINLITKQPFLHNANTASISYGTASQRRITSDLNLIVSPDSAFRLNIMGQDSGVPGRNNVKNKRWGLAPSAAFGLGTSTRVFVNLQYINQNNIPDGGVLTIGLPGYSTPDSTRTQISTAPRVDSKNFYGTGSDFEHVKSSMTTVRIEHDINDKTKLQNTLRWGRNEQSYLLTSYRGNVENLITPDLADPSTWTMNREIPIFKNQTNTILTNHTNLNRTLKTGPIEHNIATGMELTRERMQGYGISSSGRWPAANLYHPDPDVSGLHWAANGAYANGRTDTTAFYLFDTLKLNQHWQLNGGLRWDRYNTDYAALLCDPVRSRIYCNTTPITLNRFNGKTSGTLFGWKTGILFKPTEHSSLYINYAVSQQPPGGSSLDLSAKPQDANNPKYQTQAARTAEAGVKWNSSQEGLQLTAAIYNTQVKNDIVQDPIDLQYYQNGKKRVRGVELSAIGQITDAWSMSAGFTTMDAKVKQGPAVSADGSLTLAYTPSQAFTAWSTYTLPFGLTIGGGARYVGEMKRDSKTAIGTPTYIESYWVLDMVLSYRLNKNLDLRLNSYNLLDKNYVAAINKSGYRYTPGTPRAFLLTANFHL

SEQ ID NO: 8946 - protein, 778 aa, Methylobacterium radiotolerans
MSLRRMFHHKKGVIPGLLAAALLAPALAHAFEPFVVRDIRVEGIQRTDAGTVFGYLPVKVGEKFTDEEATEAVRRLYGTGFFSDVQIQTDNNVVVVVVQERPTIASISFNGMREFDSKAITKSLAQVGFGEGRIFDQSMLERAEYELKEQYLAKGKYGVEVTATVTPLPRNRVGVSFDVFEGEVAKIREIRVVGSKAFSEGELLDQFDLTTPGWLTWYTNTDKYSREKLEGDIERLRSFYLDQGYLEFTVEPPQVTISPDRKDIYITITVHEGEPYKVREVKLAGNLMGLDSEINNLVEIKPGEVFSAAKANNSAKAITNYLGDLGYAFANVNPNPQLDRAKHEADVTFYVDPSRRVYVRRIQIGGNTRTRDEVVRREMRQQEAAWYDAGDIKVSRDRVDRLGYFNEVNVKTDPVPGSPDQVDVNVDVKEKPTGIINLGVGYGSSEKAILSAGISEDNVFGSGTNLTLQLNTSKTNRAVVLSHTDPYFTKDGISRTTSAYYRVTEPWDNNDGDYRVKAMGLGMNFGVPISEYDRIFLGGTFERNQIDLYNNSPQAYRDFVDQYGNSTNALIFNTGWSKDTRDSALAPTKGAYTRLKGDFSTMDLKYYLLTAQQQYYLPLGRSYTLALNGMIDYGRSYGGLDYPVIKNVYAGGIGTVRGYEGASLGPRDRLTGDYIGGSRRMVANAQLYLPFPGASKDRTLRWFVFTDAGQVAAGSGMSCTAGKPDSEVEDPCGWRFSAGIGLSWQSPLGPLQLSYARPLNSKSGDDTQAFQFQIGTGF

SEQ ID NO: 8947 - protein, 802 aa, Methylobacterium radiotolerans
MTSDLSKKDSRFHPSAIAAGVAAAIGATAPGMTFSAELEEVVVTARQRAESSQDIPMMVQSLSGEDIQKQGITTLEDFSRQVAGLNIQTTSPGQNTIVFRGVSDGGGFLVDPTAAIYLDEQPMSMTSMAPDIYPVDLARIEALAGPQSTLYGASSQSGAIRVITNKPDPDAFSANIGAGVSSTSDGGTGYELDGAVNIPLSDSVAIRLAGFSARDAGFIDNVLGSTVVDDVFGSGLGGQKDNSGMVGEDINEVNWLGARASIRWLVNDNWSVTATANYQDLESDGFNDYDPSVGDLETIKFVQETRTDEWLQTSLVIEGDLGFAQLVSATSYYDRDTLYVHDTQSYAAYFHYAFGLYYGYATYDFGLDPTGYLVNDQNNESLTQEIRLSGSTDRINWTLGGFWQESEEFWDFYTYVDDYRNSTAFETWSYYYPGIAPTDAWWNSYQATDRTDKAVFGEMDVVLIEDRLTAILGGRWYEVDRELSYTVERPDARVDQQLPNRTASDDGFIPKYGLELQVLEDVMVYGVYSEGFRVGGTNRGRGLDRGGPTLPVDYQSDILENTEFGLKSSFFDGRVVFNAVYYTMKWNDMQIEVVDPSNALGTFSVQDENGDPLYGNIPFQIVVGNVGNATVKGFDFELKALVTENLEIGVNLTDIQDAYVNGQEFYDEPRAQGGKVPSGLQAQSSLPLFADTSYYLYADYSGINMFGGEVGVRLQHSYVGESLNQLTDGFTSPQRVQGDYDITDAILSFESGDWQAQLRFSNLTDERGITYQDTSDFDTVWGRNSSSVIRPRNYSLTVRKAF

SEQ ID NO: 8948 - protein, 1604 aa, Methylobacterium radiotolerans
MSLQNSHSKKYVLTFFMSTCLLTSSFLSTSARAASFTQLANQIPTLSGLSEVQRKQKWNSYTLQEKQEAWRRAKLTPDFVQAMIDMQTGFTESDLSSRNNKTRHKAREKKSELDLYIAGTKQGFKEKVDGYISQGKIPTPEEAAQNLEIDYDAKKTDNKLEKNQNVRRVEKDKKALLDLYIHSITTSVKEKEYITTGQVPELGELEKALNISKEEAKHRRTIIRDQVMANERPKLVRSGTVLTKKELHKRFGKDTTTDDTKYIDDITTEVMYTKKQGYVNTDFLPKISEIMNEFKVDKGRANLYLNQIKAGIEAKLLADNNQTTTKPFTKHSRTTTNTAGISSGVPFDTGRTKPETKSFDFKRSMYSLLNRKQEDQLSKTEQHLKQQIKLEENKEEFKEILTKNPIDALLFAEQSNLGNSFKQEAISNIDLSKDISRILFTVDDKGNRTILNTILTTTPEHKDELIKQAQHHAIQTLPTSISDKDVSDKKKLTLATLAATEDKKVLEEALDNWLSTNGYKRKPEVESLISILLSDETTLKAGIDKIFELPVENNVNNNSNKGQNGTPILPPTPPLNGSMPPSPPPPLLNGTPTSTAFNNSNPNHKFDLKNFEATYPRLYKSYNEFIQNTTSASQSQATTTSNNIPDTKAKMGESLELLKQKVAKQNEVIGLIHNEVTKLYNFSPKTFVNLFNTENEEIIKKIEQIAKREDIQKILQDNDIKITSTFVSKIFNESLEQTKQRLRSSNIINAKQYKRIEQYANKQECVTEFLRITNPLEQLKFANKYINILGQSTFNGKLNELIENPNKLTFSQKINFVLQGYQELTREIPTAKANLNKLKQNILEKIEIQQLIANKDISRKDLLDILNNKNPELLKSLLEAKVILEENKLNNSANEVDLKEIIPSLNYLTSEQLTSLINRITIEGVKTALKAKWQQENKTVSNNTEKPLIYNNGTPMPPPIPNGNSNFGTNDYLISMGYTQEFIDRMDKVKPNNNFGKNHNYTATDFKSNVGKNYYESTSKLGGTDILLTDSQKLENAIKKEVLAKYIEEPNRDMQDDSLLKQAFEEKFYYAEDKNTKVIPKPSEVNFDPNFIGPRTEVGQEIYELYEQELLKLARDPVFIEYVKNNNNTQKDERELLISFIEQIESKRPELEQKYGSDVQSEDNNQEKKVGHLNMKQFQSLFQQENESANDESSTKDDPQPEDSNKKSEKSDSETALSPRLLSSNDSKNDKSSDDKKSLLVLRSSEEESKKDIALESEDEAIDMSFKTEAIAEQDEATQRQQVSDDTNRKVAILVKATSTLHKPVHYNILSDRLKVAAIGAGDEEASINRGVWISGLYGINKQGTWKNIPKYQGRTTGVTIGADAEFINSHDVIGIAYSRLEFQIKYNKKLEKTAVNGHLLSIYGLKELIKGFSLQAITSYGHNYIKNKSKSINNIIGKYQNNNLSFQTLLNYKYRTKYDLHFIPNIGFKYDYSRASNYKEYNVDIENLMNQKKSNQSFESSIGGKIVFKPIATVNNIILTPSLYGNIERHFNNKNTKVNAKATFKGQTLQETIIIPKQPKLGYNIGSNILMSKKNINVLLEYNYYTHRKYQSHQGLIKLKVNL

SEQ ID NO: 8949 - protein, 940 aa, Methylobacterium radiotolerans
MPKYKLLSASIAFSLLMSHQAYAHDEAFDQLSTKIAGQSQSWYQHLDAQVVTPFPKKGTLEAEVDRKISWDMQNNTTAERLALAKEDKNQSFAHVSHEFRKSALKEFAPHITDEQFVNIFKNLEYLSANAIYSDDSNVGRMRAYDFILKDKYLRGRPYQVMDREGKYIEGYENLKTYIDSQGRERKNSSYPSGHTSNGFGQAVVMAMAFPERGQEIFSRALQYGESRVIVGAHFPTDTMTSRLARYYYMAQLLNDDEIAQGLVRYIKQARQPFEESCQNAPLKSCLEMLSQDLHEQYKASDYHIGYYGTLKSDEKASRLEPEEMPGTAEALLRLRFNYLDGDARRQVLASTAYPKNSHAHMGDLDNKNHTWGLINLPKAYDGISHIYQDIETTTQDKHLDFAGFSLEDTWKNDISGTGRLILNHPGELTLSGNNTFAGATVKQGHLKFTGNNALADDSYINQGTMSVTGQFQSKVVLNHDAKMMIVGQSDQPTTVQEIELSAKDSWIYVAPKGVFQVNANSQENNTTTDSQISIQTLSGVGHVMVEDHSNLHIDKLSGETIFAINPSDAPVKINELKGRHGVGIPSHISKDKNHQSLLKVDNNQGSFYLIDTNNNVVDAAEQGAYAYQLVMRPNNTLQLSQFANDNSPIASSMTKTALNTGMGSLYTLSSQMNHLGSMNNRQSVWLNHRYQENNIKSHNTQFDLKLNQTTLGAGSKVGQTYLGAYINKSEGDVDHVFGGKNDLDATGFGVYLNRLLPNQQEIFLQGAWQNVRQKIHAKQANHDNLTASIKDNTWAIALGAQQQMKFHNVDFQPSFEIGHIQTNPKSFRYDQMPNLQINPKKASMTTVNIGTKISKNYGLLQPYLKAKMFYQDTKQDLNIIDMNNEVSWWSTDLSGFGFAGALGVTSQINSRFFISGEASAQYQEEVKTPIEAKLSLNYQF

SEQ ID NO: 8950 - protein, 170 aa, Methylobacterium radiotolerans
MRALLFFILLLWFKGCGYKPIAAYAQNALGDSVYVKLIVNLPNPENSVEFKDLMNRLVVQRFQSRLASEKDADSIIIIEITNVTDTSITQNKEGFTTFYRATVSVNYTYDNKRGTQKTFQDSGYYNYAVNLQDPLNTYQNRYYAINQAVEQTLTKFVAQIAYEGKFNNEK

SEQ ID NO: 8951 - protein, 276 aa, Methylobacterium radiotolerans
MTKLLASLAAFTALTAAASAADLPRRAAPPPVFTPVPVFTWTGAYFGINAGYAFDASSRTNNTFAVPFPYAAPGTVASFRDRSQDGFSGGAQIGYNWQITPGSGVVIGFEADAQYLDFGRNRNNAFISGAVAPGYYVTDPRGLSSLDYFGTVRGRLGYAFDRTLVYATGGFAYGSGSADRSFGGYAGNDSFRTGYAVGGGIEYALPTDSFLNFFRSSAVTLKVEGLYVNLERGTRNQGALVVNAANLVPVAYSAIGRRDDEFAVVRAGLNYKFGSY

SEQ ID NO: 8952 - protein, 191 aa, Methylobacterium radiotolerans
MTKLLAKAQILILIGSVLALSQGAMADRERGVYIGGGLGQADIGVDNFLGGKIPVKTAELFAGYKYNNWLGLEVRMGASLRDETYALDSTSPTGRIELASLWINQYRSIYYRPEITNDIAKIYGLIGMTLAQTTSTIKDVDYHASAEGNSYGIGAGLILNEKTYFNLEYRILIETEIDTFSIIGFNVDYRF

SEQ ID NO: 8953 - protein, 826 aa, Methylobacterium radiotolerans
MARSDNRPTAGSPAPAFLALGCIGFIASAPALAQDAQPANGEKRLGGMTVTDTAIDEEGYKAERVESPKAVAPLLDTPRSIVVVDKQVIKDTGSATLVEALRTVPGITFGAAEGGNPIGDRPFIRGFDSQGSTYLDGVRDIGAQTREVFAIEQIQVVRGSDSTLGGRGSAGGSLNIVSKLPQEETFFAGSGSYGTDDYKRVTGDVNVRLSDKVAFRLNAMWHDQDVAGRDAIYQKRWGVAPSVTIGMDGPTKLTLAYYHLDTDELPDSGIPFLYTCSTTLCNAPAGNVITAPALGDITTASGVTGHVGRDTFYGLKSRDFRDSKTDQATIRAEHDFGSVTLRHTARFSHSSQAYSFLLPDDSTGNVFGNPANLAQQPGGQVWRRANTRFGYTDSFINQTDLYGTFETGSIKHSFAIGAELSSEKAERGAFVLATGSTISPRCSALAIARYYCASLFNPNPNDPWINYSNDTATGVPTPITRAAPSARTQNEANTKAVYAFDSITLTEQLILNLGARYDRFRTTSTLPLTGGTRPVVRRVDNIFNWQAGLIFKPTPNTSLYASYATAATPPNSLLGEGQEQNALNAVQAASDALRVEKTKSFEIGAKADLFGGGLSLTGAVFQTKTKNARVTSDANTVAFIGERRIRGVELGFNGNITDEWSVFGGYTYLDAKIVDGGFSTLTAAAVGSQAAKTVLVQSVNTGKQFPQTAKHTFTLWTNYKVTDALSIGGGAFYSSRVYGGYADNRKAVQDAAGVVTIVPATTTLARAVPSYWRFDARVGYKVSEAIDLSVNVQNLTNKTYFNQVYSSHYASIAPGRSAFATLSFKY

SEQ ID NO: 8954 - protein, 326 aa, Methylobacterium radiotolerans
MGKGILITAGTVIALMGIVTGTSATPLPTNQSIEGNRTVQLGKEQIEVSGRLGFGRIWGESRELVYEKNRKVSELIWPLDNVYMLNAGVSVQPSSWLKLNADIWFAVSNGGGKMDDYDWTAQGMDWTHWSHDEDTPLDRGIMFDINAEIPFYHINRTTFSAFLGLKQDNWKWNSYGGSYIYSHNAFRDSTGTFPDDELGISYEQWWTVPYIGLGFASSLSNWDFSGRLIASPFVQGRDEDMHHLRNLFFEEDFDNSFMWSIDLAANYKIDPQWGIIGAFKYQYYQEALGTTTMTNMVTGEQVFFGGDAAGGDNRALLLTLSLDYQF

SEQ ID NO: 8955 - protein, 810 aa, Methylobacterium radiotolerans
MAVLGGFCPFPPVAGPAAWEFGPSWHVHGQTPRLAGFLTAKPSARSACTCAARTFPILETIMIRSRKHGLKTSLALIAAMSGTLHAHAEADDARRSDPEKREETVIVEGESLYIVPHVSSPKLTQELVNTPQTISVISGQLIADQGAVSLMEALRNTPGITMQLGENGNTSSGDTFTMRGFSSQSSIFQDGIRDLGAVTRDSFNLEQIEVAKGPAGSDIGRGASSGYINQVSKTPLDDDFTSLFAGATSEGGVRLTGDANKMLTGTAGVRLNVMVQDMPVPGRDEVTNKGYGIAPSIAFGVGTGTEFQLFAQHIIQENVPDGGIPSIGLEGFYNADETLLAGAAVDRSNFYGSKSDFEDVEANMITAKMIHDLGGGLTLTSTARYGKTQMDRVLTGINGLDAPSSDPSTWTVSRSRQRVDQTNDILGNQTIITGSFNTGRLVHDFSTGIEALNESQKSGSFSTTGLTTPAASLYNPDPNIVLPTPYPSGGKADGSTTTLAAFLFDTINLDEKWYFTAGIRAENYETDVNGVTITSSRSHPDLPPGTALAYDLSDDGNLVSWKLAGLYKPRENGSVYISYGNSLTPPGGANFSLSSGESSINNPAFDPQETQNLEVGTKWDLFGEHLALAAAYYSTTNKDELSVLDPDTNTYEQLGERKVEGVELSAVGKITPDWQVSASLTTIDTEVTEGTTGNNSEGASSRWSPDLAATVWTTYNLTPAFTFGGGARYMGEQKRVVNPGTDISTQNVPVIPEAWVVDAMARYQFTERLALQLNVYNLFDEDYISTLNNSGARLTPGQPTSAYLSLNVRF

SEQ ID NO: 8956 - protein, 880 aa, Methylobacterium radiotolerans
MRATTKHTLLASSIAMIISTGQLWAQESPTDTGANEDIEQISVVGIRSSIASSVARKQESGQVADVISAEDIGKFPDLNVAESLQRIPGIQISRSRGEASGVSIRGLDEVATLLNGRNYFGGASGVSINRFASFEDIPAELVGSVVVYKSVSADILEGGIGGVVDIERTDALSLSGPTIAGSVKEHYGDLSKEWSPRGSLVAGNIWDYGNNGGEIGVIFGVSYLEREYREDLVRNSSATSIVGDFAGGTAPDGAKTSASLNSSPAWGDRERTVYSLGIDVSLNSDTKFYFDSGYTDYSTTQLRQEFVWGFDGANTVDADFSNIDENNVYPRSVTLSDMNFDVLSMIDDRYTTTYDLALGFETVAGPWSIEGEVSYVDTDNDTNFHNTRIRDSWDALPVTINNSGIPNQPPSVDFGTFDVTDEGNFDIVQWRHESRQLQADESAAKLDIDYAFDEGLVRSIEAGLRFASLGTTKNIQNNHIFDASGATYGSDDPLNLVEPSAWDDFMDEYDGGNFPNDYVGVNPNYLLSRNDEIREFYGFTGQSETENPRDSFEYEEDVTALYIKANLETEVGGYFISGDIGGRYVQTDTTADYFFDTGNADESGAPIYQGTKSEKNYSEFLPSFNLKVELNDELLLRLAGSKTFSRPHFGDLAPSLNLNFEQGRGTGGNPDLDPFTATNLDLSLEYYFASGGMASSAIFYKDIDGFLQTSESQETIGGNDFVILRKSNGGSGTVRGLELAYQQFFDFLPAPFDGLGVQANYTYVDSDVPSPNPLLPNISLEGLSDNSYNLVAIYEDDLVSGRLSYNYRSDFLVTTEVAQEGFGQLDLSLAYNVSESFRFTLDALNLLRRDHFEYRAGDKYDPYHWIATERQVLVGVSYTF

SEQ ID NO: 8957 - protein, 766 aa, Methylobacterium radiotolerans
MHISASQRPRGHTARSKRTMKSRPDELKLGKFTTLCSVLAASPAFADGTPPAAPASTEGHLAPIEIQGKTEHSYKADFSASAKFTAPLVHTPKSVTVIPQELIQSSGAATLTEALRTVPGITFGAGEGGNPLGDRPFIRGYDTQGSMFVDGMRDTGATTREIFNTERVEITKGSDGAYGGRGGAGGSINLITKAPHLGTTAAASAGLGTDRYRRFTADGNWQFAEHAAFRLNLMSHNNDVAGRDAVNNERWGVAPSIAFGLGTPTRVTASYYHLQTDDMPDGGIPYFYTTSNKPANVGTIYPAPVDRHNFYGLIDRDFRKTTSDISTIKIEHDITPNLTVRNTTRYTESTQDYIWTQPDDSQGNVVNGKVWRRNNNRNSSINSLANLTELFGEFRTGPFKHSFTTGIELSREWGKRDSYTVATDKGKICQKGIGAASGYNCTSLWSPNPNDPWAGSITRNNDYAHARTTTKSIYGFDTIEITPRWQVNAGVRVDDYSTRFTDTKANGGKTTTRDDTLVNWQAGLVFKPAQNGSIYASYATSSTPAGMMLGEGSETQSLTPGRGGVGPNADQLSPEKNRSIELGTKWNVLNDKLSLTAALFQIDTTNARVTLPNNQYAMVGNKRVQGLELGLAGQITKQWQVFGGYTYMKSQLRDNGKDAANNGNRFPNTPKHSLTMWSNYDVTPKFTVGGGAFYMSEVFGDPANLRAVPSYWRFDAMAQYRINKKLDLQLNVNNLFNRTYFDQAYPAHYASIAPGRSAFVTLNARY

SEQ ID NO: 8958 - protein, 716 aa, Methylobacterium radiotolerans
MYRIPRVELYAALLLTLLASTSAFAQSAASPSVTLPELSVAGSSAPSVGTSPAPGENAGSVTVPSVAQQRAAVNSTVGSVAFVDAEDFQDRYANTLRDVLKDVPGVYVQERYGQELRLSIRGSGIARGFHLRGIEVLQDGIPFNLADGSGDFYQIDPLALRSAEVYKGGNALTFGATTLGGAVNFVTPTAYTAFAPNILRIDGGSFGTIRENFQFSRISGPVDFMVNGTFTNSDGFRFHETQRTQNFNANIGYQLAPGVETRFYLGGYLTDQKLPGSITLGQALNTPRIANLSAITGNQSRRVETERVANRTSFLLDVGKLDIDTWAIHKNLYHPIFQVIDQDGWTYGISPHWAGTFDVGGFRNDTILGLRAFAGQNSAQQFVNIQGQRGVQTLNALQSASNYEAYGENRFWFLPDMALMTGAKLFSSNRTYSNKGGLPASPRVQYGNITYEGINPKIGLLWQPLPDIQVFADITRSRDVPDFSDLVQQNLISATFVPLAAQRAWTYEAGSRGHIDRLTWDVTLYRAELRDELINFSTNPGLGIQAATFNAPRTIHQGVEAAVSLDLVRDLTGTGDTLAVTQIWTHNDFRFVRDPVYGNNRIAGIPNDVLRTVLSYRHPSGFYFAPSVDWVPQGPFADHANTLQAPGYALFNIQTGIDFANGVSLFVDARNLTDERYISDIAVVNNAQTAVGGAAALAAFYPGNGRSVFAGVRASF

SEQ ID NO: 8959 - protein, 689 aa, Methylobacterium radiotolerans
MSYRMGHACLGPSTAMAAALAVLAAPGYAQDTTTPLGRIILGWGTDQVALDTPQAVTVIDQEEIERQQAATIGEFFDGVPGVQAIGSDRVLGQTFNIRGWGEVPAGDEGRVVVLQDGATQYYEQYRMGSFFSDPNLYCNIEVLRGPASATLYGSGAIGGVIRFETCDASDYLTEGQTSQFRFSLGAETNGEGGNVALRYATRLGDNWEVFTNLNYREADDYVDGDGDTIEGSAFDSASALISATYSFDASRSVRFIYETWNSDLDDTSYSQTGSDGFGNIDRRTRDQTFSMIYNSVEAFGDLEMTLAYSDTDVEQSDWEATFPSSSVLFEDTDYGYSTISLDGRVTRDITLGGIDTTLIYGATLAQQVREAEAQTSTFIEFHPEGTSMRAAIFAQAEMDFGNGLTVVPGMRLEYALNTPGDDNGGTALDSREEVEVISFSPKIAFTYDISDQWGVFGSIAQTQRAPNLDELYSYDTRDGETPATDLDPENARSIELGFTYSRAGLLNADDAFDARITAYYSYVEDLIERDSRAGTPYHRNIAEAEIYGVELEAAYVSERWFSNLSLSVIEGTNLTDDEVWSQLPQDTLSLTLGGRNADLGIEYGWRMNAFADIDYADTVSRGVVNDNVFAGYATHDLFASWAPQDGALEGLEFRAGIDNVFDRTYTNALDGDPGRGMTGRLTVARVWNF

SEQ ID NO: 8960 - protein, 195 aa, Methylobacterium radiotolerans
MTKIKLISALALAGSCAFGTQAALAYSAGDFIVRGDIAKTDVDASNVEDDNGFMGSVGYLFHDKLGVALTSSEKFEHDFSSNGTSGDFEQRPTNLTLQYYPLGGTNSRVQPYAGAGVNYTEFSSEHASNGQSVSMDDSWGAVGELGVDLFVTENLAFNGFASYTDVDSDTDINGASAGEVNLDPVTVGGGLTFRF

SEQ ID NO: 8961 - protein, 239 aa, Methylobacterium radiotolerans
MTLDLPRRFPWPTLLSVCIHGAVVAGLLYTSVHQVIELPAPAQPISVTMVTPADLEPPQAVQPPPEPVVEPEPEPEPIPEPPKEAPVVIEKPKPKPKPKPKPVKKVQEQPKRDVKPVESRPASPFENTAPARLTSSTATAATSKPVTSVASGPRALSRNQPQYPARAQALRIEGQVKVKFDVTPDGRVDNVQILSAKPANMFEREVKNAMRRWRYEPGKPGSGIVVNILFKINGTTEIQ

SEQ ID NO: 8962 - protein, 1971 aa, Methylobacterium radiotolerans
MAMTNISPKLLQKAIQQGLKAALFTTSTAAIMLSSSGVLGVAVGVISTNNNAAFSDLAVANNWNDITAQGVANGTPVDGPQNGMAFTYGGDHTITADEAGRIITAINVAGTTPVGLNITQNTVVGSIVTGGNLLPVTITAGKSLTLNGTNAVAANHGFDAPADNYTGLGNITLGGANAALIIQSVTPAKITLAGNIDGGGIITVNTGVAINGTIGNVNPAAQISVGASPLSLGGAVIKATTTDLTDAASVLTLTNANAVLTGAIDNTTGVDNVGVLNLNGALSQVTGNIGNTNSLATISVGAGTATLGGAVIKATTTDLTDAASVLTLTNANAVLTGAIDNTTGVDNVGVLNLNGALSQVTGNIGNTNSLATISIGAGTATLGGAVIKATTIDLTDAASVLTLTNANAVLTGAIDNTTGVDNVGVLNLNGALSQVTGNIGNTNSLATISVGAGTATLGGAVIKATTTDLTDAASVLTLTNANAVLTGAIDNTTGVDNVGVLNLNGALSQVTGNIGNTNSLATISIGAGTATLGGAVIKATTTDLTDAASVLTLTNANAVLTGAIDNTKGVDNVGVLNLNGALSQVTGNIGNTNSLATISVGAGTATLGGAVIKATTIDLTDAASVLTLTNANAVLTGAIDNTTGVDNVGVLNLNGALSQVTGNIGNTNSLATISVGAGTATLGGAVIKATTIDLTDAASVLTLTNANAVLTGAIDNTKGVDNVGVLNLNGALSQVTGNIGNTNSLATISIGAGTATLGGAVIKATTIDLTDAASVLTLTNANAVLTGAIDNTTGVDNVGVLNLNGALSQVTGNIGNTNSLATISVGAGTAMLGGAVVKATTTKLTDAASAVTFTNPVVVTGAIDNTGNANNGIATFTGNSTVTGNIGNTAALATVNVGAGITLQAGGSLAANNIDFGVGSTLEFNGPLDGGGNTIPYYFKGAIANGNNAILNVNTKSLTAYHSTIGTVAEINIGAGNFFAIDASAGDVTILNAQAINFGVPDSALVLSNLTGVGVKNILLAADLVAPGANGGDVVFNGGVNGLNIGSNVAGTARNIGDGGGDKFNTLLIYNAVTITDDVNLEGIQNVHINNNAAFTSSTAFNAGAIQINDATYTIDANNGNLNVPAGNIQFAHANAQLILQNTSGNDRTITLGANIDPDNDDEGIVTLNSVTAGKKLTIAGGKTLGGAHKLHTIVFKGAGDFGAAGTTFNTTNIVLDTTGRLELGATTANVVLLNDAIQLTQTGGNIGGFLDFNAKNGTVTLNNNVNVAGAVQNTGGTNNGTLIVLGASNLNSVNGIAMLKVGAGNVTIAKGGDVKIGEIQGTGTNTLTLPANFNLTGSINKTGGQALKLNFTNGGSVSSVVGTAANLVGDITTAGATSFASSVNAKGTVTLGGTTSFADTFTNTGAVTLAKGSITNFAKNVTATSFVANSATINFGNSLAFNSNITGSGTTLTLGANQVTYTAGTGSFTDTLTLNTTFDGAAKSGGNILIKSGSTLDLSGVSTLALVVTATNFDINNISPDTKYTVISAETVGGLKPTPEENVKITINNDNRFVDFTFDASTLTLFAEDIAADVIDEAFGPGGLLANIPNAANIKKSLELMEDAPNGSDARQAFNNFGLMTPLQEADATTHLMQDVVKPSDTIAAVNNQVVASNISSNITALNARMDKVQAVNKGPVSSGDEDMDAKFGAWISPFVGNATQKMCNNISGYKSDTTGGTIGFDCLVSDDLALGLAYTRADTDIKLKNNKMGDKNKVESNIYSLYGLYNVPYENLSVEAIASYSDNKISSKSRRVIATALETVGYQTANGKYKSESYTGQLMAGYTYMMPENINLTPLAGLRYSTIKDKGYKETGTTYQNLTVKGKNYNTFDGLLGAKVSSNINVNEIVLTPELYAMVDYAFKNKVPAIDARLQGMTAPLPTNSFKQSKTSFDVGVGVTAKHKMMEYGINYDTNIGSKYFAQQGSVKVRVNF

SEQ ID NO: 8963 - protein, 1232 aa, Methylobacterium radiotolerans
MYRFWNRCFVALFIIAVLAASAIAQSTGGRILGKISDPSGAVIPGATVTLTNEATGVANTTESDKDGNYGFPSVPVGDYGIEYTATGFKQNVLHHVTVILNQAMTLNQTMQLGQKQEVVDVSSEAPIVDTTSTQLGAVMGSRSVEQLPLNSRDTYQLLQLQPGVMSNVGGSNTVAYGSDKPGVVSVNGGRGRSNNFNVNGGDANDLFANLPTIQPNPDSIEEFRVITNTFDAEYGRNSGAVINVVTKSGTNNWHGSAYEFFRNAVLNAQGYFNTFKPAFQQNQFGGTLGGPIVKDRTFFFVSYEGRRVKQGTPTDLSFMPDSAMRNGDFSSLLDPVNMPQFTGNVNSAEDGSSLMADTLNSRCGPYLANGPVVGGEAWADVFPGGMVPSQCLDPTASALTKLYVPLPNQPGGYYQSAPPQIINGNEGSIKIDHRLTNNQNLNFYWYMDDSTTQQALSFFQAAGANVPGFGAQIPTRVQQYNLSHTWTISNTVVNEARFTYMREGQRGFEKPARTDIVQNSCQGLVDPTMCFSDPTNPKLGITPNLGASVEGVPFISVSGAFNIGNNFEGQLPQVGNSFAWSDNLSKVWGNHTLKFGGDVRRMRFDQTLYYNVNGYYSYYSDSTTTGLPLADWFLGLPASYSQGSAQRENVRSTSLYLFAQDSWKIKPNITLNYGLRWELNTPLADQLGHVQTYRPGQVTDKYPCTCGPNAPDNAFFPVGLVFPGDKGVPPGMTDTYYKGWAPRIGIAYSPNADSGLSKALFGGPGKTSIRAGFGLFYNPIEQLVLEQFGAEPPFGGSNYIYDSMFNTPFQDTAGNQYPNPFNGILTPKPGTSIDWSSFRPILLYGDMQPHIRTQYSEQYNLNIQREFGKDTVLQLGYVGSQAHRLLVTHDINYANPQTCLDLNATMGDGTCAQYFGDSSFYIPEGTVIAPQGLNLPYNPDGSTFIPGGTVVGPNGITLVGLRPYSSPNCHPMTGVGCPADQVPVFSSIFAQDTVGNSNYNSFQAMLQRRFSAGLQFQLAYTYSKSLDEGSSFEGIVNPVDIHRSYAASLFDARHRFVASYDWELPIRKFEGFAGKALNGWATSGIVTIQSGFPIRITDQNDNELYSSFDFETVGQPNQVGKFTTWDPRSHGGYYFDGTDGQIFTDNVALGTVGNASRTICCGPGIANWDMTFVKNTKFGERWDTQFRAEFFNILNHTQFYNPDGNITDGSDFGRIKSTRDPRLIQFAFKILF

SEQ ID NO: 8964 - protein, 591 aa, Methylobacterium radiotolerans
MPVKYCMAAALSLALSVGLPVASAEEPVFDDDGTPMYEVNFVDTELGEFIDSVSRITGTTFIVDPRVKGKVTVRTVDLHDADAIYDIFLAQLRAQGYATVDLPNGSVKIVPDQAARLEPVPVEPAGQQGEGSDSVATRVFNVRNAATEQVLGILKPLIDPRVGVITPYPAAHQLVVTDWRSNLERIASLLRQLDRPSETAGSSSTQVIYLRHATASEVVKVLRGLSQEGMAPAEGVAEGEAKDRPVMAAPGGSGIRLEYEEGTNAVVMVGPDSELAAYRAIVEQLDIRRAQVVVEAIIAEVSDSSAQELGVQWLFADEKFGAGIVNFGSNGVNIANIAGAAAGEDTEALGKLLSATAGATAGIGHFGGGFNFAMLVNALKGKSGFNLLSTPTLLTLDNAEASILVGQEVPFVTGSVTQNNANPYQTIERKEVGVKLRIKPQINIDNSVRLDIVQEVSSIADSSAASDVITNKREIKTKVMVEDNGLVILGGLISDELSTSNQRVPLLGDIPYLGRLFRSDASKNTKQNLMVFIRPRILRDGPSLAGLSEGKYRTLQQTTPLQLPDLAGAEGATPLLQVFPASRARLDGGNW

SEQ ID NO: 8965 - protein, 747 aa, Methylobacterium radiotolerans
MSSPRPPAPWRAPLALAGLSLGCAAGAYGAPAPAQTVVTLPAQEVIGDSVAAARSVLRLPEIERAQADNFASLVDQLPGISMAGSPRPGGQSLNIWGMGDTEDVKIVLDGAPKGFEKYRQGSVFIEPELIRRIEVDKGPHNLVDGNGGFGGTVKIDTKDAADLLPPGARFGALAKYGRHSNDGQDIYSVALYGRTRADGADGLLYANRRDGGDLRRPDGTRFAYSRNNQRSLLAKVNLYPDDAQTITLSAMRSNAAGWQPFAAKRDDLPAPSQADIDRYGLTEAWRRKLVHRDQLDQNYSAKWNIAPSAHPWVNLTLAYARSDTRQRDRRSSRASQSAFLGTLGNKSWVDYRDDRFDLSNESHVALGTAEHVLLAGLRWHRHRRDTLMYYPPGRGKPDYNHGYFQPHYMPSGTQTVRSLYLQDAVTVGGLTVTPGVRYDHVANTGRPNDAPRYNNPAPVAGHDYRRVSYAGWTPHLGVVWKAARSVALFADASRTWRAPVIDEQYEVQYAKSNVSGSSRALRPERIVGLRAGAVLDFNDIAARGDSVQIRTTLFRNRGKHEIFQRRGVACRGQAEGGAASDCPKPLSNYRNLPGYTIEGLELETYYDSPAMFASLSLSAMRGHRDASPRDPWGPRTWIAEIPPVSARAMLGVKLPRLDMVLGWRGEFVRRQDRSPTDGDPLAGYWALPKTAGYALHGLFASWQPRHVKGLDVRLAADNLFNRPYHPYLGEAVSGTGRNIKLSIAQRF

SEQ ID NO: 8966 - protein, 630 aa, Methylobacterium radiotolerans
MAAGLCLVIAGSVSAQRAAENVVRAAADAFGSSVGDEQIGLYSATNVRGFSPTAAGNIRIDGIFIDRQSGFSDRLVSGSQIRAGLAAQGYMLPAPTGIADFSLRRVADEPVQSIILERSRYGGVRLAADLQARLAEGVEAAFGVGYEEDEEGNGTNDIAASAGGNLRFTLQPDADVTVFADYVEELENQFSQRYFTAGPYEPPEVTPLKFVGQPWAKFTGPRYNVGVLANYRPADWEYRLGVFRSSREWDQQANVLYTDVRPDGSARRRSALGPSTTLLSDSLEARVTRHFYEGSRRHSITVNLRALDRSRVYGGTVGIDLGDANIDEPVYFERPDIEVGEQSRESVEQVTLGFSYDLRWENAGQLNIGIQQSDYSREVIVPGSNDLLDEENPVLYNVNANAPLGERVVVYGGIVRGFEESPVAPISAINQNEAPPAAETQQIDAGARITFGELTAVAGVFEIEKPFFGFDEDRFFGAQGMQINRGVEFSVAGPVTEALQLVLGTVFYDVSLTGDAVDSGALADSPAGAITRSTTLNFDYRPQWAPGWSFDLGVTSQGEQNADSQGLVTIDPYTLFDLGLRRQFSFADNDVVIRGRLTNVFDEFAWNAGSTGAYRYIPPRALSLSLRMDI

SEQ ID NO: 8967 - protein, 597 aa, Methylobacterium radiotolerans
MIKEYFIYTYKIIYIYNMLKEGIERLMGNYRYIFKQQEFYNKCIIKNILRKSVAVTILPFFLLVTSVNAFAMPGFSRNNGFNPLTNSDSESSTPSISSSSMFRNMCRRGNPCPYLTVGCIIGGVLGTVAGVLFSNMFTFPHSSERVGAVVTGTIGGCFVGFCAGLGIYYCSKRSSCVHENPTPEDGIPFYITLGDNTREANLCECSGSCECPLLAPSQRPFGSHQTDSHRGSGNRTSSCFLPGYNRDGQTSSLLGMQCILASSSEHVLMNLKALTLKAHEYSQESMGNMEDNYFPLQKKWLSGPSRGFISTFKNYKPSFISYRVFASMDNYQSNLEFKVRSGSAGVVTELFPGISVGLAYNRHTDTRKEYGGIQLNTGSGIVQSRSKTEALSAVVALNPETKGFTGHIASYYGWGKMQNNRSVTHGYSETTSKGKPDMSLTGLVGQVGYNIPIAKSVTLTPYVEYMYTMVKWDAYQELSGILPCEISGNKEQIIEKSIGLRSHWEVTSGSQLQTWVAGISGSHKKSGLHSRPLATSMPSYKAAVPVNKKQYTRTEVGLSYVVNITDMLEIGCNGILRFKQAKKIDSQYLALQAQYRY

SEQ ID NO: 8968 - protein, 447 aa, Methylobacterium radiotolerans
MEHRNRIRTLGSLALLAVVGSSGAQAAEAFSSESKWMTGDWGGTRTELLEKGYDFTLDYVGEVAGNLHGGYNDDKTARYSDQFALGAHLDLEKILGWKDTEFKLAITERSGRNLSNDRISDPRAGQFSSVQEVWGRGQTWRLTQMWIKQKYFDGALDVKFGRFGEGEDFNSFPCDFQNLAFCGSQVGNWVGGIWYNWPVSQWALRVKYNITPEFFVQVGAYEQNPSNLEIGNGFKLSGSGTKGAILPVEAVWSPKVNGLPGEYRLGYYYSTAKADDVYDDINGNPQALTGAAFKSHSSKHGWWVVAQQQVTAHAGDINRGLSLFANFTVHDKATNVVDNYQQVGLVYKGAFDARPKDDIGFGVARIHVNDDVKKRAELLNAQSGINDYDNPGFVPLQRTEYNAELYYGFHVTNWLTVRPNLQYIKSPGGVDEVDNALVAGLKIQSSF

SEQ ID NO: 8969 - protein, 1123 aa, Methylobacterium radiotolerans
MYRTLRSLCILVLLSCLSIVSRLVAQDAAGTIFGTITDLQGSVVPDARVRVTNGATAVSKETVTGKDGSFRVLDLPVGKYTVTAESPGFAVTHSEEKPLQINQNLRIDIRLQVGTEKTVVDVTGEAAGVETVNSTLGQSVTSRPLVDLPLNGRDVLQLALLQPGVTETNEGNTGAGSYSIGGGRSDSVTFLLDGGINNDLLGNEVVFNPNPDAIAEFRILQNNYTAEYGRNGGGVISVVTKSGGNNFHGSGFEFLRNDAFNANSYFNKLNDLPRNVLKRNQYGGTIGGPIIKNRLFFFVSYQGQRLTATEDPSLYGNSTTTTVFTNPELQNGDFGGDPNVANFLNAHPYFIAPGHTAADAVIDPAKFDPVAQKYIGLGLIPSTSTGELNAIGNQTDNRNELSAKIDFQLDEQDKIGATFGGNRNSETDDFRFSNVPGSPVSNHYSQNFLTLAYTRTFSNSMLNEFRFTAQRTTHLQDAPLGAKHTPADVGVGIHSDDPTGVTVLGFDNGLTIGPSLFGPTNFASNTFSYSDNFSWVRGKHSWKFGAGFTPYQNNTLYDFYVNGYFQFNGTGSGNSLADFLLGVPTYYIQYPQAPSNIRSKNTFLYAQDEWHVSRRLVLNLGLRYEYSTPKIDTEGRSYSIIPGQQSTVFPNAPNSLVFPGDKGTPTGANFPDKNDFGPRLGFAYDVFGDGKTSLRGGVGLFYDILKGEDNLQFNGQPPFFSSAGLLFPDATANSNYAFLADPYGSAGVTDPFPSKPVDHNLDFGAAGFLPFNNAGSAFFVDPHLRTPYTYQYNLSLEREIARNTIMDVSYVGSDSHKLTSLVDINPFDLSNHSGVRLLNELPANQSCDDAFGGFCFASMPEFKNASNAVYNALEASVTRQPTPTWKLGQTYFTLAYTYAHNIDNASGFRQVTSQVPYYNGNQFRASADQDIHHRLTFSGGWDFALDQWWPSGWKRLTQGWSVFPIMTWRTGFPYSVFARFDDSFDYTVPGPSGAGDPALAYANVVGSTGTLDPRKYYSGLGAGAYWINPNSFSNANEYDYGSPYGDFARNSLRGPHETNLDFEVAKTTKLTESLRMQLRAEMFNVFNHAEFRLPDTNITSPSFGQILGTYDPRIIQFAVRFTF

SEQ ID NO: 8970 - protein, 482 aa, Ehrlichia ewingii
MNNKKQQLQIAVALALLGGFGAIGTVQAGGFTTPTYGAPGWGRAFGGGSLFKNDPSAAYNNPAAMAFIDQNVAQMTVDYARIKMKYKGDAYDYQGNPATTLPVDASGVPTSGPVPLEGNGGQGGFTAWLPTGFMVMPINDQFAFGLSQVVPMGMRSTWDNDNSKIRDFSVDTKIETVGLTGSLSFKVNDDFSLGAGVIVQHSKGFVSQNLNLTGAAAVSPGLGGIPLPSGVGANLMRVKVDNTSVGWFTGVVWKPTDRDTLGLNYHAKIKNKMDGKYNVRADAVGRQYMTQPAGPNGESLVELAYPGLKLNPDGANASAQLDIPASAGLDWVHVFDDRFTLGASMLWTQWSSFKDLTLKSDGNTLVSIPYKYKDTMMYSLGGDYRFTDQLTLRAGVAYDQTPTRNSTRDPRIPDNDRWFTSLGFGYDIRAIPGLTIDGAYSRQFVKEAKIKTQNVDRLGASRLDGKVDAKGEVVSLSATYHF

SEQ ID NO: 8971 - protein, 969 aa, Ehrlichia ewingii
MRKKFTLFIICLLCSISVSMAQEINIKGQVKDQQGQPIPGVSVKVKGTSKGAISEANGSYSVSAPANGTLVFSFIGFVSIEESINNRTAINVSLSEENNQLNEIVVVGYGTQTKKDLTTAVVSISSKDLKNQPVTNALQAVQGRAAGVQISSQSGKPGSEMAISIRGNTSITASNSPLYVIDGVTSRNAGFLNPNDIESMTILKDASAAAIYGSSGANGVVLITTKKGVEGKVKVEFNAFTGFSNFWRKQDVLNSTQYTALMTELGYTSFGTGANTDWQKETFGTGTQNQYQVSLSGGVKGGQYYFSTGYQQDKGVVAPAKLDKYTMNFNGTQQVTKWLKFNGTAALTARNSIDVPDNNGIDRGGVILSTLTTPSTIGIYTPSGIYTSVPNAGGWDNPIALAYGKDNKTRNFRFIGAFGGEIKFSPDLTFKSTISTNINRNFYSGYQDPFMTSYGRQERGILDNNRTNEHVWLNENILNFTKNIGKNAFTATGGYTIQESDWQYRDYRETRFYDIPTGTIPQTPSVGLTIPQRAQWSKQSYLARVTYAYDGKYLFSTNFRADGSSRFAKDNRFGYFPSASAGWRISGENFMKDVKAINDLKIRGSWGIVGNDEGIGDYAYMKLYQINAQGQYTLSNPANNDLSWERTTQTNVGLDLTMFNNRVTFTADAYIKKTNDLLINVQLAPSSGFGSQAYNVGSMENKGLEFVLSTKNFDREKFRWSTDFNISFNKNKVTSLGETTQNLTFGGINGRTDAIRIEVGQPLGSFYGYQFTGVNPATGDATYADLNGNNQVDPGDRTYIGSAQPDFTYGLTNNLSYGNWGFNFFFQGVQGSQLFNASRIDLESMSDSKNQSTAVLNRWTPQNTNTNIPRASYQSIDNSLTSSRFVENASYLRLKTATLSYNFGPAALGKWNMSKLTVFATGYNIFTFTDYKGLDPEVNRDNANGPSMGVDYGTYPQSRSFLFGVNVGF

SEQ ID NO: 8972 - protein, 757 aa, Ehrlichia ewingii
MSNKKFNNKSYTQKSTKSSTFSLSLTRAPLALAISAALSTAAWAQTDAIDKPEPSNDMEIMVVTADFRSASLEKMPSSITVIDAQQIQDESAQHFEDVMSSIANFNWSGGSSRPKYFQIRGVGEQEQYQGAPNSSVGYIIDDIDLSGIGMVSSMYDLQQVEVLRGPQGTRYGANALAGLIYLKSNDPTDVFEHGAEVSLGNDDLQTFSGFSSGPLTDSGKLLYRVSLQQHQQNGYRDNLYLNKEDTNGRDEFTGRAKLRWYASDNLQLDLTLLHADFDNGYDAWSLTNDPKHTISDQPGVDSQRTTGAGFKATYSGAESFELTSLTSFANTDHHYSYDGDWANPEYWASKQCDIYDADWNSIGKLPCVYDATWSKVGQRKTFTQELRLTSSDAGRIFNESTDWLIGVYFSSLQEDNSLIDYAKYSNGGLNPSFKERTKYLDSTYDAQNYAIFGQLDIDMSNDYLLSLGLRLENRSSDYSDTNLDDFSPSETMWGGHLALSKALSEQHNAYIRVARGYKAGGFNMTLPADFSDKKEFNTETLYNYELGLKSSWLSGALSTNVALFYMDRQDQQVSASQQNPEDLSEFILFIDNAGSSKNYGLEIDANWYIDSNWHLYSSVGYLNTAYGDYQYEVAEDQFVDLTGRDLAHSPHLTYSLGGTYRANSGWFANVNMSGKSEFYYSDSNDSRSEPYTIVNARLGYEASAWSAYLWGRNLFDEEYGVRGFYFGNEPDNGWAEKQYIRYGDPRQIGVTLNVKFM

SEQ ID NO: 8973 - protein, 528 aa, Ehrlichia ewingii
MNNKIITGAVSAAVLSLSGMVYADTTEDLVNALVTKGVLTEEEGALLSKGHDKKKANTPIVKNKGGKFSIQSADGKNEIALTGRMHFDFRDSDLDEDDFGNDSHEDKYDIDGKSTSPSEFEMRRARIGIKGKLDGMWKYDVVLNANGKSGKNLDTASLTWAAMKPFQIQFGRFKQAFNLEGLTSSNDIDFVERSFMNQISPHKKLGVAFKGSPTKGLNYAVTKYQEGYSNDVVEDENNYSGRLTYNWAEANKIKDSIFHVGIAGFTEDYAQRPKTSSNGSSATDGATTHSRLFKFKSAGRGYSPLAALDIQGEDLSYGGASAKGKTAVRHENRFAALEGIYAKGPFKIQGEWGKGTFEGTNEGSNGGSGEADVEIGYISANYVLTGEHYSKSYKGGKMKGIKVKNPFDFEKGTGTGAWELGFRYEYLGIDDVKLTQSSSSHGAETRLRGAWDCGGSISDSYKGTGAGCDLDINQYTIGLKWIANPNVLAKVSLTYSDYGEDVKAPDFGTKTNTFDSETLLHTRIQWMF

SEQ ID NO: 8974 - protein, 499 aa, Ehrlichia ewingii
MNYKVASAKNIATLLFLLSSQSQAFDLGKIAKIKAGAESFSKVGFNNKPINTNKGLYPTETFMTIMAYMQVDFTELLPKSATANGHHLDGSLGGWGGAVIYDSTKDFINEVTGKTYGAMAWNYVGYWGGLVGQKPWASCGLATGNLTQGQYDKMTQAEMTQLSNQEALEASTCAKGYAAHTRNYVIYNAYLRYNYKDIFEIRGGRYESPADYMSGYNQGLDMTLNLGNFKFWWFSSFGRGFAYNEWLYNFYSPKTYTLKNGQTINPGVHAFYAIWNYKGWSIQPFVYFSPFNEYDPNFTITYDSNPTFTGLGFRSQTDVTVLNPFYAKRFWDTYQFGMPAGKNAHSLMIKQKFEWNEYNFGFGIYKSFGNANWMIGYHGNRLGFDFWTNTVYANTLNSLSYMMDANAFTVFAFGGGVHRKLLWGLLGRLTYGPRANEQVLSLNFGYKFTKNFSADIKFEYYNVLMHQGYKMGWNGPKLDSQPATDQDRSHIFTEIVWKL

SEQ ID NO: 8975 - protein, 277 aa, Ehrlichia ewingii
MNCKKFFITTALVSLMSFLPGISFSDTVQGDSVSGNFYISGKYMPSASHFGVFSAKEEKNATVAMYGLKQDWNGASASGHTDADFNNKGYSFKYEDNPFLGFAGAIGYSMGSPRIEFEVSYETFDVKNQGNNYKNDAHKYCALDYQGSTNATQNKYVLLKNEGLLDISFMLNVCYDITDESIPFSPYICAGVGTDLISMFEAINSKISYQGKLGLSYSISPEASVFVGGHFHKVIGNEFRDIPTLKAFATSTATPDLAIVTLSVCHFGVELGGRFNF

SEQ ID NO: 8976 - protein, 278 aa, Ehrlichia ewingii
MNCKKIFITSALMSLVSFIPCISFSNPMQDNNIVGNFYVSGKYMPTISHFDNFSAKEDTIETIATFGLSKTYNRSSPIHSDFTDSKYSFKYENNPFLGFAGAVGYSMEGLRLEFEISYEKFDVKNPDNSYSNGAHMYYALSRKDNANIGTTPQDKKYVYIKNEGLTDISLMLNACYDVISEGISFVPYICAGIGSDFISMFDITSPKLSYQGKLGISYSINPEMSVFIGGHFHKVIGDQFKDITPLKPNGIENTTATHVLVTLHMCHFGAEIGGRFTF

SEQ ID NO: 8977 - protein, 672 aa, Ehrlichia ewingii
MNYKHYFISLFLSGAIIAQEKPQSTQDTKPTQTPAENLTQSEKVQAESPPKNETLPSETHFITASRSERAPETLAANVTIIGPEKIARSNARNVAELVKYEAGVDVKKKLNTPSSYRIDVRGFGEVASANTLVLVDGRKINMPDLSGMNLDTIPLNRVERVEIYRGGRSVLYGDNATGGVINIITRKESQNSNTLTLSAEVGSYEYYRLGASLEGFAEDLYYAFDSSFTESDGYHDNSGYRTKTLGFSVLSTEFENLELSISGGKSKSHFDIPGARNGKRDSASYDGYYGDLTEEYISITPKYWITDKVDLELQMNYREAEFDYTYPAAWGPSPDTYTSEDISLSPKLTIRDRWNGVNNTFVVGMDHRYSKMEDYGPDKSRRSTGGYIYNTSAFLDDTLFLDLGYRRESVRMNLNNGEDYDTNNLDAFSAGLTYKYADESKVFISYDRSFRTQRVDELGGAWVWPTPPNEELDPQITKTWQSGVQHRFNDQWLGALTLFYIDTQNEIFYDSTVGFGENYSYGETTRTGAELALDFQATEALSLYVNYTYMDAELGEDSPSNDANDGNTVPGVAEQFANFGFSWDFIESWNLNMNAHWNDDQYAESDYANNSDKQDSFITVDARVTYTWNWLSVYGGVNNLFDEEYNEFTATYGEYTAPERNFVTGFVITHEF

SEQ ID NO: 8978 - protein, 341 aa, Ehrlichia ewingii
MKYKALSLLPLVAALAACAGGGVAEPHVPVSIPTATPLPTGEVKLSDDNSKIENINTADTGSTSGISIQQRKYEVESYGIKREEKAFIFQTPGGAQYALSSYADPITVSYSSPDFKIPDRHAGQRLADGSRIFICCSESGATSYAEITKQDYMKFGAWIGPNGEIDLFAGGFPVGKTPKPKYSWGNTEPETKGKGKITYQVWGIRVRNRQFVTSSYTPPKSGSYYGTLANTPVLSFITANFNSNKLAGEIRGNSDYGPSVKIENATINSLSFSGTATSGGKTGNLEGKFFGKFNGYRDTETSIGGKITFDGDRSLDTVFGGVSYKKELENNTDTSTTHLTK

SEQ ID NO: 8979 - protein, 1656 aa, Rickettsia endosymbiont of Ixodes scapularis
MAQKPNFLKKLISAGLVTASTATIVASFAGSAMGAAIQQNRTTNGVATTVDGVGFDQTVALANVAVAPNAVITANANNGINLNTPAGSFNGLFLSNANNLAVTVSEDTTLGFINNAANNANRFNLTLDAGKTLTITGQGITNVQSAATHNAQNIVAKFNGGAAIANNDLSGLGTIDFGAAASTLVFDLANPTTQKAPLILADNALIVNGANGTLNVTNGFIQVSDKSFATVKAINIGDGQGFMFNTNATNANALNLQAGGTTINFNGTDGTGRLVLLSKNGAATDFNVTGSLGGNLKGIIELNTVAINGQLIANAGPANAVIGTNNGAGRAAGFVVSVDNGKAATIDGQVYAKDMVIQSANANGQVNFRHIVDVGIDGTTAFKTAASIVAITQNSNFGTTDFGNLAAQVTVPDTMTLTGNFTGDANNPGNTAGVITFAANGTLASASADANVAVTNNITAIEASGVGVVQLSGTHTAELRLGNAGSVFKLADGTVINGKVNQTVLVGGVLAAGAITLDGSATITGDIGNGGGGAALQSITLANDATKTLTLGGANIISANGGTINFQANGGTIKLTSTQNNIVVDCDLAIATDQTGVVDASSLTNAQTLTISGTIGIIGANNTTLGQFNIGSSKTTLNGGNVAINELVIGNNGSVQFAHNTYLITRTTNAAGQGKIIFNPVVNNNTTLAAGTNLGSAANPLAEINFGSKGARADTVLNVGEGVNLYATNITTTDANVGSFVFNAGGKNIVSGTVGGQQGNKFNTVALDNGTTVKFLGNATFNGNTTIAANSTLQISGNYTADFIASADGTGIVEFVNTGPINVTLNKQAVPVNALKQITVSGPGNVVVNEIGNAGNYHGAMTDTIAFENSSLGAVLFLPSGIPFNDAGNTIPLTIKSTVGNETAEGFSVPSVIVSGVDSVIADGQVIGDQNNIVGLGLGSDNGIIVNATTLYAGIGTINNNQGTVTLSGGVPNTPGTVYGLGTGIGASKFKQVTFTTDYNNLGNIIATNTTINDGVTVTTGGIAAGGIAGTDFDGKITLGSVNGNANVRFADGIFSNSTSMIVTTKANNGTVTYLGNAFVGNIGDSDTPVASVRFTGSNNGAGLKGNIYSQVIDFGTYNLGIVNSNVILGGSTTAINGKIDLLTNTLTFAGGTSTWGNNTSIETTLTLANGNIGHIVIAEGAQVNATTTGTTTINVQDNANANFSGTQTYTLIQGGARFNGTLGGPNFTVTGSNRFVNYGLIRAANQDYVITRTNNAENIVTNDITNSPFGGAPGVGQNVTTFVNATNTAAYNNLLLAKNSADSANFVGTIVTDTSAAITNAQLDVAKDIQAQLGNRLGALRYLGTPEMVGSEAGAIPAAVAAGDEAVDNVAYGIWAKPFYTDAHQSKKGGLAGYKAKTTGIVIGLDTLANNNLMIGAAIGITKTDIKHQDYKKGDKTDVNGFSFSLYGAQQFVENFFAQGSAIFSLNQVKNKSQRYFFDANGNMSKQIAAGNYDNMTFGGNLTVGYDYNAMQGVLVTPMAGLSYLKSSDENYKETGTTVANKQVNSKFSDRTDLIVGAKVAGGTMNITDFAVYPEVHAFVVHKVTGRLSKTQSVLDGQVTPCISQPDRTAKTSYNLGLSASIRSDAKMEYGIGYDAQIASKYTAHQGTLKVRVNF

SEQ ID NO: 8980 - protein, 241 aa, Stenotrophomonas maltophilia
  misc_feature (6)..(6): Xaa can be any naturally occurring amino acid
IALISXSAAQAADVIVPHEVAPTVISAPAFSWTGFYIGGQVGNFSSKVEITDPNKKDKLFSKDDTPKPSGFMGGIYAGSNMDLGNNMILGVETDAVWADREDAKTSSAKVIREDELVNFKDSLKNANAVFAKDKTMDDVKQDEKHTDSLALKEKWSGATRVRIGFTAADRIMPYVAGGVSYAQVQAVSSTKVTKAADDAEIASAQLFDKTKTLVGFTLGGGVDFAMTDNVLLRAEYRYSDF

SEQ ID NO: 8981 - protein, 965 aa, Uncultured Acidobacteria bacterium cosmid p2H8
MRRYLLFVGLLLFAPLVGHAQSTGSVAGTVTDANDRPLPGVNVAIQAVQRGAATGPDGSYTISALEPGQYTIQASLVGYETQRATVTVEAGENVVQDFVMTAASLNLDEVVVTGQGSEVSRRALGTNVSTISAEDIQETPTTSIDKLLQGRVPGSTIRSQSAQPGQGALINFRGITSVFANQTPVIYVDGIRVDNSSSTSFSFGGETTSALSEILTNDIERIEITKGGAASTLYGSDAANGVIQVFTADGEAGETEVTFRTRQGVDFPVSRFFKDTGFSFPETREDEDSPDFGRTNYIENEFLRRGYSQDYYVGVSGGSEAITYNLSGRLQDGSGVQPNNSNTLYALRGNVSADVAEELSVQFNGSYTRSNFTRLSNGTAIADPLTMLEVGDAKFFTGTNNLRDALDMATLPQIKEGVDRYRLSARAAYRPNELFNSSLTVGIDGRTNEQRALFPREADPLTGNTNGSLTRFNRDFKSITLEYRGTISYPREGPVTSTFTFGAQGFRDEESQVWAEAETFALPGTEDVGEAGSVVADELREQVFNGGVFFKEQLGYENRLFLSTGLRLDGNSAFGEDVGVQVYPSAELSYILTDEPFWQGSLENVLSQLKLRAAWGQTGKFPDPFTRDVTFQATSFRGASAPRFDNPGNANLGPEKTSTLEGGFESSFFDGRFGLDFTVYQSRTTNALFEVPEQPATGRGLQFRNVGEIRNVGTELSADVRVLQLENLFWQVGGSWSWNQNEMESLGGAAPFNIGGSAEFAQQRVKEGQPIGAWRATTPYDSNGDGQLDASEFRFTGETPFPVHTGAFTTSLTVQNFRLFALADWATGSEVLDWGSHWASFNGLERAPRPQKFDENGDPITDADGNPVDFSTAEAGSALLQDGDYLKLREVTLSYNVPGSLLDVAGIDQGSIYVTGRNLWAFTRQELVDPELAGLTDTDNVALGGSQSITLSPPRQIQVGVEITL

SEQ ID NO: 8982 - protein, 733 aa, Escherichia coli
MMISKKYTLWALNPLLLTMMAPAVAQQTDDETFVVSANRSNRTVAEMAQTTWVIENAELEQQIQGGKELKDALAQLIPGLDVSSRSRTNYGMNVRGRPLVVLVDGVRLNSSRTDSRQLDSIDPFNIDHIEVISGATSLYGGGSTGGLINIVTKKGQPETMMEFEAGTKSGFSSSKDHDERIAGAVSGGNEHISGRLSVAYQKFGGWFDGNGDATLLDNTQTGLQYSDRLDIMGTGTLNIDESRQLQLITQYYKSQGDDDYGLNLGKGFSAIRGTSTPFVSNGLNSDRIPGTERHLISLQYSDSAFLGQELVGQVYYRDESLRFYPFPTVNANKQVTAFSSSQQDTDQYGMKLTLNSKPMDGWQITWGLDADHERFTSNQMFFDLAQASASGGLNNKKIYTTGRYPSYDITNLAAFLQSDYDINNLFTLNGGVRYQYTENKIDDFIGYAQQRQIAAGKATSADAIPGGSVDYDNFLFNAGLLMHITERQQAWLNFSQGVELPDPGKYYGRGIYGAAVNGHLPLTKSVNVSDSKLEGVKVDSYELGWRFTGNNLRTQIAAYYSISDKSVVANKDLTISVVDDKRRIYGVEGAVDYLIPDTDWSTGVNFNVLKTESKVNGTWQKYDVKTASPSKATAYIGWAPDPWSLRVQSTTSFDVSDAQGYKVDGYTTVDLLGSYQLPVGTLSFSIENLFDRDYTTVWGQRAPLYYSPGYGPASLYDYKGRGRTFGLNYSVLF

SEQ ID NO: 8983 - protein, 1377 aa, Escherichia coli
MNRIYSLRYSAVARGFIAVSEFARKCVHKSVRRLCFPVLLLIPVLFSAGSLAGTVNNELGYQLFRDFAENKGMFRPGATNIAIYNKQGEFVGTLDKAAMPDFSAVDSEIGVATLINPQYIASVKHNGGYTNVSFGDGENRYNIVDRNNAPSLDFHAPRLDKLVTEVAPTAVTAQGAVAGAYLDKERYPVFYRLGSGTQYIKDSNGQLTQMGGAYSWLTGGTVGSLSSYQNGEMISTSSGLVFDYKLNGAMPIYGEAGDSGSPLFAFDTVQNKWVLVGVLTAGNGAGGRGNNWAVIPLDFIGQKFNEDNDAPVTFRTSEGGALEWSFNSSTGAGALTQGTTTYAMHGQQGNDLNAGKNLIFQGQNGQINLKDSVSQGAGSLTFRDNYTVTTSNGSTWTGAGIVVDNGVSVNWQVNGVKGDNLHKIGEGTLTVQGTGINEGGLKVGDGKVVLNQQADNKGQVQAFSSVNIASGRPTVVLTDERQVNPDTVSWGYRGGTLDVNGNSLTFHQLKAADYGAVLANNVDKRATITLDYALRADKVALNGWSESGKGTAGNLYKYNNPYTNTTDYFILKQSTYGYFPTDQSSNATWEFVGHSQGDAQKLVADRFNTAGYLFHGQLKGNLNVDNRLPEGVTGALVMDGAADISGTFTQENGRLTLQGHPVIHAYNTQSVADKLAASGDHSVLTQPTSFSQEDWENRSFTFDRLSLKNTDFGLGRNATLNTTIQADNSSVTLGDSRVFIDKNDGQGTAFTLEEGTSVATKDADKSVFNGTVNLDNQSVLNINDIFNGGIQANNSTVNISSDSAVLGNSTLTSTALNLNKGANALASQSFVSDGPVNISDAALSLNSRPDEVSHTLLPVYDYAGSWNLKGDDARLNVGPYSMLSGNINVQDKGTVTLGGEGELSPDLTLQNQMLYSLFNGYRNIWSGSLNAPDATVSMTDTQWSMNGNSTAGNMKLNRTIVGFNGGTSPFTTLTTDNLDAVQSAFVMRTDLNKADKLVINKSATGHDNSIWVNFLKKPSNKDTLDIPLVSAPEATADNLFRASTRVVGFSDVTPILSVRKEDGKKEWVLDGYQVARNDGQGKAAATFMHISYNNFITEVNNLNKRMGDLRDINGEAGTWVRLLNGSGSADGGFTDHYTLLQMGADRKHELGSMDLFTGVMATYTDTDASADLYSGKTKSWGGGFYASGLFRSGAYFDVIAKYIHNENKYDLNFAGAGKQNFRSHSLYAGAEVGYRYHLTDTTFVEPQAELVWGRLQGQTFNWNDSGMDVSMRRNSVNPLVGRTGVVSGKTFSGKDWSLTARAGLHYEFDLTDSADVHLKDAAGEHQINGRKDSRMLYGVGLNARFGDNTRLGLEVERSAFGKYNTDDAINANIRYSF

SEQ ID NO: 8984 - protein, 326 aa, Pseudomonas putida
MKLKNTLGLAIGSLIAATSFGVLAQGQGAVEGELFYKKQYNDSVKHIEDGFNPGARIGYFLTDDLSLNLSYDKTNHTRSNDGTGNQKIKGDTGSLVAQYHFGQAGVDSLRPYVEGGFGHQSRTNVQADGHSGRDQTTFATVGTGVKYYFTNNLYARAGVEADYGLDNGKWDYSALVGLGVNFGGNAGAAAPAPTPAPAPEPTPEPEAPVAQVVRVELDVKFDFDKSVVKPNSYGDVKNLADFMAQYPATNVEVAGHTDSVGPDAYNQKLSQRRADAVKQVLVKDGVAPSRITAVGYGESRPVADNATEAGRAVNRRVEASVEAQAK

SEQ ID NO: 8985 - protein, 351 aa, Aeromonas hydrophila
MKKTILAIAIPALFASAANAAVIYDKDGTTFDVYGRVQANYYGDTNEADSTAASGYKDVDGELKGSSRLGWSGKIALNNTWSGIAKTEWQVSAENSANKFDSRHIYVGFDGTQYGKVIFGQTDTAFYDVLEPTDIFNEWGSEGNFYDGRQEGQVIYSNAIGGFKGKVSYQTNDDQAVKVADVAGGIKTTVFPDVKRKYAYAAAVGYDFDFGLGFNGGYAYSDLEGKTTDASGKKSEWALGAHYAINGFNFAGVYTQAEVKNDTTGYKDEGRGYELAATYNVDAWTFLAGYNFKEGKENANLSGSSYEDLMDATLLGVQYSFTSKLKAYTEYKINGVSGKDDDFTVALQYNF

SEQ ID NO: 8986 - protein, 989 aa, Burkholderia ambifaria MEX-5
MKQKMYSCDARVILSILIGLFLSCNVFAQDVTIKGNVKDAKGEPIIGASILEKGTTNGTVTDFDGNFMLSAPKGSTIGISYIGYKSQDIINQGQSNLIVVLQEDTEVLDEIVVIGYGTVKKDDATGSVTAIKPDKMNRGLTTTATDMINGKIAGVNITTDGGAPGSGASIRIRGGSSLSASNNPLIVIDGLPIDNDGIKGVSNPLSTINPNDIATFTVLKDASATAIYGSRASNGVILITTKKGEKGSRPRVTYDGNVSISTKTKSIDVMGADEYRNFVTDRFGAESSAVKLLGKENTDWQKEIFRTAVGTDHNITVSGGLNNMPYRVSVGYTNQNGILKTSKFERYTGSVNLAPSFFEDHLNINFNAKGMISNNRFADTGAIGAAIAFDPTQPVMNGNSKYGGYFAWENAGEFISIATKNPVAMLQQKKEEANSKNLVGNIQVDYKFHFLPELRANLNLGMDMATGTQDIYYPKESPLGYVDNGKTGYETIDKYNHLLDFYLQYAKDFNEKHHFDIMAGYSWQHFHRSTENAYNNLNGDNPTSYIFKTESYLISFFGRVNYSFMNRYLITATLRNDGTSRFSKDNRWGLFPSVALGWKIKEEGFMKDVDAVSDLKLRLGYGITGQQDISQGDYPYMATYFAGQDGAYYQFGDQFVPIARPDGYNPNLKWEETTTWNAGFDFGFLDNRITSSLDYYYRETKDLINVIDVPAGTNFKNRIVSNIGSLRNQGVEFSINAKAISTSDWKWDLGFNVAWNNNEITKLTAQDDASSIVLTGTVEGGTGTMIQAQGVNHPANSFYVYEQVYDQQGNPIEGLYVDRNGDGVINDEDRYFCHKPAADVTMGFTSKLVWKAWDFSFSLRSNLGNYVYNNVASSNAALSEGSINNKGYLSNRPLSAFDTNFQNMNVLSDYYVQNASFLRCDNITLGYSFNKLFGVLGGRIYGTVQNPFVITKYKGLDPEVANAADKTFGIDKNVYPRPLVGILGVSLNF

SEQ ID NO: 8987 - protein, 380 aa, Burkholderia ambifaria MEX-5
MKKTLIVAALAGIPAIAAHAQSSVTLYGLIDAGITYTNNQGGHSAWQETSGSINGSRWGLRGTEDLGGGLKAIFTLENGFGINNGTLKQNGREFGRQAFVGLAHDGFGSLTLGRQYDSVVDYLGPLSLTGTQYGGTEFAHPFDNDNLNNSFRINNAIKYQSVNYGGLKFGALYGFSNATNFANNRAYSVGASYSYLGFNVAAAYMQLNNNVNAPALAASDPGAVAGDWTFAAGRQRTWGAGLNYGFGPATAGFVFTQTRLTDSAGISAGQSGVSRGIALTGGTRFNNYEVNGRYALTPAFSLAGSYTYTDARLDGQSPSWHQFNLQADYALSKRTDLYLQGEYQRVNADGLAIGANINGLGSASSTNKQIAVTAGMRHRF

SEQ ID NO: 8988 - protein, 790 aa, Burkholderia ambifaria MEX-5
MSFTFAARPSRGRLALACAAAFAWPAAYAAATDDVRAGTARGGGVDRPPTTATAAPAAAGVAAASAPAGDTLSAVSVTAQRQPVDPDTPAVVTSITREQIDAHTNVTTEDALKYAPNLMVRKRYIGDRNSIFAGRDFNELQSARGLVYADGVLLSNLLGSSYAYPPRWSLIPPDDIARVDVLYGPFSALYPGNAIGSTVLLTTRRPEQLEASLSTQFFTQRYHDGYGFADSFGGNHQTARIANRVGRFWFALSLDRLENNGQPMQYAGPNSTYNPKLGAAVPVTGAATDIGPNGKPRTIVGAQTIERTEQLNETVRMGYAFTDHVDATLTLGHWENHYRQHGETFLRDAAGNPVYGGNVSIGGQNMTVAPNAFAPQRGDQENWLYALGLNGRLDSGWRLSGVVSAYDVSRDVLRAASTVQGGAGTLFQGDGTGWRTLDLKAEAPVVKGHTFTFGYHYDNYFLRNVTYNTADWLAGPTTSLASVYRGDTRTQALFGQDAWRFAPRWLATLGLRYERWDAYGGALGNARGTLGYADRGANALSPKVALQWDATEVWRFRLSFATGTRFPTVGELFQGTISNNAIVNNNPNLRPEKAIDWDFTAERDVGVGVVRASVFQSDLRDSIYSQTTVSGATTVTNISNVDRVRVRGVELAFSGENVGVRGLDLDANVSASNAQILADAANPAYVGSRFPRIPRMRANLLASYRFDEHWLTSVGVRYSGRQFNTLDNSDVNPDVYGGTSSFTVVDLKARYRFDRHWTASAGIDNVTDRRYYTFHPYPGRTFYGELKWSL

SEQ ID NO: 8989 - protein, 384 aa, Burkholderia ambifaria MEX-5
MKNHVIFAAALAAFAAPAFAQDSVTLYGLIDEGFNYTNNVNVHGVGKTDYQLASGYAQGSRWGLKGSEELGGGLKAIFTLENGFDVNNGRFNQGGRMFGRQAFVGLSASRFGTLTFGRQYDSVVDYLAPLTANGNWGGTLFSHPFDNDNTDNSFRVNNTVKYASPDWNGLSFGGTYSFSNSTGFSTNRQYSLGAQYSLAGLQVAAAYLQANSPGVGNAGAIAADDANFVADRLRIFGGGINYTFGPATVGFVYTKTDVKNPVSTVYLPASTFSGLGLTATKFQNFEINGKYQLTSDFYLGAQYVYTDGKFDAATGSFKPKYHTVGLMADYSLSKRTDVYLQGAWQKVAGDKTGTAADGGYVVGTDGPSSSSNQFAVRAAIRHKF

SEQ ID NO: 8990 - protein, 369 aa, Burkholderia ambifaria MEX-5
MTLRLKHLAWLIAAAAPAAASAQTSVTLYGRIDGGVEYLNHIATPNGSSTRWSAEGGDWGTSMFGLKGFEDLGGGMSTVFNLETAFQVMNGTTGGGRMWSRRAYVGLKSDTWGQLQAGRNLFIDSDGVWEFDPFVQQAFSSASLVRGRNWQQSSNNIEYHSPVIGGFDVQAQYAFGNQSRGFNYGAADDFGRSDGIMISYHSPVLDVRGIYDELRDNNGKFSNIFTASREYFVGANVKVSKFKIQGAYTHYQAPDSPAGVADRADHYWLGATYTATPQWAVTGGGYYVKVGDGGGDASHDPSGHAIMYVLGTTYNLSKRTFLYGTVAYVRNGGNSNFSLIASPRDATSGTSPMTGESQTGAYVGMMHTF

SEQ ID NO: 8991 - protein, 681 aa, Burkholderia ambifaria MEX-5
MKIRPLVATVAALLFAADARAQSSDSALTLGKVDVHQHHEGQLSAHQVLTSVDVLGADQIEDKNVSYSWELLGQMPGMQLTETRQGAESGKVSFRAFNGEGYLNAIKTLIDGIPSNVNSGNQRFIDMLFPLEISYIEVVRGTNDPRYGLHNIGGNINFGTRQGGSYTDARVAYGSYASRDAQIAIGREHDGFAQNYFIGAQASDGYRAHDRSSKYVLGGKWFYGNLDDGMRIGLTARAYRNQADEPGFMTAAELQTDRRSSDRRNRNDGDDRDMQQAGVHLDLKLTDALFLGSKLYYNRYEDDRRVTFSDLPIGNAPRQRRRWDETQVGMLNTLTWRANDLLTLEGGINYEHQDNAYRRERFNYAEPTDFTAAPARIQNDDRYTFDNWGAYVQAIYQPVEALKLVPAYRVDRFDGDTLLPGAVRAPLQRYGSIGQPKLSVIYALTPTTNVYANWGRTFQVLTGSTAPAYLTPGQAGIRPSTNTGVELGMKFSPFAGSQARIAVWQQDAENEVSNMPATGTTVTLGKTRRRGVDAQISAQLGDRWTLWASHAYQEARITRDDRAAALSLQGNEVIATPRYISNIGVDYRATEALQLGLQGRAQGDYYLEERNVAGKYGGFATLDLTVRYTINPNWSVDVQVRNATGREYAYVWYDSFFWAQAQPMFSPAAGRQLYLGLRMKL

SEQ ID NO: 8992 - protein, 316 aa, Burkholderia ambifaria MEX-5
MKTKVTNAVLLSSALLCSTAYAEDIKLYGRAHLGIQSSDVGEGRETDIESYASRLGVLSNHKVNDSLEAVFRFEWEVNVTEQDHDGAKAENLTARDQYVGLKGNFGEIMIGRMDTAMKKSENQVDVMNDFAADIKVLFNGENRLGDSIRYQSPLMGEVKLLVTYVAKENSKQNDENGISAAITYGDIHLKRTNMYLALARDEKVAGYTVTRLTGQFQLGDLMLGGMYQDSEKDADGTDGDGYMFSASYKIDDYKLLGQYQHSDMAFGKLKDTGDAASLGVERKLSKQARMYLLYSMFNMDTIEDQDHLAVTLRYDF

SEQ ID NO: 8993 - protein, 910 aa, Burkholderia ambifaria MEX-5
MKRIRNLFCLSLLLVAVGLPAVAQTKLHVPLPDSITTVGYATGLRKNLSGLVERITENQMNKDQITNPLDAIRGRVPGLTILKGSNGPAALDAVRLRGTTSLTTGNDPLIIVDGVFGDLSMLTSIYPADIESFVILKDASETAQYGSRGASGVIEITTKKGVSGRTSVNYNGSFGIASSYKTVRMLNGNEFRTLAQERGISILDMGNNTDFQKEIEQTGLQHNHHIAFSGGTNTSNYRVSLALMNREGVIVNEKLQNFTSNMNMTQYVFDNFLKCDLGMFGSVQKERNLVNLHKVFYSAASYNPTFPNHKNPETGSWDGYAYASQLSHPLAWMDVKDKNATSHISTHARLTFNLAEAWKLTFFGSYTYNVVENAQYLPVAVWAQGQAYRGDKKMESLLGNLMLSYKKEWRKHFFDVLGLAEIQKDKYSGFYTTVTNFSNDKLGYDNLQGGAIRPWDGTNSYYEDPRLVSFMGRVNYTYDDRYILTVNARGDASSKFGSNHKWGFFPAVSVAWVVSKEKFMEKLSFIDNLKIRAGYGLAGNQNGIDSYTTLNLMRPNGIAPVGSTPVVTMDKLRNTNPDLKWEVKQTFNAGIEVALLGNRLLLTANYYNSKTKDMLYLYNVSVPPFTYNTLLANIGSMRNYGTELSIGITPLKTKDMELNINANLTFQQNKLLSLDGNYQGEHISATEYKSLAGLDGAGFHGGYNHIVYQIVGQPLGVFYLPHCTGLVSDGNGGYTYQIADLNSGGVSLEDGEDRYVAGQAVPKTILGSNISFRYKDFDISLQINGAFGHKVYNGTSLTYMNMNSFPDYNVMKKAPAQNIKDQTATDYWLEDGDYINFDYVTLGWNVPLKNTRYLQSLRLSLTVNNLATISGYSGLTPMINSSSVNATLGIDDKRNYPLYRIYTIGLSVNF

SEQ ID NO: 8994 - protein, 694 aa, Burkholderia ambifaria MEX-5
MVGAAFAQENTAAPTGATTDMLPAVSVSASTVRDPGEGYNPTNAVSATRIDAPLRDIPQTVNVVTAEVMRDQHANSLQDVLKNVAGVGFSTGDGQRDQVTIRGFSAIADQFVDGIRDDALYFRDLSNVDRVEVVKGPAAVLYGRGSSGGLINRVTKKPGVDVTNLGVSYGSWADRRVEADVGRVLANGAAAFRITGAHEEAKSYRSQQFLNRTAVAPSFEFRIAPKTTVLLQADYLEDRRVTDFGIPAYKGRPVDVPASAYYGAANAGEVDYSRSRVYSSTATIKHEFNEQWSIRNATRYYHYSLDRNNTLVGSVNEANRTFTLNHGNVYREEHGWFNQTDLTQKATLFGMKHELLYGMEFGQQNKDLVNYSAPVTGANGKPMNFDLFAPALPALPLHTSTTPATNNLGIFKTLGFYTQDLISFNDQWKALVGIRYDRFEQETLDRRPKQPGLSRTDTAWSPRLGLVWQPTRAQSYYVSWSRSFQPSGEAFSLAANNAELAPEITTNTEIGAKYDWLGGKATTTISVFRLDRSNIKVANATNTALIPIGEQRTDGVELSGAAELSHGWRVLAGYAYLDATVTNSTAALQGKRATLTPRHSGNLWLTKNLGGGFGVGGGLNFVGARMADPQNTVTLPGYVTADMMAWYAHGPMSLQLNLYNLFNKGYIVSAHGSNANLNLPGAPRSVMATLRYEM

SEQ ID NO: 8995 - protein, 455 aa, Burkholderia ambifaria MEX-5
MLKFQKLPLLFVSILYNQSPLLAFDYKFSGVAESFSKVGFNHSKLNSKEGIFPTATFVTATIKLQVDSNLLPKNIEKHSLKIGVGGILGALAYDSTKTLIDQATHQVYGSELFFFIGRWWGYLGDAPWKDSRIESDAHTRNYVLYNSYLFYSYGDKFHLKLGRYLSNMDFMSGYTQGFELDYKINSKIALKWFSSFGRALAAGQWIRDWYAPIVTEDGRKDVDYGIHAVQLYFSNKHVQATPFFYFSPKTYEAPGIKIHIDSNPKFRGLGLRSQTLINVIFPVYAKDLYDVVWRNSKIGEWGASLLIHQRFDCNEFNFGFGYYQNFGNANARIGWYGNPIPFDIRSNSIYGLVFSNAVTADSVSGYVFGGGVYRGFLWGILGRYTYATRASERSINLHLGYRWGSFASVDVNLQYYEVSMHTGYKVNDLTSPFNKAFKANTQDRSNLMVSVKFFF

SEQ ID NO: 8996 - protein, 385 aa, Burkholderia ambifaria MEX-5
MKKSLLALVALGAFAGAAHAQSSVTLYGIIDEGFIFNNNAKGGHLYGLSSGVMQGSRFGLRGTEDLGGGLKAVFVLENGFDVNSGRLGQGGLMFGRQAYVGLSSQFGTVTLGRQYDSVVDFVGPLEAGDQWGGYIAAHPGDLDNFNNAYRVNNAVKYTSPTYGGFSFGGMYSFGGQAGQFSRNQVWSLGAGYNNGPLVLGVGYLNARTPANFGGMFNTGASAATTAVSSPVYGAYANSANTYQVIGAGGAYTFGAATIGATYSNTKFKGFSVGPFVNQTATFNNGEINFKYQLTPALIVGAAYDYTQGSKIDGNSAAKYHQGSLGVDYFLSKRTDVYVIGVYQHASGNALDAAGNVVQAHASINGLDPSTTSNQVAARVGIRHKF

SEQ ID NO: 8997 - protein, 394 aa, Burkholderia ambifaria MEX-5
MNWRLIFVAMPALCAAPAFAQGSVTLYGLVDAGIDYTNNVGGHSAWQMASGFAQGSRWGLKGTEDLGGGYSALFQIENGFNVNSGTLAQGGRMFGRQAYVGLGNTRFGTLTLGRQYDSVVDYLAPTTANGSWGVYPFSHPLDNDNTGNTFRVNNTVKYASPDFAGFSFGGTYSFSNDTGFANNRQWSVGAQYEQGGLLVGAAFLNADNPGATAGGAIAGSGSVGADANFASARLRIFGAGINYTAGPATLGFAYTNSNVTRPTANVGYLFGDETIEPVAGPLAGGTVTAIKYQNFEVNGKYQFTPAFFVGAQYVYTTVRYDATTGSAKPKIHSIGLMADYNLSKRTDVYLMGAYQRVAGDATGSSLDQAYIPGAADLSSTSKQLMVHAGIRHKF

SEQ ID NO: 8998 - protein, 386 aa, Burkholderia ambifaria MEX-5
MKRTTLSLISLASFAAIPAAHAQSSVALYGVIDTSITYVNHAQGKDNAWMLGNSSAGNLSGSRWGVKGTEDLGGGLKALFQLENGFDPSNGRQGQGGRLFGRQAFVGLTSERYGTLTFGRQYDPLVDLVQGITADNYLGSVFATPGDVDNYDNSFRVDNAVKYTSAVYSGLQFSAMYSFGGIAGSTGAAQSYSAAVSYNNGPFSVAGGYFHATNSPASNGLRDGWTSSSDGTFDGPINSGYASAHSIGIARIAGQYVAGPFTFGLGYSNAQYRRDASSAFDSNEHYNTGQGFVNYQATDALLVGVGYSYTRSGGDTSATYHQVSAGADYSLSKRTDVYLSAAYQHASGQTGDGKGGSMAAQASIASYGYAGTSSQTMVNLGLRHRF

SEQ ID NO: 8999 - protein, 767 aa, Burkholderia ambifaria MEX-5
MHCYPLARRPICAALFGVFGLSAALAYADSTANAANATYVDSSSKGANPRSAVLAAASARGDAALLDPVTVTATRTATAASRTAASVSVITDDDLEEQQATNIKDALRYEPGVTVRRTAYRPGSAALGGGRDGDSSINIRGLEGNRVLLMEDGIRLPNAFSFGPLEAGRGDYADLDTLKRIEILRGPASALYGSDGLTGAVNFITKDPRDLLSIYGKPTYFSFRPSYDSADRSVGATVSAAAGNDRVQGMIIADGRRGHEVDTRGSNNSASTLRTTSNPQDVYSESLLGKLVLTPTARDTIKFTAETVQRRVSTDVLSAINRPDTLGLSTHDRLERNRFSVDYDFRDDALRWFQTAHVQFYYQDAKQDQYAFETRGRQPSRSRDNEYQERTFGGSAFAESGFSTGPLAHKLLYGVDGSLSRVTNLRDGTVPGVGESFPNKAFPDTDYTLFGAFVQDRIGYGRLLVTPGLRFDTYRLSASQNDPLFTGTAVSTSANEVSPRVAVLYEITPALIPYAQYAHGFRAPTPDQVNSSFSNPVYGYTSIGNPNLKPETSDTFEAGLRGKAGTGYGIVRYSAAAFTGRYRDFISRTTISGSGRPVDPFVFQYVNFADARIHGLEGRAEWVMPNGITLKTAMAFTRGSTRNDGAASQPLNTIDPFSAVFGVRYEPGERWFVQTDLLFQAAKRDNDIDKSDCSNKACFAPPSSFVVDLRGGYRFNKHVSATIGIRNLFDRKYWNWSDVRGIAADSQVLDAYTSSGRTVAVSMKVDF

SEQ ID NO: 9000 - protein, 384 aa, Burkholderia ambifaria MEX-5
MNKKLLTIAILAATAGTAHAQSSVTLYGVIDAGISYVNHSKTANGGSGKLFKYDDGVAQGSRWGLRGTEDLGGGLKAIFVLENGFNSGNGSIGQGGAIFGRQAYVGLSQSQFGTVTLGRQYSFSTDILGSNYSTGGNTVAGNYAYHVNDVDQLTSSRINNSVKFQSANYAGFTFGALYGFSNSTDFAGAAGTGATNTGGSSRAYSFGVNYANGPFALGAAYTDIRFPSQSSPAFSTTIANISTGNIRDLRTYGVGGRYIFGPATAWALWTRTQFTPVAAGASGTFYNAYEAGLKYAFTPALSAAAGYTYTNATQNGGSAHWNQGNLGLDYALSKRTDVYGLVVYQKASGNNVQAQIGSSTSYFNTSGTGSSNQLAARVGIRHKF

SEQ ID NO: 9001 - protein, 201 aa, Burkholderia ambifaria MEX-5
MKRTTKIASIALIASSAFAGAAAAGSLENTTVEAPVFTPAPMPTPVAVDGNWTGFYTGLQVGQTDIDSDSGTLDGDDTSYGFHAGYDYDFGKFVLGGELDYDKTDIDLGTAGATADSVARAKVKAGYDFGNTLVYATAGAARADTSVGDETGPFAGLGVTYKVTDRYTVGGEVLQHKFDDVGGTGDDLDATTISLRGSMRF

SEQ ID NO: 9002 - protein, 642 aa, Burkholderia ambifaria MEX-5
MNLRHLLATSAATALLSPIAHAAGDAALTQPRPPADGTDLPTIAVTDTRHLPESFDQRYATTQVLTRADLDRLSPSEPSITQALAMLPGVTVSQTGGPGSSASVSIRGSSASQVAVFIDGIRIGSPTTGIAPWADLPTEAFERVEVISGPAAASFGANAMGGVVQLFTRRAAGQPNQTSVSFGGGSNKTFDTQLRTSGTVPSTGPLAALGGLTYSLGLHAYNTAGIDATRPVLPYHEDGRNPYHAQDLDARLGYARDNWSISTFALYHRSDLSYDNAGFANRELDHQLTTGIAFHLDITPDTQFDQSFGYANDRQFLYASDPSIRTDRIDSQRVSSSTSLTHQTHGFHLFGLPLSGETKVAYDFTREQAFLPIDVPDGVPTRNDSAFSLHQSATLGSVTMFVAGRHEIIAGKAVNTGNAALSWAITPVYTARVSYGNAFRLPTFNDLYYPGYGNPNLNPERSDSVEAALDANTAYGTFSAAIYDTRVNNLIAYNPATFSPMNIGRAHIRGIDLSYKGTIGRTTPMSIAVGILNPQDETNDSWLNRRPRQTVSVNIDHTWDELHLHALSTGASLNYGGTTFDDPANATYLPSYLTVNLRASYKINAHLTVSATLSNLFDRQYMTAYGYNTLGRTAFGKVSYTF

SEQ ID NO: 9003 - protein, 611 aa, Burkholderia ambifaria MEX-5
MNRNLYLLFALFICGCLHATAQNDSINWLDEVRLSDVKLQQFSTGKHINELSDSLLIKNQPQLTEILSFNSSIYFKENGRGMVSSPSFRGTTASQIAVVWNGININSQFNGQLDFNTVNTGAYDQISVRGGGGSVVYGTGAIGGSVHLNNSLSFKKKQEHQLLLQYGSFNTIDARYNFKLAKNKWSLNLALSRNSSDNDYDYPNERGKNLNGEYSNNSVNVAFGYRFNSANTLKIISELYDGERHFSLIRPTENKTKYRDLNNRNLLEWNSEFSNFKQITSLAFLREDYQYFANIDSDTYSYGTAKSYIAKYDLGYNLNSDVLLNTVVQNTYTDGEGSNIANNDRNILSVAILGKHSITQSLQYEAGLRKEITGNYESPILFSFGANYKMNDFYTLKLNASKNFRIPTYNDLYWSSAGNPDLDPETSLQAELGNHFRFENMEAGISMYYNDVSDMIRWLPGGDGIWRPRNEDKVNIYGLESFVNCKKSFSKETNLIARASYAYTISKNSETNKQLIYVPYHKVTGNLSYQIHQFTPFLQVLYNGSVYTRTDYSEQLSGYFLANLGMSYTIDKERDWELGGRVNNLFNTEYQNVEDRWMPGINFNLYINFKF

SEQ ID NO: 9004 - protein, 397 aa, Burkholderia ambifaria MEX-5
MNKQLIAAPLLLSLAGIASAQSSVTLYGIVDAGVTYRSNERGGSPGAYTGHSEVGLTTGNLSGSRWGIKGSEDLGGGMRALFVLENGFDITNGTSGQGGRQFGRQAFVGVGSTRYGTVTLGRQYTSLNDFVSPVAPSSFIGGFGAHPGDIDDLDQTARVDSSIKYTSANYAGFTFGALYGFGSQPGSMKQRNTWSVGAAYAAGPLRVGVGYERSDNSKTGATDPTAGKWRSTDDGLFNSSINEGYASAQSQQVIATGATYNFGPAVVGVNYSNIQYRSGAQSLFSGHATFNVAGVFTRWNVQPQTQLFAGYSYTRGSDVDGIDNRAQYHNVTLGAVYDLSKRTSVYLLGAYQHASGTTLDALGRPVAATAAVSDKANGHSSDSRSQAIVSLGLRQKF

SEQ ID NO: 9005 - protein, 723 aa, Burkholderia ambifaria MEX-5
MPSRRTPRRARILRPWRASLPALITLCVASGAHADAEPAKAASAPASVSPPERELPTISVNASAVADPTVGYQPRTSSIAGGDERPLKEIPQSVAVVSSSVMQDQQARSLDDVLGNISGVTQTNTLGGTRDAFIKRGFGSNNDGSVLVDGVRTPVLHSYLATIDRVEVLKGPASLLYGMQDPGGVINLVTRKPEDTFGGSISASRTSHGGGSAQFDLTGPLGKPGQVAGGTLAFRLTGEYDTSRYWRSFGRERNALIAPALSWHDANTSIDVSYQYVDYTMPFDRGTVLVNGRPDDALRYRRYDEAWAQSGGIQETLRARVEHRFSDAWRVRATYGWGRDRYDQYIARGTTFNSATGAMTRTADANLGRNDSDQIATLGLLGNLTLAGMNHALYVGGEYERQRSFRGDTIRGKAIKGFDLYDPVYGLLAPGGMPNAKSSDSLSKVHTYSMIVQDSVKITDRLTAVGGLRWEDWQQESGMGRPFAFADRSHGNVWLPQFGLAYALTPSLTAYANVSRSFKANVASNVTSPLAPEFGRVLEAGLKFNLKPGITGTLAAYQIDKRNVAVTVGDITSTIGTARSRGIELDVAGQLTQHLSLIGSYAYTNANDRDSNTSLVNVARHTGSLFAVYDTALANLPGRWRFGGGARLVGARPGDTANSFTLPGYVTVDAFAAYETTIGKFPTRIQLNVKNLLDKTYYPSSNSNLIVAVGEPRLVTLTTTVSF

SEQ ID NO: 9006 - protein, 364 aa, Burkholderia ambifaria MEX-5
MKTKLGAALATAMVLAGPACAQSSVTLYGIIDTGVSYYNNAAHDGSFTGMPTLTGEVPSRWGLRGTEDLGGGYQAFFVLENGFQPGTGALNYGGRLFGRQANVGVNSPFGALTLGRQMNMSMIVLTNADVIGPSIHSMADFDSYLPNARSDNAIGYKGTFHGVTLGATYSFGRDAAGPAGPSATGCAGQVPGDIVACRQYTAMLAYDASNFGLAASHDVMRGGGGALAPLNNPAYTDTRDIVAGYVKIGPAKLGAGWIRRNLAAAEHLQADIVFAGGTYYATPYLALDLQGVRYLQRRENSEGGTNATLLVGRANYFLSKRTTVYTSVGYMFNSTLAANAVAAGGTVGTGMNQLGVMAGIQQKF

SEQ ID NO: 9007 - protein, 277 aa, Burkholderia ambifaria MEX-5
MKKTLLCAAAGAAAVAPLAAHAQSAGSNVVTLGWFHIMPQQSSTPMTTNVAPTPINTPLRLPPSFTSAGTGLHTSGADTVGLTVSHFLTDHIAVTSVAGVPPVFKVSGQGTIKPPGPAGALGTQNIGLGSVNPIVKSVRQWSPAVILQYYFGQATAKFRPFLGLGVSYNWFSDLQLNTNFIKQTQDNLGAILAAGAGKPGTTSVEAKASSSWQPVFNAGLQYNLTEHFGLIASVTYIPLKTTSTVTIKAADGSVLAESKSDLKADPIISYVGMTYKF

SEQ ID NO: 9008 - protein, 359 aa, Burkholderia ambifaria MEX-5
MVKQAVAAAVIGMSAVSGAWAQSSVVLYGSMDAGVAYVNNVGGHAKWAMIQGNTQPDRWGLKGKEDLGGGLSAIFQLENGFYTNNGQFATANTIWNRAAFVGLSSERYGTLTLGRQTPLTFDYLDPLSTAYLAMSWYAFHPGNIDGLAATGNVPYNNAVKYRSPSFGGFSAAATMALGNTTNFSTGKSVGVALNYANGPFKASAVYSNEHDRAILISQTGITSFQGQNTANGYLANKVENIGAGASYQIGDFLVHGLYTRVKMQSNGFSDTFQSYDAGVNYRSSAFNTIAGGAATTTLAGRRWTQVELGDIYSLSKRTQLYANVLFEHGSGGAKASFFTAGTSSTANQVIVLTGIHHSF

SEQ ID NO: 9009 - protein, 747 aa, Burkholderia ambifaria MEX-5
MKSRPDELKLGKFTTLCSVLAASPAFADGTPSPAPVSTEGHLAPIEIQGKTEHSYKADFSASAKFTAPLVDTPKSVTVIPQELIQNSGAATLTEALRTVPGITFGAGEGGNPLGDRPFIRGYDSQGSMFVDGMRDTGATTREIFNTERVEITKGSDGAYGGRGGAGGSINLITKAPHLGTTAAASAGFGTDRYRRFTADGNWQFADHAAFRLNLMSHNNDVAGRDVVNNERWGVAPSIAFGLGTPTRVTASYYHLSTDDMPDGGIPYFYTTSNKPANVDTIYPAPVDRHNFYGLIDRDFRKTTSDISTIRIEHDITPGLTVRNTTRYTESTQDYIWTQPDDSQGNVVNGKVWRRNNNRDSSINSLANLTELFGEFRTGPFKHSFTTGIELSREWGKRDSYKVATDTGKICQKGIGAASGYNCTSLWSPNPSDPWAGSVTRNNDYAHARTTTKSIYGFDTIEITPRWQVNAGVRVDDYSTRFTDTKANGGKTYTRDDTLFNWQAGLVFKPAQNGSIYASYATSSTPAGMLLGEGSETQSLTPGRGGVGPNADQMAPEKNRSIELGTKWNVLNDQLALTAALFQIDTTNARVTLPNNQYAMVGNKRVQGLELGVAGQITKQWQVFGGYTYMKSELRDNGKDAANDGHRFPNTPKHSLTMWSNYDVTPKFTVGGGAFYMSEVFGDPANLRAVPSYWRFDAMAQYRINKKLDLQLNVNNLFNRTYFDQAYPAHYASIAPGRSAFITLNARY

SEQ ID NO: 9010 - protein, 1068 aa, Burkholderia ambifaria MEX-5
MNHVYRVVFNRSLGVYQCVSELAKTCGKSSGKSSKTAAKNGFTLRALSTALFSVLGLSIASVTHATTYDNGAVNIVDNGYTIVDDIVKNDGTILKNNDVNTYNYMQMNGDQELPSRLLITDKGAVQTNQFIIYNNALVDIEAGGRLEANSIYTSNYYGPNNQQIASDTKINVNGSGSLLKAQDWLSIRSQNSETTLTVENGGTVEANYLNIYSYSYFDENNQLTPADTSVNVDGSGSLLKAQGWLSIGSRNSETTLTVENGGTVEANYLDIYSYNYYNQDNQPITTSKTNVNIDGSGSSLKVQEDVRISSENSGTSTLTVKNGGTAEANSLGIYSYGYYYQDNQPITTGETSVNVDGLSSSLKIQEDVRISSRNSGTSTLTIENGGTAEANNLYIGSDDYNNSTSTASKSVVNVSGNGSSLTVNNLYAGIGGKGQVDVTDQGTLEVTRQLQLGGSDTEGANAVGELTVDNATLIAPATVVGAFGSGTLNIVNNGVIKTQSIERFENSAKSEVNFDNGTLKLTGSQPELFRNFTGDNLINLGAGGGTIDTAGFSAGLFEDTTLAGNGAVITGTGDFTKTGTGSLTMATTAKQWTGATNVKQGTLRLDGDYTMRDGEILGIGLNSLDDYGQLVVNGSADITEGQLNVNASEAVQRLNGATVWNDIVRTSNLIGNFESVTDNSQLVGFVADYSTPNAVNLIMVRQDKFVDTIQNQANRTGLSLAGVLDRSIDIRLANNTNELADALISSTIGFNQSQIAAAVNELQPLLMGASNRIITDANIVISNAITEHSLSSSKRGLWAQALGSNINHEEENGTTGYDADSYGGIVGIDTPINSNLNLGMAVSYNDSDVDSDSQNLNHKMSAKSWQVLGYGNYAVSDATQVNFHAGAGRSNIEGERYLSILTDAVAQSDYDVDTLQAGFGIGHRIGTENRNITPFAQVNYAQAKSDSYRETGAGVYNFEVDENTYESMRWTAGIKMSQALTPKIALTGQLAAAIENGDQRSDITASFISMPEDKFTTVGQEVGQEIGIAGIGIRYMPTANTTLSAGYRGEWRDNYDDQGANVALQITF

SEQ ID NO: 9011 - protein, 622 aa, Burkholderia ambifaria MEX-5
MIKKSSLLTALSVTAFSGWAQDTNPDTLIVTANRFQQPVNTVLAPADVVTREDIDRWQAKNLNDVMRRLPGVDINQNGGMGQSSSLFIRGTEAKQVLVLVDGVPMTRPGITNNPDLNQIPISLVQRVEYIRGPRSAIYGSGAMGGVINVITHSDQEQSKITAGVGSKGYQQYDGTLRHRFGDTVATVAGSYEGNKGFNVQPGSTWDHDRDRDGFRSKAFWGSLEHKFNDNFDGFFRGHSYTNNSDYDLGSPPSIPAYSADESQLYNQSWDAGLKFNSGIYSSQLLASYQKVKDYNYSSIYGRYHDGTTLDRMTQRNLQWGNNLIVGHGSVSAGVDWQQQRLTSSDTVMSDTYKRDNTGLYLTGQQQFGDVTLEASGREDHDEQFGWHGTWQTTAGWEFIDNYRVTIGYGTGFLSPSLGQQFGSTRFGINANPNLKPEESKQWEAGLEGLTGPLDWRLSAYHYKITNLITYYFDPNTYQGEYDNIDAATIKGVEWTGSFDTGIFSHRVTLQYVDPRNDDNGEVLARRSKRQAKYQLDWTMFNVDMDVSWQYYGKRYDNNTSQYNNTQQILPSYSTVDVSASYPITDRLTVRGKIANLFDKDYETAYGYQTAGREYYLSGSYTF

SEQ ID NO: 9012 - protein, 641 aa, Burkholderia ambifaria MEX-5
MSISVIITHNNALGAETKLSPIYSTAETHLTQPPGLIVVDLSNEKRFSLLSDALKSVNSLQVLDSGVPGDPVLVSIQGASSQQTRLLINGIPTNSSQWGTYDVNKLPIDFIERIEIHTSSHSQGINQGIGGTINIITKKTTPSSLNIGVGSYGKQRFGMHYAIGKNQRLSISHQKFANDYRLPIASPADNPQAQNQKQSLKNAEFSITSAQYHYVHSLANVELNAAHSEKGVPDYFRNTPLNSASLEKKSYGILITSNQKSFFNLPKISQNFHLSIKQERENFKDIEGTIGLSSNDDVYDQEQLELSWKPDYSSESIYSFLSITTKFDQFSSQHRLDDDSFLCTTPQGSCDQKAKQYQLNTNGSVTVFSQDKTHSLTSQASLFQVNQENSERNNTRITQSDDVYEQYALIYELDANSPSLDELRLKIGFEKNIRIPSLFERFGDRGLLIGNQDLKAETGRKWFIELPYQYKQVSIAGSLFHRDLDNAIVAVYDSRGVGRYENTSKAAMSGLELKVRLDKEFWYYQISTSQYDSETQSTQVKSFNNKQLPGIYHNMIQTQLGFSHHHWKGNLEYQYADKLYIDRSNLAEGDEREIVNAYLEYEYSSLTLTLSIQNLTNNQFNDYTNRPVVGRQWMINSAYYF

SEQ ID NO: 9013 - protein, 1017 aa, Burkholderia ambifaria MEX-5
MKTFRFVLLLFLVLSISNTAWAQNQTVKGRVMDSKLKEPLMGVSILEIGTSNGTVTDLDGNFTLSVPKGVVLRISYVGYLVQEVPINGKTYLDIFLKEDTELLDEVVIVGYGAQKKATLSGSVTSVGGEKLAKTPVTNVSQGLAGRLPGVVAVSNTSEPGYDGATITVRGVNTFGKADPLVVVDGVPGRSLERIDPSTIETMSVLKDASAAIYGAQAANGVILITTKRGKAGKPRVGFTYNYGIAAPTVIPEMTNAVEYATLMNEIDKYAGNKGRYTVDDLRLYADGSDPWGHPDTDWFNETLKSWSPQTYANATIDGGTENVKYFVSVSAKGQDAFYRHSGSNYHQYDLKMNLDMKINKYVDTYVNVTGRMEDRKYPTRSAENIFRMLMRSKPNSPAYWPDGRPGPDIEFGDNPVVICTNQTGYERDKRYVLNGDFGVNIKVPYVEGLTLKATASLDKTFRFRKIWQKPWYLYSWDGTSMDENGQPLLVEGKKGFSDPRLTESMEDNLGVLLSGIASYSHTFAQDHDVNILAGVERITDKGDSFEAYRRYFLSATIDQLFAGGQDEMNNTGTGYEEARLNYFGRVNYAYKSKYLVEFVWRYQGSYIFDRSNKFGFFPGISLGYVISEEDFFKKKLPFISFAKVRASWGQTGNDLIDPYQYLASYTFNDLMYLTNNGATMNQALKEGVAPNQNVTWETATQKNIGFDLQFLNGDLAFTIDYFYNKRSDILWKRNASVPSTSGLVLPDENLGKVQNQGVDFNIDYRRNFKDFRLGINLNGVYAKNKILFWDEAPGTPEWQKSTGKPIDSGLYYEAIGIFKDQAAVDAYPHWAGARPGDIIFKDVNGDDVIDGNDRVRNDKSRTPRFTGGLNVDLGYKDFDLSFLLQGAMGGVFYQTTESGDFANFLKSFYDNRWTEENPDADSPRTYNRSNEYFINQQNTFWLHKTDYIRLKNIELGYTVPSIWSKKIGVEHLRIYINAYNLLTFSPDMKDYDPENTSGSGYNYPLNKVINFGVNLTF

SEQ ID NO: 9014 - protein, 360 aa, Burkholderia ambifaria MEX-5
METNVTRMIRFAVPTMAGLLAASGVMAQGSVTLYGIVDQSIRYTTHANASNDASVQMTNGAITNSRWGLKGSEALGGGLKAIFQLESGFEPQNGQLDGALFGRYAYVGLASDWGTVKLGRQATEAFNLFGDLDPLTVGNYTANMWPYFITQGRASNAVSYDGTFGGLDVGASYGFGGVAGSLGANAYWGTHVSYTLGGLMVGATYQQVRDLHSRAQQAWGAGARYAFGAATLYAGYLGGIDRTGMLDRQLLNAPGRDVTYGSFADNPRRDAIFYTGVSVKVTPAVSVTGVGYYDDIRNVNGVAGNGGKRYTGVLEAEYALSKATQVYATVDYNRVSGGAFTEMPGRGNQTGIAAGLRHLF

SEQ ID NO: 9015 - protein, 729 aa, Burkholderia ambifaria MEX-5
MGTATGSVRRAIAIAAGGTLCAAAAGGAHAQASSAAASPSADAAAMLPKIDVTGEAGRASLGLVGLRTATATRTDTPVAEIPQTTNVVTAQQIEMTGATDLNQALRYVPGFATFGSDTRTDWYAALRGFTPTLYVDGVAAPNTAVIANWRVDPYTIDSIAVLRGPTSVLYGAGEPGAIVDAHTKLADGERVREAGVQIGNDARKQTMLDIGDKLDPDGRYAYRFVGVARDGNAVTGPKADRRVAVAPSFRWRPTADTSLTVSASFLQDHGDISSNFLPASGTVLPNRNGRLSQDIYMGDPTFNDYRKKQWSLGYALEHRVNPIWTLQQDVRWSRLSLDDATVFGNGFMPGSTTNMMRFAGLFQLNYSRLDIDNRAQARFATGPLEHTLLLGLQFDRQTTTNSVWLALAPSLNLYHPVYRPVTTAIFSGRTSLGHVDQYTAMNSLGAYVQDQIRWNRWTLTLGGREDRVNARFDDRAARIGTQQDVSAFSGRVGLTYQGDAGLSPYVSYSTSFDPVIGVRMYGGGLPKPTRGKQTEAGLRWQPAGRNLMLTAAVYRIDQTNVVTPTPTNLDPTGTSSVQTGKVRSRGIELSAVGNVTRELSIVASYVYQDVKNVQANDASLNNWPVSVPLPRQMASLWTDWTWHTGALSGLGVGAGMRYQSASAGAPDNSLTVPSATLYDLAMHYELRHWRFALNVANVFDRRYVGGCQSYAVCVFGNERTVLASAKYNW

SEQ ID NO: 9016 - protein, 888 aa, Burkholderia ambifaria MEX-5
MNTKTIIKLWKGNEMRPSIFKKTVLATNIAILLGSAVSISAVAADAAATTAAPENIEKIEVRGMRASMKASVNDKRFSDAVVDAVTAEDIGKFPDGDVGESLGRIPGVAVNRQFGQGQQVSIRGASSQLTSTLLNGHSVASTGWFDQQAIDRSFNYSLLPPEMVGGIQVFKSSQADIAEGGIGGTVIVKTRKPLDLDANSVFLSAKGDYGTVSEEIDPQTSGLYSWKTEDEKFGFLVAGSLDKTQYQRNGIESLLGWGEIVPTTFQQDRERTAVNAAFQYRPTDNLEFGLNLMSLQLDANNANTSIFLFPTQQGENTCLKKNAAGVCTLVEHTGKGGFAWAQTWARKASMSSDTIDLDFAYQADAYKLEGRIGKTKAEGGTDITSNYGQSIGKPEDFAGTYDATGDVIGINIANNSFDASDFNGQLETAGWALKKQPNTDEESFATFDITIPVELGAITSFKSGISYADHDVTQTTEAAQSSNIVAKDASAYYSGTMSSGAGFTLPKPIFDNMINDAYAAIDGFTLDKSGYGTLQEKNLALYTMATFAGEGVRGNFGLRYVSTDVESDYYAFSKTGTYADGLSTDKASYNDVLPSVNIAFDLASDLILRASAAQVISRPNYADLFATSKLPGFNDGTPGNEKKVTGSVNLQPFKASQADVSLEWYFSGEGLFAATYFIKDVSSFISTREKLNQQIGIEDPNLIAAGGSTCGAGIYDCWTVSENYNANGGSIDGIELQLQDSFDSGLGYSVNYTFADASSPAENYADRVGVFSDSSKHTINLVGYYEMDDFSARVAYNWRSEYMMRELPGFYGNREHQAYGTLDLSASYNLTDYLSLTFEVVNLLEEDSVQKGVSPVDAEGVISEFKDNYPVWSFDGEARYKLGVALRF

SEQ ID NO: 9017 - protein, 961 aa, Burkholderia ambifaria MEX-5
  misc_feature (6)..(6): Xaa can be any naturally occurring amino acid
  misc_feature (549)..(549): Xaa can be any naturally occurring amino acid
MHSWKXKLVVSQLALACTLAITSQANATTYDTFGYHDDAATVFGWDDTNDHDYLTYGGYVYNTPASDSGYFDTKFTGDTVNGVISTYYLNHDYANDTANTLDVTNSTIHGMITSYQMGYGQYVWTNGSDYTTHDWVDDDTFNLNISNSTIDDDFEAFYFTDTYLDSDGKTVKTDYDKLVTAGLGTAITLDVESNINITNNSHVAGIALYQNDLGNSTYTTEAHQWDNTINVANSTVTSGSWSEDEEQGHFGNSSEPSDYNGNGWNKDDVALAFVDDPYSNYRMVNNVTFTDSQLLGDVVLESSWNYNFYSNGRLVDDSTTVYTNGGWADDDQNVDHLTLTLNNTKWVGAAVNDSQSMDPVQFYDVDANSLDPDSTNYDAWGRVNSAASFQSGIFDVSLNNGSEWDTTKTSVIDTLAVNSGSQVDVANGSNLTADTITLNGGSAMNIGEGGYVDTDHLTVDTFSTVTLADDVSSAWSDDALYANTITVTHGGMLDIQTNNTNADSVIDTDTLELTSSNVADNNGNVYAGVFNIHSNDYTLNADLVNDRTXDTTQANYGYGVVAMNSDGHLTINGNGDINNGDEADASSTTDNVVAATGNYKVRIDNATGAGSVADYKGNELIYVNDINTDATFSAANKADLGAYTYQAKQEGNTVVLEQMELTDYANMALSIPSANTNIWNLEQDTVGTRLTNARHGLADNGGAWVSYFGGNFNGDNGTINYDQDVNGIMVGVDTKVDGNNAKWIVGAAAGFAKGDLSDRTGQVDQDSQSAYIYSSARFANNIFVDGNLSYSHFNNDLSANMSDGTYVDGNTSSDAWGFGLKLGYDLKLGDAGYVTPYGSVSGLFQSGDDYQLSNDMKVDGQSYDSMRYELGVDAGYTFTYSEDQALTPYFKLAYVYDDSNNDADVNGDSIDNGVEGFAVRVGLGTQFSFTKNFSAYTDANYLGGGDVDQDWSANVGVKYTW

SEQ ID NO: 9018 - protein, 408 aa, Burkholderia ambifaria MEX-5
MFRKIMPAALLIPCLTAQAQSNVTLYGIIDIGVNYLNNAQSARTATGLRGGKQWSVMDGGTGGLQGSRWGLKGAEDLGGGMKAIFLLESGFSANNGTLGQGGAEFGRQAWVGISTTRYGKVTLGRQYDEVVDFYAPLLAAPQWGGYMVEHPSDLDNASNTRRVNNSIKYTSPTIAGLTVAGLYSLGGVAGSFGTNRVWSVGAGYANGPLSVGVGYLNAHNPNTSFYGTNPNAGPATANNLGGAGSATSPQSNPIYAGYASAKNLQIAAISAAYAIGPATLGVAYSNTRFQDLGSSSGPNPLGYTGTAYFHNIEASAKWQVTPAFVLGAAFDYTTGSGAAGRNGAKYELSSLGADYFLSKRTDVYTVAVYEHASGTDSLNQPAVATITGMTPSSTNNQVAVRVGIRHKF

SEQ ID NO: 9019 - protein, 201 aa, Burkholderia ambifaria MEX-5
MSRKLLSGLTCSCCAIVFFQSAYAGSPYAGLTVGKAYLNNSSIKGSNREYSCDDGEGYCYAHGLELGNFRLEGEIGYQKNDFDAIEPGVRTANGDLSILSLLGNGYYSLSAQGSRVMPVISAGVGVANIEFEDEVNAVDDSDLVLAYQVGAGLGYKLSESVTVTTMYRYFSTSDAGFDEEADDLHVDISSHNIMMGVKVNF

SEQ ID NO: 9020 - protein, 999 aa, Burkholderia ambifaria MEX-5
MKKLITLIYIGCLLSLASFGWAQVNLEVSLLRLPDLQPVKNIQVYLENPAIGYRTQSVSNAQGKVWFRGLSTLGAYQVSVPENGQYLAAKITGIDLRAQAKPSVQLLLTRKNSKQLDEVVVSAATSKINTINAEVASDLQLKEIQALPIEGRDITRALYRLPNITQATGFYPEAPNISINGANSLFTNYMIDGMDNNERFLGGQKFAIPVGFTKNITVLTNNYSTEFGLTGNGIVNITSRSGSNQLSGEVFLLVRPGSVIDSPSEFAQRDLSGNQVKDGFQRYQTGFGLGGALIKNKTFYYINAEQTIDVKDNLLNSPDLNINETVRGQNRFTYLSGKIDHFWSKYWSTTLRANVGISAIERQGGGLEGGTLFPSAASLQDRNSTLIALKNLYTGKQLTWESNVQFARFRWNYGRPQNGESPQVNILVNNLPAAVLGHPGFIFDSHEKTWQIQQKLEYSLNSQHTIKAGLELLSAQHSLFGGGNINGNYTVLPTNAELASIIAQNKGANLQIDDVPATVQVLSASVELRPNSFGGTQNIYSAYVEDVYSVTSRLNVILGLRYDFDNLSQTGAGKGDFNNIAPRFSFNYKLNASSSIRGGIGTFFEKILYAVYSDALQQNTRSDNYLLQLQQLQAQDLIDPSADLNQLVFDGNLTANVDNVGYLQAPAALQNERNNIFSNERRILSPNGWQNPYTHQISLGYQYEFDRDFLFYVDLVHNQSYNLFRLRNLNAPKPFSPSQAKPVRTQTEADFTRPVPILTDANGSYAIINGQRISGIARNVVVSETAGRSTYWGASFNLQKAQGKSKVSYRFTYTLSLLENNTEDINFRAMDANNFEAEWGPALNDRRHVINGVINFFPIKNFTVTTAFLLQSGQPINRIPDASIFGTTDLNGDGRSFGDAYVGNSDRSPGEPRNSDRLPWSNTFDLSLRYQIPLGKNSRHKFEISADVFNVFDAENLSGFSNNASQSNQIQVGPRASGNLTIRNAAPPRQFQFGARYVF

SEQ ID NO: 9021 - protein, 363 aa, Burkholderia ambifaria MEX-5
MKSRAERSLRAAVLTGSAAVAGLTAGAAHAQSSVTMYGIMDAGIEFANHAAPEGGNSYKLKSGNKNTSRWGLRGVEDLGGGLKAVFRLESGIDLANGASDDGPDSIFGRRATVGLKGKWGEISLGRNFTVTYDYMLPFDPMGYAQNYSWATSSMATGGRKDGMFTRSSNAVRYDGEFSGFKFGAMYGFGNVPGSVKTSSKYDAAIGYEGGPFAAVVAFDRQNGASDSVTPADPVNYIQGIHAGLSYDFGNLKTMAGYRNYKRTYRTSAANQLSDMYWVGGSYQFTPTFSLIGAVYHQNIKGGTDADPTLVSMRAQYALSKRTVLYAAGAFAIGQHGQKVGVSRDVNGYGTTQVGVTAGIQQRF

SEQ ID NO: 9022 - protein, 386 aa, Burkholderia ambifaria MEX-5
MKKLALSTLSLALLGAAGAAHAQSSVTLYGVIDTSIAWVHGNNGEANNSWQMLSGNLQGSRWGLKGAEDLGGGLKAIFQLENGFDPGTGHLNQGGRMFGRQAFVGLQSDQYGTLTLGRQYDPLVDLVQAVTADNYFGSVMATPGDVDNNDNSLRVSNAIKYTSPVWAGFQVEGMYALGGVAGKTGSGQTWSVAAAYNNGPVGVAAGYFYAANPSPTTTPGRPGWGSTTSDAIFDGPINLGYQTAKSIAIAQVAGQYALGPVTFGLGYSNAQYKPDAFSGFTSTEKYNTGRAFVTYQVTPPLLLGLGYSYTKASGDTSAKYHQVGIGADYSLSKRTDIYLVGAYQHASGTQRVDATTTQSAQASIASYGFAGKSSAELVALGIRHKF

SEQ ID NO: 9023 - protein, 376 aa, Burkholderia ambifaria MEX-5
MNHPNGRADRLAVPRAALVAALLTCASLPALAQSSVTLYGRVDTAIEYANAGPNHVTRVGSGNLWASQWGLKGVEDLGGGYAAIFKLEDGFNAASGALSNSSALFGREAWVGITGPFGGVQFGELYTILHTTLVTYSLPGLGAGLAWGNATNNFVGPAFLRVRNSMRYTSPRYAGFMLRAMAARGANGAAGQPATLGDTYGAGLNYARGGLSIDVDYMQQKFSPVAASALGATSPAANGNYTLGAISYDFSVVKIAALYMRHRGGPDVAAAIDSQSAYPHSDTMELSATVPIGRASLLLSIGHYRKVADSDGNADSYGIRFDYPLSKRTVLYTGAAMVRNGAHARFVVNGAAGGGVAVAKPGATASSIVAGILTSF

SEQ ID NO: 9024 - protein, 243 aa, Burkholderia ambifaria MEX-5
MKRKLAITGAAALAFTFAGSTAQAQSAGDFYVSTGWLHLSPQDSSDPLFVYRVGGTPINQSIPNTGAGINDADTLGLAAGYFVTDHISTELVMGIPPKFDITGKGQFDRFGVLGRAYQWSPAVLLRYHFNDANAKFRPYVGVGATYVWFTGAKITNSAFENGVLGGPTSATTSNQWAPVLNAGFTYNFTKHWFAGLSLSYIPVSVTATFTTARRTPVGTLTETSKAHISLNPIVTYLNLGYRF

SEQ ID NO: 9025 - protein, 708 aa, Burkholderia ambifaria MEX-5
MRHTLLVTTLALHTLPAFAQQTTAPAVTALDGVDVVGRAQTLYKSEDAAVATRTDTPLALVPQSVQVLPRELIDDQAARQITDLYRSISGISFFSYAGVTLRGFRQENVLYDGLRSDPYAGFSVPQLFNIERVEVLKGPAGALYGGGEPGGVINYVTQKPGHQAARRVELQVGNQSFGAASFEATGPVREDGRIRYRIGAYADGEDGFRWNTDSQSQIGDASVAFDIGNTGELTLQYTDITQNLGGNRLRGVPVDNAGNFLTDRRWNHNEPPDFLDMRAKVAFAQYRFAPSSAWSVDMALRWFKNDEHQIYHEPMGLIDRDRDGTAEWMTRQLRNQYRDNDAISSNVNAVFRTSTGTIEHTLLMGADSYRLDANFRAQTANTADTGRVRGPVPGIDLFNPVYGRSGFYDYGLHSLPWRATSTRSQRYGTYLQDELTLTSGWYAMAGLRWDGFKDDNLLDGSRVTGNDLSWRVGSTVVLREGINAYASYASGFLPQDAANQDSSAGGPFAPERSTQWEVGLKTALNDGGLTFNTALYRIERSNILQANGRIVDGVNQLSALGLVRSEGMEVDVLTDLTERWVLNLTYAYNDARVLDAGTNGITNASGNRFANAPRNTFGLWTRYDLPAWRSAIAFGADYVGERVSLDGQRVKPYAIYDISWQTHWDAWKLQINIKNLFDKVYAVSGFNTRAGHFPGEPRRIYAQLAYRF

SEQ ID NO: 9026 - protein, 418 aa, Burkholderia ambifaria MEX-5
MRNATYRLGYSFVSPDTPLIDLNFNLYRNETDYTQIDQNPAAARRDVEVATTGFDLYNASRFDLGIVPTTLTYGVDYFRDEVETHDDVGSTELFTPSGTREVYGGFVQARFEYDTWLEVIGGGRFDHFDLTSTATTEENTGDRFSPKLSVGVTPIQGFQIYGTYAEGLRSPTLNEAVVSGLHPAPAAFELLPNAGLSPEVGHTLEAGVNLSYDNVLVGGDGLRAKLAVFRNDVDDYIEYATLDRPGVANPCLAGRGPICFARLPYDALQYQNIDKARLEGVELEASYDWRWGYVGLAGAIIDGENRRNGDPLNSVYPDKLTTTLGFRALNERLTFGGRWHAVAAKDDVTDPTLASDRYDVFDLFVAYEPNENTRFDASIRNLFDRQYQAYSGFPASETDPAPGFEAMFGVSIKFGVDN

SEQ ID NO: 9027 - protein, 358 aa, Burkholderia ambifaria MEX-5
MKKALVAAALMAAGVVTAHAQSSVTLYGRLDAGIEYMNGLQNGHQVRAESGDWGTSLWGLKGSEDIGGGNKILFHLEGAFNTMTGGFSGSIWDRFATVGISNDRYGTLLLGRELAIANGVWDFDPFGQSAWSTASLVRGRNWNKTSNNVSYQSPSLYGLDFYGQFSFSNSTSFNGNTTAGQPGRAMGGQVTYTNSLFQLRGIYDETRDSNGRFSDVFNYSREYFAGVNVFLGQFKVQAAYQASRADGSGGPAVNAGVTGTQQVWGGVTWQATPAAALIAAVYHVNANHGGGNANIYTVGGSYNISKRTLFDLQVATVRNSSSANFGLNANGAGTAVSTGNPHQGGSQTGVYAGIQHLF

SEQ ID NO: 9028 - protein, 1027 aa, Burkholderia ambifaria MEX-5
MKTLYFKLALCFFLLLAGNATQGIWAQQEPIQIAGIVLDEHGDPLPGANISVKGKEKTGTITDMDGNFSMKSLAPKTTLIVSFMGYKSKEIVVAQTDKKMRISLEPDSESLDEVVVVGMGTQRKVSVVGAVTSVNPAAISAPSTSVANMLGGVVPGIIAVDRSGEPGQDVSEFWIRGISTFGANQSALVLIDGIEGNLNDLDPSDIESFSILKDASATAVYGVRGANGVVLVTTRSGQEGRTKVTWKSSMTLSYSPRMPEYLEAYDYASLANEARVVSNMDPLYSPTELEIIKAGLDNDLYPNVNWQKEILKDVTINHQHYLNVSGGGKVARYFVSVGGTFKDAIFKQDKVNKYNTNVKWAKYNFRAKVDMNLTSSTIMGLAMDGAIVEDRAPGFGTNNDALWAAQAYLTPLTVPLRYSNGMLPAYGKNGEQISPYILLNHTGFKKGNRTTMNINFTLRQDFGKWIKGLTARGMFSYNNNNIHNVVRSKMPDLYKAFGRYNDGSLMTQRTVSASNIQFAKSAASDRRYYFESQLAYERLFNQEHRVTGLIHYYMQSTETTEANDEISSIPKRYQALSARATYSYKDAYLIEGNVGYTGSENFEPGKQFGLFPAIALGWIPTQYEFMQNHAGWLNFLKIRASYGEVGNDQIGGGRRFPYLTLINFGGGSRWGSNGLTEKQIGANNLHWEVAKKYNLGIDFQFLNDKIGGTVDIFRDTRDNIFQERKMMPSEVGVVTNPYTNVGRMRSSGIDGNIYLNQKINEDNSFTVRANMTYAVSKVVHWDQDAVRYPYQSYSDVNYGVMRGLVALGLFQNQDEINRSPKQTYGEVRPGDIRYKDVNADGKIDDDDIVPIAHSNVPQIQYGFALEYRYKRWTISALFTGAAKVNFLYGGSGFYPFSGGEVGNILSIVNDPKNRWTPAWYSGDPSTENPNARFPRLTYGENKNNNRASTFWLADGSYLRWKSLDISYRIGTNKVLRTVGISDMNLQFVGQNLAVWDSVKLWDPGQASKNGAVYPLQRTFSLQLTATF

SEQ ID NO: 9029 - protein, 373 aa, Burkholderia ambifaria MEX-5
MKLRCFTSLVATMVMASTAVASEIYNKDGNILDMFGSLVGGHYFSKDNTKNGDNSFVRYGFSGTTYINDQIVGFGMWEHEISLKNTEGSIVNNNDKVLLGYAGIKFGNLGSIDYGRNYGVLYDVGAWTDVTPGFGGDILFVDNFLSNRSSNVITYRNKNFFGFVNGLDFALQYQGKNDVNKATGRTLKTANGEGYGVSASYSLDNGFAASLAYTNNKRIIEQTGLDSNLCCNANAEAYSLGIKYDGNGMYVAAIYGETYNMTPFGSFCDNLNPEYIYGFVNKAKNIELVAQYQFGFGLRPSVSYLYSKANDAENDAYSNFLKKCVTVGTSYVFNKNICTTIDYRINLLHKDSFTSASQICTDNVIALGVAYAF

SEQ ID NO: 9030 - protein, 397 aa, Burkholderia ambifaria MEX-5
MHSSANSPAFRVRPAARAALLATAVITLGLAAPALAGATPDELETRLRALESKVATLTEENATLKQRLGASAPAKSGPAAVVPMGKEAKLAIGGFLHLQGEWGDAPDARFPVGDRFLVRRARLGVKGSFVEGFDFALTSDFGSNSLGTVSGYRAQITDAYVAWSRFPAATVTVGQFKTPFGYEQLMSGTKHIVIERALVNDQLTLRRQIGAMLSGSVGGPRLTYAAGLFNGNGSNNSANDNDQFTYVGRVAGTWIQTDAGRVSTGINAFTGRDSGSFSGHRRGLGVDLQASYRRLELQAEYLNTCFDRAIGRDYTAEGWSLLGSCVIIPKLLQGVLRYEVYDVDRDLAGDTTELWTVGFNYLIKGDDLKLSFNYLLGDLPGPRAEEGRLISRLQVVF

SEQ ID NO: 9031 - protein, 384 aa, Burkholderia ambifaria MEX-5
MNGDTYKKGKLMKQTTRLAAIAGGAALAFASQYAAAQSSVTLWGVADASIRYLTNANAKNDGLLSMANGAITNSRFGIYGTEDLGGGLKAVFNLESGVNLQNGGFADSGRLFNRAAYVGLQSPYGTVTLGRQKTPLFDLLADTYDPLTVGNYLENAWLPVALGGGLYADNQIKYTGKFAGLTAKAMYSTGTNYESTGAGGFSGQIPGSLGKGNAWGVSLSYVAGPLSIAAGAQQNSDNSARKQTIYHANVVYAFSKAKIYAGYLRSKDDTGFVDSLLAQQSIPVAKGTGRIDDGPFAGVSWQVSTPLTLTGAFYYDHMRNAMTTNGTLASGNRYAIVGIAEYALSKRTEVYGTVDFNKTNGAANVELPGRSNQTGIAIGLRNIF

SEQ ID NO: 9032 - protein, 1404 aa, Burkholderia ambifaria MEX-5
MGGKPAARQGDMTRKGLDIVQGSAGVLIGAPTGVACSVCPGGITYANPVNPVLGAKVLPGETDLALPGPLPFILSRAYSSYRTRTPAPVGVFGPGWKAPFDIRLQIRDEGLILNDNGGRSIHFEPLFPGEISYSRSESFWLARGGVAEQHSSQPLSALWQVLPEDVRLSPHMYLATNSLQGPWWILNWPERVPGADEVLPPEPPAYRVLTGVVDGFGRTLAFHRAAEGDVAGAVTGVTDGAGRRFHLVLTTQAQRAEVFRKQRATSLSSPAGPRSASSSLVFPDTLPAGTEYGADNGIRLEAVWLTHDPAYPDELPAAPLARYTYTASGELRAVYDRSGTQVRGFAYDAEHAGRMVAHHYAGRPESRYRYDDTGRVTELVNPEGLDYRFEYGQDRVTITDSLNRREVLYTEGEGGLKRVVKKEHADGSITRSEYDEAGRLKAQTDAAGRRTEYSLHMASGAVTAVTGPDGRTVRYGYNSQRQVTSVTYPDGLRSSREYDEKGRLAAETSRSGETTRYSYDDPASELPTGIQDATGSTKQMAWSRYGQLLTFTDCSGYTTRYEYDRYGQQIAVHREEGISTYSSYNPRGQLVSQKDAQGRETRYEYSAAGDLTAIVAPDGSRSEIQYDAWGKAVSTTQGGLTRSMGYDAAGRITVLTNENGSQSTFRYDPVDRLTEQRGFDGRTQRYHYDLTGKLTQSEDEGLVTLWHYDASDRITHRTVNGDPAEQWQYDEHGWLTTLSHTSEGHRVSVHYGYDDKGRLTGERQTVENPETGEMLWEHETGHAYSEQGLATRQEPDGLPPVEWLTYGSGYLAGMKLGGTPLVEYMRDRLHRETARSFGGEAYELATAWNTSGQLRSRHLNLPQLDRDYDWNDNGQLIRISGPQESREYRYSDTGRLTGVHTTAANLDIDIPYATDPAGNRLPDPELHPDSTLTAWPDNRIAEDAHYVYRYDEYGRLAEKTDRIPEGVIRMHDERTHHYHYDSQHRLVFHTRIQHGEPQVESRYLYDPLGRRTGKRVWRRERDLTGWMSLSRKPEETWYGWDGDRLTTVQTQQTRIQTVYQPGSFTPLLRIETENGEQAKARHRSLAEVLQEDTGVTLPAELAVMLGRLERELRQGSVSEESQQWLAQCGLTAEQMAAQLEAEYIPERKLHLYHCDHRGLPLALISPEGETAWQGEYDEWGNLLGETSAQHLQQSLRLPGQQYDEESGLYYNRNRYYDPLQGRYITQDPIGLEGGWNLYQYPLNPIEHIDPLGLALDLNYYSPSDPIYKGSLNVREFPTGFTVGGHGSPTSMSDDRIKKGSDLTIKQLASDIRANPKYHEGMPVVLFSCETGKGKNSFAQKLANELDATVIAPDEIIWIWPDGNYAIMGQTARITIGGKDNGVFELVPDEKQPGDFHKFTPTGSK

SEQ ID NO: 9033 - protein, 707 aa, Burkholderia ambifaria MEX-5
MLLAAGAVLSATPGTVPALRAQEATTLEEISVTSVSPIQGRPAAPAPAPATLPARAAEVLPVVTNTFSPVTVVPQERIARDQPRTLGDALFDRPGISASTYAPGAASRPIIRGLDNARVRIQENGIVNGGVSDLGEDHAVPVNPLNASRIEVIRGPATLRYGSGAIGGVVSTENNQVPTFIPARGVTGQVTTGYTTVDNGRTGAASVDAGADGIAVHADGFKTATDSYAIPGGIQRNSATESQGGSVGISAIGDRGFIGLSYSHYDAIYQIPGGEAEEARTRLTPNQDRLLARGEYRPLNGPFEVLRFWAGGSVYRHEEIGIGEDGVEGVQAIFKNREVEARFEAQHVPVFTALGTLTGAIGVQAGRRVLNSQLESFLPPTESRMLAGYLFEELAVGGGLRFQAAGRIEGDRLNSIATLFPGDFLPDGTDPASFALTRRFAPKSASIGALQDLPYGFVASLNGSYVERAPTGYELFSQGPHDATATFEIGDPTLRLERARTVEISLRRADGPLRLDATGYYTRYTGFIFKRDTGNRCDDDFASCGTGDELQQVVYSQANATFYGAEIGAQLDLFAVGDGWAGLEAQYDFVRAQFDDGSYVPRIPPHRLGGGAFVRANGWFARINLLHAFDHTEIAPFETVTPGWNDLRAELAYTQALDPAVYGATEVTLGLQGRNLLDDDIRNSASFKKDEILLPGRNLRLFLTARF

SEQ ID NO: 9034 - protein, 669 aa, Burkholderia ambifaria MEX-5
MNKTKLAIKVMLALSLATTPAFASQIPSYDMGEIIISADAYRLTTDTETINIKVVSPGKTTSIPDILRQVSGIDVQQRTPYDNQDGTVKLRGFDTRRFTVLVDGRPISMSGVMGGNYVDWNAIPLDQVEKIQIIKGAKTAQHGNTLGGVINIITKDAQTAGGTLETGMGENGQYQYRLHYGASSHDLAWNIYGSKFGRDAFLRNNSYDADQYGFTAKYRISPGDSLKANWHKTKEHHGMIIPNYPGGTTGYDRSYPVINATDAEKFLGNIIPNPGAYWEKNFTTYDATWSHKTTQGFIDLTYWKNDEKRREVNYSSGAVSLDRTVVTDLSRGWQLKGEQTAGRSTYAYGAEYKQLRYGYGWYTAGSGMALYPSQKVNLFGSYLEKTWSLDDRWTGNIGLRYDKMTGRPDAASDIRNVDHNALSPKLNFSFRNDQQTTTFISVNRLWRSPSMAEFYWWSKNYTSTDPKVIGDGLMLNPEKGWEYELGVERKVSPQLTTKLTAYYQNINDYINFTHQYPYSCYNIPKAKLWGVEWENSYQLNQAARVFLNYTNQHTKKEGVDPSDNLGLRHELDYRPRHKATLGYQYDAKPWHIRYTVDYTGEQSANYPYGTPAIIRLGGYVVHDLAVTRDLTEDSSLTLSINNLFDKHYAEQNNYPMPGRLVSVVYRYKL

SEQ ID NO: 9035 - protein, 809 aa, Burkholderia ambifaria MEX-5
MSSAVTQRRHRTFSLKQNLAGAVAQGLVCLGASTATALLPTWALAAEQAQVEFDIAPGNLASALTRFGQSAHILLSYPASLTEGRSSPGLRGRHDVDSGLALLLSGTGLQAVRGANGDYSLQTRGNGASLELSPVSISGKAPGSTTEGTGEYTTYSSSSSTRLNLTPRETPQSITVMTRQRLDDQNLSTLTDTLEATPGIIVTRDGLGAETDSYWSRGFAIQNYEIDGVPTNTRLDNYSQSMAMYDRMEVVRGATGLISGMGNPSATINLIRKRPTSEAQASITGQAGTWDRYGGGVDVSGPLTDSGNVRGRLVADYKTESAWVDRFKQQTQLLYGISEFDLSEDTLLTLGLSYQRTDVDSPLRTGLPTRFSSGERTDFKRSTNTSPDWSYNDHQQTSYFASIEQQLGNGWSGKVEFTHAENQFDELFNFAMGSVNKDGSGLTQLPVRFSGTPRQDNLDLYLTGPFSLFGREHELIGGMTLSQYKERTPSWGGWRYDYAGSPAGPIDNLFDWNGHSPKPSQNVSGKASIDENQYAAYLTSRLSLTDDLSLILGSRVINWSSDSSDRPYGGDETKVKREENGVFIPYAGVVYDLDDTWSVYASYTSIFNPQASWVRSEDNKPLDPMEGKGYEVGIKGSHFDGRLNSSLALYKLQQDNLAIWQHDNVYSSEQDTTSKGVELEFNGELAEGWQASAGYTYSVTTDADDQRITTGVPRNSFKTFTSYRLQGPLDKLTVGAGVNWQSKIGGDLHTFTQGSYAVTNLMTRYDISRNLSASLNLNNLFDRTYYSNAGSYGNYGAPRNLMTSFKYSF

SEQ ID NO: 9036 - protein, 402 aa, Burkholderia ambifaria MEX-5
MKIGRRLAAAAATLGCMHAHAQTSGSVTLYGTVDTGIIYSTNQQFTRADGSTGGGHAWQMGGGNLVPSRFGFQGAEPLGGGLDAVFSLEQQFLSANGQALQGGTAFSRQAWVGLREDGIGTLGLGRQYDSYTDMLGAYVSSNNWATPYGSHLGDVDNLNAAVNFNNAVKFTSADFHGLTVGGTFSFGGQAGDFSAKRGYAVAATYTRAPIAFSVGYLDLHQPLDAALGGASGYIGDFACSNPGAMYCLLQDAGSMRAFGAGGSVTLGAATLALTYTHTRLGDSRYFSTDAQPRTQAFTFDIGELNVTYMFTPALQGGVAYIFNAAHTDGRGTTRFHQVNVGTNYSLSKRTALYAVAIGQIASGAGLGTDANGNAANYAQIPVLANSNSSRQLAVMAGIRVNF

SEQ ID NO: 9037 - protein, 490 aa, Burkholderia ambifaria MEX-5
MKKQKTIGTASKMLLAWGLPALAGVSLTGVAHADDAAPAPLTVAQAAPSAGASTTVAQATTPNAVINAEATQAVTPPDEPSAQSKSKGFIADSHLDFLFRNYSDVLDSKGGPHRHAWVQGAMANFESGFTTGLIGIGFDASLYAALKLDGGQGAGSMVHIAKGGGGGNQLAWAYPGIYDIKARISNTVVKYGLQAVDNPFMEQHDNRALPPTFLGATIVSNEFKNVMLEAGSFTKTDARGHTTLTNLTTQYGGTRINRLTYVGGTWDYSPNGEVALYANQADDVWHQYYASVKHSIGSTQTIKWTGFGNVYSTHDTGDALQGKIDNNAYSLSLAAQHGPHELLLGFQQVLGDQFFDYLNETNGIFLTNSMDVDYNAPHEKSLQLRYTFYGKEAGLPGFKAMVWGVTGWGADGSAGAANDPSKSSIYWANGAPVQGRHHEFGFIPSYTFQSGKLKDTKVTFIAMWHNGSAHYSDATNREYRLVVNLPLHAF

SEQ ID NO: 9038 - protein, 354 aa, Burkholderia ambifaria MEX-5
MKKRFIAVSAAALMASPLAVMAGDLNLYGEAHLSVDHADDKTDSSQFLASRFSTLGITGSEYLGMGLTGFFQYETEVNLTAGGDGLFDGTTESFLGVQGGFGTVLGGMLDDPLFATLDGLDLFADRVGSVHTMARLDGATSHTNVLAYVTPDFNGFSFAAVYGPEQGTDKGSRFVGQLGFEGEVEGGTISASLGYLQANEGVVNAVAELEPGDPGYNDLKLKIWQATFGYEITDVWRGFAFYQDYGSSDVMEDDKAYGAGVGFMVSPQVELLAQVSRYDADASREGATTYALGADYFITDRTTLYGIAGMTRNKSEQALMPTDVDYYQGAGPEGISPAAGDNPWVVSLGVIHSF

SEQ ID NO: 9039 - protein, 192 aa, Burkholderia ambifaria MEX-5
MNDMKKGLIFVLFALVSIVSYSQISWNAKVGMNMSNFTGDMDTDMRIGFNVGVGMEYQFSDMWSIQPSLMFTQKGAKQDEVKMNPMYLEIPVLAAARFAIADNQNIVVKAGPYFAFGIAGKCKIGDEKIDFFGDGDDQFGAKRFDAGLGVGVAYEINKFFIDLSGEFGLAKLADGDGAPKNMNFSIGVGYKF

SEQ ID NO: 9040 - protein, 405 aa, Burkholderia ambifaria MEX-5
MKKRVAFAMTAAGLAAATAAHAQSSVTLYGIVDNAIAYQNNSSATGATTGGHSKVQMATGIWAGSRFGLKGSEDLGGGTKAIFQLEAGFNANNGSSQWTNGIFTRQAWVGLSNQTYGTLTAGRQYTAYYTLLSPYSPTTWLTGYYGAHPGDIDSLDTSYRANNSLVYMSPKFYGFTVGGSYSFGGVAGSVNRGSTWSAAIQYLNGPAGIAVGFQRINNATLGGGVWGANSTAQNGLDTSGNGAEQAVSSINNGYRTAQAQQRLAVTAGYQFTPAWDVSVSYSNVQYIPGTLSGFRNTAIFNTAGAVLHWKAAPQWDFAAGYSYTRATQSNGISSAAKYHQVTLSQYYSLSKRTGLYAVEAYQHASGNTLTPTGGVILATTSTGDGVGAGSKQNQIAAGVGLIHRF

SEQ ID NO: 9041 - protein, 1084 aa, Burkholderia ambifaria MEX-5
MFKRHIMKKVLLTLSFIMALILGANQTFAQGVTTSALSGKIEDDKGEALVGATVVAVHIPSGTQYGVATNVNGRFRLSNMRVGGPYKITVSYIGFKNNERSGIVLALGQTLNLTIKMLSDAATLKAVEVVGRKDDVFDGNRTGIQTIVNEQRINETPTVSRSIADFARLEPTANLSEGDDGFSVSVAGQNNRYNAIYIDGAVNNDVFGLSGSGTNGGQTGVAPISIDAIEQFQVSVAPFDVRQSGFAGGSINAVTRSGSNKFEGSVYGFFRNQDMAGITPIEKGDIATQRAGLPDFSAMTYGVRLGGPIIKDKLFFFLSAELQRDETPLPFNASTYQGNSSITDLNQLVSKLNGYGYDPGGYIQNNSFLNAERFLARVDYNINKNHRLTFRISNTGARNQERFQSGTQNINFQNGAESFTSNTTSAALELRSSFGNSYANKFTAGYTRVKDDRDPTGNPFPRVEISDGQGTITFGSEPFSTANLLTQDVFTITNDFEIYKGKHTITIGTHNEFYSIGNLFIAFNYGSYEFSSLNDFLTDQPSTDYSRNYSQVDNIVGDNSQAIAKFNAGQIGFYVQDEYQANDRLKLTAGIRVDIPIFQNTPTNEAFNNTTVPLLSQNYDLKGARTGSFIKPQVMISPRFGFNYDVNGDQTLQLRGGVGVFTSRVPLVWPGGAFNNYGLNVGGVFNGTDVFNPDVNSQSPGAIDPGNVTPSGSIDLFAEDFKIPQVLKADIAVDYKLPWGMIGTLEFLYTKVLSAPTYQNVNLKPSTSNLTGADNRPVYDRRDEIDDTYGRILLASSTDKGYAYNIVAQIQKPFDNGLSFAVSYSYGDSYSVFDGTSSQNSSQWRGLHTVNGRNNMNEIQRSAFSAGSRVLAQVSYRKEYAGFGASQIGLVFTGQSGRPYSYIYNDNGNLTNEDSRERSLIYVPRNASEINLVDITDDNNNVTKTAAQQWTELDSFIESDKYLSTRRGQYAERNMNRAPFLSFIDLRFLQEFYVKTAKGHKNILQFTLDIFNWGNMLNSEWGQLRTVSSEFQLINYEGRAADGTTPQFTYNGVQKNDPAYANFDDSGFRSSRWQMQVGVRYIFK

SEQ ID NO: 9042 - protein, 372 aa, Burkholderia ambifaria MEX-5
MNKTLIVAAAAASFATVAHAQSSVTLYGVLDAGITYTSNVQPALGQAGKSRWAMGSGIDQSRFGLRGSEDLGGGLKAIFTLESGFGIGNGKLGNNGGMFNRQAFVGLSSQYGTVTLGKQYDATQDYLAPLTATGSWGGTYFAHPLNLDRLSTTGDVAANNTIKFTSANYAGLQFGGTYSFSNNTNFGNNRAYSAGVAYQFQGLKLAGAYSQANLGDGTNANGATSSAIGGVASQGRVRTYGAAAGYAFGPAQVGAAWTQARLDNNAVGLGTLRTDNYEVNAKYNLTPALGLGAAYTYTNAKINNGSTHWNQFGLQADYSLSKRTDVYAQAVYQRAAKNGIGASIYNGDSFSNNLPSSSINQTAATVGLRHRF

SEQ ID NO: 9043 - protein, 649 aa, Burkholderia ambifaria MEX-5
MGKRLMAALALAAMVCAGTAHAEDAPPASGGATLLEEEVVVSAPIIEGNEVTRYAGQYTEVTQEQITDLNAQDMSSALRRTPGVNISRYNPVGSFGGAEGGGVFIRGMGSSRPGSEIMTMYDGVPRYNPVFSHPLLDMLPMDPAQSIRVYKGVQPTEFGNAFSAIDVIPKRMTEDGYRTRLFTSYGSYNTFTQGVEHGGKQGGVDYYAGQSVRLSDGHREHSDGQIENYFGRLGYDLYENWNVSWFGNVTRNVARDPGSSLSTGNDGRFYTDDVLNVITLANDYGDADGHIKVYWNNGYANWAGQKGNADTTISDWDLYGLRARESFRAWEGGEVTAGFDYDVMSGKALFENDNGTSSEFEREDFVLFSPYAAVSHEFGSRDGFYAIPSAGMRFYTHNEFGDQVAPHTGLVFGYRDTELHAGYARGVNYPGLNVAVFSENVIPPIMGGPFRDDWKNLAPELVDHFEAGVSQKLWGKVKADLTAFWDEGTDRYAVVQGTPKRFRNIESFTIQGLEGTLTYTPFADLSVYAGATWLDTFPSDLPYAPEWTFSAGLNWRFLQHFRLSLDAQYVTGEQVLSQGRTENAVNASEVDPYHVVNGRIAYVFDYAPWEIKEAEVYLALENITDSDYEYRPGYRMPGSSATVGLSVTF

SEQ ID NO: 9044 - protein, 351 aa, Burkholderia ambifaria MEX-5
MKYRLFSLSCFALCCIVGNAHAQSSVTLYGSIDTGLLFQSKTADDHGKAFGTLSSGLWPTWWGITGSEDIGDGTKVIFKLESGFSSNTGGIGDSNGNFWGRQAYVGVGSRFGTLKAGLQISSFYESIVMADPRGNALFFAGSVSPYVTAFGLNGAFESNAVVYDSPTFAGLSFSLEYAFGNVAGNTTAGSHEVASVNYKNGPFTATASYFAAKDSETGASTYHGQNVGAGYSIGPVTVKVAYQKYRNMSTDAPLTNLNVYEAGADWNITPALTANAAMYVTRDRNVSANRSMMYGSGLSYALSKRTVIYGQVGYVNNEAAMNTVLAIDASPSFAIAKGGTVAVDVGIRHNF

SEQ ID NO: 9045 - protein, 1077 aa, Burkholderia ambifaria MEX-5
MNNDFSRQYALVLWILFFGVFLGTNTIYSQTGTVSVDFKNSSPQKIIDNLKSRTPYQFIYQKDLDLSSPLVTLKKDNVSIDEILSDLQKMTNLNFRRNENNIAVNSKDADKKKKKGKITGKVVDINGLSLPGVNIKVSLLNFGTQSDIDGNYVLELEPGEYTIEISAISFQTQQITGVKVTEGEDTPLVVSLKEDAQSLKEVVIVQNYKQATASVQGLLLQQKKAAQFSDGISAEQIARTPDRDVASSLKRITGVTTIDNKYVVVRSMGERWNQAVMDGIALPSTDAYQQNFSFDIIPTSMVESIVVSKSATPDMNANFAGGYVEIKTKDIPKENFTSFSISSSYNSRSAFKERLTKSEGKYDYWGFDDGRRDYPNLQPIEIPTNEASSGPFIEQSKKFTQDNFSTYKTYGAPGTTIQFAIGRSYKLKDNNKWGFVGSLLFKNTQEKLDIEHTERGRFLTNTRFVQEGQGGREYSVFEKFGFKNSGANYNFNSTLGGMFNTAIQLGDHKITSRNTVMHIYNNQLNQITGWDKGTGVPEVLDGTNLPSTTETNYPVYQTFIQNKIEGNHRFNKLEVNWYGSYSSITKDTKDATFLETFRKNIGDDMLEYHSVYNSGGRFPFSRDNYTNDESDYNWAASLDYSFNLGENSKNDIKAGYFGTYKKASNQQRSAKVVTVGQGTDRADIYEPLSEFLDGSQYYYGGFGWMDYGKYGDKYEGEVKIHSPYLMLDNKIGRFIRFVWGVRAESYVYNEISNQFEAPGEFPLTNVDKKWQFLPSAGLTISPTQKTNLRLGYNRSVLRPQFAERVGTPYYDPIRSAKILNWSAGMISSVSNNYDLKLEWFPSGGEVLSFGVYHKDIKDPIESVGTVNGNSGIIYNLNSNNAKLWGVEMEFYKNLSFLGDGIILEQLFVSGNASFNATKVTSYVNVDGTGGLYEANRPLYGQSPYTYNLGLDYTGDRLGFSVRHNAIGDQYILVGFEYSREEIRMPYSTTDAQISYKFFKDKNLELKCSMRNIFDTGIQTYNNANSYSHLEDVSYGSNPRDRYTLGANATKKYDEDIDQVIFKAFSGRTINVSINYSF

SEQ ID NO: 9046 - protein, 374 aa, Burkholderia ambifaria MEX-5
MKTKLAALAALAGCSALAHAQSSVTLYGVIDSGLVYQSTSAASFSPTAPNTGKVFRMKDGGIYSSFWGIKGSEDIGGGYKVNFKLQGSFDSGSGKLQLSDTPGAVAIFNQVASLGVSGPFGSFTAGRQIVPMIYAMADTDVRNAQFFGSVLIAWLGLNTAAGWSGTSTNAAIGALYDSNALVYQSPTFAGASIALEYAPGGVAGQFQGGTRESVVLKYANYGLNASAVYYNGHDTSPAPGVAPTGVDNNRFFYVGAKYTIHDFSVSASYGNGRNPSHADKVNLDMLSAGIGYRFTPALQVTSAVYYLKDRNVSANKSTAVVLAADYSLSKRTMVYAQVGHVNNRGTMDQMLVYGQPVAPGVGTTAAMIGLRHNF

SEQ ID NO: 9047 - protein, 719 aa, Burkholderia ambifaria MEX-5
MKAFARNFIATAVASALLSSAAVAAQNEASAEENKEKAGTQEKIFEHIKVTGSSLDQATTATGLPLTLRQTPQSISIIDRTFIDSFSLDTVADVMQFAPGIQAQQAETDRFFFRARGRDVTNFQFDGVPIAYNSFFSEALADSVIFERVEIVRGATGLLTGVGEPSAAINLIRKRPKAEDGGYASLGIGSWSNYRLEADHSQTLSEDGNVKGRVALAYEEGDSYVNLSEKENAQIYAVVTADLTTQTRLTMGADYSERNPKGSMWGALPLFYDDGTQADDLPVSTTTASTWNRWDRESTSVFVQLEHAFDNGWDIQLDVERRKDDMDGYLLYFEFFPDKTTGKTPNSDFQPSPNHYVAEREQTSYRFLASGPFELFGREHQLTAGALSSEQNVDSVSYSSADAIDVPSLFDWGNGVDPINFSDTPAYGTYESYKQKGVYAAAQLSLTDDLTAILGNRITTYDTFVQSPWSPSDYKNSGVNTPYFGLVYDVTDVISTYASYTEIFKPQSARNADNELIGPVEGSNAELGVKGDFFNEALTASVAVFKVKEDNLAISDPNNADFLPGTTIRPSIGVDGAESEGYEFELNGKPTDSLNIFFSYTHNESEDRDGSDYAPYLPEDMVKASVLYTATDALKVGVNANWQSKISSNPNIGPNGETFIQDSYTVVNAMANYKLSQNWDLSFNVNNLFDKKYYSSIDFYNQGFFGAPRNVELSVKYAW

SEQ ID NO: 9048 - protein, 880 aa, Burkholderia ambifaria MEX-5
MKSRHRISLLVTTAVSVMPCMSALAATTTAHPATRHHSAKPSSAAHSAAHPAATTATPAVVAPRKKKTDVNFTGEAETINVTTGTHATNRKARESSSPVSVISAATLRHSGMMNVADALTRTYASINVQAMGADSSALTSSIQMRGLGPNEVLVLVDGKRRHNTANITADAGPQFGSTGADLNTIPASAIDHIEVLEDGAAAMYGSDAIAGVVNIITKKQAHGMHTSVQTGANAYNGDGWQYKVDADGGVKWGNDGYLHISGEVYHTDHMVVGARDHRLIGSWPNNATTTGYYNGVVPNAMNVPADSNKIMSTPEETRESLAIDFGKTITEGVNFYGLITYMHRHGEAYENYRTPAIAPTMYPAGFSPLETSEENDYAATLGLKGDNFFGFDWDLSTTYGADGNKIGNKNTANTGMLASTCSTDPTSSYYSTDGCGWSPSSTRAETYRMAQWTNNLDFRRQFNIAHTVPMTLAFGGEHRLETYQIKAGTPPSYELGGTQGYAGLGPNSAGNWSRDIWAAYVDGDFHPLKHWDLDFAGRFEHYTDVGNTENGKVSTRYDVTSKIALRGTISTGFRAPTLAEQHYSAMNVDPTGASGLLPVSSTAARVLGASALKPERSVSASGGIVVEPVKNFHVEADVYQINLRDRIVGGGTVKGESAIEAIEAMGYSLPLNSITADNVSAYYMTNGASTRTQGLDIKADYMIRFHNAGNLNLSMALDLNRTRLHHNGTDTNGNPLLNAQNIAYITTAYPRSKIILNALYTVGKWDFNVRQTRYGETTSMLTYYDWTDKTLPCPSGGSLAYSNSCFAQFKNTPRWLTDIEVGYRFNSNWHLAIGANNIFNVRPRRVQQVNNSRGAQIYDQFSLQVPITGGYYYGRINANF

SEQ ID NO: 9049 - protein, 351 aa, Cyanothece sp.
MKGWFRMAAWCGCSAVAPAFAQSSMTLYGSLDTGVTYTSDVASAPRGGRQLALQAGVSRNDVWGLTGREDLGGANFAVFRLESQFQTSDGALTVPGSAFSSQAYVGLGGDWGTVTLGRQFDFVGDLLPAFAIGANTPAGLLAWGLPTNASAGGALDNRVWGVQVNNAVKYVSPTFGGVAFGGMWGFGNVPGTVARSSVQSAMLSYTQGAFSAALAYFGQHDVTAGGNLRNFSGGAGYNVGPFRVFGMVSDVRISAAAPLRATTYDAGLTYAVTPSLQLGGGFQYQQRGGDIGSANQVTLSADYSLSKRTGLYAVFARGHDSAYGAQVEAALGGAASGSTQTAVRLGLRHQF

SEQ ID NO: 9050 - protein, 398 aa, Cyanothece sp.
MSKVNVGYESGSEIVSDRSGFKAAMQWTIDNRSRLVYGFEYGKDNTEQGRDRDVILSLDANGVPITESQYICSVCDLTETKLSPFAQYWNQITDDLTLQIGLRHENFEIEVPDYQRYSRGILSEKQGDTLKYHKPLVNLGLVYSLNDSTDVFASFSQGYSHADMRMLRDMPVDSVAEFSADIPATQTNYYETGLRFNNQDLQGSLSFFYSDITDGYAYDYNVDAQISKRVAAVVVADEKVWGFEATLDYRINEAIKIGTSVSQSEGKRTNSETGVDYWMNGTKITPIKASAYADYRFNDMASVRMQVNYVGDRDKNAPESEAGYSYYESPYDGYTLVDLISTFDTGGYGRITLGIDNLLNADYQPLVSQMNKEVVWEKYRNQFSGYGRRLALEYSVDY

SEQ ID NO: 9051 - protein, 656 aa, Cyanothece sp.
MNPILGLSLALGGLALGIPAWAQPAASSPSAQEVLETGVSAEILNQPVTTPFRRPGLLRDSSRPVYVITRQQIREQGARTVQEALRYLPGILSDGTAGTQLGALSSQFMRGGRTAQVLVLLDGRPINDLGFFGGFDLSQITTDVVERIEISPGGGSTLYGSDAVGGVMNIVTLEPKPGSETVLEAAIGSYGLNEQGIQNRGQAQDLGWVVSYRRLQSNNDFPFEIRRLGKAGRRENSAVEYHNLQAKLTWQLAEGQVLTGNALYLNKAFQVPGSTEFPSPDAVQNTNDLLLDLSWLWDQERGSLQARVFFDDLNYRFSAPQSQGSRDEILRTGWGSQLQYTWKAAENLELTLGADYRSISARNTTFSFARGSTNVNYDNTVNQGAFFARLDYRPQPNFYLNLGVRQDSSNLVNGSATSPAAGIRWVLAEGTTLRANYAGSFRTPLISNLFFRLRGFFEVDGNPNLRPERGESFDIGLDQALGDFGLLRLTFAHNRIRDGITFVSTGPRRGTYENIELVEYTGLEAALDLRLGENWTLFANYTLNDPIIRSALDPKAVGKQLAFVGADSFNLGLSYRDAEDRYASVFLHHIGTFFTNNANTQSLPGYTNLALRGGIPVAENLALEVGVDNLLDEQYEVFPGYPGVGRTVRLNLRGQF

SEQ ID NO: 9052 - protein, 668 aa, Cyanothece sp.
MLKLLWKTLLVSPAFAGIVLASNSAAAEGTSQFEFNESATQGVEIAQAQDELLDKLENYSQEGNSNSNDQVTSVSELRDVSPTDWAYEALRSLVERYGCIVGYPDRTFRGNRATSRWEFAAGLNACLNTMERLIQENVAVLREDIEKLKRLMQEFEAELAALGARVDNLEGRVAFLEDHQFSTTTKLVGEVIMAATAAGGSRSSEDNQAVLQDRIRLSFNTSFSGEDLLVTRLSASTGTGTDRFTLNEPNLRVINPATGQPIGIAFEENTLINPTATQTFNIGPRRNEQDNDVTIDWVGYYAPIEPLNNFKIDTYITAWGGRWHHFVPTLNPFFEDFDGGKGSLSTFAQRNPIYRIGGGAGAGMSFQVGFLESLLGPTSVSFGYLAGTANDPCLNGGGQNPDGSIRGCQNSNADNPATPGFEYAESDGGNGLFNGNYGALAQLNTNLFDVINIAFTYVHAYHKPDSPIFGSGIPFGPGEVGTSFANFSRSELNNAFAAGSIGAPGTSTPDYNSEADGQGLLPVNPFDIGGKVTNSYGGEFTWRVAEWLNFSAFGSFTNVRFIGRGLSAEVWTGGGGFAFPDLFKEGNLLGIFAGVQPYHGGRNRPTTADFFELPSRNPVTAEVFYRYQVTDNISITPGVIWIANPDQFVNIQGADDEVIGTVRGTFSF

SEQ ID NO: 9053 - protein, 797 aa, Cyanothece sp.
MIIIIINMIVLLNVFLAIYLRINNHIKDTIMNFLLIKHEPHFQGMGAVSFSSHAIFLLLTTLASFNSVASQSTEKASQTQQSETVVLDPIYVSGKLNSSVEAGSTALTLKDINRIQPNNIAELVDKLPGISSSGSPRPGGQTLNIWGMGNPEDVKITLDGTPKTFEKYRQGSIFIDPELIKRLDVDKGPHNITQGNGGFGGSVRIETKDPDDLLLPDQHIGMFLKYGHHTNDRQNRYSGAIYGKLMDGTADGLFYFNRRKSDDLRRPDGTKFGYSQSDQDSFLIKTNVYLTDAQTLTLSASRSVSDGWTPWAAKRDELAKPSQYDVDKYGFDGAMKRKLVYRDQKDDTVSVKWNIQPIDSDLINFTLTYGYSNTKQNDKRPDNASSYLSSSMGNQSWVNYKNHQIEVKNESTVMQGATEHVILVGARWHRNDRNVLMFTRDKAKNPNYNYGYYAPPYMPEGTQTTTSFYLQDSISYRTLTLTPGVRYDIVKNQGAGSRAKVYQDPNPYYGHDYSDVTYRGITPHLGILWKATPNIRFFGDITHTWRAPLIDEQYEVQASISSLTGTSRHLDKETVTATRIGAIVDFENVFQQEDQLQLRSTFFDTRGKDEIFRRRGVYCESGKVTGNNGSCPPSLGNYRNLPGYHIQGMEIEAFYDSTNLFGRLAYSTMKGKRDQSPRDPWFGQKTWIAEIQPDALHATLGMKIPQINMVAGWTGDFIGAQRRSPMDADPAATYWSLPKSKGYAIHGLFANWKPAFIDNTEIRFTVANLFNRDYYPYLGESVSGTGRDYRFTVVKSF

SEQ ID NO: 9054 - protein, 379 aa, Cyanothece sp.
MKQSKVAVAVALACAACVPAIGHAQSSVTLYGIIDAGVTYVNNTGGSHVFKFDDGVAYGNRFGLKGTEDLGGGLKAVFALESGFHLGNGQLGFGGAEFGRQAYVGLQNNWGTLSFGNQLDITNELVSIYNISAWGSGYAIHQGDFDRFNGDRLPNSVKFLSNDLSGFKFGAMYSFGNVAGNFHRNSAWSAGASFTKGDFSIGAAYTRLNNPNGIYAFDPYAMIGTHTFLGQQTVTVDPATGQRTDLFANTAMNVDSQGTFGVGASYTIGKLTLDANYSYTTIKGFGQSSHMQVYEGGGLYQFTPALSFIAGYQHTRFEGHHWNQGTAGLHYLLSKRTDVYISGDYLRASQGVDAVIGYSFTPSTTQTQADVRIGMRHSF

SEQ ID NO: 9055 - protein, 199 aa, Cyanothece sp.
MRKVCAVILSAAICLSVSGAPAWASEHQSTLSAGYLHARTNAPGSDNLNGINVKYRYEFTDALGLITSFSYANAEDEQKTHYSDTRWHEDSVRNRWFSVMAGPSVRVNEWFSAYSMAGVAYSRVSTFSGDYLRVTDNKGKTHDVLTGSDDGRHSNTSLAWGAGVQFNPTESVTIDLAYEGSGSGDWRTDAFIVGIGYRF

SEQ ID NO: 9056 - protein, 589 aa, Cyanothece sp.
MRKVKMWKLFFQCLKATSGVAALSVIVAQSAIAAPDDSPINPSQADIVSPEEALGILQNRPTLKTPLNRDTSKQFQDNSTGNGMSQVTSISELRDVSPTDWAYEALRSLVERYGCIVGYPDRTFRGNRATSRWEFAAGLNACLNTMERLIQENVAVLREDIEKLKRLAQEFEQELIALGARVENLEERVAFLEDHQFSTTTKLNGEVLFTFSTAAGERAIDSRQRDAIDNFGAVLPNATRRIDDNATLAFRTRLNFDTAFYGKDRLRVRFQAGSIPRWDRATGTTMARLGHDASTDADVVFDDVYYRFPIGNFRGFVGTNALDIDNIFDVGNPFMASSGTGALSRFMRRNPLVFRGPEGIGAGAEYKLFDDLFVVRGLYLSDNGNSPDLGEGLFNGSYSAGGQLGVYPTDSLSFSFTYLLSYFAADEANLSASNGSRVASDPFLEAPTLRDSYGITGDWRINDTFHLYATGGYALARAQGDDEDGADRRGFGADLWTWSAILSMVDLFKEGAVLSIGGGQYVTAERIDARTGDLRVPDKDTPYIIEAQYQYPLTDGILLTPGFYTVINPEGDEDNNTIWVGVLRATYKF

SEQ ID NO: 9057 - protein, 1045 aa, Cyanothece sp.
MILLMILMLHIRVPLSNNSGSGGTSVVNFNSKSIITELDALNIYNTNYSGAVITNVDIDGDVISTTSQATSFYNDAYNGSANFTFRANNVTGEYSGISINNSSHNSANNNHDNAVITDILLTGDLTSTSGSGLQINSYMDDGDIKVSAQLENIYSYYEALSVRADTLTGNLQFNIDVSGNIVAENGLGFMVMGGASEGNSTMIINANNISSGSQALNIYNYSGLGSAFTAVTATGHLVSEQGIGAMFSTYVSQGDATAVINLNDITTAGSGVKIDTIANGGNSTTYLTVVGQINSSLYDGIDLRATATEGNTLVSIDVNNIASEYDAIHLDNKNYTTGADNGTSTIDLITRGALVSQQGYGINIETNTADTYVTVGGLVHGGNGTAIGIHRLDNIQTSATLELQSGYALEGVTQALVFNGSYAEINDAALDLANSHLVLGGAGDAAFDLTRIDNREEAILDGDPNRITGFGTLTKTNNSIWTLTGANMADGDANAFLSANIAGGILVLDNATLGLTPDAGALTGATVNRLSAADIAADPTLVATETGALTLAEGGALSSLGDSVLSGNLISAGGILLSNHYTGGNGAATDDRLTVTGTYFGENNGSGEGAWLALDTVLGDDDSATDRLVINGDATGTTSVRVNNAGGLGDKTLNGINLITVDGLAQDDTFLLAGDYVTTDGYQAVVGGAYAYTLQADGEAATAGRNWYLSSELMLTEGVRYQAGVPLYEQYPQVLAALNTLPTLQQRVGNRYGAPGALADLDFDNNQWAWGRIEGSHQVTDPARSTSGSQREIDVWKLQTGIDVPLYQSQDGSLLTGGVNFSYGKAKADIHSFFGDGRINSAGYGLGTSLTWYGNNGVYVDGQLQTMWFDSDLSSRTAGHAVASGNNGRGYTSAIEAGKGYALGNGLSLTPQMQVTYSRVDFDTFRDPFDSEVSLQEGDSLRGRIGVSLDKETTWSAKDGTTRRSHIYSHLDLHNEFLNGSKVQVSGVEFATRDERQSVGLGAGGTYEWQNGRYAVYGNVNLLGATRNVSDNYAVGGTIGARVSW

SEQ ID NO: 9058 - protein, 429 aa, Cyanothece sp.
MSDANVIMMDEPVTRSSVTASAENFITLTTNTLSGNGNFYMRTDMANHQSDQLNVTGQATGDFKIFVTDTGASPAAGDSLTLVTTGGGDAAFTLGNAGGVVDIGTYEYTLLDNGNHSWSLAENRAQITPSTTDVLNMAAAQPLVFDAELDTVRERLGSVKSVSYDTAMWSSAINTRNNVTTDAGAGFEQTLTGLTLGIDSRFSREESSTIRGLFFGYSHSDIGFDRGGKGNIDSYTLGAYAGWEHQNGAYVDGVVKVDRFANTIHGKMSNGATAFGDYNSNGAGAHVESGFRWVDGLWSVRPYLAFTGFTTDGQDYTLSNGMRADVGNTRILRAEAGTAVSYHMDLQNGTTLEPWLKAAVRQEYADSNHVKVNDDGKFNNDVAGTPGVYQAGIRSSFTPTLSGHLSVSYGNGAGVESPWNTQAGVVWTF

SEQ ID NO: 9059 - protein, 746 aa, Escherichia coli
MNKKIHSLALLVNLGIYGVAQAQEPTDTPVSHDDTIVVTAAEQNLQAPGVSTITADEIRKNPVARDVSEIIRTMPGVNLTGNSTSGQRGNNRQIDIRGMGPENTLILIDGKPVSSRNSVRQGWRGERDTRGDTSWVPPEMIERIEVLRGPAAARYGNGAAGGVVNIITKKGSGEWHGSWDAYFNAPEHKEEGATKRTNFSLTGPLGDELSFRLYGNLDKTQADAWDINQGHQSARAGTYATTLPAGREGVINKDINGVVRWDFAPLQSLELEAGYSRQGNLYAGDTQNTNSDAYTRSKYGDETNRLYRQNYALTWNGGWDNGVTTSNWVQYEHTRNSRIPEGLAGGTEGKFNEKATQDFVDIDLDDVMLHSEVNLPIDFLVNQTLTLGTEWNQQRMKDLSSNTQALTGTNTGGAIDGVSATDRSPYSKAEIFSLFAENNMELTDSTIVTPGLRFDHHSIVGNNWSPALNISQGLGDDFTLKIGIARAYKAPSLYQTNPNYILYSKGQGCYASAGGCYLQGNDDLKVETSINKEIGLEFKRDGWLAGVTWFRNDYRNKIEAGYVAVGQNAVGTDLYQWDNVPKAVVEGLEGSLNVPVSETVMWTNNITYMLKSENKTTGDRLSIIPEYTLNSTLSWQAREDLSMQTTFTWYGKQQPKKYNYKGQPAVGPETKEISPYSIVGLSATWDVTKNVSLTGGVDNLFDKRLWRAGNAQTTGDLAGANYIAGAGAYTYNEPGRTWYMSINTHF

SEQ ID NO: 9060 - protein, 120 aa, Escherichia coli
MRTFSGKRSTLALAIAGVTAMSGFMAMPEARAEGFIDDSTLTGGIYYWQRERDRKDVTDGDKYKTNLSHSTWNANLDFQSGYAADMFGLDIAAFTAIEMAENGDSSHPNEIAFSKSNKAW

SEQ ID NO: 9061 - protein, 1039 aa, Escherichia coli
MKRHLNTCYRLVWNHMTGAFVVASELARARGKRGGVAVALSLAAVTSLPVLAADIVVHPGETVNGGTLANHDNQIVFGTTNGMTISTGLEYGPDNEANTGGQWVQDGGTANKTTVTSGGLQRVNPGGSVSDTVISAGGGQSLQGRAVNTTLNGGEQWMHEGAIATGTVINDKGWQVVKPGTVATDTVVNTGAEGGPDAENGDTGQFVRGDAVRTTINKNGRQIVRAEGTANTTVVYAGGDQTVHGHALDTTLNGGYQYVHNGGTASDTVVNSDGWQIVKNGGVAGNTTVNQKGRLQVDAGGTATNVTLKQGGALVTSTAATVTGINRLGAFSVVEGKADNVVLENGGRLDVLTGHTATNTRVDDGGTLDVRNGGTATTVSMGNGGVLLADSGAAVSGTRSDGKAFSIGGGQADALMLEKGSSFTLNAGDTATDTTVNGGLFTARGGTLAGTTTLNNGAILTLSGKTVNNDTLTIREGDALLQGGSLTGNGSVEKSGSGTLTVSNTTLTQKAVNLNEGTLTLNDSTVTTDVIAQRGTALKLTGSTVLNGAIDPTNVTLASGATWNIPDNATVQSVVDDLSHAGQIHFTSTRTGKFVPATLKVKNLNGQNGTISLRVRPDMAQNNADRLVIDGGRATGKTILNLVNAGNSASGLATSGKGIQVVEAINGATTEEGAFVQGNRLQAGAFNYSLNRDSDESWYLRSENAYRAEVPLYASMLTQAMDYDRIVAGSRSHQTGVNGENNSVRLSIQGGHLGHDNNGGIARGATPESSGSYGFVRLEGDLMRTEVAGMSVTAGVYGAAGHSSVDVKDDDGSRAGTVRDDAGCLGGYLNLVHTSSGLWADIVAQGTRHSMKASSDNNDFRARGWGWLGSLETGLPFSITDNLMLEPQLQYTWQGLSLDDGKDNAGYVKFGHGSAQHVRAGFRLGSHNDMTFGEGTSSRAPLRDSAKHSVSELPVNWWVQPSVIRTFSSRGDMRVGTSTAGSGMTFSPSQNGTSLDLQAGLEARVRENITLGVQAGYAHSVSGSSAEGYNGQATLNVTF

SEQ ID NO: 9062 - protein, 836 aa, Escherichia coli
MASTVEYGETVDGVVLEKDIQLVYGTANNTKINPGGEQHIKEFGISSNTEINGGYQYIEMNGTAEYSVLNDGYQIVQMGGAANQTTLNNGVLQVYGAANDPTIKGGRLIVEKDGITVLAAIEKGGLLEVKEGGLAIAVDQKAGGAIKASTRVMEVFGTNRLGQFEIKNGIANNMLLENGGSLRVEENDFAYNTTVDSGGLLEVMDGGTATGVDKKAGGKLIVSTNALEVSGTNSKGQFSIKDGVSKNYELDDGSGLIVMEDTQAIDTILDEHATMQSLGKDTGTRVQANAVYDLGRSDQNGSITYSSKAISENMVINNGRANVWAGTMVNVSVRGNDGILEVMKPQINYAPAMLVGKVVVSEGASLRTHGAVDTSKADVSLENSAWTIIADITTTNQNTRLNLANLAMSGANVIMMDESVTRSSVTASAENFTTLTTNTLSGNGNFYMRTDMANHQSDQLNVTGQATGDFKIFVTDTGASPAAGDSLTLVTTGGGDAAFTLGNAGGVVDIGTYEYTLLDNGNHSWSLAENRAQITPSTTDVLNMAAAQPLVFDAELDTVRERLGSVKGVSYDTAMWSSAINTRNNVTTDAGAGFEQTLTGLTLGIDSRFSREESSTIRGLFFGYSHSDIGFDRGGKGNVDSYTLGAYAGWEHQNGAYVDGVVKVDRFANTIHGKMSNGATAFGDYNSNGAGAHVESGFRWVDGLWSVRPYLAFTGFTTDGQDYTLSNGMRADVGNTRILRAEAGTAVSYHMDLQNGTTLEPWLKAAVRQEYADSNQVKVNDDGKFNNDVAGTRGVYQAGIRSSFTPTLSGHLSVSYGNGAGVESPWNTQAGVVWTF

SEQ ID NO: 9063 - protein, 81 aa, Escherichia coli
MKVKVLSLLVPALLVAGAANAAEVYNKDGNKLDLYGKVDGLHYFSDNKDVDGDQTYMRLGFKGETQVTDQLTGYGQWEYQI

SEQ ID NO: 9064 - protein, 1250 aa, Escherichia coli
MRIIFLRKEYLSLLPSMIASLFSANGVAAVTDSCQGYDVKASCQASRQSLSGITQDWSIADGQWLVFSDMTNNASGGAVFLQQGAEFSLLPENETGMTLFANNTVTGEYNNGGAIFAKENSTLNLTDVIFSGNVAGGYGGAIYSSGTNDTGAVDLRVTNAMFRNNIANDGKGGAIYTINNDVYLSDVIFDNNQAYTSTSYSDGDGGAIDVTDNNSDSKHPSGYTIVNNTAFTNNTAEGYGGAIYTNSVTAPYLIDISVDDSYSQNGGVLVDENNSAAGYGDGPSSAAGGFMYLGLSEVTFDIADGKTLVIGNTENDGAVDSIAGTGLITKTGSGDLVLNADNNDFTGEMQIENGEVTLGRSNSLMNVGDTHCQDDPQDCYGLTIGSIDQYQNQAELNVGSTQQTFVHALTGFQNGTLNIDAGGNVTVNQGSFAGIIEGAGQLTIAQNGSYVLAGAQSMALTGDIVVDDGAVLSLEGDAADLTALQDDPQSIVLNGGVLDLSDFSTWQSGTSYNDGLEVSGSSGTVIGSQDVVDLAGGDNLHIGGDGKDGVYVVVDASDGQVSLANNNSYLGTTQIASGTLMVSDNSQLGDTHYNRQVIFTDKQQESVMEITSDVDTRSDAAGHGRDIEMRADGEVAVDAGVDTQWGALMADSSGQHQDEGSTLTKTGAGTLELTASGTTQSAVRVEEGTLKGDVADILPYASSLWVGDGATFVTGADQDIQSIDAISSGTIDISDGTVLRLTGQDTSVALNASLFNGDGTLVNATDGVMLTGELNTNLETDSLTYLSNVTVNGNLTNTSGAVSLQNGVAGDTLTVNGDYTGGGTLLLDSELNGDDSVSDQLVMNGNTAGNTTVVVNSITGIGEPTSTGIKVVDFAADPTQFQNNAQFSLAGSGYVNMGAYDYTLVEDNNDWYLRSQEVTPPSPPDPDPTPDPDPTPDPDPTPDPEPTPAYQPVLNAKVGGYLNNLRAANQAFMMERRDHAGGDGQTLNLRVIGGDYHYTAAGQLAQHEDTSTVQLSGDLFSGRWGTDGEWMLGIVGGYSDNQGDSRSNMTGTRADNQNHGYAVGLTSSWFQHGNQKQGAWLDSWLQYAWFSNDVSEQEDGTDHYHSSGIIASLEAGYQWLPGRGVVIEPQAQVIYQGVQQDDFTAANRARVSQSQGDDIQTRLGLHSEWRTAVHVIPTLDLNYYHDPHSTEIEEDGSTISDDAVKQRGEIKVGVTGNISQRVSLRGSVAWQKGSDDFAQTAGFLSMTVKW

SEQ ID NO: 9065 - protein, 448 aa, Escherichia coli
MVMSQKTLFTKSALAVAVALISTQAWSAGFQLNEFSSSGLGRAYSGEGAIADDAGNVSRNPALITMFDRPTFSAGAVYIDPDVNISGTSPSGRSLKADNIAPTAWVPNMHFVAPINDQFGWGASITSNYGLATEFNDTYAGGSVGGTTDLETMNLNLSGAYRLNNAWSFGLGFNAVYARAKIERFAGDLGQLVAGQIMQSPAGQTPQGQALAATANGIDSNTKIAHLNGNQWGFGWNAGILYELDKNNRYALTYRSEVKIDFKGNYSSDLNRAFNNYGLPIPTATGGATQSGYLTLNLPEMWEVSGYNRVDPQWAIHYSLAYTSWSQFQQLKATSTSGDTLFQKHEGFKDAYRIALGTTYYYDDNWTFRTGIAFDDSPVPAQNRSISIPDQDRFWLSAGTTYAFNKDASVDVGVSYMHGQSVKINEGPYQFESEGKAWLFGTNFNYAF

SEQ ID NO: 9066 - protein, 379 aa, Escherichia coli
MKKHLLSTSAIALGLVAAPASAQEWNLDWGGYMNQHVAFADVSGTAAAGIDYDGVGFHSNSEIFFTPSVTLDNGLTFGINVQLEAENQSTSVNAAGTSGTNSYIDETYMIISGDTLGRIEIGSENSAGYKSMVGAPSVTSMAINSPSISAFIPLSNVLPWNFRQAGISAWTEVGGNNDVDRISYYTPDFNGLTVGISYARNNGGNAVGSHNNSVVGSATLEDIFDIGVNYSQTFGTTSVSLAARYGSAEAIAPAGYDPETWGIGAQVGFGDFTVGAHYAENDNAASGAAGDQSGWSFGGTYDAPGAWAFEALTFQGEFDMTGTGAADEEYTAYKIGASRDMGPGVDWDIYAIYAEADDKGTAGTDLKGTVIGTAINLSF

SEQ ID NO: 9067 - protein, 729 aa, Escherichia coli
MLSTQFNRDNQYQAITKPSLLAGCIALALLPSAAFAAPATEETVIVEGSATAPDDGENDYSVTSTSAGTKMQMTQRDIPQSVTIISQQRMEDQQLQTLGEVMENTLGISKSQADSDRALYYSRGFQIDNYMVDGIPTYFESRWNLGDALSDMALFERVEVVRGATGLMTGTGNPSAAIDMVRKHATSREFKGDVSAEYGSWNKERYVADLQSPLTEDGKIRARIVGGYQNNDSWLDRYNSEKTFFSGIVDADLGDLTTLSAGYEYQRIDVNSPTWGGLPRWNTDGSSNSYDRARSTAPDWAYNDKEINKVFMTLKQRFADTWQATLNATHSEVEFDSKMMYVDAYVNKADGMLVGPYSNYGPGFDYVGGTGWNSGKRKVDALDLFADGSYELFGRQHNLMFGGSYSKQNNRYFSSWANIFPDEIGSFYNFNGNFPQTDWSPQSLAQDDTTHMKSLYAATRVTLADPLHLILGARYTNWRVDTLTYSMEKNHTTPYAGLVFDINDNWSTYASYTSIFQPQNDRDSSGKYLAPITGNNYELGLKSDWMNSRLTTTLAIFRIEQDNVAQSTGTPIPGSNGETAYKAVDGTVSKGVEFELNGAITDNWQLTFGATRYIAEDNEGNAVNPNLPRTTVKMFTSYRLPVMPELTVGGGVNWQNRVYTDTVTPYGTFRAEQGSYALVDLFTRYQVTKNFSLQGNVNNLFDKTYDTNMEGSIVYGAPRNFSITGTYQF

SEQ ID NO: 9068 - protein, 423 aa, Escherichia coli
MKKIMLKNPVGLAVALVSSNVLAGGFALNEQSISGMGSGFAGRSSSAEDASTIYGNPAGMARLKREQVSVGAATLFAKSDISQTRSTFGGKEDGDMVPATTVPMGYYVKPIDEHWAFGVGFYVPFGLITDYGSGFAGRYYANKSEVTTLTFQPTISYAFNEKVSIGFGPTINRIGGEISGMVPNPLSPGRNDGKLKSTGDDTALGFNAGVLVQATDQTRLGLTYHSKVSYHLDAKTKVTDGIFSVLGVSGRSYDASLDVDTPESVDFSLTHQFNDDWTLYVGSTWTRWSRFKELTIENSGLPPLLSGQLGTISEEQNWHDTWAHAIGAAYRLNNQWVLRGGFSVDQSPANNTNRGPRIPTGDRKVVSFGAGWTPVDNVTIDLAYSYLWEESVEVNDTSASRGAYRARYKNSASGFGTSVSYRF

SEQ ID NO: 9069 - protein, 955 aa, Escherichia coli
MGIKQHNGNTKADRLAELKIRSPSIQLIKFGAIGLNAIIFSPLLIAADTGSQYGTNITINDGDRITGDTADPSGNLYGVMTPAGNTPGNINLGNDVTVNVNDASGYAKGIIIQGKNSSLTANRLTVDVVGQTSAIGINLIGDYTHADLGTGSTIKSNDDGIIIGHSSTLTATQFTIENSNGIGLTINDYGTSVDLGSGSKITTDGSTGVYIGGLNGNNANGAARFTATDLTIDVQGYSAMGINVQKNSVVDLGTNSSIKTNGDNAHGLWSFGQVSANALTVDVTGAAANGVEVRGGTTTIGADSHISSAQGGGLVTSGSDATINFSGTAAQRNSIFSGGSYGASAQTATAVVNMQNTDITVDRNGSLALGLWALSGGRITGDSLAITGAAGARGIYAMTNSQIDLTSDLVIDMSTPDQMAIATQHDDGYAASRINASGRMLINGSVLSKGGLINLDMHPGSVWTGSSLSDNVNGGKLDVAMNNSVWNVTSNSNLDTLALSHSTVDFASHGSTAGTFATLNVENLSGNSTFIMRADVVGEGNGVNNKGDLLNISGSSAGNHVLAIRNQGSEATTGNEVLTVVKTTDGAASFSASSQVELGGYLYDVRKNGTNWELYASGTVPEPTPNPEPTPAPAQPPIVNPDPTPEPAPTPKPTTTADAGGNYLNVGYLLNYVENRTLMQRMGDLRNQSKDGNIWLRSYGGSLDSFASGKLSGFDMGYSGIQFGGDKRLSDVMPLYVGLYIGSTHASPDYSGGDGTARSDYMGMYASYMAQNGFYSDLVIKASRQKNSFHVLDSQNNGVNANGTANGMSISLEAGQRFNLSPTGYGFYIEPQTQLTYSHQNEMAMKASNGLNIHLNHYESLPGRASMILGYDITAGNSQLNVYVKTGAIREFSGDTEYLLNNSREKYSFKGNGWNNGVGVSAQYNKQHTFYLEADYTQGNLFDQKQVNGGYRFSF

SEQ ID NO: 9070 - protein, 747 aa, Escherichia coli; identical to SEQ ID NO: 1

SEQ ID NO: 9071 - protein, 377 aa, Escherichia coli
MKSKVLALLIPALLAAGAAHAAEVYNKDGNKLDLYGKVDGLHYFSDNSAKDGDQSYARLGFKGETQINDQLTGYGQWEYNIQANNTESSKNQSWTRLAFAGLKFADYGSFDYGRNYGVMYDIEGWTDMLPEFGGDSYTNADNFMTGRANGVATYRNTDFFGLVNGLNFAVQYQGNNEGASNGQEGTNNGRDVRHENGDGWGLSTTYDLGMGFSAGAAYTSSDRTNDQVNHTAAGGDKADAWTAGLKYDANNIYLATMYSETRNMTPFGDSDYAVANKTQNFEVTAQYQFDFGLRPAVSFLMSKGRDLHAADGADNPAGVDDKDLVKYADVGATYYFNKNMSTYVDYKINLLDEDDSFYAANGISTDDIVALGLVYQF

SEQ ID NO: 9072 - protein, 700 aa, Escherichia coli
MKIFSVRQTVLPALLVLSPVVFAADEQTMIVSAAPQVVSELDTPAAVSVVDGEEMRLATPRINLSESLTGVPGLQVQNRQNYAQDLQLSIRGFGSRSTYGIRGIRLYVDGIPATMPDGQGQTSNIDLSSVQNVEVLRGPFSALYGNASGGVMNVTTQTGQQPPTIEASSYYGSFGSWRYGLKATGATGDGTQPGDVDYTVSTTRFTTHGYRDHSGAQKNLANAKLGVRIDEASKLSLIFNSVDIKADDPGGLTKAEWKANPQQAPRAEQYDTRKTIKQTQAGLRYERSLSAQDDMSVMMYAGERETTQYQSIPMAPQLNPSHAGGVITLQRHYQGIDSRWTHRGELGVPVTFTTGLNYENMSENRKGYNNFRLNSGMPEYGQKGELRRDERNLMWNIDPYLQTQWQLSEKLSLDAGVRYSSVWFDSNDHYVTPGNGDDSGDASYHKWLPAGSLKYAMTDAWNIYLAAGRGFETPTINELSYRADGQSGMNFGLKPSTNDTIEIGSKTRIGDGLLSLALFQTDTDDEIVVDSSSGGRTTYKNAGKTRRQGAELAWDQRFAGDFRVNASWTWLDATYRSNVCNEQDCNGNRMPGIARNMGFASIGYVPEDGWYAGTEARYMGDIMADDENTAKAPSYTLVGLFTGYKYNYHNLTVDLFGRVDNLFDKQYVGSVIVNESNGRYYEPSPGRNYGVGMNIAWRFE

SEQ ID NO: 9073 - protein, 351 aa, Escherichia coli
MKKSTLALVVMGIVASASVQAAEIYNKDGNKLDIYGKVKAMHYMSDNDSKDGDQSYIRFGFKGETQINDQLTGYGRWEAEFAGNKAESDTAQQKTRLAFAGLKYKDLGSFDYGRNLGALYDVEAWTDMFPEFGGDSSAQTDNFMTKRASGLATYRNTDFFGVIDGLNLTLQYQGKNENRDVKKQNGDGFGTSLTYDFGGSDFAISGAYTNSDRTNEQNLQSRGTGKRAEAWATGLKYDANNIYLATFYSETRKMTPITGGFANKTQNFEAVAQYQFDFGLRPSLGYVLSKGKDIEGIGDEDLVNYIDVGATYYFNKNMSAFVDYKINQLDSDNKLNINNDDIVAVGMTYQF

SEQ ID NO: 9074 - protein, 790 aa, Escherichia coli
MKRVLIPGVILCGADVAQAVDDKNMYMHFFEEMTVYAPVPVPVNGNTHYTSESIERLPTGNGNISDLLRTNPAVRMDSTQSTSLNQGDIRPEKISIHGASPYQNAYLIDGISATNNLNPANESDASSATNISGMSQGYYLDVSLLDNVTLYDSFVPVEFGRFNGGVIDAKIKRFNADDSKVKLGYRTTRSDWLTSHIDENNKSAFNQGSSGSTYFSPDFKKNFYTLSFNQELADNFGVTAGLSRRQSDITRADYVSNDGIVVGRAQYKNVIDTALSKFTWFASDRFTHDLTLKYTGSSRDYNTSTFPQSDREMDNKSYGLAWDMDTQLAWAKLRTTVGWDHISDYTRHDHDIWYTELSCTYGDITGRCTRGGLGHISQAVDNYTFKTRLDWQKFAVGDVSHQPYSGAEYIYSDAWTERHNQSESYVINAAGKKTNHTIYHKGKGSLGIDNYTLYMADHISWRNVSLMPGVRYDYDNYLSNHNISPRFMTEWDIFADQTSMITAGYNRYYGGNILDMGLRDIRNSWTESVSGNKTLTRYQNLKTPYNDELAMGLQQKIGKNVIARANYVYREAHDQISKSSRTDSATKTTITEYNNDGKTKTHSFNLSFELAEPLHIRQVDINPQIVFSYIKSKGNLSLNNGYEESNTGDNQVVYNGNLVSYDSVPVADFNNPLKISLNMDFTHQPSGLVWANTLAWQEARKARIILGKTNAQYISEYSDYKQYVDEKLDSSLTWDTRLSWTPQFLKQQNLTISADILNVLDSKTAVDTTNTGVATYASGRTFWLDVSMKF

SEQ ID NO: 9075 - protein, 466 aa, Escherichia coli
MNSEGGKPGNVLTVNGNYTGNNGLMTFNATLGGDNSPTDKMNVKGDTQGNTRVRVDNIGGVGAQTVNGIELIEVGGNSAGNFALTTGTVEAGAYVYTLAKGKGNDEKNWYLTSKWDGVTPADTPDPINNPPVVDPEGPSVYRPEAGSYISNIAAANSLFSHRLHDRLGEPQYTDSLHSQDSASSMWMRHVGGHERSSAGDGQLNTQANRYVLQLGGDLAQWSSNAQDRWHLGVMAGYANQHSNTQSNRVGYKSDGRISGYSAGLYATWYQNDANKTGAYVDSWALYNWFDNSVSSDNRSADDYDSRGVTASVEGGYTFEAGTCSGSEGTLNTWYVQPQAQITWMGVKDSDHARKDGTRIETEGDGNVQTRLGVKTYLNSHHQRDDGKQREFQPYIEANWINNSKVYAVKMNGQTVSRDGARNLGEVRTGVEAKVNNNLSLWGNVGVQLGDKGYSDTQGMLGVKYSW

SEQ ID NO: 9076 - protein, 774 aa, Escherichia coli
MTPLRVFRKTTPLVNTIRLSLLPLAGLSFSAFAAQVNIAPGSLDKALNQYAAHSGFTLSVDASLTRGKQSNGLHGDYDVESGLQQLLDGSGLQVKPLGNNSWTLEPAPAPKEDALTVVGDWLGDARENDVFEHAGARDVIRREDFAKTGATTMREVLNRIPGVSAPENNGTGSHDLAMNFGIRGLNPRLASRSTVLMDGIPVPFAPYGQPQLSLAPVSLGNMDAIDVVRGGGAVRYGPQSVGGVVNFVTRAIPQDFGIEAGVEGQLSPTSSQNNPKETHNLMVGGTADNGFGTALLYSGTRGSDWREHSATRIDDLMLKSKYAPDEVHTFNSLLQYYDGEADMPGGLSRADYDADRWQSTRPYDRFWGRRKLASLGYQFQPDSQHKFNIQGFYTQTLRSGYLEQGKRITLSPRNYWVCGIEPRYSQIFMIGPSAHEVGVGYRYLNESTHEMRYYTATSSGQLPSGSSPYDRDTRSGTEAHAWYLDDKIDIGNWTITPGMRFEHIESYQNNAITGTHEEVSYNAPLPALNVLYHLTDSWNLYANTEGSFGTVQYSQIGKAVQSGNVEPEKARTWELGTRYDDGALTAEMGLFLINFNNQYDSNQTNDTVTARGKTRHTGLETQARYDLGTLTPTLDNVSIYASYAYVNAEIREKGDTYGNLVPFSPKHKGTLGVDYKPGNWTFNLNSDFQSSQFADNANTVKESADGSTGRIPGFMLWGARVAYDFGPQMADLNLAFGVKNIFDQDYFIRSYDDNNKGIYAGQPRTLYMQGSLKF

SEQ ID NO: 9077 - protein, 317 aa, Escherichia coli
MRAKLLGIVLTTPIAISSFASTETLSFTPDNINADISLGTLSGKTKERVYLAEEGGRKVSQLDWKFNNAAIIKGAINWDLMPQISIGAAGWTTLGSRGGNMVDQDWMDSSNPGTWTDESRHPDTQLNYANEFDLNIKGWLLNEPNYRLGLMAGYQESRYSFTARGGSYIYSSEEGFRDDIGSFPNGERAIGYKQRFKMPYIGLTGSYRYEDFELGGTFKYSGWVEASDNDEHYDPGKRITYRSKVKDQNYYSVSVNAGYYVTPNAKVYVEGTWNRVTNKKGNTSLYDHNDNTSDYSKNGAGIENYNFITTAGLKYTF

SEQ ID NO: 9078 - protein, 763 aa, Synechococcus sp.
MTSLGCALSMNAGAASTAPQKRAVGVHGRPEAAAGSGSGTAQPVKTEEVTVSVRRRSEPLQKVPVATSVYTASQARRDNVHDLQGIFEFVPSANFRANASSKDRAIFIRGIGTISTSPGVEPSVSTVIDGVVLARPGMATTDIVGLSQVEVMRGPQGTLFGKNASAGAVNIVTDRPTADFHAYTEGSYFSGNEYRLTGGVSGTLVPSKLIANADFLVGGFDGNVTNIASNTMVNGYEHRGVRSKFLWTPDDRTQVTLGLDYMYQNDLVPSGVYSSTSQIAFPTNVATSNPTLAAALKAEGITPSRNNTEVSNNIQSRSVDHSGGASITLDREFAGGYKLTSISGYRRWQNVQDQDYDGLGSVPAGVTNVHDHGLLNFWQASEEARVASPRGHFFDYVAGFYYLHSLDQEVYSRDVLVGTPATPNPGYGVSHYGIANNNYAVFAEGNLNFTKRFRGILGLRLLRDDLAYNMARNSTATAANPVLGIRPSYASTGSTSQNGYVDRIGLQYDVLSDMQAYFTYSHGYKGPAYNTFFNMQATDAQVLRPEQNNTYEIGLKSQFWHRRITANFAAFIEDFSNFQANFLDNVNGGAVYRMINAGSVSSKGVEGDISAHVLRDLTLGGNFTYDYAVVDRFNCPAGAPASCNVNGEPLPFAPRWKFVLNADYTRALNDRFSVSVDSDYTWQSRTQFALTETPDTVQKAYGIWNMSTTLRDSKLRLQLSLVMRNAINTHYLSYISYGVLGGTADFLPRDYGRYGGFVLRKEF

SEQ ID NO: 9079 - protein, 672 aa, Synechococcus sp.
MSKTTPFAPKPLAVVIGALCTSFSVFADTTPIEADEQLVVTATRTQMELKDAPASMSVITAEDIENDPGITLADIVSNATSVESDFDSTRAGRQQISIRGMDSKYTLIMVNGRRMSSASAIVRGNDFDLSAIPMDSIERVEIIRGPMSALYGSDGMGGTINIITKSPSNDWSSQLSLDNTTPNDGNGGQEYTVGLTTSGALIDDKLFARFSASQTSRNAWQPYSGEKGGIDREEVTALEGRDSLALFGTLSWHLADNQFIDLDLGYSDDERETAAESGTTVLFSESRVKRNSQALSHTGFWSWGDTQVRYSRENVENIEAANDGADSIEELTQIFEASATTYLGESHTVTFGVDYQTSELTNPEHIVGNKAEAYQGAVFIQDQWEMTDTLMATIGGRLDKHEHYGEEFSPRVYLVHQTTDDLVLKGGVGKAFKAPTMTQNHPDFSMNSCKGNCNIVGNEDLEAETSVNYEFSALYSGRNWNLEGAVFRNEIENLIEQTDISCEVGTWSSAVMSCIDDNGDPIDRELSNPYKSYQNVSKAVIQGVELTGSIQFNEQWAMSGNYTYLDTEDKSTGEELNERYKHSAFARLNWYPTQDLNLFASARYRGDRKIDSQLTQDAYTTMDLGTVYHVNDALRIRAGITNLTDESVSRELENIGYVEAPRTYYVGMTADF

SEQ ID NO: 9080 - protein, 419 aa, Synechococcus sp.
MKTSLRTLSVALAAALVSPSVLAIEKIDFHGYMRAGVGVSSDGGLAEWQKTMVGRLGNESDTYGEIGLGAEVYKKEDVSFYLDSMVSMLSDGSNDSETTIGDDAQFGLRQLNLQIKGLIPGDKEAVIWGGKRYYQRHDLHIIDTKYWNISGSGAGIENYTVGPGAVSVAWVRGDANDVDTRITGDSDVNINYIDVRYAGFKPWAGSWTEVGIDYAMPNPTKQQKEYGGLYDADNAVMLTGEISQDMFGGYNKLVLQYANKGLAQNMISQGGGWYDMWHKTDEAKGYRVINTGLIPITDKFSFNHVLTWGSANDITEYTDKTNLISLVGRAQYQFTQYVRAIGEVGGFYQKDTYHNGSNYKQGGEKYTIALGLAEGPDFLSRPELRVFASYLNDSENGKPFEDGTSNDTWNFGVQVEAWW

SEQ ID NO: 9081 - protein, 769 aa, Synechococcus sp.
MTSDQTVLCGAALALLLAGSPLPALGQTAVTLEELSVEGEAAPAAGRSAAPPFGVAAPPGSAPAVIEHPVGEIVTGIGRDDTIANRPATSIGSVLVNSPGVTVRQGNGGRDVVISIRGNNARSTGVIKNTVVLEDGFILTQPDGASRFDLTDPRAYGRIDVFRGPQSPLFGNYATGGAIAFRTRTGREIDGYEIGVDAGSFGYLSNYFTVGGVSGPFEISLFASDVHANGYQDHASYDTQTINLLASYTPTPDNRFTLKVINNTLDANLPARASLAQYRINPYQRGCAAAASAAPGCTTFNLFRNGAFGATVPVTADEGGFGRNDRRTIVAARWEHDIDAFTTWRTQLGFDERNFDQPFYTTSSRGSYPSWNFLTDLTRRGDLFGLPATGYVALAYNTIDNHITTFNRAPYDGPRLGALIGDQAAVQSNLGGRARLELALSDQWTGILGLSAETTSITGRNIAYAYAASGTTRTVADANRSFLNVAPELALVYRPDAAWALRGRVATGYTTPAASNLFITPAGLPGNNTQLQTQENLGFDLGAEWSPMTDLRLSVTGFYEFFRNELVSQSPGAGLLAYTFNAPASEHRGVEVGADWAFAPGWRGTLAYTFDDQIYTRYTEQLSAGSLTRSFDRAGNRIPGVPAHQLLARLGYDVPSGPLAGLGAFVETVVQGDFYLDNANLLKAPGFAVVNANLHYATELTGGYAKRLSLYVEVRNLFDTTYVASAQNLANGISGTTGLQNGAAVLATTTGSVFAGAPRNIVGGMRLAF

SEQ ID NO: 9082 - protein, 618 aa, Synechococcus sp.
MSPDGKQVALVAPSGVRGAKLLVIDIAAGTSKTILVSSGEPERLSGCRWSTETRLVCKIYAIIKSAENNVQYTRVLALNNDGSDMKMMTEAGNNRSIGVAQDGGSVIDWSADASASAILMTRNYLPEMTTNTRTASEDDGLGVERVDTVTLARRSVEKPYPNAVEYISDGRGSVRILGLRPTRGTSGYAGARTAYLYRQEGKREWLPLSQVVSGPTGYTGFNPYAVDPKLNVAYGFNEKDGRQALFKVSLDGSLTQDLVLARPDVDVAGLVRIGRQDRVVGAYFVTDRRETEFFDPELRKLGAALGRALAGRIVTFIDASADESKLLLFAGGDSDPGVYYIFDKSTRKLQDLTGARPQLEGLKLATVKAVTYPAADGAQIPAYLTLPAGSDGRNLPAIVMPHGGPSARDEWGFDWLAQFFAHQGYAVLQPNYRGSSGYGADWFQKNGFQSWRTAIGDVNDGGRWLQKEGIAAPGKLAIVGWSYGGYAALQSAVLDSDLFKAVVAIAPVTDLEMLRNEFLNFENYLQASAFIGRGPHVTEGSPAQNAAAIKAPVLLFHGDLDANVGIGESRLMERKLKAAGRSVELIEFKGLDHQLADDAARTQMLGKADAFLRTALGF

SEQ ID NO: 9083 - protein, 306 aa, Synechococcus sp.
MIKSWTKKWFLILFLMASCSSYLVATTGEKYFKMATQAFKRGDYHKAVAFYKRSCNLRVGVGCTSLGSMYEDGDGVDQNITKAVFYYRRGCNLRNHLACASLGSMYEDGDGVQKNLPKAIYYYRRGCHLKGGVSCGSLGFMYFNGTGVKQNYAKALFLSKYACSLNYGISCNFVGYMYRNAKGVQKDLKKALANFKRGCHLKDGASCVSLGYMYEVGMDVKQNGEQALNLYKKGCYLKRGSGCHNVAVMYYTGKGVPKDLDKAISYYKKGCTLGFSGSCKVLEEVIGKKSDDLQDDAQNDTQDDMQ

SEQ ID NO: 9084 - protein, 246 aa, Synechococcus sp.
MINIFNDEAFMKKYYPLLTVILLGLPLCSQALTLNLRGGYRSASHAYETLIQVSQGWNNGWWASFESNTWNTIHNNENELFALNYNKIDINKTYKIDDKWALIPGIQTQWMSAGSQYNPYLKISYQATPDLNLALRYRYDWKAFRQTDLDGNRARNDQHQFDGYVTYKINDSWLFAWQTTVYTKVNNFKYGNHKKTATENAFVLQYKMSPVFTPYIEYDYLDKQGVYKGKDNKHENSYRVGVLINF

SEQ ID NO: 9085 - protein, 761 aa, Synechococcus sp.
MNNHKIWRLSAVAVALLISGNSYADQTLHFAQQPHNTGDHTVIAAPEVNNFSLADLTANAEGQAVDATNAGALSLRVEPTQGDAQANGVLVTSGTFTNQAQGSITVSASSQDQHAVASGLQATDAYWSTLRNQGSIRATSNSLHGSAEVYGIQAGLAFSDAAGDHYGDHMMLSNEGVMQVSATAEQDAFASGIYTNAGNGVVNNGRLDVSAHASAGDARATGLHTLSANPSVDPDPWNPANPTHLMSNNGSLSVTASGNNATASAISTEGEGVYIYNNGTLIVDAFSESAQGGASAYGIHVLNGSATINSSGRILATATGGSQQQAYEVMADGSVVNIERYTLALGNETPWAVSNGGSIVLGNGTQGADLVLMAGQASEGFAYGKEYSLDNLAYDTTSGQQSTVGGSIAGLYGITPDIKVIHSGSSSSSLGSAALVYAPDVSHAGVSALAQRSSMEQASNIISSQLHSQLVSNAGCNQKLESADSCVFITPYAGEYRRDPVTSGYSGQRYGVLLGQNQHFGDFQLGWHGGYESASTDFNGTSVGRKEEINTLMLGVQGGMKLSESLFIAATSTWFSSDTDYSDSNTYYGVGSQSGSYDSSGLYTDVSVGNSWQLNRNYAMTPMVGLTHIWQQRDGYTVSSNNKNYDLIDTRYSSYSDHAVALHAGVRLDGRYPLTNETLLKPFFNVGFQQMLYGDEITIDQSIPNSPVVGVSTKDKTTQGTFDLGMALVSDNGVSASLQLSGMVNSDRQDFTGWANLGWAF

SEQ ID NO: 9086 - protein, 200 aa, Synechococcus sp.
MHYLRILILSMSFLNILNAENLSYMSSSYQIGTVFMRPLNTNKLLQGASILQGYEVNPKNDWAYSRYYFFIDYGNVLFNNDSTLQANMFTYGVGGDFMVAYAKNPINRWAFFFGLQLAANTWILNNKVKDLVVNTWDSLKDFNFHNTYFRAIGKFGVQFRTIVLYHKVDVEIGMKIFLTPERRSLFERSFLFFVSHSWHF

SEQ ID NO: 9087 - protein, 1073 aa, Synechococcus sp.
MKEKVLMLLACLWLGIGFSMAQAPKTVAGVVTSADDGEPIIGASVLVEGTTMGAITDVDGKFAINNVPADAKALIVSYLGMITQRVGIQRGTITVTMKSDTKVLDEVVVTAQGLNRKQKALGYSTQKVAGEDLTISRQTDLGNAMAGKVSGARFIGGASSGFDAGTIILRGAGSIPSSSQSDNPANEPIYVVDGAITNKNSINMDDVESINVLKGPAATALYGSRGGAGAIIITTKAGQSEKGLLEVSHTLQAETYYNHFNMQKLYGGGGYGGTEKGNRAQDIYDLYSGDIPGLQGAYVYDYNEDTSWGAAYDPAVKYVTPLSLDETSDYYGKPATWQHGLDLRDLYRTGVTNTTNVSFSKSVKDFNTRVSFTNSYRTGVQPNSDAIRRFLGFKTNFKPTPWMNVSLDYKYTYRQDHNAAESGYNGSRTVLQEYTQWGQTNVNLKDYKDYKRPDGSWRTWNINSVNNQSAAFHDNPYALFHEYNHRTIYQWNVFSGDVSVDLPYNLKAGVRVNGNIRGYKLERERPSGSINFRSNYRQDQSSLIDLTVQGRLTWGQSFFKDKLTVDAALFAEVRDYTYDNLYAYTNTNYDLSLDNYYNLAASSGTIALAYNKKTHYKERSVYATATMGWDDTYFLDASVRNDMSSTLSPNHNSYWYGGLSASVLAHKWVNAEWLNFWKLRASAAQVGTTLDAYNIYPTYSLDTSYGSHVTMYEPSSQKNYNIEPSISTSYEIGTEFRLFNNRLWGDFNYYTRDDKDQIISVTSAPQSGYSTRKMNAGLIRNRGVELSLGGMPVSTKNWKWEMNFNIAKNSNKLVELADGVDSYSIYWTSFTTRLYNYAMVGKSLGVITGNTWERDDNGNIIFHELSASQKALYGGEYVPTYNQNTLDELGNFHPDFTGGFNTSISFKNFRLSANIDFSVGGQIVSYTNMWGSSSGILDKTAELNDRGVNVREPVSKGGGIHMTGVDQDGNKVDTYVNAKLYYTTASRVWEEWVYDRTYVKLREVSLSYVFPSQTLKKLNIGLSRASVAINASNPWLIYSACPNVDVSEIGMGYFEGGNAAATRSIGFTVNLAF

SEQ ID NO: 9088 - protein, 405 aa, Synechococcus sp.
MKQQALRMALTSGVALAAVAPAFAQSSVTLYGIVDNGIGYQSNATTVGSTSGGKSVVRMNQGVWAGSRFGLKGSEDLGGGTKAIFTLESGFNSATGAAQYTDAIFGRQAWVGLTNTTYGTLTAGRQYASYYQTMSPFSPTTWITGYYGAHPGDVDGLDTIYRANNTIEYTSPKWYGVTLSGSYSLGGVAGSTNAGSTWATGIQYAAGPFGAGVAFERVNNANTAGGAWGANSTTSNGGSQIGVSAVTNGYQTAKAQQRFAVGLSYRFSDAWDATATYTNTEYIPGAASKFFNTAVFNTAGAVLHWKPSAVWDFGAGYAYTRATESNGITDSAQYHQFNLSQYYSLSKRTGLYLLEAYQHAKGKTLGTSGAGSIVDATATLGDGFNTAPSSTGNQFGFGAGIIHRF

SEQ ID NO: 9089 - protein, 1067 aa, Polynucleobacter necessarius
MTKDFKRFYVSRAMFLGATMFLASIGMASANPSTDTFGSNEPNPVVASPQQAKHTIKGVVEDQFGPIAGANVVEKGTTNGTITDMDGNFSLEVAPNSILIVSFIGYKEQQIPVNSQKTVTIKLTEDSQALEEVVVVGYGTQKKVNLSGSVTSVNVSEMAESRPLTNISTALAGTAPGVQITSSNNIPSNNGDADIKVRGQGTLNNSSPLVIIDGVEGSLNSVSPQDVETVSVLKDAASSAIYGSRAANGVILITTKSGKSGKMKLDYTGYVSFQTLDKPYDVVSDYASYMEYLNEGMTNSNKPAPFSQNVINLWREKSKDPNGLNEYGMPNYLAYPNSDIFDVYETGVSHQHNLSASGGSEKITYYTSFNYLNNPGILENCGYERFSLRANIDSQIKDWLKLGVNLSGYTANTTPVSENIKDIYTYGLTGGNPGIAYLDDQNRLGINANAEDDPQNATNNPYNRLRNTTGNVQTNTLKTRLYAILTPLKGLTIQGSYTYDYYDKFKESKPNFVPMYNFQTNTLYTDGVGQTSIYNYNEKTFRNFMDATIRYERNFFDDRLSTNLMVGASQEQYKRQYFSATRKDLIDPSLGVIDGAIGESSSTGNITEWAMRSYFGRLNLGWDDKYLFEANLRADGSSRFLADNRWGYFPSFSAAWRISEEEFMKNISWLDNLKIRASYGSLGNNTLGSNRDNDGNYTSQSLYAQTNYVLARAVAMGLSQTAIANAALTWETTYITNVGLDYNVLGNRLSGSIEFFNKKTDGILIDLPAPMVHGNATIPKQNAAQVTNKGLEFSANWSDRAGKDFSYNIGFNFTYIKNNVDKFKGDDPSYDGARMLKEGLPIWSLYVREVDRIVQTDEDLALVQSMLDNPDVKGKVVFPYGTPQKGDILYKDLNGDGLVNDDDRVVVGNGKNPTFTYGMNLGFNWKGIDFSALLQGQAGIKDVYLSALYKSTVRQGYQLNADIIEGRWYEGRTDAKYPRLLDYSDTRNEQYSDFWVASKAYLKIRNITLGYTLPSAWTKVAYMDRVRIYGSLENFFTFTKWKGYDPEIDGITYPTMRQAVIGVNVTF

SEQ ID NO: 9090 - protein, 171 aa, Polynucleobacter necessarius
MKKSLLAMAVLGAFAGAAHAQSSVTLYGVVDANVEYVNHEQNVTSAGIALPGSSGSRVAMQAGGLSSNRWGMRGVEDIGGGLKGLFVLESGFSMDDGRLQQGGRLFGRQAFVGLQGNWGKITLGRQYTTIFDMMANFSPSGYATQYEPVVGLLGPNFREDNVIKYTGRSAR

SEQ ID NO: 9091 - protein, 707 aa, Polynucleobacter necessarius
MNDPLRLAGLLLAGTSLCAIPALAEEVAPLGPIPLDPITIRGLETGAVLDGYRADVISSATRTATPLQQTPQSVQVLSPELLEDQAVLSMSEALRNVSGAQGTIPLQTPAFESTLLRGFPAEFYRDGMTSYINTGDANDMAGVERIEVLKGPNAILYGGGTGTPLGGLVNIVTRKPLPATVTEFGLTYGTNGHVEPSFDINRRITDSVLFRMNGSYVRSGADPDVIETDRYSFSPSLTFGHGTDTRLTVEGYLSRWEQQEYQGLPAVGTVTGGFEIDRDLYIGDPDIPDSHTETRKLTLTLEHDFNDRWSNRTQVRYGENEVEQITQIILSNAPDAGATDWALYNSYVPGEQTEYSVNTSFEGRFGTGAWDHVLLFGADYSRIEDYSLMYMDFAGNNDLANPGDWPAWTMPSTLAMGEGDGTYTTSGAFVQMQSSAGRLHLLGGLRLAHLETIYDSEGYGRRDRLEETRLLPRIGAVYDLADRWSAFASYSEGMKANAFYFYASTPKPELSRQAEIGLKFDGGALSGSIAAFRIERENVPVTDPTDPTFLTSITEGQQRSQGVELDAVWQPGGAWKVMANYAYTDAALTADVPLGAPAGSKLPGVPRHSGGIWLDYDARKDRGDGWRAGAGLQAVSSAPLDQMNSYETAGHATVNGSASFTQDGTTYALAVKNLFDTDYDLPMYGYMGGRVVPGAERQVLLNVSKRF

SEQ ID NO: 9092 - protein, 656 aa, Polynucleobacter necessarius
MKTAKGFKGRYFSLAAILALNAGVSLLSANDSLLAQESDEATQGAYAAKVQRYAQSELGEGEERAWVESYTAQDFARSYAQNVYEFLQQKTLLMAKPNYGNPFVQSLDMRGYGENGHQNIAIIVDGVRREGIDISPISLSFLPLDAIEKIEIIRGLGSVRYGDGAHAGILNITTKRQSGGLVHLSSASHATHDGRFYGRYVQDTLNIGSYAQGLNTEGDRGIGEGDKKDAKKNRNAGGSLFFTPSEKLLLRASGDYGQYDAKYANPLTQKQFLENPAQTGVGYNHYARHEKRALGGATYHLSDEWQVSLDGSGYSATGEWRGSSPSVSKYRGESLDLGTSYDFEGHRLEVGSTFKENLRQDDAPWSHDSISKDSDAYWATLSKEAGAHFLKIGARHERIAYRRDGGTYIDQKHHSLEGYEATYEYALLPETKLFVAYQHAFLAPDVDRFFKFGGGFNEFIDPSKSDTYQLGARTIQGRHALSGTFFYTRLRHEIYYNPATWTNTNLDQSEKRGMEISYKTRWLPDLSTSIEYAFVQAKILEETQGALSFAGKELPGASKHTLHLGIEYQPLSSLTLLANYKYGSKAYAYEDFANTQTKTPSYKNLSLGASYHFKDWELYAYINNLLDDKNAILVRENAYYPYDFERTFGAGVKYFF

SEQ ID NO: 9093 - protein, 702 aa, Polynucleobacter necessarius
MRIKLHPICAAVAGSFVFQPMLVWAQSAPAATPAQLPEVTVKADVSRELGAGYNPPNAVSATKTEAPLRDVPQTVNVVTAEVMRDQHATSMQDALKNVPGVSFSTGDGQRDQVSIRGFTAIADQFVDGIRDDALYFRDLSNVDRVEVIKGPAAVLYGRGSSGGLINRVTKKPGIDVTDFALSYGMWADRRAEADVGRVFADGAAAFRITGAVEKANSYRSQQFLDRKAIAPSLELRVAPETTVLFQADYLEDRRVTDFGIPAYRGRPVDVPASRYYGAANARDADYSQSRVFSGTATINHRFNENWSIRNATRYYHYSLDRNNTLTSAVNEATQRLTMNHGNVRREEHGWFNQTDLIQKATLFGTKHEILYGMEVGQQNKDQVNNTKPVPGTFDLFNPVLPVLPRQAPGNPTTSNLGIFDTLAFYTQDMITFSEQWKALVGVRYDNFQQETRNRIAGQRDLSRSDSAWSPRAGLVWQPSKTQSYYVSWSKSFQPSGEAFALAANNADLGPESTRNTEVGAKYDWLNGKASTTISVFRLERSNIKVANATNTALLPIGEQRTDGVELSGAAELGSGWRMLAGYAYLDATITKSSAALQGKRATITPRHSGNLWVTKDLGHGFGVGLGANLVGARYADPQNTVTLPGYVTADAMAWYRRGAFEAQLNVYNLFDKGYIVSAHGTNPNLNMPGAPRSVMATLRYRM

SEQ ID NO: 9094 - protein, 903 aa, Leptothrix cholodnii
MAANAAHDRVRASADGATPRQAVAIPLNPKSGSLANRDIAVRPREPVAASRANRNTRTSSRENNVKKVHFVGASLLALIVAGPALAQTPAAQPSSASTVEEIIVTATKREQTLQDVPISVAVTGQKTIERAQIRDLIDLQSVVPSLKVSQFNAVGQTNFVIRGFGNGNGNDGIESSVGVFIDGVYRSRSASALDDLPEVERIEVLRGPQSTLFGKNVSAGAISIVTKRPQFDFGGKAEVTLGNYDQRQLKGTVTGPLSDTVAVRLSGSVNKRDGYANNVTTGNDVNNRDRWSIRGDVLWVPTDQTSVRIIADYNKITEICCAVASIYNGPATQFIGAPAPFGLGKPVGNPAKIFDRDVIFNTDPTNRLTGKGISGQVDQDLSVGKLTAITAYREQTSASFQDVDFTGGDLANKGDGNTIKTFTQELRLASNGDGPFNWLIGGFYQDEKLDTGRTINYGSDIRAYAEGLSGQVPAALLSALPVALRPALTGKSNLYALEFLQSLVTPSIVPGKTYFQAGQGIDDDYAMKQRSYSLFGQADYRITDKLTVTGGLAYLNDRKRVASNVVLRDPFSALNLQNVPQLTALGLPGNLYGALGGLQFYYGNSPTHGPVNFPNVNESGELKGDKVTYAVRAAYDFGWVNAYVSYSTGWKAGAYNLSSDSRPPNANGVGRTAAPEDVSVYEAGLKANFQGGYLNLAVFDQSIKGFQSNAYTGIGYSLVNAGEESVKGFEVDSAYKPADWLALTAAATYLDPTYDSFTGAACVNYDTARCPVNPATGLRPNFRDLTGDRPAAIPKWSLSTSATVSHDLGKGYGGYLRVEYDYASKTQLTETTPPNLSTWGQSIVNASLGVTNDAHQLEVMLWGRNLANDESLIATFPTVAQDGSYSGYPTAPRTYGVTLRKTF

SEQ ID NO: 9095 - protein, 915 aa, Leptothrix cholodnii
MTAALPAHAYEASALAASVAVAGEVVHGRVTNAAGDALPGAEVIVRATGQRAVTNTQGEFDLVLPTGTAVLDVRYIGQPSATQTVSVVQGGTEVSIMLGAGEAATVSDVIVTGVITDGVARSLNQQKNADGTVNVLSADAIGRYPDPNVAESLQRVQGIAIQRDQGEGRYINVRGAPSAFTAVSVDGVQVPAVDPGTRAVDLDTLPSDIVANVEVSKTLLPSQEADSIAGAVNIKTRSPFDKRRLAVSGYAGGSYNDYGGSDTRAAATASNVFANETFGALLSVSYSETNRRPDNVENAWVKEEQNGAEIFVLEESLFKDYETKRTRQAVTGALEWRPTDDFRAYLRGSFAQFEDDEYRNTLGLIYSDGKLQPGATDTTATYTGARITRQIRHRTQKNDITTLVAGGEKTFGNGGVWDASLSWAKSEQSYPNRNELLYRSSATTLSYNTADHYMPSYSVFSDPTGFYRDPTKFTFRENTFRENTTSQEDVAFKTNFELPSQFAGRDVTWKFGAKFNSREINADEQRYRNRASSASPGTLASVLSDRESRNYDYDLGFKFDADLADAYFASARAASPIREPDSITADYTAREDILAGYAQARFDLGATNVIVGVRVENTKFDGDAAKVVDGAVSPTSVSRDDTEFFPNLTVRHSFSDNLIGRFALTRSISRPEFDQIVPRRIEETDGSNISYEIGNPDLQPTLSNNIDAGLEYYFNSLGVVSANAFYKDLTDYRYVLKYTEPFGADGEADFETPVNAPDGHLAGLELNLQQKFDFLPGLLSGFGVFANYTWTDAEIKTDRLYAGRDTFSLPGQSDSNYNAALFYEMAGFSARLSYTKRGDYLDEINADDADLDLYVEGREQLDFTTSYEFGNGVELFGEAKNLTDSAGVRYYGSRERTYEYEKFGYNIFVGVRFKL

SEQ ID NO: 9096 - protein, 1042 aa, Leptothrix cholodnii
MEKIRLIYLTLILFCCCQLSAQNKTVTGQVTAAGSEEPIIGASVVVRGTSNGTITDVDGNFSLSVPVGKELQISYIGYITQYVRVPKNNKVAVVLEEDSKALDEVVVVAFGTQKKESMISSIETIKPAELKVPSSNLTTALAGRMSGVIAYQRSGEPGKDNADFFIRGVTTFGYKKDPLILIDGIETTTTELARLQPDDIAAFSILKDATATALYGARGANGVIQVATKEGKEGATKVSIRVENSFSSNTKNVELADPITFMQLANEAVRTRNPLAPLAYSREKIDNTIKGTNPYVYPANDWRKLLVKDMTANQRVNMNVSGGGKLARYYIAASFSKDNGNLKSNSMNGFDNNINLRSYQLRSNININLTKTTEAVVRLSGTFDDYRGPLDGGDVMYKKIVRSNPVLFPAYYPSDALPTAKHLLYGNAIRETEANYTNPYAELTKGYKDYSRSTMDAQFELKQDLSFITKGLNIRGLYNTSRYSYFDVNRSFNPYYYNVSSYDKKTNQYNIGLLNEKSNPTDYLGYSEGWKDIQSTTYIEAAMQYNRSFDIHEVSGLLVYQQREKINANSGSLQKSLPYRNQGLSGRFTYSYDSRYMAELNFGYNGSERFYKNERWGFFPAAGLAWVISNEKFWRPMNKVIPKLKLKATYGLVGNDAIGDENDRFFYLSEVDPNDSGKGYWFGTNFDEGKPGVTVKRYDNRLITWERAKKANYGLELTLFDALNIQLDYFTEHRTNILMDRASIPADMGLAAKVRANVGEAKANGVDLSVDYNKFFRNGYWLQAHGNFTYAHSEFLKYEEPAYNEKYRSHIGQSLNQWYGLIAERLFIDEYDVQNSPKQTFGEYGAGDIKYRDVNGDGQITDADMVPLGYPTVPEIVYGFGFSFGNQRFDISAFFQGSARSSFWIDAKATSPFQHINPTDDDPYHQDIPLLKAYANDHWSESNRNLYAMWPRLSTTVIENNVRTSSWFMRNGAFLRLKTLEVGYTLPESWTKKAYISSARVYCSGNNLLLLSGFKLWDIEMGGSGLGYPIQRVINLGVQINF

SEQ ID NO: 9097 - protein, 715 aa, Leptothrix cholodnii
MPVSTLIQGRIVFHGTPPYPRLLLLTALLGSPAVADDLFIDNADLPQVLTATRLKQSPAAVPGSMTVLDSELIRASGARDIPELLRLVPGMMIGYGAGNQPTVNYHGTNVNEARRMQVLIDGRSVYRAGLATVDWSDIPVALEDIERIEVFRGPNTVSYGANALMAVVNILTRNPADSHGTRMKLTRGQDGIDDYYLSHGFGWDGGDLRLSVSGQKDDGFDENQFGQDYRDSRRLNRFNLSVSHNLATNQTLEWQLAAKEGSNQRPYTYQPVFPFVTESGNNADVNAKDYAGSVRWNIDFNPDHSLYVQGSAQHFDRQQVWRACDAALSFSPELTRLWQLNPNFAEQVARGANNPPNSSNPEEQALVDAIKDQWNNQGGSNVVCGDVDQSTRETRYDLEIQDTLSLTDNLRLLSGMNYRYDRADSQTYFDGGLDDQTWRLFGQLEWRADDHWILQGGAMFEDSQLSGSSLSPRMAVNYLITPRHGLRAVYSEAVRSPDMFENNVNWSYTVKNLTPTAFGQQNGEYFVKTRGPGDLDQERMRSRELGYNGQFTDIDLNMDVKLFYDEITGMISEPLRNNQYIASNANKARFSGSEAQLDWRPTRRDRLRFTYAYVDAWASNPADSANTARNSGSAGWMREWGDGWSSALFYYGDDALNQYRYERLDLRLAKRFRIEGSTLELAALWQQRLDDEPTTTLQNRYDSRHRLSVSAELEF

SEQ ID NO: 9098 - protein, 673 aa, Leptothrix cholodnii
MMICTVVPTNNNTKEHEMTRKRTLVKHHILSLALTTPLSVYAFDSLTVFGDSLSDTGNNGRWTWDSSQNYLYDEQLADRYGLALSPSSKGGSNYAAGGATATSELNPQDNTADQVRQWLAKTGGKADRNGLYIHWVGGNDLAAAIAQPVMARQIADNSAINAAAQVGLLLGAGAGLVVVPNVPDISATPMLLEAVITAGLGAAAPPALKAALDALAAGSTPDSASRQQAIREALLAAAATVSSDPSIQQQLVEQLLAGYETAAGQASSLTDYYNQTEEKGLEQHGGNIARADINGLFKEILDNPQAFGLTNTVGMACPLGVSASACSSAMPGFNASQNYLFADHLHPGPQVHTIIAQYIQSIIAAPVQATYLNQSVQSMAQGSRTTLNSRYQQLRQGENPVGSLGMFGGYSGGYQRYDNNEAEGHGNHNNLTVGVDYQLNEQVLLGGLIAGSLDKQRPDDNYHYDARSFQAAVFSHLRAGQAWLDGDLHYLTAKFSNIQRSITLGALRRVEEGETNGRLWGARLTSGYDFVVMPWLTTGPMLQYAWDYSHVNGYSEKLNTSTSMRFGDQNAHSQVGSAGWRLDLRDSVIHSWAQINYRRQFGDDTYVANGGLKTTALTFSRAGKAQDKNWVDIEIGADFPLSAAVSGFVGVAQTAGLNDGNQTRYNVGFSAQF

SEQ ID NO: 9099 - protein, 228 aa, Leptothrix cholodnii
MHKHLLRASLVALALTAPVAAHAYQPGDFIVRAGVAHVQPNEDSGEVRLDGAKVSGTKATVDGENQLGLTFAYMLTQHVGIELLAATPFSHTVSVKGLGPGLDGKLADIKQLPPTLSLQYYPMEPSSKFQPYAGVGINYTTFFDTDLTGNRKDQGFSNLKLKDSVGLAGQLGMDYMITDNVLLNASVWYVDIDTKATVDGPSALAVGKTKVDVDIDPWVYMVGVGYKF

SEQ ID NO: 9100 - protein, 717 aa, Leptothrix cholodnii
MKTEKGSFKLSTVTLAIVAASTVFTAQAQEYTTEENMVVVASRTPKAISDIPGTVWYIDADKIEQEYRGGKSLGEILSASIPSLDVSSGARTNYGQNLRGRKMLVMIDGVSLQSSRQISRHLDSIDPFNIDRIEVLSGATSIYGAGASGGVINIITKKAQGEELEFESYVGGSSGFNSGEDFDYKVGQSISGGNDKVQARSSVVYTETQGVFDADGDIVTPDISQGSLQFNKTVDFLTTVGVNLSETKKLNFLAQYYDSQQNSPYGLYITGRDFVDVRKGFYSDREHGTERIMLSASYVDDQFLGHQFIAEASYRKEDQTYTPYFQSSGQQITDVISLKTALAKSFNKFNIVYGIDAYQDQLDSNQALYDRTIANNSGNLVNKTYAQVGRYAGVKVSSIAGFVQSDYAITDDWTVEGGFRYQYISNKIDDFVGYSQQKKIAAGKGKTADAVPGGETDYGVGLFNLGTIYHLNSESQVWANFSQGFDLADPAKYYGQGSYKLVGDHWKLNDSINVNDSKMSGIKTNSFELGYRLDTGELSLQTAAYYSQSDKSVKYNRKTLLIENINDKKRVYGLEAMASYWVHDNIQLGASGHYVTSEVKGNDGWKDVSAGSASTSKASAWAGWYDTDLSVKVQSQTMFDYEDDKNKLDGYTVFDLVSTYQLPVGSLGFGIQNLLNKDYTTVWGQRAQILYSSHYDSAAYDYKGRGRTYTLNYQVKY

SEQ ID NO: 9101 - protein, 502 aa, Leptothrix cholodnii
MNKSLVAVGVIVALGVVWTGGAWYTGKKIETHLEDMVAQANAQLKLTAPESNLEVSYQNYHRGVFSSQLQLLVKPIAGKENPWIKSGQSVIFNESVDHGPFPLAQLKKLNLIPSMASIQTTLVNNEVSKPLFDMAKGETPFEINSRIGYSGDSSSDISLKPLNYEQKDEKVAFSGGEFQLNADRDGKAISLSGEAQSGRIDAVNEYNQKVQLTFNNLKTDGSSTLASFGERVGNQKLSLEKMTISVEGKELALLEGMEISGKSDLVNDGKTINSQLDYSLNSLKVQNQDLGSGKLTLKVGQIDGEAWHQFSQQYNAQTQALLAQPEIANNPELYQEKVTEAFFSALPLMLKGDPVITIAPLSWKNSQGESALNLSLFLKDPATTKEAPQTLAQEVDRSVKSLDAKLTIPVDMATEFMTQVAKLEGYQEDQAKKLAKQQVEGASAMGQMFRLTTLQDNTITTSLQYANGQITLNGQKMSLEDFVGMFAMPALNVPAVPAIPQQ

SEQ ID NO: 9102 - protein, 727 aa, Leptothrix cholodnii
MQILKTDECELSMKCLVGVVALVSVGAAFAENSVLEEITIIGSRTDAREISGSAYVINEEDLERFDYIDLKKILAQTPGVYIRDEDGYGLRPNIGIRGAAAERSQKITLMRDEILITPAPYSAPAAYYVPNVSRISSMEVVKGPAAVTHGPHTVGGAVNLVSAPVPSAAMGVVDLSYGSDGYYKAQAAYGNMKGNFGYLVDVLTYGADGFKSIDGHGDSTGFERSDFGIKLLYQNPESPRDHKVSLLIEGGEEGADETYLGLADADFIDNPYRRYAASQLARFESEHINVLLNYSLSLTQKTRSNVKIYWNDFDRSWNKLDGFLAGPTLQKVLQAPTQYQDQYFVLTGQKNSALKDDEILDVTNNDRAYESSGIQWSISDQRTLGSITLSSRGGIRLHQDQVERNHQPATYLMTNFQMIPDAVPREAKVVNKAESEALAVYGITRISLGGFSIDLGVRHEDIDGEVFNQLTGERLKRSQALTSPSISGIWEVSDNMSFFGGIYEGFSPAGPGSDASHEDSTNYEIGGRFNNGGSELSLVGFYSDYGNLIGRCRVSDTSCEPGSEFNGGEVEIFGAELSALHTLVISESLSLQGALSYTYSESEFATTFFSGFPQWGLVKAGDEVPYIPESVGSLRISLLGDRWHIDSTLDFQSQMREVPGAGAITEELHSDGFAILDLSATYDMTTHVSLQASLLNVTDEAAIVSHRPFGARPNRPQSIVGRIRYSF

SEQ ID NO: 9103 - protein, 915 aa, Leptothrix cholodnii
MKRTFNKTLLSVSILAILSGATIVQAAETSTTVEVEKKASAKKAKKKDDKGIEVIEVVGTRGSLKRSMNAKRFSDQVMDGVSAEDIGKLPDNNIAEALSRVVGVSMSRADGEGEFVSIRGMAPGLSQVTLNGQSMANSNSKSITSNGASSRSFNLNNIASEMVAGIEVFKSPIASMVEGSVGGTVNLKSRSPIDSGNKATITARADYNENAAAAGGGLNLFLNGVNDDETFGSSVAVSYFDRTTQRNSFESRGWALQKKAPYVNEYNEDGTLNKAGVSDTPVYRIEDIRANFRHDERERINVNAKAQWLISDELDFSVDALYSRQQRNFISTNWDVDFRDNDKLIVDMDSIVIDGENVVSQIASANDKAGKNYNHEQTGFDRSYDDETIAVNFTLDYMLNDNWTITPKIGYSQATGLRDDINPLFSTKVQNLGYSLPNGSYMPEIIYPTDPDELAAMNPENLQLDVMNYKSFEVEDQQGYVQLDLSTDLDNEYISSIEFGARYNEIQKTNQVFQDKIQADILEANGGTQIILSDYSNYTVTDGMLDNAPVDAWYVPDFDKIDQEFGHLVEKLEVQRENYEITESVTAAYVQANIDTELLTIPVRGNLGVRYVDTKIESTAYKFLAGEDPALTESDKDYQDVLPSINLAFNLKDDLILRTAAAKVMARPNHADIAPVFREIRSWDAEDGGKYIIGNPDLDPYRANQFDLSAEWYFDSEGLLSTGIFYKDIESFITTRTESTTLPGIGDGTPYEVTQPINGEGGVVQGFEVSFQQAFYMLPEPFDGLGTAINYTYNDSETELINNVTGEFMSLPGLSQDTANFMVYYEKYGFSTRLAWNYRSEYFNQFSWSEEALYIEAYDQLDFQLGYDFTKKMSINFEAKNITDETVYEYVGNPSRAYAVRDNGRTFSLSFKYAL

SEQ ID NO: 9104 - protein, 305 aa, Leptothrix cholodnii
MNFRRLKYFVKIVDIGSLTQAAEVLHIAQPALSQQVATLEGELNQQLLIRTKRGVTPTDAGKILYTHARAILRQCEQAQLAVHNVGQALSGQVSIGFAPGTAASSITMPLLQAVRAEFPEIVIYLHENSGAVLNEKLINHQLDMAVIYEHSPVAGVSSQALLKEDLFLVGTQDCPGQSVDVNAIAQMNLFLPSDYSAIRLRVDEAFSLRRLTAKVIGEIESIATLTAAIASGMGVAVLPESAARSLCGAVNGWMSRITTPSMSLSLSLNLPARANLSPQAQAVKELLMSVISSPVMEKRQWQLVS

SEQ ID NO: 9105 - protein, 590 aa, Leptothrix cholodnii
MNKMNLTIKLNLIFLVVFLISIKAIAQRDTINTDKLIIVKQYSPTVNDAFKIKQKPSEKDSIKQVRRELSYSFIDVPVASTFTPAKGTASGVRMSPPDKLFENYSRFGVGNFSTILADFYSNFDINRDRNLDIAFNHLSSQGGIDGVVLDDDFSNTNVRLDLTSQDRYFDWNAGFDINRREVNYYGLGSEQVDALTQDQLNAIDSKQTYTKLEAFGGIRFTDLVLKEAELTVYNFTDNFSSSEQVLTIQPVVEIPLRTQKLSIKGDFKFLNGSFEENLIGEESLDYRQFQAEINPFMKFNIQNVNLKLGAKAVYFSDFENSENKVFFYPDIKAEFNLNQESINVFLGANGGLEQNTFENLSQQNPFLSPTQFIRPSNNQYNAYAGFTTKLLENLSLSSQVNYSSTNNFAFFIANPEIDYAIEQSKRGFDYQNSFGVVYNDLKTFGISADLAYQIDSDFNVGFFGKYSDFSTGDEQPAWNLPEIELRAYADFEFTKNWNFSAALFYIGERTDAQGKISINSNSIPISGGQINTTEVDGYLDLNASLEYKINPRLAVFVNGNNLLNKSYNRWQNFEVQGIQVLGGLTYQFNW

SEQ ID NO: 9106 - protein, 341 aa, Leptothrix cholodnii
MKKLAYSLLAVASACAFNGAYAQSSVTLYGVVDNGIEYQNGGAGGAVRAVSSGLFATVYGLMGHEDIGGGVHVNFQLEQGFSGVTGAATDPTASFNRLAWIGVSGRFGELRFGRQKKPEYLFLNGEVDPTAVKSFASPINNFTDASVRASNAIAYFLPDFRGLTVQGMVSLRDQTTSPSNGLRFYNVVARYVHGPIHVGAGYESSANATGTSVQKIFRAAASYRLGAARFYLAYQTERQSDHSEKRDIYEASGTYLFNPFNRFSVMYGYAHDRTGQGNNAQQVGLIYEYYLSKSTILYTAAGLIQNRHQAQYTLDGTQYSGIAVEPGAYARGAIVGMTHKF

SEQ ID NO: 9107 - protein, 628 aa, Leptothrix cholodnii
MNKSKLLPLSVAAMAVLCGISSLASANNKSDEMVVSANRFEQPISSILAPVTVVTREDIDHWQSNTVIDVLRRLPGVDIAQYGGIGQQSSLFIRGSESRHVLVLIDGVRLNQAGISGSSDMSQIPISLVQRIEYIRGARSAVYGSDAIGGVVNIITRRDNVGTTLNAGIGSYGYQNYNGSTQQKIGENTTVTAAAAYTYTKGFDLAPKDVSPRDYDKDGFLNKSLWLGVEHQLSSEISAYARAYGYDNRTRYDASEYSGVRVDTRKLYSRTYETGVKYHQNQYSTSLSGSYSYVKDYNFDPRQGQYASSSNLDESKQYNIQWGNNYRLDKGNISAGIDYQRQSIEPNGYALITKKETMNNTGLYLTGQYSFVDSVIAEAAVRTDHHSEFNWHTSWQSGLSWEFYDGYKLVGSYATAYKAPNLSQLYAYSSSNWGTTKGNPNLKPEESKQWEIGVEGITGPLFWQINAYHNDIDNLIEYKYGNFINTYENIGKAEIKGIEWVGEFSTGFLHHQLTYQYVDPRNKKTNKVLERRAKQQVKYQLDWNIAEVDMGLTYHYIGSRYDNDFSQSPSKRLKQGGVSLWDLTAAYPITSQLTIRGKIANMFDKDYETAYGYRTAGREYFLTGSYNF

SEQ ID NO: 9108 - protein, 380 aa, Leptothrix cholodnii
MRPIRFIKTASLVGAAALAVTSEQASAQSSITLYGVADVSVRYLTNSNAKNDNRLYMTNGAITNSRWGLRGSEDLGGGLKAIFDLESGINLQDGSASDSQRIFNRNAYVGLSSSQFGTLTLGRQKTPLFDLLGDTYDPLTVGNYNETSWLPGALGAGLYADNAVKYTGTFSGLTVAAMYSFGTNSESTGEGGFSGQVPGHLGAGNMYGFTLSYMAGPLSVAAGVQQNSDNSNHKQTIFNANAVYAFSSTKLYVGYLHSKDDTGFVDSALAQQTLVPGVDIVKGSGRIDNGPFAGVTWEATRALTLTGAAYYDHMSNAAIGDGQLGSGYRYTFVALAEYALSKRTEVYGTVDFNKVSGAASVELPGRNNQTGVALGLRTIF

SEQ ID NO: 9109 - protein, 896 aa, Leptothrix cholodnii
MKFNKVAKFISLACGGVMALSAPVYAAETEEDSVERIEVTGSRLKRVDMEGATPVTTITAEDMAVAGFSTVGDALRSSTLNSFGSYGGTANNSWSSQATIQLKGASASDTLVLLDGQRMAKSPVLGGAAANINTIPTSAIERIEILSDGASAIYGTDAVAGVVNVILKKSFEGIEFKARAEETEAEGGDNHSFSFTGGLNSENGNLVFTMEHYKKDKILMSDRPYTAAHVRDGEDPTDFRSWVGLSQTGRTLDMGPNGGWAYQAPFSNTDRTCADVYGDNFIGPLSDSKYAGETACAYNYTNAAALDVDRERTNTLINYGYDITDDIKLTARAYWAANKTIDQSAPVPGYIYFPDAMPAYTTAEGLDLVATPEDARMLYRYDTAGNRVRENHDNMYDILIGLEGTTEYVDWDFAATYNRYDNFVWGTGYELKGASTDLVGAWDDATNSFVGWDPRDPNSVAPSGGMANFDMRQTASYAELSGGAGFDLFELDSGTAAMYVGASYREESLDSKVDALSEAGLIKGASGGSGGEGERDIKAIFAEMTIPLLDNLELNLAARYDDYSDFGDTFNPQVSIRYNLFEPLLLRASWGTGFKAPSLSQLNQTPSEGWNDITNYMQCYEETGVVDGCTIENSIPVYVDKNENLGPEESESYNLGMVWDITDNINMTVDYWVLDTDNLIGQIGNDELVYTQAKLWEAADAMGVARPDISVVYPGTSISQNSSGKLTEMDNVLQNFGTAEREGIDTNIAATFETGVGEFKLGLAWSHYIKYTDSAPIGGELVVSRNWAGSSGTPDDRVSFSTNYIFADDHSLFYKADYIDGQTTYDINDDGSKYEIDSLIYHTITYSYMMPWNNSISIGVNNLTDEEPAFEQNGDYSSSLYDIMGRSYWVSFSQSF

SEQ ID NO: 9110 - protein, 386 aa, Burkholderia ambifaria
MKRTTLSLISLASFAAIPAAHAQSSVALYGVIDTSITYVNHAQGKDNAWMLGNSSAGNLSGSRWGVKGTEDLGGGLKALFQLENGFDPSNGRQGQGGRLFGRQAFVGLTSERYGTLTFGRQYDPLVDLVQGITADNYLGSVFATPGDVDNYDNSFRVDNAVKYTSAVYSGLQFSAMYSFGGIAGSTGAAQSYSAAVSYNNGPFSVAGGYFHATNSPASNGLRDGWTSSSDGTFDGPINSGYASAHSIGIARIAGQYVAGPFTFGLGYSNAQYRRDASSAFDSNEHYNTGQGFVNYQATDALLVGVGYSYTRSGGDTSATYHQVSAGADYSLSKRTDVYLSAAYQHASGQTGDGHGGSMAAQASIASYGYAGTSSQTMVNLGLRHRF

SEQ ID NO: 9111 - protein, 733 aa, Burkholderia ambifaria
MSRCIQSRATPPRRASASVAFAMMTCAAAPACADEGEPRHAPHLNPIFVHGERDAGSRVDRSGSAKYATPLLDVPQTITVVPRVVLDEQQALSLREALSNVAGITFNAGEGGGGSGDMFNIRGFSANANMQIDGLRDSAQNNRSDLFNIEAVEVIKGPNSVFGGAGTTGGSVNLVSKTPKAGASTEAGTMLGTSGYRRVTLDANRPLPGTDDRAAFRLNAMAHVNEVPGRDDIRKRRWGVAPSLAFGLGTPTRVTLGYFHQYDNNLPDYGLPAHNGQVLAGVSRDSYFGWRNLDRERITSDAFTVKAEHDVSSSLKVQNLSRYAHLNRDTVISASHVNLQGLPPGRYKPAGPQGYGRDASTAMWANQTNITSEFATLGIGHTLVTGFEISRETYGRTTYSYGLNRFYPADGFALAAPPGIWQGPARRQDSARNDTALVVKALYAFDTISLGRNWDVDVGLRHDWIDGWAESTPAGKPTERADSGDRHLSTRAALVFKPTDNGRAYFAYGTSFNPSAEFLVTTGSGVSAATGALAPEKNESFELGAKWEGLAGIALNGALFQTEKKNARERMADGGYALVGRQRVRGVELGAAGKVTPRWDLFANYTYLASVTLSSPATPRRGGQALGNTPRHAFNVWTTYRLPAGWTMGYGSHFVGRRNVTSQGDGKLGAYWVHSLMAGYEVSRRLRFQLNVDNLFDRAYVERVRQVSGSESRSSAVELGDGRSAMLSAVYTF

SEQ ID NO: 9112 - protein, 358 aa, Burkholderia ambifaria
MKAFARRASRTSVKLIAAATCVAAAAPVHAQSSVSLYGQVDEWIGATKFPGGDRAWNVSGGGMSTSYWGLHGAEDLGNGYKAIFTLESFFRAQNGQFGRFQGDTFFARNAYVGVSSPYGTVTAGRLTTHLFLSTILFNPFYDSYTFSPMVYHVFLGLGTFPTYPSDQGAVGDSGWNNALSYTSPSFGGLNFGAMYALGNTAGDNRSKKWSAQFNYANGPFAATAVYQYVNFNNGPQDLSSLVTGMKSQGIGLVGATYDLKYVKLFGQYMYTKNDQVAGSWHVNTAQGGVSVPLGVGNAMASYAYSRDGGGLDQTRQTWAVGYDYPLSKRTDVYAAYMNDHISGLSSGNTFGAGIRAKF

SEQ ID NO: 9113 - protein, 202 aa, Burkholderia ambifaria
MNGAVGQTKKGIFMLKSTFLLGLVGLVSLPTFAAGIEGGSYIGAGLGVHQDSDTDGGGNLDAESMGYSLYGGYQFNRIVGIELGYTDYADYESYGTKVFSPTSLSVAANLGYTFDNSIRPFVLAGLSYVDLNANSSNAFDDDSGAGFRFGVGVEYTPVDNLTLRLISQADAVNIEFFDSRGNRLQSRDVAFSTVTLGASYNF

SEQ ID NO: 9114 - protein, 789 aa, Burkholderia ambifaria
MNRRPAYRSIPSSRSAPFRRRLLPLSICLACAGGAQLAGADDTPAGTEEARQAQPATTLQTVTVTSRRRVENSQDVPTAMSVLGGETLESQRIYRVQDLQQLVPSTNVAYVHARQSSVSIRGLGNNPASDGLEGSVGLYLDNVYLGRPGMASFDLLDIEQLEVLRGPQGTLFGKNTTAGVINIGTRAPSFTPERSVEISGGEDGYFQARGTISGPLGETLAGRLSAYRTRDDGYVKNLHDGNTLNGGARQGFRGQLLFKPNDDFSLRWIGDYNEEDSDNGVLTLFSSGPTVNGVNRYEQRAAAAGATLVDGHRRKVNFDSDQQVTVFQGGTSVEANWKLANDFTLTSISAYRWWDFTPRNDDGLDVPAAYNAGVSVRDKQWSQEIRLASPSGGFFDYVLGAYYFGQDLDNKSFTDYGPRADIWNGTPAGALSDVSTRGRGHIDTDSYALFAQGTWHLTERLDLTAGVRGTYEEKSAWVERYAPLGGAAVSGAAAAARNGRVGAYDSGDIGLHSVSPSALLSLSYRFSDQVLGYASLSHGEKSGGVNLTVASAPSAGADSLLIGTERANDAELGLKTTLLDNRLILNGNLFWTVVHGYQANAYDEANRTQYLTNAGDVRSRGLEFEATALPIRGLTLNFNASYNDVRYLSYKNAPCAPEVAFQAGAPASCDLSGHQVVGASKYIANFNGEYRWKLDDGLEPYLTASYAFRSRAVGTIDDSAYGQIPSYALVNASAGLRGDYGDGQWDLSLWLKNAFDKTYFTSLWNSANGGYAGVLGTPRTLGVTARYDF

SEQ ID NO: 9115 - protein, 409 aa, Burkholderia ambifaria
MLCVGLSLWSATFGIHYVLPTNRFQCGSSEETILKRKTLALSIAAAGLCAGTHAHAQSSVQLYGLMDLSFPTYRTHADANGKHVIGMGNEGEPWFSGSRWGLRGAEDIGGGTKIIFRLESEFVVANGQMEDEGQIFDRDAWVGVEDERFGKLTAGFQNTIARDSAAIYGDAYGSAKLTTEEGGWTNSNNFKQMIFYAAGPTGTRYNNGLAWKKLFSNGIFASAGYQFSNSTAFATGSAYQLALGYNGGPFNVSGFYNHVNHNGFRNQTFSVGGNYTFSIVRLNAGYFRYNGDQGSLGQRHDDSWTVSVKVAPKGALDYELGYQQMRVKNAANNADGFTPNANLGTFSLTNGVGNGFKETIYGSVFYHLSKRTEVYLAGDYMRLHGGYTVASTFGAQNQLELTSGIRTRF

SEQ ID NO: 9116 - protein, 773 aa, Burkholderia ambifaria
MEWATGTRLRAIAAAASVAFGMAAGHAFAQTPAAAGAQNGVQDGGSAATPVAAPKGTAVGTAVGTAVGTAVGTAVGTAVGTAAGSAAGTLPAITVKASAAGDGTVGLVAKRSRTGTKTDTALDEIPQTINVVTAQQIEMTGATDVNAALRYVPGFSSYGSDNRSDWYAALRGFTPTAFVNGLQVPNTLNLSSWRVDPYMIDSITVLRGPTSVLYGAGDPGAIIDVQTKTADGERVREAGVQFGNYARKQFMIDVGDKLDADGKYAYRFVGVARDGNALTGPNNDQRVALAPSFRWRPDADTSLTLSATYLQDWGDISSNFLPAQGTVLPNPNGQLDKDVYGGDPNFNYYRKKQWSLGYQFERNLNSMWTFRQNVRWMHLSLDNGSVFGAGFADGSLTDINRWAGVFQTNYSRFDIDNNLQGRFGTGPFEHTLLLGFQYNRQTATDSEWLAAAPTLNLYNPVYTPVTLSVFSPPNTTYRTNTYTTMNTFGLYAQDQIKWNRWTLTLGGREDWVNQRMDDRAGGTQSKADVTAFTGRVGLTYQGDYGLSPYVSYATSFNPLIGVNLYGGGLPQPTRGKQIEAGLRWQPPGKNLMLSAAIYQINQTNVLTPTPTNLDPAGTTSIQTGEVRSRGIELNATGKLTRNLSLIASYVYQDVKNVQANDASLNNWPVDIPRPRQMASLWADWTWHTGPLAGFGLGGGVRYQSAAAGAADNSLTVASYTLYDAGVHYDTRNWRFAVNGTNLFNRHYISGCQSTSVCIFGTDRTVIATAKYNW

SEQ ID NO: 9117 - protein, 1024 aa, Burkholderia ambifaria
MKTKKMNEPGKIMLLFLVAIMFTVQAVAQNLSVSGLVQDGTTGEGVIGANVVVKGTTNGTITDLDGKFKLQAKQGDIIVISFIGYKTQELPAAAQMKVVLKDDSKQLDDVVVIGYGSVKKEDLSGSVVAIKAEEMNKGAVTSPEELIMGKVPGLAVAQGDGGPGSGSTLRIRSGSSLNASNDPLIVIDGIPVANNSAPGTPNALSTINPNDIETFTVLKDASATAIYGSRASNGVIIITTKKGTQGKIKVTYNSSYTFKDPYKRFETMNADEFRQAVTNQYAEGTALGDAARNLINLYPQQSTDWQDAIYQSGLSTDQNISVAGKAGFMPFRVSLGYNNERGTIKTSKYERYTASVNLSPKFFDDHLRVDINVKGTINKNRFADSGAVGAAAFFDPTKPIYGIDTEDPTYGSNLYNYNGYWNWSTGKNTPNTLSSANPLSLLYDVDNAGTTKRSLGNIQLDYKIHGLEDLHANLNVGYDVAKSTGGNYTVPGSFQTAKDSDFKNIGRGNDWNNLRRNHLLDFYLNYAKNIESIQSNINVMAGYSWQHFYYRDLSIYKSNVTENLGTKEGWTYNDDEGRYIQNNNTPSPWENYLVSFFGRLNYNFKERYLLTATLRQDGSSRFSKSNRWGLFPSAALAWSIINEPFMEKARDIMSNLKLRVGYGVTGQQEITDYLYITNYSLGNNTTSQYMGSYLLKPDGYSPDLKWEQTATYNVGIDYGFLNNRINGSIEYYQKRTKDLLNTVSVAAGSNFTNMITANVGSMKNEGLEFNINAVAIQTKDFSWELGYNVTWNTSKITKLTATYNPDYEGINAGSASYGSGTVLQKHQVGYAPSTYWLFQQVYDENGKPVQNAVVDRNNDGQITNDDRYMTKKSPMADVYMGLSSQFTYKNWDLGFNLRASIGNYVYNASAADNGSLNAFSNQGFITNYYKSAVESTGFTLTSSTEQKASDLFLENASFLKMDNITLGYTFKNLFTSKLSGRISASVQNVFTITKYSGLDPECNAIDQSLWPRPRTFSLGINLNF

SEQ ID NO: 9118 - protein, 212 aa, Burkholderia ambifaria
MHKTIRTCATAAVVAAAIAMPSLSHAASPGDGINQGDVLVRLRAISIQPNERASDTLGAINTGVNNAIVPELDFTYMIRDYLGVELILGTSRHQLTSSLGNLGGVGVLPPTLLLQYHFNHAGKVRPYVGAGLNYTYFYNNGLNVGGEGVSINKSSFGPALQFGVDVQLTKKVFMNVDVKKIWMSTDATLGDKGIGTLHIDPLIVGVGVGMKF

SEQ ID NO: 9119 - protein, 287 aa, Burkholderia ambifaria
MKKTLLAVSAALALTSSFTVNAAENDQPQYLSDWWHQSVNVVGSYHTRFSPKLNNDVYLEYEAFAKKDWFDFYGYIDIPKTFGWGNGNDKGAWDDGSPMFMEIEPRFSIDKLTGVNLGFGPFKEWYFANNYIYDMGDNKASRQSTWYMGLGTDIDTGLPMGLSLNVYAKYQWQNYGASNENEWDGYRFKVKYFVPITDLWGGKLSYIGFTNFDWGSDLGDDSNRTSNSIASSHILALNYDHWHYSVVARYFHNGGQWQNGAKLNWGDGDFSAKSTGWGGYLVVGYNF

SEQ ID NO: 9120 - protein, 243 aa, Burkholderia ambifaria
MKRKLAITGAAALAFAAAGGTAHAQSAGDFYVSTGWFHLSPQDSSDPLFVYGVGGTPVNQSVPNTGAGINDADTLGFASGYFLTDHISTEFVLGIPPKFDITGKGQFSRFGVLGRAYQWSPAVLLRYHFNDANAKFRPYVGVGATYVWFTGAKITNSTFENGVLGGPTSATTSNQWAPVFNAGFSYNFTKHWFAGLSISYVPVSVTATFTTARRTQVGTLTETSKARIALNPIVTYVNVGYRF

SEQ ID NO: 9121 - protein, 389 aa, Burkholderia ambifaria
MKKSLLALVALGAFAGAAHAQSSVTLYGIIDEGFIFNNNAKGGHLYGLASGVMQGSRFGLRGTEDLGGGLKAIFVLENGFDVNSGKLGQGGLMFGRQAYVGLSSQYGTVTLGRQYDSVVDFVGPLEAGDQWGGYIAAHPGDLDNFNNAYRVNNAVKYTSANYGGFTFGGLYSFGGQAGQFSKNQVWSLGAGYNNGPLVLGVGYLNARTPANYGGIFNTGSSDPAASGKPVVSSPVYGTYANSANTYQVIGAGGAYTFGAATIGATYSNTKFKGFSAGQYTNQTATFNNGELNFKYQLTPALILGAAYDYTQGSKIDGNSAAKYHQGSLGVDYFLSKRTDVYVIGVYQHASGNVLDSKGNVVQATAAINGLDASSTSNQVAARVGIRHKF

SEQ ID NO: 9122 - protein, 710 aa, Burkholderia ambifaria
METNPILNQLNMFFSFRRFFSSNWIQILFLFLFYVSIQAQDENIKTENKVIQKESPNTTTTDSKKDNGNGQNGQIVPEESQIVVTGSRGERRLKDSTVSTEVISRKKIEASGARNAAEVLETQLGIDVVPFFGGSRVRMLGLDSQYVLILIDGERISGRLNNAVDLSRFKVQNIERIEIVKGASSALYGADAIGGVINLITREADKKLSYEMRTTYGNGSRKNFNTEGEFNTTANMGFRNEYVSGAVSAGYNKNPGYRLVPNSQATTGNAYQDLNTGINLTFNPDGKFKGKTRILYQHRDQNGVDVTQSKAVFDRNNKTHDFLATGSLEYGFGKRNLISFRGNISKWENKYYNNQRGSDELDVKQLNSELTSQGTVQLDMEASEKHFITVGAESFANELESDRLQSRYVYRTRKAVFFQDEWTVSRSPRIRVVPGVRYDDDSQFGNQTTPKLAARYDIFQNLVWRASYGRGFRPPSFQELYLRFENPAVGYVVEGNPNLKPERSITINSDLEYSPFSFLTFSLSVYRNDIINLIQYKFDSNKGREFAEFQLQNIAKAYTRGGEFGVQYRFLKYFTLELGYNHTDTRDLSSDRPLEGRALHQASANFIYNSPGGFQFNLRGKHLDKRPFYSSTNNLSAAGQDYIPSEVKLNENPPVIYGKPFTILNVRIEQKFFNKHFALFLGVDNLLNQYELAYNPTRPRFYYGGFSAQF

SEQ ID NO: 9123 - protein, 1770 aa, Burkholderia ambifaria
MRFHRTAVDTTSKKREGLVVNHSFRSIWSEAAGCWVAVAETARARGKRSGGESGASRRAGRMAARRSPLRVAALGAALAALSAGSAYASTCGDGSAVASGGTCALGSYSPTVNDNLAGATTVSGGDTVGVTGAWTSAGGDPGYTLTPIGNTSIVSGNPNQPLLSLGGKTQSVSTPDSITGTHTSIATYDSSAFAASTAGATNVPVYQDVNGNQYVNLRLGTVDNTGGTLNVSIGNPANAPDAAGNAISIAPKQTDLTFADGTGSAKSVVNWNSRNQIWLGTGDYLASGGAVGQVQLDVPTYAGTFTAFDGSTWTVSDAASLAAYNDFLARAVRSGALGTQAAYDTAFGQAVTFTQETFQYANNVSAGDKNTLPIDHLSVMHGTGANATLQIGKDGQIDFRGTNTIESSSAVLAENGAHFVNDGRLSGDFTLVRLLSGASGVNNGVISAGYASGDNVDTSSSTPPDNFGFHAYTEGNGVYASGTGTTFVNNGVMNVGAWTLDGNRPDLQNYAVAVTGGANASNAGTINVGVNATTLDSQVIGGFAAGGTFTNDAGGTIQLGRAAQYAPGAAANDVALSARAYGILLGASGTASNLGSIVIGSQTQNGAGMASVGSSSGTLRNAGSIVVNGAAPGTPLANVGMLAANTAATVTNTGTITLNGVNGIGIMVVGTSTATAATSTGTINVAGWLDPASDTRNYGVWAEGSRAQATVDGALNLTGNGAIGVHARSGATIDVGANAVPRFMSGTNQIGFYAYGAGARINVAAQHLSVDTDDSTLFRIAGGAAYTGASAAGTLTTDVTGQRARGVLATGAGTTLSTGNATYNVNGANGIAVAVEGGAQGSIDAAATINLNAAGAIAGVVDGQAHDLAGANAGAPVTTTLANAAAVASSSAGVTGFVARNLGTLENRGSVLLTGAGSTGVVIGALGTVNNASAIRVSNGTGALVQGASATLANSGTIEADDGVAGVHLTGAGASVALSGAGTVIANGSADGVRVDASVADGGIAAGPTSIAVGGAGKGIDNLGTNTTIALSGTQIGTTGNGADGLSSTGAGARIATDAATVVRTAGDNARGLVVAGADSTLAANGTTVATTGAGAHAIVAGSGASAWLSGAKVSTAGAAADGLVAQNGGRIGDTGSSIASAAGSGANVDSGGVLALTGTTLKGATAGVLSTDTLATGATSAVLVDGGSVASVAGPAFAARGGTVDIAVRNGTVVTAGNGTLLDLANGSTATFNASAVNLSGDIVSDASSNGNVFLANGTTLTGKIDPVALTVDGTSTWRMTGSSVLSSLNNAGLVAFAAPSGAPTAAGSYRTLTTGSYVGYGGTIALNTYLGADASPTDRLIVNGGTASGTTGLKIANTAGTGAQTTGDGIPVVVTANGGTTAASAFHLAGPVQAGAYEYRLYRGGQSDANGWYLRSQLDPTDPDDAIHPSGNGNGNANGNGNGGNLAYRPGVAGYAMTPLLNADYGFSTLGKLHERVGDIYNLEKQAPGNRDGVWGRIGGQSLDANAGRFAADERTFFAQFGKDWTLEQAAAGGSTHAGVTASIGVANASFDDIARADTPGLSTSTGSVEMHAQSVGGYWTRYLADGTYFDSVGQVTHYGNRYRDSYGNDASQNGFGIALSQEVGKPFGIGGTPIAVEPQAQLMYQYLKLNGFNDNVSAVSGTTTNALRGRVGVRIFRPNLDANAGGGAATPYFTADVLHDFLSPGQTVVGGTPFATHLGRTWYELGLGVTAGFGKSGELYANVKYARNLGGDYRRGVTGQVGYRYSW

SEQ ID NO: 9124 - protein, 360 aa, Burkholderia ambifaria
MKKALVAAALMAAGVVTAHAQSSVTLYGRLDAGLEYMNGFQNGHQFRAESGDWGTSLWGLKGTEDIGGGNKILFHLEGAFNTMNGGLGASGTIWDRFATVGISNDRYGTLLLGRELAIANGVWDFDPFGQSNWSTASLVRGRNWNKTSNNVSYQSPQFYGLDFYGQFSFSNSTNFNGNTTAGQPGRAAGAQITYTNSLFQLRGIYDETRDSNGRFSDVFNYSREYFAGLNVFLGQFKLQAAYQASRADGSGGPAANAGVTGTQQVWGGVTWQATPAAALIAAVYHVNANHGGGNANIYTVGGSYNISKRTLFDLQVATVRNSSTANFGLNANPAGTAVSTGNPHPGGSQTGVYAGIQHLF

SEQ ID NO: 9125 - protein, 380 aa, Burkholderia ambifaria
MKKTLIVAALAGVAASAAHAQSSVTLYGLIDAGITYTNNQHGHSAWQETSGSINGSRWGLRGTEDLGGGLKAIFTLENGFGINNGSLKQNGREFGRQAFVGLAHESYGSLTLGRQYDSVVDFLGPLSLTGTQYGGTQFAHPFDNDNLNNSFRINNSVKYQSANYGGLKFGGLYGFSNSTGFANNRAYSVGASYSYMGFNVAAAYMQLNNNINALALAASDPGAVAGDWTFAASRQRTWGAGLNYTFGPATAGFVFTQTRLTNSAGISAGQSGVSSGIPLTGGTRFNNYEVNGRYALTPAFSLAGSYTYTDSRLDGQTPSWHQFNLQADYALSKRTDLYLQSEYQRVNANGLAIGANINGLGAASSTNKQIAVTAGMRHRF

SEQ ID NO: 9126 - protein, 786 aa, Burkholderia ambifaria
MSFTFAARPPRGRLALACATAFVWPLAQAAPIDGASADPTSGATRVSADGVPSAAVPTPAPPPTGDTLSAVSITAQRQSVDPDTPAVVESITREQIDSHTNTSTEDALKYAPNLMVRKRYIGDRNSVFAGRDFNELQSARGLVYADGLLLSNLLGSSYAYPPRWSLIAPDDIARVDVLYGPFSALYPGNAIGSTVLLTTRKPDRLEASVSTQFFTQRYRDGYGFADSFGGNHQTARIANRIGRFWFSLSLDRLENDGQPMQYASPNAAYNPRLGAAVPVTGAATDIGPNGKPRTIVGAQNIERTEQLNGTVRMGYAFTDHVDATLTLGHWENHYRQHGATFLRDAAGNPVYGGNVSIGGRNMTVAPSAFAPQRGDQENWLYALGLNGRLDSGWRLSGVVSAYDVSRDVLRAASTAQGGAGTLFDGNGTGWRTLDLKAEAPDVHGHTFTFGYHYDNYFLRNVTYNTADWLAGPSTSVASVYRGDTRMQALFAQDAWRFAPGWLATLGLRYERWDAYGGALGNGSATLGYADRGANALSPKVALQWDATDVWRFRLSFATGTRFPTVGELFQGTISNNAIVNNNPGLRPEKAIDWDFTAERDVGVGVVRASVFQSDLRDSIYSQTTVSGATTVTNISNVDRVRVRGVELAFSGRNVGLRGLDIDANVSASNAQILADAANPAYVGSRFPRIPRVRANLLASYRFDEHWLGSVGVRYSGRQFNTLDNSDVNPDVYGGTSNFTIVDLKARYSFDRHWSASVGIDNVTDRRYYVFHPYPGRTFFGELKWSL

SEQ ID NO: 9127 - protein, 427 aa, Burkholderia ambifaria
MKKKLIALAVAGALAAPVVASAQGTNVTLFGRAQAEYSLVDFAGQPSQGALQDNSRSSRWGLQVTEDLGNGLKANARLEFGLNTGSGSATTPREQWVGLSHSHWGDIRFGRLQSPFKDFAGGMTIDPFAYTTLQANGAGGTMSGAANGMGSGANTFVNSAIRYDSASIEGFTFSGILMPGDANSLNPLQDGSLLSGFLPGGLGSNGNTGGRNGEFDGQAAAKYHADFMGMGLDIFGGYSRDNANGIQKSIGLRTEEIWRVGASWAWENFKLSGQYEDVNNALGAATCSTAASLTANPLDSGLVSGQCNSAMNWGGDGNLWFASAQYRLGSTTLVAQGGMTKAHAGGVNAAGSRKADSFTVGAIHNLSKRTSLFGGYQHVYVTDNNPAGSGVNDLAPAPGATVGYTAPNYVAPGSNRSTFTIGLRHNF

SEQ ID NO: 9128 - protein, 362 aa, Burkholderia ambifaria
MKTFRTAATAVSFAAAAVSPGAHAQSSVTLYGIVDTGVQYYNNAAGGGSVAGMPTLTGEVPSRFGLRGVEDLGGGYRTFFVLENGFAMNSGALNYGGRLFGRQANLGIESPYGTLTLGRQMNMSMLVLLNADVIGPSIHSMASFDSYLPNARSDNALGYLGRFGGLTLGGTYSTGRDGAGPAGPSATNCAGNVPGDPVACRQYTMMVAYDAPQFGAAASYDVMHGGTGASAPLSSPGYTDTRTIVDAYVKFGIAKLGAGWIRRNTAAAVHSQSDLFFAGGTLYATPALSFDAQALRYLLRGRFDSNLFVARANYSLSKRTMVYASAGYMMNSALGTSAVAAGGTVGAGQNQVGVMAGIQQRF

SEQ ID NO: 9129 - protein, 417 aa, Burkholderia ambifaria
MGGRSEMDRCPGVVATEANSAQCGGRWRPREFEYWGIEPRLDISHNLFGVESDAVLGLRYHRETQDRNQFRGADPRFQSLSYAESFYGVNGGTGHREQVDIDVEAKSYYAQNTFYLGNWSLTPGIRVEDIRISTNVKRAEGQPQNNPESDLTNNQTKVLPGFGVAWSGIENTTVFAGVHRGFAPPRPDRDISAGGANTAVVAKTKPEESTNWELGIRSNYLKGISYETTLFHTQFDEIVISDGFGSFRNGGESQHSGIEVGGRIDFGTIYNTSHNFYISGAYTNLFTAKFKKTSLDDDIRSGDRLAYAPKHIASLSFGYEHPIGFNARIGVDYVSEQYEDVPFREGRSEYDPLSGQSGKIPSYTLVNASLSYRPIGSKATFFVSGHNLGDKEYLATRVDGMHAGRQRQVFGGVRYDF

SEQ ID NO: 9130 - protein, 728 aa, Burkholderia ambifaria
MYSTKNKPLFHIDPSCLRWRHAFCMFLGLALPVIAHASQPEDGTVGSSPTPKRLQTWTLEPITVTGAREGYSAPTSTSATRTNTPLIEVPQSVQVVTQSMIREQGSHSLSDALVNVSGVRATKPQEALFAQPIVRGFPAEIYMNGLPAFGGTAASIDPTSLIGTERIEVLKGPTSTLYGGGIGAPLGGLINVISKRPEAEPSAFVSMRTGSFGTVNPSVDLNTPIGDKVAARFSADYQENDSWIDHVNGHQWSIQPSIAFQLSPDTELLLRGRYEDRSQLEFSGLPSAQALSGHIDRKAFPGATSGQPHTTIENRTTTAELTHEFNEDTRLAVTAQYYEGKFRDYGSFVYPELLGAGPATPTVYPIFKLYLPGDVRESTLDTNLGTRVEALGGSHELLVGASYDRTDFASGVSNAELIGELDLANPSYGVSYGATPETIVSQTNRYETKALYIQDQATYGRLHLLGSLRLTQLDLKQQEQGIDTSYHRVTPRLGITYDLTDSLALYAAYSTGFRGAYNYNGRETPKPELSRNYEAGIKMAFNDLGLSGTLAVFEQTRRNVSTPDPDPANAILGYSVQSGEQRARGVEADLVWEPIPAFSLLTSYAYTQAEVTDDNSIPIGAGLPRVPRYSGRLAARYRILDGAAKGLGFGAGITALSARELTLPNTVSVPGYALLDAQTSYEFDHYTVSVSAVNLTGRKVFETYQYLGSPVVLPTQPRSAFLTLTASF

SEQ ID NO: 9131 - protein, 677 aa, Burkholderia ambifaria
MLLAAVAHAQADTAAPSTPTPTQATPLAPIFVTANPLGDTQLIAPTAQLSGDALTRRQADSLGETLNGLPGVSTTTYGPMVGRPIIRGMDGDRIRLLQNGVAAYDASSLSYDHAVPQDPLSIERVEIVRGPAALLYGGNAVGGVVNTIDNRIPREAIEGVTGALDARYGGANSVRAGAAQVEGGNGRFAFHVDAFDREASKLRIPGYARSSAQRAIDGPDTPQPYGNVPNSDGRVHGGAAGASYTWADGFAGLSYSGYESNYGSVAEDDVRLRMRQERLAFASEVRNLSGPFTKLKFDFAYTDYRHKEVDNGETATTFRNRGYEARIEARHRRIGPFEGAIGVQFGRNTFSALGDELLVPSTRTNSVALFGLEEWQVDPALKLSLGGRLEHVKVDPDPAGVEKFAGAQPRDFNAGSVSAGALFSLTPVWSVAANVAYTERAPTFYELYSNGPHDATGQFLIGNPNASKEKAVSTDLSLRYASGPNRGSVGVFYNRFSNYLTEYNTGRVVDDDGEPVAPGADGSLNEAIYRGVRAEFYGVELDGKWRAFSRRGHTVDLELTADYTHARNVDTGQPLPRIAPLRATLAADYGYGPFGARAQVTHAWSQHRVPDNDFPTDGYTSLGVMLTYKFRVGATHWLTYLRGDNLTNQEIRYATSVVRGFAPQGGRSVMAGLRTTF

SEQ ID NO: 9132 - protein, 642 aa, Burkholderia ambifaria
MNLRHLLATSAATALLSPIAHAAGDTALTQPRQPADGTDLPTITVTDSRHLPESFDQRYATTQVLTRADLDRLSPSEPSITQALAMLPGVTVSQTGGPGSSASVSIRGSSASQVAVFIDGIRIGSPTTGIAPWADLPTEAFERVEVISGPAAASFGANAMGGVVQLFTRRAAGQPNRTTVSFGGGSNKTFDTQLRTSGTVPSTGPLAALGGLTYSLGLHAYNTAGIDATRPVLPYHEDGRNPYHAQDLDARVGYARENWSISTFALYHRSDLSYDNAGFANRELDHQLTTGIAFHLDIAPDTQFDQSFGYANDRQFLYASDPAIPTDRIDSQRISSSTSLTHQTHGFHLFGLPLSGETKVAYDFTREQAFLPVDVPDGVPTRNDSAFSLHQSATLGSVTMFVAGRHEIIAGKAVNTGNAALAWAITPVYTARVSYGNAFRLPTFNDLYYPGYGNPNLNPERSDSVEAALDANTAYGTFSAAIYDTRVSNLIAYNPATFSPMNIGRAHIRGIDLSYKGTIGHTTPVSIAVGLLNPQDETNDSWLNRRPRQTLSVNIDHTWDELHLHALSTGASLNYGGTTFDDPANATYLPSYLTVNLRASYKINAHLTVSASLSNLFDRQYVTAYGYNTLGRTAFGKVSYTF

SEQ ID NO: 9133 - protein, 347 aa, Burkholderia ambifaria
MTLRFIRTAPAAAALAACSVAAHAQSTLTLYGALDAGVQYLTHADGRHAAVQLQNYGILPSQIGLKGHEDLGGGWRALFKLEQGLNLNDGTATAPGYAFFRGAYVGVAGPAGTVTLGRQFSVLFDKTLLYDPLWYASYSGQGVIVPMTANFIDHSIKYQSPTFAGFDVEALAATAGVAGNTRAGRVLELGGQYTSNGLSVSAVLHQAHGDASAADDASARRRDLGTLAARYAFASLPLTVYAGVERLSGDLDAARTIVWGGARYLTASGVGLNAGFYHTDSRTPAIGHPTLFIASTTYALSKRTVAYVNLGYARNSGQSSQTVYEYDPTPLAGASQFGAMVGMYHLF

SEQ ID NO: 9134 - protein, 384 aa, Burkholderia ambifaria
MKKHVIFAAALAAFAAPAFAETSVTLYGLIDEGFNYTNNVNVNGVGKTNYQLASGYAQGSRWGLKGSEDLGGGLKAIFTLENGFDVNNGRLGQGGRMFGRQAFVGLSESRFGTLTFGRQYDSVVDYLAPLTANGNWGGTLFSHPFDNDNTDNSFRVNNTVKYASADWNGLTFGGTYSFSNSTGFSNNRQYSIGAQYSLAGLQVAAAYLQANNPGIGSAGAIAADDANFVADRLRIFGGGVNYTFGPATVGFVYTKTDVKNPVSTVYLPASTFAGLGLTATKFQNFEVNGKYQLTPDFYLGAQYVYTDGKYDAAAGSFKPKYHTVGLMADYSLSKRTDVYLQGAWQKVAGDKTGTAADGGYVVGTDGPSASANQFSVRAAIRHKF

SEQ ID NO: 9135 - protein, 359 aa, Burkholderia ambifaria
MVKQAVAAAVIGMSAVSGASAQSSVVLYGSMDAGVAYVNNVGGHAKWAMIQGNTQPDRWGLKGKEDLGGGLSAIFQLENGFYTNNGQFATANTIWNRAAFVGLSSDRYGTLTLGRQTPLTFDYLDPLSTAYLALSWYAFHPGNIDGLAATGNVPYNNAVKYRSPSFGGFSAAATMALGNTTNFSTGKSVGVALNYANGPFKASAVYSNEHDRSILISQTGITSFQGQNTANGYLANKVENIGAGASYQIGDFLVHGLYTRVKMQSNGFSDTFQSYDAGVNYRSSAFNTIAGGAATTTLAGRRWTQVELGDIYSLSKRTQLYANVLFEHGSGGAKAAFFTAGASSTANQVIVLTGIHHSF

SEQ ID NO: 9136 - protein, 374 aa, Burkholderia ambifaria
MNKTLIVAAAAASFATVAHAQSSVTLYGVLDAGITYQSNVQTASGQGKSRFSMGSGIDQSRFGLRGSEDLGGGLKAIFTLESGFNIGNGKFANGNGGMFNRQAFVGLSSQYGTVTLGKQYDATQDYLAPLTATGSWGGTYFAHPLNNDRLSTNGDVALNNTIKYTSVNYAGLQFGGTYSFSNSTNFANNRAYSAGLSYQYQGLKLGAAYSQANNAGLSTSGAVNPSVDTNGNAFGIQGRTRTYGIAAAYAFGPAQVGAAWTQSRLDNQTNGLGTLRADNYEINAKYNLTPALGLGAAYTYTNAKQNGNSTHWNQFGVQADYFLSKRTDVYAQAVYQRGTKGAGLGASIYNGDINAYPSSKVSQTAATVGLRHRF

SEQ ID NO: 9137 - protein, 847 aa, Burkholderia ambifaria
MTRKSIQFFLLWAVALTNVIAVNPVWATEEPEVPGLGDKSGEPQYPQPATSVTEWLAQIEETLVQITEIQVNPAEQRVEIVLETGSDALSIPTTKTDGNRLFAVIPNAVLALPDGPDYRQMNPATGIAEVSVTPLTADQVQIEIVGTDGPPTVTIQNKATGLVLAVEAAKLAASEEEDLEITVTAEEIQEGYSVPDASTATRTDASILDTPQSVQVVPQDVLRDQQILRVDDALQNVSGIVGRLDAFGSTNLTIRGFTTDQITGGAILRDGFRVTDNLGSQETANIERIEVIKGPSSVLYGQTDPGGLVNLVTKEPLPEPFYEFEFQAGNLGTWRPRLDITGPLTADQSLSYRLNLSYFHQDGFRDVERDTERFFIAPKLRWDISDRTHLTLRLEYIDETNPFDLGIPALGTGVFDVPRDRIINEPDDFLEQSSLTLGYDFVHQFSDDWKLNHGFRFVTQDYFNLATLPFFVDETTGDITRFFADRQWQSDDYTIQTNVEGNFKTGPLQHKLLVGFDLNFNRFDEAFTRLDFNTPTILNIFNPVYGAVPRPDLSTAPFFPGFENETDRIGVFIQDQISFLDKFILVGSLRYDSVDFRNLTNTSENRSDQALSPRIGLIFKPIETISLYANYSESFTPSFGQLVGGGTVGPETASGFEVGVKGEFLDGNMFATLAYFDITKRNVATTDPNNPFFSIATGEQRSQGVELDIAGEILPGWNVIANYAYTDARVTEDNDIPVGNRLFNAPLHSAGLWTTYEIQQGDLEGLGFGLGFNYVGDRFGDNANTFQVGDYCLANAALFYKRDNWRFGLNFTNIFNVEYISSTNNSRDFGNAPGAPFTILGSVSVSF

SEQ ID NO: 9138 - protein, 735 aa, Burkholderia ambifaria
MKSARLLLCLFSGSVLSSMPAFAAETQPASKQKAAHPAAPAKAAPAAPKAENITVHSRNGTGTAADYRTKDVALGPLGTRSVLDTPMSIMVVPHDVLVNQQARNINDLVAYVPSVQLEMRGDPNTSRPQSRGFEGDVIANTRMDGLNMVITTPYAAEQFDSMQVLNGLAGALYGPQNPAGTFDFTLKRPTDRMTERLVVGTDSIGAPLESADVSGRVGRNGWFGYRLNLLNQNGEGYVEGSHLRRDLVSGDFDIHLSPKTVIQLDASQYTYAERGFPGGFAYSTAIQLPQAPDLSQKGYGQPQADYNMETDTVMAKIIHNFNDNWSLKLGGLWQNAARNVFSTSNQLLNSAGLYKQTISAALTANDFVAGSNMAYLNGKFRTGPLRHQIELGTNGYVMGNYNPTSSTGTLTLGEATIGHPKSFASAQPYYSGRYKSADTMNQSLLAGDTISLGKHWSIMGSLAWSWLSTNNYAKTGTKTSSYTRSAAFSPMTSLLYKPTDNQTIYFTWGKSLQAGTIAPAGSVNVNEVTAPLRSEEYEVGYKILIAKRMQVNIAGFRMARPYGFTDPVTKVYANYGLQRNYGVEFQASGNITDDLTFLGGMTWLDAQMLGTGSSLTANKQVVGVPPLMANALLDYRLPFLKGAAVNANVHYMGRRAANVYNTTFAPSYVTLDLGARYATHAYGQPLVFRFGVNNVTNQSYWASVYPSSINGVSTATNSAVAGLPRTYHFSIELDL

SEQ ID NO: 9139 - protein, 747 aa, Burkholderia ambifaria
MKSRPDELKLGKFTTLCSVLAASPAFADGTPSPAPVRTEGHLAPIEIQGKTEHSYKADFSASAKFTAPLVDTPKSVTVIPQELIQNSGAATLTEALRTVPGITFGAGEGGNPLGDRPFIRGYDSQGSMFVDGMRDTGATTREIFNTERVEITKGSDGAYGGRGGAGGSINLITKAPHLGTTAAASAGFGTDRYRRFTADGNWQFADHAAFRLNLMSHNNDVAGRDVVNNERWGVAPSIAFGLGTPTRVTASYYHLSTDDMPDGGIPYFYTTSNKPANVDTIYPAPVDRHNFYGLIDRDFRKTTSDISTIRIEHDITPGLTVRNTTRYTESTQDYIWTQPDDSQGNVVNGKVWRRNNNRDSSINSLANLTELFGEFRTGPFKHSFTTGIELSREWGKRDSYKVATDTGKICQKGIGAASGYNCTSLWSPNPNDPWAGSVTRNNDYAHARTTTKSIYGFDTIEITPRWQVNAGVRVDDYSTRFTDTRANGAKTYTRDDTLFNWQAGLVFKPAQNGSIYASYATSSTPAGMLLGEGSETQSLTPGRGGVGPNADQMAPEKNRSIELGTKWNVLNDQLALTAALFQIDTTNARVTLPNNQYAMVGNKRVQGLELGVAGQITKQWQVFGGYTYMKSELRDNGKDAANDGHRFPNTPKHSLTMWSNYDVTPKFTVGGGAFYMSEVFGDPANLRAVPSYWRFDAMAQYRINKKLDLQLNVNNLFNRTYFDQAYPSHYASIAPGRSAFITLNARY
